United States Patent 7,468,248 (METHODS AND SYSTEMS FOR INFERRING BOVINE TRAITS) - sequence listing, part 4

SEQ ID NO: 26273 - DNA, 3566 bp, Bovine  19866880546426
actggccccaaacagatggggtcgaaaactcccccaaaatgcagtcttgctaaattaaaaacttgatccaggagtggaacaaatagggagccatgaatggaatggagtcaggtccactcaggcgaattctttcttctccccttctttttcctgccttttaaaagagaaaaacgcgccattccatgtctatcagtgtcagcgtctgtgcagagcttagcagttcagtgtcttgctttaattagtctgaaaattaaagggcaactctgggccaatgtgagtgattatgaaaataaaatacatgtacatcccatgcaatcctctcatttaattaatagtcttgtaaactgtacagctcactttaaggcagtctcgcagtataacaagtccatttaaatatccacttaatacttaacaaaatgtgagggacataccgtagcatacggtcccttctcaagtttcactgtctgaaatttttcaaagctgacccaagtcaacctgaaaaatgtttaacaccctaggcttgaacacaagaaactctgtgatgaacagacattcaattacattttttaaaagtgagaagcatttttgtaaaatagagactctggaaactaattggcagccacgaaacttgtgagcgaaggccagatcttgtggggaacttttactacagtaacacggctcaaagaaaatgtgaataaaaggcatctttgtttcccagtcaaattagctgattaagaaataaaacatcttaacgtgtttttaaatgtagaattaattatttatatgaaaaaattaaaggcaggttatgtgaaattctactctgtgtgtgaattgaatggggcagaaagagtaatccttatggactcgtcttaggtcaagaagacaaaacttaaggaaagctgaatattaagagctttgtcggaaaaaaaaattgcattcagatcacaagttgtgcttcccattttgattttcaaagtccagattcgttatggtacacatgaaaaaatgtgattcagaacaagaaaactgctttgtagaggctgtgtcctgacaattgaggggaagaagaaaacacagctatacaaagagcaacgcttactcctgggagaatacaggtcttttgctctaaggaacccaaagaaggattcacaggaagaatttgaacaggccactctttattttgctaatgggtgagtttggaactcaggaaaacaagaaaacctaagttacttgttaggctcagaaaagaagtaggcaggtgacctttgacatcttaggcctcctcgtctcagtccaagtcctctggccctgacctcttcacattccaatatcctgaagccaggccctgcctgagccaaggttgcaaattatctctgagatgtggataaacatccactgcgtcagtgtttttcaaggtgtggtctagggaccacctgcattggggttacctggagaattttcagaaatataggttcctgggccccaggaattactggaccagagaggaacgaggttcagaattttaccttttgaacacattgctcaggactctagaaggatgctgaagtttgagaatcactgtgccagaggccacttagagaccagaggagtaaacttcccgacatttctttaatggattccctttagtgaaaggcattaactaaaatgtgaaagcctgtccacaaatccttcactaaacaaaaaaagtcctccagccattttctccatttctcatggcatctcttcacagagggagtataggaaggctttgtcctttaaaataagttcagtgagtacttgaaaagtcgtttggcaggagatgagggatgagacaaagggggaagattaatgacgaacagaatcagagtccttgctaaaataaaaatggattcacacccaacttcttatgaaggctaagacatatggcagctcatgtgggaagcgagcgtgtttagtagaaagaggtcctgctgcagagctgtgtgatataggggacagctttctcagccaaaaacagaacatcacatgctctgggagatgcaccatctctctgatgtgatgagaggctgactttctaaaacttgagcaaactctgcccgaatggctttaataagtttaatgagcttctcagagttgagatgatcaggttttggggtttagatcttggttttgctcttatcttcatgcgtggcctgacagccaatcattttctgtgactgtttatggaagccactgatagttgaagtttcctcatttgtaaagtggaagtcacaatcctccatcatttctgagaactgggaggaggaaagtgctggccactaggaatcgtgtctgagtttcagctacaaaccatggacttttgagagactttagcaggaaaatgccaggacatacctggaggatgtttttgtttccctttttgttttttaaagggagaaagagcaatcctttgtactttgtgacctgttatgcacaaaccttaaagcagcaagggccggaccccattcctagggctcattcaaagttataaatgcacagatatacaaaggatgtttacaaatatggcttattatgcttacagtagcaacaacaggagttcagttttagtccgtggaaaattgctgcttaataagaactttcccaaacccatgtcccctttgagataaaaatttccacactaagtttcatcgcccactagaatttcctttggaatgtttgtgctaaattcctttctccctgattgaaatatacaacacaaaatctagcttcaagacttaaaaagtaatgcactgaaatgcacagatacatagagacagtgggctgagggaagcagcagagagttggggaaatgaattaaactccccaataattaagaaatgatttacttggcgcattcagaatttggattgcttgaacagtagggcagtgtataacttcattatgtgccatgggcaaccccagcaccaactcagttttgctgcaagaagccttttttattttttcggtatttcctgacttggtatgtgcagttgtgaacttaattaacacactagtgattctgcaccctcagggaaaaatggtacattttgtaaaatataaacacagaaacaaagagaaagttcctttcctttctgttcatagttgtttttcttccttcttttatgttatgcattaggaaaacatgaaaggcacacacgttatagagcccagttctggaccccactaaggcacgatatttaggaactcctctaaatcactctcgtatcttacagaccagtggcccccaacctttttggcaccagggaccaatctcacggaagacgtttttcccgtggactggaggagaagggatgctttcaggatggttcaagcgcattacctttatcttgcactttatttctggttgttacattagctccacctcagatcatcaggcactggaccccagaagttggggacccctgctgtggaccatccttagctgtttttggatgagacaaagccgggttaataggtagcaaaaattagctctttcgatggtagcattgcatcttatatgccttttt

SEQ ID NO: 26274 - DNA, 1535 bp, Bovine  19866880591178
tttattgtgatcccacagtcaaaggctttggcatagtcaataaagcagaaatagatgtttttctggaattctcttgctttttcgatggtccagcggatgttggcaatttgatctctggttcctctgccttttctaaaaccagcttgaacatctggaagttcacagttcacatattgctgaagcctggcttggagaattttgagcattactttactagcgtgtgagatgagtgcacttgtgcggtagcttgagcattctttggcattgcctttctttgggattggaatgaaaactgaccttttccagtcctgtggccactgctgagttttccacattttcttgtgttctagagcttgtgacttgcaactactgagcccacatgctgcaacacctgaagcctgtgcacatagaggccatgctccacgagagaagccactacaatgagatgcccacacctctggtcgctgcagctagagaaaggctgtgtgcagcaatgaagacccagtgcaactaaaaggaagtaagtaaaataaataaataaagagacagtcttgatcctcaagctccagctccaaagttcctccaaatcttcattgtctactttcacaagaaacctctctggggaatgttccctcctagagtagggaataattcggaaacacaaggatgaagatgttgctgtttcttaagagataataaaagcatcacgttgggtgtaattatgactggacttattgtaaatgccttcccaatttactagatctcttaagctctcctgcccaccctcatttatttcccaggattcttcgtactgaagtaatgtgcccgattattgcataacattctgtggacagacataatattgtagaaataatttaattggcgacttgtaatgaaaagagagctgggtaagtcgcttgggttgcaatttctctatatagttttacatggagggggatagtgctgttgacgtgaataggctgatattgatttcatttaaaattttcaacatctgaatgatgtgagcagtgatctgtgggaagacactgtagagtggtcggcatatcccctgctaacaaaataccattttcaaaggatttttctattagcattcacaaagagattgaaaagggttaggagaatgttaaaatttttactgaccaaagaaatatgaattaccatcttcattttactcttaattaattgagttattggagcttatataatcctctgttaaacacctgaaagaaagcaggcaggaacctggaggtattgtatagaagactttgttttctaaaggtagtgacttcaatgaccccatgagagagtccttagactccccctagaaatggatttcgaatgcggcagtgactccttaatgctgccccattaatgagttccaattcagtggttctaagttaccatcatttaacaagaggaacacaaattagattttcagactttcagagatgagtttctcatggtacccaagtccagtttggataaagaaaaggttgtgggggtgggggggttgg

SEQ ID NO: 26275 - DNA, 1350 bp, Bovine  19866880602907
atggcatttacgacatggtgacataacactggggaaagggaaaaggaaggcaggaactgttgctgttgattttgtcctttagttttgatctgtaaagctccccgtcaatatacctggttctagttcaagctctacttttaattagttatgctacattgaacaaaatgctaacttgtaagtttcaattaaaacaatgattgtgcatcttatttgccaggttattgagttaggtgatctgaaaagtcttatggagatgtctgaaaatcaaatggagtaatttgtgtaaaaccataaaacttaaacattaataattggtaactgcttaagtttctatgtaattttcccttaattatataggggcagttctcccctggatgaggaaggaagattatctcacaggctttcataactcttaaaattccaaagttgctgcctggaatttcaataggattctccaaaggccttaaaaacgttaactctcaatttcttagaggatacccaatgaagtgtttatcaccctctttaccaaaaacacacatacaaaataacatagacctcaaagccataaccagaaaatgtttcccaacagccattaaaacttcttaaaaaacacattaaaaaacctattaacagtattttttaataagattagtcaataatgtagacaaaaggtaaaaagtttcttacttggatttggctgcaataacacttcagtttgtttcattattttttctgtccatattttggtacattcagctttgctaaggaggttctctaagtgagcatccaattctgtcttctctgcctggccaagcttttcttctgtgaactgttattgattgtataataaaaaaaattaaatataccccaaatacactttaggaatctatatcagtaattaaaaataaaactcaaatccaaacaatcctggacatacaaataattgttcttaaactgttgcatatgaaggctgttttttgcccctcttgtaatatatccatacctcttaggatatgataaccctaaggcacttaggataatcatatctcatagttaatacatatccttagttctgctaaaatgtatggtgtgaatgatagaaaatttgccatactattttgtatataaataaagtatataaatattttttacatataaaggtaggataaccaatcataaccagtaaacatttttgagccagctggatctgaattcaaatcctgctgctgctgctaagtcacttcagtcgtgtccgactctgtgcgaccccatagacggcagcccaccaggctctgccatccctgagattctccaggcaagaacacggagtgggttgccatttccttctcc

SEQ ID NO: 26276 - DNA, 2707 bp, Bovine  19866880696378
cattgaatctttccattctttctttaggcctcattagtacagataatcgagggctggcagaacttcagagaagtatctcttgaaggagatcaaacacttctcaaaatccaactccctctgaaatggcaagttttttcattctcatgggaaagtcattgcctagagaagcaaatggacagaggtgctgagagagagagcattcctctggtctcatccaccctctgatgagacagatgcaataaagcctgactaggctggtgattggtcctggcctaaacctgtgcataatgtgtgcgcatatgcttgcactcttgtgtaatatttgaatctacctcgaggctggatgccaggacagagacatggaggtcaatgtctgtgagctgcagctttctccttcagagcgagagctgtctccaagtcagggtccctgactctcccctcttgagttcaggggctgctcttccaactgaccacccagtggtgtggaactaatgatattaactcttcggcatcagcacttgcgagttttctccactaattggtaatgcaaaacccattagtgattagtgtagggacacctcggagtctagatgtcagaaggttaatgaaaaattgagtacagtaatggcccagtaccctcccgggattaatccagaggatatgaaaacccacgatgctcaagttccttatataaaatgttataatatttgcttataacctatacatactcgagtatacattaaatcatctctagattatttgtaacatctaatgcaatgtaaatgctatgtgaattgttgcctgcaggaggcaaattcaagttttgctttttggaactttctgaaattcttttttcagaatttttttgatctgaggttggttgagtttgctgatacgaaatatgtagatgtaaaggaatgactgcactgtattttgctggggggattaaagtttttcaggtgggtggtatctttttctcctttttgccagcaactaagattgaacattaagctattggcctccaggagctggccgtaagtctgattgggttatctggaagatcagaaaatttttgtcaccaaatacaaacaaacaccatctagaactatccttcactgtttagaaatggagatggctcccatgggtcacataaaaagtaaatttaattgcccaataattgcaagagttttgtctgcaaatatatttgttaattaaatttttttttccatatttaggatcctggaaatgaataagagggaaatttattggagaactttatttggactggaggacccatttgtgcaagtgcattccttattaataggtctttgttcttgctgtaaccctcagccaggtattttgagaggcattctcattttcttctaagtcatatcagcatagtaatcacttggctgaaaaccagctgccatttgcatgtttaataaaaatataacaccaataccatattcaaaactatttttccttttagactaagacttcaagataacctagttccctatatctaccataaatgctgtttaccgtgggtttgtctttaaaatagggagataatcctaaaacagtttgattactctttccttaccctatcagtcacaaaccatctctcttaattatagtgtaaggatatttacataaccagggggagggtcctataaccacatttctattatgcttggcacttgtgtgaaaggatattatattcatgtgcattagagattgcttataaaagatcaagacaataatagccgatcagacgataaaggtctcttttctcctcccagacaggctgtctctggcagaagaatacacttcatcaaaagtgtctgcaggttgtcaaactcagggaggtttggggaccctctgaggctgtcatggtcaacaagaagattttctgtcgggctttgccatcactcaccccgaggaaataatcactcactacattctgcatgttctcatgatagagctctccatttgagagaaaagagccattttatcaaaggacaatatagcccttctctgggtccacgtagcttccattatcagaccataataaatcatatttatgttctcagttaataagactgattacaacgcaggtttcagatgtgggaaaagcaaagcaggttgaaaagatgttttaatgaaaatatgataagaaaacagcttcttgtgaacattcagtgctattatttgtaatgattacagacaatttttgatgcatctttagcaatggtttaagctgcataaattggctcactggtagataagtaaaaataataaggaaaaaaaatcgtgaaatcatcttatgttgtctagaatcattatgtacataacaagtataaaatgagtctaatgtatatgctggggatggagggaaaacagattgctcaggaaaagcatggtttgggtattattcaaaatgatttagaaattttttcctcatcttacttattaaaggtgtatgtgctctgaaatttgggggtgccagatattaatttcatcttgttaatgaatcaactctacctcttttattcagtctcaacgttgttttcccctttcttcctttttttcccctccatggagctcagtacagagacatgtatttcctacccagtgtttgggcacaattgccattagtgctaagtgcctattgggaggaaaacagaccccaaagtttaatattgaa

SEQ ID NO: 26277 - DNA, 653 bp, Bovine  19866880722422
aaaccttgcctttgcccaacagccatgatggcaggaggtggtccaggctgctctggggaggtggaaggtgctaaacctccctccagttgctacttggagcgggcttggtccacatccaacctggggacccagcaaagtctagttgtcccagcgtctctgccccctcccacactctctccctctacatacccagggcctttctgcaaagggtatggaggtatccagggctagtgagtctagccctctcagagtgggcagagctggaaatctgcagtgcatacaagtcctgaagccaaaggactaaaacctcttctttgtgggagtctggcaccctggggaagggagggggcaccttggcaagtgtgccaagaatttacttggtaggtggtacctgctctgaactctccagagatctgagaatccggttatatcccctattacagcttctccccatgccactgtgcagttcaccccttctccccacccccaacatttcctttgtgtatcagggaggttttccagcgcctccctggctgacagatcagccatgtgagtcagcctgtgcctcccatttagtcacttaggcctctggagtaccgggtggcccaggcctaatgccaaacccactactactaatagcaatacgattataa

SEQ ID NO: 26278 - DNA, 1382 bp, Bovine  19866880723087
tacagacttattaagattcaatacatagggtcttccttggcagtctagtggttaagacgttccctttcgatgtagggagtatgggtttaatccctgattggggatctaagataccacatgccttgtggccaaaaaaacaaaacataaagcggaaacaatattgtaacaaattcagtaaagaccttaaaaatggttcgcatcaaaaaataataataataatctgaaaaaaaagaaaactcaataaaattatttttaaaaaagattcaatgtttgttcattgaatgaataaagaaatgaatgagtcagtgaatgaatgaaggctgacctttattaagtataagggtcaggcactctaaagacttggtgtatgttcttttatctaaccttcttgatatccatgattattgtccattttagagatgattaaactgaggctaggaaggtaagacatttacccaaggtcacacagcttgtaagtgacacagcaaacattccccaggcttttctgcctcagaaaagtgcttagctacgctgctacatggcctctaagtaaatggattcctcagaattaaagcatttctctggaaatctcagcctccctatatgaagacagatggtctctgatgttccacccctatgaaaaaagcacaaaacattgggagttgagggtgattagttcaaaatgtacaaaaatctaaaaatatattggcttcactcagatatttgtccaataggggtggaacaactttaattagtgtaacaggacaataggaattaaattggcttggtcagaagatttttacaggatgacactgatggtattactatccaacttcaaagatttggaaagatgttcctgctaacactggagaatagaaacctgtttttcatcaactaggctggcctgacaaattaagtctgtagagtcattagattaagataagagcttatctcctcagctgacatttattcagaggtttttatactgctcagctagtaattagtgctgttgaatttttaacactgctttgtccactcattcaaaacttctagaggtgtatttgcatctcctgtgtatatttttgggtattaagaatagaagaggaatataagttaattactttaagaggtttgaagaattcttccaaaagttattctgaggtgaaacctgcagcttaatgatttatttctggaagaagggaccagttctcccaaattgatcagtgtggaataaagagttggcttttactatgagatctaccatttattttgaggcatatatattataggtttataatgttctagtggaatcattaaaactaggattgcatgcgatgatggtttcctgctgtttcacaccccaactccctactatagagtcc

SEQ ID NO: 26279 - DNA, 1557 bp, Bovine  19866880764797
tagaaggcagcctaccccaggtgggaaggtggaactcaagtcgcccacctccccactcgggtggggaaatgtgagggcagtgggcgctgggaagcaagggggactctgaagcacggagtccaaggagaggatggagacaggaactgaaactgggcaaagggtcagcttctgggaccaggcccggtagacaaaggcgagcaagaccactgaggagggacaactctcaagaagcatgtgtggctaaacccacagaaggagaaggagctagcagggggccaagtctccaggaatgcccaaggcaaaatgctggcggtgggctagctagttcagtgcatggtggtgggcatgcatgctcaatgtccaactcagtgttgcaacctcatggactatagcccaccaggctcctctgtccgtggaattttccaggcaaggacagtggagggggttgccatttcctactccaagggatcttccaaacccagggatcaaatcagtgtctcttgtgtctcctgaactggcagacggattctttaccgctgtgccacctgggaagctagctgagggtgggggagggattaaatacaatctataaaatacaatctttctcacccaatccctggtgagaaggagttagtgttaaccactcaaagcaactgttcagaaaaattgtgtgtggcctgctcactgtgttactctatgtcttctcagtgaagcccgtattagagtctctatcatctaatttcacccttttagttgtaattgaacctgccaagccttcagttacacagaccctgcctatttacctggaacctagacaagggcaatcccttagtattgctaggtaacaataacaaaccaacaaatatttgcacagccttactgttttctaaagtgttgtcataacgtttctcatttgcccttcattactatgctgggaagaaggaaactcagccgtagctaggaagttaaagagccggatctcagacctaagacttcagatgccaagcctggtgtaattcttatctcagcaaatagctattatgtacttctcagataacactgaaatgccctggcagcctgaggaaacacctaggttctactcttgagagaatatattccaggcttaaggcaaagttccgcagaagaaaccagcctctccttgtttccctcggaatcaactgtatgtgctggaccttctgtccattcctccccgactgggacagacagagtagtattgccaagatgccattcttaggacagataacttgtagggcccactccctccccaactgggtagctgctcattgactgtgcttggaatcagagccatagttgcttttgtgtcacaaaaagaacaggggagaaaagtaatcatgtccagtccagacctgaatgacacacagatgaccagcacagcttttaaagcagcagcaaccaggggagcagctggccctggctccctctatgtgcatttcaccttccttcccccactccctcctctttattccatctccaccatcagtgatgctcagcatagagtcactggttaaaaggaaa

SEQ ID NO: 26280 - DNA, 868 bp, Bovine  19866880960079
ggttatataaacagatagaccttggtttaaactccaggctctatcaccaccccagtagctgtgtgatatcttgggcaatgttacttcacctttctgaatctcagtttcctcatctgtaaaatggggataatctcggtaatcacacctatcttgtaaggcatgatttaatggtcaagagttgcagactttggagccagactatctggatccccaccttaactctgccactcactatgtggccttgggaaggtcacttcatctctctgaacctctgtttcctactctgtaaaacacagataatgatggtgcctacctcactgagttgttatgagaagtgtaaagcatttataatccacttgcgtggtagggccctaccaagaaataaacccttatggaaacactgtacacaaagcaagtgcaatttcagtatttgctaaataaataaaagggacatttgagaagattaagaaaatgtgtatgaagacaagtggctagtgtggagtcagtgactaaaatttgtaccgccaaccttgcactcctgccccacctccagcctgccccaggcctgggcacatggtacgtgcagggtatatacttattggtgacagttcaatcaactctaagaaataagtgttactctctggccctcaaggtttatgttctttctttgcaaggggaagctggggctgaacttgagagccttgtgaagggagatgtaattttccttatttactaacatttacttggactggtgtctgggacacccaaaatatgctatgaatcagtcagaggataacaagatctgcagtcctgtacagattactcactaatttgacatttggggatttttgcaaaatgttagggaaca

SEQ ID NO: 26281 - DNA, 1730 bp, Bovine  19866881048017
acaacttagcacacatgctgtaaatgtttgacttgggctgtgcttttggagaaatttaaattaggaaaccaagctataatttataatagccaaaaaattggatatgtcttagttatgtgatgattgatcctaagtgacacctgactccaggaccatctgcccccttaacggtgtggtctgactgtggccctgaggagaagaaagcttaagaattatgaggtttggtggtcagagttggggtcaacctgcccttttggcccttccagttggagagagatccctgaattcatttccaaatggcctgtcttcccctggccatgtaaaatgacctctccttcccttctactattcagattctatcttttcttcacatatatagcatatatattatatatctagatctacatcttcatctatcctgaatctgaatcttccactagagtggaagctccatgcagtcagggactttgttttgtctactactgtataaccagcacctgtaagagtggtaccttgcatacagtaggcacacataaatataaacaaactgcatataattccatgagaggattaggtcctaatggcccagcatccactctttgaattaacttctgtctcaatgcatcaagaatggcactagctatacaccattcttggaatgagaaaatatttgagaaaacagtcactcaaatcacttgtgtgttgtggttcaaatgaggaaaactggttgagaaaatttaattcatgagtgcatgtgaggataaaaagtctcacttcctctaagttgcctcctcagaccatcctgtttcagagttagttagtgatacgtcagcaaaattaacagatcgttgaatttccacacagttttggtaattctgctcgcatctattatgtatgtcatggggtagaaatggttaaaattgaaagacccctgcttaatgactggtgtgcacttaggagacagatacacagccatcccagtaaggtgactttggggaccctgtagttaatggctctgtaagcagatccggccttttaatggtttcacaaaaggcacatacacaattgaggctgcagttttgagtactgtctggtcctgataaggctggctgggaacaccctgttctatcctttccccaaatcaaatgctctttgagagccggccaagcatttgagaccaaccaagcagtactaagtgcattatcttgtctaagcaaagcatgagaaataaattaagatccatgctgacctcaccagcgtgaaaaaaatctctgcttttacctaatgtctggccagtgccctaaagaggatcttcttccttcccttaaaattgcatttaggttcagtccttttgcaataagtcccattttacaaggacacttgtttcaactttctccagtcatttataaaccaaacaccagaaagtgcaatgggattatcataattaacttgggatccaataggacatttctaggagctgaggatgtactctgctaagcactacaggggaagagtagatacctgaaaagaaaagcagggttctcataacaaggaagcaaggagttggtactgggtgtgcaaccagtagtgcccagcatgaaggacttcatatggacttgtagcatggaaagatttacatactaaataaaagaaacattatttccaggactgagatttcagatgttctctgtggctgcaggaccccaggtttaaggaaaaatattttttaa

SEQ ID NO: 26282 - DNA, 1011 bp, Bovine  19866881050327
gaaaagttagagcttctgtgcatgagtcccttgacaaaactgtttatttatagtagagatataaaaagatttgaaaaattaatcataagcatacaaaaagagacttaaaaaaaattaaggccatgtcattttcagcagaaaaaaagggcaggacaagtaaagaaatatagttgcaattcaccatagctcatcactggacaatgtttacatgtacataataaactaaaattgttttatttaaataaatatgtggaaagggagagaagaagatatctaagagttaaggttttatctactatggcaaaaatacaataaaatattcctaaaatttatcagtcaagaaataagcatattatttacattaaatgaagtaataacacttagaacagtgactattacatggtaagcagtatcggctattattagaaatacaaagttaaatatcaggagaaagagccagaaatgagagtgcttgtctcttgggcatacgattcagagagaaggaaaactattttggttcattacaagctttttagtactacatgacttttaaaataatatacatgtattggttttataaaaataaaaattaaattaataataaaacagctatattgtagaataaaatataaacataaaaacgttatggcattgtaaatacggaagtaaaaagtaatttataagtaaggtgaatgtaaattttaagaaacaaagtatgtattgtaaaaaagacatattaagctttttcatataccattgagttaaaaactaaacaaatttttaaaaatcatacatacttaaaaacaaaaagaaacatattccataaacaaacaaaatataaaacaaacaaacaaaaaaacaaaacccagaacaaaacagagaggtctccctaaaaagagatattgaaagctagagaaacaactgagaaaccaagttgttaagtgaaaattaaatatccagtgcgtaaaatggatacaaaccacctacctgagactagaagtcagaatagtg

SEQ ID NO: 26283 - DNA, 1733 bp, Bovine  19866881128530
agaaggtgaatctaagagacccatattgaaacacacagtaattaaattgccaaaagttaaagacaaagggcttccctgatagctcagttggtaaagaatccgtctacaatgcaagagattctggttcaattcctgggttgggaaaatccactggagaagggataggctacccgctccagtactcttgggcttcccttgtggctcagcttgtaaacaatccacctgcaatgcgggagccctaggtttgatccctgagttggttaagatcccctggagaaaggaaacgttacccactccagtattctggcctggagaattccatggactattcagtccatggggtcacaaagagttgaacacaactgagcaactttcactttcacttgctgaacaaaagacaaagagagaaccttaaaagcagcaagggaaaagcaactcattacaaagaaattcccataagactatgagtgaatatttcagcaaaaccctggtggagcagattgtggaatgataatttttgggtgtggaaagaaaaaaactgccaaccaataatgttttacgtagcaaagtttttcttcaattctgaagaggttttgctaaaaaaaaactgaaggtgtggcagcacttgctgccgctgcgccgtgctgcacgtgccgagggcttctgcagctgctcgcgcggagccagagaagaacggcgagaacgagattgacacttttgctccccgccgccggacacttacgtgggacccttgcccaactcagcctcagagctgtgcgttaaaaaaaaaaaaaaaaaaaagcagccgccgtccccttttgcaatattgcaagatagggggaaagcagaccatggtgaatccggacagcacctcccagccgcccctgctgacggccagctccctttcctggaagctgtgcgcaagctgcgggggcaagattgcagaccgctttctgctctgtgccatggacagctactggcatagccggtgcctcaagtgctcctgctgccaggcgcagctgggcgacatcggcacgtcctgttacaccaagagcagcatgatcctttgcagaaatgactacattaggttatttgggaatagtggtgcttgcagtgcttgtggactgtctattccctgcgagtaaactcgtcatgaggacccaaggcaatgtgtatcatctaaagtgttttacatgctctacctgccggaatcgcctggtcccgggagatcagtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatcttgttcatcacaggtggatcccatgtgtcttcagtagacaagtcacctttgtagctagcaccagtgccagctccatgccattgcaccttctttagtcttgattgctcttcccgcatttatgggtgtattaaaatgactgaatatgaacattaaggactccgtgaacttgagctaatgggagactgtagagaaaatgaaaaaagatccactggaggatatctttggtggggggagaggaggggagggagcttgggaagagggaaatgactaatgaagctaattaaaagaagcattcaaatttgctttctaccctcattaacaattagcagggcacggccagag

SEQ ID NO: 26284 - DNA, 1422 bp, Bovine  19866881141593
tacagtctctgagagaggctggatcagatctgtctagccggctttctccaaattcctgacccaaaggaaacttgaaaaagaaattgttcctttaagttactagattttggtataatttgttatgcagcaatggctaaccagactccttgtctcaatctctcaatctgaccacaggcagaaagggattaagtagctctaacccatcactgtgcaatggctgatggtctggcatgtagattcaaagcccctgggagcaagagccctgtcttcatcactgcagcagttatagcaccaccccatagcactgtgcttggtatatttcatctcacagatattcacaaagtacctactctatgctagggactgtgctagaactaaatgtctaaagtatgctctttgctcataaggaatgtaagaggagacaaacattcaactaataaattgtggtaagtttgatgagggaaaataaccaggtacatttaggaagaattaagagggatatcatttagatgggaggagagtcagggcaggggtctctgagactggaaggatgagaaggcattagcctttcatcagaagaacatgggtaagaacaattcaggcacaggagatggcccttatgaatgcctggaagccccaaagaaattgctatgaataatatactcagtaatgtgtgtttgcctgcctcagcttgctcagtggcataggtgtggtcccggtctgctaacctgtctgaactagtgcccatggcaggccgtcctcctgctgcctggcagaagccccactgtgcaaacatattacaagcttccgctcatgtacctgctagcatcccattggacaaagcagatcaaatgaccaagactaaacactgggatagagaaatacactcctcccatggagctgagaggaaggggtgcacatacttttgcaaacaatcctaaatgtctgtcaaatgccctgtgtttcatattatgactgtggcccgggctccctccttttatctgtgctagcacttttgtagatggtactggcaccaactggactgttcttcctgacaccttcagctgtgatattggctctcatccggtccctccaaatatccacgtccatcaaccatcccatgccaatgccttgtttgcttctccatcctcatcagtctgccccattctgcagcacttaactgcccatgccagctgtatccgcctatgacaaggaaatctgataaaaatgtaggatgctggcaaaaatcatttcaaagagataaattaaagtaaaattgcccaggctgattaaaatgctgatgaagaactgaattggaacagtataataaagctcacttatcttagtagaaatgtcatgaaaattagctagttggtattcagggtctgaatacaaaagaaaaattgttattgatttacatat

SEQ ID NO: 26285 - DNA, 1119 bp, Bovine  19866881277445
tcttaaaatttatttatttattttaattggaggctaattactttacaatattgtagtggtttttgccatacattgacatgactcagccatgggtgtacatgtgttccccatcctgaacccgcctcccatctccctccccatcccgtcccgctgggtgatcccagtacactggccctgagcaccccgtctcatatatagaacctggactggcaatctatttcacatatagtaatatacatgtttcaatgctgttctctcaaatcatcccaccctcgccttctcccacaaagtccaaaagtctgttctttacatctgtgtctcttttgctgtctcgcatatatgctcatcattatcatctttctgaattccatatatatgtgtaacatttcttttatagaatttaaattgcagtaactttgccatgtctctgaaactctaataaatacactgtattcaaaggccatacattttctcattctgtaaaaactctgcatgtttagtgttaccgaaaactgtgttcacatgctttggtgctattctcactaatttagtaaacaactagatagaagatggtttgttaacctgatattaaaataattatgtatgagcttaaaacagtagttctcagtttcagctatactttcagtccagttaaattagaatccttgggacttgatttgacatcagtgtttttgagagctcccttgattccaaagagcagccaaaattaagaaccaattgagaagtatctagtttcagttcagtcagtcagtcgtgtccgactctttgcaaccccatgaatcgcagcacgccaggcctccctgtccatcaccaactcccggagttcactcagactcacgtccattgagtcagtgatgccatccagccatctcatcctctgtcgtccccttctcctcctgcccccaatccctcccaagcgtcagagtcttttccagtgagtcaactcttcacatgaggtggccaaaggactggagtttcagctttagcatcattccttccaaagaaatcccagggctgatctccttcagaatggactggttggatctccttgcagtccaagggactctcaagagtcttctccaacaccacagttcaaaa

SEQ ID NO: 26286 - DNA, 999 bp, Bovine  19866881292293
taagagcagtaataggagttatcataaatgaaaagaaaaaaaaaatcattaaaatctgagtaaactcttgggttatcatatttaagaaattcacatttacattgctaccacagtgagatatttcagagacaaataagaaagtaaaagtttccagaaaaaaatgcttaaatataaattaaaattatgatcccaaaagaagttaaataggttccttctaagcacctcacataattcctccacaagtttcacacagtgcactgaaaatttcaaaaataagttgaaccagtaacagaaacatttcagaagttggcaaaagtgttcattttaataaacaaaatatgctgttggaacaatacttggacttgtggtagactctggtgcagcatcagaagagtttttaagtaagaatttaaaaacctttaaattagttaaaaccaaaatgagtcagctgaaaacaaaaccccttagaaaatgttaactaatctcagaatttcattttctgactgtgaaagtgattcgtatctttgccacctgtttacccacttggtcaaaagtttaaagccaaatcccatgttgatttcattcagttcaaaaaaaaactggtgtattttaaataaacatttcatttagggtatcaaaaagtcctaataaaatcttaacaagaaatgcaggcaattccactataatgcaatgtacacttctgaaaaaatcctaggttctggaaaatcatatactaaaaataacagggcttacagaaaaaagattcggtctaaccacttaaaatctgtgtaactttataatgagagcacaaaataaaacacaaaaacaactgttactaaacattgaaataaaattatgtgagctacagtaattctttctactgacatcctttccaacaatgttggtgacattatttgccaaccacaaaaacatgctgtaggatagactatatattggaggaactatggctagagcaaaaaacaagaggaaaaacgtcta

SEQ ID NO: 26287 - DNA, 1034 bp, Bovine  19866881308405
ttttgggtttttggcaaatgcaagaaaatgtcaaaaatttagtcaaatttttcttctcacccaccttcttccttatactttatgaatgaggcatggggaacttctactttataggctttgagggctttaaaaatttattagtgatgatgtgtttattaacttatttataaaaatttgaacttcatactctaaattcaatttgtcagatatgagaatatcatattatgatttatttcttccctgatagcagtgtgagtttcagaaaccaatacagagcttcttctttctaatcctaacagggaaggcaaaaaggagcagatatctctatcaaaatgtcttaaaactagtttttgtccatacctgacacatacctatgagactttaaagcaccaggaaaaatgaggaactcctaaagagattcaatacaggaaaaaaaaaaaaaaagattatcttttgggtaatgagactcaggaatgcatttgacttctatcagcaacattgggtgctggaaactaatggaatgatgctttcaaagttctgatggaaaataactttgaccatagaattctatccgcagccaaaccctggtgaagtagcaaaaggaaaaacatagcgaacatgaaataaattatagtttatatttctgaaaaaaaaatcattgagagtgaactccagaaaaaaggaaaacatcatgaaggaggaaggcatgagatccaggaaacaatagctctaacctagagaggacagagagggaagtcccttggtgacagctgggcagtcactcaagaccaagctgcctggatgggagcagaaattcagagacagctgggtggatgtctcaggaaagaaagagattggtccacaggtaaaaatatttatataatcgtgatcatataagccctgtttataggttgtaggttattaattgttagagtcaatccctagacaaactcacagaaggcttaattataattacagaaaagaacataaatgttgtcaattttgacaatgtaaatatatcagtagagttgaca

SEQ ID NO: 26288 - DNA, 1059 bp, Bovine  19866881317079
ttctttacttcctagtagtcgtctgctgtgtgaacttatgttgtgtggttaatagtttagatgttcatctaccaatgagtttttaaaaaccctccatggcattaaaatcacttggcattatatagtactgggcataaatttattaatttcttttgtgattttataaagtaggttgtaagtatcatcttttaatttctaaagaaattaaagctctaaagttcagagtattccttaatacctttggatatttcttaacttaatggtaagttcattagaatacattcagtctatcacttgatctgttgaaactgttgtacacaataccaggcatatatctcctctttccttccctgagccttctgccacacctcacaatcttgactaactttgtgaggtatcactttaatattttctttttccttgaaagccacagttcattaagtcgaaagcatttatattcttatgtcacattagcatgtctttagcttaccagatagtattttgtttttagttgattgcaaatgttgatttctgtttttttcagtttgcaaaactatatgacaggaaatcagtagctaaatatcactttatgatttccatctgttcaagtacaatagtgtttatagcacagtccagattgcagtgtgatagaaatgtcctattatagcagatagaatttaaaatgatcattatatattctaatgagaaaacatttttaaacaagtacttcacttaatttcaaagcagagtaactgaatgctacaatttgatgacagcatctgctattcagtgtgtgtgtgctgtcaacaataaaaacttttttctgacttccttagaaattaatcagtttgctcacatggatactaataatggaagctgagcagtcagggagacaaagttcttttgaatatcttaaaaattttttttctattattatggagagtatcatacattattttgtgtggcttaactctgggggtgggactgttgttttgatatttttattataatttttgctaaattttattctgaaaatatgttcacatttattaaatagaa

SEQ ID NO: 26289 - DNA, 1736 bp, Bovine  19866881353704
atagctccttactgccctcttctggctgtggcttttgtttgtcattgagcgtgttttagtttttaatccttagaattttagcaatattttggatagattagtggttctcaagattagttgcacattagaatcactttggaaagtttttagaaaaaagtaccagttcctgggcttcacttgtgaagattttggtttaattgattttgagggtgtgtttggcagggctgggtgttggtgtttctggattttgtttctaattcttgaaatcagtcatttttggcaccagggactcattttgtggaagacagtttttccacagactgagatggggtttagggatggtgtggatggtttctagatgattcaagtgcatacatttattttactaccactgatgtgacaggaggcggagctcaggtggtaatgtgagcaataggcagtggctgtaaatacagatgaaacacctcctgctgtgcagcccagttcctaagaagccacggacttgtaccaatctgtgacctggaagttgtgaacccttgcttccgatgattaaaatctctggctagtcattaaaatctaaccactggaatagatgccccttggaatcctgtataacttgaactacttagatatagtccttatgtttttaggtatcatagtggtttaaagaatttaaattgaggaatgtaggacttcagaagaggcatggtttagataaggatatgatgtggataagactttataaaatataagatctgtataatatctcctaatactagaagaagttttggagtgtactctattctatcattttcctgctttaagattcatatctcaattttcacttccttttttctgtctcaggggttcagcctgaggcttctgtctagatttggccattggaagattcatactaataagtgtggggggaacccttgtacttcttagttgggttagaaacctaatgggaaatatgtatttatcacgacttcttaaatgaaacttgttgttaaataccagttgtaattagcatcttattaataatgtcttctccagtaattacattgttaagaatacttttggtatctcttctgtttcacatttcagcccatggtataaatttctgttatctgttaaatctctattactaaacttaaatgtgggttatttttaaaaataatagaatgtatttaattttttagggatttaggattagcactctagtgtaaaagggagttatttgaataagaacctcttttttttccagaggaagattatagtaaaatttattggtttatttgttaaagcatacactgagaatttatctaattgattcttttgatttttttttttttttaaaccattagggttcttgaaaatccaatactagagctaacattttactgttagctaacacttgtgacatttgctaagtttgttaatatgattatagttcttaatttaatcctcaaataagttttaggatcttcaggttttttttaagtggcatattaactagctcttcaatatgtgaccattttactgtgtttcttttgctgtgggattcatttattcagatgtaacctttgcatgatacccaaagcaaatatatgcatttggtagcagagtttgtgaagtcctggcaaaacagtggatttgaatggttttggcttaggtcatctacagcttacctgtttcttttgtctttgaaacatatgtggtttctctgactggtt

SEQ ID NO: 26290 - DNA, 1432 bp, Bovine  19866881509915
cctataggagctctctagggagtgaggataaagaaatgaatggggtatagccctttctttttgaaggtgacagtctagttagagaggactgaaaaggcagacgatagtacaggtgccatgctgcgtaatgaacagtttaccttagatacctaaggaggtaattaggaaggatgttgttggggtcttggataaggaatagaaatttaaactcccattctaatacagtcgtgaatttattttgcttttcatgtttatatgtcattttcctctccattacatgtactggcatgaaaattttagtcactcagttgtgtctgactctttgtgaccccctggactatagcctgccaggatcctctgtcaatgaaattctccaggcaagaatactggagtgggtagccattcccttctccaagggatctacccaacccagggatcaaacctgtgtctcctacattgcaggcagattctttaccatctgagccactagagaagcccaggtggcatagtaggccctcaaattattgatgcaggaaagctttgaacaggactatggctggaatgcaatgaagtagccacacttgattcttgcataaaaatctcaatacatcaaacactcggttgttcatgacccataccagactccttatcagtgtaacatgtttcctttcttttttgtaagggaagaaattatgtagtagggaagtttagtgactcatgtaaggtcacacaacattcagtgtcaaaactccaagcagggtctgctcagcaggctcctaatccctggggattcacctttgtaacagccaacgtctgaatgcacgtgtcttttcaaggaacagtggaagataaagcctgagcaagaacagatgtgtttcatcactgctggtgatagaagggtccacaaaagtgcatccagcattgagatcttgcaattattaggatctcgcaattcagccaatttcttacctggatgttaatggctgcaattagttatccaccttggcctgacactgggaaaagtcggccaggtgctctcctgccctacagaaaccactttgctaacaaagagaaaaggccgtttcttgccactgaattcatagaggggaagcaattctttctaataggcctggaatctgaactttcataaaaggcaccttagctccctgactttctcatatgtcttcatctgctccatcgactctcatcgatgaaatataccagtaggtgctgcaaagtgctttttaataccttagtaaacagttgagagaagaacctcattacagataaagtgagaagtaaagttggacagcccatttatcttactcagtgtgaaataagggctattgttcaattaggttaaaataaaatctctcacgtttccttccaaatgtcttgtttggggacagagatatggggtggtgggggtggg

SEQ ID NO: 26291 - DNA, 897 bp, Bovine  19866881759208
atttaaatctctgggcaaatgtgacttgcaatttattatatgtgaaaagcataagtggcagcagcattgtgattttttttttcaggatacagaaaaattgataaggtctgagttgagttatctcctgccagcgtcccctcctgctacggtcccatcctctgcggacctggagggccttcctcatcttccactatcaacggggtcatgtgtgatgacacaagctagatagaaagattacgaaaggagcgtgatggggtgatggaccctctacaccgcaagaataacgtttggaacaacggacgattattatcccagaggtagtattgcatctggtatccctctgttcttgttcagagaagggaaggtcacagaaatggggatggggaagcagatccaggggagtgtctgggaggccaaggcccatgtcctcttgccctgtcctggaggcttccctggctctacaccctgggcaggtcctccttcccaagaaaggtgttgcagctcatatcattaagaggcttggctgtcttcaggcaatcgctcaggggttttttgccttattaccaatctgcctttcttagaaaaggtcatgaaatggacaggggatgcctcatcttcgttataatccactgtttgaaacatttcaattaagcttcagatcaggccccagaactgaggctgttttaaggaggggaagtaatgaccttctgttgcaggtgttttctggcacaccatcagctttgattcttcttgatctttctgcaccctttgatagccgggatcaagggttctctttatatgcttcaagcacactggaggactttcagggactccactgacatggttttcatcccctgcagtcttagctgagcggttgtcaccgacaagttctccacg

SEQ ID NO: 26292 - DNA, 848 bp, Bovine  19866881828410
acgaactgtcttctggcaggcactgtaaggattacacttaatataacagactcctcatatttatcagagtgtgtatacaaacaacatctctgaagcactgttatactgctccggccaaacagatctgagctttccataataattttcagattttataagacaatactaacaaagactgtgattggccccatagttgttgcccaatatagatttactgaaagaatgacatttaaactcttgtttcataattctgtagtttaataatttacttacttttgtcacttcctctgcccaaatctagccagcattaaaaattgagaaaaatatagagcatgaaagaaagttggaatttaacattttctacagcttagtatagaaaaatgtaaatattttaattcacgtggcatactttttccagagtcacattaacagattaaacagtaatagttaaatcaataaagcttaatatactgtgaaagtatgccttctatgtttaatagtattgatgtttgagtcttatactaattctaaattaataacaggtttccaaaactgggaatatttaacacctctcggttctagtattctcatcagtaaaatgagacatttagagtatatgatttctaatttctcacttaggttcaaaattctgcaattttaggaagttaaaataaagcaaggataaatggacacaaaatgttgatagagccatgaggggaggcaaaataaacttgagatatgatgaacttaaagttaccagagttaaacatatcttataagtagatgacacaagtagtaaaacaaatgcctaataaatgaaacaaagtcttgataactgttcagcagga

SEQ ID NO: 26293 - DNA, 2467 bp, Bovine  19866881849940
tctagttcccttcttcgcttagtcgtgtccactctttgcaaccccatggaccgcagcacaccaggcttccctgtccatcaccaactcccggagcttgctcagactcatgaccatcaagtcggtgatgccatccaaccatcttatcctctctcgtccccttctcctccctccttcaacctttcccagcatcagggtcttttccaatgagtcagttcttcacatcaggtgactaaagtagtggagcttcagcttcagcatcagtccttcccatgaacattcagggctgattcctttagctaagattgactggtttgatctccttgaagtctaaggactctcaagagtcttctccaacaccacagttgaaaagcatgaattccacaatttctacagaagtctgtgcctttaatctaaaaaccaagtgaatttatagaaccatcatataatcttaattttaatgtacacatattagaatttaaagttttaaaaatacaaggattgacttgcctttcgtatttcttcagggtatgccaagacctggctgaggctgattgaaagagaacatggttgaaggcatcatacactaataaaataggaatgatctttgaatagggaaattgtgggcagacagaaggactttcataggtgaaaatttgataaaactttaggtgattgtggcagtttttaaagtaatgcatcttccccaaataattccaatttaaaatcaagcatcagccatgttttttttatctttgaagacttgaatcttttgaaaaaaattgaataagtatcactaatatgaaagtatgtgttctaattgccaaatccagctataccaaattcagattttagagtctgaatttatacataaatatatagtgccttttattacacaataaaagatgttaattttatgttaattgacatagatattaaaagatattaattgacaaaaaaaacaaaatttacttagttggattttttttttaagtagaagaccatcttatcagctcttaatacttgtttgtatgttgtgcagaagtaacttgtttcactttgttcactggtgtaatgtgttctttgtctcttacctatgcacttaagcaactaaactcagcacgccttgaaggagataacattatggtaaatttctcttacatgctcaacctcctgcatgtaaaatggctgaaggtttgttggcctactgtgttttctacatcttgaataaagtgccttctcttgctattatctacatgtaaaagtctaaagtagttgaagctgtgcattcattagtctaacaaaaaatacagagaatgctagctgaagtaatactggaacttgaagaacagaaattatgtgttctagttgacaaattcagctacaccaaattcagattctagagtctgaatttatacataaatatatattgccttttatatacaataaaagatgttaattttttatgttgactgacatagatattccaaagatattaattgacaaagaaaattaacaaaatttacttgacttagagaaaagtataaggtatacaaatttactttgcttcacagtaccttcagtgtttactttaattttcacccaaactcaacacagaattaatttcttctttgtaattccaggccaaaacaaaccctagtagtttatgtatttctgtagtgttgaggactgtgcaagcaagctcagtcacttcagttgtgtctaactctctgtgacaccatggactgtagcctgctgtccatgggattctccaggcaagagcactggagtggtgggttgccatttcctcctccaggggatctttctgacccagggatcaaacacatgtctcctgcagatcctgcattgcaggaagattcttaactgctgagccatgtgttaattcacttaggagagttgctgaatagtgatagctttgaattagtaatgagaattattctatagtatcctgtatattttattgagcttgatttgaggaaatttttgagatgttaagcatatttaattttttagcaagatagaaattagtaaaatctaaacattgtccccaaactcataaatgttagccagtaaagatttataggtacagtgtttgtcataatactcctgactgtattactgccatagaagtagatggaatccactgttaagtagtaaataattggcagtttttatttgttaaatcagttgactacttttatttcatgagcactgtactaaaaggaggggggaaaacgtgtaatagaaaagattattatacagaatatgtaaaatgcatttgttttttaaactactccaattattgaagccctggctaaattagggctttccttagatagcaagagaatgcattcatttatttccattgtcctatttatatgtagataaatgagaagtatgagactgtttcactcattggtactttagtatataagtcattttaaacatt

SEQ ID NO: 26294 - DNA, 1083 bp, Bovine  19866882001363
tgagtctgaatgaattccgggagttggtgatggacagggaggcctggcgtgctgagattcatggggttgcaaagagtcggacatgactgagcaactgaactgaactgaaccttgtcccattcaagacaattttagcctgacccaggaatcagcagtgggatgtggataggggaaaacaaggatgtgtgatttaaaagtcacccaccaaaccaacaattagtattatcaggctattgaacacatggcgcctaggtcaatgattggaagtctaggaaacggggaggctaggcagttgagaagcttcaagtaagggacagaatggccatctattgagcatatgtgaggagtgaaaatggccaaagctctctattccacaatagtctcatagcttttttagatcacttctgttatgggtgttcaattttttttccttccttttattcctcacctattttataataatattggctcaatccttgaatctcaggtagggccagtatgcccactaattgcaaattgccttcccacaacatatagcagggccttcatggaaaccttagcctagctgatagaatcttccaactggttcacttgtcacagtgatagcttcagaggtgagcatatgaactcagtcagaccaataagtctttcctggtactttatcacagttcttgaaaaatataattatttggggctgccagtgactatcttgcctattcatggatggagactacctgagaattaagctaaccagagacatgtaaagaagacagagatatgataaacattgtctgaagtgctggatccaactattcctgaagctagctgttgtccatggacttcctaggtacttaagcagattaatatcccttttcttaaaaaaggtgtacgttaggcttctgttatctgcaactgaaatattcctgattaatacagtttcttttcttcttgttctttttagttttttgactgatgcagtcagatgggctttggtctttttcttttcaaaaggaggccctgtccttggaagaaatagcaggtacagtaaagaggtcttatgctttatgtcttctttagtcatta

SEQ ID NO: 26295 - DNA, 1513 bp, Bovine  19866880546893
aaatcttttaacaaaaataaatcatgaatgtaatatatgatacatcaaaatttttgagactaaacaacagaatcatttttatgatgtctatacttctgatatttattaacaaaactgaagcaaacacaggaaatttctaaatttttcccattgcatattttatagcatgacatttctatgcctcaaactaatgaagaatttattttttaagtaaaacaatattaatgttaattttcttgaaagttcttttaagaaatgagagtgaatgcataaataacaaataagagaatcattttatcatttttataaaaaggaaaagcagatattttaaataaaatcattttcatgataaaaggaaactattcagagcccagatattatatcaatgtcaactattttgaaaagtgccaaagacagtattagtaatgaaaaaagtaaagtaaattgaagtcactcagttgtgtccaactctttgcgatcccatggactgtagcctgccaggctcctccatccatgggatttccaggcaagaatactggagtgggttgccatttccttctccaagggatcttcccaacccaggattgaacccaggtctcctgcactgcaggcagactcgactgtctgagacactaaggaagctcaattagtaatgaaaatacaattactgtatttagtaatgaaaatttagtaaatttagtaatgaaaatacatatttggacaattttgtccaaatatcacaaaataaatgattaattcttttgtattgtgaaggattcttttctcccttttaagtcagttgcatcaaccaatctcttctattttcagtagaatgttactacagacacagtctaatcaaatatacctgggttaaagtggatcttgatttagtcactttctattgacaaaactttgatgaaattactgatattctctatattctgcacacttagcctaaaaatgtggataaagtattatcatcatggggtggttttgttaattaccaggagtaatccatttataccacccagcaccatgcctggcaataaaaaatgttacacctctaaatcattttacttttaatttatttcactatcacagaagatgatataaatatgtgcaaaacattagaaagacacaactattataagcccttaaaatactaactgatattattaaactcctgctttaactgtctatcactgcatcccttaccttttctccaacaccaccaactgagccaatggatcctggaggtccttgtggtccctgcagtgtaagaaagggaatacagttatccttactcttgtaataagatataaattcataaacatacatccacttgttctcaaagagagaaatatgtgcaagaatatctcaagtcatttgaaagatgagacaaaatgatgaactttatgaagttgtcaaatgtgctggatagcaaataatttaattgtattacattgattttcaaatgcaccagaattcggagataaagcagaggactttccaa

SEQ ID NO: 26296 - DNA, 2482 bp, Bovine  19866880692129
atagtttagtctcttctgaggttttaaggtttgaattatttctttcttaacacaaagttttgaaaagaggttttattagaattgaccaaatctcaaactgaatagttactgcagaggtaatatagtagtaatactatagggagacataaggaaatagtaatatgaagaaatatccatagttaatagcaaaagaaattaaattaataatccccctcaataagaagtaggaaactcacgttttctcctttgtcacccttgctgcctttttgtcctggttcaccaatttcaccctgaatttgaaatatttgagttaaaatttatatctaatatgccatacctgccattgcattatgatcactatcatcttatgactaaattatgtgctagcatttaatgtcactatttaaattggaaaagcctactgatcactctgctgtattgactaatattgctgtctagatcattttctatatgataagcatatagaaaaacaaaagtcaactgaactctgaggaatattacagctgggattttcaattcacaaaatcaatgtcatctgaaataacaccagtataaactgataatggaaatacactgatttatataaaaatataattacacattaatcaaaaatcaatctattttttctcctagttttccaactgctaacgtataatgcattatcagcacactggttaacaaattttgttatataatttcacagtattgctagaaagtatattcaattcaaacacaacacagctatacatttaaaatcaagatcttagaatctccacttacatattagtaaaaaatagagaagtacaggattatcaaagatgtatgcagctcattcttaaattttaaccctacaatatccaagacaccatggttaaatgtatacaactaattactcgaatttcacatttatctgagaaacattaaaaacagataagagtttttggcatctgctaatttttctcactaccattgttcatgtcttgtttagatcccacatactatttcacaggaaaattctaattctaagcccctaaattaaaacttctgagcacaagaaagctatattgaaactttgaaaaatatatctttagattttatatctaatcttaagaaagattatatctaggatttttgagaaaaaatttatttttcatggtatgtactaacataaataaagagtactcaccttgtctccatcttctccaggggagccagcaggccccgcaggcccggggagacccacagggccttgtactccatctctccctgcaggaccttggggacctttttctccctgcattgaaaatccaccaagtcattacttggttgtaagaaacctatgaatttgccactcataatttataagtgaagctacaagagtcataccccggcttccatatttaacaaggaaattgttttgattttcacccaaaatgcattttctcagtagcaaataataacatgaaatatcccacattatttcgtgactaagaacactaccattgctaaccatttatgaatctcataaaaaataatcaacaatcaacaaaaataatcaatagaattttcctttgaaccacacattttcaaatcaagcattatatattaaaaatcagatgcttaatgtttttgaaaactgaccctttatgttactgaccctttatgttgttctgtattgctattgaaatagctgggcagtggctggtaggcctcaaaaaccatacaatgcatttgctcatatgcccaactttataatatgctttatatgtagatgtttttcatttttaacaaatgtttcatgaatttttctagattttggtatttcaattttcttgcttttgattcagaatgaaaaggttgttagcttcttaaaattttttctttatcttttgacggtggcattattttcctcttttaaaatttaagtatattgtataattgaaaaagtagagccttggtaatgaagatggcaaaaattcctttcctaaaagtgaagacctcatcagttctgcacagagttattttttgattgtatttggtagttctatctttcctcctgttatacaatctgggaatccatgtcgttagttcctgcctttacattatcctgaccccactatctacccgcttccctatcccttaccacctcctttccaagttttatctcttgaatatatttacttcactttatctccaccattaatatcttatcccaaaatactagtagccttcctctgaactgttgaaatacctccttcctatctcacatctattcttacttccaaactatttcctatgttgtaactggagacacagatcatcttaacaacattctttagtcaatttacttgtttaccattcctaagataaagagcaagctgctagtgcagtctccccattacctggtttctactccctttgccattgctctgtatttcaactcctttagatcttttttaaa

SEQ ID NO: 26297 - DNA, 1239 bp, Bovine  19866880753890
tttggtgcactgaatccagtgaacatggcaatcagaattcaagcagatgttcacagtttctgtgattgcctggagcccaagggtggaagaaggagaatcattttgctgatttacttttgttagtatctgtcgaggcacagactgcattccaaatacaactgttaaaataagcagactctgctaaagagttgtgaagaacagatatgaatactaattatgacttcattttttgacacatttgaacttacatacatagttactttaatcagaatttgccaatgggaaagttgcagaagcacatttatcttcctctagccttatttttttttgtatcttaatttttaaatgtgattaatttattataattagcttcaagaatacagaaaactatgggataaagcaaacagaagtgtgtctatcaccctcactgcctactttgtcatatcttatattgtgctatgtttactagaacttttaaaacatatatatatatatatatatatatatgtatatatattatttatttatttatttactttaggctgtgctgggtcttcattgttatgtacaacacaggctttctctagttgcagtgaataagggctactctgtaattgtggtgggggaccttctcactgcagggacttctcgttgcagagcacaggctttagggtgcactgtcttcaagagcttcagcttgccagcttagttgtcccatggcatgtggaatcttcctgttctagggatcgaactcttgtctcctgaattggcaggcagattcttaaccactgaaccaccagggaagtcctaaaaattctttttttttttttttaaattttttaagaactggagcattacagattccttttgcttccaaataaatgggagtaattacagtctgatcaattccatacatcctttacatttttgttatgaagtttgttatcaattttgaagtaaaaatttcctgcatatgtttttaaaaaacacaaaataactacaattatataaacagtgtaaaagaaatctcgagtagaatagctcagagtttgtaaagtgacttcttaaaattgccatctatttacatcagttcaattcagtcacttggttgtgcctgagtctttgtgaccccatgggccacagcatgccaggcctcctatggtggtgtccatcaccaactcccagagcttactcaaactcatgtccgttgagtcggtgatgtcatccaaccatctcatc

SEQ ID NO: 26298 - DNA, 1215 bp, Bovine  19866881049617
cagaggtttgtgatctaggtccattagataaactgttggaatgggaacttcagtctctgagcgtttgatgtagaccaaaaaaatacaggtgtcggtttcttccagcaaattaaagctgccttctttttttaaaattttcaaccaacagataatccatttttggactttcttaggcaacgtagagcaaacccgacgttgtgattacaagttccccttataatgctcctcaaacataaactgctattctatgtgaatgtctttcataagacagacctaagtgaatcttgttggtgtgttgtgctgtgtgatgaccttactgaggacactctggaggtcacctgatggtgaacatagatataccaaagtactctaccccttggcctttcagatttagtataaagaaaatttaagagaaatttcagactgaagtcaacaaaagctatgcattttcttagcagggagaattagccaggatggcattatcataatgacactatttagctttgtttcagttccacttaaccaactcttataagaaaattcgccttattatactatttaacaaatatatcctaaggaaatcatgaaaatagatgattgctttttgcatttatataacaaaatgatttaaacttgaaatgcagcagaataaaattttttaataagatttgcagacattaataagtgaatgctttcaaaatctactgaattaagcttattcttcaaaaattactgagtttaagtagatgcttaaatggagccatatacaaaagtacagcttataatgatgtatgagaaaaatgaagtagatagaaagtgtaccctgtttagcaattattcttcattacgagggtcatgttcaaattaaaacctccatttgtctcttgttccccagtcagttttctctttccttcctccttctgtccctcatgcttttcctttctaattttttccatctctccccttttctgttcttttgggaacattattgaaaagaatctaggtccccagcagggcacttcactagaaaatgtagacaaactttctgcaattcagagatttagagtttctattaatgcactgtgacacttgaagcacattcagctgtccttaaaaatcaaagaaaacactattttttaaagacatgaacgctattctttactgtccaataatgtttaataagacttgacaagtactcttagaatttagcctatg

SEQ ID NO: 26299 - DNA, 1373 bp, Bovine  19866881110341
cttgttatcagtagttatcttgacccttatcatattattaaaaccagcttttcctctttttgttttcctcggataataatatgattctctaatttgcgcatactctatgtatgtttgttatttctcattatttagggacctcctggcttacccggtctcaaaggtgaccctggctccaagggtgaaaaggtgagagtaaaataatgtattattacactgttgctatcctaattgcagaggctacgattatgcacattaaaatcactcaaaaggaaatttcaaggaattgctttgtcattctaaccaaggaaaatgctgtcaatccttagcttccaagaggaattcagaaaagagaaaagaatgatgaaaaatgtaccagaactcagtgctatattagtcaatgttcctttgtaggaaccatatggagaaagcatatggttatactaaaataactattcagaaaataaacagaataacaaagtgcccattttttcatgtttttaaacatgaaaataaaaattttaaactagactgtccttcagatggtaattttaaagatatatgtgctctgttgcatcaaataaagaaaataaaacatttttagagtgacattaatatttttgaattatttttgtttgtaaatatttcttgggtactgaaaaatctctgaagagtagaactcattttattttttttaaattttttaagcaccaaaaacattgtcttggattatagccaattagcaatgttgttctagtttcaggtgaacagaaaggacttggccatacatatacattatccagtgcttattaaaccaaagaattttctgttgtttatttcaccaatattaaatttggtcattattggccttttagttaaaggaattcgctttaagtaaacacagcactgaaggtgatgctttcagaaagcattttgttcaataatatatattcctaatccttaatgaaagtctcatataatacaatcagtaaaggatcctattaggtgaggaggaaaaggttcttaatcctatattttattcagaaagggttaaatttttaatgtattttttattcttatatttcatgtatttaacgcagttattttatgactataacttaatacatggttgcaatttatacatcattaaaatttctttgcctttcaaagggacatcctggtttaattggcctaattggtcctccaggagaacaaggtgaaaagggtgacagaggactccctggaactcaaggatctccaggagcaaagggagatggagtgagtaaagatatcactgattttcctactcctttccaatcctacagtcaatacacccacactcctgcacacattcctttaaacagaccaacaaa

SEQ ID NO: 26300 - DNA, 949 bp, Bovine  19866881383907
ctgatacattgcacagttgtgaaatcttggatatttactttctagcagctatgtatctggcccctctcacacacattctccatattaattcccacttttctaagaggtaggggtgagagtgagaaatgttgttgtaaggataaagggcttttaatagcacactattatatattttttaaattctcctcatttttagagaaataaatgtttgcaatgagggtttttttaaaaaaaattattattattttcatcttttggccatgccacgtggcacatggaatcttagttccctgaccagggatcaaacttgtgcccccagcattggcagatgagagtcttattcactggaccgccaggaaagtccttgaggggatttttattatcagagaaagaaaaatatgagggagagattatttagggaatacattttccttaatttattttatgaaatatatcagtggtaaatgcaatctgagagcttgtttgcataatcaatttgtatatactgtatgttaacataaatataaaatgtttactcagtctgtgtttaacatatgagaaaaatgctgtgctgccttcctctcttgctgttcagcctcttgcttcttcctgccttctgtgtgcatcaagacatccatttagtcagtaaaccccttgagaggagaaaacatgccctcctttgacgggcatctattaccagctattgtgtatatcatcatgcatacagagagcattttggtttaggccagactttagaagcccaaaggaacagtatcccattgggataattttgttcatcttgagcgggagcactaaaacctgcttctcaatatgcatacactcctagtagctagaacttcagagaactttgatgatgaaataccaattttttgctaagaggactaaaatactattgaacacttcaagactaagtcaaactcataaacaa

SEQ ID NO: 26301 - DNA, 1765 bp, Bovine  19866881416680
attagagcttaattccaaaccagaaaagtgatttagactattttcttatctggaaagagaaaaagaaaactttatttctggacaactgccaggcttttatttgtaactacataaacataaacacttgtgatgatgtctttgctactacggttttgaaaataattcccacagatgttgattcttgcttttacagacatttaaaccaaactatgtcttccttatttgcatatgctgtcaacaagctgcactgtggtgtaattcctgccagagctttccctcctgtcaatgaacagtcaggatggggtttcatttcaactgactgtgtaagccaagagcttaactaattacactacagtttaaaataaatctttagtgcactatcttaaagaattagtatagtatgaaaaaaaaatcactttgagaaagatggcttcattgcattctgtaagtccctgaaatctgatctgcactaaagtggccaacaaaccattagacagcaagcaggaatgacattcaaagcaagcatttccacagcctcatcaaaaatgtgctgagatgataacagtgaatatgtattcgaactttaatttagtctcctaagtgaccttgatcatttgattgggctgtatctaagatagtgttttcaaatgcatttataaatgcctaaagcatgagatgggtaaaaaatatccttcaaacagctaccctgaagatttctcggattaggaaagaaaatgcaaaaaaccagtttggctcattaataattcaacatctttctgattttaaaaatgccctccagtcaaaatcttaactttctttctttattatttttccccagaaaattcttatcagcgagagctctaaggcattagtaaaatgtttttggacggttttttatttgtgttaaagttgtgcctttccattatgccctcctgacttgtctggaaaatccagattgcctggcacctgcgtatcgtatgtccttctgtttggggtgtttttctcacttgcttccacgttgctgtttttctgatatacattaagcggctctgataaaaaccaatatgcatataacttgtagagaaactgtgtagtttcaaaataaatttgttctatgctaaaactgtcatgtaaaacatttaaaataaaatttatttccttaaattgtaagataattggatggcatcactgactcagtggacaatgagtttcagcaaactctgggagatattgaaggacagggaagcctggtgtgctgcagttcatggcgtcacaaagaatcagacacaacttagcaactgagcaacaacaaatttaagaatagcccctatattaaaaccatctcacaataccacagattttgttatattaaaaatcatgagtatatctctttcatttatactctctctgaacgtgttatccttgttttaatacacatataattattttcatataatataatatattcaaatatttgaatagccaggtgtttgtgtagattgccacactcccttacaaacaatagggggaaagttcttttattcagcaattattttttgagcacttactatgtgcttgtaatggtgctatgcattaaatattttttaatgactagaaaacagtctgcctatccagtggtatttcatggacaaataagcaacaatgatacgagtaagtgttattaaatagacaaatatagggtgctatgtgaccacagatggaaatttaactcagtcttgaggagtagtacagacttcccagaaga

SEQ ID NO: 26302 - DNA, 1572 bp, Bovine  19866881531687
ttagaatggctccattacctcctagaatacaaggaaatattctagaaagccagtgaatagggcaaaactggatggcaagcctaaaatactcttatcacatgataatgagtcacaagtacatgaaattcacatttgtcaggaggtaggatatttttgtctcccattgattatctgtgaaacattaataaatatatgtttgggtattattacacccaaaccaggatgtatccttatattataaacctgtcaaacattaacgaatcaaacagggatagatagatgacaaaccatatagatagatagtagatagatatagataatctcacgtgcatgtaactacctttatattaataagcaaaatttatatatgaaatcatttaaccatttaatgtaactagtcaatcaatcaaaagaatccttagtgaagttctataatgagctcaaggaaaactaatgcaaggtaaacatgtattttaaaaacacttttttgcttaaaatatgtatatttcacatagtcaaaaatagaatctcagtgcattgagtgcatgagttgagtagtagtcctctcaaagacatatcaaatatccaaatattctggaatttttgaatattactttatttggaaaaaaggggtcttcgtagatgtaatttagttccagatcttgaaattagatcatcctgaattatccaggtggtctttatatctaatgacaagtgtctttataagaagaagagaagataagaacacagaaaaaaaggccatgtgaagaaggggttggagattgcacacaagccaaaaaatgccgagggccacaggaagatggaagaggacaggacagattctcccacggggcttttggagggagtatgggctggctgacacctcagttttagacttctggccttcagaagtgtaagaaagtcaatttccattgtttaaataaccaagtttgtggtaatttgttacagtagccctaggaaactgattctgtggaaatgagggaaaatgaagaggatcaaagaagagccattctttctcttaaaataatatcaaatggtaattcaaacctttagggaactagacaggaaatcaaaacttctagatctattaattaaatgctgcctaggaatagaccttattccaattacaaggaagtagctgactatgacttcctctgtctctaaaatactccagtccaaaatcacataagctctctgaactctctgcaatcccagtacccataaatgcatctgactttctcttgtaacattatattttaaggattcatcatctctacattacaaactgaaatgtaaccatagatgattaatgttaaatgtattgacaaaatgctaataaacaagctataaaaatcaagctaattgttttacctttggaccttgtcttcctggatatcctggtaatcctggaacgccaagtttcccctaaaggtaaaataataataataataatcacttcaaaatagaattcagtctattagagcatttgaaatggaagatttggcaaggttttccattctttactttcactacatttcttaatttgaatag

SEQ ID NO: 26303 - DNA, 1138 bp, Bovine  19866881617707
taataaaattgagtgctttagagaacagtaatattgctatattctcctctctgctgtatagtcaaacatgatttaataattttatgttaatttttattttacttttttaagatataattagcatctattttagttttaaatatttattttgtttcataatcttttattttaagaactatttgttccagtgtagctgaaaaactatttagtatttttacaagtttaccttatcatacattaattctttttcgtgctgataagtaaaatatctgataacgttattttttaagccataattgctgaataaatggtaggattactgaattatattttaaatttttaaatgctacatttaacttatctgtaaacaggtttgagatgtgtagtattccataatgattaagcaggtttaaatcacaaaacatttgcttttcaccaaattaaaggttattttacaatactactttctaaataaagagtaggatctgaattttctctaaattttaatgcactagaattttgagatgcatagtaaagcaaatattgtgtatagcatgatacggcaagggaaaatatttgattgtgtattctagacacctaagaatgtatcatccctgttttccttttcactttatcacttatgaattatgtatttcataaggtttttcaatttacaatattctaaagaggaaatagaaaatatctgtacctgaaataacatttttatatgcagagttgatatttttgatgtgttccaggttcagaggatttttataactgctatcacatcataacttgccaatgtctacttccaactgatgaaaataagaaactgactttgcttggcaaacgcctccttagatatagtttgaaattttatgatattattagcttaaaagaattaacattcatttcctataactctttcatgaaaagtatttatagaaatgatttgaaagcattacaaacacaaataacttctagtatgtttcccattaccctgagcatttagaatctgtagtgtttcttttatttttgccattctagcttttactattagattgtcatgagaaagctgattgataaccgtccagagcatatcaaaaacaaataacaataattcaatttccatatattt

SEQ ID NO: 26304 - DNA, 806 bp, Bovine  19866881730996
tattagatattgtggtaagcatcatggtatcagaagtagataaagtaaggaagggtcttctttaaaggaacttccctttggtgagtgagatagataaatcatttctgatagagaggcagaacttagttctgaatgagtgcccgtagtttatcaaagaaccagtcatatctgcaagaaagttatttaaatccaaacttccacgaaaacagaattaaagtcttaccaaatttgcaatcaagactttttgccaatctatgcaaaggaagtatgattgagcgaatattaaaggaacatcttttccagggactgttgtgctaacctaatgtttgcctgttctgtcttgttaaatgtggctgccctgttctggttacacaggtgaaattcaatgtttgggttattgacatagttttctttctctgtcttagaaaacccactatattcatggggtgccgtttgcattcttgtataaacatcaaataagatactttgagaaaaaataccattgccattttttgtcagttagcccatgcttttcttttctttctgtcttcttttcctttttttccttctcacttgattctatccaccaaaatgcagtttttcaccatgttaatagcaacttcccccatttctgaatcttgctctgttactactgaaaccccctttcaaaaactttaatagaagagttctgttcagaaagtcatttgaaaaatgtcaggaacaaccctttgccctgtctcgctggcattctgagagttgccagtccacttaccctgtggttccttacctagaccacagcttcaaga

SEQ ID NO: 26305 - DNA, 1051 bp, Bovine  19866881933369
atactgttatctatgtgtccatttccaaaacttgcacgtgtctctgaattccatctgactctaattttatgacaattgcagaaatatgatggcaataaatatatgtattatgaaaaaataaacctgtaatttctggtggctctaattcccttcctttgatgaataataaaatgcctttgtatatattgatgttgaagagttcagttatttgatgtcgccaacaaatttctcagagggcaaaacctggaagacttttggaagcacataccgagcaactcttctcttctgaccgtaactttgctgaatttcagccaaaaacatcatgcattttgatgctttattcagtgctatacctcaaccgttttcttttcagaatccaggatctcacaggatacttgtatatatggaaaacaagcaagtttatatttttggacaggaaaacgtgtatgagaagctattttaacagattgatgcctacatcaagcaatcaatcaatcacatgtacaatttctttaactacgttatctcatctcattgttttcagtgtgcttcagctattcaggttaatattaaaagatggaaactaagcagttatttatgaacttgttaaatgttatattttaatcaatcgacttctagaatttgatgctaagttgcatataatcttcaaatattattttacttgcacctgtccaacaaatattatttcttttctttcaagataatatcatacattatttgacctacctaattgctaataacataagggtgaactgttactaatagtgcttgtactaaaagtcatacttattaaaaaaaataaaaatattttttccactaaggcattttctttcaggtagcttgaaatagcagtaaaatctaaaaataacaaattgaactttgtatctattttaagtaatatatgtaagacttgaaaataaatgttttattatttcttatatgaagtgttaagttaattgatacctagatttcactggaacattttcaactgataatttatcacaaaagaacatacttgtaatattgaaat

SEQ ID NO: 26306 - DNA, 836 bp, Bovine  19866882259847
cccttggagaagggaatagcttctcactcccagtcttctggcctggagaattccagggacagaggagcagggagggttacagtccatggggttgcaaagagttggatacaactgagcgacctccttcagtttcactttttactttcactttcaaaatctattagaccaataaagtctgtagtataaatgtagcacaaaacgaaaacatcatataattttgtcatttgatttgtgctagagctacggagataaaatcaaattttaatgttttaaatgttgtaaataccataaatattggatcatcattcattccaagtaccatccaatagttcaatagttagtatagcgtttctcttaaaatgaataaaggctgtgtataaactaagttgactcatataatacaatgtcttcttttacccaatgaaaatattactttaaacaaaaagatgaaactgtaccatataactaaactctctatgctgagatttattacatattttaaatcaaaccaaaaagtttaacaatttgcaccagtgtttggtccagagttcacgtatttttaataaaaccctctattgtgtgtttgcagttgtttatgtatcttcttcatatggtcagcagctgggagttatgcaacatcaagaccatgaaatgttgttctacataattcccaatgccctccgtatgcaaatcatagcagtaacagagttattaatttgagccttagataaacagtgtattttaatgcattctaagagaaaagactttagtgttctataatatcaaaacacctgaggttttcacaacagctataatactaaggacgaaagtccaaa

SEQ ID NO: 26307 - DNA, 1674 bp, Bovine  19866880351257
actagttatgtgtttgggatttttttttttttcctttcccctttctgtgtcattactgagaaataccactaatagtgcagtacatttatccaaacattttcataataattgctatttgtttggagatttgtgataggtttttaggaaaaaaagtcctttacttattagatattacaacaatctttccaagtaatttctctgggcagcgaaaacttcagctagcagagaaagcattgttttcaagcttcgaatttgctggttaacttcttttgaaacaaacatttttgtgggaaaaaaaaatcttaacaaaatgtcacacaggatttctagggctagtagaagaccccgagaaactaaaatattttatatccgtgttcaaatggtaaagaatgtgtgggagacctgagtttgatccctaggttgggaagatcccctggagaaggaaatggcaacccactccagtattcttgcctggagaatcccatggacggaggagcctggcgggctacagtctatggggttgcaaatagctggacatggctaagtgactaacactttcacttcaattttcatactccagtaagttttttttttttctttaatcaaatttagaggaaaaaaaataaaggaagagactttgcaatatcttctttgttccccagttatatgatttctgttaaaatatcggcaatagatgaaatgcctgtgtcccccaaatccctatgttgaagccctaatgaccaaggtgatgacttttagaagtggggcctctgagaggtaactaggtcctggggcagcgtccccttgaatggaattatcgaacttataggaaaagagaaagagcatgtctctcctgcaggtgagactacagcagcaaagcagccaacttgcaagctagggggagagctctcaccacacattcaatctgttagagtcttcctcttagactttccagcctccagcattgagagaaataaatgtgtgttgcctcagtcaccgaacctgtggcattctgctatagtgacccaaattaagacaatttccctttgaattttatatactctcactgcctaaactaaggagtacagtcaccactaaatgataatctatgcaaacagaatacataggtcaacaaagggaatggtgggagatcattgattgaccatcttcctcaagattgatcatttcagcttcattatgctcaatattttgatcagcctaagtaggcactatgtgaaaaatgcatttcaccaaaggcatggtcagaaaagccaacatggtattctcagaactgtaaaatcttcatgcacatttttgttattctaatgttttctaatgttttgttctctaatgttcttaccaagacttttttccccaactttattcattttcaaaattcctgctttagttgtttatacctattgtgaaacatgctgattgcagtcaaggatccttcttttgttctgactcttcttcctattctatagttcctgatctgacagagtgcatgcttaaacttggatcttgtagtaaatttgacacttcaaatttacaagaacacaagcgaaatcttgaaaagcagagcattctatagcatgaatgactagttcgtattctgtgctccagtcctttaaacattctttgaatacccacaatcttattgggcctttatca

SEQ ID NO: 26308 - DNA, 1320 bp, Bovine  19866880479539
cctgacctttctttctctctatcatctctgttttcatgtctctctctcactctcctcttattctttcctgttcatagttcctttagctaaacaagggaagcccaacaattctaaagtgggtagtctatcccttctccagcagatctccccaacacaagtattgaaccaaccaatcctgcactgcaggcaatttctttaccaactgagctatgagggcagccccttttgctaaaaaaaagagacaaatttcagaaagcaagaatacaatttttctctgagatgccattgtgtgcttttggaaaagctttcttctctgctattcatggagtggtttactgccctatatgccattctctgcaatttggcaaagttctccattaagagtttctaccccactactgtgaactcttaatattttgtctgaaagttctcctgacttttgttcttcttgtgtgtagcagagaaatttctcttaattaaagattctcaagtcaaggatggtagtaacatccttttctgtagcagagacaatactacgtgctcatgatatcctctttacaaacaccgccagcacacgacagagcaggcctcagctgccttcgtgtgaaatggttacgcacttagcaggccactggcggttggcccagtcttcgacacaatatggtgttacctgttcagacattaaggatgagtacagaaacttcgggtatctgatcaataagtgcacagagagggtcaaggagaactgaattgatgataaatccctgaattctgtcatcagtccctacagcaagttacatagtgtgctgtttgtctacaaaccaatgtgattatacataaaacgaggctgaactagatgttaccaaaggtcccttgcttgagtttctatgagtttatctttggttgtgtttactgggtttagattatcttttcctgatactacttactttcctgatatgatactactactctttctctccagtcccagtggtaccctataaatggctgcagcctatctactggcacacagtattgtaactgtttatttgtgaaatgccactactaacctctgagttcaccaagaccaagaactctggagcctcacccagagaagactattattattgagtaaataataaatcttttagtgatcatatgtgccaaagggttgggcttctaaacatagttgacaacaaaatgacagataattctgttttgaccagaattctctcttgtctctgaaatggctgcaatgtgctgcaagcaacaagacctttaccaaaagcagatgttggaagtggaggagccgtcattcagaca

SEQ ID NO: 26309 - DNA, 2083 bp, Bovine  19866880486999
tatggatgtgagagttggactgtgaagaaggctgagtgccgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagagttggctcattggaaaagactctgatgctgggagggattgggggcaggaggagaagggggcgacagaggatgagatggttggatggcatcactgactctatggacatgatgagtttgagtgaactctgggagttggtgatggacagggaggccttagtgtgctgcaattcatggagttgcaaagagtcaaacatgactgagcaactgaactgaactgaatagcttcaaattagtcagatattcagtaaaaatctgacctttgttcaaagattgaaggttggccttcacaattgttgccccaggttagctaactaaaacttggaaaatttgatgtgctcgagatatggcccctttaagagttttatgcaaatgatttttctcaatggatctgcttcaaattatttccttcttaattctttccatacttaaattgacaaccaatcctcatttagtaaaatatttcagagtactgaatatgaattcagaatgagaaacaaaaatcttgaagttgaaataagtctttcagtgtcattaactatcttcaacaacatgaaatgaatcaagtttgctgccaaacactaactggtgtctgtacttttctttgtctcttaaatataattcatctggctattatttgtagaagtgcattttgaaataaggcatagaaaattgaagtcttttaaattttctgcatttgctacatgatatcagaactaatctaactttattcatcctactgaaattgaactgggttttatgttagtgcttaaaatgaattccaacttgaaaaatcaataggaaacttgtaaatactttttcttaccccaagttctagatagctttggaattcacaatgcatgcacaggttgtttaataccattcaaattttctaaaggataatttaatttcatctgaactaagggcaaactgtgtacaaaagaattctgagataatccatgttcctcaaaagagaaatatgtgaccaagaagtctgtgttaaaagagaaaagaaagcagacgttaaaaatagataaaaatagagatttgagttgtttagtgatattatcactcactccttcacctgtgcaaacttgtgctaaaatccttcctggtatttctcaacccttggagcattcttcatcaaaatctagattatttacccaaatcatggaaaatactagttaatgcataactaggtacatttcctgcccagaaatcttcaagcagcaatggtctctatgattccaaaggctgaaaaaaacatgtaggggtgtaatggaaataaatataaaacacctaagtatatatacatgtgcatatagatatataaagctagatatacattttatattatgtatgtatatacatacaatgagagagagagtgctatagcagtacttgtttcagagtccaaatttatatgtgtctattttcatctcatatttcctgatgttttccaagtaaatcactaatttgagcataaatctgaccatttacaaatccaaatacataatgatcatctaaatatgtccaagacatttaaaaaattacctatgtttttcacatgcataattataaccaattgaaaatattttaaataagctttaaagatacaccacaaataaaacacaagagatttagagaactggaaagtttcaattacagtgatttgaaggatcaggaatatatcccattacttttgaataatgagatccaaccagtccattctgaaggatatcagccctgggatttctttggaaggaatgatgctaaagctgaaactccagtactttggccatctcatgtgaagagttgactcattggaaaagagctctgatgactgggagggattgggggcaggaggagaaggggacga

SEQ ID NO: 26310 - DNA, 1492 bp, Bovine  19866880524464
cttttctgatgtttaacgaggctgctaaataatcactgagaagaacaagttgcactttttcctgaagtggactggtggtccaaaatgcaggtccaagcaaatgtctgcagattacttttgcacagagagctaatgtaatacatgcttgaagacattagtttttagaaatgtcaatccattctctttcacaaaagttataaggcatcttccataatccagacacttcataagtaagcaactgcttttcctaaaggaaatgtactcatttttctgtttttcgcatctggatgcaaccccaggtagcagtgcctaccagcaaggaccttttcgcaccttcatttcccattcttggtgtgaaaggaccaatacttatttccttttaacaagaagtgaccaaagtgaatacagggagctccctaagctccaggggtctttacaggaatgagctgcccacttataactcaggctggcttaggaagctgacctcaccttccatcattacgcacttccagtttcctatgcaatgaagtgtgacaacagttttaagagcatgtgaaaacatattttatgacggggtcattaatttgtcctgctgtctctgatgttctccatatgttacgtgttcttctctgctaagttctttcctgataaggacttctgcttttatagggtggagctctgatgggcatcctttcgcttggcagagactagcatcattccaacattttatttgtgcatgagagtggaatgttatggaattacctgctgcggttgtgcatttgttcttactttccagaggtatctgccaaaccctggattttaagaccctagtcagtgaattttagagaattactatcaaaaattcattctagcatctgaaagtaaaaaggaaaaggctctgttactcttacaaaagggtctaagaaaatattcatggactaaaagtcatgtgactatacagtttgccatttatttcctatgtcagacaaataaaatttgtacactaatgtggtaaactggagcaaaaaataagtacatgagcctcaaatatgtttttaaatatatatgccatatgttaatatataatgatatctttttaaaggacttttaatcatagtatttgtgatactctcaatttataccttatttattctattgaatagtaacaagtagcacattatagtctaggatttactcagagagtggggtgggtgggaagaaggtgaataactctttctacttacagtagttccatgtctggcatattgaaccttaataaatatatgatgagtaaacatacattgtagatcaataaaatagatacaatgttctctaattatttgtgtaagcgctataatacagataaattttgtattatatacagatattcaaaaagggcatggagtattcagaggatggaaaatgagcccatacaccataccagaaggaaatttggctaatactgaaagaagagtaaggattttgaaggaag

SEQ ID NO: 26311 - DNA, 745 bp, Bovine  19866880555071
ctcttaatctttcttaattcccctttgccccaactgacagtagaaaactattccatatagtatcgtatcccaaatgccgcattttattattcatttttccatcctagatcagttctcacttgggtgcctgttatgctatttctctctcatagttagtttgagaagtaacaaacggtctttgctactcagagtgattcactaatcctgcttaggatgtaaccagagctactacgtaaactccaaagacactaagagaaaggggaacagtggatgctagtttgtctttaagtatagaaattgcctcaatggtcactggatatgagagtagctaatccaattcaaggttactctcaggatatgtgcatggaatgcgacctgggtttacagagataacatgattctttgatcatacaaagaccaactgtttctgtgcagaaatgtttgagttagctgaagctattgagtgaatttgtccacagatagtcactaacaatgatgtcagaacccagaaagatacagtgaaatgactccaaaattttatttgagaatctgtttaaatcccccactgaaatgttgagtatcaccaaaaaattaacaaaaagtacacttttattctaattagagttttattttagattaggagtaaaaaataaaagatgagttttaaaagtttggatacataaaacataagggtttattatcccaaagagagacattctattatgcagacacattaattcagttg

SEQ ID NO: 26312 - DNA, 1182 bp, Bovine  19866880597084
tagatatatttaatgcacacacatatcttgctcgctatatttaaccacaagcacaactgaattggaaaatgaaggtataatggctctatgaagaaaagtattatataaatcagagactaaaaattcactacatataaaaaagtcctggtgcaactttaaatattaataacttttgatgaacctatgacaaaagcaaacgacaagcatcatgtgaaagcatatttcttagacactaatgtgaatatttaatgtccttttattcggcgcttactgggctctcagaaagcaatgcattattgcccattactttttataaaagcaatgatcaatgctaaatttaccttttcatagtttctgagcactgcagttttcttaatctttgttgggccagtttctactagtgctttcttccagcataatgctgcttttgctactctgtttgaaacatttgacaattgttgacaatttcattttcagatcagttttcatgttgactagtttcttgccacctcatacacctatttgtggtaattcaactaggatgttgtttttttgtgtgcattgcagttcatttcacactaatcaatctaattcctgtggccagaataaatgccattatacacttcaagttaaagctatggtttttccaggagttatatacaaatgtgagagttggaccacaaaagaggctgagtgccgaaaaatcgatgcttttgagttgtggtgttgcagaagactcttgagagtcccttcctctcaagaggaaatcaaaccagtcaatcccaagggaaatcaaccctgaatattcactgaaaggactgatgctgaagcgtcaatactttggccacctgatgcaaagagccaactcattggaaaagaccctgatgctgggaaagattgagggtaagaagagaagggggcagcagaggatgagatgacatgagggcatcaccaactcaatggacatgatttgaacaaactctgggagatagtgaaggacagggaagcctggtgtgctgcagtttatggggtcacaaagagtcagacacaactcagagaataaacaacatatgggggtaaagaataaaatatattagtgatagaaagcaaaataaggatttatcatgtgtgtttctatgcaaacaatagaaacattaataaaagcctctttatagagatgca

SEQ ID NO: 26313 - DNA, 1802 bp, Bovine  19866880657549
atcaatttttcagcactcagcctttttcacagtccaactctcacatccatacatgaccactggaaaaaccatagccttgactagatggaccttagttggcaaagtaatgtctctgcttttgaatatgctatctaggttggtcataacttttctcccaaggagtaagtgtcttttaatttcatggctgcattcaccatctgcagtgattttggagcccccccaaaataaagtctgacactgttgaagctattaatgctcagctaagttatattttttcttgaatggtttagaggagggttgaaaattggattactaaccggggaaaatataaatagaaaaatgtggcacaaaatttgtccttcttaatatggatttatgagagttaccacattattacatgtgacttgcaaatatttcttgaagactggtgcatccaagctgtatagtcacaaaagaaatccatgacaggaagtacagcattcagtgaatgatacactctataatgataaagtcttgtagatcacagaaaagcatgcttagaggagaaagcaaagatgcacaatcatgaacctttgctgtaattaaatccctgatggcacattttagctgcatttatcatgtaaaatatttctatgattcattgcaaattgtctgtgatttatagataggttctttcttctggtactgttcattgactttgcacttaacagaatcataaaatcttcaccaagagacgctaatctcccatctacaatgccctagttgatttcacaagcctttataagacctgtataaaattcatctcagtgagtcaattcccagggaatacgcaccgggttagatcctcggataaatgcatcaatagtcattattcagttctattattttcttaacttccagaataaaataacagtgcgtttgacaatcaaattcctgacttctatttatgcaaatattttcatttcaagtcatgagatgccattttacactctacacagagtagtagtcagttgactgtattctgtgaggtgaaaaataaataccaccttttcagaatacgagatcatgatcatggagggtaaatatagtgtattgttctctgctataataaaccctgaaatatttccttgaccctttacatttctgcttggatatttatatacacttcgtgtaaatgtatgaaaatttattaagtaggaaataaaatatttgccacaggttgtgaacaagtatacttcaagtgacatataacgttaagaatcacaagtcagatgaaaaaggcttaggatcacaacattcacacttttaataaaatggcaatacaattgcgattttaaactatagacaggttggggaaatgatcctggaaattgttattactttgcttatgtaaaataaaatctaaacctgtatggtgaaacgttttcacagcatacttttacaggaataaatttaacactcatttttggtatttgcttaatataattgtgtttcaatgggccttttatttgcactgttatgtcctaaatccatgcagtcactaaacatgttatcaagcaattctagcatacagaagaactatttaggaaagttatgtgtgtgtgtgtgtgtttggtcatgtagagaaaaaaggaagagtatattcaataacataatcaatattcagtttattgatgtccaattttaatagacattgtcattatcagcaagagaacatcatttattctccccacgggcttggaatcttttacctcaatatctaaagctgtctgtcagtgaaatagctgcactgcttttattaa

SEQ ID NO: 26314 - DNA, 817 bp, Bovine  19866880658244
ggaaaaaatacaatactctgtctgcaaatcctttctcatttcatgtcaatatccacccctcccatcatcctgtgttgacaggactgatttgctaaaggagagtttaacattacaaacaccctttcatcagcttaaaaattgaggcgagtcaatatttacatcatgttgctgatcttgaaagtacataccctgttttctgacctaataaatagctgtcactcttgcctccatcagagcttagcggagagtgggtttgcctgctcaatggtctctgcattccgggaatgatctaatatttcaagtctctcctgtggcagcaggtcgatttctttctctcgctctttcttattggtttccaatgacagacctcataaaaccatttaggtctgcttagagaaaataaaatccataagcatgctgggtttatctttcaccagaaatgcatgaaatctaatgctccatgagtgaagataagcaggatatgtgttatctattttgcaatgcaatgttcaggacatatttttagcccaaaacactggatgaacttgtatttctagtgcttaccagtgaaaaggaatcacgtcaaactgggacaatgaaaaatgttcatcctttcccagagagttcatgacacttgtacacttgtccacaactcttctttcatccgtaagtgctatcactgcttcctgggtaagtttcagtatggtttactcgggccacagttattccaatggacatacattgattgtaaaggaatctcaagatttttttttaacttgttttatttttctttgattgttattgctgttggttcagg

SEQ ID NO: 26315 - DNA, 5130 bp, Bovine  19866880661405
ttttctggatagtgatcctatcaattaaaatttttcacatatttgtgtatttgtgagtatatgtgtattatagtgtgttagttgcaaggtcgtatctgaccctttgcgaccccagggactgtagcccaccaggctcctccgtccatggaattcctcaggcaacaatactgaagtgggtagccattctcttcggcagggaaccatccctacccagatattgaacctgggtctcctggatggcaggtggattctttacaatctgagccaccggggaagcccatgtgtattatatcctctgccaaatttattgcataacaccgaaatgcatttatcaatggaacaaaatgaaaaccagtcataatattgaactgtattttatcctgctatgttcatgatttttatcctgagcttgattctcgactctgcttcactctgcccatatgtaggccttccttgcaaattcatatgaaggaagattttaaatgagaccagatgctagtttcctgagcatcttctcttagataaatagccagatgctccctcagtgggggaaaatgagctgtagtggttgtcacagagattagaaggaacgcctaacgcaacacctgcaggagcacgtgaggatggaagagtctctggcggaagcccccagggcaggctcaggcccttgcttgggctatctgaggtcagcacaagtggcgagcgtgcacttgacaccctgagaaaacagaggcttcgaaagaaatgtcaggatcggtccaggggattcatttgttgacacagcttttttgcagtattctggggagaacaagataaaactatgttgctcagaagtcctatttagagttgaaagcacattaaaaaaaataaaatatcatgtttaatcagtttttatactctcagactcattcagataggaaggaaagggcatgtattcctggaagactctatttttagatcatgagtaaggtagattcagtgatgggggaagaggtagattcataaatgagagagaagctgataaatagaagctgcttaacagcgttcattgctaagcagatgacaaagaatagctgagaccctcatgtcaaaaccagcctctcatgggaagattatttgagagtattccagacagagggaatgaagtccagtatcataaagtaggaatgtgtaggcagctgttaaaaccttatagtctgtgaagatctggtgggtgtagagtgatggttggggcagctggtcctgaagagaagacaggggcaaagtcatgcagggcttttaatctaggttgaaagatactttcttaaacgcctaggaagccactgaaggtgtttacatggggtgactggggtgatctgattgccattttttaaagatcactctggcttatgatgacatgcttttcaatattttgcatttatagtctcgcctttgaatatctaggctctaatccaaatcagcagacacaaaatggtgatgtgattaggaaaaggctgtctttatagtacgcgttctggaccaatctgtagcttttatgtgcacattatcattgcccctgagccattatgggccccagattggaggcagcaatccacctgagtcatcatccaaaccactttatgaagccgtcgtccgtataagcctccagacgctcattcaatcactcataaggcccgacctttctcagcttatgaggaatatcaaaatcaggggtttggatgcgcctattaacaccaatttgagtgattctgttttcacaaagggtctccaagaatccttccacaccttgaatgtaacaaatatgacaatgatacaaaaacaatgatacagatgcaacaatgatataaacagttttgtaagtcagtgaagcttttgttttttctaattttcttttctcacttaattctatcctagcagtgtcttggcaaaaggcaaatctcagtattttgccagactcatgttatttcaagcgagaaagaagggtcataaacacagaaataagtcttgggggaaattatatatatatatatatatatatatatatatatatatatatatatatataactaaaccaccacaaaatcaaccctaatttgggtatacatgttctcagctcacctccttccaaagctcatagctggagaattgtttttctcctcaatttcccagaactttaaggagagtcgcaccctcaccagagaagtttctggacgtttgtggtggagaaagggagaatgggcacatggaagagctgagtgtcatgagacataagtgcttagcaaggtacaggtcaagttggcgtaagtgggagaaaggagaaaacagaagcggtctttcagctgagcttgcagggatcaagacagggggcatattatgaagatgagagggcctgagagatgggggaaaggccttggggggaggaaaggagatttgagagaagtgagctgggaatgatgattctgaccagaattctctctctctttcagtttttcttcagacccacttgaacacaaacacttgactgatgggatcagtaatttcaaagggaacaagtaaaacttttttttttttttttaattcatttggtaagaaagaaggtaaaagaaaatctaaaagaggaaagagggggagatctatgcaggaaagcagattagaatatgggaggaaaagatgcacacatatttaacagttaagggtttcatcacttaccttttccagctcttttcctatacagaggtcttctaagctgtgaaagaagccttctctttcacctggacggctgagccatgtgatggaggaggagccatctcttcttcctcagtgatatcgggtagtttgctgggcatggaaacgacgcgccacctgaccggaaatcaaaagtgctcaagagtctagactaaacctgcctgctcttcctggctcatctcccttcaaagcgtctccagctcttcacatctcagtcagaggcagtggcttactctccccaggcacagcttcctgttttctcaccaggaatgcctttccttccacttcccttaatttattaaacagtaatctattttatgttttctttttgtgagaacaaatattcaatcttccacttcccagcactgcttttgaaattatatgaaaatgttaacattttcactataatacctttgacaagaattcctataaacatgcaaccctagagtaattttccttatcctcttatctttctctgcatcacacacgaaggcacacacatgtacacatctacaaaacatgtacacaattgtacatcctttccccagcctcacacatatattaagggtagcagatcttttagtttaaaataatcatttctagaatcctgttttccatcttgccttggtcagtgacagctgtggccccagaaaattcaaaacattacatgttacctcactggtacaaatgagttagctatcttccagtatcaaaatcttagtaaatatatatatatatatatatatatatatatataatctgcacattatatatatatatatatatatatacacacacacacacatatgcatacacttatatatgaatgcatgcatatgctaagtcccttcagtcatgtctgactctttgtgactctatggactgtaacccaccaggctcctctatccatgagactgtttaggcaagaatgctgaagtgggttgccatgccctccactgtggaatcttcctgacctggggatcgaacccctgtctcttacgtctcctgcgttggcagatacattctttatcattagtgccacctggaaatcccatatgtgtgtgtgtgtgtgtacatatacatatatatatgtatatatatatacatgaggattctcacatacattcttgtttattatatatcttatttagagaatttaaagattgtgatacagcttgttatagttattaataaggaagagataggattttcagttgaataactatgactgcaatcacctaaaactcaataatgaactttgtctaaacatgtaggcaaagcattactatggctaatcaaatactgtaagaaattaatctgactccatggtagcagcttgactaggaatagaaacctagtcagcaggtgggggtaatgatcactaaggagtgattttattttactgttcggagaaaggaaatccatccatgtgccaaatgaaattctaaatcaattcttcagtttactgtttaaatgcagagtactcaaaacattacttgattaagcacttaatgttgtgaagcaggattcttgaaagaaagaagtttgattgtatcagtgctgcaatgattttcatttataatacactaacaaaaaggccaaagctctccaaggagtaaacatgagtacagagtgctttgaattatggaagggtgacataaagtacaggaagattactcgcaattacactcttttatcaaggataacgtttatgattctgactttaataaaatgaagacaaagcagatgaggaacttgaaagatttgaataataaaaataatgatgtatccacttccttagctctatcttccccagaattcatgaataatgctaaaatctgagtaggggtcagtcatctgtggctgactccaaagtaaagcttctacatgcacttataattatttacatcaattgaaatagattaagtactttaaacagcttagcacacagccctagattagattaaccatttgggaattaattactggacgcttacaaatcagttacctatttttttaaaaaaaggaattgtaagagatattaacgcatgctgttttgtttcacagatgtatcgtgtcagaagcaagatttgaaaattttccaaaagttttaaaaaacatgtttcaggacctttattgtagtttttcagtacaattatacttagtaaacaagcttattgttttctttttggcctatttttgagagaacaaatgaagcactttgtatatctatataaaccataagtgattgaaagggagaaaaaatgattttcatgagaagcagtggaaaagtgaaaactctatcaaaaatatctccagtaaaaacaattagttacgtttagaaactcagtagtttttggccactgttatgagctgggaatacaa

SEQ ID NO: 26316 - DNA, 1496 bp, Bovine  19866880672500
ataaagaatgccccatagcacaattagacagcaatatttctatggactaagaataaagaacttttttgagcagaaggaagcctaccaataacttcttgagatataaagagaagcaagttcaaataagctttgtaatctattcaaaggcacatggtatactcagagctggtagtggaagtagttcggtggttaaagacagtggtcttttcaagatgctgtgtattgaattcttcagttgaaaaaagaaaaaacatatagatatatagcatgagaggcctcttagaaaatattactgactccatttgtgttgactctttcctaagattattacaaaaagatttagccacattttagaaaagttttgctatttgctctgtttcaatacatctgaacagcagccttgcaatggtaacatctgtttactctttcaaatagaagctaagaccagtggcaccttatcctagaaatagtgttggttgtaataattaggggataacatttatttacttttctctatgaatcttacctaaatcacttcagtctcaattattcaccatggtgcttagtttataaacttcacaccttttcaatatatatcaatatttttccttaaatgaaatagctccgtgagatgtgaatttgattttagtgcataaataagaaagcatgaagaattatttaagcctcagaggcaagttatgtgaagagcaaaagtataagaaatgaaaaagtgttcctgattgcaaagtaaacctatattttatggtgctttatcaaaattttacttgtaaatcaattcagtattttcagtacatatttatgactccacatttataaatatatatacatacatgtttatactaactccttctctactcagtttaattagttactctgatatttataggtgaacattattaatccaatactagtaattgcataatctataaaatggtatgacatgttcttagggccataacattaatctatgtaaaatgaaaacattttgtggtttagtatgcatttggtaatctaaatgcagccaggagcctcagtttcttctcccctgttttctgaagtgtattgattcctttttctatatgaaaattggtacaggagaagccacaccctgattgttccctcctaggattaaccacaacaaaataagttttactatagcgtattcataagactagtccgaatagaagaaaatcatttgattattataagatgaccttttcacatttccacctgtattcacttaaatacaatcaaacaatatatttttaatttaaatatgagacttcctaggtggtgctagtggtaaggcaccctcctgtcaatacaggagttgtaagaggagctggttggatccctgtgtcaggaagatcctctggataaaatcatggcaacccgctacggtattcttgcctgcagaatcccatggcagaggagcctggcgtgtcacagtccacggggtcgaaagcagtcataca

SEQ ID NO: 26317 - DNA, 1506 bp, Bovine  19866880799143
tctttctgctatatagtgaagataccccaataccccatcttatagatttgtgtgctgattaaatgagatattcttcataaagcatctagaaagtaccactctcatagatgagagccaagaaatcttagctatcaatattaaaagattgaatgttaggagacaggagtttctaggtcctggcttaatatttactaaccagtaaatttcacatacagcagaattgcttggagtttcgaatgtaatctgtaaattgttagatgaattgcaattactttaaaataatttttttctgggtccccagattggaagaaatgaatgtttaaataatgtcatctgagttctgaaattaaagaaataaactactataaaagtatcatatttccctgacatattaaggttggaaaaaatatggttaattgaacacatggataattcaaacatatcatgaatatattttattttacttccattcatagtatggaggaagattttagtctttgtggttatctccataaatacagccaagcaaactttaataaaagtttcttcagtgattctcaatcttattaggcatctattatggcttccctggtggttcagagggtaaagactcttcctgcagtgtgggagacccaggttcaatccttgggttaggaagataccctggagaagagaatggcaacctcctccagtattcttgcgtggataattccaggacagaggagcctggtgggctacagtccatggggtggcaaagagtcagacacaactgaacatgcacacaaacttttaactagagcccttgctctatgtcaagagtttgaaacgatgccgcaatgaagagcccacgtggggcaatgaaaaccctgcacagtcaaaaaccaaataaacaaaaaaaaatttttttaaagcagattccaagttggttttattgctgttgttgaatccttaccatcaatgcatctttttactgcctgtggccaggacagacttggcctcccacttccctcaattacttttgttaccacatagaagggcacaagcccctctgtttgcaaaacctatgaacatatttgatggttcatcactttttagaatgtgtcccagagagcagacactgggccccttccaacaggacttatcgtcaattctgtctcattttttccttgactctcatttcctctcatcctagaaaaatcctttcctaccttgaaggacagacagtaataagtaggtgggagcaagtgaaatttaaacttaacgcactgctttctctccaaggttttcctatatgccaacacttagattcccttaggggcctaggtattctgagccatgcagtcatgaaaagtctctttctctcttgctttctgtttctcatcctttccctaaggcataccgctctttgggagcactgcaatagaaagtgaaaatctttatctccagctctttggggttagttactgggttccccccacttgcagaagcagagacatccccttaagg

SEQ ID NO: 26318 - DNA, 2591 bp, Bovine  19866880881336
catgaggtattagctcatgctggtcagactagccatcattaaaaattctacaaacatttaatgctgaagatgatatggagaaaagggaaccctcctacattgctggtaggaatgtaaattggtacagctactatggagagaagtacagaggttctttagaaaactaaaaatagaactaccctattacccagtaatcctgctactaggaatatacctagagaaaagcataattaaaaaagacacatgcaccccaatgttcattgcagcttttgtttgtagaaagatgctgaatttcagatgttaaaggaaggaaaatttgatgtatatcttatgacaacatcatgtggatatcactctataatatatccttattaaacatttttatattttgtttattgtagatattatattaatttttagttttataaaatattgcattgaaatattatcttggttgctgagttttctaatattcttttaagtggtatgctttagaaaagtgccttatcctcctcaccccagtcatgcaagttaaaaagtagtcaccctctcccttttcttttgtacaaaattataacattacacatagtgcacgatgatgtttacatatcattaagcattgtttctactaatttaatctccagaaaatgaaaacgacatcatatacgcaagcctaagacagagaatattgttttccccattgcacagatgtgaacactgatgtttgagggtgatacgtaattatccaacactgtgcactcgtgagtcttggaccagggatgtgaaacctaatctctctaaccacaaatcctccactttaaacagaatgggcttcccaggtggcgttggtaatgaagaatcgcctgccaacacaagagacccaaaagacgagggttcaatcccggtgtcaggagatcccctggagaaggaaatggcaacctgctccacagactactacagtgaacatatttttagcctctggaaatccctgaagaaaggacatgatcatggttgactgtttctgcagttgaaaaaggttgtggactcttttcccaaataagaaagttgaactgatttgctgctggtggtgctgctgctgctaagtctcttcagtcgtgtccgactctgtgcgaccccatagacggcagcccaccaggctcccccgtccctgggattctccaggcaagaacactggagtgggttgccatttccttctccaatgcatgaaaatgaaaagtgaaagtgaagtcgctcagtcgtgtccgactcctagcgaccccatggactgtagcccaccagtcccctccatccatgggattttccaggcaagagtactggagtggggtgccattgccttctctgaactgatttgaagaactgtgaaattagttcttacagagaaacttaaaggtcagcttcccaaaaagattttccttcttcaaagttatgaccatagttttgagctcttacattccatgttccctagaatggctgctgcctcttaggtactgaagagacatttaacagaaatcaatatgcacttgtaactgtcactgaaaagggaaggcagattctagtttcccaatatttcagagtaactttctcctgcaaaatgattaggtctgtgtgactttctggtcaacctgacttcaaataaagttatttcaatagacagtgaaagtcctcctagctcacagacaagaaagaccttaattaaaatcaataaagaaaaaaaaatctgtaaaaacaattaagcgctgaggttgactccttttaatttggggtctgaaggtcttcttgggaaattactgaatcattgggatgatttaatttggctgccttgaattaacttgtggtgtactagatagaaagggtctttcagatatcatgtagacacattgcaggaatggtataaaccctaaaagaaaacaaaacatttaaaaagtcagctgagcagaggaatagattctggaatagattctttcagttggcatattttatgagctgtttgttccacaaaatgtttagaaattcaagtgttaatagaaattttattataagaagggtctatgaagtgagtgaagtcactcagtcgtgtttgattcttttagaccccatggactgtagtccaccaggctcctctgtccatgggattttccaggtgagactactgtagtgggttgccatttccttctctaggggatcttctcaatccaggggtcgaacccaggtctcctacattgcaagcagacgctttatcatctgagccaccagggaagtctaaggtctatgcttcacactttttctagaattcagaaatcttatttttttttttttatagatagaaaaaaaaagggtctatacttcacactttttctagaattcggaaaaagtttatttctgaaaaaaaaggtcttatttctttatttaatgaaataagtcagtgagcaaaatagattaggggtggctatgtgactcaactcagtccaaaacttaacgataaacaaaaatcagacctaaagctttatgtttaaatgattagagaaatataagttctctctctctctcttttaatgaactggaaccaaaag

SEQ ID NO: 26319 - DNA, 1879 bp, Bovine  19866880905082
gtgagcatagcaaaaatcctggatttctgtatgaaggtataatcagagctcaggtacagactgagggcaccacctgccccgctagagatcccccgaaggaagattgagatttagtgatgtcttctaaccctcagagcagaagtccccaaactttttggcaccagtgaccagtttcacgcaagactatttttccacgaatcagggtgagggaatagtttgtggatgattcaaggacattgcatttatcgtggactttattcctatcattattgcatcagctcctcctcagatcatcgggcattagatcctggatgttagggacccctgctctagagggcatcttcagactagttgttataagaagtaagtctgcttctctcttccatgggtgctaattgctaagattaccaaggaaaatctaaaagcataaaagtctcctgaattgttcatcacaacttgactctcaaaccccagataaaagtcagttactcaaattcatatttcatccacaagaaccttttaccactcaccttcaagtgatcttagagctcagagaaattacaagcaaatattccttatgctttccggcctgccacaagctctccagttactctagacagttatatatatataaagaaacccattcagttttctttttcatattaaacatttcatttatttttattattttaatgaaagtcatatactcacataccttgcaggatgaatgaagatgaagtaagtagcatatggtgatgagcagaaattaaacagcacattgtgaagtgctctgagctattagttttgagctataagtgcaaattattattattgctggaccatattctgccaaatgtttttgctgtaatgtgcgtattaatggaaggatacaatgcatttccactaagggcaaagcagctaactatatgctttgggatattcattataaaaaccaaagctgttataactctgtcactgaacttggttttgaaaatgcatattctggggcttctctggaggctcagtggtaaagaatcagcctgccaaagaaggagacaccagtttgaccacgatccaggaacatcccacatgccacggagtaactaagcccatggaccacacgctgttgtgcctgcactgtagaatctgggaactttaactattgaagcccacactccctagagccagcactctgcaacaagagttgctgctgcagtgagatacccgagcaccgcaaggaagagtagccctgctcgctgcaactggagaactcaagcagcagcgaagacccagcacaggcctaactaaataaacagataaaactgttaaacacacacacacacgtgcacacacacacacatgcacactgagtttaaaaaaaaaaaaaaacacattctaaaaatgtttctcctgatttacaacctcctgatttaaaaacccatgattgtttttttttttaatttaaatttatttattttattggaagctaattactttacaatattgtatcggttttgccacacatcaacatgaatctgccaagggcgtacatgtgttccccatcctgaacccccctcccatctccctccccgtaccatccctctgggtcatcccagtgcaccagccccaagcatcctgtatcgaacctgcacttggcggttcgtttcttatatgatattatacatgtttccatgacatacccccaaatcatcccaccctctccctctcccacagagtccaaaagactgttctatacatctgtgtctcttttgctgtcttgtatacagggttatcattatcatctttctaaattccatatatatgtgttagtatactggattgggggtttttctttctggcttacttcactctgtataat

SEQ ID NO: 26320 - DNA, 725 bp, Bovine  19866880964885
accaacagtaattctcttctttgtctctttggacaagtaattgtattagtgttataaaaaacaactgttgctaatccacattgttcttttcaaaaccagaggtttaagattttatgttaaatgttgactgaccatgcatctcaaatacccttttattacagtaaaaaagttcatagggtggactcataaatgcactccacaccttggaaaacaatgtagctgaaaagataatatagaggcctgggtgagacctgaattaactaggcattctgaggctgccgaacgtttacattttcagcacatctaattaaccttgtaggtattgcattccagtcaattcagggaaactcatacacatgcacgaaaaaatcatcgccactgtggaatggtgagtgtttcacacttacaccctgagaggctgttttcttttttcagaattaaatatgcatcaagcttcatttgagaatccacctgaaacttttccaatacttccttttccttcatgcttgttcacttttaattcctagtgagaatagggaatggagaatgtgaagaataacggaagaaaaattctgaccatattttcaaccacaaacataaaaaaaatcatagtttttacacttcatgggacttgattttaatcaaattcagtaccttgtaaactcattcctccacttctagtccaggaagcaatatccagtgttcactttaatgagtaaaatttt

SEQ ID NO: 26321 - DNA, 746 bp, Bovine  19866881055626
cactctttctcatgagagaacttaatagcaaatgactgagtcacctgaattgttgacccaagctgtacatccaagcctgataatgacgaggaattgctgattctcttaacccagccgtttggtattatggatgcactttgtcattactgtcagcagatataaattttaaataacgtaccgtagtaaagggagcagaagcatgggaagtagtccatgtggtataagcaagggacagtcttcttgttaccactccattccccaagagactccagcagaggcgtgagtacagcatgactgtacctgaggccagcctgcttcatcagtgatgctcatggcaaagacagagcaccttccaattctacacctggttggtccagttgattctctctaggtatctccacagcgaagtccttgtcattggccaaagttataacacgttataacacgtaggttcttccacagtggtgacagggaaatctaggagtcttggtctgaagaaatctgcttctgatgggcattttgctggtgttgaggctccaggtagataccctgatttctactcaaaggcgaatccaaatcatgactgaattgtataatcatgcaccttaaagaatgcaaccgacctagagaaaaataaattgtgtcctagtaggaacattaattatatataatatataaatatattatataatgtatatataattacaattttatatatattaaaagacttgtgatttaattcacac

SEQ ID NO: 26322 - DNA, 1538 bp, Bovine  19866881082470
tttccccttcttttattaatccatagacctccactgggctgactattcttaatgtgctcattttacaggtgagaaaattgaagctggcaagtctcaaggtcacgcactcactatgtaaagcagctgggcctggaccccgggaatttgaagccagaaccctggctctgatcccacttctctattacctcaagggacacttaatgaaatacaaatgaaagatgaaagccatcctctttggaagtattaaaaataatttattgaggacaactatcaaagcagagttctagagcaggaaaagtctcattggaataaatgcctggttgcaaccagtgggggaaattatgaaatgaaattcttattaggagatgtaaactttgtattttttcaagggcaagaagtacatgattttacatgtatattttttacagtttcgaggttgatctcccacacaattcagttctaggaattttatttatttattatttatttttaatgatgatgatataatgataatacaactaaaaatcacgaagaaaaatagcttctctttgtaagttatgagctaaacataaatgtagctggatagaagacacgaaacaaaaacattggtagagaattaatctttgcattcatgtttgtggatgaggaagtatgtaaatgtaaagagcaaagctgaattaaaggtggtccaaaatacacaatattttaataacttgggtgaactgccttacaaaaacttatcagtgccagtaatttaacttaacgtaaataagatagagtcaattttgtcactataccgttaagaacaggctgcttcccaactagaggaactatgagattttaagcatgtctacatgacctggaaagtgtttatagtaactccaagccactgttgaattcaattaagaggttggtcttcttagaactctatatggtttcagtttcaagtgtgtataatttgaaaattctctaaaaactttctgcagcaattcctctttaaataacctgaagtatggaccaatgacttctcaaaattgcttgacatggtagagcgtcatggacctttcaacacggtgtgtcaatcctatgtgaaaacaggcagcctcaaagggcccccagttttggtctccgacaaagatctacagagaggacacaactgaaggatgtgatctggaagtctcaggaggtggtggcaggtggagccctgctgggcctccgctctgacagctgatccttgttgaacaaaggggaccaaggagcactgccagtatttatcatccacaggaaacgactcccacccgaatctatatcaagacgctctgtctacagacttaaaggcaatccccaccttggttgtatgattcagcatctgtttggacttagttaaaggtaaagttaaaaggcttttgataggcatctctcatatataaaaaagagacaaatatgtaaagctttaatattagtaaaattcttagtctaaatgtaatatgtgtgtgtgcatatattacatataagggctttatattaaatgcaattta

SEQ ID NO: 26323 - DNA, 1229 bp, Bovine  19866881123944
aaaaatggcattagttgttctacagatgcttttcagcaatttttaaaataatgctttatttgtgaagaaactcagttcagcatatgaacattaaacagcatatttccaagagttgctgtacactgtatcttgctgattctttcacctttcccactgagactctagtgatgcctggtatagcaattactttctgatttcagcacggatggtctcatctaaccctcacagcaaccctgtgggggtacttcagccagagagagagttgacctgccgcatgtcacccagctggagtgtgttagaacctgaatctggactcaggcagtctctcctctgctcctgcacttaatcactgagcagtatcagcttagatggagggagaagagaactcatgaaaccaggatccctggatttatccacagccttgcctgtctctccttgggatgtcactccacctatcacatgtttttcagtccctgaagaacgaatggccaatgcaactattttatattcttgctggacaggagaccacatctgctaggaaagggctctgagaacagtggccatcagttaggtttctgctccatggattaaatctgaccaaaagaaggagataatggaatcctctccccaaatcctgccctgtcgtgttatttaagatacaacttgttttgaggtataaagtcctaaaaaagatgcctggaggccgaaaatattcagaaaagagcttacgtctgcacggcgactttaaacgtatgtgatataaacaaaatgcaaaattagcctattctatttgcattctggcttaatgtacatgagtttgagcaaactccaggagatagtggaagacagaggagcctggcatgctgcagtccattgggtcacaaagagatggacatgacttagtgactgaacaaaacaacacattttcattcacacaggaaaagaagaaactttctcagatcttggacagattggccgctcaaaaggtcttagacccaccagtgatttggctaatcaggttgggaatgaaaccgtagcatgctcagtacaagagaaatgctgcattttagaaacacaggaaaatctggaaaagggacatgaggcacaaatggtgtcttgattcagctttaacagtctatctttttcacacagtcttcctcagagatttgatatttgccttcttattgaaagaaatgcatgcagtagtattaataaaaggaaaagacagc

SEQ ID NO: 26324 - DNA, 1265 bp, Bovine  19866881149114
tcccgtgtttccttgtgtgtgctcagttgtgtccaaccccgtggactgtggtcctgcaggctcctccgtccatgggtcttcccagggaagaatgctggagtggattgccattttcctctccaggggatcttccagacccagggactgaaccctcgtccctgtgtctcctgtatcggcaggcaggttccatgtcaactgcaccaccggggaagcccatgacttgagccccgtctgcagtgcccacctaactcattttcccttttggacacgttttccgttattcaggtcttctgcataacacctgccccaaagtactctgaccagtgctcctcctgcagtgtttcaattccaacagctcttgtattttactgaactccataattttggtgttttgtaccctgtatgtatataactttttatcatttaaatcattttcttacataaatttgtgtggcaggtactatcttccccaattatcagacagaaaaactgaggctagatgagctgatcccaatttttaggctaaagatggaataggcaacgtttggatccaggtgttctaacttcaagccctaaacatttagtttgatgccaaaatattgtataaatatcacccattcagggtcttattttcatttttattaatttcaaattagaataaaatttatctagcagaagttatcatgtcttacacgtattctagacaaaaaatactaaatatacagcacatctcccactactttcttatgaactgtctcattgaatggaatggcagcccgctccattattcttgcctggagagttctatggacagaggagcctggtgcattacagtgcatggagtcgcaaagagtcagacatgactgaaagactatcatttactataaattatcatttcatcttacttatatgatgcagagtctatttcatctcatttccccaatgtaagttttgtttctattcttcagtctcagaagaggaaagcatacaaatatttccccagatataatgagaaagatgaatactttctgcttggcttaaaaggatggcctctgagccaatccttcatgataatctcatctggaaaatcactgggaagatgagaccagtagatggctctctaattcctgagttacaaaggagaatgaagctgacacatttcgctactggggaacagatttgattcgattgcaccaatgacaggaataaactccatgcacacttgctgaaatgggacactctctgctgtttgtcacgtcccttaa

SEQ ID NO: 26325 - DNA, 836 bp, Bovine  19866881210350
gttagtcttaaattctttactacctcatcaagccccaaaattcagtcccgatgcttttaagattctacatctgaagtaataatatattttcttccatttttaggaaattattctgaaaatgctttgcaaagagggatttccaaaatagtctgagaattggggagccttgcagaaaacgtctaataaagatacaggtgaaaatgtcactcatttgacagttttcaaaatcaatcacttgagtttgtatccaaattttgaataacaaatgaggtatttgataaatgtccctttcactgggtaaatgaatattacatgagaaaccataatcccaacttaatggctcgcacaacccagagatgacaatgtccatcaccttgtcttctaaagagacttccactccctgtttcttcaagaacctacccagaaatgttccacaaggcttgctgttgataaacctctcatgccatgacgagatgacgagaattaacttcttgtagactgattgccgatcatgtggtcttagttcattataattatccttatagccctggctacagcgttccacttagttttccagagttacaattccctctcgactatgattagactgtctttgggttcatgggcctggaaaatttgaacagtccaatttaatgaaaaacaattttcatagccatctggaaagggtctgactatttctagaagttaacttttcatgtattaaacttctgaaagaaataattaaatcagctttcataatagcccatgtggagagtctgctctgtctgttccctccagcctgctgacttgtgtatctgttatacttcctcagtagt

SEQ ID NO: 26326 - DNA, 1752 bp, Bovine  19866881245495
aatagtttagcctagggagagtgagagagaaatgagactctaaacttaggtgtgagcaccagacacagcaaactgaggtaaaatccttggggaaaacaatatctaaggaactataggaacttggagtgatgcctggcttgacaaagtggttaaatgtagccaaaagcagctgaaagtctgagagccctgggaggaagcaagtcacagagaccacaggcatgggcagatttgttttagattagagaccagatgtttaattacctgacatttctagtcatttgcttaacttgagcctctcataagtctcttaaggtgaatgatggaggctaaacacccatcctattaaagtgaatgagtacaatcctcatagagagctagaattaagattagagctttccatgaggttgattctctgctttacaaaatagagtgatttttgcaggtaccattactttagcacaaattctaagcattaatcatttaaaccattcaaagcacatattggatagtttttccatttcctccaaaacaaggcatcatcttttgaaatctggaagtttaattgactaataatattggtgaaattttcattttttttaaacataaatcatcatttattattgtacttaagatttttatcccatcttctttcaaaatcatgagcaagtgttgccataaaaacataaacaaaaaaaaaaaaaagaaaatctgtactaaaactggtaatacaaaatgatttgattgaaggatcatcaacagaaggcttctgcatggtttagaaacgtgatagaaaggaaagagactgtgatatctagcttttaagtctctgtcctgctctcccagacaagttacctgagcatctaagtcttcatcagtgtattaaggataatagtaattaattatgtttctaatgaagatgaagagaaattgtacaaaatcttcctgtgaatcgtaatgcactaatgactaatgaagatcagcagaatttcaatcttcaaactatttggatatgaaaatataccttattttttttactatatgaattgatttatgtattctctggtggcttggacagtagagaacatacctgcaatacaggagacctgggttctatccttgggttggaaagctctcctgaaggagggcatggcagcccactccagtattcttgcctggagaatcttcatggacagtggagcctggtgggctatagtccatggggtcacaaagagatggacatgagtgaagggacttagcatgcacccatgtatagcagagagatgattctgtcatgttgaatagaaaattcattcttttcctcagggaagatgacacttggtcttgttgctgaagaccaagtcttctctgcattcagcaacaggagaggcaaatgttgtctgttgctaataatctgtggtctagttttcacaagaaacaaagtttcatgttgatcgaccatggggattttccaattgagaaaagatgggcagaatgtttgtggtctacagggatagacagttgagtacatgaaaccagggaagcttgggaagaattggggaaacttggtgatgggaagcctcaagtgggacattgttttgagatgaaaacatctgtccagaagatgccagaagaagtctgcctaagagaacgcctactgggagggtaactgctcgcattcccagaaggtctattgcattggaaccttcaccaactagctgggcttgtttgtgcatacgtggaaaattaatatca

SEQ ID NO: 26327 - DNA, 1728 bp, Bovine  19866881246381
taagtcctcctataaagttataaacagtcctctgaatctgaggtttctcatcttctgggtcaaccaaacctgggtcatgtagttttctagtaattatttatgttaaaaaaatccttatataagtggacctgcacaatttagaaccacattatttaagggtcacctatgctttttgccttaatctaatctgtaatttggtttcccaggtgactcactggtaaagaatctgcctgtgaatgcaggaagccccggagatacaggttcgattcctagatcagggagtttcctctggaggaggaaatgacaaccactccagttttcttgctcgggaaatttcatagaggaggctggcaggctccagttcatgggctcacaaagagtcagacacgactgagcattcatgcacatgtacacacaagcacacagtctgtaagattacagtgaagttcaaacttgttgtcacaggactgcagcactcagtacaagcggctgcaaatttctgtttatctgtctctaggctgcaaactttgtatgcataaggatttacctgctttatttttgagctccaatgcacagtagtctctcaatattgcttattgaataaatgaaagtgccttctcaggagcaaagagcaccactcattcttaatacacaaatttaattaagtcatggtcggtttattcattggtggttaggaatgtgcttgtcaacattgctgagccttcaggcattgttactaacattcaatatttctgtactattgattcctggctgcattagattaaaaaaacattacagggaaaaatgataaataaggtaaatgtcatacttttattctacaaaggaagtggaccttgaatttttttttctgttttaaggaaaacataaatattttatatcataaaaaatattttaaaacagagttcaaatatatattgttcttgtgaaaaaatagtatctagccttgcttttaaaacttaagtttgcttcaaagtattgatttagcatagaatgaacatagaaaatgtccacgataatacatttatcaagaaaatctgcttttcttccaaacctcccttctccatgataccatcattctggcaactctcacgatcatctacttctgacattttcgtttcttctcgatcttctcaaatctattcatatttatccccaagtggatgaaactacttttaggcttttcactgcgtgaaataacatgggttaagcttaagtaatttttttatctttctctctctttccctttctgcctttctcttatcctctgtaaaggaggaaaaattattttccctctgctcctccaggtttttggctaaggcaatctttgtaatgttaaggattatgaaaagatagagaagaaagattttttgccttactacactgatctttcttttgtatcaccaaaaaccaagttttgcctctagtgagttgcgtgtttgtgtaggatgaatgctttttattttacagaagctcgagtaagtctggagaactgcagtcccatttacagacgaggagtacaaggccacaacttaaatggcatgcctaaggagcacttgtgctagacttgaacttgtactcctgagtactccttgtacaagtgctcgtgcttgtactccttgtgctaaggagtacaaggccaaaacttaaacgtcgtgcctaaggccacagcaataatgatgaggagtaggaataacataaaaccattca

SEQ ID NO: 26328 - DNA, 1974 bp, Bovine  19866881266651
agattgatatttgacctgtaacagtaggatgtaattgaagttcaaatgttataagttggaagatgttcctttggctaaattttctcaaactgattcaattaattttcaaccacaattagcaatgtactgtgtctcttcttaataagtaaacaagtccataagatacatacgtagattactaggaactctcctgggaatagcaatgcaattaaggtcataattaaagcattcttttatctgttgggtcctatgcttaaatcaggaaattaagacttaaatgagggcccagaggagaatagagcaagttattaaaataatgaagtaataaaatatataagaaaagactagaagaactgaaaattttgagaatagtaagctctataaattgttgctgttgttcagttgctaagttgtgttcaactctttgtgaccccatgaactgcaacacaccagacttccctatccttcactctctgctggagtttgctcaaactcacgtccacggagtcgatgatgctatccaaccatctcatcctctgttgcccccttctctacttgccctcaatctttcccagcattagggtccagacagtaagaagttcttacagactctgtactttatggaagcagaaacagaattaaggactgtttggaataaagttttccccaagtttcttatagagataatatctgacatgatttgttccagagtgacccaaggaccatagttgtactacctaattcataaatgtggcagactacatcaaaagtcctcttacctccacaccaaagctttattatttaggtacctttacaaaaaattgataaaaaggagtctttgaaccagtgtcaaaatcagacagacaagagaatcttgagagggcttcaagttcattagccacatcctagatttgattaggaagcagagaagaaaatttcagctgaagtctccctagctaaccccatggcgatgcttttgctaaaacaaacagggacaagattttgattctcatggacatagtgagcagcaagtttgtgtgtgtgagacattctttagcttgttttaatttagaatgtctctaatttagaaaaattttaattttaattgtttcgttaagataccattggtaacttcacattttataacaagattggccatttttccttttaaggaaaacacatcaatttaacagagagaaagtggctgtatttcacatttaatgttaagtggttcttatgactttgggaacggtctgggatgtctgtttaagctgcatcctttggaaactggcaataaaaataagggcttaatctgcacaagcttctttagagagttgctgtgagtaactagaaaactgaaatggccaggctttcagccttatctcatacagcaccccaggcacctggccctcttatttcctggcaaatagaagggggaaatgtagaagcagtgacagattttattttggggggctccaaaatcactgtggatggtgactgcagccatgaaattaaaagacgcttgcccctcggaagaaaagctatgacaaacctagacagcatattaaaaaacagagacatgactctgtggacaaaggttcatatagtcaaagctatggtttttccagtagtcatgtatggatgtgagagttgaatcataaatgaggctgagcactgaagaatagattcttttgaactgtggtgcttgagaagagtcttgagagtcccttggactacaaggagatcaaaccagtccatcctaaaggaaatcaactctgaacattcattggaaggactgttgctgaagctgaagctgaagctccaatactttggctgcctgatgcagagagtcaactcactggtaaaagaccctgatgctgggaaagacagggcatgaggagaagggggtgacatataatgagatggttggatggctttactgattcaaaggacatgaacttgggcgaactctgg

SEQ ID NO: 26329 - DNA, 1235 bp, Bovine  19866881275458
ttccgaatattcttcatgtggcacattttataatctctattcttgatatgaagctaagagtataatcataaaattgtaggtctagtaaagtattttcaagggaactgaaagaaaatggcattgaggtattgaaaaatctgctttttcaggaagctttaagtcagaaacttcattttcatgagaaaattgagttaatatgtaaaatgagcaatagaatgcacaactcatgtatgaaaggttatatacaaaatagttatgtaggtatatatacacacatgcaaacacacacatgcatatatcgtatatatgttctgtagaacgagagagctttctgctttctttgttattcattgtgtaacttaccaatgtacctggtgtccttatatccccaaatatattgagtgccaacaaaaatgaaagtgccttttcacagctgagacttccagcaagcaatagccagttatgggtactttggggactttctatggcagatttgttctctgtgaaacactggatactgacatttgaaataaagtgacattccttcaggtttgtggtgtcaaataagtatgcattgagttgagtccaggttcccatagctttcatcacattgcatgtagtagaggaactggaactgtggaaaattcacttaaagaaaaagaaaccagagaaatagggaataatcttatacctaagaggagtttcattttctctcttctcctctccactacagacttggaatccagctgctatattatggatagaaaaacacccccatggacacacaataaaaaatgagaggccaagcatctgtgtgcccaccccttctgcttttgcaggaaattgatcatgattacatgcatctgatcttaatggatagtccctgctctgagccccaaggagaacagccaaaaaggagaggaaaaagcaactcaagacccctgccaaaatgccaaaatgccctgaggaagaaaattgcttccttgggttaaatctgcaaatgattttggacttgtgtttatgtgcaaaaaataagtcaatagcattaatatctattccatttatgccaccaaatagtggtggtattctctccaaagtaaattttcataccaaattttcatttcaaatgctcagaaaattaacattgtataaaattccactcaaagggtcagtacacaaaaaatttaaaatttatcaaatattcatgaaaaacatagactacatagaaatatcat

SEQ ID NO: 26330 - DNA, 1521 bp, Bovine  19866881343735
tgtttcggtttcttggctgagaggcatgtcggatcttaactcccagatcaggggtcaaaccctcagccccggcactggaaggtggagtcttaaccactggagggacgtctcctacagttaagctttttagcattgccgctcttctacatggtgcagttgggactggtttcctcctgtttgtaagcagtaaagtaaatatttgtgaggaacctcattttctctcacatgactttcaggtaagtgataccatttcatgaaagaaatgtaacccttcactcaggttatattaatagaaagcagttaattctctcttttttttttagaaagctttctttgtgagcaatatttttctggctcctaaagatatttgatctatttggagagttttctaatttacctcaaatttacatatgaagaaacactggatatttttttttcaaaaatccagcctttaaattttatcagactttccctcctctgaatgtgtgatttaagcaaatagggtgtcataaaacaggttgtaatctgtgatttcatgatctgttagataggactgctcttcctgtggtcaacggatggcagttacagacagatgaagagtaaataatgaaaaccaccattataaaatgatttcaggatagccatggttgactagtggatgaagaacagaacactgaaaaaattagttcagataatctaaaatatcattatcgaatcaatatgacctgatttctgtaattaatttcttaaacctgtgaactgctgtcgagtgagtcactgctgtactaccagtaacatggattgtttctgctaattaaatccatcctcaaaatgtttatttagagagtaaaaaatgagagacagagaaacagacaaactaatgatatccagttgtgtgaattttcacttctctggttgagtcggtctcatgcagacgtaagtatttacgaaacccatgtccagatacttggttaatgatgaacttgctctgcaattctttaactccctttggcttttctttccccatctgtaatgggtgacacctcccccactgagtcacttttgactttaaattatgaaaccatgccaaaactctttgcaaaaataaagtgttctatatgtgattcataatcaaaataatgatgttaacctctacagggtctcctaaaaataattatgcttatagagtccaaatcagtacagctggcttggattccatatttaaacccacattaagttatatgcatttgatcaagtaaacccagcttaaaggcaatagacaagctataggagagatggggtatatagttatgaagagaacaagtagaaagagtcagaatgtgttttttttttttttttgtaatttgtatacatgaacacaggtaatttcccaaagcagggaagcaattccttgttaaagagagagagagagagagttggtaaaaccaggtgggttaatgtcctttggaaaaacaatggtaataatttccatttgagggtattgtctgcaccagaaactag

SEQ ID NO: 26331 - DNA, 1148 bp, Bovine  19866881385714
taatgcatatacatgtgaaataaattcacatataagagttacatagcttaaaggacaggtgcatgggctctacattttaactcactctacctgtatctttttattcactccattgttatacagcatttggactccaggccgtatcttgagatgctccatcttcccaagccatcagcagttttccaaatgatgtttttagctttcttaggaacagacaatgaaaccaaaaaatgagttacaaggggaagataatgttgggtagttattcagagccatctctgcacagttcctttttttttttgtgggggaatgaatttcaatgattcatttcttctgagccatgtttatgccaagtgtatttcctgggatggattaaattgactgaaaactaatgtaagcagagtgaagaattaacaaggtttaaaataattttatttattggtaggggatagtaaatttggaagtcaattttccatccataaatcaggacagaggtttatttttccctgagtcttatgaatgtatagtgtgagaggcatgcattaatatattcagtaaagatttagttatattaagtaactgtcagattaccacggatgataatttatttctttgacatctactaatggtcatctcaaagtatgtaatgccatgaaagtagcttttattgaataactaactgataacagcagatgcaaagaatatagtttaaatgtatacacacgcacacataaaaacacacatatacacacatatatatctttgctaccatataggaggcagactaggagatataaaattatatgtgcttactgactataaataaggaacaactgtcgtattctcttagagcagcaaagtatccttccttcgccagtggcaacgggtggtaaggaagaagaaatcttgcagcaaaagagattgatttttggctgatgcgatctacataaggaagtcagttgcaggtgattgtacatcttgcaatttcaatcagaaagaatgtttttgtttgtttttttggtttaatgacaatcaaggttatatgaaatgcattccttaaattaatataaaaatataacattttgcatatcttataatatgcaatgctaatagaaggtagtgctggtggctgtgttgggtgttatgtt

SEQ ID NO: 26332 - DNA, 946 bp, Bovine  19866881397539
atgaaataaatgtttcccatgacaattttctgctgtgagcacagtaatgcagaacactcgtcctcaactctcacagcccaggagaattcacctgggagcttttaaaattcaggatgctcagggtgcatcccaggccaattaaatcagatgctctgggggtggagctagggcaccagaagtctgtcacacttcccaggtgattctaatatgtgactgaggttacgagctcctgatgcatgtgccatttcattttatttgcaatagaatcaagtatgtgatagacaccagttaataatagaatggaaagaatatatattatgcttttgatacaagagccaaaagccagtcttactttaattaatgaatcactaatgtttgaccctcaaattgtctggaaaattcaaggtaaagaaacccaacagtcatagctatttattagctcgtatttaatttgaataagtgcgtgatgtatgtacaagagatatttttataagaacaaaactttcactcttaatagagctcagtttcctgccgcctgtttcccgcttaatatcttaatcttctgtgacatcacaattaattcctatggagatggtgctagttacacagagaggattataatttcaggcaaatgataaacagcaggaagagaaggtcatttttcacttctgaagcaaaaacagcctgataggaatgacagccaaaaaaagaaaaaaacaaacaaataaaaaaatagttacttcagaatattatgaaactgtagatttagcttcttttgtgaaaggcaatttactctttaaacagttatctatcgatggcaccagcttaatgacttaaacggtgagtgttttgttacatcagatatttcattaggattactttaaattaagattactgatgtacctttgtggtttggatttatcagtatcattattgcggataatgg

SEQ ID NO: 26333 - DNA, 1559 bp, Bovine  19866880436823
ccctccactagcatcccctctctcagctcctctggcttcaggatgccagggatactgctgagaggtaactgctaacagatgtgaaaataagaattataaataaaagaacgattagaaaaagtgtgttgcggtttgcctcaacagtcagtatggtccaggggatggcaaaggatagcagaccccagacaagtaacccaagttacaagctctctcatctagcagtgggaagacctgggtttcactgggcaccatgaaaagacccttagtttgtgattcaatagactggaaagtccctaggacagtttaagcctgtgacgtacctggtgaaaagtcttcgtggacttttccccattcgttccaaacaatagcatggttcctctgctctcactctaagctctgagcagcctctgcactcaagagcgtaagcaaaccacaccagctggatgtggagctccattctgctgtcggagaagggcaagtccctgtaccatgatccaagctcaggtcctacctagattgggaacctccattttctctgggctcttcaactaggacttggaagatgaaacaacactgctggctgccatagaagatcaactggatcgaagcacacctcaccaaagtcatggtgcttcttggcacagaggaatctttgactcccccagaagcttcctcacctgtctctactcagaaatgttaacctatgcaggcttgcggctaaatggggaagggaatgggaagagcctgctcagtcagctgggctatgaatttcagagccggtgggccttagttcaaagtcttcacagcccagagagctggacctttccacaaggtgcttcacccttccctcctttgtcatcctgggggctgcagtttctgaacaggactgaaagggccaggggcttctggagccaggcagtaaaagactgaggcagcctcaaggtcaaggttaaggccaaggccaaggtcctattttcctatctctcactagaggttttagggatttgagaatccataatgaatgaatgaaagggacttttctcttgaggggataaggtggtgagagaacgacaacatccctcagcctcagcacctgcggaagtggagcagggagtcccagagtgctcccaccatggcccctggtccctgtgctgcagaggaactgactagttctgaaaggatgcccagtttatttcaccttctcttttcactgatgtttagttcaactggttagtatttagtgtttatatccagcctatttctgggtgtggggtggggttacagcaaaaccaaaatacccctaaaaatagagcagatccatttccttgcctatgctccaaacgtgacctttaaaacagatcatttctctgcaaactcctttcctgtttcactaaaaatgcccactcctggaagccctggccataccagcttcctaaaatgaagaaatataatgtagccatcaagttcctctctccccaccccactacagtgggtaggagaaagtgggaggaccattcccaccctaccccgacaatgagttcattcatcacaacaaggca

SEQ ID NO: 26334 - DNA, 1158 bp, Bovine  19866880444096
gtatacctgtggcggattcatttcgatatttggcaaaactaatacaatattgtaaagtttaaatataaaataaaatttaaataaataaaataaaaagaagagcttgtccaatctgagaaagaaagtaaaatcccttatgttcttgctaatttctaagttacaagactagaaaatgcaattccacattacttcaggagagctgtaagcattgctcattgtattaaagcgaaagctctgaagttaggtctgtgttcaaatccctttattgaattctgggcaagctactaatttttcagttaaaaaaaaggtacccctttcacttgctctcaggatttactgacagaaacattcaggtcaagtgtttagcacagacccttggaacataggaaagttttaataagctctataagctttaactatctgaggattgactgaaaatgctgcatatttaattaatgcatttactccaagacattataaactcttccgttgttttcaatcttcagccttgtggaggaagatcattgaacagttatggtaaattttctctactgctattgttacagttaaataattatttaaatctattccttatcattcccactgcacacacaaaaatgaattgattctgacaaaagcttttcttaatttgctatgaaactgacaaagtttcttgacttttttcagttcagtattttaaaaatctctaaacaataaaattgagattaatttcataagattttttttcaatttaggcacattacatgtatccacttaaatatgaataatacttatttattctataaacccctggaggaggaaatggcaacccactccagtattcttgtctgaaaattcccatggacagaggagcctggcgggccacagtcctcaaagagtcagacacgactgagcaactaagcatggcacatacataatctaaggtatatatcatcatatattttaagatatctaaaaattcctatgcagaatcttagatttcttattgttcttacacaacattctcatatctgaaaattattacaactggctttaaagaaaaatcaaattagttgtcttcaactagcctttatttaaattttaaacttgtacattgcgaaaacataggagagaagagttttagaccaaaataaaggc

SEQ ID NO: 26335 - DNA, 696 bp, Bovine  19866880491237
tctggatcaatacaatccaagtgtggttgtaggtacactcaacacattaacacaactcttggtatctgacactgatgaaaaataaaaaagggtaggtgaacaaacacatactcatacattattacgttctccagaagctgttctttgtggaaggaaacaagaaaggggaccttcaggaagctattgatggggactgggaaggcttaaagctatggctttggtaagcacccaagtgagctgtaggaaggcatttgtacaagtagattctgcagcatcaaaggataattctctaaaagaggtgggcattttctcagttaatctaaattctgaggctctcagcagttgagggctagaaacaagatccaaagaaccatctttgcaaccgcttacgaaaggtgactgtgccattcagctcgtgatgctaaatggtccaaaagcctttggtggtgtgatatggacaagaacaatattaatacacaaaccacataacaccattaaaactcaaaaaacattttttcatttaaaaaagttacttagaacacatagaacaaggcagcattcattcctttttctcgcccgcgggtgcggggtctgtcggcggctcctccacggcgggcgctgttgctctctgagccagtggttgctgtcgctggtgccttcctctgccagactgtccaccccttcctgcccactctc

SEQ ID NO: 26336 - DNA, 1090 bp, Bovine  19866880555117
cttagtctgccccatggaaaaatgggcacagtgttgtcctaacaacttccctagagctgttgggcgaattccgctcaatgagatcaagaggatggaggagctctctgtgaccacaaagtgataagaaaatacagactttcttcgtatcggttcacttaatgatctctaactgggaaattcacacacaacaggggcctcatcttggtggtcaccagacatgaaagcctccagcctagacatcagtctttttctttttttttagtttatttattttaaatgaaacaaagatgaatattttaatgagagaaggtacaattcacaaagaatagacatcataaccacaaagacacctagcattagacacataaccgcaaagaaacaaagatatataaatcaaaaattcagaagaaatatagggaaaaagaaaaaaaaataatcatagtgagacatattaacgtttctctgagaatattttatcaagtgcagaaaaagtaagaataggagcatctggaatgatgccattaataatttaaatataatagactttaattaattatattaatcttatatcctacacaaatatatttaaaattctgtatgtcatatgttgctactagatagacatcagtctttagcgagggtagagagagacacttcccacgacaatcactggaataatctctgctgaaggcgtgggtgcctgctttgaccttttaagggtaatttttcccccagagatgtaggagtttagcacccctgacacatgagaacagaagtctcttgctttggctgcagggcgggggagcgactctgccacaacctgtgtgctcccatagcctccggtccctgacaggctgagcccacttctgaccacagttccttccaggaaaggaggtttcaaccacacttcgaaggttcttaccaacccctgattggctggcctagccagtgcctggcacagaatagatcaaaaatgttggtggaatcaatggcgaatttggggtcttcccacacctttgactcataagttttcactctgcccaaaaacccctgcactgcagagatctgtccgggccaccgggccctgcta

SEQ ID NO: 26337 - DNA, 748 bp, Bovine  19866880596648
tacaaaccagtacttacctccctcaacaaaaccagacatattatattacgacagtggaattctttgtcatgtaatattttaagttgaatatgtgtattgcatatgttttatttctagatttatccagaaccacgctggtaaagacggtggttgaagaaatagatcaacgtggtaaagttctttcatcgagggttcagtccattgaagaaaagacatctaaaatgaccaatggcaagacaaaacaaagagttcccttctagttgtcacttttgagaaaagaatcatttggggaaagatcctgcaaaacttcattattctaaatatcaaggagataataaaaacactttctacccttaaagattagttacttaccaagaaaaaaataatcctgttgtcttagttacctttttatagaaagttgggtgtttgttttcaaataaataaaaaagtagatgtgcgcttatgtccattcactcatgacaaataaataattgagttattttttccatgtctaattcatagggaaacatttatggaatatattttaacttccttttaccctagctttatataatagtcaataccacatggcatttaaatattaaacattcactaggcataatctttgttgttgttgttgactcactaagtcacgtccaactcttagtgaccccagtggactggactaataacctgccaggctcctctgcccatgggattttccaggcaagaataccagagtgggttg

SEQ ID NO: 26338 - DNA, 797 bp, Bovine  19866880597919
tatctgggatgtacttataccgaaaaatgatttgttatttatctgtgatccagatttaaatgtcttgcgtattttatttgcaaactctggcaaccctacccacgaagccacactttgcatttgaaccagaacttgctttgagtgatgggagttagcagtagcattctaagaaatatcagacaccagagaagtctatcttgcccattttcacttgtgttacttcccttcattagccagttgcttacactgagaatgatgacataaaaggaaagactagacaacctagagttcctattcctttcagtccttccttactcatcagttaacctaagtttactagaatgtgtatgtatcaggaagtgaaataaaaacaattgaattagttttgtgcagtgtttccactgttttcataggagctaaatgaatatacaagctgtgagaaaatcaaatagggaaatccaagaaagctttcctaaggaagcgatgtttgtggtgagatcttaaaaatcagtaggcattaaccaagtaaagcaaagatatgggttgtaaaaataagggcagagacctcgagatgatttgaggaatggattggggccagagtggctggagcacacatatacaaataagtctagagtgagtaacgtgacctgaccacacagaaccttgtaggctggctcagtagttgtcctaagcatatcgagaagctgttgcagagctctttgagcatctttaagacctttcaggctgcagtgtattgcaggagaacaaaagtgactgtgagaccaggttcagagata

SEQ ID NO: 26339 - DNA, 1474 bp, Bovine  19866880668547
taaaatggataaccaataagaacctactgtatagcacagggaactctgctcagtgttatgtggcagcctggatgggaagtttgagggagatggatacatgtatatgtatggctgagtccctttgctgtccacctgaaactatcacagcattgttaactggtgatactccaatataatataaaaaagtttttaaaaagttaaaaaaataaaatttatgctagcttcatatcagggcacatttaatctcttcagtgatctagtctgactttataaaaccatgttggtttttaaagcaaaagttatgttctttactccaatgtagtatttttacttattataattaattactttatgtttacctacttcagcctgaagtcatcagcagtcagtctggcattttcattttgtagagcaatgctggcattacaggtagtcacagaaataatctaaataggatagatggtgcaaaatgttaggtccaaaagtcaagggagattccagatctcattgtgattcttatcttcttaatccataaaacatctattttagtatcattttttcctattttaaagaaatctggattttctccagagtttaagagccaaatgtaaacttttccaatcacagacagttttattactcttcatcaaaaagtatgaggtaataaaagatcaatgaagcaattctatctgtttggaaacaatttctctttcatcaattaattctgcaaattcttattgccaggcagtgtgccaagcactgggaatgtagagttagcaaattcacacaaatttgctaagcatgttttctattacatcttttttttttttaaggttcagttcagttcagttcagttgctcagtcgtgtccgactctttgcgaccccatgaatcatagctcgccaggcctccctgtccatcaccatctctcagagttcacacagactcacgtccattgagtcggtgatgccatccagccatctcatcctctgtcatccccttttactcctgtccccaatccctcccagcatcagagtcttttccaatgaatcaactcttcgtttttaaggttatgcacacccaaagcctgtagtatgcatctttcttacctgccttttgagatcttcagtgactgagaaatatttactacagtcataagcaagttgtcggccagaaccaggcccatatttctcataccagcccttgattttctgctcgaggtcagcgttggcctcctccagagtacacacgtggtccagataggatgccaggcggtcattgaggttctgcagtgtcaccttttcattcccagggaggaggccatgctcattttcaagaaaaccagtacagacaccacttcccaaccctccaccaccatgagagaaacttcctctagaagaaacgcttccaagagggccagagaagctgcttcctgctcccaacccaccgcatgcatttccagccctgaagcctgt

SEQ ID NO: 26340 - DNA, 1301 bp, Bovine  19866880707421
atgtaaaagattaaatataaaaaactaaccaattacttccatagatacagaaaaagcactcaacaagatttcacatctatttctctttttttgccacagaaatagcttattgagaaaatccatcaagaaattatttttcctctgtgaaaatgcccaatacaataaatgggatccaggaagcaatatgaccaataaaatagggtctgaggtcttacagactttaatactattttgacaatagatgacatttacctgcccaaatgaaccaaattgttattcagccaaataaccataaaagcttatttattttcttttcattaggataaaaagtaggctttccatatctatgccatcggatctacctcaatacatgataaaatactgagcaagtgaatgccaaatagacagtttctgtgttattaccaggcactgagtgagtcaaacatcagttagcagcagcttgggacacagggctcaaggtgggctgagtgaaggctgtgaggttgatggtttccaggtctggggtgggctgggtagagttgagcaggaagcaggtgggcacatagggttgaggaatgtggcagggtttgggcagctgtcacggcaggttgtctccagtaaccaaaccatacgtgagcaggggctgggcaggcagactcatgcccagaatttgtcagaggagcagacagtagtggcggggctggtgggaacatgcagcagaggggagcacaataagctatggcactggaaacctggtttgcttttggtatcttggagtgaaagatgaaatatctaggatgaaatgtctcctctcactttggggctctttatatatctgcttcatcaggtgttgatccatcaaaaggcttcctctcgtttttatttatgccactgttttccactaaaattctctaatcaatttgacatttacttgtccattaagagtacctacccttattaaagtaattgtatttttgactcattgacttatcactttttgtcataagataatcacattttatattcacagggtcttggaatgccaaatcttacatgaattatggataattaatccaaaagacaattcagctatagtttcagaggctaaagtcttctcatttttttcttcttagctttaaataatatgtacatgatatgatttttaatggttaattttagaatatgcaacttaaatgattaattggatcaacaaagacatggctagctacagatgaatgttgcatatgactatatgcatctcagatgtatctgccttatttattgatgatataattcaattt

SEQ ID NO: 26341 - DNA, 1140 bp, Bovine  19866880764487
ggtagtagtggctgagggacgcagccagagctaaggggcatatttaggcaaccggaactggcttaaccccttactgcccatttattctttgtattaagcacctttgacactcttcttactgcgcttgtttaaagaagaatggttcaggtgggaataacctaataggatccctgtttgcccctttcccctttttttcctttctagttatacttcccttgaatcttcctatatcgactccattccatctaagtctgcgctccatcccccatcgccccgcccgattcttttcctcagaatccctttccctttctctagcttgatttctccaacctcaaggctgactgctaccggcccggtctcctcagagtgaaatcatgaaggtggtgaacctgaagcaagccattttgcaagcttggaaggagcgatggagtgactaccagtgggcagtcaacatgaagaaattctttcccaaaggagccacctgggacattctcaacctagcaggtcttaagtgaagtaggaaggaaggatgggagggctaaacccagaaatgttgtaacactgaggcttcctttgttattctccttgcagaagcactactggagcaggccatgattggaccttcccccaatcctctcatcctgtcttacctgaagtatgccattagttcccaggtaaactcttctatctattccagacaaggtttgaaggtgaaaggcttggaatacagttgtcagctcaaatttttaggtgaatttgtttgaacacatcatttccctgagcctcagttttcttgtgaaaataataatactccagtggttatgatgaatattacattaatttgctctatcaataaatactcacatatgccctggggatttagctatgaacaaagtctaattccagcgcacaggtattttgtgagtaatataggtatgtgaataagcagtcaatcataagatgggattatgatataggacagagtactatgggagtacatgggagggatacctaatcccaggttgagcaaccaggggaagaagtgatgtttaaaccaagacttggagtgttaaatgggaattagccaaggagattgatgagagtgtacaaagcagagagaaaagaatatgcaatggttgg

SEQ ID NO: 26342 - DNA, 1415 bp, Bovine  19866880793430
ttttcttgcaatatatttttgtagttttggtattggctaagtttagttgaggctttgtcaattttgctgatcttttcaacgtaccaacttttggttttgttggctttctctatttttcctattctctatttcatttaaataaatatttctagtctttgttactttcttccatctttttgaatcaggtttagtgtgttcttgttctgatttcttaaggtaaaagcttaggttctttatttgagatctttcttcatttttctaatataggcatttacatttaataggcattataaatttctcactaagtacatcttcagctatatgccataggttttaaaatctttaattgggggtgaggataattatttaacaatgttgtgttggtttcatcccataggtttttatatggtgtgttttcatttttattcacctcaaagtattttccagtttctttccctgtgaattcttctttgacccgttgattatctaagagtgtattgtttaatttctgcatatctatgaattcttcaaatttccttctgttattgactgtggtcagagaacatactttatatgatctcaattcttttaaatttattgagatttgttttatgtcctaacgtgtggtctatctacgttccgtgtgcacctaagaagaatgtgtatcctgctgttgctgggtgaagtgttctacagatatttaataggcccaactggtacataatattgttcgtgtcctttatttccttactgatctactgcctcattgttgtatccattattgaaagtagcatattgaggtgtctctgactgtgattgttgaatcgtgtatttctcatatttctccctccaattctgtcaacatttgtttcatttatttttggtctctgttgtttaggtgtgtgtctgtttacttgttatgttctctggatggatgaccctttttatcatgattacatatcctttgtctctgcaaacattttttgtcttaaaatcgatgttgactgatatcagtatagcctttccaatattttgaggggtaaatatttgcatatttttccatcgctaggatatttcctatctctctctgcttccagcacccggtggcacccccagccatggctgcatgtttttgaacccagagtccatcagccaacccctgtctctgtggtgccagcacctgatgagtaacctgcactttagttccaactcctgccctattttctgggctctggtagcactaccttttcctctgttcctccagttctagggatggtggcaacttcctgctgtttttaatatctgggtggcttcaccatccactgtttgacttatctgctcttctatcatctgtgtaactgactccctatgttaaattccttttgtctgaaatatctagagcaggtcttcttttt

SEQ ID NO: 26343 - DNA, 2953 bp, Bovine  19866880829247
ttcccttcttcggggatcttcccaatccgggattgaacctggggtctcctgcactgcaggcagattctttaccctctgagccaccagggaagccccatcatcaccttttaggtcatcataaaactcaagctaagggacttccctgctggtctcctggttaagactccgcacttgcactgcagagggtcccatctctggtggaggaactaattatcttacatgctacaagccatggcaaataaaataaaatagaataaactcaaagtagaaaggatatttaaaaaggttaaggcagaaactgtataaaacaaaacaaaacacccttcaaactaagcttttgagtccaactgttaaaatatactccaaacttcagggtagattattcataatcataaaaataaataaatttctttgacacaagagaatgagaaaactcaaaattcccttttgtatgactttgacattcatttgtgtcagtcccccaataaaatatataattcagtgagtcatttgaacacgcatttggtttaaaacaaataaactcaaagaatggaggtgacctcaaatagcctaaataaaagagggaaaggcttaggcaactgttttggtttcttttcagccccacttactttagtctgaagtcatcagctgtgagccttgcattgtcattttgcaggacaatattggcattgcttgttgttgcagaaattatctgatcaatggagaattagttatgaatgaggaaatatttttaaaaattcagatttccttgaaataaagtcaactataaaattatagcaatatttttggcatcctgtctctaataagaagatgattcttgaaaatggaaaatttaagtatagcctcttttactctctatcttacccattaaaaaagaaaaaaactttctatggaaaactttctatgtaaatatataactggagacattgggcagtttttgatattttagtatttctgaaagcataaacatgtataccacataccagatgatgagtaagccaagtttgaagaccagaattttaatataataattttaatattaatattaaatattagttttaatattaataaactaccgaaaattagcagctgagagcaaagccttgctgtgatcacttaggcatctgtgcctgtgtggctaattacccttataggtactaaacctcacggcactgtgtttcttacctggttcctaaggtcgtcaatcaccgtgaagtatctgctataatcgtgatcaagaccacggcaggaaccaggcccaaatttctcataccagcccttgatcttctgctccaagtcggcgttggcctcctccagggcacgcacgttgtccaggtaggaggccaggcggtcgttgaggttctgcatggtcaccttctcattgccagagaggaggccatgttcatttccagtgaaggccgtgcaggaagcacttcctccgcccagccccccgctgtagcttcccgcagaggagctgcctccaaaggcgcaggtgaagccgcttccaaagcctggcacactgcctgtgctgccgaccccaaagccggctcccccaccggagagccgcacagagccagctcctccgcaggagccaaggcgtctggatgcagaagaaaagcgcacgctcatggtgtctagactgccctgcttgttcctggaggtaagctctgatggcaaatgtcctactgaaacagtttcgtgtacctttatatacacattatcagggtgtttcttggtgaactctgctacccatagcaaaatgttgtttgtcagctcatctgaagtattcataattaggtatttttttcttaaatgaatgcctttaccctaatgtgtccattctgtaggtggatagttgccttggggttatttgttatctccaaaatgagaaaggggaggagtattatcaagattattatagggatgcatttcaaatttagcatgagtaatccttcctgtcttccaggccttaggactataaagttcctataagaataaaatagtgtgacacacaagtttctttttcccttgctcaaagcaataactttgctttttctctagtaagtgagccatcatagtcatggttttctatagataatcatgatccttttggatagatcaaaaataatttcaagaaccagtgggttcatggtaccagaggaagaaggccaggtacaaaatgaaaattaaggaattaaatgggcttttctttgaagacagatagtcttctcttgattcttatccctcctgagttacatctttattggttttctgtctaagctcttttctaaccaggttaaataacagtattggcgtttttagggcagtgaaactgttctatgtggtattatgttggtggatacatgtcattatacgtgcgtcaaaacccatagaatgtacaacacaaagaacgaaccttaatgaaacggacttagttaatagtaatatgtcagtattggtccatcagttgttaccagtgttccccacttaatgcaagatgttagtaataggggaagctgtgggggaatgtagaggaagagattgggaggagtgggtatatgaagactatctgtattttctgttcaatttccatgtaaacctaaaattgctctaaaaaataaagtctatttttaaagcttgacagagtcttgatgacatcatttgtcattgctatgcctaaaattagcctagtctgtggactatgcagctacaagtcaatgcattctccttttagcttaagcaagcttgggttcattttctgtcacttgtaatcaaaagaagttctgataggtttggagaggaaatccagcatagcggtcaggtaacaacatgcagagatgatgacagaccgaggcccagcagccatccaagacgggtttcaacaagccggcggtgccaggttggagctgctgtggcgttggggatccgagca

SEQ ID NO: 26344 - DNA, 1517 bp, Bovine  19866880843076
gagaaacctatgagggatactaaaagtcttcatggtaattagccagggaaggatggtgagcagtattccagacgaggcacagaagcaagaaacattatgatggtatctcataactactggagtactggaaagggaaagcttcaagtaggtaccctttcagagatctttcaatctggacattctgcagttctctgcctgcttccccatagtccctgactcttgtaggcttttcttggaccagtgctgtatttcttggtggatgcttccataggctccagtatgcacattaagtactcatggctgcttctgctccctctgtaattaagataggtaggttgttcaccaccatcccttaaaagctcgctgggcacttgttaccattggttatgaaagacaatttttaggtgcccaggttatagaaataaatagcaacagtggaagttgcttcctaggttctattgccctattaagagatcagaaataccagctggtaaaaaagcctcaattctatggtaacactttctccatttgtggcagcctatgcccttcattcttacagttttcatctcctagaaagccttcctcaaatgtgttcccttgccctctctctgctatagaacctgcatctgtctattgggcttccctggtggctcagctgctaaagaatccgcccgcaatgtgggagacctgagttcgattccttggtggggaagagtccctggagaagagaacgtctacccactccagtattctgggctggagaattctatggactgtatagtccatgaggtctcaaagagttggccatgactgagaaactttgacttttctattactccttggatgtttttactggttaggagtttgatctcctttcagacttcctgggttcaaattccaattcttccactcactagttgtgtgatcttgggcacatctccaacctctctatttctgtctccatattagtgaaatggagataattccaacttcatggggttcctgtgagaattaatagggtgatataggtaaaataccagagctcaaagcctggcgtacacataagtattagcttttataccctatatgaatcaactacaactaacttgattgtaatattgttgttttcctattacctggttttattgctctatttcatttgatatagaaggatgagagataaatgcttaccatcacctagaattgggttctggtttttaatggcgcctgaggcttaactgggttattagctttggaagctggcctgtaaattactgctctaatttatattttttcattaaaagctcagcttgcctcttctatagagatcttctctggtcctgaaacccttgtgtttagccattaaaaaatatttttaaattaaggggccataattctctccactccccacattgtgtggatcaatgggactagtgatgggaaggtacacaaaatatcatattcttatctgtaacaaaataaaagcaaaggcctggccctatttctcatctttgaaa

SEQ ID NO: 26345 - DNA, 977 bp, Bovine  19866880844116
cttttgcatgcctatgcagatatttttatttctgtgttttcctcgtttgagctcatttctcattcgtgtttttgtctcatttgtttccatcagcaaatgcccagcacaccagggtttgtgggatacaatccatacagtcatctcgcctacaacaactacaggctgggagggaacccgggcaccaacagccgggtcacggtaggagaatcaactcttacagcatccagcaaacaactggaattgaccagaaatgccttcaggtttaggtccttttgaatcatcagcacagccatttaaaaaaaaatttaacctggctttcagattattttaaatattcattgtacaatcttatactgaaaaacaaacaaaaaaaaaatagtaagatctggatatgtatatagaagagaaggagaatccattctgtttggtgattggtagagataaagccttgggcacttaatgctagtactctatgtagacaaacctaggatttcctatggttaagatgccctttttgaggcgaagagtatctttcatttaaggtatttggcattaggttcaataactattttcttaatagagactgggcttatagacgtggcctttttgggctatcctaccagtttgaactgctgcacacaattatttgtcttttggatttaacagttgacgtaactgagattcgtttctttctagttaaaaagatacttgtgccaattcaaagaattgcagaatgaaagctgaaggaaattactttgagttaccagactatacatatctacaacccagaagtacatttatagttcagagggtaaaggatatgatttctgaaactttagatgtttcacttaaataatcagcctgagataccaaaattgggatgatgtacttcaaacttttttttttaacttcagactttttattttaaaattatctttaacttcatttaaggaaatttaaggtacccaaaaaacaaa

SEQ ID NO: 26346 - DNA, 1216 bp, Bovine  19866880985142
aatgcaaagtaccaacctcatagaatggttggagggttaaatgagtaaatatacataaagtgtctaaaacagtgcctggaaaattttaaaggtagtaagagttatcattaccactatgacctctgcgacctataacatactcgtgtagcctaagaaggatcaaaagcatttgagagaaaatgttgtaatgggctcctggctcctagtgtggttaagagaagaggctctgagattgaaccacttggattcagcttccacttttgcctcttaaaacttgtatgaacccctgttacttgatctgagcctcagttttcctcatctgtataatggggtcagtggagggatttaccccataaggttagtgtgagaattaagttagcactttgcctctcacaagatgaatgctcagctattattcatttagacattctctataggacctaatgtggctttcatggtaatggaaatgcttagtgtaatcttgaatgcttttcaagatattcttgaaaatatcttttcaaggtattcttgctgcttgggtgaagtgtggtacagagaagggtccagctgaggtgtgcatcctgggaaagtttaggatagttataaaatgtaaagtctgagtatcttcattttaaatgtgatggtgagcttggaaaatggcccaaatcaaaaaagagttagtgggagaaaatatttgtgaaccatgaaaccaacatctcccaaaatttgcaagcaacttatgtggctcagtttttaaaaaaacgaacaacccattcaaaaaatgggcagagggcgtaaacagacatttcttcaaaggagagcctttggtttgtaagttcctctctcgttctgctcctttctgtcccccctctctctttgtctctggaggatgctgcaggatcatgcccaagcccagaaaggaaggtcaggacatcctagtggtacattacaaactgttgacctatcacttctgcttctagctgggtaaacagcatccttgaaaaagggaaggaaattcagaccttctgctgcatgaactgtgggtttgtcctttgggttacagaataggggatagttagtatcttaagcatgattcttcagtgacaaaacagagtggtcttgcccttacataccaggctctgctgtgcttgaagctcaatttccagagtgttggctgtgcgcttcagttccaagatctccgtctggcagccctgca

SEQ ID NO: 26347 - DNA, 1207 bp, Bovine  19866880985718
acagaatagctggcttcattgccatccccctgcaagatcccaacagggtccttcagcctctctttggtcatgtccagggtcagggaacccattactggagagggtgaacaatctactgttggagaaccttgactttaacaaagttttccctggatctctagtactggtttcaattcttccctctggtctagaatcggtgtattgatgcatcaacaaagcacttattcaaataaatcttatctttgaaaacagtgaccatgataaacattcctggcttctcatgatctttcatacagcatactctatagatcttaaaatgaggtccccagaatggcatttaaggctctgtacgttcatagactctatgacgcaagggctcaaaagcccataaaagcagaaaggacccctccaacacttgtggtccaatactggattctgtatcaggaacacttggggtgaagggcttgacctctagaaagtgacactgttcagatacctcatttcctagaaggtgggaggaaaatcttccttggtaagatcttttttcactccattagagcccaccatattgcttagtgatcattctagagagctgagaacaggagccttggaaaggagtgcagttcagatggtggggagagcatggcagtgacctctttgttgctttttctttttttaatttgcagctccaaagatcaaggccatcacacaggagagcgtcaatggaagaataattctttctcaagtgaatgagatctgaaagtacaagtgaggccaataaaaatttctgcctgttgtaaaaactatttcccctcaatggaaagtccttgcccaggtgaattctaagaggtttccttggagttaacaaactcagaaactttttttctctgtaacaatcccaccataacgatcttcatatattgctgcactttttcaattgaagtatgagttcatgagcttaaagctgtactttactactacagttgtcagattcccatcattgtacaagttttatagccaataaaactccacaccagctgcatcatgtcctttttttttttaatatcacaaggcaagacaaaacctcaagataaggtcagtcttgtcttgacaagacctctttatcctaaaaatggatcctcggagcattgtccatgaaagagcgacagggaccttaatgctctgaaggtgtctgcagcaaacactg

SEQ ID NO: 26348 - DNA, 1976 bp, Bovine  19866881023533
aaaaagttgaaactaggacaccgaaaggaaaaaaaaaaaacaacccaccaaattcacacataattttctcaggattactttttttcctcctggttacagaagttgaaagtccatccagatggaatttattttatttttatagaatggatgtgggggaacctctgtaggccagcattgttgattaatgtggaccccgttcctacctcctcgtggttcttcttcaggtaggccagctcctcagtgaggctctcaatctgcatctccaggtcagagcgagtcatggtcaggtcatccaggactttccgcaggccattgatgtcagcctccacggtctgccggagatgcagctcgttctcatatctggaagagcacagtacagcccatttcaaagagcacagtgcattctcacatatgcaaaaaaatgttttttctcccccgagcaatttgatcaatgaacgataagttttctcttaggagttttccccttgtaaagcaaaacctgaactgtacattaactctattgatggccaacatttttgataacaaaaatttcatcctgaaattgcctttgttctgttcttgtttgtggaatgagggttttgtaaaatgtacccttgtgaatttaggtcttgatcccataaaagatttctttaaaatttagaataaactaagccaagggattggattttatttttcctacaatgtttgttttcaagtcttcacttttcttacttcagtctgaagtcatcagcagccagtcgggcattgtcaatttgcagaacgatcccagcattttcaatggtggcagtaatgatctagacaagacaataatagtgaataaatcgtggttgctttttttttttaaacctatgtctacatgcccatctgtgagagtagatgtctcctgagttaacctttaaaggtgacttgctttgaaaatttgcttagtaatgacacctgcattgatgagcctaatgtactttagactaacatccttctgcaaaaattagcagcctgcacatttgctggaatgagcatggaacattgtttcccagaacacaatcctctacatatttttgctgttttggaagatcagttattctatgagctttttcagaaaatagtgtgaaacatgaatttcacttccaaaagagtctttaaaactatatttcccatacaactatgtctaagcatgttagactccatcacattctcaaacaatatttgcaccaggttttctaggaagaaaaatatctgtaaggctatttaaatctagtaagaggctaaaggacaccaatctgccagaattaattgtgatgaaaaattagaggaagatagtgtcgacttatagccatcactcttaggttaattagctgcctggcattgtgtaaattctactcttctgtggaaatactcaaatgtgagatgcaaacaaaattaatatgtttggatgtgttgtacacagtgtcacagttaaagcacaccacatcccgttttatacatacaacaaaacaaatatgttttcaaataattctgtgacttaaagtcatcattcatgatctgaataaatgggaaagatacagaaataatagaaactcagcatggctagtgtctcacctgagtcctgacatcttcaatgactggatagtatttgctgtaatctcttccagctccaccatctccagacctgggcccaaatttctcataccactccttgattttgttctctaggtcagcgttggcctcttccagggctctgactttatccaggtaattggccagccggtcattgaggttctgcatggcttgcttttcacctccagagaaaaggcccccgtcaccaaggccgccacccacgccaccacccacaccaccagcatagctgtagaaacctccactagcgcctccagcgtatcccgcactcccgccgaagccagaacccccgccaaagctagagcccccaccaaagctagagc

SEQ ID NO: 26349 - DNA, 1541 bp, Bovine  19866881026021
tctgatcgataacgtggagaaccgctggctgagatccgctgcgacctggagcggcagaaccaggagtatcaggtgctgctggacaccaaggcccggctggagtgtgagatcaacacataccaggggctgctggacagcgaggacagcaggcaagttccacacgatccctcttaaaatcccccagagtcacaaagaggctcttgaaggaccatcctgtttcccaaagatctggccatattcaaacctccttaaaggtgttaaaggatattcttaaagagtgatgaaaagcagcaaggctagtcacatgacaattgaaatgttcaaaatgttctaaatttccaaggcagaaaaaaatataatatgtaacatttcaagctgggactttcactttgctcctgacttcaggaaactcaggagaaatattccagggtactgaatgatttaactactagacaaatgacaaaatatgcataacttttggctaatgggacctaaataggtattagaaagcaatggaattaataacactgctgtatgtgatatattaacatgaaagatgttaagagagtaaatcctaagagttctcatcacaaggaaaaaatatttttccttttcttttactttatatccatatgagctgatggatgctcagtaaatttattgtgctcatcatttcatgctgtatataaatcaaatcattatgctgtacaccttaaatttatacagtgctgtatgtcaagtatatctcaataaaactggaagaagaaaaaaaggaaagtcagtaacacacataagatggcatttgccaactaaagaaaatacataaaacgtttatccaactgtctctgctacagtgaacatgaagtgacaattctgggtccagggataaaacaggcttcattcaaatgttattctgaaaacagagttcaaaatataatttgaagggcaaattttggcatgatttttttctgagttgacattttatccagcttctccatattgagattagttaaaaatggatttttcacaggcttccctgtaacccatgttctgcaacaagcatgtcaaatgacacttgtgagccatgttcggcgtacgtaatttgcacagtagaaaacagctgtccctgaaggttaaacacccaacccagcagatggaggaagggaagccagcagaatccttgaaagaagacggtgcttcaatcagggacatccaaacttgaaattcaagttaagaaggcttttgtattctaaaattgtcctctaagcatgcacgaagtatctctattctgtcatttcctctcctgcttgcttatttgtgatattctaggagtctgtaaagctttcttgctgctctccaataaaatgttttcattcctttagcacgataaatactgccttgtagctcattactgttaatataataaccatttgatgccaaggtaattgtctaaacccatgccagtagtttggttttgcctaaacccagaaggaaaatatttgttaactcctgaatacaaatagattagctattcatataaa

SEQ ID NO: 26350 - DNA, 714 bp, Bovine  19866881026505
cccccagaagagggacaaacaagtcaccctaaatactaggtatcatccacctctctcccagagagcctgcaggagggcagaagcctcagggcaacaccaggagctcgagctctgaaaaccaaggagcccagggagctggcatggctgggtggcctccctgatttggtccacacccccttccccagccatctgggctgattctattctggcctgggccacactctgggatctctccccttccatgcatatagccacctctatcccaagcttatagatcttacaaccatatggtctacacacacacacacacacacacacacacacacagtgggggtgtgtgtgtggggggggcgcttttccataggtgttgaggtgttggcaaggatgggaagggctctaacctgaaagaacgtccccccaccccagggaaaggtcacccccaaacccctaaaaagctcacaatctccactaccctcccgcacagcctttggccactccaacgtgccatgagcctggaagcgggcactgggtctacaaggagagtagggattcgggggcaaagtcctgggctcttaaggctggaggggcggggagggtaggcagggaggaagcaagagagaaatccccagggagtcttggcttccccagcggtctcccggtccggctcccggtcaccttagcgtgccagttctcccctcgaggtgaggtggggga

SEQ ID NO: 26351 - DNA, 1937 bp, Bovine  19866881033740
caccctccagaaggctcactgttctgtcttctgtgcccctcccaacccgtagcacttgttcacacctctaatctctctgcaaccaagagagctgtgtgcacatctgtccctctgctggggaaagagtccccaaaggcagcatcctgctcttgttcctaagattcccgccccctcagcaccaactgtggcagctggcacacagtaggcactcagtaaatgctggaatctaattgaatggcaactaactaacctgaattagggacagcctgtaacaaccgccaggctgagatacaaaaaccaagccatgacccagatggacagattctaacttgtacgcaatgcaaatatcttgttcctttcctgtagaagtttctgagcttctgtcatcaggacctccaccccaagtcctgccactttgccaaactcaagtaaacatgttcaacgctgggagacagaactttggtttggctcagccctttccccaccccatgagacagagtcaggaggaccagacagagctcacctggatttacgggaacccactgggtggggataggatttttcatcctccagaatgacacatttagctctggggctgggtgaggcaggatgctttctctgttattctcctctgccttcttgggcagtagatgacagaagaaaacatttggggccctgacctctcccctcttcctctctctgtcttcatctctgacccaggtagggtcaggccaggaatcaagcgaaacagagatataacacagtctgtatgaaggaccctgttctgggacctcacatagactgcccatattgggtgtcactggtgtcacaaacaatgaatataaagtccctgtcctccaggagcccccgggctaatgggagacaggatagggagacacagcatagtctcagctttcaagtcgctctccagctaacgtggtcaccgccacactcaggaaacatccaggccagagtgggggactgtgctggtgtacataagcatcatccagagttaagtagatacagccccagtcacggcacctactatgtgccaagcattcgatatatgtatcagtgttttcaaactgtggtgctggagaagactcttgaaagtcctttggacaacaaggagatgaaaccagaaaatcaatcctgaatattcactggaaggactgatgctgaagctgaagctctaatacttcggccacctgatgcaaagagccaattcattggaaaagaccctgatgctgggaaagattgaaggcaggaagagaagggggtgacagaggatgagatggctgggtggtatcattgactcaatcaatggacacaagtttgagcaagctgctatcaactcaaactactatctcgaggagacagcaaagaacaagaaagcctggagtgctgcagtccatgcgatctcaaagagtcagacacgacttagcaactaaacagcaataacaacatcgtatacatggtcatcatccaagtggtgcggtctcaaaactgtgttatcatcaggggtggcaactgaaaaatgacaattttgaaataactaggtttgtttacttgaattcctgaacctgaacaaaagggcttcacagatcacagcgatgcttcttcagtctccttgctcccaccctctttctcctcacacattgcagctgctcccaaacctccctcctctcttagtcttgctcctgctatatctttctctctctgtcttcccaactctacaccacatttgtctaaggattattctgacaaatcagacgcctcattggaggctgagagaggcacagaaatcaagaagatcaagccagaatttccctccagtgtgcacggggaagggaatgcccaggaaagaatgtgtacttgggtgctaagtcgcttcagtcgtgtctgactctttgtgatcacatagaccataggctcct

SEQ ID NO: 26352 - DNA, 1066 bp, Bovine  19866881061699
tggagagagcctcccgttttccgggggaggggggcttggcgggggtggaggtctggaggtcgcagaaggaaaaccagtgggatgggagcccacccctcaatgctggctcaggccccaggaaggggagggatatagggggctgtggtccaagatgagggggaagcaaatgtgccatgcagacacagagatatgcccacacacacatgcacacccagggacacccaggcggactcaaggacaggaactgctggacacacccacatggggacaagggaagaggcacgctgccactgcacaggggagctcagaagggtgggacacacccatgggagaccaacccttgcataggcatagggtcacggggagatgctctcatacacaacaaggaggagtcgctgtcacccacacagaaaaagtcactattgcctgcatgcatgaatgcagagcaattgcacacggccacacattacaaaagaccctgtcactcacaggcacacacgtgctcgcatgagcccagtcacacaggcatcatcgccttgccgtgacagtcgctgtcactcggtcaaacgcaaatgcagttgcacatcaacacacatatacacaactcagcaacaagtattttcctggactcttcctgtggctttctgaggtgctgtgtaccacacaaaaaagaccctgctcccataatggtggaaggcacgcagtcactatagataacattctctgtctctttcccttgtcatcccaccccctagatggtgagctccttgagacccaggagaatcactggaattgctctggatcccacccagagccaagcatatgaagtgctctgtaatcctttgtaattgattgactgtgggaaccctgcacacaggtgcaggcatctgcacacagtcccaggggctcaggtgcaggaggcactcagaaggttcaggaccacacagtcacaggtctacacccctggatgcacgcactgtagctgtgcggccaggcacacccctagatgtacacgcagtcgtagacttttcccctcaagcttcctcctgccttctttttccaggct

SEQ ID NO: 26353 - DNA, 1917 bp, Bovine  19866881090241
gacagtaggagtccgtgggctactgtcccagggttgcaatgagttggacatgactgaggcaactcaacatgcacaagaaaatattcttggggttccctggtggcttattaataaagaatctgcttgccaatgcaggagacgtgggtttgatccctgttccaggaagatcccacatgccacctaagcctgtcacaactgttgagcctgtgttctggagcctgggagctgcaattactgaagcctgcatgccctatagctcatgctcaccaacaagagaagcccccgtaccatagctagagagaagcccccgctctccacaactagagaaaagctcagaacttcatcaacaaagacccagcacagcaatatataagtaaatgaaaaaactctttaccatctgagccactagggaaaagaaagaaaatatccttgaatacttttgtttgtgattattttaagctcttttcatcattttccaggaagttatcttttctactgatttctcctctcatgggtctcctggaaatgcagtcccctcttgagttccagggttacccaggatcttacctgctcctgcaggtggctgatgctttcctcatattgggagtagtcttgcttattgcctgaatctctttgctgatgccacttcaggatgcagctttctagtttcacattggcctcctccagggcgcgcaccttttccaggtaggtggccaggcggtcattaaggttctgcatcatctccttcccatttccgcctaggagggagctgcctcttccagacctccaagacccttcagggagtggacagctcggtgaggagaaggaaagagagatgcgaacacccccggcaccaccatggacactaggagcccgggggaagctccctggccggccccagctgcctcctgtggcatagagggaacctgagcgcttctggctgaagctctggttggaattcatggtcccatctgtgtctggggcaggactgggctctggtccactccctggcaccacaaaactgagccgccccagactgccccagatggctttatgccctttgctgtgggagttcccttttctgacagctgtaccgacaagatccaatcattgtgcaacacgtgtttcctcttggtcaatcccgaagcgcccccgggccttcacacacgggctgttgtttagagtcgcatcgatataccaggttgcttctcccttccagtggtaacctggaggtgtggcccacggccttaggtgggtgttagtctcaggtgtctttccagtctgtctgtgggttttttccattgtccatttatctggaaaagctctgattaaagtccacagaaaggtgatttggggtggcatagatttcctttgaaaaagtagacattaaacacacaaacacacacctgcccctacccaatccccaaataaacacaccccagctctaaagcaaggatgggagggactcgtgatgcaagagccagatcaggacagaatctcaggtcctggatgaaaatacttgtgcagaggaaaatggagacaattctgaatatctgatcctctgtcgcagccgctgttggatggaaagtaatttcaaaggaatcattcttaagaacaaacccacaattataattaatgaatgaatgaccgaatcttccacttccaggctgcctttcatcccagcacacctcaaaaccaaacaaccccagcctgtgcccaggactttcctcggcccctgggaggcagatagcctttgttaagtggccagcagctctgataccactgagccctggaaagggcatctatggcctgcggagggaacagagggaaacaggaaatgtgccatgggttgtcgaacacgccttgatgaatcctttgctttggctgccaaggtaaatgttaggaatgaataaagaa

SEQ ID NO: 26354 - DNA, 655 bp, Bovine  19866881099724
ctgttagggggagggggcgctgtcctaagtcgccgccgccgctgcaacatctgaaagtccttttctgccgcaggaggaagcggcgcagtttggaagccacggcaggggccgagagcgcttccgaactggggccccggggggcagcgaagggtgaggaaaagcgaaggcgctgctcctcggttcccccacccccgaccttggaggattctcccccggacccctgagatggcctgcggtcccacacgctgagagcgcgacgacctcctggccccaactcccgagtccgagattaagtctccctggccggagagagtcctttccaccccactcaagggcttctcgtctcagccgctggagaactggtccggggaggaggggaaaaggggcccagaaggttctgacggccctaagaagttaatgggctctctcctcacttgcctcttccaacctgctccggcccccagcctcctcggcggctcattggaggccctgtcccgtctggcttacccaggatgaagtcaacagaactcccacctggagagggagatgcccagacgcttgctccttcctggatgtttgcttctactgccccaaatcggctgaggagattgccactctcaaaggcaaagtgtgcattgcacaactccagggggca

SEQ ID NO: 26355 - DNA, 1353 bp, Bovine  19866881102021
tcctagaacttatgaagcccctcctcatccccacccccaaagcttggctcagctgcaggtggccaaataggggccaactatgtctgttccctgactcctggagtggccccaagtggccctcacctttggcctccttggccttgatagacggtgaggttcctgctctgggggttgggagggggaagggctggggctcagggttcccgtcattgcaggcctggcagctaccctaccggctgcagatggctcccctgccagcctggcggccagcgcaaatgctttacagctgtacctctatggacttgcctgagagcctggagtcagaggcagggagctggggacaccgagctgtggtgggtgggggacaggccaagacagcagtccagcaaacccatggtgctaagatagtgagggcaaggaaacttgagatccaggaaaggcttccccgacgtgcagggcttggagtggaagcttcccgaggaaagatcgagtttcgggtcctggaaggtccagggctcagggtccctgtcttccttctgggtcctggtctctgagcagagccagaagcttctaagttgaagcagcagggaggggagcctgtcctcgtccccacccaggggaaattggaccagactgctcaggaaacaaattcaattttccagcatcatggaaggttagtcggacaatagaggttttttccccctaaaaacataagaaaaaaaaaaaagtccaattgcttttggctgaactgtttcccaacttcatttctcagcctcagttcaaggcttctcattcaaagtgacatgtgactgttcagtgaccctggcctgatcgccggccttgtgaggggtcaggccaggccagcctggagctcctgctcccggggtctgtgaccacccccacttataaaagccctgggcgggcccagtcctaagggagggactgtggtaaaagcaaaaagcttctcccgaagagattttgaatttagggctgagtgctaaatcccaggcaacaggcccagacgggtttatattaaaatgtaaacggacctgaaaagctttggaaagttttcttttcgaggggtggggtggggtgggggaagtttgcctttaaaatgcaaacagaccttgtaaacccctgcttgggaaatttaatggggctggaatgaggggagctggccttgcaggctagggaagggccagcctccagtcgtgttcgctgctgatggtggccttgtaggggaccctgggcactggcagaggaagagaggtcagcacaacctaaagaagagggaaggcctgctaggagctgggagagaacagggcttcccaagaggtagattcggaagttcta

SEQ ID NO: 26356 - DNA, 1197 bp, Bovine  19866881106740
gttcaataagagtttcttgactgaatgaaagaaggtgctggaaaatgaacagggcaaatgttataccctgcagtgaacaatacatttttcttatttttttgtaaccttgatgggctgatgtaaaaagaaaagaactataagaatcttttttgttgttgttaattattctaataaagtgcttcttttatttttttgatgtggaccatttttaaagtctattgaatttgttacattattgcttctgttgtttatgttctggatttttggccatgagacatgagggatcttagctcctgactggggatcaaacctgcaccccatgccttggaaggtaaagtcccaaccactggactgccagggaagtcccaagaatcttcttgacttaatctccagcctcaacatctttagctcagtgtttatcgacttcatcagaagtatttcacaaacctctctctacgcccttgactgtattgttggtgtcaagaaagtacacgtttcacattattacctggagaaggcactggcgacccactccagtattcttgcctagaaaatcccatgggcagaggagcctggtgggctgcagtccatggagtcgctaagagtggcgtcaagaaggtacacatttcacattattaccattcaccttttattaaaattaactttattaaaacaatactactcgattaaggtcctatgattaaaaatatgttctaggtcaatagaaaaaagtttattaaaggactacctcaggtccagaaagatgtaaggcaattttgatttgttatcaagacccacatttctacaattatttgtaattaaattttgttcaaaggcaagaaaaaaaaacaaacaaacagactcaaagttaatagggaatccaaagaaaatgaaacaaacagaagcagagattgaactaatatatcatcttactctaaaaggaataatttctacttataaatttcttgttcctaaggaactaatcatggggcagatcttgtgaaattttacatcagttcttcaatttccttaacttgggatgagaccacctcaccattcaccacttcctgcacaattgtcttgattttccgggctttgttagggtctaaagattaaacatggaacaaacggagcaaaagttagtgcttcaaatattcatctaacatttgttgtttaacttaggcttctaaattaggt

SEQ ID NO: 26357 - DNA, 3198 bp, Bovine  19866881124994
tttgggagtagtttttgcccattacccattctcactgaacccattccagtcggctggaaagatctccttggccctgaggtagaccaacaagtttagatttcaactgatttatttcaggaacatggaggcttggtagaagtagtcagatatgcagaaatccactcccaagctttactattaagagacgtacttccttagacccaatggctctgagaaggatccacaaggagccccagggctcaggaccatggctgctgaacctctgcttccagctacaggccttctggaacaggcaagacaggttctaaaatagttttcccccacccccacctctcactacgaaccagtgtttaggatgcccaccacctccagattgtggatgttttgctctggcaaggaaatcctattatggggataggaaattaggtgatggtgacagagaatgacagatgagccttttgcttagcaggcagagagaaagagcgagagcgcgcgagcgagcaggctatacaggattgggtggctctcctgtccaaagggcttccccttggccaagccccaccccaaagcccaggaagtccagagcttggcacccagccagggtgagagcattcctccggactctgacaggccgtgggggatggtgggtagtgctcctacggcgaggatgggggaggggaaggaaacgcgcaggggaggaaatgacttcggagggtaagaggtggggagctattatagttcttggtcccacgaatcccttttagaaagaaaggctgaggctgaatgtcttcccaacagccatgcgaagggtctgcagcttcagagcaaatgacccctaagtcacctctctgctcagggtcaccactgaagtcctgaacagtcctctggaggttctctgtctccgcgtccctaactctggggctgtggttgagctcgggagaccccgagtggcgaaaatctggaattgcagctggactgggggaggagtccatcgggtctccctcagcctctccaccagggcccctcccttttcctgcactaggcccagaactctggaaatagcacctggtaaccggagcgctgacagatgctgagttatagaagggcaagtgtcctttacgttctagcttcattgccttggagctgtttcgctggaaaataagtgccttaggactcctcccattcccttccacacatctctctttagtatgcccctgggtagtgtacctcttggctacaatggaagtccccctgtttgtgtcccaagagacttttagcctttgggttatctactatgacctctatgactctggagggacaaatggcacccgactattctgattttaaatttacccttccttttctgagcactgcttaatgtacaaccctttctcctagtcagccttcagtcgcataccttccattaccccaattcctacccaaaccctcagtctcacatcttacctggggaaaaggagtggagaagaaaatggacaaagtctttgtgagaatttttcccaaggaaaacggttccctctgtttagcttcacttgaagaattgatgcttttgaactgtggtgctggagaagactcttgagaatcccttggactgcaaggagatcaaaccagtcaatcctaaaggaaatcagtcttgaatattcattggagggactgatgctgaagctgaagctccagtactttggccacctgatgtgaagaactgactcattggaaaagaccttgatgctgggaaagacaaagcaggaggagaaggggacaagagaggatgagatggtggatggcatcaccgacttgatggacatgagcaagctccgggagttggtgctggacagggaagcctggcatgctgcagtccacggagttgcaaagagtcggacacgcctgagcgactgaactggctagcttttcctggttagtccccttgctctgcatcaaaccttaccactggactgatttttactgtcctgccctcccctttcctccaacatgatcttccagggctctacccatcctgggcaaatgttctcaacgctgggagaggattctgcattctggaaataatttgcagcttgaggaaacagcccatagaggaagaactgttttcagtgttgttggggaaagggaggtgatggaggaggccacaaactgaaggctcactctaggagaggtcacgttcccgttatccggcacataattaaagaactcagctggtattcggggatctccgagagctctgccaacatcgtgaagaactctagggaaatcaagtacaggtagtcaagtttgcagctagggattaaaactctacccaactcctcctccaaaacaatttcctttcacgatatccctcctcttgaatttgcctcatcttttagttgtatgatccttaaagctatcagccagggagttacgtgggtttgaaataatcttaagtagaggcagcaacagcccccttttgcactccagccctcaatcagctttcctctcctccccatgctgctgctccacattcaccctgaagggggcacttttgttcagtcgttaaaagtccttttgccagcgaaaaaggagccgaagaaggaaatgtaacaattggtcacgtgttgggcgtggggtcctcgcagaggtttctgggaagggaagggaggtccacgtggagtgggcgggactcgctgaaagttttggcggggctggcaaagggagaaatatgcccgaatttgagttgtgattttatttgaaaaaaaaaaaaaaaaaggcagcagagagggtggagggtgtgtcctgcggagaggcccccgcggaggggagaaggggagcggcacgcaagcatcctgctcgcggaagcctggaacgcagggcagggtatttgccagaaagagctctgggccggtgccgagcttcagagccggaaacttctgtggctccatgctggttccccatcccccaatcctccagaagggaaaggtagcctctccacccgtggtctcatttcggtgccctgtggagctgggctactgccagctacgcagccccagtctttatttacctttccgagagcctcaggaagctgcagagatgaatcttctctttctgggaagaagccaaagcaagtctctttttactacttagttctaccccactattagtagggaaaggcaacttcatgcagtcttaaag

SEQ ID NO: 26358 - DNA, 2731 bp, Bovine  19866881145621
gttcaattcccggggtcgggaagatctcctggagaaggaaatggcaacccactccagtactcttgcctagaaaactccatggatggagggtcctggtgggctacggatggagggtcctggtgggctacagtccatggggtcacaaagagtctgacagaactgagcgacttcactttcactttagacagaagagaatggagagctagaagaggtccctgtgtaaactgattgataacagcagagagaagtctgatagaaaaaccaaaaaggaaggaggattttaaatggattatattataagtaaattgtatacccaagactgaaagtcctgtctaagggaattttaagacattccagaagcaacaaaatcaaagtttaagtattaaccaggaataaaacagttttgactaaagttagaagcctcagctctggccaggattaactaaaaaagccaggtaactatgggttgtagtagcaagtaccaaaacacgacaacacaagttacatagtgatcacaggataattttctaatggtacacaaaaatgtttagtttaatagttacatattcatgggtcttttaaaatactataacagtgcatctcagtcccctaattttacagatactaccgcttaagacaaagctaaataaataatattgggtatgactcaaaaagtaaagattatatttagttgactagaatttaggaaatactagagactgtccaggcttcttgaagagttaatatagaaggcctaaaggtgtgacttatgtcaagttaattggcacttagaacctcactatatcacagctagtaacattcagtatccctcaaagtctaataaattgactatagtagacactgagaagggggtactatagaaaaaagggaacaaatgcattgtaaggggccataaccaagagaaatcaatgtttggatggtggcactaagaacttacctgctcgagtgttgaaatgaaaagaacagagtataattgaggttgatatttatcagaaataaaggttttgattgtcttctgttatgattagatcacaacctcatatatgatttgactgcccccttgtggtaatttatatttatcagtggtttagggagaagacttggtgtccaccaggatgtacaaatttatgcaaaaagaccttataagttccagttttaatcttttgacttaatatggtaaaaactttatcctttcctaaaatattgctcaaaactactgtctctgtgttcacatttgtttaaatagaaaataagcctaagaaagagtaatttaaagttctgattcagagaggatatgattcggatcctgtgaaggcttggaaagaagcccagcaaaaggtaatttcttggttagcattttctatgttattagagattgtgtacaatctaatgtctatatttcacatttcctattaaagatacattttaatttcttgtttaggttccggatgaagaagaaaatgaagaaagtgacagtgaaaaggaaactgaaaagagtgactctgcaacagattctggacctaccttcaactaccttcttgacatgcctctttggtatctaaccaaggaaaagaaagatgaactgtgcaaactaagaaatgaaaaagtgagttgttgctggatagtacatgttgcttggttgtattctaatggtgaaagaaaattgtgggctttgggaaaatgctgtttatgcacataaattaactcttaattttctgactgtcttatgaaggagcaagagctagaaacattgaagagaaagagtccatcagatttgtggaaagaagacttggctgctttcgttgaagagctggaggtgtgtagtttataatgcccatgttagaatttgtattaatgaaataagctattctagcaatatacctcgtcaggaaatttcacagttgacaatagaaagaatatagggggcataagtaaatggtaccaggaaacacactacctagaagttttcacaggaagaggggaaaggacaaaagttgatttttgacctattgggagtgagaatttaaatgtagaagaacaccaacccagcccccgaagtaaacctgaaaggacaaagacagtttccttcagggctggctaatcagtagtttaagaagatcctttgtttccaaatcagtaatactgttttgcaacattatctttaacataagaaaaagtatcttaattccataaattaagctaaaatctttaatgtgaagatttatgttattgcacttcagtttggatgtctagcttataatcggtgattggatacattactggaatcacatcctttctgcttatttgagtttataaacgtatacatttatgtgtatgtatatgtattttatccttaattctgattccccattttatcctcaaaggttaagttgtagaatcaaacgtagaactcagtcttttatctccacttttcaaagtgtgccttaatgtttgaacagcttatcacaaatttacctttgagatgtaacaaactgaaatcagtttaatcattgccttttattctgtccctagggataaagtgacatctatgctgtaatgtccttgttaacttatagacttgctttcttttttttttgatgtgaccccattgtatatatatattttttaattgaaggataattgctttacagaattttgttgttttccgtcaaacctcaacatgaatcagccataggtatacatatatccc

SEQ ID NO: 26359 - DNA, 947 bp, Bovine  19866881163898
tttctaaaccctccggttcctgggatgtgtgggtggggaggacacattagttatgagcattgagctgctctgcatcatttcactgtccaagtccaggaatctggtttttgttgttgttgttgtttgaaatggagaattgactcaggctttaaaaacagatttactagttatctgtcttagatttatacagtgtcattttcggagatgttaaagtactgtggtttgaagtttgtttttaattttgacagtatgagagggcacattctcttctttttgtgttctagatcgttaggccttacaatggagaaggaaatggcaacccactccagtgttcttgcctggagaatcccagggacagaggagcctagtgagctgccgtctacggggtcgcacagagtcggacacgactaaagcgacttagcagcagccatctttttaatgaagccattcttcacaactggttatttaattgaacacaagagtagacttctcattgatttgtgttccttttagatgagaggacttggttgccgtgttgccctgtatctgggaatcatacataacctttggaacctggtatttgccacatcaagtagtctatgcatatgtaggcttctgagtttatgtttttcaggcttttgaaaaataacttgggacaagaggaaagagtcttattagggggaaaagctgaactcttggatatataattttattcttattagaaaaattatgtttgaaagattattgtcataaagttatatatttttcttctgccttcccggtggctcagtgggtgaagaatctgtccgaaatgcaggagacacaggagacacgggtttgatccctgagttggaaagatcccttggaggaggaaatggcaacccatccagtattcttgccgaaaaatcctgggacagaggagccggcaggctatagcccaggagtct

SEQ ID NO: 26360 - DNA, 1327 bp, Bovine  19866881165545
atgggtgtgcaaagctttaattctgcgaacacatgctcttgtacacatcggaccagataagcacacacggtgacacgtgtagtacacaccctgttcagttctaccaccactcccaggctttcgcattcctgtctctgcctggcccatgcacagtaaacagaggtggggcattgtccaaggagcctcaacccatatgttgcctggtgccactccccccaccttgttactttaaccttgacgtgcttaccctgagcatgtctccatacccgcctctacctgggacagtctatccttagcgacagaatgctttgggcataggcatcagaaataaggattatctggagtgcatattcggtaccacttccccactccatggctatgtcacctctggagggtctctctatgcctcatggtgttggttggcagttctagagcttgtcacccatctccagggctctgcttcgtcctgctgccagtaggtgaaagtgcccttgtgctcctggtctcgctctccctctgcctaccatctcttctcctcaccctaattagacttgccacaacctgctgctctctgcttggctcctacctgcctgccagtacctgcctctcacaggccaggccctcaccatctattgcgccctaccagaaagggcagatgggtggtgcccccccttttccctccccccttccaatgccagttcactcgaggcctacccagccctttttacagaaggaagataaagaccacatactccactgagtatggcaacagagggcacagtcgagatcgagagtgatggacacccaatcagcaatttttgtaggcctccctcacttgaatacaggcaggtccatcaaggtgtgcagcctgattttttgcagtgataccaagagtcctcctaagcctcgagccaggaagctccctctccactggtaaatggctccctcacccttgcctttaatgtctgcgtctactccgaacccaatccattcagccccttactgtttctctcacggtcagccccagcgcccaagttcaagcctcgcgcggcccaagtgggcgggcccctgaagggtaggggcggggactgggcggggactggaggagggggtgcggtctcagttctgccaccttccccccggccaggagcgcagccgccgacgccgccgccgccgcgtcctcacagccttgcgctccgcccgctgtctctgccgccgcagcccggcccaggagcgcagagcctttgggcaccggccccgcagcctgcccacccttcgggccgcgtgcgctgcagccggcatggggggccactgagagccggcactc

SEQ ID NO: 26361 - DNA, 1478 bp, Bovine  19866881330205
acaactagtgaaaacctgcaggcagcaacgaagacccggcacagccaaacataataaataaatacgtgaaaatttataaaaataaatatttaaaaaagtttaggggaaaaaatcctgatgtaatcaaggtccatgcattgcatctggctgttagatctcattagcctcttaatctagaatagcttcttttttagatgacattgacttttcagtctagacagatatcttgtaaatgcatgaattgtctgattgtttccccaccgctcttctttacttgtaccttcatcccctccgtagagtctaagctactggttctgtctagagaggagtgtccaatacaaatataatgtgagccatgttggtaattaaaatttttctagtactcacattaaagaagtaagaagaaacagataagttaattgtaatattttatttaactcactgtatccaaaataatgtcatttcagcttgtaatcaatataaacgtattaatgagacattttactttcctttttttgtattaagtctttgaaacttggtgtgcagttttacttgcaacatatgtggattcagactaatcactttaaaatttatttttaattgaagtatagttgatttacagtgttgtgtcaatttctgctgtacaccaaagtgactcagttatacgtatatatatacattttaaaaatattcttttccattttggtttatcccagaagagtgaatatagttccctgtgctatatagtaggactttattgcttatccattctcaatacaatagtctactaaccccaaactcccagtccatccctccctgaccctaacctcccctggcaaccacaagcctgttctctacgtctgtgcagactaaatcacaatttaattgatcaaccgctaccagtgactatcgggctcctagattggaccgtatagttctagtggttttctggagcttaaatattctagggaagaatactttataggtgatgttgttaatagcattacaccaggaggcaaatagtgtccatctggcccctgttagtggtggctgaggttgactctgtggttaaagagacgctgccaggtttctccattaaaaagataccgttcccccactgcccccgctttgcagttagtatgcagtgatttttgcatatggcaaatatcctgggtatcccaaccattcactcttgttcaaaagttatttttaaatgtattgtgtaacatttcaatcatacaaaaagtttaaagacaaatataatgaacaccggtctccactcagtttaagaaatgaaatcttaccctacacctgagatccctggtaccctaccccagtcacatccttttcctttctccccagaggccactacttttctgagcgtggtatcattttcatgcatttctgtaaactttcattacatatgtatacatctcaaaacagcatagtgttttgcatttagggggaagtagcagttt

SEQ ID NO: 26362 - DNA, 1217 bp, Bovine  19866881336927
taaacgtatattaggggagttggggggtgggggttggtttggttgagtgtgtgtttttctttttttaggacttgtaaatttgtgttatttaattctagtttgtgagataacttgaattttttttctctcctctattctttatttccatagacatggatggataacatggggaaagctggtgagatggaactcaaagccctttagtggagaagattatacatgtattaccttccaccctgatttgtctaagtttaaaatggaaagcctagacaaagatattgttgcactgatggttagaagagcatatgatattgctggatccactaaagatgtcaaggtctatctcaatggaaataggcttccagtaagtattttactgaatgtaggcaatgaggtactttgtgtgaccatcatcaaaagcaaagttgatttttttttcctcccatttgtttttcttagcacttctcagatatgttctgtaaagaaaacataatgccacattttaaaaaaatcagttaacttattttaagttcactgaagtctttctcaaagaatcttctaactaaatccttttgtgtcctttaatgaccaccctcttatacatatcagtgaacaccgtttcattagttttgaaaaatctttataacctactttttcatttacttaaaaaaaattaatactattattttttaggtgaaaggattccgtagctatgtagatctgtatctgaaggataaggtagatgaaactggcaatccattgaaagttatccatgaacaagtaaaccacaggtgggaagtatgtttaacaatgagtgaaaaaggctttcagcaaattagctttgtcaacagcattgctacttccaaggtaattttatttttgaattatcaatcatgattatatttacatatttcatataagtattcttgttttaaatatataaaatgaacttgaatatttggctaccttggcatcaagggaactaaattagcttttaaaatgtttgattattattacaattttgagggtaatggatttacagtttggtatttttcctcattagggtggccgacatgttgattatgtagctgatcagattgtgactaaacttgttgatgttgtgaagaaaaagaacaagggtggtgttgcagtaaaagcacatcaggtataatactttaacactgttctttactgaaagtcaaggaagaagcaaaagt

SEQ ID NO: 26363 - DNA, 721 bp, Bovine  19866881371783
ctgcccctctccttgtcctcaggagtagacgtgccttcttcccattctgttggctttctgtcgtatcttcaaggtgtgtctcctctgtaatcacacatttgtcactgttagttcccagacaaaaacgaactcttctgtgctgacagtccagagccgcagcatccaatgataaggtagtcgctcagtacaactgaatacacataccaagccctgagacgggctagtgtgaccaaggaactttcagcatgtttaaaacaaattggaatttggaaaaaaaaaaaaaatctactttttaactgtaaattttgaatctaaatacaaatcaagtatttctgctgaaaatttagcttccaaatttcaatgtgctttaagtctaaagtgcacactggtgtttgaagagttatgaaaattaatttcatttaaatttcattaaaaggagtcggtagcagaacatttctaattacacagggacatatttctttggacaatgctgcgtgaagtacttggatttaatgagtgagaaagcacgtaaggaaatggtataagactgataaagtattttgttataagtcatggtaggctgttttctgttattgctccaatagtctgaaatgattttcttcagtttttttttttttcttcagctaggaagataaaaatttgagtaaagacctatggtgggggtgttttagtcactaagttgtgtctgactctctgtgac

SEQ ID NO: 26364 - DNA, 1093 bp, Bovine  19866881374414
ttaactttgctgtagctggtaagatctttactttataaaataatttccattttctggcaacgttgcaataggtttgaaacattgtatagtatacacgttcagtgaactaggcctgagactctagaaccctctgatattttaaactctcatacacttgtgaattattttcattgcaacttattcatcaaatgtcttcattagctgtagctcacagttcgcacttcacatgaaaacaagtaaacatagtgtttggcagcctgaaatataaaatagaagctttgagtataagccagtgctttcagcgttgcttcaccaactattcgtaacacttggtactacatggctgctagggcaaccttcctgtagacacaggagcttggtttttttcctgccgtatatatgaatacagttcttggccaagaaaacccacttgtgaaataagttctctgactcagagattgtaagaaaagaacgtgactaagagagtgttttgttttctgactactagttgtgtggtttgaaagtagaagtggatatggaaaaaattgcggctgaaattgcacaagctgaggagcaggctcgaaaaaggcaggaggaaagggaaaaagaggcagcagagcaagccgagcgcagccagagcagtatcatccctgaggaggagccagcagcaagcaagaccgaagacaagaaggaggacgagagcatgccgatggagacaggtagcctgccaggtgattacagagtaaatgttgagggcttttacagctgtctttaattctgactttcctttctcagtgctttctggaggtcctgttaatcttgcctcttgaattattctccatattacatgcgcattctttcttcccaaatcttaatctcttataatagattcacttaaagtgttggtattggtacaaaatagcagtgatgtgttgcctttagtctggctgtttgaggtcttgggtatttgcccagattgagtcatatcattccctgacttgggatataaagtactgaatgtagggtttaatggttaagggtgctggcctggagggcccacagatgctgggtactgtttcaccccatgctagca

SEQ ID NO: 26365 - DNA, 910 bp, Bovine  19866881413421
acctcttgaaattgagttcccaaggataaagaagcagatgtacataaaatcatcattactggctttgacatggtattggcactcagtattttaacctttattgctaaaattgtttaaacagcatgtggtccttgcccttaagatcagtcctctttgctgtcctagaacagagttgggcaaataaaacctgcaggccaaatcctgcctgccacctatttttataaataaagttttattggaaccgtttgtttacacattatctgtggctgccttggggctccagcagtgtagttgagtagttgcaactgagacagcctgactcaaaaaacctgaaaattttctatctagtctttacagaaagtatttattgattccatcctagaaaaattcatacttccagttctactgattttcctgactaaaagcatgcctcaaggcaaacaataacatgtaaagcttacgtgaagtactgattaaatcaattattggttgaaatcttgggatcgccctgcacgctgttttgaccctgcccagtgcgctggatagtaaacagaactgagctggaagcatgggaaacacaaccaaaagctccctggactgtcattacaagggctgagagggcccagagtcaccctgggtgctctgctgacagcttctgatttgacatctggaaaacatgaagtggaatatgctagctatcttgaccagatatttctacagaatgtatcagcatattaacatttcagatagtcagattttaagtttaattatctgaatctttttctgttttgtgtgaacgtgttttttatcttaacaaatttggagcatgaacacgttttgtggttaaagcgagagcgtgagaacgacagcatggttccttcactccctcggcagctgggacactgctcag

SEQ ID NO: 26366 - DNA, 730 bp, Bovine  19866881421256
ggcctactcaggcctcagggatttctcctagagttgcaccagctgctgttggccccgtctggtcatccaaatgccccctagattctgaagttcctcctcagctcttccccccacccagtctccagcccagaaaacctccagctctctggccactcagaaacccccgtttacctgcctcccctctcttccattcagagctgaatggcatggtgttgctgtgtaaggtgtgtggggacgtggcttcgggcttccactatggcgtgcatgcctgcgagggctgcaaggtgaggcaaggggagggaagggcaggggcaggtgaccctctcacacaggacacatcttggcctggaccaagatgctcactcgctgccctgctccacagggctttttccgtcggagcatccagcagaacatccagtacaaaaggtgtctgaaaaatgagaactgctccatcgtccgcatcaatcgtaaccgctgccagcaatgccgcttcaagaagtgtctctccgtgggcatgtctcgagatggtgaggcagcaccatggccccgccagcttccccgcaccttccccctttcttccactcgaggtttctgaattagtccctcccttaaaaagtcccaagactgtgcgtctcgtctcgtttgcagagggggtggccacatttcatcagggcttgggtaaacacacacttctttcccagttagtttctctggtcccctcctaccacaa

SEQ ID NO: 26367 - DNA, 1084 bp, Bovine  19866881603801
ctgatctgatgattatctctaagtcggttctaaaattttagtaagattaccatcctggctcagacggtaaagaatccgcctgcaatgtgggagacctgggttcgattccctgggttgggaagataccctggaggagggcatggcaacccgttcgcgtattcttgcttagagaatccccatggacacaggacccatattggctacagtccatcgggccgcaaagaataggacatgactgagcgactaagcacatcgtattagcctgcactttgagggagttgatggctggggtgggaagacacatgaagggggaagaaatgagaatacaggggaaacactgtagtggtgcaacactaaatcctcgggcttctcctccgccctttagcttaaaatggactgatacaacaaatctgaagcagcacaacggcttcagaggtttcccttgattcgtaatttttactaagcaaacgaatacagtcaaacaatctgcttcaaacgtaggtagaaatgagagatggaaaaagaatatcatgaaacaactctaatgccgcagtgaagctgtgacaggtcaccgctatccacccaagcccaagatggccgggcaaggaccgtagccgacagcccgcccaagagcaactctcctcgcccggggcccaaccgccgggaagtcagaggcctcaccacgccccttcacatcaccgaatacgcaatcccgcgcacccgcaaacgtgccgcagccgtgccagctccgcccccagcccctccccccgaaaagcgaggcgaccagcgccgcaagtgaagcatgctgggaccagctctcaagcctcccggcagcccctgcgacgggcgcggtacgtcaggatctggcctgcggcggccgttctccgtaagatggcggaccggcggcggcagcgcgcttcgcaggacaccgaggacgaagaatctggtgcctccggctcagacagcggcggttccccggccgggggcggtgggagctgcagcggtagtgttggaggcggcggcagcggctctctgccttcccagcgcggagggcgagctggggcccttcatctgcggcgggtgg

SEQ ID NO: 26368 - DNA, 775 bp, Bovine  19866881609261
atacagatagcttttccaggaaatgaaagtcatgcagggtgcggccggggggaacgtgaatgtggagataaatgcagccccaggagtggacctcactgttctgttgaacaacatgagggctgagtacgaagacttggcagaacagaaccgtgaagatgccgaggcctggtttaacgagaaggtacatgtagcaaatcacaggccaagggtttgttcaggagaccaccaagcgggtcactaacctatctgacaattacgcttcagagcacatcgctgcatcagcagatttctgacgatgcgggagctgctacggcagccagaaatgagctgatggaactgaagcgcaacctgcaaaccttggaaatagaacttcagtccctcatggccatggttcgtaggcgtcatcgtgacttgaatgtgtgtgtgtattaagtaaatacatacatatatatgtgtatatgtgtgtgtgtgtgtgtgttgttgttgtttagttgctaagtcatgtctgactcttgcaaccccatggactatagcccgccaaactcctctgtccatgggattctacaggcaaggatactggagtgggttgccatttccttctccaagggatcttcccaacccagggatcaaaccagcatctcctgcattgacaggtggatgctttaccactgagccacctgggaacccaaatgtatatatgtatatatactaacatataactgaatatatataactaattatatatcgaatatatataactaattatatttcacta

SEQ ID NO: 26369 - DNA, 1836 bp, Bovine  19866881664555
ttagtaaagtgcctggcatatagtaagcatggaatacatataatactaacatactacagagcagtagcaaggggctgttacctgacttcttcctcctgagtctgccctcgaagatcatgctcaaaaaagagccctttccggggtatgtatgctgggttcttccgatcttcatcatcatccaaatgcttagggccctttttaccaactttgttctccacaggctctgtgctttcctgtcggacagataaagagctctttactcactccaagtttaaaagcccctgttccagaattcgaatggaaatggaggcctttggtgggtactaacctgtccatccccactctgcctctctccagtcacagtgcctttggtgtcaggcttttcttctcccttctcatcttttgctgaagaattagcagcatcattggcttctgatttcagctccactttggagttttcctcttcactgtactccccgtcatcaccctgaaaaaagtttcctggtacttccttggtggtcccatggataagactccgtgctcccaatgcagggatcccaggttcaacccttgggtcagggaactagatcccacatattggcaactaaagagtttgcatgcccaactaaagatcccacatgccgcaactaagacctggtgcaaataaataaataatttcccttttaagtttccctgttagctatggagataagatctaaatagcgcattctaaaatttttcattctttaggaaaacattttctaacaaattttactataatgcaaggattaaaagcaaacacttcaatgtttttactaaaatttctactgaatagaagcattgttaaaaaaaaaaattaaagccacattaaaaaaaacctatacagggaattccccagcagtccagtggttaggactctacaccttcaatgccaagggcccaggttcaactcccgggagaagaatgaaggttcatccacaagctccacggcccagacaaaacacacatgcacacatctatgtgtgcacacacacggcttcccaggcggctcggcgataaagaatctgccaacacaagaaacggggctttaacccctggggcaggaggattccctagagaaggaaacggcaacccactccagtattcttgcctgggaaatcccatggatggaggtgggctacggtccatggggtcacaaaagagctggaaacaacttagcgactaaacaatatatatatgcacacataaacaagcttatatagatctctgttaagttttccagtaagatatgcatggaactgtcaggagcagcagcctctttcactaagcttactgtaataatcagttcaccatgtaagtcaaacaattatgctgttgttacaccttaaacttatatagcacaattttacctcaataaaactgaaaggaaaaaaacccaacaaaacaaatagctgcagcctctggggaagaagcccagggcctatggatcagaggcttttaggtgtctagaccatacagaagaagctttctttttgataatttctctcaatacattgtctcttaaacatgcagtgcctaataactactcaagctgttaattctctcatctcaaaatgtcttacagcagagattcccaaccttttagattacgtgaatccccttttaggacctaaaattttcatggaatcccatgagatatagcacagtatagtacccatgaactgagaaaacacataatgacaaacaactgctataggttcaataatactttaaaatacattaatatatttttattaatttatatatattaaaaaatagtagtacataaagatagat

SEQ ID NO: 26370 - DNA, 1078 bp, Bovine  19866881677913
agccgcctggatccactagaaagtcgaaaagacatggcgacagcaccaaacgaccctttctcagagaggagcaaggtcaaaagacaccatccatggaagttagctctgctggccttttataggacttagtaggtcatttcagccttaactatgtcgatctgtaataaaatattacttgcatgctaattgttgtttttcataattgggtgattttttaacagtgtccagtctgtaggtggaaagctggcccaaggatatctttgtatacgaaaaaggtgccagatacagtaataccaaatcatagttttaaaagtcaatattacatatgagtcaatgtacatctttttgacctccgaaatatattttagttgttttttccttccaatataacaaaagattcataattcaaatgcacaatgtctaatgcttttattctataaatacttatgaagtattttattattcatgtgttattgaatgttttctttcttattcaaatcaggtgctctcaatatatagtgatcctttggtagtgggagctctctaattgattaaaaaaaaaacataaataaaagtcctgcagaactttgcttatcaatttaactaaaaattagtgagtatgtgacattgacagaaaaattacttgtattgagatttcttggttttgtccaggaacagaatgtctattcaagtaacttctgagcctccaaattgctcctttttctaattcaaaaatattgtttaatgttttatagtttaaatgtatgtatttaagacattatgaatttttttgagaaatgagcttcatgttggtgcggagggagtaaaatatatgaaaaagagggggattttcatcactacttagaaaaccaataatcatggtactctagataaaagattagttgtcattggtgagcagagtcttcctccttctgctttgatgcccatgggaagtcatcctgtccggttgttcttcttttccctgttgggcaaatgaaaataataacgtgaaaagtctcaaatgaatgttgagcagttccaataattaagattacaacacagtggagggcacaaacat

SEQ ID NO: 26371 - DNA, 1729 bp, Bovine  19866881692330
aggtgaatgacgggacctccctcgatcctgcctgttaaagatataccttccttcgtctgccttttcaaccatcttgtgttcagtcttcgtttctccaccccctgaaaatagtagaactaacccatgtcttctttccttcaggagagtgaagatggcatcgagggcgatggtgagtagcatcatgatagagatcttcaaactcaggtcacctgtctgcagcagttgacatcttctcagactgttaagtggagaaggaaatggcaacccactccagtactcttgcctggagaatcccagggacggaggagcctagtgggctgccgtctgtggggtcgcacggaatcggacacgactgaagcgacttagcagcagcagcagactgtgaagggttttggggagggtgccacaaaggggttctttgtagtttaatgttcaagagcttaagttctagttgtatgatcttgggaaagtcaaagtcactctttgaacctgttttccgtctgtatatggggactataatttcatctacctcataggttgatgtcagaattaaatgagagttttagcttgacccacaacaagcactggaaaatgtaattataaaatttctgttgcattttttttttctttatatgtttctgttttctttcagctgttctttcggattatgaaagtgcagaagactcagaagtgagtgtgatagattctttttcctatgatgtaggttggaaaatgtgttttaaaagttgtacccacctgtggtttgaaagcatctgacctgtttgttactccgcttgtgcattcttcatttatgcttctgaaaaactattatacaaagtgttgttcagttatagagagggaaactttgtataaacctcttcaggccacatgtgttacactgtttatagctgacctttcaccctatctaaagaaaataagatgctaaataagagaatgagaacattctttggcccttcacaggatgtttgacactccattttatgatgcctaggtggtgaaaccagccagttgggtattttttgagtatgtctgaagacctcagaagggtaggattctgagtggtttgtgtcagaaacatttctcggtttacagatgaggttttctgtctttagcagaaagtttccctaagccaaatgtttgtgaacttagtttgctttgattgggtaaactactagagatgttatcagaatggctacttgtttcctggaactgttgaatagagctctgatttatacagaaagaattggattgtggatcaaaggttcattctgtaaattttgtagaactgttgctacatattagatttaccattaagccctggagatgcagaagtgaacactataacaaagttcctatctttcggaatcttacagcctactaaggaagtcagaccgacattgaggaaatcataggacttggtgacaactgctgggggatagggttaaatagggtgttaatgactgggtactgattccatattaggcagtcagagaagaataaattggagttagccaggcaaatcatgttctaggcagagggaacaacagctgcaaaagctcagagataggagagaagattgactgtctggaaacttgaaagtagtttggtgtggctggaacatcgttgggacaggatggataccagaaataaaggcaaattatagagtaggggtcagatcatgcagggattacttcttctttttctttat

SEQ ID NO: 26372 - DNA, 664 bp, Bovine  19866881993016
ttacttgtgtgttatcctactctgcagtaaccctttgggttttccccctctctttctagactgtgttcctactaagtggcacagtgcttggcacacagtaggtacttaatcagtgtattgacccactcttgaagaaatgcattggtgctttgcctgttctccattagccaaactttacaaagcgtgaggtattgactggtttacaacttaccctccggggatgcggtgggaggggcttctggcagggtctggctgtggctcctggtggctggacagggcatgctggaagaagtagccccagggcggacaaagtcctggggtcctggggtcctctgggatgggggagatcctggctctgggaaaccgttgatcagcacaatgggtatgtctgtcatggagttagtgatggatggtgggcaactgctggcatgttccttggccagtggtggggagcgggttgctctgggctggcccatgcttggggtggcgttgctggggaccctggaggtcactggctctcgtatacagggacactggaccaaggttgttgaggctggaggaagagctgctggggctttccaaggatctagaagatgactgatggctggagatgctggagtggaggagggactggctgctgtgaggggagagagcagcaggaagg

SEQ ID NO: 26373 - DNA, 784 bp, Bovine  19866880275656
aaggcaatggcaacccactccagtactcttgcctggaagatcccatggacggaggagcctggtaggccgcagtccatggggtcactaggagttggacacaactgaagcggcttggcagcagcagcagtatcctcatatcaactggactgaataacagattagaatttaaaatcagtttttctctagagtcagtcctcataacagtacttcattttccctggttacagttactgttggtggtgattaccacagtcttttactagactgtgatctcccaaaacgcaaggattctgctttgttcatgtatttatttccagaaaggtgttcaataaatataggataaatatgtgaagtctaagtatcaaattatggcaataaacataaatggctaaaatttcttcaaagcctcagattaaactgaaaaacaaaatctagaactttttttgcttttaagagttatatctaaactttacaatattgtattagttttgccaaatatcgaaatgaatccgccacaggtatacatgtgttccccatcctgaaccctcctccctcctccctccccataccctccctctgggtcatcccagtgcaccagccccaagcgtccagtaccgtgcatcgaacctggactggcaactcgtttcatacatgatattatacatgtttcaatgccattctcccatatcttcccaccctctccctctcccactgagtccataagactgatctatacaacagtgtctcttttgctgtctcgtacacagggttaagtttaaaaata

SEQ ID NO: 26374 - DNA, 1587 bp, Bovine  19866880461620
taaaagttggtctcaaaatcaatgaaaatagattttacaggactgtgtaatgaagcccctgtggccagtgtcacagatcacagagtggctgcattttatgtctcatataaggtaccctgacaacgctgagtgggagctttggtattttcctgactcacaaggaagggagcgtgccatcagctgaatcatcctcctcgcttcctggggtgcctggttgttccaagacactaatggaggattaaattctggttaccatgacagctacgtaaatgctgtcatgatcttatcaacagatgtcgtacagtgctccctggaatttgaatttttttccctgtcaaaaattcaatttcaacataaattcttcaataactaggcacagtgggtctaaagaattggtgatatccttccttttcttaactagctgtattaagatacaactcatcttttacttaaaatgtattccttctagtgaatggtgtttgtcttgtgatgttgcttattgtgcttttagaaattaaaatgaatagtatgaatagaaataaaaatgaaaagtataatcaattctcttagacttacagaaactcaaatttgagaaaacaaatctgaatacctagagcattagctggcatctagtggcaatgggttggttttatctgtaacggcgctaatgtaaactgttttgtgtaaggacctgatggtggagactgtgtttttggtagatgttctgtccctttcctttctccattccaatggttagagtcatccctgagaggcagagtagcagccacagaggttcctgaaactcttagttcctcagtcgtgtccgactctctgcaaccccatggactgtagcctaccaggctcctctgttcaaagaattctccaggcctagtgaaacctgcatttttattttaaaaacttttctttggggaggtttacaggtgcttcccaggtggctcagtggtaaagaacccgcttgccaatgcaggagatgtgggtttgatccctgggttgggaagatgctctggagaaggaagtggcaacccactccagtattcttgcctgggaaatcccctggacagaggagcctggcgggctacagtccataggttgcagaaagctggacacaactgagcgactaaacgacaacttttaggatgattgccgccacgcttcaaggactagaaacacttaaaagtcttccaaaccaacatcataaaaaaaggtcagtgaccttcagagttcttgaaaagcctttactaaatgtgttcaaaacagctctgagcactagttgctttttgtcttttccctgctttttatatagtattttctcatttcacttgccttcagatgttggtcattattatttttgctgaagtattccttggaatccttctaatttcagtggcacaaaaaaattgccaagggcctgttatatttctttgtgttttggtctgctttacatggcttgaggatcccagttccccaactagggcttgagccctggagtgaaagcgcagaatcctaactaccaggccaccagggaactcccaggcctgttatatttctaacctgttcctggttagg

SEQ ID NO: 26375 - DNA, 1296 bp, Bovine  19866880545008
cctcctgtggctcctcagtctggaactttctttcctcactctccacctgcctctctcaggtcaccatttaggtcactgctaagacaggccatccctttccccagactgagctgagaccatgcgtgatctctgtcacagtacttctccctttcctacacaacacttaggactgtttttattctgtttttttattattcttttattatgtattacttgtgtgtcccactaaatggtccacttcacaaaggtagggaaccagtctcgttcatcatgatttgcccaggaacacggtgtctgcgccacaaaaaagtattgaatgaaagaacgaataaataaatacagctagattttaatatcccccgggggtagagtggggggatatttcttttcaccctcagccaaaagtttaataaatacttattgacctcagtactgtattatggaaaaaaaaaagaacaacagtaacaacaacaaggaaaagaatgacagcgttagaagtcagtgtgactgaaggaaagtcgtgggctgtaatgtcattagtctcagcaaatgaggggcaggattatagccacgggatccctgagtttgtgaaatagcgatgtacttaataatggaagtttgttttgcttggaaatagcagatgaattggatgcacatctggatatttggcatcgtgcagacaaaaacatctggatgattggctgaatgcttcaacaaaactaatgtgtttcagggctgtgtaaacagtcagagaatgactctgaaattatgttttttgggacgtggccacgtgaataagtggaggaggagagttctcattccagaaagacgatggactcagagacttgaaatccctcctatcccaaacacacagggaactcaggatgcatgtgacccttggaagctgcatggccaaggccatgagtctttgaaatcaggaggagactgaaaatcagagccatgtgagcccatgaactgacctgggagtctgtttttgctcccagtaaaccttgggagcttgggcttgaaacccagttgaggacaggagacaaggttttggaatcctgagaagtcttaagtcaggacatctgaagagctgaactctcagtggaaagggggattagaagaaatctggctcttggcacaaggaggagacgaggaagctggcttagctcgagtagaaggaaacagtctccctagagaaaaatgaagccctgggcttgcccttgggctttgggtccaaaacatgtctttactccactcagaaagcatgcaaatatctctgcaaggctcaag

SEQ ID NO: 26376 - DNA, 2937 bp, Bovine  19866880555929
aatttacttctattggcatttcttgggtagtttcccaacattcaggccaagcgacttaactgagagcacagccacattctcaactgtgagtttccatttctgtgagttgcccagagaagaaagtgctactcagcttgtcaacacatttattaagtctttatgatactcctggcccaaataggtataggaaatagaggtttggagaggagaaccatttgtttctttcctctaggccacctccaaaacctagcctagtctttcagagccaaggctgcagtgcggtacttctatgaggaccagttcagctcatcagttgttctgtgagaacagggtcagccctcgcgatgactctcactgtttgaatctgcagtggccctgattgtgtgtttgttaaatagtgggaagaaaaagaaaggggagatggaaaatgaaaagcaaagtcaggaagtgagaggaccacagacagccagtcaggcccttccttgagggatcagcacccacatctggcctggagaggaccccttagaccaccctgaaacagactcaggacccatgggagctaatttcccatcaggggaaagcaggagttgaggcagctgctttcactagtgctgcatctttcctacgatcaataccccatcaataccccatctgcctgggggtgtatttccattcactccaagtcttcagggaacaagtagaactagtgggattcccaggtggctcagtggtttaaaaaaaaaaattgcctggaatgccagagacatgcaggagacatgcgttcaatccctgaatcaggaaaatcccttggagaaggaaatggtaacccactccagcattcttgcctagagaactctgtggacagaggagcctggtgggctacagtccatggggtcgcaaagagacagacacgactgagcatgcacatgtgcagaactggtatctcagacatcaaagaaatcatgtttgtttcagaaacaagtttcagcattgaatcctttggtatctccagatagtgatctcttccttgcatttattccttcactaattcattgacttggcaaatatttatcaagatcttcttaactacagagcagtaattaagaagctaaaggattaagaaggataaaatgtatttcgtacataggtaacgacaggtattacagagtgtgacaaatccatgatttagggacaagttctcacaatgacattctctgaattggaagtccattcgaacaaaaaaaaatctgtaagactagccatcaacaggagttactcaatctggaggatatggatgtatcagtcccccctgacatatccaccataactgtaactttattttgtgacttgggtaaacagaacacaaggttgtgttgtaatgctgtaatgacagaagcattattttctggggaaaaatagttggaaaagaaaagtatttgcaaatggtacaaatgaacttaattacaaaacagaaatagagtcacagatgtagaaaacaatcatatgttaccagagacggaagtgggggagggataaattgggagattgggactgacatatacataccactatatacaaaatagataactaataaggacctactgtaggcgcaggtaactctactcaatactctgtaatgacctgtatgggaaaagaatctgaaaaagaatagaaatatgtatgtgtaaaattgaattactttgctatacacctgaagctaacataacattgtaaatcaactacacgccaataaaaaatgatacagggagagagaggaataaaaaagaaaactatttgccagcatgtttccagtactgtccaaggaagaggaaatcatacaccaatattcgttatctagatggaaatagctccagagagaaggctaataacatttgcacagtacttcagtttacaaagtgcctttgtgtacattatctctttcaacattcacaattgcctccataaagtcagtgccattatcaagtctgttttattgaggaggaagtggaggctgggaaactaagtgactttctaaggtcacactgcttgggaagaacagaattacaggtactctgacttctcggcaagccctactctccaccaccccttagctgtcttaacatgcaccaaaagcccccaccaccctaagttaatgcatcatacacagcttccaggcaatgccccatttcctacctgactctaggctcaccaagtcttttttgtttttgggggctgcacggtatgtggaccttagttccccaaacagggcttgaacccacatcccctgcagtggaaacgcagagttttaaccactgggccaccagggaagtccctacaccttttgatcagtaacttggtctcttgggagaggtcaacctccaggaggtaatcattgcacttaggatgagcttcacgggtgtgcaaccagtgtagctccctggggttctgtgctaggaaaagccacttggtttaatgcttttctgtcattgcctgtttttttctttaatattttttggttgcactgggtctgagttgcagaatgtgcgatctttgttgcagcattcgaactcttagttgtggcacacgggatctagttccctgatcagggatcaaacccaggctcccctgtattggaagctcagagtcttagccactggaccaccagggaagttcctgtcactatattgaaattcttaacaacttttgaacaacatacaaattgtgttgctggtcctgagtgcacaaatgatggttaccagctggactgggttcctgggtcatcaaccaatgccttgggagtttaagagcacgtatgtgggatttagaaataaggacaggagagaaagtggaggacagtcttgctgggggagaagctttgagaaaggcagagtggtggatgaataaggcatgttttcaggagtaatatctttttgcagg

SEQ ID NO: 26377 - DNA, 1848 bp, Bovine  19866880582894
actctttgcaaccccatggactgcagcccaccaggctcctccgtccatgggattttccaggcaagagtgctggagtggggtgccattgccttctcctttcaaaacacagttgctgccaattaatagagcttctcaaatggtgctagtaagaaagaatctgtcttccaatgcagaagacataagagacccaggttgaatcgctgggtagagaagagcccctcgagtagggaatagcaaccagatccaatatttttgctaggaaaatttcagacagaggagcctagaaggctacagttcatggggctgcaaagagtcggacataactgagcacaggctatcaattattagtactggtatgtatgccattttcagacactaaaattaactaacctctgtacttttcaacttttgtagttcattttccagcattaatttctcctctgataatacttggagatcactttgaatctgtgtgtatttctaaaaacaagtattataacttcattaataatgaaaagcaaacatatcaatatggagaggttattcgggtacttgattattaaagtaaaaaagtcttttttaactcatagaaatcatgaaccactggtattaatctgcatagtgaagttataacaggtgctgaaagaggcaaaggtactatgattgacaatggaaattcagagactgtgggatattatagttcagtatttcaaaagtcaagtgtttctgagtgatttaataaagtctactaaaatcaaaagaatagataaaaatttccagctctcatatgcataaaaatctcttgaataaactaagcatctatcagcaacatcaaggacaaagtgcaaattcaaactgagagcactatacttacagcctctaacatcagttgctcattcatagctctgaaaaacaaaccaaaaatataatttaaaatttttatttttatttatgtaatatcatgtattttctatgtaaaaaaaattaatataaataaggttagagtatactttgactagcattccaaaatttcagtgttcttcctagagatactgttcgattgctgtgtatctttccaaaacttgttccatggatttatgacactttatatacctattgtacactttttcttaatgagctggatgtttgttttgtttcctttttcatataaatgacatcactggatatgttctcaacatttttttcacttaacacaacttctgagatctatttatataggtaaacatagattcctctcactccctttaaatacaatttcttattccatatcaagagttggcaaactttttctgtaaagagccagatagtgagtcttttacactttacaaaccagttagtcttgtcactaccagccagctctgcagtggatatggctgtgttttaacaaaactttataaacaaaaacaagcttcaggctagatttttttttttaaactttacataattgtattagttttgccaaatatcaaactcatggactgcagcttgctgacaactgttccatagtacagataaactattttttggactaatgagctttttattaattataatcagaattttttaaagttttattatgattaacatactataaaattaactcactttatacaattcaataccttttaatatattcactgagtaacaattgttgtttagttactgagctgtattgaactcttttccgaacccatggactgtagccaaccaggcacctctgtccctgggattctccaggcaagaatactggagtaggttgccatttccttctccaggagatcttcctgactcaggggatcgaacccgtgtctcctgcatttcaggtag

SEQ ID NO: 26378 - DNA, 908 bp, Bovine  19866880729164
tttgttcctttcacttgactgaaacttcctgcctgtccatcagtaacttcccctttcccctctgtttccagtctctcgtaaccagcgttctactctttgataccataggagtttgactttttcatttcacatacctcatataagtggaaccagggttttttctgattgacttattcactgagcataatgtcctcaagcttcacttgtgttgtccaattttgcagaatttctctctctgaagtctgaatggtattcttttgcatgtccctgtcgcatcttctttatctgttcatctgtcgctggacatttaggtcattccacatcctgactgtcgtgagtgatactgtaatgaacactggagtgctaagacctctttgagattctgatttcaattcttttggacaaaaacccattggtgggcttgcagagtaggattctgaacatggaggagaggagcccactggggggtgtgtgtgcagtgctccctccggttctaaatgctctgccggccctgtactgggagcacaggaaagtgggtatcaggtggggatatttttgtgtttgcaaactggaggctggctgtgtctcctgggccagggagttagccagtgcacctcgtctgctaagtcatcccctcttttcgcaggagacagtcttataaatttggctaataactcccatttcatttccccaaactccattagagggaaattataatgaagctcaaatactcgccaggttattcatgggaaagacctttggctcttaaaaaatatattttagatggctggattaatctagtggcacattataatacggccctgctgaagtttgcaggagactcctggcaccaggcattgtgccttccacaatgctgccaaggagcataattatctttacaggaagag

SEQ ID NO: 26379 - DNA, 2033 bp, Bovine  19866880936126
aattgtattctctaggccctttaagggacccacataatcaaaactattaaaaataatgttaaaatgttagttgcctttttaaccatgttgacatttgatttgtgcatccttgcacttgagattgaacaacatcctttggtttcttgatgctccaagttcctttcaacctcaggctccttaagcatcttgttcccagtgcctggagtacttccccacactcactctccctcatgagtaacactgacgagactgacagttggtgtgctctttattctttggttcattaacatcccttctccagagtgattctctgctgttcttctgccttccccagtctcaggttctcccctaagtgctgtcatagcccttctgaagtaccctcttgtgcaggatggaattctagtcaattatttgtctgatatctgccccgctgttatttccactaaagcagagagtgaatctgtcgtggtcatccttctggtgtggtgtccagcataactggcattccataaatacttaaatggatgaacggttgaaatgctgttgcactacactgaaaagctgagtggaataatggaaggaaacctgaagtgaaaggagacttgagattgaattttaattgtgttgtttatatatttggacctttcacgattctaattccttatctgcaggatgagttagtgttgaaaatagagtctctatctgccagaaaagacactcattaagtaacaatcactcaacagtatgagtgaccaccatagtaacacttaatttctgtgctgggccttggaaatacaacagagactaaaacagacatacttggttttgtggagtttattgtagtgggtttgttctgggccctaagtaaggacttttccagaaaggttctaagtgatgcatagtaggtatcctattttgaaggttaaatatatggtgatgtctttaaaggagcttagaaatgtctgtttcacatttaatttgtatagttgaaacttttgtttctgttttttagtccaagccttatgcatttgaccgggtgttccagtcaaacacatctcaagagcaagtgtataatgactgtgcaaagaagattgttaaaggtaaatatattatataccttctaagtcatcccagcagtaagtccagttttgtttgtgatctcttcaatttacccagctttctttttttttttcattttaccttccctttctttttagttagttgcagaagttcagataataaaaaggtcaaatatagttaaaccctattgctcaaatttcatgaaataatttatgtacaatgcctgttgaagggtgttatgagaattacaatgttgtatacatatcctggaaaatcccatggatggaggagcctggtaggctgcagtccatggggttgcaaagaattggacatgactgagctacttcactttcacttttcactttcatgcattggagaaggaaatggcagcccactccagtgttcttgcctggagaatccccagggacagggaagcctggtgggctgccatctatggggtcgcatagagtcggacacgactgaagtgacgtagcagcagtagcagcagcagcagcatggcgcctgtgctttcccagtctacactgcccaggctccaggtttctctgaaggggaactatgcaatcgggccctggattgcgtgcacttcccaggtctaagctgctcagtttcaggttcttgagtactccacaaaggcacagactctgttgggcctgcattttgtgcccttcccaggtctgaggagctcaggccaccaggtgcttggcgagtgcactatcccaggtgtgcagtgcttcttatcacctttctggtcccagctgatctcaggctgtgactctcctggcatatgtcaaccgtccaagatcctaggaagacttggttagcaaacgggagcctgctcacagttcggaggatgccgtctctggggccaagattgcctctcgccttccagctctggctgtcgtccacctgcctttctccctcctgcagggcag

SEQ ID NO: 26380 - DNA, 2250 bp, Bovine  19866880966050
aagtcaatctttgcttctgtttgtatgatgtactgctccccataggatatccatggtgaagcatggacgtattcaaaaaattttttaatgtactggagtatgttctgagctctgtagatgccttcatcttttaagtgacaatgacatactgtacagcttttctgaaagcagtattcaatttacctcttcctgatccagcatttgtgtcttcagtttttctaccaattggctctgttgattaatttcttcatcctagaattttcagttacaagttaacaaaatagttcacaacctggttctgtttcctaacacaaactgtaagattactacccactccccagtatttcaaagttgttttctccaaattcgacatagcttattctaacctcttatcttagaaagatgttgaaacaaatggagcgtctttcaattatcagtaactgtaacatccttatcatgcaataagaaaaaaggcttatgtttatgaaagttattcacaaaatacatgctaaaataaacatgtttaaagctattactgaaaataatgccatgtagccacttcaaacctacctaccatccctgtttaaaatacattaaaaatatcacctactaagaaaaaaatcaaagacaacaccagaacaattttttctagcctctttactgttgtttttcccatcctttttatttggttcataattgtgctatttttcatactactgatatcatcaaagtacaaagaagatagtatttccatttgattctattccctcagtctaacctcttgcatcatttttatcattagcaccatagacagctgattctaaaaggtcatttcattaagactctccaaggatccacgtcaaatttccttttgcaagttcttttagcttaaagagaaggggaagaaaggtatgccttatacatttgtttctgcacagaaacagaaattgtcattttatattttctgttaatacaatgatcttgaaaaagttaacaggaacctaggaatatgtacataggtcatgaggacccattaatactgaaattagaaaataaaaacaagtcaataatgttctaaaacaaaacagaacacaaataatacttaccttgtcatcgagttgtttgtacagtttagcaatttcttcttcacactttcttctttcagcatcagtaaagcttccagtaactccaattgtggctgctggtttatcattggtaatagtaatatccttatccactgcaaaagcttccaagttggctttctctttgtcaaactgttcatcaataggcactgtctctcctaaaataagacaacagaatggttaacaaaactcacctgtctaaaattaattttaattttattcaatttcagcagctcttatcaacttaatctgctcagtccctgagatctgaaaagttggaattatctttgactgtcccctttatcttctaaagccagtcatctaatcttgtatttttaattgatttcatcctaaacatcttgccgtcttgagacttcaatagtcagctagctggcctttatgcctctatttataattccaggtaaaatcagaatttaaagtaaaagattttattcatttttatttgatgatccctaatatgtttttattttcatttatatcagagtctcaaatttataaaatagctctgaatctctattccacaaactctaaacaacaaattcataaggtattaattaccattacgccatcggttgagttcattttcaagccactgaatggtgttccggagggtcttatttttttctttctctctttcatacttctttttccactgttctgcagttaactctacattgacacaaactgtgttcttaattgttttggccctaagacaagtagttggggggagaggggaagtatatgacttaattattttcaattgatatctatatctctgtaatataagcatatgtggctaggtaattgaactattcttctctagttatctctgactaaattctaggagctgtacttagtttagtgtttattcacaacccattagatttgggtcagttacaacacctctgaatagcttaaaaaaaaaaatcagcaacctgataagggaaaaaaaaaaacacgggcccattatttttccaattcacttgtaagacagaattaagaaaagcaattatcaacgacagtccaagtcatcattattgatttgcctcagctaaccacctcatatacagttatcccattatttgaa

SEQ ID NO: 26381 - DNA, 1371 bp, Bovine  19866880969485
tttgacaaagagtaaggaatccagtttgacgagagcagagtgagtgaagaggagcataatgcccgagagcagcaaggaaaggggaatgccaatcctactggaccttgtaagcagttttaagaactttgactctttttctgagtgagggtggggaataattggactattttgatgtaagtatggcatggcctgacttacctatttttaactattagtttgtttattcccatgaagacagacgaaagtagaagagaaatcagtcaggaggctgtaatgagccaggcaggaactgggtgtttggatgcaggacctgggagcccctgctggagccctaggcattgctggctggttcttccaaatgtcactaggagacaggagagaaagtgattcagctctccggtagcaaaaaggcctggctctccatgcataaataatcaggggtttaaacttcttaagtggcttcttaaaaatgagtcatcacttatttccccataaggagtcttacacaatactgttgtttttaataagctgtttttaattcagtaatctaaaaggtataaatgtggtcttaattgttacggctaactgttaaagccattatttgcttaaataaataatgaatataattaaatctttgcataggaatttgcacagtataaccttgaataattgtttctggcttggtaatatttattagaacttcctatagagcagatagaaacaccttttccaatttagacttatcttcatttttctgtaatattttataaaatatgagtgcctgcagtaaagcaaaatatagttctagatgctaagtaaattacaaagataatttagttctcattctttaaagaattgaggcccccaatactacaagagaatacatcttttaaaggaaaaaatgtaaagattgttagactagcatctatctaagcagctcacgttttggacatcagtgtgtaaatgaataaatgattacagcacaatttcttaggcagagagtgtagtactccaggaggcagaagaaaggtccttttaaaccaggttttgaagaacaagaggaaatttgaggggcatggggtgaaacctggtgaatggtggtccatcccggtgaacaaagcacagaacggatgttgcagacacactatagtgcttcccttccggtggatcttatctgcgatagccactgtcactctcagctgactcaatgaaaatggtatttctgatgcctcaaatatgtgatatgcttgtactgccaatgcatttgtcaaaagactattaaaagccacctgaaaaggcaaaaatcttctaggggtaagcaaaaataacaaaggaagtaaaagaaaaaaacataatgttagaggggaaaga

SEQ ID NO: 26382 - DNA, 1927 bp, Bovine  19866881009344
atagagatatgaggaattgttatctgatgtattctaagtaacccccatgggagcaacaccagatttagctgcaggagatcaaggtgctaaaagtgatggttaatgactatggaaccaggagaaatcaccaactttcctgggtctcttcatctattacactagatgactgctaggtctcctccctcaatttgactatctatgattcaagatttaaaaagtactttggtgatactatataccagtgctacaggatagctccctttacctaaaatagctacttgatcgggttctagcaaagaagtcttattggctattttaggatggagccacccttatgggaggaaaagtactctgatttcccctttgtaacaggtacacttcattcaatacaaggtgtatgtcttggtcagctcagctggtggtaggttatctcagcataggaggtgtgaggtgagaagagggataatatggttataccagtaccagagtcagaaagtaatactgtttgttgttgttcagttggtaagtcatgtccgactctgcaaccccatggactgaagcacaccaagcttccctatcctgtatttcccagagtttgctcaaactcgtgtccattaatttagtgatgccaaccaaccatctcatcttctatcacctcttttcctattgtcctcaatctttcccagcatcaaaatcttttccaatgagttggctctttacattctgtttactaggaatctatatatcctggggaatttaaatgccaaagcagtttattcacaaatagtaaacatcatcttcagcatctgctgtaagaaagtatcataggctgcgaggcttacactgcagacatttatttctcacagtttcagaggttgaaaagtccaaggtcaaggtgatagtggtgaaagccctcagttcttggtgaaggccctcttcctggcttgcagacaacctccttctcactctgtgctcacatagcccgtcctgggtacgtagagagtgctctcttcctcttcttaaaaagacagtaatcctataatgaggatcccaccctcacaacttcatctaaaccttattctgttccaaaggcccgccttctaataacatcacatcagggcttagagcttcagatatgaattttggagggacacgaacatttaacccgtagcagtgtttttgttcagtgacaccaaatgtcaaaacattcacaagagctatggaatccccattctttcaggaaacgtgcactacaccaaattctgtttcctgctttttctcctctctcaggagtataacattggaagatcaaaataattatcacagaaaaacaacatcaaactttcattttccaagctagtcaccacaacaaacacacattcttggcttgggctttgaagagctcccttcatttcctctgttactggctatcagtgggtttgggtatgacacaccttctttctcacttgcagccataaaggtaaagggtacagagagagagagtaagactcacgaagccatgactcatttttgcatcttttggtttttgatcaaatgccaacagatggcaagagataaataaatgagtcttcaataatgggctatatggaaaccagtaacattatgggtgattattcaagtttcattattaattttcttcctccttaaattgtaaataaatgtcatacaatagacaaaggatacattcctaacactttctgggaggagagagaagttgcagttttcagctacatgtgtgacttactcacagacatgcgagtaagagatgaggtaataactgttcaccataagcctgtggtgtttcagatcaccatggaaaatgtgtgttatttatgcaacaaactataaaatatatttttatttcaaaacacattcattttctgcctcaatagcagtacaaaggggg

SEQ ID NO: 26383 - DNA, 1371 bp, Bovine  19866881057143
aaaaattagtgaagtaatacaaactgtctgctcttgatggagctacaatatggctactttacatggtcctcttaggcctaaaatacattttaaatttgagctgagagctagcccagaactcagtagagaattcaggaaaatgaaagcagaaaataatggttttgtgagtactgaatgaaagtgaaaatgaagtcgctcagtcgtgtccgactctttgcaaccccatggactgcagcctaccaggctcctccgtccatgggattctccaggcaagaatactggagtggggtgccatttccttctccaggggatcttccctacccagggatcgaacccaggtctcccgcattgcaggcagacgctttaacctctgagccaccagggaaggtgactgaatgaaaatacctgtcaatatttgagttgatctttcatttaatagatttcactgtaccttttgtgttttgttctattaggcaagtttagcaagtatagatgctgagcttcagaaacttaaggaaatgaccaaccaccagaaaaaaagagcggcagagatgatggcatctttactaaaagacctggcagaaattggaattgctgtgggaaacaatgacgtaaaggtaattgtaactacctgagagtaagcatgattatctgtatagagctcacgctttcatttttcacaaagctcttttcatgcctgtcatctcctcctccaagacccatctgtagtagagggtattagcttcattttaaatagatgaggaagagggagaggataaagggtcctcaaggagacatgctcagtcagtagcatttatctggactacatgtttagttttcttctctatgtaaagaattttgcacttagaaattattgttaataaatgactccacagaaagtgtgtaattgaaacaatagctccaggagtaaactgtaagtaaattagcttctgattgctgtaagtgtttaaaaagataaaaggtgagcactgctaattaattctctatatttggaaattttttaaacatacagtagtaaacaggacaatactgtgaacctcagagttaatcagttatcaaaattttgttacatttttttcttttctaataatctttttcagggtgcggatacttagttatattagcactagtgtgtagttaaaaaaaaattgcaacctggtagattttaaaacttagatcaaaaatacaagctagactcttaactgaaaaaacatgcacataacatgaaaggtttgtatgttgcagtagatatttgtatggacttccttttttttaaattaaagtctaattatagtgacaaggagagcaaatttataccttgagtttgtagtgaaagccggctaagcagcc

SEQ ID NO: 26384 - DNA, 866 bp, Bovine  19866881121340
agggaaaaggaaagacgcagctgaacaaccgcaactttgcttttggtttattactgacgtacgtcacaaaaacaatctcaactgctgacatgtctctctccctacctgaggctggaaggacgccgttcaccccaattccaagcaccacatcctccttcatcttgaatcccatcagttgttccgatgtcaccaaagcagaagcagcaaattgagcactagcagaatccaaagtcttggacacaaaaccctacaaaggaaaacaagagcagagctaatcagcaccacttagtttccaacgattattaaagctacacagctatatgccaaaatcagtctgcacacaaaccaaagtggcaaaccactgaaatatctccatttcttctcgacagtcataactttgattaatgttcagcaacagcatcttgtaacccgaggattataaatttaaaaaataaattcttttttgctgtacatcgcattttggaccttagttcccagggactgaaccaacactccctgcattggaaggtggagtcttaaccactggactgtcagggaagtcccaaggattatggattttgatcttatgtgacaatatataacatggaattaccaaaataaacctttaaaatgtggaaatggtaaacctccaacacaaagtgttagacaagaaacacactagtaaaacatttcagtgatttgcaatcaatcaatgcatgaataaattcatataatgagtaagtgcataggcaaaatttccttcaccaaacttacatacatacatacacaaccaaaggcagccaagggacagtaacagaactacccctttagaacagaaggaacaaaacatcgatcacatcctaact

SEQ ID NO: 26385 - DNA, 1013 bp, Bovine  19866881213710
tattttgtcagtgttgcctaaatttcaatgtacatattttctttgactaatgtctactaatgtaaatgtatgttaaaagaaaattgtatgtgactaccacatacgagtagaaaactagcatcacttgccataaagaaaaataaataagtcatgtaatgtaaggagaaatatatttaatccgtttgtcaaaatgttctccgatgagaagaaaagtgtttaagatcagtgaagaagtaaagatattcaggtcaattttgcatagcttaaaaaaaaatatgaggatctacagtcatgagaatgtttccattttgatgtaaacttgcacaaagaattctaattcacgtgcattcatcgtttgaggggtgattacacagaatttactcttttgacagttcctaacaaaagtgatgaaagtgatttttgttcaacaactcttagtcaaaaggtaccatctgaagagattgtcaaagtttgtcctcacatagagttatttggtgatgacacccaaagtgatgcaaaacacattccttagtcactggaggttgccagtagagttggaaaaacacttatgagacttttttttattaagtggtttgagtctccttagctcaaaattttctcagcaagatgtggggactcctctgtggtcaggtggctaagaccccacactcctaatggagggggctcggttcaatctccagtcagggaactagatcttacatgccacaacaaagttcgaagatcccaagtgctgcaacaaagacccactgcagcaccaaaaaaaaaaaagatctgagatttgagctagggcttagttctaaaccaatgtgatcaactaacaaaaggaatcacacacagtaaacaaagtgtgcctccctgggtccagttttaggaccactgtgtacactctggagaaggcaatggcaccccactccagtactcttgcctggaaaatcccatggaccgaggagccggtaggctgcagtaccatggggtcaccaagagtcggacaa

SEQ ID NO: 26386 - DNA, 1162 bp, Bovine  19866881418646
ttgtagcctgtgttggaatttcctttggtgagcttccgcttaaaaatgaattttctaagaaataccaaaatccctgggtgtcatttaatgttacatttctctatgtgtcgaagttaccccagcactgcatattaccatggtgaaactgcaagagttgtaatctattcttagaaagtatcctctagtcactagtattctccttatgaatatccccctttgtttgatcaatgtccacatggggatatttattaccttgaatcagccagcattctctcctctgtcagcccccttgttcagaattgttttatgaagtttaatgagcaaaaaggaatgctgtacaaaagcatatttcacaccttaaccatgtagaccctccattgattggggaattcctgagcaattttaatttaaaatgtgccttttccacacccattcctcctgcgactagattcctttccaggctccacttcaagcctggctttccacgttctttcttcctgtttggaatgcacagcttcccagagttcctggaactcttctgaacgtagtgattagggtctcctctaagacctttgctgaatgtagatgccactgctcactgccccagagaatcaggcacaaggcaggcttggtggttagcagaaaatattctctgagtcaacctacagcaactattattcaatcttttagctgttggagtgatttcttttctccctctgttccatgaggtagaggagatggggtgtgggggaggggggtaacccagctatgaagaacaccccaaatagggtcaacattggccccctctcccagttttactgggatatatgcattgaatataaccttgtattagtttaggatgttgaacataatgatttgaaaaatatacatatagtgaaatgattaccacagtaaatttagttagcatccatcacctcacatgatcacaatttttccccttttaagatgagaactttgaggatttactctcttagcaattttcaaatataaaacagtgtcattaactttactcaccatgctgtacattacatccccagaacgtatcttatgactagaagtttgtaccatttgatcaccttctcctatgccccacctccacctcacgcctctaaaccacctgtttctacgagtgggcttttta

SEQ ID NO: 26387 - DNA, 1433 bp, Bovine  19866881471395
acttattcatacctattcattccagtgaatccctttcactcacatccatccaccatgtatgtatgttatctatatttaactccccattagacaacagggaaatagaaaacaagtgtactcacactaccctcagccaaagcagaaatgacatttccaagagcagaaagggacttgttgatgttcttagcttcatccagcacagcaccttcagcaccagttttactaacctatacataagattgcaaaagaatgaaacaaaattatgtttcagtgattctaattttctaaaacgttcagaggtcatcaataactagtaaaaaagaaaagggaaagcttcaagactttgtttgccaagtatttaccctggtagtagcagtgaaagtcactcagtcatgtccgactctttgcgaccccatggactatacaatacagtctatggaattctccaggccagaatactggagtgggtagccttttccttctccaggggatcttccccacccagggatcgaacccacgtttcccgcattgcaggcggattctttaccagctgagccaccagggaagccccagtatttactctaagttatcagtatttatcaagtatgacttttctgagaccttggttttttttaacatgacaaaaatgagattaaggagataccaaattttatttttaggtgtgctcatgaaattaacctatttatatgtagatttgtattgacagcttactaatgtgttaacccccttcgatgcatgggaaaatgaaactaaaaaatttactaaagcacaatgttgatgttgtgatggttagagagagactgaatttacatatatcaattttatacaagcaaacttgcttctattaaaaaaatgtaaaatacataaagataacagaacaatatgtcagcaatgatgcctgaagcagcagcttctcagtatttgcaaaattagagatacactttgaaggatgtgtttaagatttttgtgtagaagggagcaggtatattattccaatcagaagaaaacacaaattagcagaacaaacaacaaaaaaaaggtcacataggtcagtattaagacatttgaacttattttgattttgacataaatcagaatcagattgtataggactataatatttaaataatcctccaaaaggagtacggcgaaatccaaaaggacttattcatggacagtttttagagggaggccattgtcagggtcaataaaatagacaccaaaaattaggaaaaggatacctagtaaaattcttaatgacatacattcaacacactatcaataaagcatacacctatgtcaaggataacacttatcggcagaattggattatggcctaaaggacagtaatttgcaatgacaaaacactggcataaatgcttatagctctcaaaactaccaccaaacccagt

SEQ ID NO: 26388 - DNA, 2230 bp, Bovine  19866880531000
ttcaggcaaataaaaatcattattcaagaagaggctataattactcaaaggaaagtaccctcttttcatgatcaggaaagccacacagtggcatttggcatttagcttgcaaacgtgtgcccacatgaaattaaaataattaggtataagggccaacttaattcaattctaaattcttattacccaaataagtctcaagaaatagagcgaccgtgccagcaatgtgctagatttcaagcccgaatgcaaacttgccatctgctgaggcacaggacaaggttttcaaagaaaagtgaccgtaggccattgaaaatcttcattagaaacagaccccactgcatgttgggaggtgaggcgctgcagtcccttgacaacagcaggactgcccctccaagtagattttcatgcacaaggaaacttttttctttgcttcccacttgatcagcagggacagtgctccttttggaacaaccatctggattcagaaacacaaaaatggtcccagaaaattacacatgcttaaatgtcaagagtatgtggcaacattaagaagcatggaaaagatgcttttcctattacattttctacattaatttagcagccaccataggtggaaacacttggctcatgtcagtggcttaagtggcatgaaagccattttgccactcacaaattatgcagaaacagctttagttagatttctagtacaaaacaggtctgcctccatgcaattttaaaccttctttatcctaccttgtgatttgacatgacatgacatgatgtgcgtgctcagtcatgtccgactctttgtgaccccatggacagtagcccatcgggctcctctctgttcatgggattttccaagcaagaatactggagtgggttgccctcatccaggggatcttccagacccagggatcgaacccacatctcttgggtctcctggattttttaccactgcgccacctgggaaacccatttattctatcgcaaagaaagtcaaattttaagttaaattataatggaaattatccaagaaaccacctccttttggaaggctacccaacaaagaaaataaattgttcaggaaagcagcagtgcatacaaactcagttgacttatgaactctgccatcataagctttccaccttctatacaactaaggttcctagaaaaagcactgggcacacgcatctgtgagacaggaagcaccttgaagtgaggcctccaccctgttctcctttgtcccccacagcctcttattcacatgatattttatcaagaaagcaatgaataatatgaccattcattcaacacagttgtcgagcatccattctgacaagtactggaggtacagagatgagtaagccaaagttcttttgtttgcctgaactgttttttatttatttaaaaaaatcaaatatatacaagcacaagaagtctcaaactgcaccttaacacaaatttcgccacaaacagaaactgcaagtgaactctgcttcttcccgtggcttcctgagaggccaaccagtgagccccttcggtagactgtgattggctgggcattttcaaggggggaaaactaaaggaacgtttcatttttcccccttctgttttggtcacaccgtgcagcatgccagatcttagttccccaaccagggatcgaacctgcactccctgcattgtaagcatggagctttaaatgctgctagagaagtccctaaagggccatttctttaaaaagccaaaagggaatgtcaggtaacttgtttggtttgttgtgacccccagttcagattaaatttcctaaggaggtgaagtaaccctggatactctcaacagttaagagatttcaacatcagccatactagtactgatgtagaaacttgctccttaaccctcatcagatatactaaggtcactaatccttagtcatcgaagcagaattctcatccacagcagctttcccatcattgacatcaccttgtactggatatggatgctggtactgtcatcccctctctagagggggagacctccgtacacagctgacccaacaaagaaacattcctgtccagggccaggagccgggcactcatctgccctcttgatggttcccaagaggagaatgttagagttggaatccagccctgccacttaaaccagctgagtcacctactggataactactcatcctcctagccctgcctgcctctgtctagataggcag

SEQ ID NO: 26389 - DNA, 3744 bp, Bovine  19866880550163
taaaacacttagcagaatgtggcacatcataagaattaacacataacaatgagcatttggacagagcctttacatctgctttttgtctcatcagaggcctctgatgaggtgaggttaaggaaatgacccgtttacagtatttctcaagccaaacgaatttgcagacttttccataactgatcgtgagccttatctgatgatgttttcaagatacatggtaacaacttcaataaatatttataaatgttagcaaataaaatcatttgaagagtaatagttctgagtccatgaagtgcactgagttcagaacgaaaggaagaagtaaatcaccgacttgtttcatgaacttcaggaattcctgaactctccatagtctcctcctttcatttttttgtagacagttttctttgtaaactgaagggcctgaaactaaccagcccatgaatggaccaactttattacttcaagagataaattaaaaaaccaaaccagtttcttaagaagtcatatatttactgcaaatctgtttgtgcctcttgatcaattggatttcaacaccccctcctcgcgtctgactcaggtcagctaatgcaggtgtgcagatagcaatatagtagaaggcagctgtgctcccataaatattatccatgaagattcttgagtcacgtttcctcaaggcacgtgtctgtgatcggcacttaattttacccagattttgacttcttacaatattatggatctctacatgcccaaacctgctagtgtttttatttcataattattgtcaactgtaggagggactttgatgtcaaaaatcttgtcttccattttgcgtgtctccggaggctgatcctgcccttctttcctgtgtgatctgacctcccatcaggatggaattttgagatgatgaactgcaatgcctacgcttatgatttccaaagaaaccaattaacctttgctgtgatcttgaccttcatcagagcttgcaaatgctaatccttggagcatcttcctttgataaatttagcacaaatcaatatcagaaataacaatttctgaggtatttggagaagtagccgatggaagaacaatgaccttgtccattcccctgtcacgtgttgtctggatgaagaaagctgaagttcacacctgctcctgagcagaaagcagagtcattctataagctggactgtgagcgccacaagggcagtgtatctgtaagtccccacatcatgcctggcacatagtaggctctctattccataaacattgttctgataaatatgtcttccttcggtgagcatttactaataaaggaatgcatggaacagtgaactaataaatttatctattgctgtactgggcttctccactcagcagcatggaatctgcctgccatgcaggagacacgggttcaatccctgggtaggtaagataactgggagaaggaaatggcagcctactccagtgttcttacctgaagaatcccatggacagaggagcctggagggctacagtccatggggttgtaagagtcagacaggacttagcgactaaaccaccaccaccatgttgctggactacagttaaaaaaaatatgtaagagagcatttggttcaggttaaaccaagatcatttctttattgtaatggaagaagcatttcagagaaattaaacaaagaattctgatactcagattattttctggaagccttggttcttggctctatgttattgaagatggcatatacttttgaagagaagtgagaaagcagagtaagggaacagaaggtgtctgctggagtccccaggggtgaatggggtctccagaaccgtgggggccacagaggatctgacggttcttgggtcctgggaactcttgtaagtggtccagaaagttggatgcccttggtggtgctggctaagtcagcgctataatgatccctggtcattgtgttgtgaggctgcggtcatggccctccatgagcccctccctgcacccgcatctgaccttggactggacagattaccagcctctgacttacgttttactgatatttctaaactgcctacctaccacctgtgctactaatttcctaatgctcttagtattttcctataaatggactcactggaaaggacttaagtttgtccaagaatcacttaaaccatctgctttatgagtcacactttgggaaacactggcttactcagcctcaacctgaaatacaccacctttgctgaaactcctttgtctctaagcaatatctctgatgtaggattcttttgtgtgtgtgtatgttgcatatgctctcatatgctgctgctgctgctaagttgcttcagtcgtgtccatctctgcgaccccataaatggcagcccaccaagctcctccatccatgggattctccaggcaagagtactggagtcgcttgccatttccttctcccaaatggatctcctatggaacttgcctaacacaattatggattttattttttttaagattcagggtcttatgctcattttaaaatacagtacccccatgctctaaacgctataatttcagtctttgcttttcatagagcttatgatttcttaattttatgtactgtcaaggaaatagacttagattttacaacctaagttagaaagatgtttaacaaatctcgtgaaaaattgctaaaacataggaagtgttcttttgaatacagaaattgcagttgatccttagaggagggtaagaaactcagtatccttgttcttgcccctgccctgttacctgttataattagcttttttatgggatagaaatcttccgttctttggagtttctcttataagctggctttatttaggataacagcagatgttgttgatcttggttatctccagcttctgaggggcattttcttgaggcaagaattccaaagggatctgtgcttctcatctgtgttcttgagattcagacagacactgtctgagtgttgatcctttatttctaagctttatgaaatcagaatcacagtgtatccatacatagaaaccctgacgattctggatttactattctcagatccctcagaataaagctgtaaattcttactacctgttaactttattttctcttgacactctgtggtgactcttgaaccattgaagggctttgattctaaggcacatttttacacaaaattgagagtttgatgttttattattttgttctgtactgaaagggatattctaacaattggccccctgagcttagattttggatcgactaactatccttggtttcagcttcattctttcagtaggtatttatcgagcacctactgtgtcccagacatagtgttagattgtagaggtgcagcgtctttccttcaaagaccagatgggagactggccagcccacctgaacttctactagatttcattcaaaggcctctgtgttttttcgtttgtttgctttattttggtttcgaacagttgttgatccacatatttgccatttacttctggtggccaatgtgttcttttcaattctggctcaggaaataaccttccttattagttgacggttgttgttccaaactttatgcttatctcaagggttttaagtatgggatgtataacttaggttgagagttgtgaacagtaggaaaaatgtcatttgctttgcaaagtcctcaaggccacagattccttgttgctagctgtatcggctttcatttccaagattcc

SEQ ID NO: 26390 - DNA, 1134 bp, Bovine  19866880556146
tacaaacttacagtccataacagtgtatttgtctgagactctggtgggctggattattttttaagaatctcttgcaaatgacacattttttaaaacatacctagataaaacttgaggaagcatagctgagcatggccaaagttgtccttgaagcgttatctcctgcaaagaacagaatgtcctttaaggtgggagagggtccttctctacttgtgccctctgatcccttccttcaccctccctgcctttctccatgctccgaggagctctcatgggatcccttttggtgggtttctgacaggatggcttcaccgactcgatggacatgaatttgggtagactccgggagttagtgatggacagggaggcctggcgtgctgtggttcatggggttgcaaagattcggacacgagtgatcgactgaactgaactgaactgataggatctggcagcagagggcaatggaggcaggaagcaggcagtgttcccctgttcccttcacgcttcattgtctggctcagcaagtggcaacgtgtccccgtgacacaccttctgccagcgcgagcacctcctctctgagtccagctctcaccgggccctccacttcctaccaggccagcgtctatcacagcttcccgctgttttcatttctggtgctccgaactctcttaccctgcccactccactgtccagtcccttcgttaaggaatcttctgttgaaccacctgagaagttttctatctcctctgggaccctggttgatatatgcaattataatacatttcaatattttcccatgcaacctacttccctatcagtcatgctcttagtttaataaaatattttccatcattaaaaaagaaattctggagaatctccaactggcacatgcagcttttgcaaggtcataataataattgccttaagggaaatagtcatttttagtattgcttggaaacgagattgagaaatgcagtcaaggaaataccatctatgctcatggcttgatgtcttaagaaatgtgataaatgggaaattagatgtcggaacaggaattcacagaattgagttatcaaaagatcatttgatcatttctcattttgcgttcccactttaaggcaaagtactaattat

SEQ ID NO: 26391 - DNA, 1121 bp, Bovine  19866880620906
actcctctcacggccaccctccagcacatgtgtatttttgagaacattctaggtaatcagttgattgtattagaacagctgacacacacatatttagttcctttttgcgctgtttgtttcatagaatcacttatttttagagtactgggggcatgtcttatttttccattcctgtatcaagggtccctgaggtgctatcagctacagttggagtttaagagcatctgtaaagatgtaatacattctttggaagaattggtatacaaaacaaaagccttgtatgtgcaataaaataagtcagaagttggttatgaatcaccactttcctattattctagcactgtgctctgtggagcagaaagaggttttaagcatcagaaagttgttttttttttaaaaagacttaagcacacaggatgtggaaggtttggcctagaagcaagttctgttgcatttcagttgtgtgaccttagatgtattctactcaattgccctgagtctcagtttccccaactgtaaagacgatggggctaaccactttcaaccagcttcttcctgggaccagttcctcagaatccaggaagaggggggcacggagctcagagcaagggaatttgaggaggcgaaatgacatttacacccggaactttgatttccaccgcagacagcggtgtgctctgacatgtttggggacatcaaagtgaaaactggaactcagaaactgggaaaacagctcagtggggcaagaagccaggtcggggctctgccagagtggggctcacctcaggaagcaaagtgaaaaggatctgagacagctgtgatcacgtggcaggtcagctccctcacccgctccgagctgtgatgtccattctggaaggaaaagctggttccagaggcggctctggcagcagtgccatcaccatttgccaactggcaggtccagcgtgagccagaagcctcttctcttctcgttagtcttggctgcatttttgaagagtgaatgtttcttgtataaaggaggattatagaaatcctatgaaccccactgaatcacccaaatcaaatggaaaagaaaacaaacaaaatgcccatggcctcttttcagctccttctacacagat

SEQ ID NO: 26392 - DNA, 847 bp, Bovine  19866880675652
tgaaatccttttgaaaattaaaaaaaaacaatttttttttatgtggaccattttttaaagtctttatttaatttattacaatatcactggtgtttttggccatgaggcatgtgggaatcttagctccctgactggggtgcgaacctgcactccctgcattggaaggagaagtcttaaccactggatcgccagtgaagtcctgaaaatttcttgctttaagcttgtatttcttccttgggaaaagtgatgagtgagccgctatttcatccctcattctcagaccggtacatactattgcattctgaactgtatctgttgcatttcacgataaagaattacgttcatcttcacctgagttcatagagttggctgtattttatagcacctgctttcattaaagtctaagcacatgcaagaaaatgcaaatacagttcctaataagcgctcttggatgggagaggggtttttaacaaaatttctttgtcttgtcccttccagcaaataccatttttgctgtttcaccatctatgatgaaagtaaataaccttctaggtaatgaacaaaagactacattttgtgaaacttgtggtcatttaattggattagaatgaaatagtcacccagcgttcctttatttttttcttccattttttaaaaccttatcagcctgtgaaggaaatggcaacccactccagtattcttgcctggagaatcctgtggacagaggaactgttgggtcgcacagagtcggacatgactgagcgacttcactttcacttttcactttcatgcactgggagaaagaaatggcaacccactccagtattcttgcctggagaatcccagg

SEQ ID NO: 26393 - DNA, 1167 bp, Bovine  19866880713889
cacgtgctgtacagtctccctgcttcctccactgccgtctttctaggtcaggagtcctgcttccaggctgctctcccggggagcctccctcctgctgtctcccttcctgccctcgattccttgcccttctccacgtttatttacagtcgctttctctttctgaggctgccggggctgctcaaataggccaggccccagccctccccgacctcgaacccagccgccccgagtgggccctgggcaggcagccgggcgtggaggccggtgtggaaggaggcctggggcgagctgagcgctggccgctcctccagagctcggggaccgctctgacctccctcgctcctcctggctcgtttataatcagcttttccattatcttgcagcgaagccctctctgagtcccattaattgcctgtagctgcagctgggtggttcatttactctttctaatttggaggatgcaagtggtttaacccttgtttgttattttaaagcttcaggggttttgtaaactttggaggcactaaagccagagtggccagacacgtgctcacatgagtctaagcacacacaccgtggtgcacaccacggcacacacagggcggacttttggggtgaggcattggggaagcaggtaatttgatttgagaggctggaagtaagggcagcacccatccctccaacccaaggacactgacatcacctcctccatcaccatcaccaccatcacctccaccatcaaaaccttcacctccattgccgctgctctcaccactatccccatcacctccaccatcaaaaccttcacctcaccccgaggcctaaaattccaccatcgcagctttattcccatggcttaattattggctttcttcagccattctctctgaattatgttagtgtaaaataacaaggcccagacctgcttttctcagtgactgaatgtccccaggagtaagagccagtggggagggctctaaaaacttcggctagccaagaggtttgttcgggtttttccaaaccatgagaaactggaacaaacctcttggtcaacatgataaggttggaaaaaatgtgcatgggcgtgtgtgtgtgcatgcatgcacatgcagaaacatgtcttatcagttaaatttaaaaaagcctacgacccctctgcgacaggat

SEQ ID NO: 26394 - DNA, 2092 bp, Bovine  19866880726392
ttatactcattcaaccaaaatttattgaacacatactacgggctaagggcttccctggtggctcagtggtaaagaatccacctgccaacgcagaagtgggttcgatccctgggcggggcagatctgtgaaggaagaaatggcaatgcactctagtattcctgcctgggaaatccaatggatagaggagcctgatgggctacagtccacggggtggcaaaagagctgcacacaacttaagtgactcaacaacaactacacaacagacaactttctagggagcggggctgctgtactgcacaaacgtgcatggtgtccaggttcaaagagccggcctgtttctcacctataccaagatgcactatattccaacattttaacatctctgagccagaaataactactgtagtgctgtctcaagaataatattggcgcttttttgggtgtgtgtgctacatacaatatggggcctcttacaaccgagaacaatttacctagatttagctttaaggtcatgttgtgaataggaaatgtattggatgagctttcaaagtcttgctctgctaacagtttaaaaagcacataattacttcttttaaatgaaaataaagacagttgattaatctgtacccttcttgaatctacgaagtccacactggtttacttcttaaagtaatacgaaaggccatcaacactttctattcaaaacagctgccactgatttgtaaacagtaattgtgctaccaacggatttttatgtcacaaaccttattgaaccactcaggacttttctttttagccaaagacaacgttgtggcaaatccagctagcattcctgctgcagcaacagaaccaaggaaaattccacctgtcaagagtttcggcggcaggaagaaaaaacaaaaaacctgaagttaaaaagatggacacaaataagtttcagatactatttaaaaatcaatttcgaaattcgagaaacgatagctaagaagctcctggcaaaggtaaatgatagcggctgtgaaacctgcgtggccgcacgacccctggttcctgaggccattctagtgtaagtgtcccaagagtacagaataggcacagggtctcttaccctctttctcccgaggacgaaaaaagagacattgggagttagaaaggggaggtgctgtgggcgggggggagacatgagagaaactacagagggaacggggtaaatgcagcctatacagaacagccactaaactcagggcactcaaaccaaggtctcccccggcagcgtgtgcgtgggaacgcccgctccagcgcaggctagcgccccgggtgagcctgacctgacacccgcacctcgccacaccacacctttaaccaggaaaagccggtcatcggcagacaccgaggcctccggctgagaggacggttcagccagccctgcgtcccccgcctccatgtttctgagctttcgctactgcgtccgccgccaactggacccgggtagaaacgagcgcgagatcgaaaagaaaggttccgctgccacctccctctgtgcaacccgaataccggtccggagaacgacctctgcacgcaaaccttctctgctgccctcggggcccgggcgaagatgctgtagcttgcaccctggggggcagtgtcttccacgactgtctaacccgggaggatcatttgcccgctccaaggtgatgatcgatgcgcttcaatccatacctacttgaaacactgttaggctctgactataggaggcagtgaggggtcgcagattgcgccaggagcctagtctcagcctggttagagaccccgcagctcggtttcccgatcggcttcacactgtatccagggagttggctcagtctttcctccgtactttgctgggaaatttcgtaaccgtaaagctgtcactttagatgtaagtgacagggtgaatatatgctttcatttctttgggggaaatactagaggtggaattgatgagtcagagaacagacatatacttagttttataagaactgactcatttgaaaagaccctgatgctgggaaaggttgagggcagaaggagaaggggacgacagaggatgag

SEQ ID NO: 26395 - DNA, 1577 bp, Bovine  19866880806628
tgattttaggaattctctacaaatggaatccttttaggcactcatgttataaagtgttgattatagcatcatctgaaagaagcacaatttaatggaaagggcctcatcctgtacttaggaagtctctgctttgttagcccacatgtgcgtgctcagtcacttcagttgtgtccaactctttgtgatccaatggactgtagtccgccaggctcctccatccatgagattctgtaggcaagaatactggagtaggttgccatttccttctccaggggatcttccagacccagggatggaacccgcctcttgtacgtcgcaggttctttaccatctgagccacgtagtatgcccacacagatcccttcataccttatacctcaagaccccttgagaagttctctctcccagtgttgtcacgtatgcttctcattacggtattgagttatctttgcacttgttatagcatctgtatggagaaggagaacattgggtatcacatcttaattttaatttagataaacctgtgacctttttcttgatgattttataatactgccagtactttggccacctcatgcgaagagttggctcattggaaaagactgatgctgggagggactgggggcaagaggagaaggggacgacagaggatgagatggctagatggcatcactgactcgatggacgtgagtctcagtgaactctgggagttggtgatggacagggaggcctggggtgctgcggttcatggggtcgcaaagagttggacacgactgagcgactgatctgatctgatctgaagtgaaagtcactcagttgtgtctgactttttgcgaccccatgggaattccccaggtcagaatactggagtgggtaacctttaacttctccaggggaaccttcccaacccaagaatcgaacccaggtctcgcgcattgcaggcggattctgaaccagctgagccacaagtctccctaaactgaagattaaagagaaaaatgacaccatgagcgatctcgtctagtcatttctgaatttgaatttatttttaaagtgaatatttaaatggatttcatccaggtaataatatcttagtgaaactcgctttttatctcatacagtagtgagtacatgcctaacatccaataaatatccagaaagtctatgttaatgagtaaggtaaatgcagacagtcagcactctatcctcccactacattcttaagtctttacactgagaatgtactgattttttcagttttacattcttattttaacttaaaaattgagactactttatagccaatataaatttgctgatgatggttgtataataacttaactcccatcatacaagcacaaatctacttctggctttgtataggaattataggtgttaggcttgtgcaatagaaaatacttaccttatttttgtttttacaagattgaaatttattataaaagaaccagaaagcttagctgatttctgttgagagtgaaattgaattactaccacctgaaaatcatgtgtgaaggctgaaatactccctactcccactagagggggattccttccaa

SEQ ID NO: 26396 - DNA, 1492 bp, Bovine  19866880833387
ctgggcatctgtccttagagccgtgtcccaacccccctggctctgctaacctgttctacgttagcaacagagtgtgctccccaaaaagcttttccctcagccctcgacttcaggctacagagcccctacaactttgctctcattacttacttaacaaagaaaaatacgctttaggaagctgcattttcctctctcctctcccagtgcaaaagtgacattgatttgcatgcctaggaaggaccaacctgagcccattcattaccatggaagggaagccacatgtttgaacactggctttcagcacatcattgtacttttttcccctggctgcagaaagtagaattctttcaataaaaacttgccatctaaaaataaagtagtggcaaactctgcaattatacttctccattggagacaactgctttccactctattttccaaaatggacaaggtccaatttgttggtcagctaatgggtcacacccaaggcccaaatgtagtgtaatgaactcgaaagccaaaatgatgtaggtctgagttgctgtgtggttgttccccgagtgcagcaagtacatttactttccgtcagctgtgtgctattcctctcacctgtgccccacagagcggggccctgattaccgtttgcccactttcagcccaaggaccatcaaatgaagcttagaggcagctactggcaatgtgctccttgtctagttccctcctctgctgctgctgctgctaagtcgcttcagtcgtgtccgaccctgtgcaaccccatagacggcagcccaccaggctccgccgtccctggaattctccaggcgagaacactggagtgggttgccatttccttctccagtacatgaaagtgaaaagtggaagtgaagtcgctcagtcgtgtccgacttctggcgaccccatggactgcagcccacccctaaccttcccccttctgctcctttccgtttgcagctcttcatcctcccattacaggacagcatcaggcttgcttgtggagttctgggttaccatggtgacttggagttaccaaaaaggttgctcagaacctatcagaagggctcctggacactacagactgatggctcttattgtctcactgggagtttctagcaactcaaggggtaaagaatctgcctgcaatgctggagacccgggttcgattcctggattgggaagatttgctggaaaaggaaatggcaacccactccagtattcttccctgaagaatcccatggacagacgagtttgtcaggctattgtccatggggtctcaagagtcggacatgatttagcaactaaaccaccacagaattgtaccattaactagatgagtaattctggtaagaggattttacatctaatacatcagggttctttgaaggaagaaaggtgaagtcgctcagtcgtgtccaactctttgcgacccaatggactgtagcctaccaggcttctccgtccatgggattctcca

SEQ ID NO: 26397 - DNA, 1327 bp, Bovine  19866880877119
tttctctaatagatagtaatttgttggcactggctctgacagaaaacagatgggtccagcattaagcacaatgaaggcagcagatgctaggccagcccacctcagctggacgggccttgcagccaagtcctagagcccacagttttcaagtgggttcatcttggcacaccagctttggaaaattggtcaccaaatgaattcagattttaacttaccgggagctgtattcaagcaccagataacggaagcaggagctacactctattcacatcctcagcattattttaggaggatcacaaataactctatacctgactccgcaattttaaaatttgctagttaatattaatattccaaggttacggctcctatggaattattaaatgtttccacttattttgcttcttggtttcaaccatccaacaatgacttaggaacaagtactgcatgcaaggtcctatattatttccctttgctgtggagggtaaaacggtgcacaaatcacagaatagacacttgaaaaaaatgaataattagctatatattatgatgaacacatttgtgaattaggtttaaatcagcactttttatggttatctactacacacatttactactacatctgtcatgtttattgaggcagaatttctatgcattagcatgcatacatgccctatgaccaccagcacagctaagacatggcgagggtatttctatcaggacaaagagttgccatctggtggtcaatcttgtccccagccctggcagccactggtctgatttctgttcctacagtgttgctttccccaggatgtcatgtaaagtgactcatatagtactgagtctagctcctttcactcggtattgtgcttctgaaattcacccataatgctgtgcatatcaggagtttgctcccttctgctgctgagcagtattccattttctggggacatgtgggctgtccctgtttctggcaatcgtgactgaagctgctgacatttgcacacaggtctcccagtggatatgtttcatctctcttggtaaactctagggatgactgctacctttgtacattaagtgcatttttaactttgtaagaaactctactacgatacatatgagagttccaagtgctctactgtacatccttgatattgcaaaattttaaaaaatatcagccattccagtagctgtgttgtggatactgttatggctttaattttcattttcctaatgacaaatgattttgagagcattcttcatctaaataagatccttgctgtgtaaaaaagttgtatttcaaaaaccttcttccaatgctactttt

SEQ ID NO: 26398 - DNA, 754 bp, Bovine  19866880984784
ttcgtgttataattttaaaataacaggattaggaaacaagaaaaagtctgggagactatttgttgtgtctacattctgcttttactctggttttttggcagttgggtttttgatattgtattactgccttagcgtctctgtgtgcgtttaagggccgaattgtctggcagaattgtggttgaaaatctcacaaattctaaataataaaagtcaaaaatatatcttagttgcctcgttgcgataatggtctattttaatattttcctgaattctgctgatgtcacggctaccactgaatcagtaagcagagagttttgccgtgtatagtttattcacttgcacacagccacagtgtccttgcagtgtgcagtgattgtgtggtcccacatgccaagtcacaggacttgctgctgtgatttgttgcccactttgcccatgagtgggcactggcctccatctgagcagggaagccttctttccaggccagaactacctctggtgtggctttcctttgatcttaggtggaaatgtgaaaggaatgattcaggggaggaagtgaaagatgtacagggaattgtaggtctcatgctctatgtgatcaagtcaattaaatcctacggagctacacattacaatttaaggcccttatttggctgcctcctaagatgccatgtacatttttctaagaaattcctcttaaactccctccactcttcccaaattaaattttcatttcagtatgactttcttatct

SEQ ID NO: 26399 - DNA, 1626 bp, Bovine  19866880987976
gaggcctggcgtgctgcgattctggggtcgcaaagagtcggacacaactgagcgactgacctgacctgatccgaaagtgcaagcagtcaggcaaggatcaccagagaaacaaacgagcgggaataaaaggaacttgcaggacatagaaaacttagaagaaattttaaaaattatttttggttgtgctgggtctttgttattgtgcatgggcttctctagttgagatattcagttgctttgtgcaggcttctcatcatggtggcacctcttgttgcagagcatggattctagagcgtgggcttcggtagttgtggctgctccttggcatgcggaatctgccaggaccagggatggaagtcatcattccattgtcttctggcttcaagctgatatttcagatactattctgatctcaatattttgtataggacctgtttttccctgcctgatgatattaagaggtggggcttttgggggtgggggggtgatacagtcatgtacttggagctctcatgaatgggattagtgcccttgtaacagtttgcttccttctctctgctctctaccaggtaaggatacgaaatggcaacccactacagtactcttgccttgaaaatcccatggatggaggagccatggacggatgctacagtccatggggtggcaaagagttggacacgactgagccacttaactttcactttcactttgcaaaatttaaagcaatttatagatgtaggaatgtacattatttcaaagttatttagtctgttcttttattaaaatcaggaaaattaaataacttataataccatttctttttaagtgagagactggtatctgggtttataatatataaagttaaagattttttcatgggctttcagagccttattgaacttctctgtagacaaaatgttttgtcatgttaacaaagtttaagaaggactcaacagagatattgcattagtcattttacttcagtgtgctaaaatgaatctgattgtaaaaccaatttggttaaggattctgagtgcctgtcatttccttcaagaccaagttcaaaatttacttcctttatgaagcattcactgatgtcttcttccacatggcaattagttatttaatatcctttatatttaaatatttaaagcatactacaggtaaaatcttattttaatgagtacaattcaaatgtgcttagtttaggtctattttatgctgtcagcgatactaccattgttttattaacttgaatacaataaagtatatgtcaggaagtgaagttaagtcgcttagtcgtgtccaactctttgtgaccccttgaactgtagcctaccaggctcctccgtccatgggattctccaggcaagaatactggagtgggttgccatttccttttcccatatgtcaggaagtactgtataaaaatgactcgatgtaaatactttttttttgatatattctgaggaaagtcaattatttcccaaagtatattggaatttttttcttgttttcactatagaatgctaaatattttttaagtttctataaactcttttgggacaaagaagtggaaatcagagatatttagggaccccagtcagagggtcggttttacaggaa

SEQ ID NO: 26400 - DNA, 2671 bp, Bovine  19866881027869
tgctgagctgcgcggctgtgagaagggcgcagggggggccccgctcaccaggcctcccagcctggagcgtattctgaaggtgaggaggggcttcttcagctttttccagcagaaactgggttagatcagcaacaacaataaaagccagcaattcatgtttcctgtgtgctaacctcagctccaagttctcagcattacctcctttcatccttatgtcaagcttaagagagcccagtcactggcgtcctcacttcagggaggaggagcctgaggcgatatgcagagtgacctgacccaaggtcatgtggctaacaggcctcaaaaccgtggtctgaataccctattccgctagctgcacccaaatggcctctcaaatacttaacagaaaaccacaccgacataacagcatggtcccaatcatgaaagcaggttttctttaagggcacctacaaatctgtaagaagcccagagttttcaacagtgactgatgtcagctctttgttaggtgctgcccgtgaactctctctctcacatggctgcccatgaagtatatgaagagtgagtattttaggctttgtgggctagatgatctctgtcaaaactaaaccgccactgctgccttgatgtggccagaggtgacacacacataaatcagagcatctgtgttccaataaaactttatttacaaacacagtggctggccagagtggccacaagctgctgagccctgtgacagaccagtcttgggacaagctccttaagaaagtgctccatcagcacagaaagtgacctgttaaaggtggcagctactttcccctgggtattcctggaagtccaagggctggagaggaacaagagagcaaggcactggccatctgaggagctggaatgggcaggaaaatcaaagggaggagaagggacagcagaagttcaatacaaatcacatcaggtgcccctgagttgcatgcgagtcagtgttttacagcagcacctcaactataaaccgtattttcaagaagataccctgccattgcagaaataatcaacctgatattgtttgtaagtaaacactggtgattcagatggtaaagaatctatttggagacctgggttagatccccaggttgggaaaatcccctggagaacagaatggcaacccactccagtattcttgcctggagaattccatggacagaggagcctggtgggtccacggggtcgcaaagagtcggacatgactgagccacttacataacacaaaaggtaaacaaacattcactgtttatcaattttgaagttctttataaaaagttctgaggctgctttgaagctgctcatgtgtcccatgggaccacatggaagatccccgtctactttcccatggcaccatctcagaggaaagggcgccttatgctcacactggatgggggggtcacagagcagtggacaagatgctgtgttcccctcttcctgtgctttcccagagcacagtcctcagaactctgctctgtggcaggatgaaggctcacccctcgccaccccgtcctctctcagcccttccctacagactgtttgataacatcagtgagatacagtgctcttccctggctcttgcttttattaaaaataaactcatttgtagcttgaacgcaaacgaaattaatccacatattcttcctgttcctctgtagctagtttccactctccctccctcaacacttggtaagtaacttatttggtaagaaactttattcagtgaaaacatatgtaccctttgctttccaaggaaatgcaatgacttttaatcttgtttcagaaaacaagcatttacatggttattgcagactaagcccataatgcacttgatataagaggaaggtccttggttttgctaaatcctgcttacagttgaagtagaatgctgctcatacttggaacagagaaatattgtccctctgggttcctgcaccttgggtttaactgccaatcaggggctgtattttagtaaccacaaaaggaaaacacctgagatgttcagtacccctgtccccgtcttctatctttctcattcattttatgtgataagaagagaagagctctgtttcagtagcattgctcagttccacagctggtcttcactgcacagcaggaaccgttctgcaatccgggagaatatgcatcagagcacaaccaccacgcgcacccacatgcatgtgtgcactcgtgcttagaaaggcccattgaaagctgggctcccagtcttattttccctcaatcagttgggctgatttcacaaactggcactcaaaagcacatgtcaagagagtatgttctaattatagaggcctctatttggtggaagaaatacaaagttcccttttcttctccttgaaactttaaaagactttcctcattaaactcacatgcctggataaaaatggtttctaaaggctttaaagggcttaagaggcagcaacagacaaagcacaggctgtagaaactggatttgatactgggttctgacactttctaggggaaccaccttggacaacttatttaacctcttggaacatgagttttgacagataaagtaacaatattaacgggcaataggcagaaaggactagtacagtgccaagcatagaattacctcataaattatagctatcac

SEQ ID NO: 26401 - DNA, 2217 bp, Bovine  19866881047867
agtcggacacgactgagcgacttcactttcacttttcactttaatgcattggaggaggaaatggcaacccgctccggtgttcttgcctggagaatcccagggacggggagcctggtgggctgccgtctatggggtcgcacagagtcgaacacgactgaagtgacttagtagcagcagtagcagcaaggtccttaagacataattcaacttttcggttatgtgttttcagtcaacaccataaactttgaaaaactaacttgctcaacacatatagctgttaagcagcagagccaggattttaaagcagccccaccaagtctttatccactgccgaggggccctcaagcttggggttgataactggaagcacctggaagggcttgctgggctgtactcagtcgctcagttgcattggactctttgcgaccccatggaatgtagcccaccaggttcctctgtccatggaattttccaggcaagaatactggaataggctgtcatttcctgcattaggggatcttcctaatctagggattttcaaacctgcgtctctttcatctcttgcattggcaggtggattcttcaccactggcctcacctaggaagccctatctctgccttacttacagttcacatctttaaaatccatatgaacagaccattgaacagtactgaaattgattcagaaattttaaaactcccaacaaacaaaaatgcaggactgctttaacacttgaaattctcttctcgcaagactagagaggaaaaatgctggttcctcaactctccccattctttgatgtcccctgaccaaaagcatagacatttttttattttaaggattatattactatttaccataagaaacagaagagaggtaaaacatctttaaaagttacagcgtccggggctctggagcctgtgtctattttgagatggcaacctcagaccctgtgggcatctgtctgtcctgattcctgaggacgcggttcacaaactcctccccttctttctaactcctaaacgtaaaggacaactttcctccttcctacatgaaagctcgttttcctggtaaagagaaggcggaggggcaattcaagcaaacagccagatactctgccttagagagcaatttgcattttgaggattcttgtcagacacacactttggagaggagggaccgagacctacttggacaaggcgagctttcgagggaattacaaccccattcctcactggccccagcttcctgtgccttgttctctcccaggcctggcaaacatgcctgatacaagggtggagagtccctggcccagagattaggcatcccaggcaccacaagttagaaagcttaaagactgttacccaaggtctcatatttttacagggcccacaattgggtatttcaggtgcaatctgaataattggtctgttctaggatccctgaaatctcatctagactggtttctatggaaatgctggatacaagctccaaacaggagacttgcaaacatctggagcatagtgtgtttataagacagggactctagttctaaaagagccagacagagcatttccaagtggaaaccagtgatcagaaagttcctaaatggtgcaccatgcaattcaagcggggctgccttttcaacggaagtatgagtccctttcagaaaaatgtaatagaacggtctggcaagcaaaagaggctgctgggaaaacaagttcatccaagacagactctgttgctattttggtgttagtttttagtcagctcagagtccataccagtgatgcctctcatcacattcttatttcaaacctcttggcccctgtaggttctatttcaaattttgacatctaggaacctgttagcattgcagttcccagaatttgggtagccctagctccagctagttccaaacactgatgggctttcccctccagctattttaaaaaaatatttcttgagaacttcagtttcgccctatttaaagtatgaggttgaattctttttaaaatctgataaggatcacatattggccatgcttcttgctgcttcttgatttaaggtagctgtcaaaaatgtggtgcagagatctttaaaaattattgcctaagtaagtggtctgcattcccaggtggcacagtggtaaagaacctgcctgccaatgcagaagatacaagagatgcaggtttaatccctgcatggggaagatc

SEQ ID NO: 26402 - DNA, 1522 bp, Bovine  19866881102433
ccagctgagccatcagggaagcacataagtttgagcaagctctgggagatggtgaaggacagggaaagcccggagtgctgaagtccacggggggttgcaaagagtcggacacgactgagtgactgaacaacaacaaaagctgtctgaatcttaccttggagagattggtccacacagcgcaacgcagcagtttgtaaagatgtttccgtagctgtaggggttgtaattttctttacctcttttatttgaccaagatcctttaatctgaaagaaaaggacagtcagtgacacagtctgcctcgcaccaatgccccaggttgggtcaatcagaccatgagaagtccataaaaaatgcgatggtctttactcatttcttcagcaggagaaaccgaggtacttttctcaaggacaactggcatttactctaaacttggaaatgtccccaaacagcaggtcagaccagggggagaagtagcattctctggggagaataatctcttatttccacaacctggtacttaaaggccagttcacataagccagtggagatcttttttcttttttttaaacaccatttttaaagtctttacaatagtgcttctgttttatgttttgctttttttggccatgaggcttgtgggatctcagctccctgagcagggtttgaacccgcatcccttgctttggaaggtgaagtcctagccactggaccaccagggatgtcccaccagtggaggctgttttcatgttacatttagtgtgataaatagtaatggaaataatgggggaacgtgcctcctccaattgctcattgatagcctggattcagctcctaaatactcctgcagagcatttctgatgttcttagttaccaaccacatgtaattgtcttaacagtctctgaactcatgcatctcatcagcactaatttttcaagtctttaaggcaatctgactaattctgagacatttagttcatgtactggcagaaacttctctcagaatccaaatattcagagcagaagggaccagggtcatgacaaaacattttccaacattagattttctggttttatatctcctctctgtcatcattaaatacaggcagataatcctagacaaaagtttaaattttgggtcagggcagtcgcctcccaaaatatgatggaatcattatctgcgagaagccagcctgcactgtctcttcagtggggcagggtggcaagttgctcccaaaacattacaaaggaacagagcagaagcccacctcaggcctcggaattagggggcagccagccgatctgagtagctaagtggtgtggtcaggacaatgtgatgatttgcgatagagaaattggagatgggtgtcagaaaatacttctcccgcaggctctttgcttccagaggctcacatctggaaagggaactcggaagacctggcggcccccacctcttctttctctatttcccaccaaagaacatgcccatgccccacccccacaggaacttacgtcttcattcgt

SEQ ID NO: 26403 - DNA, 696 bp, Bovine  19866881131642
tgctttgtctttaataacatggcttttcagatcatagctattactttaaaacctaattggccaaaatccaaagggctaaattcttagttaacacaaatcactcagagcccttcaagcccaatatagctggggcctgacacacatacgtttcttccccttctctttgacacattaatgcactatctccattactatgtttccacatcagtggctccttgcccatcagcacaactgcgtcacactggcttcaaggaaataatagagaaaaagtgccttgctggcaaatagcaacagggaaaatgaattataaatacacctcactaaagaatagttgctggaaggtgtgtgcatgtgtgtgtgtgcacatgcacagaagacagacacaagtgcctatggaggcccacgaggacacaccaacccgcctaggtgtgtgtgtgccgtttccaagcagagaaaccactgctgagactctcacagaacagtcagctgtgccaacaccaatagttaggttgctactgatccagctaccaagacttaatgaaatttattcaccttgttaaagagtggctaagactgaaaaacagtattaattaaaatctctaatctcctactttactaaaagcaaaagcatttaaatttcagttatctgatcttttcagtatgacttaagaaagaattaaaatgcaggtcctccag

SEQ ID NO: 26404 - DNA, 1112 bp, Bovine  19866881327460
catttataataacggacacacaatccttccatattgctagactctcaacttctgtatagtttaaccaagcaagggcttacgattggcccagccttagtcatatgctctctcaacagtttctaagctctggtctcctctggattcagtagtgaaaaatacaatgttgctttttaccaagtctcatccttggaggactagccccccaaaaagtagccttcaaatacacactaaaacatacagcaaatattcagtaacagcagcaaacgtatcatgatgcccaaaggctttttgtatgtgtattagcaatgcactaatttgacattagtcaaagcactgatctcaagcaaggttttgggtataagattcctacagtgctggcagagttactgaatatacccatgtggctgactctttaattgatttttgcttgtcacttctattctatccaggtatgcctctgagttgcttttgtgctgacatctaatttttctacggtgcaatcagtttctagtaaacacagaaaaaaattaagttcatgagactgtatgcaagtaccactcaatctccaattcatactcacccaaaaacttcacatggtatttaatgtgagtgttggataccaggctcactttgggcaaaaaacacatggaaattcttgcctcatgacagatcctgtcttcagtgatcattacataatctggtaaataacttttgtccaaccaaatgaagtagatgtaaagcaatactactactcctagaatttatttttttatcattaggttcaactgcgacctatattcaggctgcaaaagttttgatactgaattcttttttggctgccacacaaaacgaataacgctgagttaatatacttcagaaagtatggtatctaaatagcagggactagagttgctagttcctggatcatctcagaagacaagtaccttaagctgagatcaagcttggtaggcactgactacctctacaaggtgccgcaggcaatgtcagacccatgagatgactagctcacaaacttcatcctatctgaaaacacaatatttctatcatacatattatttgagcacattcattgctttcctggtaactgcagg

SEQ ID NO: 26405 - DNA, 649 bp, Bovine  19866881395994
tacaaaggtgtatgtgggtatggcctcagaatttacaggaaggagggagacactctgaagatctattgacttctttatccttatgtagtattactctcctctacgtttcgtgtacttcccagtataaaacttgatgtatactctcctgtttgcatactatgtggtgcttcttactaagtgaataaaaaaagttctttggtattaacttttttattactgatgtttgttctttttaaacgtcaaaacttcagcttagtattgccattggtttttatttaaactaaatctttcctctctagacctcatataacaacatgctctcaccccaaaagtcaaatactatgacttatatgaactaaggcattggaagaatagttaagataaccctaaaatactgaaatatattttacaagaaaactgtagccaacatgtttagattcgctatatccttatttcttaatcttgaacatatatatcttaaaatttgaaaagggcagtaagaaatggcttactagtagagtgtcctgttttctagcagggaatataggatagccatctgagtagataaataagtataattattattaacatcaaaatgatcacatttttaaccctctgtaaaatgttaagcttaatgaaactagcaaat

SEQ ID NO: 26406 - DNA, 1634 bp, Bovine  19866881422867
aataaaggctctgaatttttggaacattacttttggttttacattttaaaaaatgtgtgacatttcattctttaacactcaaaatgtactttacaattttaatcaagattgcttagtaagtctgctatgatgttttaaattttaaaatattagcaatttgttctaaactattttaatcccatttcattaatactgccaaagtttcgtgattagtaaacaacattgaaaagagagatccttagttacagaacaactgcttataggtagtggtgaaacattatttaatgtcctgtagtcctcctgtcagagaaggcagtggcaccccactccagtactcttgcctggaaaatcccatggacagaggagcctggtaggctacagtccatggggtcgctaagagtcgggcacaactgagcaacgtccctttcacttttcactttcatgcactggagaaggaaatggcaacccactctagtgttcttgcctggagaatcccagggacagaggagcctagtgggctgccgtctatggggtcgcacagagtcggacacgactgaagcgacttagcagcagcagcagcagtcctcctgtattgttgtacttctctctcattttctctctgttctcactgacatgatagaacaatttgggtaccttttgccttcagctgcctcagattttgctttggttccctgagtgtcatgaagtgtatttgtgtcttgctcaatactgcctgcctgtcagttgctgggcagttgctgggttctctctcggccttgtattgaccatcctgcctattcctgaatctctagtggagaaacataattttaccctagtttgtgtcaaagtgtggatggctgattttctctggggtgctgattttcctctcttgctactgatttccttagccagggaagctttgatgctaggcatacatataaacaacagactactgtgttcttattcatcctcgtgtgtcctaaaattcactgtagatgacattcctggaaatttatttctaattattaataagaataattatcatagagtgaaaacaaatttggggtggccttgggcttaggattcaaatagattgaattcagacattcttgattgcttttacttgcttgtgatcttaaaataattataacttctttgaaactgccatgtcttcagtaaaatgaatctcctatacttattgatagaagattatatgagctacctaatgcaaagagctaagagtccttcttactttaggactttattcccatgtcatttagcctcaagctccttatctttaaaatggggatagtaacatgtagcatcatgtaacagagttactgagcaaagtgtgtgtgtgtgtccagagacaacctctgagtcttctgctcaggacatcagttagggcccggggtatcatctaaggcatggggttctcctttaagctcctgggggttgttggcagaattgatcttccttacagctgtaaaacttaatggcagctagctttttcaaggacagctggaggaagtctatctgaccctgttaaaagggctcccctgattagatctggcccacccaagataaccctcccttttaattaactcaaagtcaattggaatagtaacctcaat

SEQ ID NO: 26407 - DNA, 1080 bp, Bovine  19866881600986
acatttatttaatcacaaatacttactgaatgcttacttatatgtctggttcaaaggatatagtagggaaagaaacagagttcttagtactcacataatttatgttcaggtgagaataggacaaatgacacagagaagtaagataagaactatggggagtgttaagactgtgttgcctataagaaacagaacttaaacttgtgagtcctgactgccccaccatcttggtctatgaagtataccaggctgtaatatattcatgtcttgggacgtccactgtaagttatacaattactagatgtgtgctaattaaccaaaagtatacttatttgcctgtctctctcagttttgttataaactaaaatcctaatgttttgttctttcaaatgtttaattgatgattattttgatttagttcttaaaagctatttttaattagaaaaattccctcaaaacctcttctagtgttaaaattctaaggaaaatactaagctaaccaaatacaatagtgtgtgtgtgtgcagttgctcagtcatgtccaactctttgcaaccccctggactacagcccaccaacactcctcggtccatggaattttccagggcaagaaccctggattgggttgccatttccttctccagggtatcttcccaactcagggattgaacccaggtctcttggatctccttcactggcaggcggtttctttaccactgagccactagggaagccccaaactcacgattttatacacacacaaatactgaggtatagagtatatatgtacacattggtgtacatgatctcttcactgagagaggctagaagcagtaactcctcagaaataatgagtaggcccaatgcccagattttagtctcttaacccccttctccactaaaaagaaccagagctctgaggagaggtgacttgattatagaactggggtgaggaaaataaaagatgagcctggaattccttgtgacttctaaaaaataaagatttgaaggagcttctaatggtcaaagctggaacaacttgagcaacccaataatggcacaatgaattttaatccatgagtg

SEQ ID NO: 26408 - DNA, 717 bp, Bovine  19866881651394
aatggcagctactgggaacagaaggcctagattatagttttgcttgtgtcgatggctcagaatctagtagggtagacatatttatgtaaatatgctgcagtgtgtgaactgatcaaaactagcagtgtgaccttaggtgaatcataatttacctgaggctcggcttcctcatcttaaaatgtggatgaggttgctataagataactgaaatggcacatgaaaatgctctgtaatctgaaatgtgatacacaaaagtaagagatgatgatgataattttctggtttataaattgctacgagtatattttaacttctgaacactccacatattcaggagcagtttccaaccagcatgaagaagctagtttttatttcttcattttttaagtatgtgggatccacattactccaatacttgtgtaactgtctacaaattccaaaagattaaaaaaatatatactcctgtctcctaccatttagtctccctggccaaaggcaagtggttttttaatgtatcctttcagggatattttataatttgtttgtgttagactgtgcatttcctttatcatgagtaaagttgaacattttattttacagcagtttcaactcttttcctagaactacttatatcatttgtccatttttctgttggccactctatgtcatgactaggaagcatttcatcttgcagattcagctgttattaccaaatag

SEQ ID NO: 26409 - DNA, 1679 bp, Bovine  19866881702711
agaacaaatgagaggcagttttgttttttttttaacgaggtaacatggaaaacaatattcagtgacacatgcacgtctccagggcaggtgcagggaccagaaggattaagaattcatttgaaaggctctctcatttgacacatgcaagacacataggtacttaataaaaaatgtaaacattgatttgatttaggctcagcttcaaaacagtggtaaggcattaatcagaaaagtatttttaacatttattccctttatcctctatttcttacctgtcaagaactaagtgggctaaccagtgtggataaatgaaaggcaactaactttggaaatattctgtatactattagccgaaacccctgatgcctttcagctaacttcaaaaactgtaagccaaggcagagaaacacagggttccaggtgaagagggtggtttgtgggcagagctctggaacggggcagtgatgttacagagaatcatttgtggggtgcagggctgggaggctctgagacccacagaggggctggtcactggctctgtacccccaaaaggctgctccagggaccccaagtagcttgagttccagtacttccctggagatgccgtcacacacctcggcatcaagggcaccactgccggtgttggcaatcccatctttcttggggttgaatcagggcatgaagagtgaaggggctttcaaagccacagaaagcgcttgacccactcaggcctcctgacatggggtttgcttctcgttttgaaccccagtcagcatcctaaacgcagcaggggaagatggcagtgcactcggaggagcggggaagagctccgggaacatccttccttggtggcattccggaccagaacaggtatctggcttttttgctggctcagggtgagaaggtgccgtccttctcataggctgaaatgattacatctgaaagctggaatgagcatttttgagcaagcacagcacaagcgctgggctgactctccccaggcgcagagcgacaggtcgccatgccctttcagtggcaggctgtcagctgctctggtattccatccacggccttcctgggaacctgggcgttcaagctaaatacagccttcacgtgcctgagaagcctgaagcacccgagccctcctggaaggatggaggcagatgaatttttaaacaacaaaatgagtgtgtacgtgagtgtgtttgagaacggtccaagctttaatagcatggtaaaatatttatcctatattttatagctagtatgcaatcaatccataacccactgacagaatgtagaaagatcaaggtctattcagccacaactagatggaactactcaatattaaatagatttatatgcaatcaggtgatgggaaatgcagacccataaccggggaaatcagtctgctaaagatcaacccttcacccacagggaagaaggcagctcctgggagcacaactggtcaacctacagacactgcattctttttcaagccacagagcgaaggactacggggatccctctggtttgggggttttaagaggttaattgtcttagcaaatcagcccactcaagttcatcttcctcttggaccctgaagatcctagctgggtgtcaccaatacccccaatcccctctttgataagtggtatcaagtgtatacaggggacgga

SEQ ID NO: 26410 - DNA, 1517 bp, Bovine  19866880187951
tgaggttattgatatttctcctggcaatcttgattccgcttgtgcttcttccgtccagcgtttctcatgatgtactctacatataagttaaataagcagggtgacaatatacagccttgacgtactccttttcctatttggaaccagtctgttgttccatgtccggttctaactgttgcttcctgacctgcatacagatttctcaagaggcaggtcaagtgatctggtattcccatctctttcagaattttccacagtttattgtgatccacacagtcaaaggctttggcatagtcaataaagcagaaatagatgtttttctggaactttcttgctttttccatgatccagcggatgttggcaatttgatctctggttcctctgccttttctaaaaccagcttgaacatcaggaagttcacggttcacgtatagttactaacatattaaatcttttgacgtgttagctgaataactttctgagtgcttgcatcatgctaaaatggtagttgttgccatagcaatgaaaaggtttagtggaatacaagcaatattacctggtatccctgagcatttgagaagagttatgaaaggaggacttattttaggccagtttaagtttataaaatcgaagaatcatgagctgtgttaacttgacatgcttatagttatatttcttagtattctaagcctcatcacaatatagtttttccatgtgacttatgaaggaagcataaaaaattatttagaatgtacctatcacaatcataatctgtaaaacttttatcaatagcgaatagtcatctttggaattatttttcttcagtttttgtaaatagagctaattatttctggaaaatttaaatggtggtacaactaactaggcataatcctttacagaaaagatagaaactatgaacaaaagcaaactcaaaacgttttgagtgaatagtgattgcaaaaaaaaaaaaaagcaaaaaagagaaagacttgaaacctagtaacccatggttttttaaatagagaggtcattttaggattacattaattgctttagggttgtttgaaaatattttgatattggaatactaatgagattcacttttctagtatactcttcacaatattactatatgtgtcataaaaatttgaatactagtagctgtaagatctgggacagatgaacccacctgatttcaacttcttcagtttattcaagtatatggctgaaaattgaggcaaaaggactaccttgtgtcccctttctgctaggacatgctaagattatagaattaagagggtaaatatagccctctagtgggttctgttatatacttacactgttaactttggtgcatctatcatttttcttaaattgccgatttttaggaatttcactattgagtagaatcagatttttataatatatggcataaaaaattacaaagaaaaaatatggtagggatatcttattctaacaataaatggtcatattagattatcatccatttatgtaat

SEQ ID NO: 26411 - DNA, 2157 bp, Bovine  19866880344262
cttctccaacaccacagttcaaaagcatcaattcttcggggctcagctttcttcacagtccaactctcccatccatacacgaccactggaaaaaccatagccttgactagatggacctttgttgacaaagtaatgtctctgcttttgaatatgctatctaggttggtcataacttttcttccaaggagtaagcatcttttaatttcatggctgcagtcaccatctgcagtgattttggagcccaaaaagataaagtctgacactgtttccactgtttccccatctatttcccatcctttatcatatccttcaatactggtaaatgtttcctgagttgtatgatccactctaggaaagtaaaaaacctccaggagagggttatgagaacccctgacttatcaacaacttggacagaagttctgggtaacttggggtccatctgaagggagggacagtcacatgggagtgagcccttaatctgtggaatgagatgctgtctccaagtaggcagtgtcagaattgagttaaattgtaagacaattggctggtgtcaatgaattgcctggttgggggaaaacagccatatctggtatcagaagtgctatgagtctggtagaagcatgagagtgaaggagacgcacagaagggggaaaaatgagtttttcccaatacatattttctatttcaaataacctttgaaaatgcaaaattcatctctagctcacaggttgtgcaaaaacaggcttcacactggctttagcttgcagacccctcctatcccagtgcatagtacccagatcagtgctttgtggaatatagactttaaccgagaaatatctgattaatttcatgagtgattacatgatgagtggtcgagggatgccgctgttctttgcctcttgcaaaggactccgttttgtgccctcacactctgcaccagaatctaagtccagaatctctccagtgtgtctgattctaggaacaagctgcatgaagtccccagagcgtagagccagaaatgaggtgcttcttccacacaactaggctttgatccaaactagcaggggagctgtgtgcagttaggttcaattattctggggagaaaagtggtgagagtattagaacaatattattattattgcatttggatggcaggtattcatgtttctccatgaatgtgtaaaatcctcccttccatgctgattttaattgaattctgacaaatccaactttcctgaggcaagagaaaatgagaatgttggtattagcatagctttcccccttgttaactgtatttacatatcaactcctgggacagcatacattattttctcctttgtgcctaggttttatcacagcagcaccaattagctctgttaagcatctttctacagatacacaggaatgtgagagatttttactaccaacaattcaggcattggctttgcttctcctataaagtcagttttaggaaataattaatatgacattaaatttgaagcacagactatatgtgtacctttacacatttcacatacttctctcttctctttaaatactcaaagattgtgaggttgattatcattgtttatttcaggtgaactctatacattcacacatttgctcactagagcaatgttgggatataaaatcatcagtagtatccatataaattgcattccttagccgatttcttactctaaaaggtaggagatgtttcttagctgaaaagtacaaaaatgtccagtaggggttgctgttgtacactgaattagccaggagagcttgctgctgctaagcacttcagtcgtgtccgactctgtgtgaccccaaagatggcagcccaccaggctcccccgtccctgggattctccaggcaagaacactggagtgggttgcccatttccttctccaatgcatggaagtgaaaagtcaaagtgaagtcactcagtcgtgtctgactcttagcaaccccatggactgcagcccaccaggctcctccgtccatgggattctccaggcaaaagcactagagtggggtgccattgccttctccgttagacttgtcaattctctccaaaatatattctttatttttccctatgcgtccacctgataatcttaaagaaatttccagaatccctaagtgtatctttt

SEQ ID NO: 26412 - DNA, 1307 bp, Bovine  19866880352077
cactgctgagttttccaaatttgctggcatattgagtacagcactttcacagcatcatcttttaggattgaaatagctcaactggaattccatcacctccactagctttgttcatagtgatgcttcctaaggcccacttgattttgcattccaggatatctgactctaggtgagtgatcacaccatcgtggttatctgggtctttaagatcttttttgtacagttcttctgtgtattcttgccacctcttcttaatatcttctgcttctgttaggtccataccatttctgtcctttattatgcccatctttgctgaaatgtccccttggtatctctaattttcttgaagagatctctagtctttcccattctattgttttcctatatttatttgcactgatcactgaggaagactttcttatctctccttgctattcttcggagctctgcattcaaatgggtgtatctttccttttctcctttgcctttagcttttcctcttttctcagctatttgtaaggcctcctcacagccattttgtgacatgttgcaattcgttttcatttcatgcatccatttatctaatggatttttagaacagcctgacaaaaggaattgggcacatagagagcagaaacttatggcttatgtctcctccctttcttatgggtaaaacatgacctcacataattttagggctcaaatcctaaaagacattcctagtccccagttttgaggatgtggaaagctgagcatcatagttacttttctcttccctcctcactttctttattttttgtttcagtttttgggtcagaggagagaccatttatacaaataatgctatatatattcaagtactctcccaatgaaattttcattaatcatctctcaggtggaaaaaaaagtttgatttcttcttgcagttgcaaaccctagttaagactgtgcaatggaatcaatgggtcaatgctatttttcttggcactggagttaccattgcctagtaatttgggaatattccacaagagattaagagttttctcaaaggaacaaagctttctgtagaaacaagatatgtaaccacttttgtagttctgggtgagttttttgcttcaacattaatttctactatgcccacatttactttgaggttctttttagttcattcaagtctctttttttaattttctgccatacttaattagggtcactaatcgtaagactttatctcattgttcccatcttaaaagtccaggaatcggcacattgttctttccatatgttgggacagtcaataaacctta

SEQ ID NO: 26413 - DNA, 1782 bp, Bovine  19866880471689
tatttggctagatgaaaagtcattttacattattgtgactatctaaatttcatttattgcagatctctgtagggctgtatgacttatatttcttttttttatacaactattccccctttggagttaacagttcattccttttctttttctttcttgtcttctgtccatctctctccccttctcttcttctctccctctctcctccctttccaccccctatctctctgtagctttgtttcctgactgttctgtgtgacaatgaagtgattttggaaagtggaagctttagtcactcagttgtgtccaactctttgtgaccccatggactgtagcccaccaggctcctccaggcaggaatactggagtcagtaactgtttccttctccagggtgatcttcccaactcagggatcgaacccaggtctcctgcattgcatgcagattctttactgtatgagccaccaggggagcctggcagtcctatgtacctgttcctaattcatctctaaatagacgcttcagtttcctcttagtattttcatatgcatcagagactaaattgacttcatccttttcttagttatcctcctgacacccccagatctcctgctccagattacactggctcttctttaagatgactacctagaaagtcagtatccccacatctcctttatcacaagctgagaatgctttggcctgtctcctggatcagatcacctgttttctggattgcatgtcttcctttttttttttttttttggttgattttctcacagttggtggaacacatcccctaacagagtcctgagaacattatagggaagtcaaatttttaagatttggtatgcctgaaaatgtcttaatgctcctattatatttgattgattgttcacttggcatagaattcaaagtagaaaactaattttcagagatttttgaaagcattactatatagtctctcagttttaggtgttgctgctgagaagactgacagtttcctggtggtctgtgttctctctggaagcttgtcactttctctgtgtctccagttttccctctgaaatgtgatgctgatgtgccttggtatagctctttattcacccacgtacctggtacggggcgagtgctttcaatgtcgagactcacatctccccttctgggagcttccttgtatcatttctctcgtgaatttcactgccctttttgttttctctattctctttttatttggatatttaatctcctggatttatcttttaattttcttaaatattctctcctacactgtctctctttggggttttgtttgtttgtcttggtttctactttctgagagatttcttcaaccatgtccaggactgagattggctgaggagatgctcaagcctgggttgtaaaatttaaacaagcactgaaaagctcagtaacccaaaaaagataaatccagctgtattctccgcagctcaccagcagaaaaagggcattctttacattcatgaaccagttcatccatttcacaagctccagttatcatagctggctttaggtgtattaacagagtacaatgaggggaaaatttcagtgtttcctctatgtcttcaacatcataaacttattcaagttccaatccagataatttttcatgcagttttagatatactagctattttgatattttagttattgggcttggtgaatactgatttcttttacagatgtctgtgataatgatactcatgtttctggtggcgtggtccccttattccatcgtgtgcttatg

SEQ ID NO: 26414 - DNA, 1412 bp, Bovine  19866880486422
tgacccactggaaaaaccatagccttgactagacggaccctttgttgggaaagtaatgtctcttcttttcaatatgctatctaggttggtcataacattcctttcaaagagtaagcatcttttaatttcatggctgcaatcaccatctgcagtgattttggagccccccaaaaatgaagtctgcctctgtttccactgtttccccatctatttcccatgaagtgctgggaccagatgccatgatcttcgttttctgaatgttgagctttaagtcaactttttcactctcctctttcactttcatcaagaggctttttagttcctcttcactttctgccataaggacttaggggatggttttattcatgtggtattcataaaagatcattcctgtaatttctgagcagttagttttttttttttttgaaaaagcttttgcataactctagctgaaaaaataaaccagattttgatcatggaactactctggtttgcacgtaacagggaagctgaccaaaccctagccagtgctgaaatcagtgatttcactgtttactgctaaaggtgacctccccagatggctgactagtgctgaggtttggcctgcatttcttcgtcactctatttaccaggaaagtgaaagtgaaagtcaagtcactcagtcgtgtccgactctgcgaccccgtggactgtagcccaccaggctcctctgtccatgggattctccaggtaagaatactggagtgggttgctgtgccctcctccagggatcttcccgacccaggggtcaaacccaggtctcctgcactgcaggcggattctttaccattggggccaccagggaagctgtcccgagggggttctaatgtggcgaggaatcccacctgcagaggccgggagagccggcccgcagctactcctccaactggggtgtcctggtgcgttggctagggtgagctcggcaggtgccacccctgacttgattagacattccagggccaaacccaacctcagccacaccccgagccccctgcacacgcatgcaggaatcatggcaggatctcagcaagccagcctggccaggcaatggctcatgaacacactctgctcacactccagacagagcctggcaggcggaggaagccctgggcaggggtcagggtgggatgaacccaacacggagggaaagccagacacagggaccacaagatccacccgggccccccaagggccagcccaccatgctgcagggctccccacgcctttcctggcacctgccagaaatagccagtcttcaggggagggtaagtgctgcacagacctcaaccgcctgcccgcgtccgcgggccttcctgaatgcccctccctcccacccgccgcagaggaaaccagagaccaccctgacctttacc

SEQ ID NO: 26415 - DNA, 1217 bp, Bovine  19866880556391
attatgaggttaatgcagaagtcaactggtgaagtttctgtcaactgttacacttaatgtcctcttcctgattaagagaaaatgaaaatattaaaaatatagaaaagtgaactttaaacaacactattagccagaattcaagtttaaaatcagcattagttctcgtaaagttcaacaaacatactttaccaaatttaactatcatttatattaccacctttttgcttttcaaattaataatacagcaaagtaaagcagaagcaggtgaaaaaattcaaaggtaaacgtgatataaaatgaaactgtatattcagctaaaaaaaggaataccatggtgttctacatacttgctggcaaaaagaaataaaagttagtagacaataccatttctagaaattcagttacttcaagttttttttttcccactcacctctgaaaccaccaccccctcttcctcctctgaaacctccacctcctcttccacctctaaaaccacctaaaaataaaggaaatattaattaaataactgtaacctatcatattttgataagcctataaacatcaatatatttcttacaattataaagaacagtattaggttgttacaaaagttactgcagtttcagaccctgaattttaaattataactaggctcaagcacttccttattaatcaaaataggaaccattacaaccaacacacttttgccaacgagaaataagtttgtttattcctgtaacataaaaacccatgctatgggattcaatgaactcttggagagcattttctgtatcctgctggttgtggaagcttcttccctgcaaaaagttgtcaagatgcttgaagaagttgtagtcatttgccaagaggtcagatgaataaggctagaggtctggtgaattcagcaaatgaggcaaaacttcacagcccaatttgttcaagttttgaagtgctggctgttcgacattaggtcaagtgttgtcacggaaaagaatagggcccattctacggctgatccggctgcaagcattgcaagttttcggcgcatctcatcaatttgctggggatacttctcagatgtaatggtttcaccaggattcagaaagctgtagtggatcagaagactggcagcagaccaccaaatggtgaccattaccctttttttggtgcaagtctggcttagggaagtattttagagcctcttctcaatccaacca

SEQ ID NO: 26416 - DNA, 1482 bp, Bovine  19866880557158
aatggactggttgtatctccttgcagtccaaccagttacttcatcttaataaggatgtcacatcacctgatgtactctaggatcatgccagttaggggcttttatgaaaagttaggtctgaagagtcttttgaggattcaattttttgttcaatatcatatattttttaaaccctactaaacaaggattcttgaagaatttgtgaagtaatactgcaaatttataagcaaagtaatccttaactcagctttaactcaaaataatccttaacaaatggttcagaattataacacttatatcctaaatgactgtgaaatctcttcaagaacgctcatgttatttctcacacaagtttcagaaaagctgttattctagctacttacatactaattccttttggtaaaaggatttaaaatgccctgtgtgtcaccgttttacattgttccagcacctataatacaaacatattactgaagtcctattttcatccagactcaaatatattaattggattacacaaaattaaaattatgaggaaagaatctcaagcttaacattattgagagggcatgccccaaaatattaatagcaaatatatgtggatttctgaaaggaaaggttttgtgttcatgcttttccgcagttaccagttttacgaacagcaaattctcatttttatgattataaaaaaatcatttaataaaacaagattactggatcccatttccagctgtaaagaagcaaaggttggcaggcagactgtagttttgggagcaggaggccactgctgcctggactcattaacctgcagctcccttcatgtacacagtggggccagtctaggtcctctcataacttacgtttacaacaaactgtacacttatctcctatttggaccagatcacgacactatgagctgatttttctcttaatctggagcagcagagtgacctgcaggtccatgccatccccaaggaagaggccagggctctgctcagcgcccagattccacctgcaaagcagggtttgctctcttggccttcctcagaaagcgcctcttacagcagctctgaatcctcctctgtaatggacatcttaatttttttttaaagcaaaatattaagcattcagttaatcagtctaattactatttttcctaggaatactttgacattttgaaaatccacattgttcccagagtcaagggaaaagcacaaaaaataccctatttccttctttggaaagaagacttttcataaagggcaaggagacttactaacaactatttacaaatctcttttcatttccttttttcattttgaaaagctatttttttcaatgcctagacggacactagagacacagcaaaaatatcagacaaaatccttcccctacagaccttctagaatgagcaagattagcaatacacatagtggctggaaggtgatccctgtcaaggagaaaaggaaatcaagacaatga

SEQ ID NO: 26417 - DNA, 1599 bp, Bovine  19866880605142
ggggaatttacccattttcattagaagaaaaaattctgtggggaaaatgatagtaatgccagaaccagagaaatctcttgggtaatggtttaaaagttttccttcaaagattttaaaatagaaaaaataagccatgtaattttgaagaaataaggttctaagttagtagatttttcattaatttatcaaaatttattctgcaaaattaccatcatggaccacaccgatgatgttaaatgcctagaatgtattataacaacaattttaatattctaaccacttcataagattgagctaaatgttctgtccaaataaaaggaattataactgaccaaacccgtatgattgattgctttaaccccagatttcttctgggcaggaaaataattcatatttattattgaacacttgaacacaatttataaagcactattccccccattttggtatctaatgagataccaaataattctccagtttactttacttgaaagtctgcagtaagactacttgaaggaagaagcaaaaacacaatatatatttgccttcaacgctgagtaggtgatttgttgtagagattatagatggaaaatctgtatttttcctctactttaaagatgaagtattaaccatccatcaatacggtttattcctcatgatcttacttttaattcaagttttcagagtcagctccatttggtgtggagatctttgttgccacaaagggtgagctgatgggagaggacaggatgtcccaagcccctcagcaatgggccatgccccttcggagaggagatgaaagctacacttcacccctggtcaccagagcctctatcgttggatgacgcaatacagcctccgtgttctgcgcccgtatacatctggggctccgctctccatgatgactgttccaaggacgctatacaacagaaaaaaggcatttcagtattcccatcacttacagtgtccagccaacgagaccctaacagtggttggagagtagacctgaaatatgagatacaaatggacctattctcaagccattctgaacccaatttttaaaaaattaaaatagttttggttagttaagatgattcaaaggactgtgctacctgacattgctatttagctttctctgtgaactctctctctttccatttggcccataaatgacttgaaaacagagcccaggttttaaatgcagttgcattcctattccctgacatggtattctacccttaacctgctccagttgatgttggttttggtcaatgaataagtaactttggaggcactactagtaaggcttgtggtttaatgggttttccaggaatagacaaagaattggttcagagccaatcctgagcttttatctcattttccactctacctccccacctccaatctctacatgctctttcataacaggtattaaacatttatgagctggctagacatgattggggatgtgatgactcatattgggagacaggtatatgagtggctcatacagaatgggccaaactgtttgcaacagaatgagcaaaaagagagagactctaatttatttctgaaaatagtcagctaactgagtcctca

SEQ ID NO: 26418 - DNA, 1912 bp, Bovine  19866880680358
ttaaagaagaaaggagggataaattaggagtttgggattaataaacacagacacacacacacacctcccaacacacaatggataactaacaaagatctactgtatagcacaggaaaatatattcaatatattgtaatgacctctaagggcaaagaatctggaagagaacatatatatatatatggatatcactatgaagtgaagtgaagtgtttgtccctcagtcatgtccaactctttgcaaccccacagattatagcccgccaggctcctctgtccatggaattctccaggccagaatactggagtgggtagctgttcccttgcccgcagattttcccaacccagggatcaagcattgcagtttcaattctttatcactggagctaccagagaagcccacacctaaaactaacacaatattgtaagttgattatacttcagtaaaaactttagaaaaagaaattgccattttacaggccctattgacaaattggatctaggcaataattacaaagtctgctaaaacccctgggtcaaataataataataaaacataaccacaaaactttaaattaccttcacaaccaacttcatcttctcccgtgatacagtccagctcaccattgcacttatactgctttggaatacaaacacccgatttacagagaaaaccttcacctcggcagtctgtgcaaacacaaatagaagaggggattttttttcattcttaagatgcaataagatgggatcttaagtcaatgggaaagctgcttctgttttcttagaagaaagcacttgggagtttaaaggctgggttcatctctacctttacagcacagctcatcactcttgtctacacagtcattgacaccatcacaggccttcttctgaggaatgcgtttcccattcacacattgaaaggagtccttttttggaggagctgtaaagtagaattgtctgtgtgaaatttatttagcaagttgtggatgacatctttatcacatgtttggaataatggcatgaagataaattcaggcacagataaaaagtgatataaaatgcacgagtggtagcattaccataatatattaatagggaaaataaatgccaaagctggcttatggaggccctttgctaatctctgaaagccagcatttattgtggaggcttcttctgagactgggaaaggggatccgggaatctggagcccttgcaaacactggtgctcacgcactcctttcatgctgacccagccccaccccgaggcttacttgggcggttccatttacattttgatggctcttttttttagcaccaaaaaggatatgatctttaacactatatatatagctaaaatattccaatgtcaggatgaaggagaaaagcagcagtgattgtctcaagcatagatgcgatcacttaaccattttaaaggaatatgtaatcagctggactcctcaaaggagatgctgagtttcttctaatatttacctgtgtttgctacatcaattttaatccatatgttcaaagaatcaaaggggaatcaaacaactttacttcccatgtaggaagtaaaggatagaaggatatttgaatggaaaaaaagtacaataggggaaaagcgccgatttgggctctaaaacccaaaatgtgattttgtcattgtgtgtgactggcaacaggagatccgtaatttgtttgtttagtacagacttggtgtgaaacaaacagtctctaaggaagggaaaatattgggcaagtactccactaacctgcactctctgtgtaacacaccacaccagccaacccctccgaattgtgtactcccttagtgaaagtacattcagccaaactggtctctaatcctcgacaacgcacatgcagacattcagcagaatttggatcaggat

SEQ ID NO: 26419 - DNA, 846 bp, Bovine  19866880746169
ctttattaatgtgaaaactgagggcagagaggctaagtagttgtgcacgtgtgtgtgtgcagtcacgtccaactctttgcggcctcatagactgtagcctgccagcttcctgtccatggaactttccagacaagaatactgggctggattgccatttccttctccagaggaacttcttgacccaaggattgaacctgtgccttctgtgtctcctgcattaccactaagtcaccggagcagctccttttaaggtatatcttatactaaaatatcctgtataatgacttgaaatattactccaggaaggaaaaatgagcctgagcacgagagttttcatagttaaataggcaatgtggggtttggaaaaactggtgatggagtcaccccatgacctgcattcctatatcattgatttgatgatgtcctaactcacatatattccctttatgcttttgcagtataaattccaaaacctcatgagaaatgtgaaaatgtgttctggggagttttttttaagtcagttgtctataaaatgtattatatattgaccataatgtatatatcaatatcatatatattggttttttctttttcttttttttcaacttagctacacattaaattccccatcttctttaaggatcaaaacactgctgagttttcaggattgagaaacaactgtctttatttcctgccctccaaaataaatcatttgggttgtttttccaagataaattgtatttaacttccttttaatttttttgtttttttttttttttttttttaccaccagacttttttaagttagtataaaatctatacctagcaaacacatttctttaaaaa

SEQ ID NO: 26420 - DNA, 851 bp, Bovine  19866880792569
gcagacactttaacctctgagccaggaaagttcatataaataatgcaggcagagacatgaaacaggaaaagttccttttcaattgctatttctcctccaaggaaaatttttattttatttttattttaataaaataaaattttattctccaaggaaaataggcttgaaagttcaaaagccacttgacagcactttttcttattgctctccttttgtagtgtagcccaaacagaagttaacagaatactcagtgattagaaaaaacaaaaagaagcaatagcagcaggaggcatgggggaggggagaaatgaaaagaaaacccacgtctctgttaccacttggtttatcaggctcatagtcacattcaagacaacatggcataaagttacatgaatcagaaccaggaaggattcttcctcctgggtcaggctggccacacatggtctgtctcaatgccaagggtgaggaataaggcaagtaaaatttaattagaggaaaaatagatgatggcaccatatctatttagaaaggagaaataatatcctctgaaatgcatgggcatagggtgcgacctgggcagttattggctaacgtaagacatggagtgtcaagtagaggctttaagcctttgacttgcaaggaatgaaggagcaaagagtcagagtcacaaagtggcatccagacattcctccctccatggggtctgggccatgtcactgcagtgctcaaatgatttgatcaaagagatttagccaagatatggagccaagagaatatttattaagcacaatctgccagcctctgtggtaagtgcatttcccatattatcccatgggatccccacaacaatt

SEQ ID NO: 26421 - DNA, 2136 bp, Bovine  19866880827806
ttggtgatggacagggaggcctggcgtgctgcaattcatggggtcacaaagagtcggacacaactgagcgactgaactgaactgaactgaactgaagagtatttggcttatagttttcacatgctggttagtttttttttaattgttatgtcctgtggtttgtgaaaaatctatgtttcatttgatttcctatcttgccagcaagtaatctagctgcctttagcaagagcagaaatttggcatgtgaaagtgatgaaaccagcaatccactcttttcctgtgtctgttttcttctgtattttattttcaccacaattacatgctgaatagcaaaaaaaaaaaaaaaaaaaaatgagataatggatctgaagctaaaaatatatcttattaattcagattatggctacacaaatacaaatttaaacttaatgtttgtttctaaccataaatgagaaatgattaaaaatgtaggtgattaaaattcagaccataagttgaagtgaaactttaataaatccaggaggaaatattctgccattctttatgcttttctcctgttgttttaggcacaatctgcttgcagagtccttctttggagattgtatcttctattcaacatggaaaaagaagacaatttggatagctaacaagcacacagggaaggatatggttaaaatcaccctcaactcgtcattcgtgccacccagtggaattaaagtggttcgtccactcgtatagcccaaggcagagggtgatgcttgggcatctggtgagtcatctttgacctcaaacaaggtccggcacgtactccccacttctccacttactcaagacagacatttaggaatcatccctgatttctcctactacctcaccccaattttcagcctactgccaaatcctttccattttacattctaatttatctcaaatgtccacttctctcttccactgccaccaccatagtccaaacagctggcttgtcttatccggcctgttggagcagccacttaatcttttcattttctcctcttgcttataaatggtaaatctgaggggttaactcctctacttaaattccttcaaaagctctcctttgcagttagattgtaatttaacgtgtaaccaggcctatcactatttggccaatttgatttagcattctttccctctcccctcactggactctaacacaaagcttcatgtagttgctcagacacgccaagcaaaggggcacagtggatgtacatattcaggctcagctcccctttgcctctcaaggcccacatttatctgccttctgagcatttctacttggatttcttgcaagtgcttcaggcacagaaggaatgactgactcacttactttcccttcccttttgccaagctcttttccctccagtatctggttgaagacctccaggtgtaggccttgatgagtggcatttaatctccatatccctaggcatagatccatccctgtgagatcactctccaacgcctagcaattccaccacctaccggcttgtgcccctttcggcagctctccatccctgggggccacttcattagtgtccctgactccttctgccatgctgcagggggcatcacccttcaaaaaggagaacccaatcttgtcattcctgggttaaaacactcagttgccagtaataaaacccagtctcttttttattgaactggttcacagggcccccgtttctcagtttcatttatcgtcagggctgcagacatcttcaaagttttgatttttctcttaccctaggaggcatgcttgctctctcctccagcctttcagcatgattgggaacatggtttctccttttttttgactgcacggcttgcaggatctccatttcttgaccagagattgaacccaggctgagacagtgaaagccatgaatcctaatcactattccttggtggttcagacggtaaagaatccgcctgcagtgtgggagacctaggttcaatccctgggtcaggaagatcccctgaagtaggaaatggcaacccattcctgtgttcttgcctggggaatcccatggagagagagcctggaaggctataatccatggggtcacaaagaattgcacatgactgaacaatgaacaattt

SEQ ID NO: 26422 - DNA, 1303 bp, Bovine  19866880849306
tttttgttataaatttcctatttaattgtattgtggagagagaatttctccacatgaggacaattgtttaaacattttttgagacttcctttgtactgagtatatttcaaatgcttcatatgcaggggtctacataatagatgtgttagaataaaaatttttattccattagaataaaaaatcatgtcaattgctttattcaaatattttcccatttatttatttataagttttcaaggtctttatcttttgagtgtgtcccttataaacagcatatatctcattttttaaaaaaatacaatatgatgatagctgaagagtttagtccatttacattattgtgattatttacgttgttgattttcctgtcttatttggggcttattatttgcccttttcatatcctcttgtttcttccttttaaaaattctgttgggttaataaagctgttgttgttttcttaatcttccttttcttcctctacttggtttgaaaatcatatatatcctatttctattccattaatggttatcttcacgtttataccatgaatccttaaattatgaagttcttgccctcttcagaaataatacaaagaatgttgtttccatatcaacttttcagtattttgttccaccttatttgtatatattcctgaagttaattgctatcattatgtaataaacaattaccaaggaatgatgctaaagctgaaactccagtactttggccacctcatgcgaagagttgactcattggaaaagactctgatgctgggaggaattgggggcaggagaaggggacgacagaggatgagatggctggatggcatcactgactcgatggacgtgagtctgggtgaactccgggagttggtgatggacagggaggcctggcatgctgcgattcatggggtggcaaagcgtcggacacgactgagcgactgatctgatctgatctgagtactgttgttcagtcagtggttattcagatggacttcatatttgccaacttcttggtttgttgttgcttcttgcatctcacttcttcatttttcattcaattttcttttttctaaaccacatctgctagtagttcattagtgagagtctcttatcattaaattgagtcattagatagttctcatttttgacagtttgtgacctacaacctatgattcaacctaatggcaaactctctcactctttgatctcccagtattttgttcttatcatactttgtataagctcatgaacagacttctcgatttagccagtgggatttccctaattccttaagagct

SEQ ID NO: 26423 - DNA, 1741 bp, Bovine  19866880926276
ctgaaatgtttcaggacagcagagtgaagatggaatcatcctgtataacttcaagccgaagtctaagaaagaaaaagagcaaatctgttcttgtttttgtttaacttgtgacttctgcatcccagatgactaataataaccctgctggatactgaaactgatgaattattgcatgacccctgttaagagataccttattatatacaaaatgtgaagaccctttttaatgtcagctcaggactcttttggtcactgtcttgagccttcacaattacctatctacagaaaggaaataagattatttcgtattgtcctttttaaaggtaggacagagttcagacggaaaattattatcaaagtttaaatgtttttaatgatttaatttttactataaacataacttaaacattagaacttttgtttgattatagaagcagcagaaatgttgactgctgatatggatgcaggtaagttaacattattctcttttactagtgcttcactggtcaaatttgcattttaatgtcatgtgtgtgtatgtgagtatatatgcatatatgcaatataattgattcaagaactaatttccttttgatttcaatttaaacaacaacaaaaaaaaccattactacttttcttaccatttttaagaaaaacaagcttaaatacttcttgagaactacctttaaaatgggttaatatatatggcttattttgaaatggaaaaaaatagtctagttttacatatacagtttttctatttgctatgagctttgtcagatcagttttgtcaaagccaaccagatttgtgatccaggacatacattttaagtgcaaaaataatagattcttttgcaatattttaaaccatgataacaggaaatctgtgaagatctgttttttggccaagtctacactgagagccaagtttaaacaaagtattaagttcctgggaagacagtaactgataggaatttttgagtcaaacttacatattaattcctgacttagttatttgttagctgtgtgaccttaggttagtaacaagctcaaatacaaattgggagtgaaatatctccctattttaggaggattgaaaactgaagcccatgtaagactcccttctgattgccaggccccagagttcatcagcaattttttaaaaatcaggcaatgagtggaagatttagatctcaaagctgcagatatcagtcagagggatttccaacaaaggccctttattttctactcagggtaataaattaattttcaggttcaatccaagctgatttgacagtcctcaatagatgggggtctccttcttaaaggtacaagcagaaatttaaaatttatcatcacactcttcccctaacccagttcttaggctggatgggactcctccaaaatcttttatccataatcgttcacaacttctctcccttgaggacctacctgtttcttatgtgctcaaagtaattgacagtgatattaattttcctttctcatttgggactaagaagcaagtttataaaaattttcatgacatgataaaatagagcgagataataagaagagcatcttatacttttacttttttctttgtcatgaattcccttgcaaattcgtgtcttaagcctgactctagatgcctcccagtgacatgtgctatgtctgagtgtgctcactgaggaaggaaacacccgtcacatgttaagggctaaaaacacagccccctcccagc

SEQ ID NO: 26424 - DNA, 782 bp, Bovine  19866881165083
tatccttcatgattccaagttctggaaagaaagagattgtcttgttttgtttaggccacaggccaagctactgactggccacctgcgggtctgttgtccggctccaacccagccagctgtggtttggagggtggatcggtttaggaatatgcaggatactggccctcaaagatgcttcttggcaaggagtatgggaagtctaggatggcagcaacagggtgaacctttgatcttgttcagaaatctcagtcacgtctgcaggccaaatacaattaaaatctcatttttaattattcaaatttcagaaaataacaacctaataaactacggctggaaattccagggcttgagtcctaatcccagtctttgtattaacacactatgtgaaagtctgaggatctctttgtgtcttactttctccatctgtaaaaatagggagcacatatctattgcctctcgaggttgcagagaggaacaataaaattgatttgcaaagtgttttattgccataaagtgctatgttgaaaatgccctgtatttaaatagcctgatttgttgcagtgggtgataaagagagctatttttaaaatacattttaaataaatacatgcttaatctcagtttctttctgttggttacttttctgaaagtcattaaaatcaaggaagaatggttttagatgctaattaaaagctttaatcacactatttttttttcctacccaaaagataaaattccagccctatagctttattttcttctctcgagattttattcaccaa

SEQ ID NO: 26425 - DNA, 1103 bp, Bovine  19866881298257
tggacgatttgcagcaggaggcattctagtcgacgaggctcctgacacaacagtggacactactgggctggacttgggaggctgaacattttgcattacagaacaggacaaggaatctgcaactgaagacaagaaactgtttcacccacggcaataagcttgaaatacattaaaatatcaacaaaacacagtttatctgaagttcttgtagaaacttcagcagcatcacatttatctggtatgtctctatctaggaaataacaggtccaaagaaacgatttcccaaaaaacgaaaaacttaactcactaaatgttttaataacgtttaacggcaattttcctgaaacatgccacaagcttccaaaccttcttaaacaaaatgaaccccaacgatctttactaaagatcactattattaatacggactatcgcactgtgcagcagtgtacctcagatgatagaggtggtttgcgtcaacagtgatgtaatttgtgaatcatacagatgtttccagtactagctctgatcccattttgtactgtaaactgccacgtctcatttgctgtctctagtcagatgccctgtctcacaggtagctacgtaaggttctgagattaacattaggttggacttctggagcaaagcgcatgtgattcatagtcggtctctgacagctccaattgcccgacctgcaagatcatcttcagccaaccaagagataatggacaaacctaaaatgacaacctaggtgttcactggcgggtgaatggactttaaaaatgtggtggatctggatatatacacatggagatatgtgtgtgcatatatacgtgtatgtgtatatacacacacatacagtgcatgaatggatacagaacatgtggaaataaagaaaatacacacacatacactggactatcattcaatcagaaattgcaggaaatgctgccatgtgacaacgggaatggaccctgaggccattatgctaattgaggttaagtcagaaaaatagtgtatggtctaatttatatatgaaatctaaaaaagccaaactcacagaaagtttggttaccagaagcagggaggtaaggaaaatagggaga

SEQ ID NO: 26426 - DNA, 1033 bp, Bovine  19866881310187
aaactattaggaatctacctatctagtaccagcattttggattaatttctagaagatgaattacatttctctaaggcctatttcttcaattgatgaaaattaaacaacatcagaagctaacccttaatattttgtgaatgagaacatgaggctacccaaacaaaaggctgaatgtcctagtctgtatccaaactccagagctgaacatacacttcctgtgagactgggaaatagctgtgaggctaactgtccccaatattctaatattagctcagctgttaaaggcctcagagaaggggctagatagatgttcttagcccctggaactgtgctttcagtgaggtttggatccatgcacgttctatataaactttttggctcttgatacacacaaggtacaattatttaaaaggagggaagagaacaaacataatggaagttagttaagaatgcaaattcacttattgtaattttcctgcaaccagtaaaataggaccttcaagttatttctttgttgatttttcaataaatattacgggtgtgtaactacaaaggggtgagggtgggggaggaaatggaaagagagaagacactcacctagttcgggtgctttgcttagcacaaatgcataagcccagaatttgctgacaggtccattgtaaaaaccctggtcacaaactgaatgcttcaggcctttggtcatcacagtgtacaccatataagcaccagttcgaagagcaccgaatatacttcataatgaaaaaagagaagaaacaatattcaggaaaataatttcatgtctaacattaaccattagtagaagactgccgttggcagaaataggcagaactgcaccacaatcatttgcatttacccagaagcatttaaaaatgttttgttaacaagagcaagaaaactactcagagttttattctgaaggccatgccacttcactcttcacccatgttccaaaaagaggtcaggaaaaggggactagatccagggcaggatctcaagaactccaattatctta

SEQ ID NO: 26427 - DNA, 939 bp, Bovine  19866881321793
tatgtctgagtgtacagttttgtgagggctggggtccttggtgcagcccacctctccccgcacaatggaaacccctgtggtcaccagtgcttctcagcaagacctccctgtttagtctcaggacaggtgtttggcaataaatgaaaccttgccccagatcaacgaggcctggagattcatcagcaacagaccaaccagtggggagcccttttaattattttgtgttgaccatgcatttaatgataccttattatggatccaattaatttcattcatgttgcagaaacaaccaagagtagtcatgttgctgaaatactgtattctgaccctattcttatttttccatccctaggaagcctgctatagcatattcttggtcttgaagtatcataagtacagcatttttgctagatagtgatataaaatgctcatgttttcatgtgtgccatattcatttctgaagcttgtatactattatacgagactgtgtttctaccagaagctacctgatggcacaatcattggggttctgagactgctatgaaaaagagaaacacttctaaggtttgcttctgcttttcctttatacacactattttttgttgttgttgtgaagttaataaaaatgactttctgtgcagtataggtctccccctccccattcacccattttgacctgagttaagaacatacattaaatgagttacaaatgggaagttttgtcttattctgagatgatgtgaaaagtgaggcgtgtttatagcaatctagctatacagaaccttcacaagtaacaggttcttagttttaaatataaatgctatagggacattgctattgtacacattgtagagaaaaacacgaacgtgtagcctgaaacatatacaacagatcatacaaaaatgttaggagttgaagggcaagttgtaggagcaggga

SEQ ID NO: 26428 - DNA, 1270 bp, Bovine  19866881425965
gtgcttttataaatgttagtgattattctcataggaaatctatgccaactacctagacataaaaaaaaaaaaaaaaaaatccatagtttgatagggggacagacaatattctcttcctgattgtaacagacagaaatatatgataattcaagattttctagctcttactttatgacctgttgacttaggttgtacaacatcttggccctgcaactgatttttataagaaactcgctttagattgctcagggcagcagactgccgtggatctgttccttttaagttcccagtattctgatctcgcttctctaggtaaggacataacattgtatttatctgtttttacataaacatttttagcatataattaaatgtaaattctttactaagagttctcagttgtttggggaggaagacctgtgaattagataatgtctatgaaaattaccactaaactttaaaaaaaaaaaaaccctaaccctatacaaatgtaaaatgtcaatctggggttggttgtttttatttaaatacaattcttttaccattctgctcaacagtaaacttaatatatattatgttttataaatatatctttctcaggtttatatattatccccatttttgaccactgtatgttttttttcattataacttagacttcttcataatacagaatctgtactgctgttggacaagtaaaatgttatcgtttcagtagctaatacttttcctttttctctctaaagcttgcatgtccaagtattctgcagggtgcatctattattacccatctttccactatactcacaatccctcgcaagcagaaaagttacaaaaagatctaaaacggtatctcacaagaaaaattggatttgaagctgttatgagaataaggtgtactaaaggtatgaaattgcaaaaattatgctttatattatatacttttttcaaaattaataagcattcacatattgacaacctgtgaccacctttcattatcataaaaaagattttctgcttgatccaactagctgtactgttttaaatattattattaaataatcattgttcaattttttaagtaatttgaataagcaggtagaggaaatgctttgccttattaggaggaagtcaagagaaagcccatattggaggtgatttcagatgaatttgaggaatagggaggatcttaagtgagaattgtcaaattaatgaatgacctttgccttcctcatcaaacagccttcagtttaggttatctctgttttat

SEQ ID NO: 26429 - DNA, 2133 bp, Bovine  19866881460760
acatctttctatcatgctttgtaaggattttgtttactgccattgagaaaaagataataatatagctcatacttagtaaatatattagtggatatcagaatcacaaaactattctccagaagaatttcgctggtcatcataacactcattaaacacctggcaaacggacagacatggttgtttccttctgagagtttgacctctaaaacttgaccacaatgaagaaacttgtagccatacatcaagaacttgatttgaattccaagagagtagtgcagagccagtttatctaggagcagactgtcatgtatgcacataagcatgaacacacagatgcacatgcatatttaaagaagtcaagaagctgggatacaccccttgagcaaggttttgaacaataaaaccctaggtatccaactttacaaatgtgcaaattgctaaagtgaaataagattctgctaaaagtaaaaggatatcaggcttggcagggctgcatgggaagggaggtgaaggagtcctaaggaaagagaattcgatgaatgttgaatttgtaagtatttccttgggataaggaaactactccatttgtccagaagaaagagaatcagttgctgtgtttggaccctaacatatggcaaagatcatattaaaacaaataccaaaaatgcctgcctaaagcagtcattataataatatatatgcaccactgaattctatctgaagattcacctaaattgcactaatatcagagtcaattttcactgctgctgctgctgctaagtcacttcagtcgtgtccgactctgtgtgacccccatagacagcagcccaccagactcctccgtccacaggattctctaagcaagaacactggagtgggttgggaatatacactaccatatgtgaaatagagagccaggaaatttgctgtgtgactcagggaacttaaactgggcctctgtgataacctagaggggtgggagggaggttcaagagggaggggacataggtatacctctggctgattcatgttgatatatggcagaaaccaacataatattgcaaagtaatctttcaattaaaaataaataaatttttaaaaatactgttggaaagttcaccagaaaactgtcctaaccatgagggtcctgcagtgccttcttcagctaagtagctttagtcgtgtcagactctttgcaaccctatggaccgtagcccactaggctcctctgtccatagaattctccaggcaaaaacactggagtgggttgccatgccctcctccaggggatcttcccaactcggggaattgaacctgcgtctcttatgtctcctgcattggaaggcgggttctttaccactgacgccacttgggatgtcaacttgctcaaatccagcaacgaagtgtacctggtctacagagacagtcactgccaggcagggtttctgttgtccttggactgttattccttgtgggaatgtttctgatgctctgaagttcagacagatgctctgagacagtgagaggattggagtggctcataacagaggcccataggattaagatgatgtcctgtttcaggtttggcctaaaccagcttccaccactggttgcacctttcaattgaattgagagagttccttttaatccaggtcagagatttggaaaaatgacggctggttactgtgggtgggtggatttgacccttagatgtttggccacccagcacggttgacttggatgaagggtgtggagaggctggggccacctgtgttgaaatcaggcacaattgactatggatctccgctcctccggaatctactgtgtgacatcaggcatgtcactcaacctctctgagcctctgatttttgtatctataaaacggaacagtcacagttaacttattgaatcattatgaggttcaggtgaattaatgggaataaagtgccttgctcataatgaagactaatatgtatcaaagagggttctatttatcgggatattccttctgaacttacgacagtattgcatagtaaagccaaagtaaccatacttcttaaatattctctaatggacccaccacttagagaaggagctgacactcaaacccacccccaacacccaactccaggc

SEQ ID NO: 26430 - DNA, 665 bp, Bovine  19866881602070
aacaaatgggagatatcaagaccaaaacccatagtttcctcactctgattttcttagtgggaatgtgtctcttgtctttttttttttttttttagcgatctgtaatttatctttggctgtagctgcagaggtttgtcctcttcccataggaggtaattttgaaggcttacagtcttaatatgccctataatttttctttttgtatcactgtcattttttatttaaatttcaaataaacatcattagtttgtctgagtttatctcatctaggtagttaataagtataattttcatgtagatattataagaagaaacattgatctgattcctatcttctattagattatacacagatataaagcatacagcaaagaggatttcttctttcctaatagcaactaatttattccttttagtgctagataatgtaaaatggaagctcgcatttgaattaaagttttaataaatagtccttattattgcctaattagaataatttattcatttataggctttgagtttttggattccatagcaaggcacaagcctatgtgctatttttttccttcacaaatttaatctatgctaatagctattaaaactctttcagactgatgaatatttgtcttcagtacttttcttgatcaagatagtaattgttatgg

SEQ ID NO: 26431 - DNA, 681 bp, Bovine  19866881907080
tctgatgccccctcagacgatacattctttggatggcacgacttgcatcttgttcagtttcctaccttctctgtggttttctatagagctttaaatagagcaacactcagtcagtgctggcttgacaagtgtttgttaatgcaagcgcgaagctagtccagggaaataaaaagctctacgtggggcccatttgctgaaacataatttgccaaaaaacaagtatctgaaagccattttgggatttccactttcagtgatacttgatgataattcattccaaatttttttgtaaaataaatatagaaaacatcttattaagaacatcatggggcttcccctagagctcagcggtaaagaatctgcctgccaatgcaggagacatggatttgattcctctgtcaggaagatcccatggaggaggaaagggcaactcactccagtattcttgcctggagaatctcatggacaaagcagcctagcaggctacggtccatagggtcacaaagagtcagacatgactgagcagctacgcatgtaagaacatcaaaagctgaacaaaataatggggaattgctctgagaacacagagggagtttaagagtgcacactggtgaacagatacatcttttattcttcacgggggccttcagactgagtagaaggagacagagggaaggagga

SEQ ID NO: 26432 - DNA, 788 bp, Bovine  19866882052574
cccacggtggctcgtgggggtcggcccagcacagccgtgcatgccctcttcctcctcctcctcctgactgccactttcaggtgccaggagcaggcccagactgccgactgaagggtcaccctgaaggccatctggaagggcattcaacttcctgggaggcaaggacaggctctgccagtgtaagtgcaatgatggatctaagctttttccatgttatgcatataaaccctcccctctgcctcccgctgtttggtgctcatgttaacctcagcatcccgtccttgaaaaagtgctgcggccaacctggtgggtgctgtgaggcctgcggtaaacacaaaaacgactgtgatgagtttcagtgttgcccctccaagatttgcagagacgtgcagaaaacactagggccagctcagcaggtgcaggcatgtgaaaccaccgcggagctcttgctcgacaatgtaagcttacatttgggctgtaagctgtactggacagccagtgagccgcatgtaggtgttgctaggaagaaaaaaatgatctttaaagaagatgctgacaggtggtcacagcagatgaagacagaagaacataacctttgacaaatagctcacatttttacagcgtaaagctgccttattcttgtgaaaggattattttaagaccttatcttgacattagaacttcaaacgaaagaaacaaatgcaggttatcttcttggatgttgatgccttagtgtttgattttgtcttgagcaaggggtgcatgttaaagggagaaatttttaaaac

SEQ ID NO: 26433 - DNA, 1354 bp, Bovine  19866881097190
tttataaatatagattaaaaaacttaaatattaaaagttccaaccaataagtattgttatagtttcctttctcatagttgtttaagttcctttaaggaaagatcatgctgtatacatctgttcaacttttgtgtctactagagtttctttcattgtgcaataaatagcacattacccaagttccctttatactttactaattttgaaagaataccaagggtgtggcaacatttgataacataaatacttattcatttcacaaatatttgggtacctactttatgtaagatattgtataatcatggggaataaaacaatttaggaaaatgtaacaattgctttttaatttatttataactacagaatgaatctgtaaatacaaacaattttaagctcttcctgctttaagtcaatttaaatagcatatgttagagttaacatagttcattgattccaaatatgggttttgtagttagatgttggatttgagtagtgtaacccgagcaaggatgtctcagtctttctagcctattttaccatgtgtaatttggaaaaacataatatctgtttggtaggattaaatgagataatgtacataaactgcttaccttggggtctgacacatagtaagcccttaaattgcaactctaacataaattactttttaagttggttactttaagtgaaattaaagtaaattctgcctcatccgagattatcttctgttaaccttgcttttactttcatgtaatagttttcaaagaagcattaaaggatatggggaagacataggatttacaacaaaaagttctgggatccaacaaaatgaaatttacttaacttttctttttctaaggagataaaattttacagcctcttatatgcctatagagagttgaagccaaaggtagtatgatctaggtcagaaaaattacatgtttcttaagtgttattgctataataattctgtgttaaaatatttttcctttggaatatagaatgatatatcaactttcttcctcctctacttgtttttaattgttatttcattaggctattcattcaattgattggcatcatgagggcaaacaattcatgtgcagccattcagatggtagcttgactttatggaacctgaaaagcccaagtcgtcctttccagaccacagttccacatggtaagatatatgctttcaaaagaaagaaactctggagatgcagtgccactacttgaactaggaaagttggtatcagtatcactaaaaagaggtaatagaacatagcttctgattctaaatacccctttatacctccttcagatccccaccttagacccaaagtttctaaccttacct

SEQ ID NO: 26434 - DNA, 1460 bp, Bovine  19866880577153
acccacccaaaagaatgtatttattacttaccccattttattctgtagcctgtaagatttttaccttttagttttttagggtagacaaaaacccatgcaaagtctaaacttctaggatcagctgtatgccacaaaaataagaatttctattaaatattcatttcatttccatacatcacattccagttccttcaagtaaatacacaaaaagctgagtttaccttttttcctattaaactctaaatctcactaaatctaatactcatctagtcatctcactttcacttctttcaaaaaccaatgataaaacctttacttactagaaacctcttaagtatttacaattcacttgctaaatttactggacatccataacttactgcaaaagaccacaggaaaaattaatatgatttcctacctttcacaaacctaaacctgtgtttttcacatgtataaaatactagaaatcacacgaagctttaagcacagcaaaccactaggaattacatgagagcattccccatttttacaaccgcttcaaatttattgcactaaagcaagtgtggaagtgcactgcctacctgcatcagctctggaccgctggccaggtgtctttccgaatggggtcttcattcatctgtatttaggtgagcagcacagctgctggactagggtgaaaatccaacacgctccaatttgaaacttcacagacttgcaatgttcttgttaatccatcatcccaagcgctttttttttttaaacaagttcagcaaaaatacgtgaaatcttacgtactctgtaaaacagtgaaataacagttcattactagagcatcacacaagagcaaacttctccaagtaagccatcaaacatgacattattttaaatgtaacatcagtgaaaatgcattttgcccagaagcaattaactttaatttctcagtccttggtgccaaggactgcacagagaagcaagagaaaagaaagtactagacccttcaacaaagaaaagggtagtttcttggcggtcaattgaacataatacagccttgggcttccctgtatcccaatccattttgcgggcagaagtcagaaaagggtagacactggtatgtcaaagaagatttagactggcacagcccatcttcttgacgggacacaaaaagacccagcaagaccaggagtaagaaacaggtgcagcaggtacacagtggaacaactcctggaggatgaggcaacactggaatccgcttcaagcctgagccactgctgggtggaaggtcggtgaaccaagataagggattacagtcagtaagactttagcagttccctttctgctcccaagattccagaaccagagggaaagatccagtaactctggaggagccttaaagcaattttcattcattcccaggcaaaaagttaaatcatcttataaaaatggtttatcctttaaaccaa

SEQ ID NO: 26435 - DNA, 1761 bp, Bovine  19866880888345
acacacacacacacgccaacagttcaatctctggttggggaactaagatcccacacgctgtgtggcatggcaacacacacacacacacacacacacacacgccaacagcaaaacaaaacacacaaccaaaacaaaaagcattaaatgaaatgggtggaaagtgcttggtgaggtacttattaagcacttttgctagtgctttattagtgtcaaatgcttttattatcacagagctgacagtaccaaatgaagaaacaatggaaagtaagcccacccctgcaattctcctacagtggtgactgctttagatgcagttcttcagtttacaagtagcagtcagcaaccacccacctttagactaagcctgccttgttattttggggaaaaaatatttccagagctgtaccttcagttattgcaatgagtgattacttccaggaagaagactgtaagatctcgctcagggtgaaccctatgcttccaggtccatctccttcctgtatctgtctgtggctcctcccaccagagcctgagaggtgaccctgcctccccctggccatggccttggcagtggccattgtggctgccacaccaagcctcccctgccactctgccagcaggaagacctgtcccgtcacctttaaccacagatccttgggccaaacagggtaacattaaaaaaaaaaaaaaaatctaatttaagtgtaggaataccataaattctactttttactctgataaaattatcccggaagataaaacagagtacatacagtttcagtacttatatgccttggtgcttaaaatgaagatttttcactacagaatctaattggtacttaagtattaataaaaacaatatgcaattacagcaagaaaagatatgaaagtataaaacacattatttaatcctatttaaaaattctttttaaatttaaaattttatgataaattgaaatttcttaattgctaatcacaaagtttaatactttggactatataatatattggggctactgattattgccccttttctttttaggtagtattaattaccattcaaataaaaattctacttctttttgttcctatatgtatacctgacatttacattggtgaaaagaggggaaaaggttacttaaaatcttcaagtaaaacttcaaaaaatcttttcacagaagcaggtttaacacatcacagtctgctcataagcacaaaatttgcagtcaaaagttgcacataaagggtttattttaaatgttttaaggataggatagagttacatcataattataaaaattacttacagaattaacagctttatattgtttatacttctaaatgcagagaacagggaactgtctacacattgtataaaataaaattaaaattaaaaatgaattcaagcttgaaagatgaggtcatttacctaattttaaaatgcgaacacgaagacctctgaactatacacattcgttcaactgcactaatgatggaaaatacaaaaagcgcagcatttccaaggaaccacagacatttcaaccataattgttttctgttataataattattcctgttttgtctttggagaactttcttttttttttaagacaatcagcttaataatgttttcaggcactacaatttgtgacaatcaaaacagtcttctaatgggtccacggcgttcagagactcaagcccaatgcacttgggggtttggcacgtaaaacaatagcagaaatgaaatctggtttagaagca

SEQ ID NO: 26436 - DNA, 1604 bp, Bovine  19866881209642
tagatgatggaaagcctgtgttattataggggtgtgtgctaagaccttcccctccactcatctttagaaccatcctcagtctcaaacatctgctcccttgctttgccaattgtgtcggctaggtatgcatcaccgatttgaaatgttacaaaggtcctccctatcaggcaggacttcgagtgtagaaactcatctttattaagttctagtacctaaacacagtcaaatccatcgcattttataagatacaaagaaagacttacaggcacctggcccagaatggctcctttccgctgggtgacgaggccattccctctgtccgcctgtgctgaatcccgcagcatacactgttccactggggctgggaaacaggtgggctcacaccatgcagttgtttttcgtggaatgtccgtttcttcacgatacttgctgataaacccgcatggcctgcatcagctctggactgttgaccaggggtcttcccaaacggggtcttcattcagctgcatttaagtgagctcagagctgctggattagggtgaaaattcaatgtgctgcagtttgaaactttccacagaatttcaatattcttcttaatccatcatcccaagcactcgatttctgttgttgtgtttttgcaagttaagcaaaaatatgggattacgataaacaaaatttccacacagcacgctgtatgcacctgtgctccaagtcctcctctccccataatgcctccaaactatgtgggtatttaactcatttgagttcatttttgtgtgtggtgtaagaaaatgttctaattatttacctgtatctgtcctgttttcttgcaccacttattgaagagatttttttcccccattttatattcttgcctcttttgtaataaacaaattgaccataactacacgggtttatggagaaggaaatggcaacccactccagtgttcttgcctggagaatcccagggatgggggagcctggtgggctgccgtctatggggtcgcacagagtcggacacgactgaagcgacttcgccacagcagcacacgggtttatttctgttcacttgatccatgcttctatttttgtgccagtaccatattgttttaattaatgtagctgtataatatagtttgaagtcagggagtataatatctccagctttgttcttttttctcaagattgcttttactattcagagagttttgtggttctctataaactgtaggattccagctaggtgaaaaatttgatggatattttgatagggatttcattaaatctgtacattattttgtgtagtacgaactagatcaacaatatcaagttcaacaatattggttcttccaatttgtgaacatgagatatctacatttctttgtatcatctttgatttccttcatcactctttgatatttagagtttaagagtgtaaggttttgaactccctgaatgaatatattcttaagtatttccttgtttttaatgcaatttcaatgggatggttttcttaatttccatttctgataattcattatcagtgtataggaaagcaacagatttctatattaatcttgtatcagcaaattacgaattcattt

SEQ ID NO: 26437 - DNA, 1179 bp, Bovine  19866881290392
catttgaaaattttatgaagaagtgagtgtgcctggcagagtgctagctaggtcctcgatgaacaggggcaagaaggcacaccgttactcagtgtgcagcgaggctccatgtgaggctggctgcgcagagggttcaagagagggtctcacagagatgacctcacagcccatgtaaccaaaggccacagtgtgctatctaaaaaggcaagtttctgcaaaacagataaccagtgcaagttcaatgcatgaagcagggcactcaaagccggtgctctaggacaacccagagacggggtgggaagaaacgagggagtgggattcaggatgggggacacatgtgcacccgtggccaattcatgtcaatgtatggcaaaaactatcacaatgtttaacgtatttatcctctaataaaaattaattaatgaaaaataaataaataaaaaggcaagtttcagaaccgcttacttgtgggatgtccttttcttcatcatgcttgcagatacaccagcatggcctaaaagagaagtgagtatacgtcaatgaaaactggattaaaaaatagctcaaactcaggaaaaagttaacttacgaaaaactgccatataaagtatgaaattaaaccacaagggaattccctgatggcctagggttaggactctgtactactctgctttcaatgccaaaggtaccaggttccattcctggttagggaacactgcagaacctcacaagccacaagatgtggccaaaaaacaacaacaaaaaaaacccacaacagccaaaatgtaagaaaaccatttgcttacttatcttttaaacagaagataaggggttctgggaagataaaatgacagtaagagcagtttatctgcctaaaatggccatagaacacacaaaaagcaaaatcacatggataaaaactacagccaaaaaagtgacaatcctagtcataaagtactaaaaggtatagaactcatcttcctgccacaaacaactagaaaatgggacaagagatatgaaacatctggacccagacatcaggacaagaggcagcacgggactatggaaccagggagcagaaaacccacccaagggcccctacaccaaccaagtgcatcccaagaaccatttgaggacaatggtgcatgaagggtaaccaagaacaccgaggttgtgcta

SEQ ID NO: 26438 - DNA, 1138 bp, Bovine  19866880358164
aagtgatgggaccgatgcctgatcttcgttttctgaatgttgagctttaagtcaactttttcactctccactttcactttcatcaagaggcttttgagttcctcttcactttctgccataagggttgtgtcatctgcatatctgaggttattggtatttctcccagcaagtcattaagtcagtctatttaatgagtatttacataacacacattaaaggtattaaaaatgtgagtcagtggtaatgttcattttacttattagcatttttttttcacggcaatcctcagtttgaaacctctttcttgctatcacttcaatcttcttagaaattatttgaccatatataaattgaaggtcactatacattccatatttgttgtactgatctttggtcttgcattatttggagatttgattctttatggctattgctgttagatacattctgaaatgctctcaagagtaaaatgagacactcttgttttctgatgaattgccttacctagaatgcaattaagcattttacaagatagtaattcgtgtagcatgtacaacacatgtttacttatgggaattacgtggatttgcagtaattattagattctattggtttctttccattatgttaatgtttccaaagtaagcatatcaagcaattttataccatgagtattacagaagcctagggatgtttcttcaacatatttggaatgccacagagacattttatcattaaatttatacttttcattttattcttgttttgatatcaaaaaactgtgaatatacaaatatagactttttaaaataaagaaataggtattgaaatataatattacattatcatcatatatgccttataccagtgaccaacactggaaaattaactcagtctttcttcctttttttttttctttcttttttttagtgttcagtgctgaactagattctcttttgactgtactgacatactttgaaaaattttaaactacagctctaataaattataaacagccaatgtattacccaacaatttcctttacatttctggggagaaaaagcaaaacgaagcttcttgtcacgtaaagatcatcagcaaaagagacttttgcattagtgatgccctttctattaaa

SEQ ID NO: 26439 - DNA, 2212 bp, Bovine  19866880431637
ataagataaataatagtgtgattaacaaagccctgaaacgtacatgatgaacctgaaaagaaaaatattatatatttttttcatggatgatgctcttagctgtcagtgataactatactatcatgaatgagtagccagactctatggaaatacagatttggctgttgtcatcttgtaatgaggtaactgagttctagttatcgtttgtgtacttacacaatattaaaaaggatttaggtctatctgaaaggctgtgtaaatatacaggctccacttgcatgcttttctcagaaccagtctaattcagacatcctttaagggcattattctttctgcgattccctccttcaatttcccttcttactgacttacagcattcaaatttaatactatgatatacaaatggctgaaacgctgtcaccatgacaatatttggaacacttgtgcccaaatgacaactgtgtgctctggacttgaaccaaggctatttgagagcattcctgaaatcacagggtgattaagacaaatagtgatctactgagtcagcctttcttctcaggaacttattctcttttcatttattaatggtgattttctttaacacggaagcaccactgtatagcaaattgctcagaaactgacatctcaatatatgcctttacacaaaagatcagaaaaactgcattatttggtcttcctgaacacactgtaagaaaaatccctaaataaatgctgcagtttatgactgtgaccctttgaagccatgagaggaagttcactctattgtctttaagtcctcaatcttttctccacttatagttctggcagtcagtaatgaagcaggaaggtcagctctacagtaactctgcacttgctgatctttaacattttcaagaatgacagattcgcttcccatttgctgtacctgtggagactattttgaaagaacctgacgatttatgcagctccacaaacaatatagcataactttaaaaaacaaatgacacctgtctagtggttcaccatgtcagatgattaatgtcacactttttgcaaacaagggactgattcatccttttccatcttcctaagggctcctgggcaaagaagggtggaactttcatctgttctgtgtcttataagtaagagggtttataatgatggtattgaatgtaccttcagacttgtctactgggcattaaccttgagctctactgtgtgaccaaatacaaatgccaagacacaaagctatgagcaatgaacagaatgtatttcagagaagctgcagcataagctgctgacgcttcttggcaaagctttcgtttgtatctcttccagctattaaataattactctaagttaacttaaatacaaatcaataaatagctatatataacttttactgatacagttgaccttgcctaaatcatataagaaaatagtgtccaaactaaaagaaaaaaaatgtgacagagaacatcataaacacataatcgattaagatacttttctctcactattttatttttgttttctttgtacgcattacattcaaatgctaaattttgttgaaagaagaaatttagtaaataattaaacaatgtagtttaagcaaacatgtatgccaggtatttttactttaagtatttgaaaatcaaatagtccatttttttttatatgacttattagggcactgtctcttcagggagtataatttgtaacttactatacagatacagtctagactccctataaggatttcagcaaaaagcctgccaattcctggtaggattcagctaggaaaattatttaactgtgactgtcttctcctcatttactaaataaagatgatactactatataagataaactatttttgaagattagaggttaaaaaaaatcacatacaatgtttggcaaataataggacacaataaataaaaactactgattactattattactcctcaaaaatgtagtatctcaaaggatttaaaaacatgaggatttcatgggaatacatcaagagatgagagttaaaaacttgtctttcagatcagatcagatcagatcagtcactcagtcgtgcccaactctttgcaaccccatgaatcacagcacgccaggcctccctgtccatcaccagctcccggagttcactcagacccaggtccattgagtcagtgatgccatccagccatctaatcctctg

SEQ ID NO: 26440 - DNA, 1930 bp, Bovine  19866880437625
ataccaatacatgtatacataaaaaacatatgtattcaaaggtattagtttgatggccatgtagtttctaagactttttatggtaataaaatagtgatgcgatttctttgtcttaagagatcacatgagatttctcacaaggagctaggacttaataggtcaatgacccacatgtttggggttcattttcagcattcatttacatcttcttaatccttggagtaatgcctactaattaggtacaaattattttcaaattagccctggtataggcagtagtaattatttacgaagtattactgaagaacactagaagttacttcacaaaatgaagtagctatctcttaaattgttcttagaacaggcaacaatgtaggtgattaacagatgtaattcttaatggaactgtgagttttatgaaaatgatttgagctaaaaataaacatttaagtctagaataggttttcttgagttctagtctctttgtttccaaagttaagtgggcctgggcaaattttaaaacatggtgctaatagaaaaaccacatagctagcaatgctgtctggtcataatgttgcctacctggaaaaaccggctaaaacctagctggagattaatcatctcctttggaggctgaaagaaaattaggttgtatttcatagagaaataaaatgggccagtttttcaattctgttcttaagtggaataagaaagccccactttacttaagaacagccccaatacttatatatcaaggagaataaatcagtggggtgaaatcttctgttaccatttagacccagaaaagaagttagaaaagttggagcctgggtacctgtcttcaggatatttagccacgtctgatgcattcagacttcatgtatccatgatatatatgtgtatatgcatgagctatgtattatctctgatgtaagctgcacacatatgcatgtgcacgtatgtgtgatacatgcatgcatgtctgatgtatatgtactgtgtatgcatcatgtatgttatggttaataagatttcagtcttcttttccattgtctgaggacaggaatttccttgcagaacttctctctgcaattgtgcaagataaagaccctagatgatagacaatatacaaaataatctaagttgttgttgcagttcttagagcaaagaggcaccagctttgagacaaatgttccacttaaaacggtctgttttcatgttattaggttccatgtttcttccagcatgtttcagtctccttaattcacttctccagaccccagttaaaataaaatgactttgctttgctttctccgacatcaatccttcttcatccacctcagttcttcttgtattgcttttctttttacatcctagattcctgagagatttccacttagctcatgagacatcttccctttcctaagaacatttctaattttcagtactaagatgaatccattatatttgttaacatttggaaacctgtgatagtaataaaaaggtaaataaaaccatggtaaaacatcatgctctgtaattatttactgtcaatatcatttgcaaatgtataaaaatgtgactaaacactgaaatttgtaatattctccttaggaaatcacattaaggctactgaaataaattggagatacattgctatagttctagaaaagttgttttcctgtcggtctaaatcattagtatactgtaattacactttcagttagcaggtatcagattttacaagtttcttttttactggtgatttattactgaattatgactatgttagcaataaaactatttttccttttttcccctaaactctttttcttttaaaactagagcagcggtgaattttaaacaatcagtggctatagattttaagcagtattagaaactaagaattttaaggttattaaaaagctgt

SEQ ID NO: 26441 - DNA, 1800 bp, Bovine  19866880577370
ttgtacctgggctatttcagtgtttttcttgaactaatctgcttccactatgctaccatagcgtgtgtatggtagcactcaccaatcagtgattctgatgacatttgagttaggaattgatacacatctagttaaaaaaaaaaaaaaaaggccttgaatggcttcccatttcactaacaacaaaaattaaaattagtagaatgagcagctattatggtgcttatctaatttatcatccccaaatgaagaccttcttcatactgaaaaggagcactttgaacaatcagtcccagacaacatgcgtaaacagacacaatcccagacaaagcagaagtgttttcctcctactctcccacctggaagccccttcacaatctacccctgccccctgcaatgaacttgacttcatcacctgcctcctcccttgcaaatatctctcactacatacgtcttttcttgcacatcctaaaagctgtcagatttcctcctgcatcaaggttctttgcccaggcagatgtttttgcatgtaatacctacccttccttctcctatcctcagaaatcactccgtacttttcctttgtttctgcttgagtgtcgcctgaccagagaggccttcatggagatttcagcaaagagcacctttatctcacacctgttatgttcctgttcttctgtcatccttcatgtttttccccatactgtttatcagcatctgatactttcagtggatatgttcactattccttgtccactagaatacaagttaggaaagtacagaagctttttcttctctcccggtataatgatagtagaatatgttccgaaacaaaggagttgctcaattaaaattgattaattaatgaataaaaatatttgctttacactaaattgtttctgatctcctagcttgtctggcattgattagacactaaaaagtcaacttatatgcactaatccacataattctttcatgcacagaaagccaatataattttataatgtagaagattttcttgttcccttttttgactgatatgtatctatgcacaaatcttatgtgtgtatctatagatatcttaatgtgtgtatacagatttgcacacttattttttgaaatatgttctttatattagtaattttcaaagtattaggtttgtattttacatttataattatattgcacactttgcaaaacaccaaactagcatgctgtctgttgctctgagatgtcaagtaattctagatccaaatatactcattgattaattgatagaacaaacacatactacacattcacatcccagttaagatcggttttagtttagaaagattgtttcatgaatattaattagagtaagaaaacagaagtctctattgattgaaggaaacaaaaggtctaatttcaaacttatatagaacctttttaacttcatttctctactcatggcctcaaaacactatttctgtcagcccattaaggaaacctattttcatcatcatgtattctggaagatactttatcttgggtgaaatcaagaaatcgtttgtggtttctattgtttcatcatatggctacatattaacttaaacttcatctttctaaagtgttttattggtttcctcttcagccttatttacatgattgattttcaatttatggcatgtccaattttgtccaattaagtccaatttggattagctctttacaaatcaattcatttctataaacccattaatatttcacattatcaaaagcatattcttcatgaatatatatcttaatcccctacttcaataa

SEQ ID NO: 26442 - DNA, 2342 bp, Bovine  19866880736038
cacacacacacacacgcacgcacttttaagctctgactactaagtgggcctggtaacaatatctcaaaaacaatgagcatacctaaaaaccatcctccacaaagaatccagggtttcttggaatactgtttgtgaaagacagtccaatactggaagaaatttggaggatttgagaggcttgatatttaagtaatataaatttaaggaggagaagagataataaatggaatgaataaaagctataatgaatacttaatgttttgacctgaataaatactcattgacatagctcacttagttccaggcaggactgacaaaggcaaggcatctaccagattacaagaactgatcaatcaatacaaagaacaacaaccaaaaaggaataaagtgaaatgcaagctttctgtcagtaaaaagtagctggcaaaagaaaagtaatccagctaattatgaactttacaccattggaagctgataaatgttagaatgtcatctaaaaattaaggaaaaatgtatatatatatacacacactatcatttcatctataatacttgtaacaattttgtttccatatgattgatttatttggggacatttggagcataatataaattttgagtgagcttatgtgctatttcctcactaatgccactagatgagagcagaagtcccaagagtcaatcccagaaatacacaagatgcccacaagcccacactgcgaacgttaccagctactttatagttcaatgcatgtgctattctatagggttgtatcttgttctatttttcttgtctgtgaacttctctatatatatttaaaaaacttcttccacatctcaaatgtatttcaacatcctgcttcaaaatgccaagaagtgcatgagacaagggtactgctctctatgcgtttagcctgaaagggacacagccaaagcctgcagaagcggctactattggcacttagagtggctgcttcagtggtttcaaacatccctacaatttccaaagccaaaaactacacagcaaagctgcaggtttgaggaaaatggacctaaaagcatgtccacagtaatacaggcaataaagaagacagctgtaacattggatcaaatattcaattttgataaaacgttaataagataaaatatctactataagcacatgcgtcacaggacctatgaatcaaaggtaaacatctgcaccaagatttaaagccatatgggatgacttaactgccatgtttggtgcccagaacaatgacccatactcatgcacaccaggtgttatgaccttcctttcaatttcaaatcaccctcattccacaattttataataactgaaaagcaacagcttttctaatgctcacttccacagaagtcctcaaaacttttttttttaaggtacagtgtgtcttacttactgtagtaattatgtatttataatctatttatcatgggtaaaacaatactactgtttttacagggtactgtctgtctgtattagtttgtcactgatgaagatggtaaagccctgtggtttttattgcccaattatgcatagcatagtgatttgcaggaatgcatgtcacattatagcagaactgattctgtatacatatgtgcctaccacactcatctctttacacataaaattgcaagtgcttttataagcacagaaaattttggccatgaaatagctacaggtgcttcaattaggttaattacattttgttaatttgatttcagttttataatttcagagtttaagcagttacataaaccaaaacaaatgaagctcttttcattatgaaaaccaaagtaaagaaacagggaaattctggcttgttctagcagcaatttcttatctcctaggaaaggagaaaataccgttacgggagcaacttagcatagtttaaaagcacaagtggatgatatttaagagcaaaagcacccagcttgggacagcagtggaatcccacagcactagacacacacagattctgaaatgtaatgatgaccgagccttattactatactgcattatcctacttagcatggagatttcatgaaaaagttataagggtatgtgggaaagatgtgctgaggactgtcagaataatttattggtacgtgtgctattttatttctagctgaattttatcttcctgcacccacactgtcacaagccatctttgagcacctctccttagaagaggtctgtcttattaaacccccgaagtaaaagttgttttggaaggctcttctcagcctggcttggttttctgcggtcagctatttgaaggctattctaagtgtcttcagaagcagcaaggggaatgaag

SEQ ID NO: 26443 - DNA, 1328 bp, Bovine  19866880741731
tttatcatgctaattttttttagtatttaacatgaaatctttcatgttactatatttaacaatttcataagcattgatgtgtatggatatgactaaccatcaggctaaaaccaaagatgtgataaagttactatctataggtgataaagtcactgactgataaaataaagttcaaagatcaaatgattaaattaacctgtaaggtaattccttgtttcccatgcaaaatgtttcacttataaaatatgataatttatctaattatataaatacaatgaatttactaatattaacataatgtattgtgcatttatgttaggtctatccttttggtaattttattttcatttttttctcataatagcaaaatacttttcatgtttaagaaccaactgaagtattttaaaacaacttaagcattataattaatttataaaggaaacaatgtaaaaacactgagcaaaaatagagaacaaatagaaaattcactttgcaattcatttattttctatccataattatgtgttcaatgaacacatctttatgttactgtgatataaaataactgaaaattctgaatctgcttccttccatcagttttaaaaaaaatgatgtatcttatgggtgagattacactgaactttaaataccacttattactatttagaatttggtttttattcaaatgtgatgactgaatgcttacttatactctattctgttattaaggcgttttataacaacatttttcttagacttatttaaactatacatatactcacatttttataaactaaagaaaatttataatcagcaacccccaatacagtccagaagactggtcctaatgttaacagctatatttgatttaaaagtttcaatctatataattatcactttactggcatatcttcaactaatttttcaaaagctcaattatggaaggcaacattacacaatcagttcagttcagttcagttcagtcgctcagtcgtgtccgactctttgcgatggtaaactctaattattttcttacattagataatacctgttcttgaataaaaagccaacatactcaaaaaataaacaaatgagaaatatcctggagcctttttctttgctattcctagaaatttcttaatgataagggtaggctgtgcttttgatatttcttctctggacttgctaacacacacttcaaggctgcaataactagattaaagtaataacacaccaagtgtagctccaggctacagttttagctgacacaaatcatctttcactggacacagtatataggtctgtaacacaagatgactttgctggaa

SEQ ID NO: 26444 - DNA, 1842 bp, Bovine  19866880788027
caagttgggtaaattaagttaaaaacacctgcatcctcccctcccacccacacatcctccattgcctctcccatccccaacactctctgatctaggctttgagcggagatgcacaggggtggttaatgcaatatcagaccaaagaaaccctcttctctccctctccaagggcagaggtggacagaggaatcaatagagcaaactaatgtagctccccatgcccgctgaggtcacttgaacgtccagtcaaggctctggtaattataggtgaggagatggaatttatattgaagctgagactgaatctttagactggttttaataattaaaagtaacagaaaagttgtggaatctgcctaagagtgatgttaaaaaccaaattgagaatccccaacctgttaaattttcactccttaatcaaaatggaaatttgatataaaatttaaaggtcttctggaaaaatggtgtctattaatggaacagaattatcacctatttgatctggaaagaacttcaaacatcaccaatcctagcactcaattttgcaaatgaggaatttgagaaaagttgaacaaatggcccaggtttgcaagatgaagtcagagctggttctagaggccagtgatctaaattctcagttcaggtctgtttgtccttctggcacctctgtaatagggcttgaaaaggattggcaagacaaatctggaaagataaaagtaagaaagcagtaaagataaaattgacttcacagcttgacctcacatgtaaacctctcctataatggttctaaccttataggtcagatgcgttctaaaatgatcaaagatgaatttaaactgagtcttactttgcaacatttctccgtaatgctcttcaataaaagagccctaattcttgatattttagtatgaatgactatattaatcacatgaatacagttcagaatatctaaatcaatattcataagccaagaagaatatttgagtaatatagtgttctctgtttttaataattaaaacaaattataatcttaaccagttatgtgccaggtgctactaagttctttaaatagttgtgaactacttatgagggagttaatgtcaacacccctaatatacagatgaggaaatgaagacttgaaaaaagttaaatgctttgctcaaggtcccaaatagatgagcaggattcaaacccgagctgtcttattctggatacctcaggcttgcctagtacactgccactttggatgaaggtttccttgaatgttttaagtgatatgcatgctaaaatgggatattttcaaagaaattttagcagtaaataaccttttaaaacgtatattttctgtatttaatgtttatcatctgctatgcccatttcacatttcttttcttgatcatatgaagagaaaatatgcttaataccagactgttttgaaatggtgggagactataaggaaatcagtacagagttcagagatgttgggttcaatgtaagaaagaactatatgcaatgaaagtactaagagatattgtagaaattaacaaaaggagggattatgtgcttgagaagatttggaagctgtcttcccaggtggtgagaaggtggtcagccatcttcacagcccagtttggaccactttctgcctctcacatggcttgttcttaatgaattattgcagggtatttattactaggaacacaagcagtattttgacttggagccataatgcaaacccaaatttggcacaacatcactttaaactcgggaaattacgactttaattaaagattcagcataaagccaacaagataataaatctgaaattgattcttcggtatg

SEQ ID NO: 26445 - DNA, 1573 bp, Bovine  19866880846104
taaaatagtgattcaaagttaggtttcatatatatgccactaatcaaatcaccagtgaaaatatgtcacaagttgaaaggtataaaaaacacagaggtagattcagaaattaaagaagtgccaagggcttccctgatagcccagttggtaaagaatccacatgcagctgttggagaccccagttctattcctgggtcgggaagatccactgcagaagggataggctacccactccagtattcttgggcttcccttgtagctcagcaggttaagattccgcccgcaatgtaggagacctgggttcaaaccctgggttgggaagatcccctggagaagggaaaggctacccactccagtattctggcctggagaattccatgcactgtatagtcctttgggtctcaaagagtcggacacggctgagcgactttcactttcactttcataatccaagaagacttactacagtgtttttcagacatcttaatggttattaaaaatgactgggagtactgatcaaaaataaaagagagacccaccaaccagggtgagaaaaccaattgtataccaacacaatgttcgtgttaagagagggcattctaactgtgaagaaaacgatttttcagtcttctaggaaaaaaatgaatgataaaattgaaattctttcagaaaggttaactttagttttgagtgtttctcatatagttgcaatccctcataatatacagacaggtcctacctcacttgcaacctatttgagataaactgaatgcatggatggataatcatttcaagaataatcctctcatgatcatttaacctatctgaacttatcaaaattaacatagatttttttttcttaattaatcaagaagcagataaagcatccattcagccagctggggaaaattcatgttatgacagatatggttggtaagctttggctcaaatacagcaaaccattatattcaagcagatgaaagaactgagatgaaaaaaaaggtattcaagcactggaagccagcagtgacttttcagcaataacagaaaataaatccacataaaattttgagataaaaacaaatatcaataatttaagtctttattgctaatgcagttggaatgacattaaaattttctctggggaatccactctttttttttttttcttgccagaatctattaacttgtgcccaacaaaatgtagcaagcagggcctattttgtcaaaaagcttagcaatgtcatatacatattccattatttaagcagagagctctattttaaaaatgaatttcttatttatcatttgtattctcattttaggctttgcgctatatacatatatatttatttatttatttattttttcccccaaaatcaagggccctgtcaacactgagtttatcctggcaagtagcctggtgaaagtctgacttattgaagagctcagtcacattaccacatgcagtacattttgtctgattttctttttccctcctatttccatacatatgaataaatctgtagaagaaaaatagcacataaattgcttttacgtgctagaataatgt

SEQ ID NO: 26446 - DNA, 1407 bp, Bovine  19866881015743
tttctcatctataaggtcagatgcctttcaaacacagttctcaaccctggatgtacaggagaggagactggggagctttcataaaacaaatataacactagcaaatacccccaagatcttggctctattggtctgctctagaacctggacatgagtattttcttcaaaactcttgaggtgattataatgggcagctaaggttgaaagccattggcaagcagaaactttgactagaatactttacacagtcatgcagctgttaatgaaatgcaagatttttgccctattaatgatctgccagccattcaggaaaaaaaaaaaaagtctctgcttcaatacttgtcatctgtatagaccaaccttgaaaaacattatctcttaattagattctaaccttctgtactcccccttctacatgcaaaagacaaggaatgaaaggcagtggagaaggaggtcattctggtgactcaagattcaagggttaaaaccgcataaatctttcttggtggatcaatattttgataaatggtcaactgtattaatgaagggtttacaaataaggattctttgaagtagttttttatcctgtctcttccagaatgtgctataagtgtattttaagacattttaagcccgatatgcagtgcctcagatgtatttttcatgattcgtgagtgaaatacattttaaattcaaatacatacagaatggaaaactcttagtttctcttatcatcaataggttgtaagcaatttggaaaatccaatggacaaagcaatcataacaagcctcgaaggatttcatgaaggagccctagtttaaataacttaaaaatcttgtgcgagcacacgtgtgtgtgtgtgtgtgtgtgcatgtgcgtgcacacatgcgtgcatgggagcaaacttgatctatgtaagtcccatcactttttttcctatttttattgcaaacatattggtttattgtttattatcaggttgcttatttttactattctaatgagaataattatttttggtctaaagagaataatatggatgcaaagtactcaactctcaaagtgtcagcggtgttcgcatgacaggtaatgaggcaatttggcagaacatcacaaactaattgagctcagctcacatcaatgaggcttgttcagctgaggctgcgcctcctaaaaagaacagtggaattaaatgagacaatgtgacatgtacaattttaattggaagctctaatttaaaatatttaaaagcatgtttaaaataatttgtgaatccatacagatgcttccttctccagctaattaagaatattcagtgggtcatataaagtctgagtgtcaaaactatgaattattgaagtccctgcccatataagtgtacttgtacctttaggcaagatcaaatt

SEQ ID NO: 26447 - DNA, 678 bp, Bovine  19866881023229
aaggttatgcttactttattctgaagttacattgaatcgaaaatccaatcgccaaatgctgggtctgctttatatacagatatctagtttgatcctctgtcagtcaaaacagaagtttgaacaattcaccccctagggttaatccatactcttttaccaagctttccatgaaccatacttcaccaagattggtttgcaaaagtctgtgaatatgccagactattcaagagttaactgctggaatcctgcatcatcattgttgttcagttgctaagtcatgtctgactctgagaccccgtggactgtagcctgccaggctcctctgtcattacgggctcctccataattactacttgcaaaagccacaaaatcagatacacaaatccaggagcctatttctattctcgcaaaaagggacccattatctaactaggcaagagcacaatgacagttctttaacaatttgttcttggtatttaaaaagacttgcttatcaagctgagtgattttaatgaataaaaattgcagcaattcaaaatagagctcattcttacttttcacttactgaattgccaattccatttttgttctcatttaggctttcctttgtctattaaggaatattgacaagtaatctatctattccttgcttatgctacaaattaaaaataaattttc

SEQ ID NO: 26448 - DNA, 1324 bp, Bovine  19866881126001
tcaactatggacaatcagtgtccctaaccctccggcattgtttaagcagtaactgcatatgaatatctaaaaattctctcagcattataaagacaccggaggtaccacgggtaatggtgatctacaatataacttaagggtaaaaactgaggaaaaagtcctaagtatacttcttgtctaaattttaagatataaagatagccttttaaccatttcaactttggatttttgcccaacttttccattagaaatagttttctctattcaggatgtttcctgaacatgtatcagagatgggcatcagctgaaaagaaatcagagccattgctgaagttgcattcttccctagcagtctgatgaggtcagaattacaaagtttctcttatttatgaacatcaatctatgtcgcctctagctactacctaatgaaactccttgcccctggttacgcatttcaagctgccagaatatgcgactgaaagagaaataaaatgtttttttaatgcacatagtaagcactggttatcactactctaaacaaaatatgtttcccctcccccacgctcaggagaaacaactcaatatcagtgtattactgagaattccaattttcggtaaaaccttaagtcagtttttctgttaaacatacggttgaacactatgcttgttaacataggattttatgttctgatagttgagaaacttcattcatgttttttgtctacaatgtctctattcatgtaattttgttttctatgtcacatatgtcttcagaagttttaaaataatgcttaaaagatgcacaatcaaaacagattcacttctgaatatcagagtaaccctcctttgacttagttaccatcttgttgattgcttttcaatgaattttgcatgagtggtttgttcactaaagtgatcaacctaagtagtaacatcaatggaggaagcaatggcaccccactccagtactcttgcctggaaaatcccatggacagaggagcctggtaggctgcagtccatggggttgctaagagttgggcatgactgagcgacttcactttcacttttcattttcatgctttggagaaggaaatggcaacccactccagtgttcttgcctggagaatcccagggacagggaagcctggtgggctgccgtctatggggtcgcacagagttggacaggactgaagcgacttagcagcagcagcagtaatatcaaaggagtctttttcaaaaacagagcttagctacattgactcttttctgagtgaatccacataaacaaacctaagttactatatgaaaatatttttggtgataa

SEQ ID NO: 26449 - DNA, 1308 bp, Bovine  19866881136492
acagtctccttgtttaaaagtaaatgagatgcacacacatataaatatatacatgcgcaaataattttcattagtgctcaaaatgctattggtgttcattataaagagctcacccataacccataatacaatgtttctaatgagaactaactacttcagactaatctttttcctctgacatttcttcatctagttattcatataccaacttctaaatgaaataggagactggactacattaatgaaaaacattaaaaacattagaaaaatgaaaatgtaaatattcatcattttcccatctattcagtaacttgttttgctttgattttttttttctcttgaaatggatgatgtaaggcatacttctgactctaggttactagccaaacttgatttcctgagcattttaaactcatatcccagtgattcaacttgtctcactgatgaactactaaaggaaaatattagaatattagaaaatattaggaaaatattagaataggaaaaaggagtacaaaatggtggtgactaaaagacagagaagggaaaagcctgggaaaatagaacaaaggaagctctgaagatcagagtgaggacctcaggttaaaaaacagccctcctggctatcccaatctacataggacaggctcaggggaggaggaaaaaaacatataaaaagaggagctaaaattgagctgggggtttctcttctctttgcatcttttgggtcagcctgccctcacatctcgaggatgtattttcctttgcttgccaataaaactgagctatacgactggtctgtcctctcttcaaatttttgctgcagtgagagagaacagaggaaattacacactctcctgacaatagtaaatctttacacttaaactcttgaaagaaatagtgattttaatgcattcatttgtatctttgatgatcaacaaactctagggtcagcatgatttacttaatttcatgtcattatctcttattttactcacattaatctaagtaattcttctaccacctcaagccagttttacaagtattcttatttcaattaagacttttaagtgtttttaaactgtcatttagccatattacaccttaattgtttgtgttactcttccatgaaatgtttccaaatggtttttactttgcctaagggggatggaaaaggccttgtataatggcatcaagctatgtagaattatttgatgaattatagtgaccagcagggtttctttcaaagtcttaattatcgttacactggatccaactaaccaaaactatttcccctgttaccctgaa

SEQ ID NO: 26450 - DNA, 1941 bp, Bovine  19866881237388
tagtaaagaaaggagatatccaaattcatgatcttgaggtgtttcatcaaaatctacattgaatacaagtagattataatgtgacctatgattcagaaatgcagtaaataaggtagcaaggaaaaatgcaattgaagagagagtgatctagcactaaatattcagatgggtatcatataaaggcaaatagttacttcagttaactatttgcatcacccaaacaggaacttttttttgacctcttcactaacaaaacaatgaaagacctgacatttcctatcagcttccatacatttgttttttcaaattatatgcatcgttttcctcttatgtacaatgtgaaatgattcattacaaagttaagtgtgagaactgactcaacataagtaggctgatgtgacaccataagttaaaagtcaattttttgtttaattattcccaaacattgacacttttagccaataaataattatttaaattttcaaagttaagcaattatgactccaaaacaaatcgtatcttgaataggaaaaataaagcctgaaatgtgctgcattataaaataatttaactacaaaatttaaaatttataaacataaaaatgttttgcttgctttatgacatacaaaggccagtaaacttgagttaacatatgaataattcagtgtacaagttttaaaaattgggtgaatgctacattaaatataggaacttattttgaaaacatttataaccaaaatatgtgtacagagaacataacaaagtttgttattatacacatactatttccagtttgtagattctgatgttctcgaaataatttgaacatctaaaggaaaaatacaacaggcaaagttgttttgattttattagtgtgtattttttccctcatttttaaaataagtatttaattccttttctcaccacctgtgaagcacgtattattattttcataattcagatgacaaatagagaggtccagaggttatgactgaggctactgaaataatcagcagtagattcacagtacagatagttattcataagcaactttattcaaaagccacagggcaaaagtatgtgatactctatctcttttcttactcatgtattttcctactccttcctgctctttccaaagctttaagggagagttgtataattatatctcaaaattgctttttaaaattagcaatgtaaaaataaataaaatttggaaaaatgaaaactacagaatataatatactttattaagtggctggagcatctgcacttgagtatatttttagttgaaatctcagtgaaataaaataactcaaacataatgctttagaatgacaatttttaataggaaaaatacagtaaaaattcaatttatttagactagatatactaaaattgataagtaaatgctcacacacacgtgaagaagataatggaatatgtgaaaaaaattctgaaatctgcataataactaaagatgtggaaaaattcatagtggttttggatgtctaatatttttaagtagcctaagaaattgagacaggataattttctatttgaaaaaaaataaatcacattattttcctttttgacaaatgattatttttcatataatgttaacaatataaattacattatgacagacattacatcagttattcaaagctcaatttttaattaaaattctcatgagctacagccaaaatgaaaattagtgccttgaaaaattgagctgagaaattctcccagaaatgtttaagaaagctacaaataaaatataagaaaaaaaatcaatatgaagaatagaattagaagaactgatttctctctgaggaaactttaaagaaatggatactgagaagaaaagaacatatatttatagtaataatatcaactgtctattccagagatatagaaaagcatagtttaatatattta

SEQ ID NO: 26451 - DNA, 1200 bp, Bovine  19866881363295
ctgtcccccatccatgaaacctgtggccataagggcatctttgcaattcatatgcttaagagttttagtttagtattcattttaaaaatgagattctgcttagatttgggccagttttatacttggttacacaaaggccaacttttgtactgtagcaaaaaaagagatcaggtgggatttgcactaagaaaatccaggaggacctagttttcaaccttttcttttacccatacacatctcaccattccattaatttaaattctccattctggttgaagtaaaggtgaaaatataagtttagctaacggggaactgtatttcgtttggtacagattcacttacaaggtatgttaaatatgaaaataaaatgaatacaatgataataatcactttgttattgtaaattttatatgcaactcagggacaagcttcaaagagaaggattctcaaggcaatttctattgaaaacctgcaacaataatctttatcctatagttgcaggttaaaaaatgagtttcaacaaaaatatgccccacataggcattttcccttagtttgaaaaatgtacttaattatctttaggatatttcctttcaaatttgccccctgaggttcacccacttattctaaacttgtcccaaaaaggccaggtctccctagtgtttgtggttccacttaaagagtttagaaatcaaagaagagacagaagatggaaatattatgtctttcttataagatggctcttttctttgtatcctttaaaaaataaatttgtctcaaagtacagatgattctcgcttattgaatgctcaagattggaataaatatttccaaatcacagaagtgaaagtatgtgttattatgaaacaattaacaagattaacctattgactgagaaaaagcaatttaggatcaatccccctaaaaatcactaagttaaaaaaaacacaatatcaactaataagatctatttttactcatgtcatccaatcacaactccatgtccaattcttaaggaaaataccatgtaaattatcaaatcaccagatatttattcacatgaaaagtgaaaatctattaaaagtatcaaattatgagcaaaagttgttgaaatctaggaaacatttctcaacacttgcctcagtcagcattattggttgctggctgcagacattagaaacgcagtgcagccacacagga

SEQ ID NO: 26452 - DNA, 1193 bp, Bovine  19866881432893
ttcctcttacctacgaagtatatgatgtcacatacctcagtttccccaattataacccacatcccttcatacaaaacagaatctctttctcctgtctatacatctgtctgtctaataccaacagggggaggctatttgaagcccattttgagatataaaagtaagaaaattattttcaggaattttcaggcactgtgtaatttatgccttagaggaaaactcccatgatgagtgtgtaggaaaagcagaaattacatgaaacaggtccctcagaaacttttgttatggtttaactacaccacacgaagctagccagagacccttcactatatcctccccacttgtctggaacacactctcatctaatcgccctctttgaaaagaaaccttctttcttctgatagagcagatttgagcactacctgtattactctctaactttccacaaagctaaaccatctatgatgcattttcactcctaaaactaatactagaaataatgccataattaatgaatttgatgtttcttaaaagatcccattttatatagggaaaagcatattcattttctgtctataatactgagggccagaaaggctggtgtggttcagcccctcttcactaggcagttgtccaggtgtgagcgtctttccccaaatcgtcttttaaactcaattttaatgaacacactgctagagatgtgccaggaaaattgttccttaacatttgcctgcaggatcgtgacccctaatatctttaccaggctgataactctgggcagcggagtcagcctgcattcatgaaatctctcagcagatgtgctgctggaggggagggacactgatgtcgcttggaaactgtcaccagtgaatgctattagcttgtgtattattccaaatacattaagagaaactaatgacacctttgttagctaatgtgtttcacctgcaaaggggtccattgcattctgaataggtttgggcagacaggggggaaaaaaacaaaactgctattctccctgatttcatacacaccatttacacaatttggtgagttttgtctctgggaaatccatcttatccatgcaagttaccatagatcagtcgtttgcttcttgtttcccctctttaagctgtagagatgtcatactctggctccctttgtgtttcttcttataaaggagactcttgata

SEQ ID NO: 26453 - DNA, 1114 bp, Bovine  19866881554523
cattatcaggaatcacttcaattggacagtaaatgcttgcaattgcaggctctgcttcatgatcactgaatctcattttgactgaatgaaatgtgattattaggcaatttctgagttatagtccacctctcacctaccttgtatggctgcaaattgatttaccaataccgtttaccctcatgatcttgtatttcttataatatccattagctttatctcccggttttataataagttaactttacttccatagaagaggttaggtagttaatacgagttgaccttattctgtttggatttactcctatttatggcgcttgcattctagaacttgtttctctgattttcatggcaaaatggctgtacccaaattcaacaaaagtataagctaaggattttatatctaatgtaaatataaatgtatatgaacaggtaaatcaaatgtatcaaacttgcaaaaaaaaaatctaatggggaagtctttatttgcaacatgaaggaaataccatgctttcccctgcttgatagatgatttctggggattgaattaagtttgttaagcaactgtaattaaagatcagtgatctgaaagagctaattacccaagatcaatgttgatggtattctaagtttgttccatatcaggctcagagtgtttatgtcatgaaacattttctttatcagcactcaaaaaaatatgtgcactttcactaatgtttagaaactgaaaatatcatccacttatttcattgttggcaaatgcaatataaagctgaaatttatttcaattacaattcttttcccacacgttaaagctattttaacctttagcagcatacaattattacagaatagatcatttttaatgattcattatgtatgaggtcatttgacaatgcaattagctttgtgatgaaatttctattcttttgatcattctgtacctataatgaatgaggagagttttatatctaatttcctgaaattagaagattaaagatagaaacaggctcttgtatttaaacgagacttgaaatgactagcttgcattagtccttcagatgtgcaccctagacgggcagaactttgactatggtgttacggtttttttttt

SEQ ID NO: 26454 - DNA, 3139 bp, Bovine  19866880156517
ccatttgtttatttttgcttttatttccatattcttggaggtgggtcacagaggatcctgctgtgatgtatgtcacagagtgttttacctatgttctcctctaggagttttatagtttctggtcttacgttgagatctttacttcattttgagtttatttttgtgtatggtgttagaaagtgttctagtttcattcttttacaagtggttgaccacttttcccagcaccacttgttaaagagattgtcttttctccattgtatattcttgcctcctttgtcaaagataaggtatccataggtgtgtggatttatctctgggctttctattttgttccattgatctatatttctctctttgtgccagtaccatactgtcttgatgactggctttgtagtagagcctgaagtcaggcaggttgattcctccagttccattcttctttctcaagattgctttggctattggagattttttgtatttctgtacaaattgtgaaattatttgttctagctctgtgaaaaataccattggtagcttgatagggattgcattgaaaaagtatccacgtgaaaattccagatgtaaaggaaggaagaatctaggacttagaggtggggaggagattcctttaattagaacccaatccaggaagatccactcaagaatcttttcctttggagtatctcagtcctgctaggtgggcatggcccctccacaagaggagagggagaaagtccttagtagccaattccacatccatgtaccacaggggaagtgtaacccctaacccctcatctcctggctgagttaagttgtcaaaagtcaagtggagaataagagggtataggaggcagagatttctagattgtagcaagcgtagctttaaagctcttaagatttaagccttggctataggtcacgctcacctctggaaatcttttagctgtcccagctcaccagttcctgggtctacatttcaaaggcatatattttaggaagaactatggaatcttctatatgtaatacaaagcatttagtcaaagtaggacctacttttgaaaatatcttcatctaaacatgccttgtttcattgtgttgcccaacaaaggcaattggttgcaagtataaatccaataaaagcaatactaagaagtgtgggaaattcagcccagtaaattcctgagggaataagatttaggatttaaaacaaatttctgttggctaagccaagaaaaagtagatttatcaagcttctagataacgccatatatcaggcattttaggcacaaatatagaaggattaaaaaaaaaatctcaatccataaatatagtcaactcatctctgacaaagcagcaaaagcaatatgctggagcaaggatagtctcttcaacaaatggtgctggaacaactgaatatccaagtgcagaaaaattctaaacatagactttacacccttcacaaaaattaactcagcctccaacaaacaagatgccctttcataggtgaatggatgagcaaaatttgtttacatttagacaatggggcattattcagtgctaaaaagaaatgagctatcaagtcatgaaaacacatggaagaaacttaaatgcatattactaagtgaaggaagccaatctgaaaaggctacgtactatgcgattctaactacatatgtcatattctggaaaaggcaaaactatggagacaataaaaaggtcagtgttgccagtagttagatgggagaaagagatgaaaagggaaggcttttaaggcagtgaaaatactgtgcataatatggtaatgatgaatagatgccattatactttcattcaaacccatagaatgcacaccaccatgagtgaaccataatgtaaactatggactttgagtgataatgatgtgtcaaagtaggttcatccttggttaaaaaaataatgtacctttctagtgagtgatttgataatgggagaggctttgcatctgtgggggcagggagtctataagaaatttctgtgacttcctctcaatttgtggtaaatttaaaactgctctaaaataagtaatctttttaaaaagaaaaactgcctaatacatgaagaataaaatagtaactcccagaaatactgacacattggagtatttttctctgagtttgttaccaattttcttttttttttagtctttatataaatgcgtcttagcatttcagtagtgatgaatcatgctcaaatgactgatttttttcctaaactcatgcttttttttacataccctctcaacttcaaaattaaatcttattgagcaggaaattgtatttcttttcaacacagtctctttctgtgtgtttcctgttttacattagaatatctgttaactactccatcctcttttaagcttgctgtctagaattggtcatgtaaaagctactggctttacaacagtctgaaaattgcaaaatttaagtaatagataattaagagaaatacgttattaataagaatagggaaacctatgccctcatggctacacaccattgcacaagacatttaaactttgtgggacttaaattttttcacccataaactatatgtgtggacagtgttaggcagtgatgagtgaaagaaggagggatattaaaaattctccgatagccttccaagttttgtgatgacaatgaaccttgaaccaaaatcatgcctaaaattgcaggtgtaaaaccgtatatatttttcttggcagaaagttaattttcaacatgttccacaaatcacttgatcgtgaaacatggaaatgagtatctgtgcaggacttgtagaataagacagctgtcctggtcttgaaagtatctgcgtggcttttacttggttgatgtgctatatggttcctgaggcctattcccaaactataactgtgaatcagtgaaattgaaaatcttatcctaagcttaccaaaaaggaggtagtaaattgcccacttttttaaagtaatactgactatttttaggttactcagagtccatttataaaattactacttttcatgcataaatatcaggcttttagattaaaaaactttctgtaatatcgcatggttgatttgcctgccagatactcaccaatatgtctctccatcttg

SEQ ID NO: 26455 - DNA, 1716 bp, Bovine  19866880361194
catgagaagttgtaagattgggttctcaattttctctggaaattatttaactatcagaaggcctgttgtgtcatttttcccagagcacagagtgcctcgttcctgatctcaaccctgaactcctatcagggcatgttggaggtcagggactgcagtgggtagagacttcattctgcagaacctgatgtggaaagatgttttcattgtcattctgaaggagaaacgtcagaactcatatggcgagagagtgttacctgctttttctttgttcttaagctcacaagaaaggtcaagaggtttaaatacatagaaagtagggctcacctctcatagggttaataaaatcattttactatatttcataggaaaaaaccactcataaaagcttagactttagattaaagctagatgactttaatctaatgcaaaatgtaggaagcagttagttgtagatctgtttctcaccctgccacttcttcactctataattgaagaagtacattcagtattcagcaaacatttgttgattgccgtcaaagtgctggagactgtgctgggtaccagtggtccaaaataagccagacatatttctgtcttcaagaagtaatcatacagcggagagttctaaagcacaacacaatggcatacacagcacaatagtgaagtgaaaagcgcaacagtagcaaagaaaaagagccaccgccctttgtacagaaaaggagggtaccattatttcacaaaagatatgacttgtgagcagggttgaagtaagtttctgaagaagtagacagacaccctagggagagaaaaaaataaatatccctcaatgctcagagagaatgaaaatttctggtgggtggggcctaccatgcataggtagaaatctaggggcttgagaagggccctatgaattagagtaagcagactcttttagtctacaggtgatgagaaatactgaaagattttaaggaaaatgatatgaccaggtgaaggtctgcagctgcttatgtattacaaggcaaatcatctcttaaaaagaagattgtaccttaatatctccactgcaccaaaacagcaaaatagcattggttattatgaatgaatgtacaatgtaaaataatcagctttgatttttatagtggaattgattggattactttcatccagggcacgtaaaaacaaagattctagtgatcttgctatgggcaatgttgcaaaggacaaaatctctgtatttttatataaagtttaaaaagcagttattaagttttgtaaacatctgaaatgaaatggtgttatttttttaattcccctctttcctattggaactttctgtttgtgtatagaattcttaaatgtggttcatttaagtacttgtgacaaccacaagtactgtcacaaaccagagtgccctatctctatatatgtcctttatcagctcagatagttcttattcaatcttcagggatgaaggagaaatgaaaaaaagtctcaggacaagccaaggagattcacttactatttatagaataaccttacgttggagagaatcagcttttcaaagagagggaactaaagctttcagtatatgtttaataggaatgacatcattgtgaaatataaagaaacaactgcaaaatgaaaggaatcatttgtaattctaaaagaagaatgtaaagaataaatataaaattatcaatgagcttaaaaaaaaaa

SEQ ID NO: 26456 - DNA, 1971 bp, Bovine  19866880477829
caattatagaattgcacatgatataatggagaccttaatagactccagattcagataatgttataacttaatgaccaagcaatacagttaaatgtcatttccaaataaataatactattgatcccatgtcagcagtgtatatacttatagcttctcttcctgatatccagatcatttacattaatcagtatcccctctgtctctctcactctctctgtctctcacatacagacacacacacagtcttcacagtcttagcatttaagaggtacgaaagattctgaaattaactgatgttataaaggaaccaaagtcttattagcatactgctcttatcaactagttagttcatcacttataccctaagatctttccaacaatgatttaaaagcctaaataattaagtttcagtcagaatgtttcatattctaagtatcatccatattttatatggatactaagtagtttatgtattttaaagtaaatggtaaatatattttcatagtaaccttcagtttaaatgtaccatgttgcatttaaaatgtcatgcagaaaaagagtttctgtatcatttgttagagactatatcagcctacaagtgttgtcaatttaggtttacttcagaatattgtgggttttcttaaaatgacatatttgcacacaggtacagactataacttggtcattactttcattaataagaagattttaaataattaatgattgcttcttagatgtagtatataatagtttgaaaccaagaaaaatcaagagtggttattttcatgctttagtcattccttatccggagaaaacagagtggctggaaaacacagggctgaagatgcagacaaataagagtctgaatccagatttgtggatatatgtatgtatgtgtgcaggaatatattagcattagcatgctgctgataagctgataagtcacttcaagtcatgtccaattctgtgcgacccccatagacagcagcccaccagggctcccccattcctgggattctccaggcaagaacactggagtgggttgccatttccttctccaatgcatcaaagtgaaaagtgaaagtgaagtcgctcagtcatgtctgactcttcacgaccccgtggactgcaagcccaccaggctcctccatccatgggattttccaggcaagagtactggagtgggttgccattgccttctcccagcattaacataaacatcgtaatattttacttttaaaaaaaatattgtttttttgtgttttttttttaagtttttaattatttttggctgtgctgggtcttagttggtttgtgggcttttctctaattgtggcaagggggttgctactctctggttgctgtgtgaggccttctcattgcggtggattttcttgttgcagcacaggctctggagtgttcgggttaccatagttgtggttcccaggctctaaagcacaagctcaaaagttgtggctcacgggcttagttgctccatagcatgtgggatcgtcccagaccagggatcaaacaatgtctcctgcattggcaggcagattctctatcactgagccaccagggaaaccctaattcccatttcaaatttaatttttatcccgttaatgaaaatttgttttgtcaaataataatgttatgtcgtttactattgattagaggtttggatcagcacacttatcaaaaagacatagaaatcatttcaagagtatcatagcattcttagaaaaatggatagtttctttctgaaaagagaaattagaacctagaggcataattaataaatttgttctcagtacagtagccagtggaagaattttgtaccatgttggagtagtcttttccaaagctttgctatacccgcagacccagttaattcatcagatgcccagtttctaggcagtgctttcccacagcactttctgcagtgatggaaatgtcctttatctgtaccat

SEQ ID NO: 26457 - DNA, 3319 bp, Bovine  19866880525520
taaagaggtgttcagggacaggagtttcaatatgtgcctctgtcctaatggggctgagttagccaagcaattaccaaaggagtagccatagtgagtaaattcattacatagcatatataaactgaaaaaactctaaatgttgacagaccatatatgagattagttagcagaattaagaggcttggttaagactcatcatgttgaaacggatacgaggttattattttttgtctcaattggaataaaagatatgtggatgttgtcagatattttatttgtctagtctgttttgttttctttactagtttccagattgctctatcgtattatggcacaatctaacaatgccaccaaacacctacaagcctagtgaccagaccagatgtcttattaggaataaggaggggaaagcaagcagattagtatttagtttggagtcttagaatttttggaaagtcatcagggagagttcagcttagaattcttagaaagattattttatagaaatattgggaagaaatctctaataaataaagctctctaccagcagaatgaagtgacattgctaaacaatgagctcttgtcaccagaagtattccacctgaggctaaaagaaccaaaaaaagattatattacaggatctgcatggatccttccaagccacagattccaagataatgatactttttgttcgtaaattaatgaattatttttggagcctgaagtcactttgataatttactaaataagtttaagaaacagagtcccactgtgagctgttcatctaagatgaagtctcccatggtagagggtgagagtagaaagtcagggaatgtgagctgggaagtcaggacacctgggttctgacccaggcttggatgatacctgtgtaagctgcacttaactactgatgatttgaagatccctggctataaaatgctgcactgtttatcactgcggtgtccttagttttaaattttatgatttccatgaatgtgcagctgtcagctctcgtattcctcatcttaccatctgccttagttgattcactatcatcctcttggaaccaattaatcagtgaagccatgtgaaattatgccctgagttaatttcaattgatacatacatttttaaatgcatccttactgtgatttttaatcaagcaaaagaagtatcacatctacatgtgtcttcaagaagactaatggtgtgtcttaaagtatagattggcctgatacaccagtattaatgtaatagatttttaaattatagttatttaatacttatggaatttgccagccatggaaatttaataatcaaggagaaatgtatacccaaacacaaaaatgtgcatagaaacaaaaatcagaaaatggatgtttatttctgactccctaattctgaataagatcttaatgttttagggtaaaattaacacttcctaaagatataatgttcacagttattaaaaaacagaactatatgcatcttcaacactgcctttttggtcatatttctttgaagataaaactgaatatctaattttgttaagaaaggacatgaattgtgtgtgtgttaattgctcagtagtgtccagctctttatgaccccatggactggagcctgccaggctcctctttccttggaattctccaggcaaaaatactggagtgggttgccatttccttctccaggggatcttcctgacccaggaattgaacccaggtctcctgcactgcaggcagattctttaccaactaagccatctgggaagctcagattttcacatacacatgagtaaaatatataaacatatatatataatgaagactaaagaaaaatagatatgtcatgggtaatacgttattataatatggttttataataacattagatagacactggtcttaaatttcatgttttaaactaataatgtaaactttagttctatggcatcaccgcagagaagacaatggcaccccactccagtactcttgcctggaaaatcccatggatggaggaccctggtaggctgcagtccatggggtcactaagagttggacacgactgagcaacttcgctttcatgctttggagaaggaaatgacaacccactccagtgttcttggctggagaatcccagggacagggggagcctggtgggctgccatctatgggatcgcacagagtcggacgcgactgaaacgacttatcagcagcatggcaacaccgactcaatggacacgagcttgagcaagctccgggagatggtgaaggacaaggaagcctggtgtgcctgcagtccatgaggtcacaaagagttggacacaactgagcgactgaacaacaacagcaagatgttatttctgggttaactggtggttctgctctatatgctctactgcccagtgtagccactggccacatgagacaatcaagcacttgacacatggcttaattgagatatcctgtaagtgttaaatacacaccagattccaaagacttggtataaaaggtgcaaaaatctcattagtaatttactgatttcaagctgaaatcacacttttttatattgagtcaaatatattattacaattaattttacctgttttttaaatgtggctactagaaaaacattgtattgcactagtcactaacatatttctgatatatagtaacactatggcatcatccatatacaaaatatttgatctataaaaattacataaactcagagctttagtttccttatcttctaaacacaggggaaaaaatttaacttcagttggttggtgtgaggcaaagctgataaatttcgtggcacatgataaaaactcaaagagtgttagttcctttctcccccattcccttctttgaaaggtaagcagctatggaaaaagaaaaacactgaagcaaaccagtatgtcagcactttcagggttcagtgctactaacagtattgtctttctatttgtctggatgctttttcttgaattagttgagagagatgatgataaatagaagattgataatggatggatggataaaccggccagtagaaacatagatcttcagttagtccacctcatctattgacattttcatcagaaaatgggaaaaaacttcctagctttccttcccttctcaaccttgagctagaatcataaaagcagtgcacagagcctagaacagtaggagcacccactaattgcttgttggatgaataaatggacttattggaataggtagggggatggtagaagggcttctcaggtggtgctaattgtaaagatgcaggagacgtaagatcaggacgtaag

SEQ ID NO: 26458 - DNA, 1033 bp, Bovine  19866880554423
atctgctgcttgaatctagtacctgatgactaatggaaaattacagagcctcacttctaaccttgacattgttataggatgtgtttcacaagagatcaggcatgtatatgcaataagtagaacacccaaaaataagctctgttaaagacagcatctatgagaacattctacttattttgcttttcctatcctggcactagaacttgactagaataattatgtagaggtcatttttacaaatacggctgcaataattcctttattaggactctaaattattatgtgcttgtctagaatgactgaactcactatgggatgataactatatgaactttactattcagtcaactgggaacataattatgtgtaatagacagtggatttccatattcctttttcactgagaaattgccataaaatttatcctgatgtatgaaaagacatcaccttcttttaaatcaagctttggttcatttcttttattctctaattatggtgggtatgctgttaagtctctgtgcttatgtttcctgtttgttttgtaaatttttctaattcttactccaagtcttcaaagtttaattgtctttaatagttatattttttaaaggttgacatctttcttatctttttcataaactacataatgccagttttatatttccaggtacaatgtgtttttctttttagagagaatgtgagcatgtgttgcacctcttttttttttatttttagggatatccatgttctttgggtagttaagtggtttcttcaaaagagaggagtggggtgggatacagaattctgattttgaagagaagaatccaggttggaaagagcagaaatatacatatgtttttgtgtaatgccaaagaatagcttcttaaatattcactgtaaactcttttatactgataatgtagattttatatgagtaattttaagcatagtaatacagatggttgaacctcaacatttttgtctacagtgtctgaaaacagggggcttaacagggtcttaagcacatatatac

SEQ ID NO: 26459 - DNA, 2019 bp, Bovine  19866880577431
ctgaagtcacgtagtttccagaaaaatatcctggttaaaaggaaacctggatcatctggcctgtagacttaccatttttcctttcagttctgtgtattgaaaggaaatacacagaacaagatgcctactgaatcatcttcccaagctagagctcacttctactttttcacgcccctctgtggccttgaggtagagcagtaataaagagcaataactagttaaatcatgcctttgaggcctgaactgtgcagcttcttgtgtaacagggattaactgaaaccctgagattacttaggtaaatacgtgttatctgatgatgatccattctggttgctttgtgtcacttgaagtcatgactttggcttatgatgcaaagactgctgatgatctgacatagacttgctgtcaaatcgcccttgtgtctttccagtataaaatgaccttggagcacttgatggactttcccccctaccccgcctctaaagctgggagcacagcagtgtccacttgaatggcaaattgtgataaagtagcaggagcgaaattgcatagcataatcactgcaattttttattgaattgagccctttgctctttttcttgacagaacagtttattgaatgtgcgtgcggaaaacaaagaaaggcagtaaagaaacgtatcatttttttctgcctgagaatagaacagagagaaaatgtgtctgctttcagagtgcacttcttaagtggaagagcattttcaggtgcaaacagactctttagaaatattataaaactgtgctgctcaagggcaattcagtgactgatgaggtttctgtctggcagccctatcaacttgaacaatggaagtttcttgtgtcctttattcctgggaaatagagaaattctactgactaataaaaatttttcattaaaaggtagaaagaaaattttaacagatggctaatgttttattttgtacattcaataatagaaggtctgtcagctgcaggttgaagttttataatgaacatgatttaatggaaaatcgtttcttcagaatttcaggtagaaattcacaatggaaattactagtttgactcatagggtgagcgtgggtccatttgacatatttcagaagcttcctagcactcttgaacttaataacctttgaaaataaaatattgaaattgtttaatttcacagattcttcagcactcttgaacttaataacctttgaaaataaaatattgaaattgtttaattttacagattcttcagtttaaaatggaaacaatggtgttgtcacaaaatgttttggtgaaatttattaataaacttaaagcctcaaattcagatactggattttattatttagttactgcacataccaatgggcttcccagatgcctcagtggtcaaggatacacctgccagtataagagatgccggagatgagggttctatccctgggtcaggaagctctcttggaggaggaaatggcaacctgctcccatattctcgcctgaaaaattccatggacagcaagttacagtccatgggactgcaaagagttatttagatatgcctgagtacacacacacacacagcaagagatgactttgatagaatattttcattgatgctgtaatctcagcacattctagttatgaagcgtaggcttttgtcatatattttaaatattcttgaaaaaagtaaaaaattgaagtgaatatcaaggatcttgggactttcatccttttgttaagttttatttgctcttaataggattttttgttaagaaaattagaagcatattttgcagttaaaaaaaacctctcatttaatactaaatgggagtttccctggcggcctatatgataaagaatccgttgcaatgcaggagacctgggttcaatccctgaatcgagaagatcccctggagaagaaaatggcagcccactccagtattcttgcctggagaatcccatggaaagaggagcctggtgggctacagtccatggggtcacagagtcaga

SEQ ID NO: 26460 - DNA, 1914 bp, Bovine  19866880607507
tttcccaggcaagaatgctagaatggattggcatttccttctccagggaatcttcccgaccttgggattgaatctgtgtctcctgcattggcaggcagattctttatcactgaacccaccagggaagcccataacacacaatactgtatgccagatacagtgtctagtgaatcagaattggattatgggccactagttcacagtctttgtttgaccatcatgtcaagtctttaaacaggatggaaaagatatttaaaaaatttttgttttgagtttgagaatgactaagatgagaatatatgaaactccaaaatcaaagtatctgaacagtcctgtttccagtgaacatcaacatttccctccacttaacatactgtgcttcattcattcttactaatgaacatgcctcatggaatgaaagagactagcaggagcagggcattggctgccttgagctggtgtgtgtaatcacgaaaatgcagtggagatcacagagttcaatctcgctataaaacagcttctctgacagcttgcagtggtgactgtacacctctaattggtgcgccatcagaatggatttggatttatggaatcacataattcataaggaaaggtttgagtgctgctaagatacatctctctccctgtcttgtactacaagatttagtataacttcttcagttctgttggcttgttttgtacaagtactggctttggactgcttgagctgtgaaaattccactggaagagaataaatattaaacagcagataatatggtctttccggagaaggcaatggcaccccactccagtactcttgcctggaaaatcccattgatggaggaccctggtaggctgcagtccatggggtcactaagagtcggacacgactgagcgatttcactttaacttttcactttcatgcattggagaaggaaatggcaacccactccagtgttcttgcctggagaatcccagggacggagaagcctggtgggctgccgtctatggggtcgcacagagtccgacacgactgaagcgacttagcagcagaagcagcagcaatatggtctttcaaacgtggttgatcaagcgctccacgctgtgggcatcatgatgtcccaaatcatgacgaaagttctcagagctctcaggatcattcttctcaaagtaattttgtctcttaatagaatcatctacaagctgaatcaatttgatgatttagtgaaaaacgtgaatattagaggaaagagtgatccttgtactcctgtcactgcagataagatgaatcgcttttcttggccatgtgctgagtatttagagttgctatcacagagccatttttaatagctttattggacataattcacatgccatacagtccaccatttaatgtgtgaaattcaatagcttttggtatattcacagaattgtgtatccttcaccacaaatagctatagaatattttcattactcccaaaagaaatcctgtacccctcagcccttgctcccagactcccattctattctgtcacacccagccccaggcaagtactaatataacttccatctctttatgtttacctattctggacattttatataaatagtcacacttgatgtgatcttttgtgactggattctctcacttaacatattttcaaggttcatccatgttgtagtatgtagtagtacttcctttttttatgccaaataatattccatttgtatggatataccacatttttagaatccattcatcagttgacggatatttgagttgcgaccacttttggtctataatgctgctatgagcattcatgtacaggttttggtgtggcatgcatttctgtttctcttgaatatatactcaggagtgaaattgttgggttttatgataaatatatttaatca

SEQ ID NO: 26461 - DNA, 786 bp, Bovine  19866880626037
tgttttcttgcctctatagtacacacgctatcaataaagtgctacagtcagaccaggtggtccactttaatgagtcctcctgagtagctattaattagcatgttactatataatgtcttattatcattctatagtttataattggttccttggttccttcatttttttcagagtatctttcaagtcttaagaagaagttcaaatgcttacaagagctcagggcagtaaaacgttttgtgggaggcaaagaactgatactggtggggacagagtacacaatatgggagccaacacgaatgggggtaactagtaataatgaaaggctaaataataatgatgagtgcagctggctcgttttctctatctcaggctttagcaccatctaactggataaaatatatatggttcaaattatagtaaagtatttttcctcccttgatgttcctttatgcactcaacaattatttacatgctgcgattcatggggttgcaaagagtcggacatgattcagcgactgatctgatctgtgatatttctggcaatggtgtctgagataaaattatttttttaaacgtcgtgataaaaattaattttaggtcccttgccttttggacttatacaagataactaccttctgacttcaacttgtgaaaaaaacttttaaaaggtgaataaaacactgtgccaatgacaaatgctgctacagcagctgaccttcaactccctaagaagagagttcacggtgagtatcaagaaggaggcatgccatgctctgggaaaactgg

SEQ ID NO: 26462 - DNA, 763 bp, Bovine  19866880651434
catattttggtgactgaatcattaattggaatttaagacagagcagcaagtaggaatgtccttggagaaacaccttcaaactatatcatatagaccaatctgtattttttgtgtccaggagattgatcctacttgttaagaatgtattgcttatcttcaaattctgtctcactatataattaaaaacatttttgaaatataacaaatttgaaatttgtgctattactagggactttttaataccccttaaagtttaataagtaatgtcttacttaactgactgtttatcggagtaacaaaatatgaattttaacaatttatgttaaaaataatgactttatagattattttgatcatttgcaaggtaaatcactacatatttccattacatctaagcttttattactaaaccacaaaaattagcaggctgtttgactacaaaattgaattttatttcttatagtcataaaatgatatgaaaattaactgcatgagagggccttattttatctttaattaggcatcaaaatatgtttaaattaggaagacaaagcctttgtaggtcattaaagagcaatgaattttcagggctttatactaatttatctattagttaaaggatttttttaaaaagaaaaaaccaaatggccaaatgtaacctatcctgtaaatatatattttactgaggatgctgtcagtggaaggatggttaaaacacacctgtcttttctttcattccctgttgatacagctaacatttcat

SEQ ID NO: 26463 - DNA, 1852 bp, Bovine  19866880702904
gggagttcatctttcagtgtcatatctttttgccttttcatactttgcatggggttcttaaggcaaaagtactaaagtggtttaccattcccttctccagtgggccacgttttgtcagaactctctaccatgaccgttctgtcttgggtggccctccagggcatggctcataattttattgagttagacaaggctgtggtccatgtgatcagtttgattcattttctgtgattgtggtttttcattttgtctgtcctctgagtgataaggataagaggcttatggaagcataatgggagagactgactgtgggggaaacttgttctttttctgatgggcggggccatgctcagtaaatttttaatccaattttctgttgatggatggggctgtgttctctccctgttgttcatttcagcagctcagtcctgtctgactctttgaagcctgcagtacgctaggcttccctgtccatcacctgctcctggagcttactcaaactcatgcccattgagtctgtgatgccatccaaccatctcatcctctgttgttgttgacctgataccaaactacattggaggtaatgaagataatggcgacctccttcaaaaggccccatgctcgcactgctgcactcagtgcccctgaccgtacagcaggccactgcccacccatgtctccgccagagactcctagagactcacaggcaagtctgggtcagtctcttgtggggtcactgcttctttctcctgaatcctgcattgcaggcagattctttaccaaccgagttatcagggaagctcacctaacttctagatcacacacacacacacacacacacacacacacacaaatataaaggattcttatagggaaattgttgccttgttttcccctggggaaaaattgagaaaacatgagttgtttggggagtggcatgaatttgccttcagggagctaatatctccccaaagggcactcagggtggatcagcctatctatcatggagcaggaacctcagaaaaacaaatttgtcccaaactcccatcttctgaaatactggggaaacttccttaaataatagagctgaagggaaaacacaaacaccagcctcagcacaaatttcctgatcggagatcactctaagaatttcaggaggatatggaatgctgtttgttttctccattcttagaagaatatgtggtaatattgacaatttaggttcatatttggtatttaatatgaattctttgtttgctagaagctaaacaagtctcataatattctccttgaaataaaatgaaatgtgtaattgccagtattttattaacagctgaagctttaaatttattgtaggcaggtagaaaactccagagcccagcttggcagcaatgctcagtggtctttgtccaaagctatacttttttcttattcattccaaatgggtgagagctttcttagttggagtaggttccatacatgaaaagctatctttactccatttgctactgatttataaaggtttgacctcttatattttttgaaattgtgggttaaccttcttgccttaaggagaatggcagctgggaatgacatttccattttctaaaggaatattaccatagaagcaggactaaaatggctcatgacattaacctgtgactcttaaggggatagcatcatttacctggtttgttaaaagaaaaaagaaagctatgatttcatgttcaattgaccaaaagaaagaaatgagcatagacactgcttttcaaaaagagcctcacaaggttttctcagtaggatgtgtcaaggccaaggttacagaagtcatgtctactctctgcactgtcag

SEQ ID NO: 26464 - DNA, 2961 bp, Bovine  19866880728043
acctgaacttctgtgcttgacttttggacatatcttctggaagatccctccagtgaaatgagaagatattctttgatttttgtcagaaaagttaatattctcatgacttaaattgacttcattacagtcaagtttatttcacactctcaattactcactactgcaaatcaacacagcacagaaattaatgcattttgtgccttaaatagtaaacactgctgtttgtgaacttttttggccaatgaataaaaagtatttcatttctaaatctcaccagaaggatttaaattaaacagtaacagatgcactgggcaggcatgggatactaaataagaactggcaaatgaaataacccagctctttgcttttacaatgaaaatgagaattggtttttcattgagagaagaaaaaggattaagtgttttaaaaaagcgttttccaccaaaagagcaaaatagcactcagtggtatagtattgttaacaaaatttctttatcagaaactataatttaatatttaagtacctaatttacatgtgacaaggtatcatattcaaaaaattaaactgcaactagaaaactattaaccactaaaaacaataccaaacacaacccaaacatttataggaaagcaatagctagaatttgaattgaaaaaaaatttcatcatatttggctcattaaacaaagcatccattacagcctgtaagcatctcttctaagtcatcaagtttatcctttgtagcatgaataacacgtaaagatagatttattgactgcatatgcacacgtgtgtatacatattgtgagacgtacactcatgtgttgacttaaagatattgtatctactgataactggctgaactttggaaggtgctgaaacccatatttctacatgacctgtgacccatttaaaaatgtctttttataaacagaagttacataaaatactctggttttattaactgactcttttcttaagcatcataatagacaatgaaggaattgcacttattttaaaggtacagtaaagtgttagattgcagcttggccatcaaagatcagggactgtagtactgagaagttgtgcattatatgcaaagatgacggtggccactgaaattaaaatgagagcaattaattacagaacaaatagggggataacagaagaaaacatgcactactcctactttaatgcaaaactaatttctccccggaaaccaaccctttgacttttcttacacaaagaaacaggttctgcacccttggcaacacagtagacatggacttctgtattcaaattctagttcattgtctctgagtgtgctgttccagtgtcatctccttaagctgcccttgaaattctggagcatctacaatattacagtctcttcgttaggttccattgagcctcaatatccccttcagctctatataaatagggtcttttattcatcttcttctggttcctgtggcaacactattatttcttcctttaaacaatcactgaagaatctgagaattgtgctgtagagatgatacttgctcttctcagatacgttatggccttcatctgggtagacctaagatattgaatggaaaggagatttaaagttgtcaaagaaagccttctctctcagaattcattacttcagctccatggcaagggaacttcggaaaacaatatttaaccaaaatctcatggtattcaattctgagtctttcatgctaaatatttcatttttattttaattagatcaaaataagacacttgagacaaaatgcaattttgtgcctgtgaattaggatttgttagaaattccctggtgttccagtggttaggattctgcccttttgctgcctgggggctggagtttaatccctggttggggaactaagatcctgcaagccaaaaaataaacaaataaagtaaataaattaggattggttatccaaaaagttagagccttctatgttcacactgaacaagatgacattaatatcaacttagctacattttgggctgtttcatcctgactataggcccctgacctccctttagagtatttaatgtagaaaactggcaactgtaagttcattctctgcccctttgaaatttatataaatcttctttcagacttttgtcagttttacaatccaggaaatatctttctcaaggacttgggaaccatctctctctctcttttttctttttttttttttttacttttagttattttggggggcagggggactgcaccatacaacatgtggttacttagttcccagaccaagaatgaaacctgcaccccctgcattggaagcactgagtcttaaccactgcaccaccagggaagtcctggaaatcatcactttaaaatgtaaacactgaaggagagagcatccccatttcccagtctccaagttatctcttaccataagggtacaagaaagtttacttttcctttcctttcctcacttttacttactttacttttccttggcctgttaccaaacaccaggaccaatgaatccctcatggggactctcaaaaactccccagcccattgtttcaaaagagttgagtttagtcttcctcccttattgcagtagtcccaagtaaaattttccttgtttgtttactttggcacgatgaaaattttactttgacagtgtccttttcaatataaacaacatgagtgatttttttaaaaacataagtgaacatattgtcacagcaattcctgggtataaagtttttagctagtgccacatttccctctgagtaaagcctcacagtctatggtcagtgccatgaccctccatttgtttattgctacaccttcatttttcatcattctaactgtggtacctatacttttgataagctgaaccacttttagttcttccaaatgcttaggaatgaaagtaactttatttccctttcataactactccacca

SEQ ID NO: 26465 - DNA, 2081 bp, Bovine  19866880731407
cccagttaagatgtacatctaattttttaaacataacaaaagtattattataacactaaacaaaattaagtgtaattcataccatgtctaatattcataccacatttaactgtcccccattgtctcaaaattgtctgtttacaatcactttgttccaatttgggttcatgaatgtctccacattgcatttggttagactgtcttcagtcacctttaatataacaatttgagctcctttcttcagagcatttacttgttgaagaaactggcgttcttacttacctttccaacatttcctcagtattgttgggctgagcttgccttgcttaatttacaagtaacccccaaggtagtcacatggatatcttctaggctttcagcctcctagaagctgcccatccatgacacttaaataacttctgtgcttcatataaataagctaacattataaatcagattgatataatcagcataaagaaggaattttgctttaaaataattgtttttatatatgctgacttcactaagaagctttcatgctcattttcatggtaatttatccatagggcaacatgggtttgggccatcttcctaacaaggcctcagcccaaaggaaaacttgggtaattattatacgcaagatccgcacccggcacctgtaaatacaattgtctgtgtatatgtagctttctcatgtgctaggaaaccatgcttaggatgacacatcttttctgcagtgaaaaccaccctattttcagtgtcttaaagatgatttctaagatttataaagttgagaactcagatggtttcctttccaaacatttatattttcttcaccctaatagcaggaagttcatttcagattacattcctatttgaattgttgtatttcctccaagtcagaatagaaacaagttgagatgtatgataagtttcaatatattgtacaaatggtactgttgctgcttgtttggataacattgcataagtaattcattcaaaatacactgcctaaactgtcagataaagggagtggagtgctgagtgggctcctgagaacaaatatgggaattttacatattttttttcttttgagctacttgaaatactttttgagattttgcatgctacaggaatataggctttaggtttacataaatggtatagatttgcacagaagaaattagtttctagaatcatgttgatagtagttttactttattttggtttttcatgtcccttaatgtgatgatggttggaacaattatgaaataaaatttataagaaagaaccttagaaaaccttaatggagaacccaaggcaattgcatttagtttaaaagatttatagtcaagtctctatttcagagagccaaattggatgcttagataaattcatcttttttctaagaatataaatttagttttgtagattttttttcttttagttataaacagtgtgactctattcacagcttagaactcttatggttaaatttcttattttccaaaataatcattttttgaggttcctacatatcctgatgagtaaagatctaatattttcctctttatcaatccttcctcttaagcatccttggagcaactttggccacaaactgtcagagcttcctttgtataaagtgttcaagcaggtgtagagagaattgcaaaatcacatgagcttattaatatacttcattttgtggattgctcctatgcgaatccacaggtaacagtcttcctgcctacctggatgctcgttttggtatactccttgtactccaagtttaagttccccttagctcgttcccacgtgctcagccttggcatagtgccaagctttgggaacttgggcaccagaggaccctcagttttagtcacaagtctcagacaaacatatcctagtgacttgaatactcaggcctgtaggacttaagcttgaatggacatgaggaccatctgagcaacttgaaaataaatgcatattccttgaccccacacacagagctctcatccaggagctttggaatgaatacagaaatcttcaactcgagtagcattccaggagtatctgatgcc

SEQ ID NO: 26466 - DNA, 1589 bp, Bovine  19866880732062
tgaagaagggaaatggcttagtatttttttctgggaaatcctaaagttttttttttctgggaaatactaaatggctttagtattttttcctgggaaatcccgtggacagaggagcctggtgggctaccgtccgtggggtcacaaagaatggaacaggactgagcaactaaacaacaacatagcaagcctagagtttaacccccaaagattaaacagataaattagataaatgtaaatataccacaatttcaaacacagggaccattcaaatagctttgttctgaaactgtctaatataagaaaaaaaaaatcggataatgttttgtgacctcagtcaaatgttttgatttgattcgaggggttatccaaacgacaaagacaaacaagcacaaagaggaggcgagttaggtcaaacaggatgggctggggatgaaaatcgtgcctatcagttcataagctgcatagaagcagtgataggtccatcagatactgaaaatattaatcatggtgtagaaaatgaactcaagacgtgtgcttcgtaaataaagtatatgtcttgtgttaatttaagaaatgattaatccgaaacagtagctctataatgaattaatcatagccagaaaggactggcagtgagcttcaaagtacattaaatactgagagataattctcaaccatcattttaaatatggttgcaaaattgattaaagtgtaagtacattatcttacaaacaatgccttctattattaaaaagaaaataggtttcatgtcctcattaactatagcagcctatgaaagataaaagaaattttctgtgataaagtttagtacaagaacatcttcaaaaagctttaagcagttgctgatacaagtagaatttgattaattttcagaataaagcaaagactttatttgcttgacataagttctttattgtgcctctagctgacatgtaagtggatgtggagtagaccatcagtagaagcttcatggaattaaaagtactttggttacgtagaccctaaattactaacacatacttataataagaaaaacaaatcatcgttgccactgccattgaccgtctagcacccttgggcaaaaggttcccaatacaatggcagggctttgcacagagttggcatctaatacatattttaacacattgaacaaaataagaacaaaggaaagggaagccatttgtaactgattttatttatagatctttggaatctctttcattatcaggcacctttgtatttaataatggtgtttggtcagttcctacacagaaaccaagacttaaacccaagagaatttccctgtatttgtgaatttgcaatcaaataagcttgtttgaagaaacaatgctattttaagaaaaagataagattttcagggaagacaatggataatgaatactgtatcaggagactttatgtaaaatgcgtagccattttgctaaatggatgaatgaattattaaacctattgcatttttctcaacctttgaaccttaatatatcttttgaatgactcagaggaggcatatcattgaacatacagattttttttatgaacatacagat

SEQ ID NO: 26467 - DNA, 2730 bp, Bovine  19866880738087
tctgtttctgttttgtaaataagcttgtttataacattttttagattccacatataagtgatatcatatatttttctttctctgactttcacttagtttgataatctctaggtccatccatgtagctgaagatggaattatttaattacttttatgcagtctcactctttaaaacatattttttttatttttttgcttttgtgcattactttatttttttataatttatttattttaattggaggctagttactttccaatattgtattggttttgccatacatcaacatgaatccgccacgggtgtacacatgttccccatcctgaacccccctccacctctctccctgtaccatccctctgggtcatcccagtgcaccagctccaagcttcctgtatcctgcattgaacctggactggcaattagtttcttatatggtattatacatatttcagtgccattctcccaaatcatcccaccctctccctctcccacagagtccaaaagactgttctatacatctgtaaaacacttttttttaatgtccttttgccatagagaagatgaagtacatgaatatactttgagtaaaattaaacccatactgtagtaatactgctctacttagatgatccttttaatgtcttttccctgggaaagagaaaagagaaatcccactagaaatgtcttcctagtaaaaagtactaatgtaaactttgtatatttcagatgtctagctaattattatcactggtctttaattttcttatcagtttggaaattctctgattttatgactacagttactgagttcagcacacttaaattatgcataaaaataatatatgaattataagtaaattaggcacagtgcaaaaagaattctttaaatttgagcaagtgtgttaccttcaaagttagttatggtgataaagtattttaaataaataaatgtttcacataacattttaaaaattctcctttaaactcacaatttccgaacaagctagttttgctgcttgatgacagcacttcgccacctgtgtaacttaagtgtgacagtctcatttaaatgatttcttggatctcacataaacaaagtgtgttataaaagtgattataatttgtattgacggaaacgtcaaaaaaggccactgaaaatgtacaccctgacagttactttgtcccagtacatctctggtggctctaaacaaaatcttaaaccgaatatgctcactcacttagaagctgaattagaacagtgtgtaagaagaatattcttagaagtatgtggaaatagtatttatttgctgaaaattttataaggttctatttattttgctgtgctgtacttactcgctcagttgtgtctgacatttgtgaccccatggactatagcccaccaggctcctctgtccacgggattctccaagcaagaaaactggagtgggttgccattcccttctccgggtgatcttcctgacccgggaatcgaacctgcatctttggaggcacctgcactggcaggtggattcttcaccaggagagccatactgggaagtccatattttttaaaattataattatagaaggttcactattttaataattattttctgaaaagcacaaggaatacaatgtgctaaaagatgtgaactcttttacagaacttctcctgattgtagatcatgttaaatggatagtacttgctggatcaatttctggcagacttttcaactcatgggataattaaagggatactgattcaataatgtggtctccttttctacaacagtagtgcaaaacatagtgaagggcactcatttcaaacacaaaccaaccatatgttattggaaattccttacaacttttggaaggtagttgggttttatgtaattctatttttctcaactgaaaaaacaaatccacttaaaaaaaagcaagtctaacacagattactaatgcaaattaatagtacatatattggcttcagcagaaaaaaaatcaacagttcaatgtataaccaagtggcaagaaattcacatataaagcctctactaaaaatcatcttattgctaaaactgtagttggagtgttttcatgttttgcctgtttacatgtggttctttctgaaagcaggtgagagactaaattatctctcacaaacatttctaagaaatgtaataatttactttgatcttaatggcaatctcctgttgagactgttgcgccctggatttcatgcctgtttgctctcactaccctatctacctaataaagtatttctgtattcatgattgcttcataacccagggaaaaagaacagatttcatctacaagtaattccagcttcacactggaaaaaaaaatggcaacattaaaacaactctatgtaaatttatgggcttccctgatagttcagttggtaaagattctgcctgcaatgcaggagaccctggttcgatttctgggtcgggaagatccgctggagaatgataggctacccactccatatgcctaggatgtttgcactgtcctctctagtgatgcagtctttagtttgattattaattttattctacaagaacacaaaaaacaacatagctttcagtatagtgatatttaaaaattgttttgtaattcttactacttaaaaaaagggcatgcatgatttaaaatagtgatgcttgctttaaaattgaacattcaataaaatattttaggactcc

SEQ ID NO: 26468 - DNA, 1812 bp, Bovine  19866880825086
ctttgtaaatatacacattttactgtgaatctgtttttctgataaactcacagaatcttgggttctactcacacaagacgaaaaagctaatttaaaatctggaaggatccaatatataattataagatattacctttagctatatcctactaagcatgaaataaaactatttttgtaaaaattatatgattatggatagccatactacaaaggatatttaaagataatttttgtatgacttgtgatattcaacaaatgttttatatatatatatgtgtgtgtgtgtgtgtgtgtgtgtgtgtgatagctaatgtcattgactattttggtcttcaaatccgtgatttctgtgaggaattactttatcacagatttccactgaaaaatattttagtgacctaccatttcttaattattttgtctttgtttcctaataagacactgcattcaacataaagctagacataaaaaaggtactatatttatatattgtatcgctaaatgtcaggggttaatgtcttcagcaacctgtccatagagacaaagtctgggtattaggtcagaacactgtgggatttttctgtataatacagataaatcaaagaaagcaaattaaaataaatctgcaattaaaaattaaaatatgaaagtaagggttgtgttagaaaattgtgaggaaactgttactaaagggatgtcataattagaatcatataaagtttatatcttagcaggaggaaaggaaggggtagtaaagaactgaaagaaatggaagcattaaagtgaatcaaaactagttttaattgaatttgtcatgatttggatgaggcagtattgaatgaaacccataatagatcgtgtcatgtaatgttaattttgacaactgtaaatcaggctaagaaacactgtgaaatcatcatgaatgatgcatatgctctgttgtggcattcagttttagacttgcaaatttgatttctgaaactgtttgcatttgaacaaccaaagcagagtgttgtgaaataaatccgtttgaaaagaaaacattccttaatgtgatttgcagagtttcttggtaagagtgcattgctgacatatttttacatagcttcattctcttactttcattatgaagctgacagcctggagcccaggggagccagaggaacaggagaagctgagaatgagtagggagtagggtcagggtttgggagtaggtcctattttgttgcgagggtcagggctgtataatccacagtgagcatttattgcttgtcagggacatttgcggagaatggaaaggttgtatgaacagtaatgatgaaaaaggtctggttctctcttctcaagcctaaatgaagtgcctcagttgtgctgtacattaatttgcctttgataataagaacgtgttctgtatcattcacgtgctgtgttttgtcagctataatgtggactacttgagagtgtcactctgattgttgtcccctatccctctactgtgagaggactttgaggaggtgcttagtacttgatgcttccaaaagatgaggggctataatcattaacctagtaaatgcagcccctgaaactgcgtccattgttctgcctggatcctctctattagaaatgaccatgttggcaaggtcagttttaaaagttgaaatttaagatatgtcttatgcctgtaatccctttatatgcattatatttatttcattagtatgcaaatgcatgacaatacttctatatgtaaattaaatacattaatctaggacagtaaccttaataccaaaggtatatcatgtatttaaaaaa

SEQ ID NO: 26469 - DNA, 1892 bp, Bovine  19866880832807
aaccaaagaacccaatcaacccagtcactgctatagacagtttgtcctctcctagtctgtcttgttctgagggggaatttcagctctctctgtggctgtgacagtgacatgcatgtgaccgtgtcatacaatctcccataaccagtaattcaaatggaaggatttgaaagcaaaacatctcagacatgagcttacattagagagcagagtgggaagaatgcattatgagatttgtgttacataagcttgaacttttagcataacttatcacaccttcctcattagggatgacttggaagatcttaaagaccagtgtgtccctcaatctctgaaaacaaagcaaagagaagagtaagtggaaggatgaggagcaggagaaagagaaaaaagaggaggaagagaaagataacaatgtggagactgtttattattgtctttttttcctaacttgtgctttgagccctggagggataaatgtggactgcaatatagattgctttggcaatcataaatttggcccagtattattaacatgattgagttgtaaaatgatgtaaacatgcaatataattaattatatgagtgcactccagtgacttcctgaagggaaaaaaggactggttagtatttgaaatataataatgaaatggatttagcatattaccttgatcaacagttgtcagttttaatgagattttgcactcctgatcaagctcactgaatccagtaggacaaacaataggaactgtgctctctatcctcaactggtattcattcccatcttcagatatagtgctcaggttgtaactggtgtaagaaaacatgtaaagcaatcatgttaaaatataatttatttctaagatataataattttgaaagggcattcccctctatagctcctgttttgctgagtgagctgatgatagcaataaacactagaattttttaactaaacaagatcaattaaaaccaaacccttaaatacatcagcaatgcacagaagagttcatggagttgctgtaatgtttagagtttaggcacagtttggttccacaacacattttaggcagtctggttgaagcctgccttcatgattctggttcaaggcagacagaatttttttctgaaagaaaaaaaaaaagcaagtatattccaactgtagttcagtaacaggccctcagagctcactggcactagaattatttgagctatttctcaaaaaatacaaactcctgggtctcagcatggagtctgtgatgtggttctggaaccagcagccacagatcacaatgtggaaaacacagttccagaggaataatctttcaaatctacacccactgctacataccttaatgccggcaaaaaattctcggctttcgatggctaaactttgtacatgtgggttctccaagaaaaagacagaagcactacaaaatatctatgaatacagttaacaaatagtcatttaccaacacaattctggaagacatatggataaattattaaaatacttaactctaacttttggtagattgtgcataagatataatagaaaaaagtaatttaaaagcttgcttgaaaattgataaaaagtccattataaaatattaattatataaacctcaacataaatcagtgttttgtagactttgtacttaagatgtttttaaaggtggataataaatgatattatcattgaaaaaatagaaacttttttccagaataaaattatattttaaaacaagaaagggacataaattcataagggttccttgataataatcagtgaattactaaagcagatactcatataaagtcactaagattactgattaatccagttatcaccggagttggcacaacttccaagaaaaaaattaaaagaaaaacat

SEQ ID NO: 26470 - DNA, 1280 bp, Bovine  19866880840189
catgaaagtgagaagtgaaagtgaagtccctcagttgtgtcagactcttagcgaccccatggactgcagcccaccaggctcctccgtccatggggttttccaggcaagagtactggagtggggtgtcattgccttctcctgcctctgtttactcatttgtaaaatgaaaatgagttactatatatagctattatgaggatcagatgaaataatgtattaaaaatatttgcttagtgtcagtacatcatacagttagactaaatcttagttactataaaaaagtaaatggagacaaactcaccatttgcaaaaatatgttttaccagcaaaattaagacaagaataaaccatagaagagtgtaaatagcgttaaataaggcaactgggtgcatgaataactttaaaattaggatacatttcctatattgcaataatcaacaataccttgcaaaatgaacaaatgcaatatcttggaagataaacagctgacatcatagtatgcaaaggcataaagaaaagtaattagaaacatgcaagaataatagtgttactgaataaaacaagagttataaagaaagcactgtgaagaagaaaaggtcttttgaaacagtgagtttcacatttgagtagggtttgagtagatgatgaatgaccaggaatttatagaatataagtttggaatgatcacttccaaccctaagtttctctaaaatcaccttaaataattatgcaatttgttcctaacacaacatgactcatttatctagaatataaaccagaaaattcaaaagattagcaagaaaaaggataatctgtaaaatgcattatataatcttcgaactttttgaaaataaaaattcctgaggggtaaatatgggaatcttctgaaaaacaaatgagagataatacttgtcattagagtttaactaaaataattacctaataaaggcatttccattcgttggcttaacattcctccgtctctggcatatataccatccttttccttagttacactgttgtcagaccttgtgagaaccacagtatgtgcaataaattcatttaaaaagcgtgtttcaactataaatgtatacacgaaaaacagatcagagttaaacttatgaaaccaaagcactgtgaataagaacatataaaaatgtcatgtgcattgaactccttgcaaattagatcagagaactagcttacacatcacctcttcagcagatgcttctctaagggactgaattgtgttccccagaattcattagggaagccctaaa

SEQ ID NO: 26471 - DNA, 3338 bp, Bovine  19866880888115
aatttaagatgaaattgatggcaaatttgtcatcttaatttatctgtatttaattcttagatgacagacaatataattgtatggttacatgatggacattaactattagcccaaacttatttatttgagggatttgtttttgtgaagtatattataaattacaccttctgagttacccctacgatgctaatcaaaagagcattatacagaaggctcatggcttgaatgcagttgtacaatttgattataaaataaatatacctttttaaaatgaaacacatcccttctgatactatctgctacatttgctggcaatcctaatcattaaaaaggctaaatatggcacttgcctggtgttccagtggttaaggatctgcttccactgcacggggtcacgggtttgatccgtggttgagaaactaagatcccacattcttcatgatgtaacttaaaaagaaatttttaaaataatttgacattttaaaatgctaaatactatcagtaaagttcattctttaaggaattgactgtgatggacccttgtctccactgccatagaaagtacttttatatttagtgctgctttttaaaattccttgatgaagatttaaattgaatttgaataggaccaaagcattgtcaaattcctttctgtagtggtcaaagtcatggctccttggcattgtatcactgtgatttctctggcatgtttgcttcttctctattcggcttctgttctttccatgtaggtggaagactcacaaatggcgcaggtgccagcttgtcccttggagcgtgcaacaggacagccctggagcgcaggagggctgtgggcccggacggcaggcaagaggtgggaggccccattccacacttgatttgcttcacatttctccagcatcactaatttaaccactagctagcctgtagagtttgttattctgatgccacactaggcaagcagagcagagcacataaaaatctgctactatccattctaccacacaccagaacacggagacctgtcttttaagttgtgtcccttgttctttgacattagtagttcacttgtcattgttgttttagttgctcagctgtgtccgactctttgcgaccccatggactgtagcctcccaggctcctctgtccatgggattcttcaagcaggaatactggagtgggttgccattcccttctccaggggatcctcccaacccagggatcgaacatagctcctctaattgcgcttccattcatgcttatctgaaagatgatcagcatgtacagtgcagctcgttcttgttgttgttcttgtaattcgtttttggctcatggtattccataacacttcgcttgtcaccttaacaatcaataagattcttacatctttgcccatatgcattatgtatgtgcatgcatgtaatgtaatataattggttaactttcccagaaattctcagaaatgctacccccaattcggttcatatttagtactgatttttaaatggcaaatttatgtactcaaaacctgccatatgtggactgcaatctgtcgacactgctagataacatggtatcttgcagaaatgaaatatggaaatatttccagctttccatgattatttactagatattatggataatactttcactccaagctttgaacagtgttctttatacatgtagcaaattcattctgtaaagagtacatgattctttttactcatgctgcttatacatttaattccagatacatatttaaaatgtattttgaatatgtaattgaatacacagccacctttctttaattcataaaagcatattttacaccctcatttgtagttacatatttgatgatattgcgaaagtgtgaacatacagaactggattccagtttttgctgatttcatctgggaccccttttctttacagagtaaaggttgctttttttaaatttgaaaaaaaaaatagcatcatttttggtaagaattttctattttgaaagtcattttagaaatctttcatttgaaacatttagtttacaattaacattaactagttagtgattttcaggattttgttttaatacttatttttcattctgtatcctctaccatcagtatcggctaaaaaataactctctcccttcacagtttcagagacttaggtatttagagtggaaagtctttctccccatttcaaaccattcatgagaaattgagtgatataaggatttcttgtcatgccctactaattcctccttgaatcaagtatacatttgcatacagtctggaccctgcatagagttaataatgaaagcaggcatgcgtttaggaatcaagaaacctaaattttagtcccagttctttcgctcacacaatgtgagttttattcatccctttgcctttctaggtctcagtttatttagatggggaaaaaaagaaaagaggactggaccaaatgatctgttaacaattttttttgtatcctacaatctatgcacagataatatcctgccatcaaagtgtgacatgaatttaggtaaaacaggtgaaaactatacttttgcaggcactgagggaattctaagatgtgaaaactgcacagggtgaaaacaggtttagttttgaacacttttacttgactgcacaacctgggtttatttgtttcctctctctcaggctgagaaagtgctgatccttacagtgctttgcacatagtgaaagtgaaagtcgctcagtcatgtctgactctttgtgaccccatggactatacagtccatggaattctccaggccagaatgctggagtgggtagcctttcccttctccgggggatctccccatccccagggatccaacccaggtctcccatattgcaggcggattctttaccatctgagccacatgggaagcccttgcacatagtaaatcttcattagatgctaattccttcccctttcctgatagatcgtggcctaatgaatatgtgcatagatcgctgtaggcataaaagcaacagtattaacaaggtctttagttttttattgacacagtctgtataaaacatttcttttggtgattaccagtgatcttttcatttccaaatctaaaaacctctgcttattcctcttcgtagttgactgttcattataacaagtaatgtctgcataaatatactcagaagaacccctttaaattctgtatgaagataatctttttatttgttgccttgataaagattttatttttcctcaaagcctatactcctacagaagtatgaaatggagagagttaagagtgaggaaatatcttgtattattggtagaaaggcaaagaa

SEQ ID NO: 26472 - DNA, 1606 bp, Bovine  19866880942337
catgtggaaggaagttgttgtggtaacacttatgcattaattatatagtatctcctttatgaaaatcatgggaagaaatttgctatttttttaaatcaagaacaattttacctcccctgaaaattgtcctaaaaaattcattcttggataactttgataatcaatctcctttatgttgactgctaagaagcttagaactatgattatgaggaacctgtaaccagtatatgggattttatatgcataactgcttgtgttaacttcatttctccaatgtctgtacttaaaataaatttatgactcaactttttaattactgttaacactacattaaaccttttttggaacaatatgacataggaattaatatattaaattccgacttccagacatatacctggaatttggaaatcaaccagttagatggttgtgactgcctgtacctggtatgtgccaatcctcttttcctctcactccccaatcagtcatatgaaggagaaagttatacagtggaaacattgtgctatgaaaactcccattgtttacatttttactggagtatagttggtttacaatgttgttttagttcctgccgtacagcaaagtaagtcacttatatgtataaatatatccactcttttttatagtcttcttacatatagatcaatgcagagtactgagttccctgtactatacagtatggtcttaattatctattttatatagtgtagtgtgtatgtgttcatccgtctcccaatttatccctcccctacccttccccttggtaaccatacggttgttttctttaaacatgtggctctatcccagagtcctaagcttgtgactcagtgtgtctagagagttctgtctcagagataacatttgccaaattaacaaataatttttttaattagtaattatgtataaagttctttgaaaatgcaaggctatataaatggatttggcatgtttcattatttaaaggtataagagaatggaaggagacctggatgacattttgtaattggaaagtggtcctactaacagggcaattcaaatggagcactcttcggttatgtgtgtgtgtgtgtgcagatgtgttttgatatatgaaatgtctgagtatgtagtatgcttattatcacagtctaatttaaaatgatcaccacttatctgataaaagcagaaacattttagaagattacattttggagagcagtatttgtgggcttttctttcaaatagcagagtcagcattctgatttcctctcagacccttcagtatatttgtagactggtggtctccatattgatccctcttgtttccatgactaaaattgattcctcctgcctaacactgagacctttgcctgtcatcaagcttactttttctcttatgccaaaatgacatttgattggattattcaacagaagaaggcttctgtcattgagcacaatcaatatccttgtgttcactgattttatagacctttcagtggctaccttcataaatgaaagctggaatggttcaggttgtagtcagattataccaaaacttaagttttttttttttttaacagttggaaaagctcttttatcaagctaa

SEQ ID NO: 26473 - DNA, 1462 bp, Bovine  19866881014654
aaatgtgactctcagatactgaatattaaaaagccgatgctttctgcaggagccattcagcagcactccaggggacacttgatttgtctgaataataataaactataatgataatagccaagcgcacctcacaggagtactaagctttaatgattcaatatttgtggaaccctttgagcacctccaaagttatgtaagcacaaatgaataggtagggacactatataccattgttatttctacattaaatctctcttggtaatttcctatcttataatgtcttgtaaggtaggtactgtatgagactaatatatgaacaaaattatggaagaaataaagtataaaataatatatagtagtgatttccaatgaaattattataatttcatattagtgaaagagaatggagtcgttaatagcatctctaaaaagtcattcctaggttgtaaaatagaaaaatgaaaatctggaatagacccttaagatttaaatgtctgaaaagagtttgaagacacacttgctattttttcttatgaaggagacacctaagattttagttggtttttttcccacactgaagaaattgtaatgatgttttctctgtttatttcctagtagaaattgtacacattattttcatacatctgtcttttcatcttctcctccatcaccagcataatttatgcaatgtgatagtacatttaatattcctagtttaaaaaatatatcttcacagttcagttatcctcatattttccaaaatgcaccattgtgattttgatactgtccctaacttccatgaggtagctatgtacaaactgcattgacccaaacagtctccaacaaattttcctctaacaccagatctccaccaatgaaagactcatttcttccagtgagtactgcctataaaaactcctctcagaggacactgtgaaagagagtgctcttcctgtccttgccttttccctttcacctagctgacatcacattctttaagacccagggtgtttccaggggtgatgaggaaaggaaaaaaaagcaaggttacctctttgaggagtgtaattctgagtaggacaacactgcaccaggttttgaacaggttcctcaccctgagagagggaagaagggacaaagagaggtggccaccgctaaagtcgcttcagtcgtgtccgactctgcgcgaccccatagatggcagcccaccaggctcccccgtccctgggattctccaggcaagaacactggagtgggttgccatttccttctccaatgcatgaaagtgaaaagtgaaagtgaagtcactcagtcgtgtccgactcctagagaccccatggactgcagcctaccaggctcctccgtccatgggattttccaggcaagagtactggagtggggtgccattgtcttctccacaaagacaggtaggaggacattaatacaaaacccacatgctttg

SEQ ID NO: 26474 - DNA, 1183 bp, Bovine  19866881036514
taagttgtcgttacagtaactctgaaaataaaataaatggagagaagcactgaatagttatatataaaaaaaactttctaaagtgggaacactttatatatcaaaattcttttcagggggaggttatttgattagtgataacttaatgttgtagacatgggtctcttagggagtatttcgccagtagacaacaggaatgctggctgagcaagccctatccaaataattatatgcaaaaaaaatgtcatttttttcaaaacacctatctttggctaaaaatatatttagttcattgcactcttaaaaataatcacacagttctctcatcagagaaaaagggttaattaggtgttagctaatggcctaaagacccaacctataacctacaatgttttcatggcttagggaaacacccagcttgcaaaccaataacattatttctcttcactactgttactgcctttaccacagggagcaaggaattggctgttgagctcatccttctctctgtatcaatttctactgttttcctgagttcttggaaggtccagattcactatttagcagacatgtggtccttcctgcttctctgagctcccatttcctcatgtgtaaagtgggaaactattttcttcacctcactgcacttatgtaaggcttaaaaacacaaatgagacagcatttataaagatgtgtatactctaagctaatgttacacatctaaagttgaaacaaagaaattacttcaaaaaaaaatcatacttactgcatcatgagcactatgttatgtaccttgatggttaacagtgtacagaaatcactgttaaagaaaaaagcaatgtaaatacacacaaactatgacattagaaatttattaacaaaatagtttaattacaattcctcttcctatgttaaagccaatagaaatactattaagaagatataataatagccattaaatggtggagcattttctatatctcaaatgattaatattttcatggcttcttattctatgctttcatactacagcagctgtagagttgtctactaactacttctatttttttttcaccttttgaaattttagtaaccagattattacctactcagaaattctgtatcaggctgatatcaaaagaggattaaaaaattatcacagttttttacttaacaagagtta

SEQ ID NO: 26475 - DNA, 505 bp, Bovine  19866881062316
gtgtacactttatgtctggaagtgctgaggacttggcaaatatgaatacttataaaaccaaacccaacatattccaactctatataacttgatagagtaaaacatgaaagaggaaatgtgaaacagcactctctgtgttgctgaaagttagaaggggaaacaatgaacaaatgtatctgtcttgaaaaatgtataactagactcagcaaactagatactttttatcaattattaaggatgcatgtaaagggaatttttcagcatactttccttctcccctctgccttatagttttaaaggttctttgttcctttgatttattgttctgcttgtgcattccagccccagagtcatagttaggggacagctaaaattaagggactaaggaataagtctgtcaatctttgcccccttgggtagaaggctgctatacagcaaatgaaaaatggaaacatcattaagaataaattgtaggttttgaggtatgttcctttattctcaaaat

SEQ ID NO: 26476 - DNA, 743 bp, Bovine  19866881189327
cttagcttcttgcaactttatactcctcaccatcctcctaatcctagcacaaaaatgtctttagattgatttatgaatacccagcatgttaaaaactgcagtggtgataatgacttccctccaggtaaagagataaagaatgagactctagtaaaagtgctttcatggtgtcaagatgttatcatcttttgctttttgcccaggccattttatttaaattgtaggaataatctttcacactgtggggatatggcagcaggagtattgacactaaaactcaaaagattctggtaagaaagggagtagaaagaagaaagctgggcatcaatgaatctctttccaggcactgactctgagcatctttggacctggaaagccagctgagagtttcaaatcgcacagagcttctagatttcagcagcccatggagcacttccatgggccctggggaggagagtcacttgaaacaggactggctgatgatgtaggaaatttggcttaccccaggcacatttgtaaagctgcacactcaatggggcatcaaaagcatggaaaaaatatttaatgtgtaatttatttgctgaaatataatatgggacagatacatgttttcaaggagaaattaatttttctgttccaatgttaacattattaaagatgctgattagcagccaactgatagagcaggagcaaaacagggggtggcattttgacttggatacagaataaacttcaataaagaa

SEQ ID NO: 26477 - DNA, 1194 bp, Bovine  19866881273086
atataatactcaaatatatgtttatttttcctatgatctactgtttcctttttttcactgaataaatgagttgactgataggactgcctagttttctgagtctccagtttgtaacaggttagaagttgatgaatgctgtattcatagtcgagatccaagtcatttctaaactgccactcttgagttgcgtgactctgatcaggtgactcttctaccacatagctttttcatatgatgaaattacattttctgaaaagacctctaaagtccctttcttcaataaaaacctattaagtcttcataatctaaccaatctaaattcttattggcttgcattttcatattggatctttaaaaataatacctttcccatctctaactatgtgcaaatggtatttccttttttcccacaatgatacagtattaatataaggacatttatcacatttacaaacatatggaaacaacacaaatggctataaataatgggaaggttaaacacataaattatggctacactcataacacagaacattattcaagagcctatctgtaaaactgtcttatttctatcttgaatttttcagaactgggaactagcaaaaattagtgaaaaatcagagcacacatatatattcataaaatatttcttaattatgctctaaaatggttttcaagcaatttattttaaatgttacaaacaattaatcataaattgagaatctagaatttaaaaaatacttttcccacctttaattatgttcaaatagcattccttttctaagcacaaactttgatttcctctaattttacacatatttatccatttgaatgaacagtttacatattttttaatttcattctctaagtgtgccctttccttcacagaattcagtgagttagaagcaataattcttatggaagcaaaatgcatgcacagtcaaattactttccttataaaggcagaggtctttcccctggctttgatatttgaaaaccttttgttgagctgctgggaacgctgccaaatggtgtcacctgccagctggagggatcatatgctccctattagagctgagggccatgctgctggtcagcagctgaatgtgggactaccagcactgcatgtactgagtagtgggctaaactgctgcagcagtgaggcctccctggaagggccagtacatacatttc

SEQ ID NO: 26478 - DNA, 632 bp, Bovine  19866881309750
cacatgctttaaggagatagccagggtcttgatgtcactgaagatagacagtgatggcatttctccacctcaaggaaaatggatattctaaaagcacaaagaaaatggctcttggagtactttatgtcactttaccaagatgcttccttagtaatcagattaacagccaacacaggtacaaatggatgtgctaatgctcatctcaattagacaaaaaggttaaatgggctcttggatgtctgatcaagatgctttgctttgtcagtggtaaggtttcatgtcggtaaaggtgaacttcatgcccatttttcaatttttgtaagtggtaattttaacagaggtacaggtctggggcatcaaggaacaatgctcttgacatatatttataaaggaggtgcagcattcaggtcaattataaaatcattgataattgatgccttgggaggagggatggggcggcgtgacagaaaagaaaactaaacaagctattcattaggggagttaaaatgaaatttttattttattttttttatagagcagcatcccaacataggtcatcctaaggagtcctgtgggagaaataaattttttagtaatgtaaagtgattacacattcttaaaaaaagatgcta

SEQ ID NO: 26479 - DNA, 1876 bp, Bovine  19866881312258
ctatttaataggatttgttatacacagtactgaattttaatagggcttgctcaataggcaaaaggaacctatattttgaaagattattttaccttatagactagttgaccaactatggttaaattcaacctgtactgtttctataaataaattttatggagacatatccacactcatttctttacatattgcttacagctccaacagcaatggcaccccactccaggactcttgcctggaaaatcccatggacggagggcctggtgggctgtagtccatggggttgctaagagtcggacacgactgagtgacttcactttccaacagcagagttgaatcatcatgacagagacacatgtggctcataaagactaacaaatttactattttctccactacaaaaaaagcttgtcagtcctcattatagaaaatatgcaaagaactactgctaaaaatccaacttttgtgaagattggaaaacatagcttgttactgacacttttatttagtaaaactggtattatttgtttttataggatagtgtttgtaaagagatacatttctacttagaatttgtaaaaatcagtatttctcaacacaccatccagttgaaatcaaacagctaaaggaatatgcagtttgggcagacggggcagcagagaccactgtccttattaactcacgtggcacagggggcaactccatctccttgagacacacagggctcttcttcctcaagttctggacacttcttctcgctgccaataggaaactgcctgatgagccgagctctcatgcgggtgcctttaggggatgccgggtcatggcatgtttttgagcaggggctccactctgaccactcggacacctggcactccttggtcatcacgcaggcctggaaggtcattggcagcttctcttgctggcagaagctgcaaaagagaattaatattctcatcacagacttataggcaggcatgaacttataggcaggcatgaacttgtaggcaggcatgaacgttccagagcaaaatcagcttggacatttttatttctacttggaagtacaatttcaatttcactgaaaacgtaccaacatttatgacgtgtaaaagctgttagactccaagctaacatttgcatttcctcttagtttgtaatagttgttaaaccattcacaggaaatagaaaataaaaggatgaagcaaaattagctgaaactaagtttaccatactgttcatttcactcactccagatttgttttaacttagaaaatgaactgttaacataagacaattttcactctgtttagtgatttaaataaacatgcttggataactactacaatattattttgaatagaaaaagtaatttaatttatgcttataattatttttaatatcatttgaaattttagctgtcaattacaattataatgtaggcttattcaaatacctcaactttttccagttcatactttaatgcaaggtctacatatgagtatattaattaaacacatcctaagcattagaggcttccctggtggctcagacagtaaagtgtctgtctgcaatgcaggagacctgggtttgatccctgggttgggaagatcccctggagaaggaaacggcagcccactccagtacccttgcctggaaaatcccacggacggagaagcctggtaggcctgcagtccatggggtcacaaagagtcggacatgactgagcgacttcacgttcactttctttaagcattagaagggtgacagaggatgagatggttggatggcatcatcgactcaatggacctgagtttgagcaaactctgggagacagtgaaggacagagaagccttgtgttctgcagctcatgggg

SEQ ID NO: 26480 - DNA, 1174 bp, Bovine  19866881350326
tgctgttgctgcacttcgtgatttatcaccttcccatctaagtgggaggaggtcaggtcagacagaggaagctattcattcaaaggtggcatttctccttccacagccagcactttaaaacacagtaattcatacctaattaatggctgtcttttgtgtcattatgagttttgttcattgaggttcacaataccatctgctactttctgatacaattcttcaaaaatattaccattaaggttagaagtgtgcctgcaatcaagagtcctgactccttttccttaccgaagacttcagctacaccaaggtggccttatcctttattcaaagggtaaagatcaagaaaatttatgatttaaactactgtgctacatattactgtctttccaaactctagtttgcagtcagtgacatttgcttacctagtctctttcattaacatttatgaaagcatacaaatattttatagccctaatagataagatacatagcaatgctttattgattttggttatctttacaaatcaactcaataataaatagtgaaggtgtttagaatgtaacactgaacctacttttatggtattgtatttccttatctcttagacctgaaatttatggcaactggaaataaatttatcatccactggggatactcatctaagtctgagagatcaaatttatattctgcatgttcaaatgtctcatcaatttggtgatgagctcaatggagagcagtatttctgtgagaatattaaataattaagaataaaaactgcactctcttttgtaatctaatcctatccattctagtttcagatattattttcagctactgtgttttaattcttcttagtatataatgtattttctcagtaatatagttcctcttgaaaactgctttttcactccctagaaagattacaccatggtcacatgaagattaagtacaaagtagtgtgaaaactcactaatttttattatcaattataaaacactcagagctgaatgaatagagatctgactgcccaatcccacagtatggtcaccaaccaataattctatactgcacttagacatctttccaaaaagcacttcttgcctattttatgtgatattcaaatggtctataaagaattacaaagatcttatttttaaaaattcaagttttagg

SEQ ID NO: 26481 - DNA, 1017 bp, Bovine  19866881361407
aatttgttatgttatgatggagaaaatatgagctttgaagtccaggaatatgggcttgaaatcctgcctctgctttaaatagctgatgaattgggcagagttgaaaagcaaagaaaaaaactatgattctctttttcaaatattgtaaaatgtgactaacaaaaatatttacctattgtcatgatgatgatcacttgctagacacttatgaggtactcagaaatgttatttcatctcccttagtttagactataataatcagtgcaaagctattatagatttctaaacagaaaagaaacacgagagattatcttaccttgaatggcagtgatagatagatttagatttagactggggagaaatttaaggttcttgagctcaaatgcataatttttttgtttctttactttttttcttttaaaattatgatggaaacactaggaattaaaagaacagagcttgtaaattgttgcttatactcaaaccttttatttgtaaaacttaacaaagtattcactgaccaagacacaaacaaaccaatttgaaaagatgccttaatctggcagtctgtttttaaaaatcagtatactttttttgtgtgcaagccagcacacaccaactgaatattagcatcatatttacttgataaaattgtgtaatatctttagcctaatctaattatgtttcaattttagaaaacatttactctttcctgtaagagcagagtttccactaatgtataccaatgcttgcttttagattttggatcaaattatattacatatatattggtataaatgtgtgtatgtgttccttcagagcagcaattgtattttattgatttatgattaaatagcccacctacactcatcaaagtatcttataaacaaaatgatattacccccaaatgtctttattaggaaaccactactatagaacttcattgcttagtctgtttatagaagacgaagtaaaaaaaaaagagcccactccgatttacttatatgtctccttaaa

SEQ ID NO: 26482 - DNA, 1708 bp, Bovine  19866881514733
tgtgtgtgacctaagctatttagacagcctgttccaagatacaatttgatcagtcattatatacatctcacctagattaatagtttgaatctcttcattaaaaaataaaaatgatgcttgggaaatgtcataaatccatacacattctttgttttcacctttaaaagtagatgactctatgttcttgaaaattcaattatatacctcaaaaaggacaattgctattataacactttcaatcttgaagattaattaccttcctctagctttgctccttcaggtgagtttctgataataggcatttactggagagtccactgccggcattttttacaccttgatcttaattatatataaatttttgcatacttcttttcaagctactgtgttacaaggtattaaatgagtgtgtctatgaatctccgcatatttaagtatgctttgtaagttcaagtttcagtcttgtctcctgaaaagaaaacatgccttgttttattcttaatcttagaggaattgattaaagctaatttcttgatattaaaaaaaaattactacatttttcaatgttgaatagcttccctaaaaaaaaaaagaaaagataaaagttctgtgcaactcattattcatccagttcctctccagatttctatattctccagtccacatcatcagtagtatagattgcactccaaacacaaaccaacctcttatcaagctcctcaccaggcagcactgcacaagctagaaggagtcccagaatatatttacttgatcaagagtctttctttttattggtaatggcattatcacatccctttcaaaggtagtagcatactcctaaaatcactaaaatttctggggtatttgtattaaagcacatttgaatagtcttaatcttatagcattgccattaatggatttctttaagaatgcaagtgaatcatagctgcaatcagtttcttcattattttttattggaataagaaatcatttacatggttgaaatacatttagtaagcaacaatacgacttgctaatcagtaaataaggcaaatagttaattcacaactgcaactcagtgaaaataatggttatgtccagacaaacatgcaacatatattcagcgttaaaaatgatgttctcagagcatgaggtttttacggtgattactaaagaaatgcaagttacaatatttgctaagattttgacaatttatgtagacagtcaaaccaaaaacacatgaagtaaaataagtattttttataattcaaatctgatttcccaagtaatgacaaaagctgcttccggagaagatttataggggattttcattcattcaacaaataaatattgtgccccaccaatgaaacaaactgctctgggtgaactacacacattaagactttgttcttgtagaatttatattcaactgtagaggaggtggaggctaaccagcaaaagcagtatagaccagaagaaaataccatcaattattgattcaaaaagacaatagaaaccaggttatactcaacgatgactggtaaaattctagattatagcctttctggaaaatttacattgactttgagttggcactgacaagggagaaggtaaggagggagagggaataattatttcaaaggcacacatctaggaaaattcagaatatgactggagcacaagggcaaagagggaaatcacaggaaat

SEQ ID NO: 26483 - DNA, 1120 bp, Bovine  19866880319980
tagaatgatgatatcaatcccagttttgttgtcactttttttcaggtgtactaacagagcaagtggcaggtcctctgggacagaatctggaagtggaaccgtactcacaatacaacaacgttcagtttccccaagttcaaccacagatttcctcttcttcctattattccaatgtgggtttctatccccagcagcctgaagagtggtactctcctggaatatatgaactcaggcgaatgcctgctgagactctctatcagggagagactgaggtagtggagattcccataaccaagaaggcccgactgggagcatcagcagggagaatcaaaggggatgagctatgtgttgtctgtggagaccgagcatctggatatcactataacgccctgacctgtgagggatgcaaaggtaaacgtcttttggttggcagttttctccttattaaggtttttctatatttgttgttgaaatccttaagactggattctttccttttcccaaataacttcccatttctcttcttctgcttctccctcttcttatctcctcaccttcattgggatgtcataggtttctaggaagatcttattagagtatttagcttggatataactaatattttccctattcacaacctcacatatagttagaagggatttatgattatgggttttgtttgtttttattgtctttttaagaaagagacatgctgaactcctctgtcttaaaattaaggtcaaggagaataagactttattcagtaaatattaaaaaatacattttcatgtactctagttaattgagaaagagaggaaggcaaacagaagggaacaaaaaagaatagctgatagtcaacaaatatttcacttagcagggacatagaagtgctgtaggggaatcaataaaattacaatccatataggatggataaaatacaacatatgaaatatgaaaatgactcagtatgaatccctacatgatcattctcctaatgagggcacaaatgataagtttgtaaagtttcagaggaagaacatagtgggctagtaggttcacctatttattttttaatttgtttattcaacaagtacttatgggatgctcccatgttagcctt

SEQ ID NO: 26484 - DNA, 2374 bp, Bovine  19866880365676
tcaatgtcagtcactattactatcccctagtattgccattctgtaatgctgagctccatgacccataacaacttctcgttctgcctcacctgttgtacactttcgaggttatccatttaaggaggctttctgaccctcataaattcatttttacatccacggtaagcagtaagtaggggctattaaaaatgtgacaatgtgcacggctcctggcagcgacctccaaaagtatctcgctgtcctctcagacattttgaggacacttaagcctccatatgtcagtgaaagcttctccaccttcatgtgacaccacaccgcactgcttctatggaaacaaaagcaccaccaccttaaatcttgatgagccaacaaaccacagaagagaggataggtccacctgaaaatcatatttttcttatctctccctcggccttacccctacatccaatcaatcagaaagccctgccaagtttccctcttaaatatttaagatcctctgctgtcctagaagatacagcccatactgcttaccatggcaaacacgatccaggcatcctgccctccctttagagcctgccactctctgccttaaatgtgactctcccacagtatgaaactgcttcggttcccacatgcgtcttgctgttttcatcccatgcctttgctcatgcaggaacacacttcccttggcctcggtacccctagcaaacttcttcctatccatcctgcagaatacaatacaggcatcttccacaaacactccccgaaccatttgccaaactaaaactgctgcttgtcttccatgttctcagaatacgttccacccatcgctatcaatgttctttgcaactactgatttgccttttcccctcaactagctatgggagttggccctatacttcactcagcttctcatctcacagtgcttagtacagagccataaacagacgctcaacaaatattccctgaaagagggagcatatttatcctcatacatactcctacttatcagtataaacatggaaaagttccttaacttctatagcaatcattttcctcatttataaaatagagagctggctggctaaatcccttgccaaccataaggtaccatgattctacaatgcatgcttttccaaaatcaccatttgccattaaaagcagaaatgaaattttgggctgatgatgtccaaaaccatttagcaaagtactcaagaactacaacctaacagtcttccttcagtttcatttccctcctgctcctttccctcacccattgttccagccacaggatcaatttcaatgttctccaaatgcactaaggactttttcatgcttctggctcttggtctattaagatctcgcagtgtggaatactgtccagcctctccttgcccggggaaatccaactccttccgctatccatgactgcaatgcaagctcttccatgaaatcacttccttgattagattttgactacaatgcttgttccttttgctctaatattatagaagctgttagcacgtctatatccttggcttcactgtaagttccttgaagtaggtcctgtttatcactatggcattcaaaatgcacagagcttcctatacagaaggtgttaaataaatgctttttgttggtatgtgaatgtattccttacatcactataaaatgaagaaagttcactcaaaggacaaaagaattggcagtggctgaaccacagcttttaatttaacattctctatcctcagactctagctacagaaaataatgtaggacttccctggtagcacagtggataagattctgcccgccaatgtaggggacaagggtttgatccctggtccaggaagattccacatgctgtggagcaaataagtcctcacactctaccctgcgctccacaactactgaagcctgtgtgcctagagcctgtgctccacaacacaagaaaccactgcgatgataaagcccctgcatcacaaccaagagtagcccccacccgccacaactagagaaagcctgagcgcagaaacaaagacccagcacaatccaaaataaataattaaaaaaaaaaagaaaagctgaaatattctgggaaaaagttgtttgaaacagtgaaaaacaagaaactcagcatgacagagcacatcaattgaacagactaccattgctattgttgtttagtcactaagtcatatccgactctttcgtgatcccatgggctgtagcctgccaggctcctctgttcatgggattttccaggcaagaatattggaatgggtttccatttccttttccaagggatcttcctgacccagggatcaaacgcttatctgcactgcaagcagattctttgcctctgagccaccag

SEQ ID NO: 26485 - DNA, 1379 bp, Bovine  19866880433716
cagtaaaggagaatgaagtgactgaattaaggcctgcaaagatctcaaaataccacagctcaaaggaaaatacaatttggagaaaaataagatttgtctgtctagaggcatagaagctagagtcagtagatgtttaaattaacagcaaattttcttttattaacaggtattgctacttccactggcatctcctttcctacaagttataaaatataaataatgcagccaattttttaggctcagggtagaaaaatacactcaacctatactaatgagtccaatggtatgctagccatagtcctgacctcaacttataatcttcctaaacatttattaaactacaacagagatgaaaaatacctaagatatttgacttaggacaagaattactataaattagagaaaggttaaactttagggagaatttccactggatcttaaaagatgaagagatttaggtcaggcagagagaaaaaaaggcctcagagagatttctcccaagtacagaatgttgtaaaaccaaacaaatgggagaagattcaaaacctaattgtttttccacttgattaacatattgtgagctctggatatataagtggcaacttattttctacacttgactttaattagtgacgtttaaagcacactaaaatgtatgaagtcagcacaagtgctgtaacacaatgaacatcaagtcttgtggcaatgacaacatggagcaaactctcaagttacttgtcataagaatctgataatctgatgaatggaggtatctgaatatgaaactgaacattttaaattcaagagagtatgaagatgccattgatttgctatgtaaatctaaggaatcacgatggctgacatacccatcaagtttctgccattcactttcaactaactcttacacaagttacaaagagaggaaatgccagacaagcacaagacagtgacactgctacaagtcactctgttctgcctcagttccactgacagtatttccattattctctggatcacatctggcgaaagatgaaaactattactgatatttgaagaagcatggtatcacgataccctggagcagtaagaaactaaccttggcaaacatgacaccaaatcagaggccccactttcccccacctccatcagccccgcaaggcccccatcaagtagaatctgcatgttctattctcttttgtaactacagggccaactgcccagtcttctcagtaattgttgagaaattaaactggagaaaaatcctaagaatgagcaattgcagactttaattcctagaggaatactccatatgatggagttgatggacatttacaagttacttccttgcttaaatataccaatacaaaaaaacacaaaaa

SEQ ID NO: 26486 - DNA, 1988 bp, Bovine  19866880516695
acggcagtggttatgatcacatttttcttttttaaccactgtaaatgtataaatttgcagcctgatttcatagtcaacctttctcagtttggttatcctgaagtccctgagacctgtttcttagcctgcaaggttgagagccaggccctgggttgtagtggattcaccaactagctggtcagccggtacctcaccgcatacttcttccaaatgatgcatgccctatctaaaagaagcagtaatttattttgtaatagggaagcttctactgatatttattttccgtctcccatttcttaaccttataacaacagtaccagatctgagaatcctgggagagcaagaaccaaagccacagtgaattaataaaaatcctagagactgcttcaatctgtggaagagatataggtaataaaaggtagtaacaaaatatttaaataaggctaaagcaaagctccattttgtctgagacaatggtgtctttccatcttctggaaactttcagctttgattcgcccaccaggtcagaactacatttacttgtgttaaactcagtgagatggaaaaagacttgaaattaaatgtcagaagtattacacaacattgcatctcaagacctttaattgtatttaaaaaccatctggctggttctgcaacatctgaaagtttcttttaatttaagcaaaagacataggcaagaaccagatttcaataaaaataaagctatacagagaaaatgaacatcaatagctgagaaaagcataatgtaatgagaagtagctaaaggaaatgaagtgtaagtggataggattatttaggatctgacctcctgtgacttgctggacctcattcataatggggctttggaaacactgtctgctgctgctgctaagttgcttcagtcgtgtccgactctgtgtgaccccatagacggcagcccaccaggctcccccatccctgggattctccaggcaagaacactggagtgggttgccatttccttctccaatgaatgaaagtaaaaagtgaaattgaagtcgttcagtcatgtctgactcttagcaaccccatggactgcagcctaccaggctcctctgtccatgggattttccaggcaagagtactggagtggggtgctaggaaacactgtcagaaacaataataaaggtaacacaaaaatgtagattccatagctgtaatgcaaacgtgagatagaacatgtttttttttccttagaacacccagaaatttagcttgatactgttggtttctgttggctccttgaaaattcttagcactcaacaatgttaagatcaacagaatttcctccatttaataagtagagtggtgcttatcattccaacagtttaaataataacaactacatttcaaaccctggaggagctatactgctttatgatgccttcagatttacaggacactttcccacactgtcattcaatcctccaacaagcagtgaagtgttattattaaccccaatttacaggggagaaaactgaagttcagagtctcaactgcctctgagactttatttcttccaatttcatcacttatttccactcacattcactgaacttttcccagtaacaccgagctaaaggaactggattcatcgtacttgaaatagttggtatggggacataagatttgcagtgatgtggaagaacctagagtctgccatacagagtgaagtaagtcagaaagagaaaaacaaatgttgtatgttagcacatagacatggaattctagggtaactgtactgattaatctatttgcagggcaggaatagagaggcagatatacaaaacggacacatggacacaggttggggagggacagggtgggatgaactgggagagatactaccatgtgcaaaatattttggaatctggcgtatatataacactgagagctcagctcagtgctctgtgatgatctaaagggggtggggtggggggaaattggtt

SEQ ID NO: 26487 - DNA, 1476 bp, Bovine  19866880552664
cagagcgggtttaccccaaacctgtgcttgtcaagggcaggtccacccattattcaatttgttatttccagaccttagtgctacgcctggaaaaggtgaatcctcaatatatgttcattgtttgaaagaaagaataaaggaatgcatgaaattaaagaaaaaatacatgaccatttccccttcttatgaactgtaacttcaatagaggttcaaggagaaagagcatttggctaggagtcagcagacctgaggtctgaagccccagctttgctgcacatgaactctgtgaacttggtcaagctcttgacttctttagtcctgatctttccatctgaaaatgacaatagtgcttatctcacttttcctgggctagggtggggaggtagaagaggatgaggtatggttaacaaaaataaatcagccacacaaaatgcatagttagcaagtaattctatatatatttgtggaatcagctgaatcaacaacactcagacctaaaacatatcaaactacaactactctaaagttgtcattcctaatttttaaaaacccttcactaatgatctgcccttaaaatattttggaagtgaaaagggacaaggtcaacggcatcaaagcgtggggagaggtgacaggagagattcagtagccacagaaatgattatgaatggtgagaagagaaaaggaatgaaaaagagaagaacactgagaattagtaatcaacaaagaagcagaatgtttgaattagcaatgaatgcctgggaagaggctgcgcatacatttgaacaggaaaaactactgaaatttgagtttaatctgagtggtaaaactagggcatagttttgcaatattttgaaaagaatcaaagagcaataataagtacaaaaaactaaggtagttttggtacaaagtgactctgtaaagaagatgttttcctatataagaattaaaaccaaaaaatgtgagagggcttgactatccatttaatcttttaggaacgaactgcagttaaataaaattaagtaaggggcggaaaaacttgagcctatgaatgaggttaatgaactctgtgggttttggagtcagtaatctacattagcggagaaggtgatggtaccccactccagtactcttgcctggaaaatcccatgggcggaggagcctggtaggctgcagtccatgggggcttccctggtggctcagaggttaaagcctctgcttgaagaaggaaatggcaacccactccagtattcttgcctggagaatcccatggatggaggagcctagtacgctatagtccatggggtcgcagagtcggacacgactgagtgacttcattcattcaatctacattagacacctggttccaccccttgagcacactgtctctcagtgggtctgtttctgtgtatgtacaatgggaataataattttactttataaaataatacacacaaggtgtacaattagtgttag

SEQ ID NO: 26488 - DNA, 2317 bp, Bovine  19866880577565
tttggatttttaattagtagttaattaatcaatattcctaaataaatgatgaatttaatctttaaacacaaatattctaagaacctagcctcgaaagtaacacataggtagctctctgagttccaattcccttcaaataccttgaactcatctcaaccaatttacatattaagacatattacagaacttgggaagaccagacactcgatgtccagagctcacaggtcctggatatctgagaaaccaccagagctttgtgatgacagttcaaagacaattgatataaccctcatctttggcaatttgacaatattacaaggcatgtgtccaatgatctggcaagtagaactctagaaaatttcctaggtataggcatacacaagcaaaaccacatgtacaagaaaagggattcaccaatgacaatgtttgaaacagaaacctaaatatccagaaataagggtctagtaaaatgaactgagataaactcttatagtgcaatactttcaagctgtcagagagataagaagctccttgtgtacccgttcctatcatatgttgaccaagttacaatcatgaagcaaggagttgaacagctgcaacctgttaccatttgtcttttaaaaggcaaataactgaaacactgactccctctcggttggagacattggttgctgggggacaggagtaggaagaagacttttccctgtgtgccttttttatacctttagaatttgtaagaggtattatccatataaaaataaaacacttgaaaaaacacatacaggacaattcacctgtgtgtttctctgttgctctaatattcgtgataacaattactgctaatggccccgagttctttattttaaaatatgtgtctattgtaataggcaaatgttctccaactcaaaacaacagcaactaccaccataaccttctgcccaaaggacaggattcttctgttaggctggccaaaaatttaattcaggttttcccataaggtggtactggaaaaacccaaaaaaagtcgaccaacctaatattttcattatcagttaatccatacaatcattcatttaacgttccatgtggcagctagtgcactgaatctacaaggcggaaaagataggtcttattttaaggagctcacaacacagtacgcaagacagagaagtaaactgactgctcctacaagtccacaactatttagcacccactacatgcaggacaaataatttaaaataactatttgggatttccaaatagtagtttccaaatgacattgtttatctgtatcaccaacagactcaattttcaggtcccactccagacatactgaatgagaatttcagggcatggggccccaaaagctttttaaggtgtttttttttttttttaattttcctggtgattttgatggcaatccaagtacaggaaccactggtttccccacacaacgattcaaaatactctgatggtgactgaaaaagaacaggtcttcctgttgagtaagcagaaagcaggcttccctgggctgcttcaaccttccaggcagaggaaataaaaaatagaaacaatgagataaatcaaggtcagtccctcaaaggggaacatttacaagtctcatcctacaataaagttgagttaatataaatacaaaaatttcttgctttgattttttttttaaaggcctgagatgccaaagcagagagcacccttaaacattattttatctcagtcacatagttaaagagttacagcctcacactggacattcagatgcctgtagtacatacaaccctaactggcctgaaaaaacagtgataaaatgatggtgtttttcaccatctgaggcaaaatgagaagcagcaactcgctcttgcaccaggacaacttcatgctttcctcaggactggcaagagcttcacattcacaactctttaaatgcatcaaagtaaatactcatttctattttgggctcatcttcctttttaaaactcagcttggccacactttgaggtattttacaagacataattacacagcagatctgacataaaaacaaaggggaaaaaaatgaggaaaactaaaccaccccataaagatatttttaaacgtttcacagtcttaaatctacatgagtcacatactaagtagaaataccacccacaattccacctgacctgcatactgttttcttccaaaaagttaagcatatgtttcttaaatgtattcattcactcattccttgggggatttatagcacccactctgtggcaggcactgtgatgcgtatgataaagtagtgatcaagacaata

SEQ ID NO: 26489 - DNA, 1084 bp, Bovine  19866880647222
ttggagaggtaagcatcatgtctgtgctgctgctgctgctaagtcgcttcagtcgtgtccgactctgtgcgaccccatagacggcagcccaccaggctcccgtgtctctgggattctccaggcaagaacactggagtgggttgccatttccttctccaatgcatgaaagtgaaacgtgaaagtgaagttgttcagtcgtgtccgacttagcgaccctgtggactgcagcctaccaggctcttccgtccatgcgattttccaccccactactggagtggggtgccattgccttctccgcatgtctgtgctggtggcacgatttgtaatgtcaatattgttgatactttaactgccatatagggatttaatttactgcattttgtggtgttttatccccacatggaagctttttgtacttgtttgtttgttttcctctgcaccatacccaaaggactccttaaggtaaaacgaatcacttccctgtatggctgcaggcagttgtcagagaggctaatcatttgaattttcctgttgtgaccagtactgccagtatattcagctatttagtgttatccagtgctgggtggtcccttccaccatagccccttgagttgtgaagtggaaatttgatgcccttatataactgagcacttgtattattcaattaagcaaggtgcttgctgtatgaatcaacaaaacaactccaaacgaagatcaggaaaatacatctcaattagtgacagcaggaccagtgcccgagggccccaatcctcgagaaaaataggactgtgccagagaaacacgaatgcatttcttacaataattctgtctgctgaactaatatttattggagtcactcatctttgcatatatatctcatttacttcccttcactttccatctgtcaagaagtttttggagtccccacagatggaaacgttaatctgtgttaaatatttaaaacatctagtaaaggtttgcctgggctcagaggcctattaatcaatttgaaaaacgtcttctatcaggcactgtactaggcattagacctgcaaaaatgaatacaatacgaagcctttactaa

SEQ ID NO: 26490 - DNA, 1353 bp, Bovine  19866880647954
tccatcctaaaggaaatcagtcctgaatattcattggaaggactgatgctgaagctgaaactccaacactttggccacctgatgtgaagaactgactcattggaaaagatcctgatgctgggaaagatcgaaggcatgggggagaagtggacgacagaggatcagatggttggatggcatcaccaactcaatggagatgagtttgagtcaactctgagagttgctgatggacagggtgcctggcatgctacagtccatggggtcacaacgaagtcagacatgactgagtgactgaactgaactgctaattttgaccagattgttttcctagaaatgactttgtagaatatattgggttggccaaaaagttcatttgagtttttctgtaccatcttatggaaaaccccaaacaaaccttttggccaactcaatacttattaaataaagtaaaatggcaatacttattaaatgaagcaaaataaagcaaaaataatttttgaagatgcatttctacctagtgctatataatctttagctatcttcaagggactaaacatttattaatgcccattttaatacccatattaaaatggatatctaatgaaaatattcttgatacctgtttgaaattattcttttgtcttttccagaattttccaatgagaaaagtgccctgtaagaaagatgctgcatctggttcattctttgctagagacaatactgctaacttccttcactggtgcaggcacattggggttgatgagacttacctctttgaatctgaaggtttaggtaaatgttgtagtcatatttaatgtttaataggatattttttgaggtttccctggtggctcagacggtaaagtgtctgccttcaatatgggagacctgggttcgatccctgggtggggaagatcctctggagaaagaaatagccaacccactccagtactcttgcctggaaaattccatggacagaggagccttgtaggctatagtctatggggtcacaaagagtcagaccgactgagtgacttcacttcttcaaatgatcttgatgatcttctctggttcctttagtctggcctcaggtgaccatatccagtgatactgacatcttctgtttgttgggttttaacaaacatattttaacaacaagggtatttttggagaaggaaatggcaacccactccagtgttcttgcctggagaatcccagggacagcggagcctggtgggctgccatctatggggtctcacagagtcggacacgactgaaatgacttagcagcagcagcagcaggatatttttgtatgcctcacttctagtttttctttccaaataagaactcaa

SEQ ID NO: 26491 - DNA, 1325 bp, Bovine  19866880666590
ttcaactgtaattttacatgccttttctgactcaccaggaagatttggcagaagggaggcacatctttaggcttcatcttcattttacatacatattccttacagtctctcttacactcctttggaatcactggcttggacaccttacttttccactagtctgtgagttccccgaggacataccctcatttccataccctccccatcacagtattactccacagtaagttaaactgtgtttttcattcattatttcattttatctgagaggcagtgaagtatagtggctaggacatgtggcttctgaagtcaggcttcctgtctatctctgaaaaaattatttaaccactctctgtcttagttttttcatctataaaatgggaagaataatagtacttaaaggatttttatgaggatttgaggaactagtatataaagtatttagaacagtgtctgaaacccaataagtgatgtataaatgttgctattggtattatttcttatttggctttgaactgagataaatagcttgacacatagtcattcatagctgaagtttctgaataaatggatctttttctagactgaataatccccactcctttatggtattttaaaaatcagactaattttccaatatttaaaaaatgttctcctttggtccttcatcttaatacagtgaaaagagtatttttggtattttgctattacaacaagaatttttgaaccaagtcacaacatttgcatctatttaaattgcatcttttcttttttgagtcattttccatgctagtcacaatgggcataaattacataggacaggcaagaggcctgccttcatggcatattcaaattcttacttgcaggaacaaacgtttcttaccattaaccaagttacttaccactctttcgaattctttcttccagtaggtcagtatgtccagctggaagtttcttactgaaaatctcagctgaacggagaaacatcgcttcaactgcagaccctttcagcaaagcaatctgatcttcatggtccaatgtctgaaatcctgaatgaagatggtaatcaaataggtatcaaaaagttgaatgttgtataacaatatttcaccatccccactgatagaacatttccataaagtgactttgtaattgttttaagactgagtagccaaatcgagttaataagtatctgttgtattccccaaatagaagctgacttttatattcattgagcaggatttggtcaatgaattgggcaaaaaaggatatcatgtctacaccaaatatatatacttgtatactatggaagacacaggctgatt

SEQ ID NO: 26492 - DNA, 2552 bp, Bovine  19866880742099
ccccacccaaaagttcctcatcctgttctgcattttctactcccctccgtacaggcccatcccactccctttaccttccaaccaaagctacctcattgttgacccaccatcacatctctaagttcttactcaagccagcccctctgcctaaaatgacctttctacttccgtcatgtctgaagtctacagcctactagactctgtctgccttgtaaccaggtcacagaataagttttcactagtttgtggctttttggaggacaggaattacactgctttttttttttctttaaaactttcattcctggggacctgacacaaggctctgcttagagaagacacttaataaattcttactgtttattgaaactcactgggaggcagaaacattttctgggatttcacatagaatttctaatggattacacaggatggctgccagtctctttatccttctcagtacaattcatacagtcacattattttgaaaaattaagttttccatacagagcagccattgccaataccagcaccctaggttttctatggtgattctcgatctgtttgctcaagaattattgttattgctcagtccctgactcaagaattactggatatctgctattcagcagtcactctcctgggccttagggtatagagatgaaaatatggtccatgcctcaaggaacaaactgtctacttgggagagacacaagtagacaaggaattataataatagtttataaagtcctatgaggtctatcggagaaggcaatggcaccccactccagtactcttgcctggaaaatcccatggatggaggagcttactgggctgtggtccatggggtcgctaggagtcggacatgactgagtgacttctctttcacttttactttcatgcattggagaaggcaatggcaacccactccagtgttcttgcctggagaatcccagggacgggggagcctgatgggctgctgtctatggggtcgcacagagtcggacatgactgcagtgacttagcagcagtagcagcatgatgtctatatcaagtcctacgaggtatgtaagaagacagacagggtctacctagctcagctttgggcacaaggctcagtaaaagtggtaagtgtcaaaaaatttccatgggagatgttgtctgagattgtcctgaaagttagtctcaggagaaatagcatgtgcaaaggcacagaggcaagtgagagctccttacttcggagcactacaaatgttttggtatttctggaatgttctaggggagttgcagaataagaagcaatggctgtacattataacaggcctagtatacaaggctaaggagtttggtctttaacctacagttagttccatggacactgtgctatccagactatgaatttacaattccaggaaatcaggctagttttgccaaaaaatggaacagtcatcttggtgaatcccaacaacagcacaaacaagttcagctaattaatctcttttgttgaatcaggtaacaaaaatcacaagctaaaaatactattttggaaaatggtaaagatataccttgcaatgacagcaaaggtgcttttttatgagaagaacttctcagtggaataatcacaggaatgaactgcccaggcaaactgtttctcaacttgggctctttcagaaacggttatgaaacagtaagcaggccactggctgaaaaagtcaagagatgatgaactccatgaagcatcactaaactgaatgccctcagaacaatggcagcatccagctgtgtcaccaggaggtccccactgcctggcactagggtggacacgtcaggtgctcaatgaatattggagtaaataaatagacaaaggaactgatccgtaaacaacaccccctcaactgaacagaaacagctgaagcccagggggtgggaaatcaagcataatatttttagaattcttgaaacgttcttaagaaaagcagtttcaatataaaaaatgcatttccgcacaagcataaacacgtgaccataaacagttgcttgatgtgactcactctgactggcacagccacgtaatctgcatgaaataaccccagaaataatggacagcagtgagttagatgtcacaaagcagttttgtgagcaaagaatgacacagtaagtgtcagctgtgtatcgtggaaggggccccgcaccaggagtggagctggtgtctcagtaaatctatccacattgactcaactgtcttgcccaggtgttgaccggatctctcctgtggtagtgacttaacttcccgggactttagctttcttatctatgaaaccagacggtaggtaagatactcctcaaggtcccttttgatgacaaggagaggtacttcaaggtgtccccggggcagcaggtagtcgccatacccacataagccctgatcatgaaggatcaacatcagcacatgtttctgagtaactctgatgattgtgtcactgtcatgacatgctggggtcttgtagggttaagggaaggcacagctcattccccatcccccaggaatgtct

SEQ ID NO: 26493 - DNA, 2440 bp, Bovine  19866880760765
cttaatagttccagaagcagtctccctgccttgcacctccctgtgtccaaggcatcctttgcaggtaccggaggatttttaagtgaaaacaccaggcttgccctctccccttgaaaccatcttatctgcttcatcaccatgttcaggatgaagtgcactccttcccttattacatgagagccccccaggaatcttccacttttcctccatcactcccatttaccttcatcttgtaccttgacattttaagcagccctaacacagttccagcattcaccaatctgtttaaaatgtcagggtcctggcacaaccttttcccaaagtttagaatttcttgtcccagctccattcctcttgaaatcttacttattctataagacccaacccaagcctctccctcatcttccaggcttttcctgacactcccctcctcgaacccaggtcttcggcattgcaggtggattctttaccacctgagccacaagggaagcccaagaatactggagtgggtagcctatcccttctccagcagatcttcctgacccaggtatcaaaccatgatctcttacattgcaggtagattctttaccacctgagctaccagggaagccctatcctctaacaaagttcatcgtcctcaagtgatagcactgattacacagcattataactgtgttattatctgattccttcaggagagtcctagtcttgagttttattcatctttgcatccccagagacaaaccttctcttgagactctcacataaatggttctagaaagactgggctttcatgtacgtcttactagactgttctctgaggaatggaagaatatttcacctctttctaacctctctttattacaatggctggcatcaatgaatgctcagtgaacgtttggggaattcttcaaatatcgttggccaaaaaaaacccttcagttcagaaaattaaaaaatccctctgagctaatttctaattagctcatttaagtataaatataaaaattctcctttttgaaattagaaaacaccacaggcattaaccatgaagatttcaacttctgaaactcctgatttttaatagtaattcaactaactggggcatcttgcagataattgaagcattccaaacatcctttctactttgaattgtcaggcagaggaaagattgttgattctctcaggcagaaggggcttcttggagagatttcactagcatttaagttcggaggggaaatagccctgtctgcccaagtagagaatttcactgttgagactggggttgctactgttccttaaaaattcagttccacactcaacatacaggcattcttacaagaagggctgtggtttgatggcatagggcaaaacctggggcttgcaatggactctccacaccagccagaggactattcagtttcatcacctactccccttatagaaaattagctatgatgtagtcaaagaactggaataacacccccctcccctgccaatagctgcactagccatcctaaagaactaatctccctttgggatggctgaacgggtgacatccatatcagtaagggaggcccactcaagacattgcagacacctggccaagtcagctgttgggggtggtggggggaggccagaacatttgcatcctcccagtgttgctgatccacaacagacaaaccaagaatgagccaaaatatcagtgctacagatgtgatcatctagtctgctttttataccatttcccctcattgctctgaaaccaattttgagttctattatttgcgctgagaggataaagcagaatggtcattttaaaggactatgacatgctcatattttggtaaaatggaactaggccatatactgaccgttctacaactttgtagacatggatttttccatttataaatttttaaggagtcgcttggagactctggttcaattcctgagtcgggaagatccactggaggagagacaggccacccactccagtattctttggtttctttcgtggctcagctggtaaagaattccacctgcaatgccagagagctgggtttggtccttgggttgggaagatcccttgaagaaaggctacccactccagtattctggcctggagaattccatggactgtatagccattgggactcgcaaagagtcggacatgactgagcaactttcactttcactttgaacctccatcaagagtaagtctgtattgcaggtgggaatgcagaatggtacagccactttggaagatagttgactagctttttacaaaactaaatacattcttataaatttaccataaaatccagctattatagtatactccttggtatatacccaaatgagttagaagcctacgtccacatcaaagcctgcacgtagatatttatagcagttttattcataaatgccaaaagttgga

SEQ ID NO: 26494 - DNA, 750 bp, Bovine  19866880772699
cccgtcatcattcaaggaattcagttaacatttttctcaagattatcaagataatcttaaatatagcttaatttcccctctttgtttgtgtaaactgataaagaattcagagattatgtgtcttcaatgcatgtaaaagccatggatttatttaaacctcagagtttatcagataaaatggacagagtcaagggatgtgggtggggactcagatttgaatgaaataaactttcagtttagctgtgggtgaattgcttagtctctttccttttttaagaaattaaagcctctcttacaagtttgagaataaaatgaggtaatgtgtaaaagtgcttataaaattatacagcactaaatatagtaaaggtgatataaaataaatataacaggctttataatcattgttataattgaaataataagaaaatggagggttttttttttaaatcatactgagtgactcaaagcagttgctcatttatgcagaaaatggttgaaatcccacattagaattttagttgactcagtacgtgttcagataatgaacttggctttttcatacacagaagtatgacacttagaatacgccccgaatgggatattgtatcctccctagtgtgttcatatattcatgggagatctacaaaatgattattcttgaggtagattatgtattttctgtaaaactagcaatcgcaataattctgtgaagagagtatattctaagatttcatgctctaaatcaaggtt

SEQ ID NO: 26495 - DNA, 1091 bp, Bovine  19866880801567
attaatagtgaaatagaaatgcaggataaaaattagttatgaagtttctttaaagttttagcccctttacttctcaagctgctggtttttaaaaagtgtccagaagttttacatattaaccatttttccttttttttggaaacagtatttagaacttcgatttaacaaatgtgttcgtctctgtggaacaatcctcttcattgttcaaacagtaagtagccgtcagttcacttattttatcttctttccatctacagtgttttttaacacctacagtgttttaacacctgggtcaagcttctttgataaatacgtgaaagaaaagaggttgaacgtaggaggaaacacaaaaggaaaaacgcctgtcactacatagcattaatccttaagatcattaaaccttgtcttagaaaatgcattatttcctgagaaaacagtgagttaagtgaacactgaatattatgttgaacaagcaacagttatggttaggaaaatatgctttttcctcttatgtctccctctgtccctaccaaagtgacagtaagggtatggcttagatgacaaagatatttgaaggaaatgtactagctaatagtaggaattataataaagggaaaacacgttgtatattttgtagcatttttgcagcatattaagtaatagatttaatagaaaatattagctgacataggaagaaaaaatttgaaaataattttccttgaaagcatatttaaaaaaaatgaatcaatgcactctttcagaaattgaactgtaaaacctaattgatatactcactgagtataaagcaacaacatcatacactcaggaggagtttttaaagccaagtgcacaatccaatgggcttcccaggttgctcagtggtaaagagtctgcctgccaagcaggagactcgggttcagtccctgagttgggaagattccctggagaaggaaatggcaccacactccagtattcttgcctaggaaatcccatggacagaggagcctggtgggctacagcccacagggtcacaaaaaaaaccaacaatccccccacaatccaatacttaaaaaatatgcaagtatagattt

SEQ ID NO: 26496 - DNA, 1191 bp, Bovine  19866880840661
tttttgactgaatgtagagattatctggggacccttcctatggtgttacatgtatttgggtgaaagaagaatgaaacaaattcaaactaaagcagaaaaactcattttacttcagagattaaatgtagcccttctctgcaaccaaaataaattattgatgcttataatttaaaaattaaagagcaagcaaactgtatttgttgattttttaaataattatgaccctacattacattttaaagccaggatgagtggtcctcagttaataaaaaaaaaaaaaaaaaaagtgaaaggaaagagtattttagaaatgtgtgggatctgaaagaaacattatagtcctttatctaatatctaaattctccttcagcattcagcaggaggcctgaaacagagagagaacaagttgctctgctaatgtttccctaccagaggtcactggctgagaataatctccccaaagtgcttagtaggcgggctttcaaatttgcaacaacagttccaaataaataatatgcaggacataaatattgtcacagcatccaactcttcaaaaatttgattgcactcaccatttctcagccagaagattcctatgggatcaaagatcaaatcatatagaaagaatctgtaagattacagtcttataacattttctcctttttttgaggataaaaaaacaatcaatagatgcgttaaagagtcagggagaattgggctaagtagggaggccaaaataaggagcatgtgtctgtgtaccaacgcagctcttggtgtgtatgtttaaaacacaatcagtgtgccttcacagccaatcagtccctcagtcccaaggttactgccctatgtcttcaacacataattagggattacaactgattcagggctttgatctttctccttcactgctacaacagtttctagcctttcctctgttccagttccattgccctttgccaatggcacttgttttctaaaacacagaaaatacaatcacatcatccccttactagtaaacctgggatggtcaagccaagtacagcaccacctgagcctggcattcaaggctctctgcaaacagcctccatctacagcctcttttcccgtaattatttcctacatattccatgctccagatacagtcaatgagtgcctattcctcagagtcaccatactcttttatcgtggtat

SEQ ID NO: 26497 - DNA, 2022 bp, Bovine  19866880863959
caagagtggtaacagctgactctgacagcctattaaatgccaaacagggctcagcagtgctcatctcacctgctgctgctgctgctgctaagtcacttcagtcatgcccaactctgtgcgacctcatagatggcagcccaccaggctctgccatccctgggattctccaggcaagagtactggagtagattgccatttctttctccagtgcatgaaagtgaagagtgaaagtgaagtcgcttagtcatgtccaactctttgcgaccccatgaactgcagctcaccagactcttctgtccatgggatcttccaggcaagagtactggagtgggtgccattgccttctccctcatctcacctaattctgcaaaaatcttattggaggatgattccagttttatcccatcccacagatgaagaaactgagacccagggaagttgagggatggtcccaacaccccatagtaagtgacaaagctgggatgcaggttgaggtcaatctcacttccaagtcttaagggaaatcaggagtgatgttggaactaaaagcttatctccctcctccatgaaatggttttatgctcccttctctttttgtagcaccataatacttttcagggtgagagttgggggtcagcgaagacttttggagggagatatgacctgagctggggctctgaggataagaagcaaggagaacagttccagcagagctgacctccaggagtcagaagtttgtcccagggaggcaagtgagtggcatgggtaagatgagagctctggagccagacagcctgagtttacatctgagctctgccccttattagcagagtgacattgggtacgtcacttaacctctctgattctattcctgtaatatgggggctataaagtactttcctcccagcttattgtaagcatggcatgagttaacatgtctggagctagtggccggcagcacaggttctctctgtttgttctcattacagactctctaggatccaggtatgacctagatgtaaaggagaggaaaacagaattaggaggttcgcctgtgatgcttattacagagaatgattacatgagctcacaaaatgtaatgtgatgctatttaaaaaaagggggtggggcagaaaatcatttaatggaggagcaagagacacgggcttttagcccagaattatcttgtcaagcatggttgtgcttatcagcttttagttatctaaaattgtgagtcaaaacggacttttttatttattgtctacttctttatgacatatttatgggtgttaaaatgtaatagtctatctcaaataaggtgaaaaagcagaggagaataagataaaaggaactacatttgctgtaactctcagttttcccctctccccctttgacgccataaaatgttttcagacaaccctagagaagagataagataaatgctgctgctttcccatttacccacatagcatttatctctcctgtatcaagtcaagttactttattctgagaagtaaattccatagcagaatataagagaagtgcaatagaagtgaacagaaagctcttatccaaggaatccattcatgtgatttacattttgtcttcatattctctggcttttttctactttatcccaacctaacatcctcaattctgttccacagtcaaaccccgtgcctggaccactctttgtgtaggccagttttatctagatgacttgagtaattcccaagaattcatcttattttttaaaaagtaatagcaatttccaatataaattcacacaaaccctctcttactgctattcaaaaacctacaccattacgttgtactagccactcacttggagaaggcaatggcaccccactccagtactcttgcctggaaaatcccatggttggaggagcctggtaggctgcagtccatggggtctcaaagatccggacgtggctgagcaacttcactttcacttttcactttcatgcattggagaacgaaatggtaacccactccagtgtt

SEQ ID NO: 26498 - DNA, 1706 bp, Bovine  19866880864741
actggcctcacaccattcagtattatgctttcatgtttcctgacattacaaaattataccattctgtacccttttgagaggaacaaatgccaaaacatagaacatggctctagaccctcaaattccacttttagagccactgaaccaaaatctatcctctgaaaattcctaaattggaacgtgctcccccaaaatgtttatctaagaggctggtttccagcttactaggcaatttggcatggaggacttttctcataaacatttacaaatattctgctcagtaatgaagttaatcagtaaaccgcacaacctctggcctctgttactcctcacctagtctcattttcagttgctgtgagtaagctaagaatggtaatgcagtttcaggagttagaaaatccagttcaaatcagtccttgtcacagccacacatcctcaggattcgccatggaagtgatgagcatgaagcccgctaaaggtaagagagtgttcacagctgcttgtggcggagcttctgccaatggactgaggaaacgtgggggacctttgcttgagatttcagcaacagatctccatcaaagatgggctcagtcagaaccagaagactggggtgaaaaactggctggggtgatttttgtagggttcgaggtaggtgagtatctcatagagattaaatctaagtgtgttttccctacaattcttcactggatattgtctcaaagtagcacggttcctccaagttaaacactaggcagctaaagtattaatgccctcagacacttgaaaaaacatttaaagtacattgtttaatgcaatgttttttaaatggcaagtcttatatcctagtgggtcatgacatctattttgtgacttgtgaccagcattaaaaatttagaattgaataagtacagtagaaatatcagagtgcagtcagggataaggatagtgttatttcatggaaattttgtttcagattatttatacatatgtataagtatgtatagggatcatgatttaagatttatttcaaactgtgggttgtggcgagaaaaataaaaagagatccaaaaaatttattgaaatagtttcacaacagttttttcccaatagtcaatgggaaatcagatgagtaaagagttcagcattaagcccagtatgtttgttttctctgaactaaaatacagattataattaaaatatagatagtataaaaaatattgtttgttttcatattttttcaaaatagaagcttaccttttgaatttccagctacagaaactcatcatttttacaataattgtaattttgaacacatttctgattgtagacttcgcagcatgttattttggttaaatgtgttgtttaaaaatgacagactgcatttagaaatggaaagtagatagaaagctggagaagcaaattccccatcatttcaatttaataaatatttattaaagatttaaactgtgtcaggcactgtgtaaggtgccacaaatgaaggaaaaaagggaatataatatacaataattgcaaggagatccaaccagtccatcctaaaggagaccagtccttggtgttcattggaaggactgatgctgaggctgaaactccaatactttggccacctcatgcgaagagttgactcattggaaaaaactctgatgctgggagggattgggggcaggagaagaaggggacgacagagg

SEQ ID NO: 26499 - DNA, 1160 bp, Bovine  19866880914620
ttatcaaatcctagtctttagaatcactaagcaatatcatccaataaagatatgctggtggggtagagagtgttgcagtcggataccacttctgctgcctactggccaggtgacttgcaacactgtaaaaatcctttcaacattaattgagcatctatagtgggtcagccagtgctgaaggtgctgaggataatgtggcaaatcagactagtcttgtgcccaaggaattagagttcagtgaattcagtgaaatgatatatgtacaatgtttgtacgttgagtgtgggcactggacaagtgttaattcttgatgtagttgtcaagtgcatgataacacttcttggtgagaaaacgtcaacacccagtgggaagtttgttctgtttcctgatcagatactaagtgatgttcccacctacatgtaagtacccagtgatgttagtgtttcaaagttggtctcacccactgagtcagaatcaacaatttatagccaaggtgagacttactgaattgactctccctctaaaatcttcttcctaaaacaattggaatgaacactagttaacatgattgtctattggcggtgctggaatagtctccctgaggactgtggttctctagctggcagttattgtatttcattgtattttattttctttaatgaaaggagcatcagcattttctggtttatttgctcgtacaaagcagcgagaattctttaaatgaaacgaatcaaccactgatagatcttaaattttatcttctcaagggtccatgctctgatttcaccagtcaatattcatttctgagcctcagaacttgaaaatatctgtctatggtacttgaattagtgtgtctcaagaaaccaacccctgggaaggtgtttgttttctaacacacatgaggctggattttatactcctggagaagagatattttgtctatccctgcattggagtgcctattgcaggaaaccttgttcagcgaatggaggaagggatataccatggggaaaggggccattcgatatcagtgttgtgagtttaataccatagatctttctttctaaaagttctggtgccatcagagtttctgacagtgaagcgagcaattgaaacacatacatgcgaatgttagatgtattcttacacactcagtttag

SEQ ID NO: 26500 - DNA, 1025 bp, Bovine  19866881017762
tgagtttgagctgtggtcaggaaataggattcagggccttggtcaaaaaaaaaaaagaaaaaaaaagccttaaaggtttaagcatcaaccaacattttattgatttcaaattaatgggtggcctactgtcagtccctggagtccagtatgtgaatgtgtgtttgtataggcatgcatgtgtgtatgatttggcagtatatgggttctgtctgtatgtgaaaatgaacgtattaattgctcagttgtgtctgactctgcaaccccatggactgtagctcgccaggctcctctgtccatggaattctccaggcaagaatacttgaatgattcccattcccttctccaagggatcttcacaaccagggatcaagcccagatctcctgcattgcagacagatgcccagggaagccccaaacaaaaaagcaggatgtccagtgttctgcataattgaggggtccattttaccatagctattcacctgccccccccaggaaccctcctagtgcaacatactcctcaggtggcaatgccagccctgtctactcatctttgactaccagggagcctctgttcctcagagaatatttctttctattcattttcaagtgacttatttgatatgggcattgttgaatatgcactggatagaagcagaggtatgtgtatggatggatttgcataagtataaatactgtatatgtagccttatttaagtgatataatgatagtattgtgttgccacctcagagtgaaagctaattaattcagctattgagatgataatgatttccttctcagtattaatacaatattaacagaataaaaacaaacaaacaaaaaaccctgcagaattatccttcgactcatcttggaataaggaattttatttctgttaattattgaactatcagtactgatcatgattttagagtgaatcatccttgggaggggctgagaataagtggaaatattaactcaggtaggctaaagtggtcattgagttcaatcatttggtaccagggaa

SEQ ID NO: 26501 - DNA, 882 bp, Bovine  19866881039981
ttctgagagctgagattcttctaaatcagagtcaaggccgtttaattggagcagggtctttccaaggtctcttccaaatggtttgtgctaaatcagagaagttccatccaccatgaactccatgtgacacacgctatccaaacaagtacaaactgataaccagaaagtaggagtccaagctaccagtcactctgtgtcttatcactttaaaaacaaatagtgcttaccacttctgaaatgattcctgggtccttaagttaaggtttacattacatcatagtacaaataaacataaagtaaaataaacattttgtccctgcttccaccagtaccaaagttttaaactttgtatcatcagcctgctttctcttcttcctcctcctgtttgtaaactgtactcaagtcacttcctttccatctttacagaaaccaccctgctttgcacctaatcatctcacttctggaatgcgaatttcctgaattttccttctcttttcactgcttactcccctgtcccgccttctcataagactaatcttcttgaacatagattttattgtgccatcaaaatttccaatagcacctcgttgactacagttaaaagtccccaacattttatagttaggaaatacttcctcctcaaagcctcaagaatctgtgtgtgtgtgtgtgtttgtatgtttaagagtgtgtaagagagaatctctgtatgagtttgcatatctttatagatgaggaaattcttcacgtatataatttcattcattttttaaattatgaaatatttccaacatgaagaacattgaataatatcatcagctttcttgtatttaacccctagcttaaggggagaattaaagatgctttgaaattccctctgta

SEQ ID NO: 26502 - DNA, 1087 bp, Bovine  19866881051129
ttgtttgaagtatatcccaaatcttgattgcaaatatggccatgactgcattaagtcacatgcatgcatacattcacactattttccatggaaaataatttctggtatctctaaaaatggtctcccagagttaaaatggaattgtgaaatgaacccttactcattcccttgtgaaagccaagagagagacttttccgagagagatgggaagcgaggtttcactaggtcttccatggttactgctgctaaggcattaatactggaggacactgtgctgtaaagggaaaccaaatttttaatgtatatgtaaactttaataataccttaactaggaataagaaaaagaaaacatattgtcacttctgaaatagaacccgatttctactacattattttttaaattatttattgaagtatagttgatgtacaatgttgtggtagtttctggcatacagcaaagttattcagtatatatatgtatatattatatgtatatgaaagtgaaaatgaagtcactcagtcctgttcgactctttgagaacccgtggacggtaacctaccaggctcagcagtccatgggattttccaggcaaaaatactggagtgggctgccatttccttctccagggaatcttcctgcattgcattgcagacagacgctttaccgtctgagccatatatacatatacatatatatattatttgtcatattattttccattatggtttattataagatattgagtacagtttcctgtgttatatagtaggactttgtttttttttaatctattttacctactacattatttttaataattacatcatcctctttctggaagctgtcacccaagaatgattcaggcaaatccataggcttaatagtgagaaaggataatttaatgttgcttccattttgcaattaatccttattatccatgaaagaatctcttagatcatgcagtattactatataatgactttaaagcacatttttctttatgcatagaaaggactatcataagtcctcactaacattcaccataaatattaataatattaatttgctggatcttcactaacatgt

SEQ ID NO: 26503 - DNA, 1374 bp, Bovine  19866881172365
ttttggagacattccagaaaaacactgcttctattttataaatgctccagggttgaggctagtcaaacagaaccgaaaaaaccctatttatcagaagagtcccaggaacagcatgcaacccttcccatacaaagaaaacagggatgcctggcttcaaagatccatccttcagccttgaagagaagcagcagaagcaaacacttttaattgcaacatgttcttcttgactatgaaaaactccagaagctgtgcacaatgtttagggaaaatgtgaggggagttatgtaatccagcaaacagggccaagttctagaaaagtgcacagcgtttctgggtgcacaacagtcccattgtgggttattatcagaggcctggctgggtctcttataccttcttcaaaacttcccctgtggaggaggagggaggagggggaagagtaaacactaataaggtaacccttgagtttgtgaacctgataaaacatcctgaacatctcttaaaaccagaaacactttgtaagtctcggatgtttttggccaaatcagccagccagtctcttccagtgtgtgaggatacccaaaccgatgatgtttcctgagatgtaaaaagagcctctagggtcagctgattgcattttatccaaagttttttttttaaatccatgcgaatatcgggttggccaaaaagttcattcaggctttctgtaagatggtatggaaaacctgaatgaacgttttggtgaacctaatagaacccaccgttaacatagagaggcagcagatgtaggaagtcaggtaaaataacactttgaaacaatccatttaattggaatattttgatttttatgaaatctttggatattaaaatgctctcaaaggcaaattgcagagtctaactgaaggaaaattctccatacactgcagattggcaaagcctcagaaaatgaaacattcagttactctactaactgcttattttttaaattgtctcttgatatgaactgacgaatatatatacttttctcattcaggcaaaccatttacctctttctccatttgtaatccttctgctctaatatttctttcaaatacttctctcttttccatctgggggttggattttctgtacacaagaatgtagtcaattcgacattttccgtctctgaagtaaaggccatttaatttgtttttttctggtactgtctgcacacaaagagaaagggaccagtttaagacactcaaccctgagccttgactgagtaatgttaaagaataactcaaactaaatgaatgttccttgtgttttatcaaaattacacttttattaataaaaatgtaaacaagagaacacaaaataaaaatcggaaaaagcatt

SEQ ID NO: 26504 - DNA, 1100 bp, Bovine  19866881271542
gatgcctctgtgcagaggggctggctaactcccactgtgcctaaaaacaggcctccaagagaaaaaggtctccaggataccctttaacttcatccagacggcatggaaggattagacagagatggctcaggcaccttgatttggaattacaagaaaatggaatgaaaaaaatgagaaaaatgtgacagaactctgaaaaattcaaacaggcacagtattgggtgctgaagacagaaagtgaaggaacagggagttccctggtggtccagtggttaagactctgtgcttccattgcagagggtatgggttcgatcccgggtcaggaaattaacatcccacatgcttggagtacagccaataagtaaataaatagccagaacattaaaaagaaagaaagaaagtgaaggcatttgtgtatctatctctcagggttcacaattcagaaggattattaccctagatctttatttaaaaaaatttttcttttcccagttttattgagatataattatattgatatataattcaccctaggtctttaaataaggaacttcaaactatgaaaggatcatgcttttttagtgtctcaattttttttttttttaaaataccagaaaactgttaaatttcaggatggcaggatgaccaggatagctactgtcttcatccgcctcctaaatgggtacactttttagtttcttactttgaaatatttaaccttgtacatacttacctatgtgtggatgtttatcttgtctagacaagataacaagggctagaggcagtgacctcaccttcactatctcctgcagctctatgatatggagagacacgagccctgcgaactcccaataaatattaactgaatcaaaaaaattactatatgaaattccctctgggtatgagtggaaaaaattcttgcttcagcacaagtgagcagcaaaaggaaatgctgtatcccataacccagtgctaaggaagatctttgggaaacgggagcttggagagcttacagacaaagaaattaaatcccatctttccaagttgggcccagcgggctatgaaaggccgaccggaatcccggatctaacatcaggacc

SEQ ID NO: 26505 - DNA, 1588 bp, Bovine  19866881278726
gaatagaagtagaatatttgaaaattggtgaaaagaaggtagcattggggaacagaacagaagtcagtaaagaagggaaaaaaagagaaagtatgaaggtagaaactcaatgtaaagtagcagagatagtccaaattatatcagtaatcgcaataaatgtacccagattaaattcacataacatagagacttctaggttgaatgaaacaagcaaaataaggcatttccatgtggcacaccaaagtgggttcatcccatttcttctgagctaagtgtgtttatgtgtgcatctgtattgtatatgtgttttgcaaggtggtggtggtggtgaagggggcaattcagtttatatgctctttgcaaaagatttgggtggcacacacaagtttttgttgggctcagtcgcacaatttttacttttgcatacattcttttacaaggtataattcaatgaattaaaaatttggggggattccatgggggtccaatggctaagactctgcactcccagtgtatggggcccaagctcactccctgattggggaaataagtcccacatgtcacaactaagacccgacatggccatataaagaaatactaaatttttttctctaaaagttcttcacctgaaatgtgcaaaatactaataaaaaggagatcatagtagatattgaaaagggtggtatcaatgagaatgattaagagacaacccaaaatatcagctggtttattcactgtatgagaaataggtcaacgtcaccattttattctaaatgcagcctttaaaatctcagagaaagaaaatttcacacatcactgattattcttttgacaattttagccagaagctcttcattctttcctggggcctgtataaatcaattgtaacaaactgtgcaattatcattcttgcaactgacggcttgtggcagatttaaattccattttgcaagcgagccaaaaactctcctttgcctcctaagctcaaaagccagaaagcagctgaaagatggtcattgctttgttcttgaagggagctaattacagagttgtctgcctgcctgggatgggctctcgcagccagtgtgtgaatagggacaattagagctcatttcaagcagacattatttctaaaaaaagacgcagaaacttcagattttaattactctcataggaattataacattaaacagaacctgaccattttttttctcctcgcaattcagttcaacaaacatgacagttctctgtcacaagaatgttctaattttatcctttctacagatggtttggtaggaacgtgaagtttagtcctcccttctttcctcactagatttattttaatcctacatcacagtcaagtttttaaaaatttgcataatattgaaatattaatgtgtcattttcctacatcttcttagaatcatcatttttacatttaaaaatattcaactaatcaatcatttacgtaaaccctacacagatttttcaagcatttcacttcatgctttggaaacattttcttgcttagacctcccgtctacgttaggagtggtattctcgatttatagttgaggacactgagatg

SEQ ID NO: 26506 - DNA, 1463 bp, Bovine  19866881300771
cctgtttattcactgttgattcccaagtccccagaacaacagtgggcatggaacatgtgaatgaaggaatatttgtttaaacacatgcacgcacaacaaacatatgcttcagatgcttccatttggaagtgatcaatatttaattttacctcacttttaatggattttcatcaaaataaaataatggtaatgatagaaattttaaaattcagggaggaatatttttctctgtatctaacacaaacattttctgaaaggcaattcagaattgatctctatctggaaagagtatactatatacatattataaaaagagacatgagtcttttccaaatttcctcttctctgtgtcccagtagaaaacctttattatgagtattgaccttagaaagtaattgcctcaagggcagtactgctgatgccattttaagaatgaagggcagggctactgaaacaggccaacactcacaggcaaggaaaagaggaggaataaattaattcctgaatggacttgtcattcacagtcatctggtttgaccagagtttaatttatctcagagagttggtgggcctgcctgaggggtgtcacatgataacaaatagtagagagagagaaggtccgattttgcatccaccataccaaccaccacaagggaaaatttggcaatgtctggagacattttgattttagcaactaagtaagggtggggggtggggggcaggaaactgctatttgcatctaatggatagaagccatggtgctactaatcatcctacaatgcacagggcagttccccacaacaagacgtactcagtcgaaaatgtcagcagtgccgaggttgagaggccctgcagtagagcatgtttaagggcatgggatctgagacctctctgtgcaaatctgaattcctgcttcatcactgtccagctgtctggcaaaccaatttcccttttcctcctgggcacaaaagtagttacattagcactcctcaagttagggctaactacacaacaagttctggtgcgtgaaatgtgggcataagtgctgtccaccacttctaaaactggcttcaaaaacttccttcaaaatcactcatctcttttcgccttccatagaccagatgcaaaggatctaggggatggcagagtcactagacagacagagcctgggtacctgaatgactgtctggagcagagacagcgcccctccatccctgtagtgacccgcagtagaccatgatatgaataacagacagacagacagacagacagacagacagacttctacaatgttaagccactgatgcttggggttgatcaggtaggtggactgtcacctactgcaggcttcttaacctctctgtgcctcaatttcctcatctgcaaaatggtggtgataacaccatctctcccatgaggattaaagtttttaaaatagtgtctggcatctaataagagttttc

SEQ ID NO: 26507 - DNA, 1549 bp, Bovine  19866881308366
ggaagtcatctgtggctttagatggcccactttgagattacagcagacaggaaattcatgtggtcatgatgggagtgaagaagagagagaagtgcacaaagacacttactttgctttaatttgcccactgttccctctaagatactccatcttaaaggcaaggattccatgtggctggtataatcatctttgagggcagagatgttttgttggtttttaacaataagactgagcccagtgcttagcttgtgggattttgagtttgtcacaagagattgtaaatagctgatttccatggctgtgtctgggtagcatcaatcaatttagctccaggatttctcaacctcagcagtactgatgtttggggctggataattctctgttataggaggctgttttgtgtactataggatgtttaacagcacccctacccactagatcccagcagtgctcctacccgcatcccaccaagctatgacaacccaaatgtctccaggcattgtcctgtgtccccaggaataggtgtataaaattgtccctggctgagagctactgagttagactcttagatccaactttatgcagttggttgcagtgtctatgagatagctaaaggaattcaaggcaagctgttctttcatccacctgggctaaataatttaagcactcttaatatcagacttttgaatcataaagatcctatgtctttgaagagataatagggtaaattaagtttgacctttcaagccagacaacaggaatttagatccacttgctacttcatcacttactgagtaaatacccagatgagactcttaagcactctgtgccgcagcttcttcatgtggataaaacgagctagtatattgtagcctgcttagaagagagtccagtgcatatgaagggcccagtgagtggtggttgtgggtgttgataaagacaagagtggtttgagccccaggtcaccttgtgttctgatctcagacattcaaccctgtaccctcttagactgaaagtccctggcctgtgtctagggagagctgtgggggtctgttgggtggcaccccccccactcatcaccagggctcagtccttctgtcacctaccactgccctgaatcagtccctcagaatcagggctacattgtcatgggtccatcttaagattgtttctccaaatggtggggggtgtgggactttctcctctctctctcatcctttctttctctggctctgtttctctcttcctctttctgtctcagtcttcctttcactctgacttgtgagattgctttaaagagtggagggcctacttatttttaccttgactgtttttgcttattcaggaagacagaatttaagcaaaacatttctgttgccaggtcaagatgaccagtacacagttatcctgaactgatttactcaaagaatcattctaaatcaatacatacttacatgactcatgcgtattcctttgcttaagacagaatattaaggggaaaattacccgttatgtaagacacagcgaagaaccaaaatcatgttagaac

SEQ ID NO: 26508 - DNA, 1033 bp, Bovine  19866881314346
acccctctaggtcatcatagagcaccagactgggctccctgtgttatacagcagctccccaccatctgttttacacgtgatagtgtacagatgtcagtgctgctgtctcagctcagcccaccctcaccttccctggctgtgtccataggtctgttctctactaggttcatcagcactatcttttccccctagattccatatatatgcattaatatatgatacttgtttctctgacttaacttcatctgtgtaagaggctctaggtttacccacctcactgcaactgactcaaattcattcctttttatcaacccaggtttttatagttttctgtttgcaataataggaatatccaagtactcgtctccctaatatggcaagaaatttagaatgacttttgttaattttaacttctccatttttgcacatgattttttcgagaccaccttcctagctaatacccatttttctttgacaaacattcacatcttctctgacttttgtcagctcagttaaacgacaaataacattgtattgactgtaaaaaaccattgattgtaagatgcatcttgattttgatggtgcaaaaagtcatttgctagtatccctcagtttttcagctaatatttttggttgcatatcatgtgctaggtcttatactgaatcctgggattacaaacagaaacaagatgtgcttatgaagggaagatttagatattaaattgctgctatactccctttgaaataattctaagagaatttggggaaataaacaaaatctttttcctaaaactttataggatcctcatgtattttcctgaaccactgccgctcaaataattttgtttctctttgtctttgggtacttttaagttttgcgactcctgcttgcctctggtggtatatattccttgtctttctttgcctttggaatttttaaaaaatgtgtttatttcttactacagcagattggaatgggctctttattttcctccaggtttgtctagactaacaatggtgtgatatagctttt

SEQ ID NO: 26509 - DNA, 1422 bp, Bovine  19866881322320
ttggactctgataccctttcctcaattgaaatttagcacagtcttttctctcaataattctatattaaaagtacatctaattgtatttcaaaatttgcaagtgttggtttgatagcatgtttatgtcagtttttattttaaaccaggggttgaccagttagtaaatatttttgactttgtgagttggtaggcaaaattgaagctattatgtaggtgcttatataactaccattttaaaatgtaaaaaccatttttagcttgtgggccttgcaatagcaggtgatggaccagattatataggttttttagataacactgttgttaggatttaaagtttataaaatgccatctgtgcactcattcatttatttgtccattattcaacaaatattcttaggcccacaagtgtgttagtcgctcagtcatgtccaattctttacgaccccatggactgcagcctgccagattcctctgtccatagaattctccaggcaagacttcccttctccaggggatcttcccaacccagagatcaaactcaggtcttctacattctacaaagatgtattattaactcaatttacaaccaagatgctgagactctggtcaggtaactcgttaaacttactcagctaacaagtgaaagaaaaataattatgtgttaacttttatccccttgatttgacagtagaatccattagttagagattcacttacatttgtcacagaattaaatatggaaagtaagtcaagtatctagactaatagtttgcttctagtttgttaactttctctgagctgctgcagctctgtatacatgtatattaaatatagtctatgattcattatttaaataaacattggaatcctgacttttaaccagttgcaccgattggttgatgttttctctaggtgtggtttggagaagacctgcctctaagtccacggagtcctctgacccccagacacgggccaggtttggctgatgtttgtcagtatgatgagtggatagctgtgaggcatgaggccaccctgttgcccatgcaagaagacctgtcaatctggttaaatggtttattaggtaaggctttcaaagatactcaaaattatgttgtcttacccagtaaatgtttattgagaatcttactctttgtcaaggaatcattgttccagaggttggggatcctctagtgaaggaaatatttgatgtccttattttcaccaaacttacattctattttacagaagacgttctggttcactctgacccccagggcttgaatagtaagcaagtttgaggcttaatggtagaggtcaagtagtaaaagctgtgaataatcaatgttttcatttttaatattaaaaaaaaatttaagtgtattggtctaatttgggagtctatatttcatgatttttttcctc

SEQ ID NO: 26510 - DNA, 1041 bp, Bovine  19866881379761
tcaaagagaataaatgaggcattaaaaccagtgctgggaaaatcagaaacctttacagcaacatgaacacctaccggtcttaaatacaaacctatccataagtagatgcgtgttagtttttataatgcacaaaaggaaattcttaatagcaccactggggctgctgatccatgctcaactaagtgatactcacataaatggagcaaattctcttttccatatccaaactatttcacagtttggaaaaaaacttcttccttatgatctaaaaggaatatcccccaaagaaaccctttaaaattcattgtatcatcagagctatttttccagaatgtgaaaaatgtgaattggaatattgtatataagacattggtttaactgtgattcatgttcccaggtaacccatctttttgacaatggagccactgttttctttgctgttttcatggcagtctggggtaagtgttctacatttgtatgacttgagttcccatcatttgctctattatatgttcctttaaaatctgattttgaatatgagaggaagaagcaaagtgaattcagtttggctgttctgttagacacaagttaataaataattcatttggtttatttttaaggtgatgttttacaggacaacatgtcttctttctcttaagccttccaacaatttcatcagcattccattattggagtaaaattcaccttctgttggagacaaaagtaaagattatagtataccaaaaggtctgatggttaagacctgattacacatctcagtgtatatgggactttctaatgtgagtggaatattttcatctgactagtgtgtgaatactcacctctaggattcttccagttctggtcagaatgactccttatacacaagagctacttgcaatgctgaattgagtccttttaaatagtttcaagccaatagccataaaataacaaggtatgatggaatgttcactgaaagaattatttagcccaaaggagttacttcacccacgtttgggtttaatagtatcttcctcagta

SEQ ID NO: 26511 - DNA, 777 bp, Bovine  19866881380956
tggatataccagtcgaaatgtttgcttgtaacttgggaaataattccattaaagcctcttccgaaagtggccccctgaagccacataaggataatctctgataatagagatcagccaacagcaacacagacggctccaaaggaaacgttctgcaacgagatatttattagaccccaagtgtgccacacaccccaaagaagtcaggctatactaaaaaccacagaagattatcactgacggaaatataagacagaacaggtaaaaattatatgtggacatttagcatcacttaagacatgaagaatctgaggctcagcaatagtgagtcacaagctcaaggacacacagccaagtggaggcagagataggattataatactgtattgtgactaaagtccaatgctgtcttttcagcaataaatgacaatgacatatgagaggatatgtaatatttgtggggtgttttccatgtgctaggcactgagttacgagggaagaggtacagagcaggggctgccacaccagctctggggtagggtagtcagcccatccccatcagagatggaaccccgaataaaccacttaaccactgtgtactatcctccaacaaatatgtattgagtgtctaccatgtaccagtgacttttcctagatatagcaggaaaccatggaaaaagtccctttttctaatagcagaatgtagcccacaagtaaataattaatgacagtggtgaggatggtggacaaaaacaaattggggaaaggaggctggactga

SEQ ID NO: 26512 - DNA, 1609 bp, Bovine  19866881533560
ctgtattttgttttaccctattgatgctatataaatctgggtctcagcaggaaacagatggaacactcaaattagaataatttgaagaatgtaataaagggaccatttgcaaaggtgtgggcagggtgtaaggaaaccagaggggcagtgtggcactctggggctagaacgcagctgtgtttacctcctgtcatcctggagggggtcgggggaggagggagccactggcagagttggctgggagcacacagccggctgctgctgctcctacggggaagcagctggagtattaataccctaccatctctctcctttaaccctcctgcattccattggtgcctgccatgggcagacccccagaagccacagggcagaggagctcacgaatatgatcttttccagccagcacatgtggcaggatgaagagatggtctgcagtggcagggggagagccccagcacagctgcaccgtttttacccctcagtaaatgcgcttatcttttgtctaagtaaaaagttcttgttcccttcacacgggacggaggaagtgccatcagctagggctcattgttggataaggtcacttcagtgatactcccttctcaacctagtgaagaagtgaagtgaagtcactcagttgtgtctgactctgcgaccccatggactgtagcctaccaggctcctctgtccatgggattttccaggcaatagtactggagtggattgccatttccttctcaacctaggaacaagggataaaagaacaatgaaagcatagcggttgcagttctggactctgaagcgcaggctgttttctccatccccactctgtgctcccttactgtctacagcttctcagcaaaggggctggaagcagtgaaacaaaccttttattccttctgagtctcagtcctggcagccccttcttcactacgtcgtttcagtgttgccaggttccaagcccagtcgtccatgctgttttagcagctcggtttcaccctgggaaatggaattaatcagtgagtcctcctctgtctgttggtcaatcatttgaccaacccaagctacccaggggtgaactcagcttccaaagctatgaaattctcgctgtgtttcctgatggaagcatttctcccttaggcactgggacttccatggtcaggtggtcaaggtcatgggagtgagaagcaaagattctgcaagtgggttactaggtatccaggttacagtgaagatcggaacactctcttcttgtttttggacccaggcattctggttgaggaggaggtaaattataaaaaatgctgttgactgttgacacgggaaacttggtgagaccggagaatccctggacgagcgtgcagtgctgtacttcccttgtctggacagaggcaacattaaatgagaccccacggcatgtgggcaggcccactaatagtggtgctggcaggagtgccccagtgccccagacaagaatctttcagagagatctgatgctggtagtaaaggtatactgttctatccccacactggaagcaagccgattcccatttactttatggttaggatgggggaaatagcatttgcctagtcagtcgctgtgtaccag

SEQ ID NO: 26513 - DNA, 1703 bp, Bovine  19866881828985
gtacctgactgactgtttggaataagcctccagtccactcaatccaacccatactcagctagtaacccaagagagaaataaaccatttgctgatatttgagatttaatttaataccacagtaaccctagggaaataaattagttctagagaacttataaagatataattaaaagggacttcagcatccattaatggcagactaggtagttcagaccaactccacactagaaaagacaacaaaaaatgtttttaatgtctgctcaaaaaagcattgtggaaccatcatggcagtgaaaaatcacctggccaccatctggccatctgggagaagatgaaagtccagagaagtaagcctgacatttaaggtcacttttctcctgggagcatttgctaattataacaaagccagtatttgatatctgagtagtttgataacctggtatagacataaaagttggatgctggggaaaacacagtatgtaggatgggaccctgaagtactgtattccagaaacaagagtaaattgaaataaaaagagtctccacactgcctgtagcccaaacttcagataatctgggtggcccagaatatctcaggcctttcaaatggattaaagagattccagattgctaatgccttcaggctcttgaaagaagcaaatgaaaatcctttctggagaaaaaggaagcaaacaaacacagacacacacattattttaagcctaaaataaatgaacattttttctaaaaaattctacaagcaattttccaatataattttggatacaatcaaagaaaacgaagcgcagactgagatgagatactgtgaacaagagtcagcaaaaccagtagaaaaatagacacagaattacatggtctccagatagtgacactgatcagactttaaaataattagctccttgaattccaggaaataaaatacagtgttgaaaatttcagcaaagaattggaaatattttatttaaggatatagcaggattgaaaaagaaccactaaatgttctaaaattgaaaacacaataactgaaattaagaacacaatgagtggagttttactagactgaaccttgtagagagagaaatgaagaacttaaaaataagtcagaagatatccagaataacacagatagaggcaaaaagcctggaaaatacagaagtgatggtcagaatgctacccgcagactagcatccgttctgggttctcagaaagagcctacagaaaaaaggggccaaaagcagtatagtaagagagaatggctgaaaaatttccaagagtgatgtaagacattgagctccagattgaaaataaaattaagtggacttggcagggaagagagaaaaggctactttcttaaaagtcaaagatgactcaaagatttatttccagtgaaagggtgatgtaattaactgagataagaaacaaggagggaggaaaaggtctgttgggctcagaaggaatcagtgtgaaatagaaatagtaggttccaatttttactttgaatttaacacccaggcagggataataaatgtgtccttatttcttaaacaattactatttttcttgttacgttcatgttccaaaactttcattgtttaaaaaggaccagtcaaactttctcatctcaagaatctagcacctcaggtctccttcccttcttgctagaatccatagtttgcctcta

SEQ ID NO: 26514 - DNA, 491 bp, Bovine  19866882017441
aatgacactattagttccctttattagttttgactagattagtctaaaacactgatgtttttaaaggtgcaaaaaaaaaaaattttaccttgcatttctgcaccagatactaattagtttcagtagaggagtaggagaatagtgactttcagatccaagcgtgctgatctagatacaaaataaaaacaatacaagataagaacatatacagacttgaaggaaaaaatcaaacaactgaaaagcagaacaagaacagaagccacacgaggacataagagccaagagatagagattaatatttaaaggataaactgaacagtgagcaactgtgcctaagatcaagtctctgctacagtcttagctataactacaccagttatcatcaccaagtggggacaaccagagaaatcaaacaaggaaacatgcaacaacaatcccggtgtatttttttctcacgcttgtcaaaatccagaggcatatcatgtgaggtg

SEQ ID NO: 26515 - DNA, 2115 bp, Bovine  19866880516234
ctgaatgttgagctttaagccactttttcctctccactttcactttcatcaagaggcttttgagttcctcttcactttgtgccataaggatggtgtcatctgcatatctgaggttattgatatttctcccagcaaaccactggttatagtctcccagattaacatgaattgagaaaaaatgtgaagatctcaacctgtacaacccaatcttcttctcttccttttatcaagcaccatatgtattcattctccagacactttaattgccttccaattgtaaaatctactcgaactcttcccacactctctctagacttttgttactttacctgcaggaaatcctctgtcgtccctttctcctcctgtcctcaatctttcctgcatcaaggttttctcaaataagtcatctcttcacatcaggtggcaaaagtattggagtttcaacttcaacacttattaaaaaggtttttaaaaattaaaactaaacatgcaataattagtgttcttaatataagtggcatgatgtcatctaaattattttttaattcagtttgatacatttttctgtagaatttttagttctattaatacatggaaggaatctttcaacactatactgctcaatattttctctctcatagcaggataagttggtttgtagagaatcacttctgatcctaggctcagttcagttagtcagttcagtcactcagtcaagtctgactctttgcgaccccatgaacctgcagcacaccaggcctccctgtccatcaccaactcccggagtccacccaaacccatgtccattgaattggtgatgccatccaaccatctcatcctctgtcaaagtattggagtttcagcttcaacatcagtccttccaatgaacacccaggactttccacatacctgaattaagttgtgctgaaagcatccatctacctttacaactggacatcagttggaggatactaaagcagagtatcatgtttatacaccacttgcttctttatcaaaatcttatctgattttcaattttttaaacatttgaaggtggaaatattaaaataagtaaataatattaaaacaagtaacattatcctaactatgctccaattgattctacttaataccagaaacttaaatacaaatatagtgtattatttttatattgttgtcataacaaattagcacacaattagtggcttgaaacaacatgaatttattatcttatgtgtctgaaagtaagatgctcaaaatgaggtcactggggtaaaatcaagatattggcaggattgtgtttcttttggaagctctaggggaaaaattgtttacttgccttttccagtatccaaagactgtgcacatttcttggttcatgatcctgcctcattccaacctctttccattttgacaactcatttgctgaccgtaaccttcttacttcttcttataagcacaactgtagttatatttaggcctactaggataaccagatttcttaatctcaaaataatgaacttaattgcatcagcaaaaccccatattgcatataaggtaagatattcaaatgttctggaaattaaggtatagacctatttggaacaccactattaggtctattagacagagtgaagtctctgatgtctcgcagtatagaaactactctattttttcagccattgtttatcaaacagaaattttatcccctggttaaaattatgttttcaaagaaattgttttctggaatgttttgggaagcaaaattttaaaagaatcaatatgtttaaagtaacttaaaaaaagtaaaattagctaaaagtacatgaaatgatacacagtaaaaaacttaaattatgtgttacatgagtgcactttataattaatgaataggcagttaaacagaattgcttaaacactggtgatacaaaaacaagtaacatctcttcaaagacaagctaaacaaagtaataaaaataacagggataggtacaaagtatgtatgactttgagacaagtaaaactgttgaaggaggtcagcaagtgattctatcaggcaaagtttcatgtgggaaatcctactgactttggttacaaagaaatcaatacaaattt

SEQ ID NO: 26516 - DNA, 2064 bp, Bovine  19866880577862
attacagagatatgagcctcttttatgtacatacagagttcacttgctatagtgctgttcagtgttaaaaacaaagttcagtcagttaattcattatatactatgctttagtggaaagatttcaaataaggagttttcaggtatggttttgcaaacacagtcaaagttttaaaaatgcccttgccacttcttttacccctcagattatgtgaattgaagaaatttttatttttatttctacagttttgtagcagcttcaatataagatgcaaaagagcaatcatgcatttgaaattttccctcataactctatttctctttaaaaaaaaaaaagcagattagctgcttttttccccaataaatgagcacataaatataaaagaaccaaaagggaaacactactttgcttttataccaccatctgctacatatcagattctatgtgttgtgttaactgaggcaaaccatatactgctgaattgagcaatatttttccaccgtctttaataaaacctcactcaatttactgattttattcaaattatgtagaaaataatgttttacaaatataaacttatatataaatatactcaacaatttctctgtgaatgaagataacttaaaaagaaaaaaactatgagaaatatggtgggttatttcctgttacaagatagtacaatattaatacatataaaatttagattttatgattatttgaaagaaaacaaaagtctttaaaatactatgtcaacattttactttgtcttgattattatgaaatgagaatttaataatggtagtcaggagtttatagctaaaatttaattaatatgtaattttgagcatttaatgtaaatgcaaagtctgtcattagtgtgatgtgaagatttcaaatttgaatgcaaatatacacataatagacataagaggggcagattgtttctaaaaagctgtacattttattataattgcttaaaaggaattaatggcatttatgaacccattgtgggcaatgttggagagtgatataaacaaatcagcttcttattcttgaaaactgcatatttgtgaagcagaatgcatgtgcaggaaaaaaaaaaaaaaaagacttaccaaatagaacaaagtatggcaaaataaagaacttctcaaaagcttcaattatgtgcaagaaaatactcagaaagaacgtagtggatataagtttactttaggctttctgtctcaccaaagtttttccttcttatagagtttagatacattaaaaaaaatgatttgagccataactcattcttttccatttcctgtattctgaaaataacagagaaatataaagaatatgtagggccctggctctggtatttggtttagttgtcctgaggaaatcaactaaatctcgttccttacatgtaccttaccttttttatacattatgtgtgaaaaagactgaggctgattttgttatacggtattggatcatgcaatcatggagaagtcctaaaatccaccatctccaagctggagacgtaggaaaactagggatgtagttcaaaggcctaagagccagatggtactgatttctatctgagcctgagaaacaggaaccttggaagaaagagaatatcaatgttccactcaggcagaaacagagtgaatccttcttgctcttgctttaccttaggtcctcagtggattggataatgcccaactacaccagttaaggtaatctgttttactctgtctactgattcaaatgtgaatcttctccagaaataccttcccagacacacccagaaataaagttaaatcaggcatctgagatccagtcaagaacatatacacacacaggaggactacccatggtaattacagtcctgattgtggtaacttggatgcagtaataggacatggtcaagcaggagatggcaaaattgaatatcgtcatcttaggaaatagtgaactaaaatggaagggaatgaaagcaaaagtgttaagttgttcagtcatgtccaatgcttttgggatcccatgggactgtagcccaccaggctccctctgtccat

SEQ ID NO: 26517 - DNA, 758 bp, Bovine  19866880652053
ctatgtatttatttttgtgactgtagatactcgcttgctttgtacaaacaataataggtaatctaatatacaggtaaaaattatattttgaaactttaacatggaactcagtgagaaatatttatgcttatactgaaaaattagaaaagaacacactgaaaagtttttcagaacagtttactttccaaaacatgaagtgccttttgagtttaggaaaaactttgaaactatatacacaaagaaaaacaagaatgaaggacaagaactttgaagtttgtaaacactattttacattttcaaatttggtactcggtttttaagtaactaaacataaatggtaagaataatagattatatcactataaaaatcaattctctattttcctggaaataaccacttttttttttcttcttttgttaggtaaacctatcactgtcattaagatatgacacctgtgtaatttgttaagataatttatattgacaaatatcatttatcaagtgactgtggctttttgaatatattgaaatatgtaaaaagcaatgccttttaatactgttgacagcagataattttgtacatgtttcaattgaatgctcacaaaaatcatgccatttttatcccaagtgaaaagatgagaccatttggcaagtacagaaattgcaattattaaatgatagacttaatcacttaaaaaagagatatttagggccaatagcatacctaaatatgggttaacaaagtaaaactataaaat

SEQ ID NO: 26518 - DNA, 1389 bp, Bovine  19866880758895
atagcttttcttccaagaagcaaatgtcttttcatttcatggttgcagtcaccatccacagtgattttggggcacaagaaaaataaaatctgtcactgtttccattgcttccccatctatttgccatgaagtgatggcacaagatgccatgatcttagtcttttgaaagttgagttttaaaccagatctttcattctcttctttccttctcctcaagaggctctttagtttctcttcaccttctgtcattagaatagtatcatctgcatatctgaagctgatacttctctcagccttcttgattacagcttgtgattcctccaccccagaatttcacatgatgtactctgcatataagttaaataagcatggtgacaatatacaaccttgtcatactcctttctcaattttgtaccagtctgttgttccatgtcctgttctaactgttgtttcttgatcctatagaggtttctcaggaaacagataagatgttctgttactcccatctctttaagaatttttgacagtttgttgtttttctgaattttatgtaaaattattagcaaaagactttaaataatctatttagtgttttgtttcctagcacaatgttcaatacatttctaccaaattagtaattctaaaaaagaatgtgtgctgaaaacttaaacataattttcttggtttgttttttactttcctataagcacttatgattaatgtttgagcaaatatgcttttgaatttgcaaatacaaaaatttctactttagaagtaagatattcaaggacaagttctaccagcatatcattgctaacaaataatatttacatatttggaatcttgagaatttttttagaattaatcacatcatgattgtaaatcaccttgaaaacagatagagctacgttaaaattaaaataaggctaataatctattatgtctctactaaaatgtttgctcctatgataatgggtgccagtattttctgacagctcttccagaaattattggttttttctccatcttttttgttcttttagaatcctgctatatatacctcaaactattttctcactcatcagcaaaaatatttaaatacaaagagtagaaatgctaatgtaagcagtggaaaaatttgactgttttcttctcaaatctctatgatttaatatgaagtttacagtatgtggttataattcttcctctcatacaagctttcataaataaaaaaaggtatattttcctttgatctgaaaaaggaaaaataagaaatggtttatcttcttgaacagactttttttcctccaagaaattaacatagctgtggatttgcttcagttgaataacctgcttttaatgcacaaaatcagacaggaaggtattagg

SEQ ID NO: 26519 - DNA, 884 bp, Bovine  19866880813722
tacaggcaattcactgaaagtttgcaaaggcagaaaggagtctcactcttttacatagtcaagcagagacaacaaattatatgcatattttcaaaataagtaataactgtcctaaagtaagagggcttggcagcaccatttgtcatgtatagttcatcctaaatttacctggttattggagtgaccattcatgctagtgtattagctttatccagagaaaaaataaaattctcacatctttatgaaaggaggtactttggcaatttgaagcaaggttccaactgaagttaggctcccagccttcccaaactgtgatataagggtacctactttccttgatgtttatatttctaagagatagttcccaagtccttgagaaagaagtccctcagtcataaagctaattttcaaaagaatttatatacatttcacgaagatgagaaagtacttatgtgttttctgatttaaaatgatctctttattttcaacagggaaaattaaaatttgtatttgttcttacacatttttgcatttttatttctgttgggcttagacaagtatccaaacttcccaaacctgtgcatatacaaacacatattgttgcaatttaaaatttatattaaaaagtatctaaaattcagataaattagaaagcccaagagaggctttagttatatggatattcttttcaagaatttttgcagcccagtttttaaacccatttttgcagattgcttgcaaaagaagatcagagtgaataaataaagcctgaaggttaattgctcacttccctcttgacttgtggcttctcttccacatcaagatcacccttgatgtcatcaagagttccacaagctgctcagatactaagcaaaggcctagaa

SEQ ID NO: 26520 - DNA, 1498 bp, Bovine  19866880908180
ctgataacatgtatctattgctgtttttcatattctagccacaactggctgtactgatactcttatttatgttccataatattttatttcattagaccagactgattgaattatttaatttgttccctgcagtaatagacaataaaatagatttttctacttctggaaaggaatatattatatttacgactaaaatcccagaacctatgacagtgtctagataagtcaggtgatcaggagatactttctgaatggataaagaaaggagtaaacagaaactgttgaaataataatctgaaactaaaattcattgaaaagttcttagatcttgaaatacttttaacattcagagtttcttcttattcaattcaaaaaagactgcttaatattgatataggtaatgttattatattaatttataaaaagctcaaattataatgggaaaatcactaagcatgtgtaagcataataagtgacaaatgacacactttaaaattctacagaactattaaagattttacttgcatgatatgtttaaacatattttaaatgtctcagaggactgccgaaaaacagtgtactctattcacatttaagcaaatgttttgacaatccccagagctaaagatataatatgagaagggcatgagccatttctagaagtggaagataatgataaaaccagattttattccctgttttcttcttgacatctcaaccagtaaaatattacagatcgttggtaatggtttgaatttaaattataggacttttttgctccaggcatgaagacttttatttgtttctccaattctaactctactttcccttacatctaaacacttgtatacgattctgtgagaaaactctcccttgatccttttgctaatttaactgtactcttcctctagatgtcagggcaaatatagccgactaaggaaaaactccctgatctctatcagctctccatgatttaagcactcataacaacataaaatattcatagcatatatcacagtttctgaatatatatttacccacttacatgtacaatcagtatctctcttccacaagctttaagtaatgtgtgaacagagatgatgctgtaggcagaataatgatccccaaagatgtccacatttgcatgttatattacatgacatagaggaattatatttgctgttagaattatgatgcaaatagcagaccttgaaactgtgagactttcccaaattttcagcgagggtgttgtataatcacatatatccttacagacaaaaggagttgggagactcaatgtcaaaataattcagtgtaagaagactatatcagtaattagtggtttgaagataggaagtgtccataagtccaggaatatgggtagtctttagaagatggacaacccaagaaagtgggttctcctctagagtttcagagcatgtagctccctcaacaacttgattgaagcctaaggatgtcacacttctatagaattgta

SEQ ID NO: 26521 - DNA, 3313 bp, Bovine  19866881185110
atttggatattgattttattttcccaactgtactgtcctcatgcaaatttcatatcattttatgaatttgctgaggctgttcacttagctgagcataatgccctccttttttattttaaaatactatctactccatgaagcccttccctgcaaggaactatagtagatgctaagttcacacagaacatgaattagataatactagctaaatgattgcaaacttcatcaaaactttctaaatctctcttaacttctcagaaaaatggtaattcagcctcaatcaaagaactataatgagtaagcaagataatactcaggcagatctagcatccatcagaaggacttaaaatctatgacatatatatatagattaaaaaataaagtggccttgcatcagttttaattctttatttttgtgcataagtacatatatgaaaatggttttaatgtatacatttataatagaaatcattacttaagaaaaatactttatgctaaacattctttgcaatatcacccttcaaagctaagaagattagaattattagaaattccttggaaacttgcatttatatttagaaaggagaaacatttgagtgtgaaaagcaagagactacagggaatatgatttactttccatatcttgaggagtatagtaagtcttacaaccaaacaaaatattcagtcttttgtgatcacaagtatcacccactcctgtattcttgcctggagaaccctacaaatagtatgaaaaggcaaaaaagatatgatgacaggagacaagcgcccagggtcggaaggtgtccaatatgctactggggaagagtaaagggcacttactaatagctccaatgagaatacagcagcaggaccgaaatgggaatgacactcaggtgtagaaagtctgttggtgaatttaaagtctgactgcataggcccttgaaatatgaagtccatgaatcgaggtaagctgaatgtggttgagtaagacatggcaagagagaacatcaaacatcttaagaatcagtgggctaaaattggctggatgggcaaatttatcttttataggttattggaatgccacagtagaaagttaagagataccttgagtaacaggcaagtttggccttagagtacaaaatgaagcagcacaaaggctaacagttttgtcaagagaacacactggtacagtaaacatcttccaacaacacaagagacaactctacacaaggacatcatcagatggccaataccaaaatcaggttgattatgttccttgcagcctaagatggagatactctatacagttatcaaaaacaagacttggagctgtttgtggctcagatcatcagttccttattgcaaaattcaggtttaactgaagaaagtagggaaaaccactaggccattcaggtatgacctaaatcaaatcctttatgtttatacagtggaggtgacaaatagattcaaggggctagatatagtagactgagtgcctgaagaactatggatggatgttcataacgttgtacaggaggaagtaaccaaaatcatccacaagaaaaagaaatgctagagggcaaagtggttgtctaaggaggattcacaaatagctgaggaaaaaagaaaagtgaaaggcaagggagaaagggaaacacatacccagttgaatgcagagttctagggaatagcaaggagagaaaagaaagacttcttaaatgaacaatgaaaagaaatagaggaaaacaatagaatgggtaaaactagagatcttttcaagaaaattggaaatatcaacggaatatttcctgcaaagatggacaccataaaggacagaagcagtaaggacctaacaaaagcagaagagattaagaagagttggcaggaatacacagaagaactatacaaaaaaggtcctggtgaccataatgatgtggtcactcacctggagcaagacattctggagtatgaagtcaaatgagccttaggaagctttactatgagctaagttagtagaagtgatggcattccagctgagctatttcaaatcctaaagatgatgctgttaaagtgcaatcatcaacattcaatatgtcagtaaatttggaaaactcaacaatggccaaagactggaaaagttttcacttaaatccaaagaagtaagtgaaagaaagtgaaagtcactcagttgtgtccaactctttgcgaccccatggactgtatagtccatggcgttgtccaggccagaatactggagttggtagactttcccttgtcctggggatcttcctaatccagggaccaaacccaggtctaccacactgcaggtggattctttaccagctgaggcaccaggaaagcccaagaatactggagtgggtagcttatctcttctccagtggatcttcctgacccagggattgaactgggatctcctgcttttcaggaggattctttaccagctgagctataagggaagccctttattgggcagggccaagtaatgtccatgatactgtacaattacaatcatatcacatgctagtaaggttatgctcaaaatcctccaagctaagcctcagcagtacatgaactgcaaactttcagatgtacaatctgggtttagaaaaggcagagggacatgagatcaaatgaccaacactgttggatcattcagaaggcaagagaattccagaaaaatatctattctgctggcttgaaagtcaacattaaatatataaataaataaataaataaatatatatatatatatatatgtatatatatatatgtatatgtatatcatgacatctagtctcatcactttatggaaaatataatgggaaaaagtgtcagattttatttttttggactccaaaatcactgtaggtggtgactgtagcttccttatagctttaactataggggcctttgtgggaaaaatgatgtctctgctttttaatatgccatctagttttgttatggccttcccaggaggttcattgttcaagaatgtgcctgccaatgcaggagaggcaaattcaatcaagaaattgagaaggtccccaggagaaggaaatggcaacccactcccatattcttgcctgagaaatcccatggagagagaagactggcgggctacagtccatagggtctcaaagtgacttagcatgcaatgggactggatgccatgatcttagttttttttttttattttttttaatgtttagtttcatgccagctttttcactctcctctttcaccttggtgaatctaatgctattagcatagactgttattttttcttttattt

SEQ ID NO: 26522 - DNA, 797 bp, Bovine  19866881193964
ggctcttttagctgtaaattttatcatgccattaaaaataaaaaatattcccagcacaaaagttttacctttgttgcacacctactgaaaattcagattatcagtaacaggattgatgttgtattacaggtatattgatttaatattttcattttatgcaatatgcatttggatgtgttcttcaatccactatcacactgctgcttttaaaataattaatagctgtgaatcagtttcttagacaatggacatcaactaagagttagtacattttaaaatcatgaaataacaaacaactaaccttcccttaaaaaatcagtttgtgacttaatatgtcgttgacacaacaacaaagaaagcatattgttacctacatactttttgatatgaaatgtgttaataaaataggatatttttatggtttatttagaattccttttgcagttagcaactcttccgtttgatttcttccctttagactttaaaagaataattacagaatgcatttaaaggattttcatcaaggtgtcctttgaaagtaaaaataaaaaccaattcaaaatttgtcaaaatggttttctacaaattgattctgtaatcctgtagctctattctatactgtttctctcttttcaaaggtcttctctaggctaccttgcagcatgctttatggatcagtgactctgctgattgtttttcctcaccaaggtcattagtgagaccctttttctcagtctccaattttcacatagactttcatctgtcttgtaaatcataatcttaataactgtgtattt

SEQ ID NO: 26523 - DNA, 1722 bp, Bovine  19866881235104
actctctgttaatttttaaagataaaatgtgtgaaattgaggtcagtaatttcaaacctattttaggcaattaagacaaagcttttatgttgttatgttgaccatggaaactttataataaaaagaaaaacacattgaaacttgatctagataaaagagaataaaaaacttagcaaaaatgaactcacatatataaaaaataaaataaaaaataactttttacatgagggaactaatacttagaacatctaaatatatacatggtatattatatagtgattcatttaatgctgttaaatagaaactgagttttattcttttgttaattaattggctaattcatttcttgatatatagtcctccattgtgatatactatcctagacacataggttaaattatatatacatttttaaaattttgctcaatatctcctctgataatatgactgaatttcaagcagaaattttggtccatgcatactttaggttgtggacttgtcactaatattcattattaaaataataataataaaattaaaaaaaaaactaaaggaaatgcaatgaattattttcttaaaggagacagctaaaaaatatatttattttatctctaaaaataaaaaaaaaagaatcttaactttaaaatttagattattaaatattctctggaaagaagttaaggtggagagatttaacttttgcggtatattctacttttgtctgagaagagtaaatgacaacatagatgttcttataatattgttacatatcttttaaaattcaagcatttctcattgtactgtaagtaatttatcataataatcatgattataattggaatgatcttgcttgcaactcacactattattttataactttgtactgaattcatctcttaagtctagtaaagtaataaggatgttgaaatgaagtgaaagtcactcagtcatgtccgatgctttgctaccccacagactatatagtccatggaattctccatactggagatgggtagcctttcccttctccaggggatcttcccaacccggagatcaaacccaggtctcttgcattgcaggtgtattatttaccagctgggccaacagggaagcctataagggtgttatgaatgtataattccttctcctatattctttgcctctttcttttactctttttccacaatacttctctcctttcctttctcattgtctgtttttaaactggatgatatcaattggctcttttgagtctccctgcaactaaagtatcctctgcaaataacatctcaggcatctctgttccttttgggcatcgtatctatgtggatacctggaggctcagtttaagattattcttcttgaagcacagtaagaatattatctgaaagtcaaagtgcatcaaattcaactgactataaagtaaagatttcaactttctttacttgtacaataacttagcaacctaacagtcaatgattatatgtccaaataacattcacatgtagcaagttacttgacagcagaaacaacacataaatatttcagcaccttggaataagtccaacttataacattaaattgtgcctgcttaaaatctttcccaaagtatatcgtttccaattctttacccaaatctggcagtgtctgcagtggtttaatgaggtgaagagttacacatagaatttcatctatgtcaagggaatctaagcatttcaatta

SEQ ID NO: 26524 - DNA, 1094 bp, Bovine  19866881335541
ttcctggttcattgctggccatgttttctgtgtgtttccacaatggagaaggatcaagggagctctctggggtctgttttataaagatattaatatcattcatgaagacttatgaccttacatataatatcataatcttgaggatgaggattcatccagtgaattatggggagacataaaccttcagtctatagcatcatttcatatcttcttgctatctttgattattttagcacatacaagtcataagtagcttgatactaaaatgataaatataagcccattcttgtgaaaaattttaatgtatatggatgatgccacttttataattttattttcagtaaactgatagaggtgttattatctgttcttagatcctaatgcaaagtcagttttagagtctcatagctaaacgtagctaattttagaagagtgacacatcacacaaaataattgtgcccaaaagactaaatttaagttaatgctgcaagagagttgaaggtttcaagagttccaactttcaaaacactttctatagtaactttaggcttttggcactaatatcaacaagtagtttggtgaagaaatattttcagtctaagctcaataaaagtggatctaaatcaatgtgtatactttgctaaatttagcatattaaatcacttttggatttagaaagttgtatttaaactctcaatttcagagaaacttttcttttacctttaaatttataaaatcatgaaaatatagactaaaatgtaagtaagtaaaaataaaaccatttttcccactctaataagtggcagagctcttatactgaaagttgtgtgaatgatcttcagaactttgacatttggtagaataattttatatgagattccagagtagctgccagttagtgaaatgaagatcactcagtcatgtttgactctttgggaccccatggactatacagtccatggaattctccagaccagaatactggagtgggtagactttctcttctccaggagctgctaataaggaaaggaataaaaggaagaacaccaaagggctattctaaacagcacagaaaaaaagaagaatgaaagcta

SEQ ID NO: 26525 - DNA, 1499 bp, Bovine  19866881361230
aatcaggaggttaaaacattccaatgttcaagagtttcacttaatgagttctgtactgagtgagtacaaaataggttatgcttcagatgaaacaaagttaagtttctaggatgtgttataaccatgttgacactgttgacaagagaacattacgatgatctgtaaggtaaatgtgaaaattttcaggatttttctgatttcaaaaagatagtggaaaatttaaattactagagtgggttgccatttccttctctagggcctctccccaacccaggaatagaacccaagtctcttatgtctcctgcattagcaggcaggttctttatcactggcgcgtcctgggaagccccagagtttgatttctgtgttctaatacaatttaaggataatatttgcttgtgtgctaatagttattcaaatactgatatagaataactattctaagattgagaaaagggcatattactcaattatgacttcttccccagagaatcaatttatatgggaaaagcaaagtattaaaacaggaaactctgtacataaaaagttttctggatttcagggaatcaaaaactcattgaaaattttgccttcttaattgttatttctgctctgaaccatagattaatttttcctacaggtataaaaaaatccatagaaaaaaagaattaattattcaaatatttattcacatacattttcagcaatagtttcaaggcttaattataattttcaccttgtgcttaattgttcagttgtgtctcctgcattagctctttgctgcctcatggactgtagcctataacacgcctctgttcttgggacttttcaggcaagaataatggagtggtttgccatttcctcctctggaggttttcctgatctggagatcaaacccacatctcttctacattgcaggcagattctttaccactgagccactgagggagcatcattttctccttagtgcaaagaaaaataaattgaatacaataaggcatttttgtctttttttcataactcagtatagtctatatggtatatatgacttacaactaattatttcagtgttcacttaccaatttttttaagtcataaagcaggtaagaacataacagtgttagcgttaagaatattaatttattatttctatcttctggtccctatgctttaccatctgagagtacaccttaaatttctctccacctgaccccttccattcactcatcctacaatcacctgattaacagtgtttactgagaattaagtagatgtcaatcattgcttcagaataagcataaaacatcctgtccttctgcttggaatcataaacatgcagagtaaaacttgttaaccttaatatgttaaacatataaacaaaggttgctaatgtgaatgctctagtcaaaagacacaaggtgacataaaaattaaattgtaaagcaaataaaggattgctatagattatagattatttagctatatttgaaaataataca

SEQ ID NO: 26526 - DNA, 1257 bp, Bovine  19866881952864
ctttacaattgtaattatgtcaataatttagtagtatttctgcaggaaggagcctcttaacatgttaacatgttcattcgctgtgaatatgtgacataatatgttatattgtataataatacaaggatgtccccaaagtacatcagttatttgacataataaacagaaattgaatgtggctgcactctacattttttgaagatatctgttatatcaatcgcattctcatcaaaggcattgaagctgtactttgagggaaagataaaagatatcattgtcctatttattataaacatataaaaataagaatattacttcatcattgtcatgtcatttaattgtataagagggatcattgccttctgtgtattatatctgttcttttactaaatgattcatccatggttcctttttaaaacttgtcatttcagggactaaagcatagatttgagcatctaacagcatatcttgaaaggggcactgctgaaatattatagcagattgtcactatagaaaaatggattatctatccatgtaacagtgtcattcatctagatttgaggcttgttcaggtgttcatgaaataagagctaattttttctccctgagacaccaaacatctagattaaaatgaggtaaaaaatggccactgactcagatgtatttaaaagcagatggttgtaaaggttttacaaaatgcaatgtttttccttgaccaaaaatatttgtgttttttaaagataattttatgtttaggttaaatgagagtttatcattttattgaacattttgaatgttaaggaattaaagtactatacattaagctgaaataaaacaatcttgctgaaaataattgaaaacatactgaattatatgctgcttgaatatatttacagtgatgttttgttaacaatataaaaaatgcattttgtacaaacttggattagaatcatttcaagagatcttccaaaatttgtgttgaccctaatatatgtattaaaaatcagtctttaataactattttattaatttaggcctgtttttaaaaaagcaatatgaacatatagcatttatctttattgatcatagactagacacaagttctgactttattagaactaatattaaagagattttatcacttgatattcttaaaatttctagtagatttctcctgtattttacataaatatcaaagcatagtgtaagtttcatgtcttttacataacattttccctactactctaaaaacagtaa

SEQ ID NO: 26527 - DNA, 1636 bp, Bovine  19866880354261
acttttatgagataaagtattaatagtagcagaataaatgaagccataatatattaaacagatttatttgttctcataactttttaaaaccagtgtgcttctgtttattttagaatgcacaattttcaaagttcaaataattgtgtcgctttgaagttgttccttttttcttaagcagtctttttaattggattaggtcaccttgtagatattactgtattaaattatgtagctgtataaaattatagctgtattaaattatgctattgttttttagcattattcaaattacatggaagaaagcaaaagtattttctcacttccatataactttgacattttaaaagaagcttaaagaaggagtcactgactaatgaagaattatagatgactctctctctggccttttccatttcatataataaagtagtttcatatgatataattttgttcaaaataaataaggttgtgaagaaacagaattgaaagaaaggaaactgactcattatagtgattatctgggaaggttatgattatgcttcagatattgtatgatagaataacaaaaatttagacaaaaataattattgaaattgtttttggaataaaagttaataatataaatcagcaaggtaatttttacattgtcaatggtattatgaaaaaaatcttccagaacatggtatgtgtgcttagttgcttagtcgtgcctgactctttgtgactccatggactacagcacaccaggctcctctgtccatggaattccccaggcaagggtactgaagtaggttgccagtcccttctccagggggatctcccccggcccaggaactgaaccttggtctcctgcattgcacgcagattctttaccaattgagccaccaggaaagccagaacattgcttttaattttgaacaatctaatagctcaaaaaattttaacaattttatgatactttacagtctgcattttgctagagtgtcagaaggtcaaacattcattaatttctaattccatccaacatggactggttgggccaatttcatttcattctattaagtttcaaagttcatatgtagaatagaataaaatcagattgatggaggcttatattcagcctttctggattttttttttaaacctttcttccctgcgttattcccttaaacataaatgtattgtgtttattgttgttcaatcactaagtcatctcaggctctacaatcacatggactgtagcatgccaagcttccttgtccttcactatctcccagatattgctcaaactcatgtccattgagtcagtgatgccatcccatcatttcatcttctgtcgcccccttctcctgcactcaatcttttctagcatcagagacttttaaaaagaagtctgatatggagtctagtaccttcacaatagtgtgagaacttccctggtattattgttctctaatttgtcattcgcccaccccacaatacccccataatagttcttgtgtattaccatatgcaacttactactttggcattgccattaggtaactacaaaaatgttattgtatttctcccagcaatcttaattccagcttgtgcttcttccagcccagcatttctcatgatgtactctgcatat

SEQ ID NO: 26528 - DNA, 2244 bp, Bovine  19866880389678
tgtaacctgtctttgtttatctatctataataatcagagacatttgttcaaaagacagtgacaatgaaagataaacatatatgccaactgcagagatataatcatatgaaatccagataatgtataaaataatccacagttaccattcaggggccatttggacaaggaaagaagttccttaaagaaaataaagtcattaagttacttctaaattgtaaaataaaagttgaagcttgatttttgtatttgaaaatgtcaaaaattattaaagcatctggaggtcagataaaaaaaatatactgcaagcctccaggaatacagagacagtatttgaacatggaggcagcagcttgcaaggtattttaatggatttataaaagctcatgtctctagggaactttacttcgctcaagaaaatgtcatggagatgtatgtctcagacagtattatgaacagtggagttactcagttttctttctgcagttcctgtggtctgtgtgtccaattgcttggttgcatttttgattgttttctgacatgaagttaggctgcctgatatatatgaacttgtgtgactcatacagctttcacataccaactggcttagaagtagccttaatctaaaataattgttatatagtttttcaattaaagcttgtagggaaaaaaaaaaatgtagttagttttaagttagccatggattgaaagtaagtacatagctgtaacacttataaaacttattacttgcccttttacattaaaaagtactatgttaaaaacaattattatagttgatttacaatgttgtattagtttcaggtgtacagcaaagtaaatcagttatatatacacatatatccacatctttttagattttttttttccatataggctattgcaggttattgagtacagttacctgtgctatagagtaagttcttattagttacctgttttatatctagtagtatatatatgtcagtcccaatctcccagcttatccctccccatcccctcgccccctgagaactatgattgtcttctacatctgtaattccatgtctgttttgtagatagtttcatttgtatccttttattagattccacaaataagtgataccatatgatatttgtctctctctttttgacttaattcactcagtatgaaaatctctgggtccattcatgttgttgcaaataatattattttgttctttttcatgtctgagtaacagtctattgtgtatatgtaccacatcttgtttgtcctctattggcggacatttaaaaaataacttgtttatttgagcgaaaatatgctgataatttacattaaatgaagtaaaatagaaaataagacagggtcagagaggcagagaaaacttggatatatttccaaagcatataatttgtaggacattgctttctggtatttacctacagaaatttagaaaaatttatttttgaaacttctttctaaagcatattaagtatattaaaaaataacatttattaaatgtatttaaatttttcattttaatttttccataaatagcattgtgttaataatgatgcatagttagatagattaatagagatgtgaaatactgttataacagtacctaatacacaaataatcacgatgcagataatcatgatggtgtgatcactcactgagagccagacatcctggaatgtgaagtcaagtaggccttaagaaacatcactatgaacaaagctagcggaggtgatggaattccaattgagctatttcaaatcctaaaagatgaagccgtcaaagtgctccactcaatatgccagaaaatttggaaagctcagcagtggccacaggactggaaaaggtcagttttcattccaatccctaagaaaggcaatgccaaagaatgatcaaactaccacacatttgcactcatctcacatgctagcaaattaatgctcaaattctccaagccaggcttcaacaatacatgaaccatgaacttccagatgttcaagctgattttagaaaaggcagaggaaccacagatcaaattgccaacatctgctggatcattgaaaaagccagagttccagaaaaacatctatttctgctttattgactatgccaaagcctttgtgtgcatcacaataaaccgtggaaaattctgaaggagatgggaatgccagaacacctgacctgcctcttgagaaatctgtatgcaggtcaggaagcaacagtttaga

SEQ ID NO: 26529 - DNA, 861 bp, Bovine  19866880396044
cagtaagtcatttacttacgatctgtcacccaatttaagacctaatacatttattagtagaatgaatagattctctccacctgttctgtgagaactagtgaattagatttacctacagtcctaggatgtaaaagaattttcagtagaattccagggactgagagaagtgaaactactagaaagaatatattgaaattactgactggcccagactaggacagaaggaaataaggttgggaactagaacaagaggtggaaagggaaggatatgtcaccaaccgttgatcaagatacagtgcagttcttcctgctctacatctgtttccctctcagaggcataatgtcttactgctgacatattttgaatcgagttgcaaaaggacgctaaaatatgactgtggagaggatgatcagaggcttggagggtgtcacattcggtacctaaggtgttagaaggagattcacagctccacagggtggtaactcattgggaagtagacccatttcatgttttgccacagctaaaccatccaacattctcagaatcgataggtgtcaccatagaacaggaatattgtgtgttcaagttgtagtaaaggtagggtaggaaagctgagtttcaaattctgacagtcttttacacctgaactgcatctacattcagttgaatttcagttcatacaaactgtgataaacctccaattgttttaaaatggaggaaaccttgctcttatttacacttccaattcagctttacaagtttttctcagacactacagtgttttactgagggtaaagtttagcagttttatatatagattattccttagttccacccacatcacactatttcatgcaggg

SEQ ID NO: 26530 - DNA, 777 bp, Bovine  19866880401918
tggcatcagtagaaaatctacaaccagtttaatcttaaattatgatattgtgacacattgaccacacaataaggggggttttaaaagctctcaaaatgttcagagcaattccacaggttttatagaagcataacaaagtagaactatctgttataggatttagggaagtatatgtgcttttttgtttttgctttttttctattatacacaatgctgagaagacatcatccatactagtgaatacaatataaaatgaggcatactcttggcttggtgactaatacttaaattgaatctttacaaggaactggttcagaaagtgtttaaattttaagagtatcagggtttgttggcttcaagagaaaaatagcagtttaaagatgtgaaatttcttttattaagatataaaacaacacaagtaaccgaaaataatgggctataaaacaaactcagtgattgacgtcagaactaccaatagctatattacagtgtaaaataaagatgaaagtcacaacttggaaacataagaccacatttcctcagaaataacaaatagaaaatacactttctttgaagacaaaacttaggctctgttgttggctgacctagattttaaactcagaaaatggcaacccactccagtgttcttgcctggagaatcccaggaatgggagagccctggtgggctgccgtctatggggttgcacagagtcagagatgactgaagtgacttagcatcagaagctttcttccaatcatacaaacttcaatctccat

SEQ ID NO: 26531 - DNA, 3533 bp, Bovine  19866880498220
tggataaagaagttgtgatgtatatacacaatgggagattttggagccatgagaaagaacaaaatctttccatttgcaacaacgtggatggtcctgaggacattatgttaactgaagtaagtcagaggaagacagataccgtatggcatcatttatgtgtaaaatccaaaaaaactgaacttatagagacagagagtaggatagccaataccagggaatgggggtggggaaaactgaaagatattggtcacagagcgcacaaacttccagtaagaaaatgagtgtgttttggagatctaatgcacagcattgtgactacagataacaacactgtatgatgtgtttgagagatgaagaataaatattaaatgttctcatcacgaaaaagaaataatcattatgtgatgaaacagaggtgttaaataacactaacgtggtaaccatactgcagtatttaagtgtatcaaaccaacattttcaacacagcaaagttacacaatattctatgttgattatatctgaataaattcaggggaacattttaaaaaataacttcagtttttaatgatggtattaaaatatggcagttattttctctccttttaaaattagactcagttcacatatacaaaaatagaatttaaccacctatagagtcaacattttaagatttttttttttggctaaatgttctgcctataaattttctcagggaaattttttaagtatctgtaggaaaactacaaatgaaggtaaaatgtcatacttttcttaagccttttaataatttgagaaagatcataaacatattccttatttctttcctcctcacttatgctggcactgaaaaacctgtattcatttaaaattttattagctcattgttctgtaaaagaacccatgattgtcttaattgttatcggcagaagaaaaaacaaagggtctacttcaaatgttcaattaggattacatacagagatgcagttttatcagtgttgacatttgcacaagctctgcatatttaacaagtgatcatgctctgctgaaatgagtactgttgctatagacacattataatatactttaattatcacattaatattgatattatcatcctcccaggtcaagatgagacagtaaaacagccatttagattaaattactcacagtattgattttattgctatttctacagatatggcaggatgctttaattttaggtccatatttgacaggacacttcagttctatctgattttaaaactctgagggtgctctatgtgggtgtttaaagtctaaaaatatttaaaaattgaatttcttcctgaatttcatcaacctgatttttttaaatgagaaaagaatgttccccaagtaagtttttaaaatattttttgctttctattctcactgactgttcattctgaattacaagaagtcattatacatattgtttcaacttaaaagtgaatatatatatatagattagagctccataactttttaatttgacttttgtttaaaaaatgatctactaccagagatggctgatgctgtatataatcttaaatatttcagaaattttaaaagatcacttattaaaagagtctgaacacagcaacttgaaatacataccataagttatttaaaaattttttgaaattattcagaacttacctcctgagctataaataaactaggaattcaagtttaaataaaataggatttgtttacttgagaagcactatttttcataatctcttcttggcatcattaaagtattttcagaactttgggatatggagagttttattgtcttattgtccatgaaatctctctgaaaacatctataactatgtttataactaaaaatataattttcttatcttctgttaattgtactgatgttaaggtttgggaaatgtcaagaaaaaacaaaatgaaacattcctagcctcaacaattataatctatttagagacatagttacatatacatttgattatgaaaaaaagctaatgtaaattaatgtttattttagaaaaatttgtctccctctttctcagttccataagtatattggaaagtcttcaaagattaaggaaaactgagaggcaatgtgtggcattttaattgccagaaaattaattttgattctaactaatatcaatcaatctggaggtaaaattatgtaacatcaaagtgaataccaactctattaaaggcacattgctttctttttagagggactgcatgtttggctttgatttagtttttaagtacaaaatcattgtaaacaaaatcttttcagattctaatttggacatttgcacttaaaaaagagatctcctgcttctcttaacctgcaaaggactaacatcagagttatttctatgaggtattggaattccatgtaattggaaacagtacaagctgaaagggtacagaacttatatgcttccaattcaatttttaactaagatgatttgaaatcccaatatgtttcctaggcaaccagtactgaccagatgcaaaatggtggcggccaagtaaaaattggctatggttatgattctgagaggaggaaggagagagtaatagaaatgaatgctagggaaccagccatctatgaaataatcttgtcattaattcagaaaagtgccaatattttcaagtctgaagctctgggaaagttaaatgaattttccaaatttgtattataatgctgcaaaactgtgactaattttctgtggtttaccttccagggaagtgctagtagatactagttactactcattctaccgtctatgaagacaatccaaaatcttataaaagtttcataagacatttattagaaaattagaaggctatgtccctctttcttctaatgtggccatacattcactcactggttcattcattataacagtgaatactttggaaaaaataaagcaatgtttctgcatttatggagtttctatttttgtatgggggtagcagaaaagataatttaagataggagcaaacccatggaaagagtaaagttttttttgtttttttttttagggatttgacagtagaaagaatgccttctgcctctgcaatgaagtatgcagtaaaaaattggcaaagcaagtgcaaattttcaaatatactttataaaaaaatacatgactcccagaaaaggatctctaagactcagcattttttaatagtggtacttgcacatattttaatgacctgttaaagtcacaaatgcatgctttttatgggtttaattacagagaaaatttcctaatgtaataaaatctgaatagctttttggtagaaattctcataatagcatgatggtcttcagacaatacacaaaatggctattaatgagtcctgcgcaaaaagcattgccttattacttgcttgcttgaggcaatttgacatggaaatgaaatgaaattattgactgaaccaagctttaatcctggccttggcctcagctagatgaatgtgaagtaactactcttgtccttagttaa

SEQ ID NO: 26532 - DNA, 1218 bp, Bovine  19866880578038
aggctctttagttcctcttactttctgcctaagggtggtgtcatcggtgtatctgaggctattgatatttttcccggcaatcgtgattccagcttgtgcttcatcaagcccagagtttctcatgatgtactctgcatataagttaaataaattgggtgacaatatgcaaccttgacatacttcctttcccttttggaaccagtctgttgttccatgtccagttctaactgttgcttcttgacctgcatacagatttctcaagaggcaggtcaggtggtctagcatttccttctcttctagaattttccagtttattgtgattcacacagtcaaaggctttagcatagtcaataaagcagaactaaaggatgtcttaaaaatatagtacttttgacagttctcaggtcatagaattattgatttatactctgcaaatatatcctaagtatattcacatgaataattagaatttggggctttgatatcatttggaagcacactatttaggttggatggttctagaatcaaacagcctccacacagttcttagttcctgtacatttcttagttattgctttttacactttggtaaattatttctgttccctttgattaagttccctcatcaatataaaagataggatcatgatagcacatacctcataaggtgctctggacattaaattagtatacctaaaactctgtcatttcatattataagttgtggctaatattaatttgttcaaaagttaagcaaaaacataattttgtcattctgtgagcttcaataattcattaatttgaattcaatttattctttgtaagttgaatatagggctttggatatcatctgaagttcaggttacaattaaattgctgattacagaggatcactaaagatatttgtgctatgtaaagaagtctattatctgttctattctagtttttcaatgtcagctgcaatctctctaaaaaagttgaagtcagcctttattttaaaagcactttaaacacttccgtgaaataatttgatgtattggtattaatgtaattctcatggtacagaagaataaatgggctgttaagaatattgaaaaaattagggaacactgaatttaaagcatcttcttcaacttttgtcagacattataaatgtaaccataatatgcagtttcctactaaagttcaacatacttaaaaggtctttctttttttttc

SEQ ID NO: 26533 - DNA, 831 bp, Bovine  19866880583083
aatgaatgaaaaacacctgttgctagaggaaataaacaacaacaaatccttgctgaactttttagacaaactagagaaaatcagaaagactctttattcagtgatatgggatgagtgtatcaaatgggagatctgttgtcagaatttaggcactaagaattactgctgaactaatgttatttattaggacttgtgtcctgatcctttacctgacttatcagaatgttgtgagaatccaccaagataaaagaatataaactatatacaccccgaaacactagtcaaaaaatatcagctgtcatttgggaaacatggaaatcagatgacttcaaataagaatctgaacgtctgattttttttagaaagtctagggtatcaggagaacatgttttgtttgtttgtttttcctgcatggaaaaactatactagagttgaacagctggtttggcacttcagtttacatttgcaaattacattatttactttacatcacatattttacattatgccatactaccaaccacaagctagctttagccttttgcccctggacctttatatatttgttcaagtgatgcccaggataagtactcctggtaattttaattatttaaaagcttatcaaattacatattttgaaatatttgaaaataaccctaagtatccccatgccactgttaaaatctccatagtcaatcaaactagaagtttttacccttcataaagtcactaattccattttcttttttcacttagtgttagttgcccagttgtgtctgactctgaaattctatgggctgtagctcaccaggctcttctgtccatgggatt

SEQ ID NO: 26534 - DNA, 3161 bp, Bovine  19866880716531
ggtttgggtaactctgggagttggtgatggacagggaggcctggcgtgctgcggttcatggggtcacaaagagtcggacatgactgagcaactgaactaaactgaaagggtagtagaatataaatgacacatcacttgtctcaagcaactgtttggcattctaaatctggttgcaaaatagctttttgtttttttactacacataatacattttcattgcaaaatatttagaaaccatagataagatgaaagaagaaaatgacgactagctgtaatcataccatcctaggtctagcagtactatattttggtatacattccaggacttactgtataaatacttaaaaacattaaataggatgaaactaacatgtgtttttaagctattttcaagtttttaaatataatgaaaatatataatttaagaatagatacagaaaattttatttgccatgcctaatgtacttagtgggagaaggcaatggcatcccactccagtactcttgcctggaaaatccatgaacagaggagccctggtgggcctgcagtccatggggtcgctaagcgtcagacacgactgagcgacttcacttttacttttcactttcatgcattggagaaggaaatggcaacccactccagtattcttgcctggagaatcccagggatgggggagcctggtgggctgccatctatggggtcgcacagagttggacatgactgaaacaacttagcagcagcagcagcagtagactaaggttagggaaccattgagatgaaccactgcaaggagataaaatcagtcaatcctaacggaaatcagtcctgaatattcattggaaagactgatgatgaagctgaaacaccaatattttggccacctgaagcacagaactgacattggaaaagaccctgatgctgggaaagattgaaggaagaaggagaaggggatgacagaagatgagatggctggatggtatcccttacttgatgggcatgagtttgagtaagctccagaagttggtgatggacagagaagcctggcattctacagtccatggggttgcaaagagtcagacatgactgagtgactgaactgaacagaattgggatggattttgcagagagggcaacagactgagttcaactgcaaatacaacaagaaaaagtgggatttatattcaaagaacaggatggagatcagtaataagaaattttcttagaagaaatattagtggtaaggatggggtggggggtttctggctaataagatttttgttaaagacaggctaggacgttaatcctagtgtgtagttaaagattatacccaatcagatatcaaaggtgattagttatcaatgatggagagttctggctaatttgatttagcaggatttttgctaaaattgaacagaccatacaagacatacacaaaagctgaagagtagggcctttgagaagatattatagatgagtctgagtagaatttgatcaagaagagaatcttagtcatacctgtaaagctatttcttaaattacatagcactgtaagacttaaaagaggattaaaatagatcatggcctatgcttgcttctgagagtggtcaaggggtgaagtttactagggaacccattatgaatcatgggagtaaaaaacccaaaccttcatttagtagagatgaaagaagtaattagtccaaatctcaggaggttatagataatcatcatgaagaggatgtgtaaggaacaaactcaaaatgtagtgcaatcagatatctaccaagaggctgtgatgccttgattctctcatcctaaaacagtaattcattctccagtcagaagatgcactgcatataagtatgtctcatgtccatgctttagactaggggcagttttactgacctcagtgtccagaaatgaggaccagaaataacattgtctgtaggcactgtactgtcatatttatgatataaatagcaaaagcttgttcatgattcattatttgtgagtgcatcactacttttttcactgacattgaacagaaagaaaaccatgattgatgagcaagagagaacattgacgaaaaaagataaaatgtcataaggtcagttcagaagtaactgagcagctggcacagaatttttaaacagtctttattgtgataagggattgcatttaatatgagcgtttttttcctaaaattgtggatatggaattcactaaaaataattgtatacatatgaacaaaatgctatttttataagcacacagtatcttaatatctattatgaggctgggttcccactgaaaatattttcaatttatagagtaataatatacttatccattggtcttacttaaaaagctacattgaatggagatatagaaaagcactgacctccgggtatgatggaacaggaaatgtatatagggaatgaaatagatgtatgaaatgtagataaaagttaccctttaaagagaaattcaagtaccattgctctctaaatttgctgaactgtatatagtggcaaacatacaaccctagtctatgaaatatgaacatttcaaaaagttctttggtttgaacttgtaaaaggacacactagagcttacagagagaaaagcaaaggaagatctgagaactcacaactggtttgctctcaggattcttagaagattatgtttgttacatatataaaactgctaagatttaatataaataggataaaacttgtgttctaaaagaatggcaatcatataattaatttcagggtttcgtttttcatttaggttaaataaaattgtttaactttgctttaaaaagaataggaaactgacccagataatctgcatagtagatatgaaattctttgtaagtgagagaataatccaggagtcaaactgataatatcctctgattgtttgtctgactctttgcaacctcatgaatggcagcccaccaggcttccctgtccttcactgtctcctgggatttgctcaaactcatgtccattgagtcaatgatgccatccaaccattttaccctctgttgcccccttctcttcttgccctcaatctttccttgcatcaaggtcttttccgatgggtggactcttcacatcaggtggccaaaatattggagtttcagcttcaacatcagt

SEQ ID NO: 26535 - DNA, 1709 bp, Bovine  19866880818347
cattaacagatgaagtatcatttaaattaaatgcttcatgtatttcattattttaaagtcatcacatgagtttacagcaagtaagcacacaacttatgacaatttacttttggcaagtaaattgtctgatttttggcaagtaaatttggggatcttctagggattggatctgtatgttctcactcagaaacaatgaagagtgacttccaaacttgcctctattcttaatgagtttttctgtgttgacaaagaagcatatttgagcttgttgctaaatgagaaaagtgtgatgcacatattttcatgctgaggcagaatgcaaactcaaattcaatgactagattttttaaaaaattatgactggattcctttgcaatggtacaagggtaaaatgtatggaaaaatcttgaggtgtttttgaatcaaatgtgaacaaatatatagtttacatctattttaaagaagaaaaaaaaatagactcagaaattaagtgacttacctaaggttctaatacaaacagtataggcattcatgttgttgtgaggcaagtgcagagaaaaaaagcaagctgggctctcaggaaaagggaaatttattagagggaaatgagagggtgactggcccttaagaagaaccagtgtcctccctttctgatggggtctctcttacaccctgccaatgaaaaattctctgactgctgctgctgctaagtcgcttcagtcgtgtccaactctatgcgaccccatagacggcagcccaccaggctcccccgtccctgggattctccaggcaagaatactggagtgggttgccatttccttcaatgcatgaaagtgaaagtgaaagtgaagtccctcagtcgtgtctgattcttagcaaccccatgggactgcagcctaccaggcttcctctgtccatgggattttccaggcaagagcactgaagtggggtgccactgccttctccaaaattctctgaagtgatggttaaattttagcctgtggttgagccccgtgttcatgtagccggaggtcaggaatctggtggtctcatagccttgagaatgtaggcaacagaaaacaggaatgttgtctgggcaatttggtcagtctcaaggatcactgtgatttttattctttgtttgtgaggtcagcataatgagccatttctaccatgagcctccatggaggccctgtcagttattctttcttgtctttatttattaatttatgactacttttcttctgctgaatgtgtatttcttaaaaggtattatacagtgcctagagccaaaatggagactgcgcccttttggatttctgcacttgtgtgttttatgtacagggttatgggggaaaagtgtttatgatgaggtggagatagcaagttgagatagcagagataataatctggggaattagatgagatgctcggattgacatttttagagaagactagtgtttgttctttggagaaggcaatggcaccccactccagtactcttgcctggagaatcccagggatgggggagcctggtgggctgctgtctacagtatcacacagagttggacacaactgaagcgacttagcagcagcagcagcagcagtctttgttcttatgggttagtgtctcattttcctctctcccttctcagcaacataataaaatttgttcccaacactaaaagtgtaaaatacaaaacaaaaaa

SEQ ID NO: 26536 - DNA, 1564 bp, Bovine  19866880883053
ctttcccccttgactgattagttttattatttatccaatttttaaaactgtgtctttggcacacctgcctctgggtagaccaccccaattaaacacattaagggaaatgcacaaaacatggtaattatgtaattaatcagttctaggtaatataacaaattgctagcctagaagcataacacttagagaaagggcaattttaagaatttaaaaccattttaatcattagactttttcttttgaattttacatacatatatgtgtgggctaggatatgaaggtatttatttctttatagcaagactcctttcacaaagtaaaacagcttccccacttggcaccatgcttgaggacactagagaaacaactgatggagaatttatgggaatgtccttaggtaacctaagtacattttaatcttcttagagttatatttataatgtattcctaattagtacattaataagtcaaagaggctatagaaaatgatctgcaacagtacatttaattacatggtttcattgtgctttgctatcatttttttttttcaattaagcttttatatactcccccattttttgtgaaagaagatagccataggaaggccacactggcttcatttgcatgtgactgaaggataaaatgaagctgtcagtttccataagccacgcaatgtcctgaagctcagctctggcagaacaatgtctagcatacatcaggtagtatatctgattattatctcaaacactgcgggaaaacctagtataagttaccatcttttctctctcactgcatattcagtattcagtccactatggcctaagttttgcttttgtcttattgcatctgttttagaaaagaaaagatatcttagaaatatgaaagccagtatgcactttaaggttcagttaacttgaattttctgtgttagtagacattgaccactgtatcatcaagcattgaaaaacatttatggaccttaaaggagaaattatattaaaaacaggtaattagaaaacataagagtattgctgtgattttggtcatcacacagggtatggtatataattggtagttgtcactcaatatctgttctcttggcatagaaacaaaactctgatttagttggaggaagcgaagtgcctagattaaaacacagagaaacgaacagattttacaatttgcagtgtcctctgcagttccacatagccatataactaaagttttgccaataatatgtaagagaaggcatttggaagagacttaaaaaaacagatgtaaggaatgtttacttctgtttctcttcatttttactgtctggaatataaatgccatagctagagttagagaaggcatattttgattcttataaaaatgaaagccagaagccaagtataataaagtggaaagacataaatgctcaattccctgatgactctgaaattaacatttgggactgcccattctgattatttttttttaatggagatagtaaaatcccaaatcctttaaactgccacaccaaatctctgtatctgatacaggcacaccagaatcacatgtt

SEQ ID NO: 26537 - DNA, 788 bp, Bovine  19866880945620
atggatatttaaaataaattatgatgaataggatttggtctctaatgcatactcaaactgtaaagagatacacagcagtaatctgtgtgactaggtgaatggcaaatggattgtgaatctcagccctaaatttctcctaggtctaggtatagtgggacagcactaatttgcaaatgttctgtaatgtatgaacatgtataccataatgtctaggaaaaaatacttaaggctttatttagtcataaatactagtataaagtttcacttagacattgtgaaaattattttttaatttattttatatgtcctcttgatttctaaaggctatttatcttaacaatgcattttcacatttttttataaagtctatgagtgaaaattgagctgaaatttaaagttgcaagcagttgtatgtcttttatgattctagtaacttatttgccattcttaatcatattaagcattcttttttttatgatatagagttctcttcagtggaaccatacactataaattaagttcattttataaatcttatgttgatttgagttgtatatttttattatccatagtattttttataaataattcatacatgtattctttttattttgaacatgcttcaatttgtctgaatttttaattacaatttgaaaagtccaatgcttaattcttataatctatcttaatgatgagtacattttattttctgcagtgattgaaagtatgaattcttatgcctaggtgaaactgtgtgtgtgcatgctaagtcattcggtcatgtccaa

SEQ ID NO: 26538 - DNA, 1348 bp, Bovine  19866880986395
tttggagagcttgcaatgaatatagaaatatgtttatcaaaaatcttctcatctcttcatcagttcagttcagttcaatcgctcagtcacatctgactctttgcgaacccatgaattgcagcacgccaggcctccatgtctatcaccaactcctggagttcacccaaactcatgtccatcgagtcagtgatgccatccagccatctcatcctctgcacagatagcactaaattaatccctaaataggctattgttataaaaaaaatcaaagacttgcttctaattatacatagatttaaaactcagttttgataaggactgaaagtaaggaacattaaattttgctttgtaagctcttccagggatgaattgcattggcctcttgaaatggctcatcatcatcactttcaaaggcatttaataattgtactagatctaaaccataacttacatgtgcatggatacttggtagctgtactaaggcctgagtcagcactggccatggctgagcaaaatcagtttatttggtggcttgcacccaactggaaaagggttgcaatattcactgtgactatgataaaccactctctctcatgttccctgatagaggagattttttgaacttactaccttgttgagattttgattatagtttcaaatgagatcctaagagattaagctggaaatttaaatatggcttttaacaattaaaaatgattgtagaattttgagtttgaatgcaattgagagataatataaacccaaccccttattttaaagataggacaaccagacacagagcaggatgactgttttagccctcacttcttgttgtcagccaggctggaatgagaatacaggactccagaatatagtgcaggtttgagcccctgtaatttgatgctaagtgccaggtttcagtatttagccatactaacataaaaagaaagagcaggagaggtatgaagtcagacttggaaataagactgatattgtttgtcagtttaaaaatccctgtgaatgaatttagcaaattatttaaatatactgatgctatgggcaggaaacacatcatacatgaaaccaactcaacaaatctttctcaataccagtatgaataggtatctatgatgccattattattattattattattatttttgcttttatttccaatattctgggaggtgggtcatagaggatcctgctgtgatgtatgtcagagagtgttttgcctatgttctcctctaggagttttatagtttctggtcttacgttgagatctttaatccattttgagtttatttttgtatatggtgttagaaagtgttctagtttcattctttta

SEQ ID NO: 26539 - DNA, 891 bp, Bovine  19866881039883
aaggggacgacaaaggatgagatgtttggatggcatcaccaacgcaatggacatgagtttgatcaagctccaggagatggtaaggacagtgatgccttgcgtgcttctctccatggggttgcaaagagtcagacatgactgaggggctgaacaacaaaaatgagtattcttatctatatagtcctctctatattttttttaatataaacattataaggatttagaataatttatattcaattgcatcatttttttctttagatcttcattctaggtttctgtaataatttttgtctcaggtcttgccaaggctgaaaaagtagaaatcctcaggctttgaagctacactgctacacataaataaggaacaattcaataagaaaatattataaaggctgggagaaatccaatcaagtcttaaaaagcccattcattttatttacaagactgcctttaggatgtgactcagaccttagcaaattatactttgcacacaatttaaggaagtttagttacctgaattccatgccccagtttacagtaaattggaagtagacagaaagaatgctagtctgacctcaggaaaggaaaataaaatctatcaaagaagtgacagaaagctcagataactcggggtctttcagtttatgaataaactttcctatgcaaatcaggacacctccatcctatcagtgtattatagcatagtacaattatgtttggtcataataatgacagtgactcatctatagcatcatcacctagcatttacttcataggagttatatggcaccattcctgctctcaaaaaatttaaaatccctctgcccagaaaatatcaaattaaattaggaatatttcaattggtaagttaaataacatggaatacaa

SEQ ID NO: 26540 - DNA, 2038 bp, Bovine  19866881115852
ggaacgaacctgggtctccagcattgcaggcagaccacttttactgtcagagccaccagggaaatctgattataagatggtgattaaaagaaataaaatagaaacctaactcagggtgaaaaatgtgatgattgggaaatactgaacatggagatagagcaggaaatcatcagaagaggaaatagaagcagaaaaggggaggaaagagcatgtgtctattctgcataaaacaaatcctatcagagaaatggaattaacccagcctgaagctggtttgctggctttcctgagggcaaagcgtcacaaatggggttaaactgaaggtgattgatgtccacagactgaaatgactagagccccctaatgctgagtagtacacaaaatctgaaatatatgcaggggccctgacttgctggaggaaaactgggaaacagcaatccttaatggcaatcttgatttgctactaatgcttttgagtcttaaggttttcagtattgcttcactagatattgatacttgagttctgggttattagcaggggctcaaataatgtttttcactcctttgtaaattactgaaaatttaaattttgtggcttcaaaagttaatcaggagcaaataagattaaagcctcagaaacatcccttaggtacagtcagcttaaactaggattaatgatcactcacagactatatgaatatattgatacaagtattttcatatatatcatacatatacatatatatacacacatatacttacagacagagaaacacatacttgcataaacacacacacaaatatatagcacccctattatcatttattagcttagcatgtaggaaaaccaaaacaattgaccaatgtcattaaattgttcatcttctgtaaaaaagaaaatggctaattattatggaatacttggagaacaaattgagatatatatgggtcatcataaagagcttgttttcataaatagaaatcaaaactgtgattaatagattcaacttatggaggaaatgacatatgtttaaattgcatactgaaactatttgctcaagtattgaaagtgggatgtggcgttttaacaaaagtaaaagatttctgctttgccacacaaattggtcaaagctcagcagtccccaaattccaaattaaacaaatactttttgcatgctcactgtagcagtaaattacatagtgcattataaattacagttaaaaggacagttttctttgaaagtgtgacacaagaccagaaagtatgagaagcaatcagcatcctactgtttcctctttgcagaagaaatgtggttagagcagtgaaggaaatggatgtcactagcataatgggcaaaccacctggtgttctgcaatttcaggtttctctgatttgctgaagttcctaatatgtttagtaacctgttatcttaatataaacatgcattacataatctttttgtttgtgtgtgggagtattaaagtggccctattcttttgccagctatattttcctgtgttccatttgtttgagaggggtagttggattatcaaaagtccaaatgggactatatgttagaaacaataaatccaagtcacagccaatccaattagaaatgtgaaaagtgaattctgatgagatgactcaggctctatacatgacatgctgtatacatctcacacataggatttcctcaaatgaattattgaagagcaacatgaattcattgtaagatgaaccttgataaaacatatattgtctctggtcaaaggataaatcaatgtattttatcagtaaaatatgtattgtgctctaaactatatattctcattaatatttttattcatgtggaattaaaaaatacctatgctactcttcttcaccacagaaaaaaacataagaaagtcattgtgggggggatcatagtcagcattaaagctgtgctatccaaagactggatattaaatctgaaatagaaagtgaaatgaagccagaattctcactacaaaggaaatataataacacctaaaacatata

SEQ ID NO: 26541 - DNA, 1011 bp, Bovine  19866881163431
ttggatgtgttgccttccctgctggctcagacagtaaagaatctgcctgcaatgtgggagacctgggttcgatccctgggttgggaagattgcctggagaaggaaatggcaacccacctctaggatacttgactagagaattccatgtacagaagagcctggcatgctacagtccatgggattgcagagagtcacacacaattgaactactaacactttgatatgtttacttctcaggaggttagaaacaactttttatccttactttgtccaggacaacataggacaatgttagggttcttgatgggcaataattgatgataccatgggtaattgtgggtgtaaaattactcttctggctctgtaaatgggaagtgtgctgttgtgggaaataatgcaataataaaaattaaaaagtggtggtgatgatggtagtgacaccggcagtggatgactaataacacagtcaaacctttaactcttgggtgtaaacactgctaccatgacaatcagacacattctttggtatttgagtaagaaaaatctcaacttctccatcaaatactaagccaaacagattgtttatgtgaatatgtgtgttcttatccctagaacagacagctgaagagaggttatctaactaaaaattactatttttttttcaaaaactatcctacagatgttaaaatgaatttcagagaatatctaatgcaaagaaaaatcacttaatactcttttaagactcttcattgaaagtataaatacatatattctaattatataaaacatattgcatatatatatgacagtgttgcagtgttatctgtgactttctttataattgatttgtttctaaatttttaatatatagatttatcatcagggggaaaaaaaaaaaaaaaaacaagcaatgagtgttacaagaaaatctgcttaaggttgaatgtgacacttcaaggatgtgccagcaatgaaaaagagcaagattgcaaaactcattgcacaggaaca

SEQ ID NO: 26542 - DNA, 1307 bp, Bovine  19866881193693
tctacctcaagtgtttggccctgaggtatttcttctcttcatctggagagtctttttgttttaatccctgaacatttaactctgttaatcatctctactcagtttctctgaatggcaccacccagtctaacttctgtccttcagaaatatatgctaaaagtgattgcttataactctacttcatcttcattccaccttttcaagagaatgactgatttccctagtaaaagttgtttgaatttataggtaaatctctatttttgtagagcatgatttttgactatttactgaattcctaacagtgggctgactgatgtatgtaaatgtgtatattttcccatctcagatgcctaaggttttctcttctttttctaacctcactattcaacttgaacgtctatgggtccaagaatttaaacaatgtaatgatgatagcagagtgatcacaaagaaagaagagggttgccctctagctcaaagcttttaacccaggcttcagacacactggtgcattttaattactaatgccatttgtgacagggtccataatttggtagtgataataatagtcaaattctgaaactggagaagggttttctattttcccacaaattagaatgacttcaaggttatccttctaattatatcctttcacttacttgccttctaatacacttcttggaaaagaactaaaatatatttcctaataattaacttgctgctgctgctaagtcgcttcagtcgtgtccgactctgtgcgaccccatagatggcagcccaccaggctcccccatccctgggattctccaggcaagaacactggagtgggttgccatttccttctccaatgcatgaaagtgaaaagtgaaagtgaagtcgctcagtcatatctaaccctcagcgaccccttccaggcctagaagcccactttatcaataccatattcactgaagtgggcctgctcataagaaatatattctgcatatgcatgcacatcacagcagaaaaacaaagttagagatattatcctctgggaatgggaggctgagattaaacagagtattcctcttcaaagatgttccccataacaccaatatgacctaatagtgtgggtatcttctcattcgaggtctaatttacttttaataatctctgtttcatacatttattaagttttcagttcatattggttcacactccacggtgttttctgtggtagacactagctgctaagtatccaatagtcatttcttttttcttcattaataactaaatttctatcgattttattcaggcttttctcccag

SEQ ID NO: 26543 - DNA, 986 bp, Bovine  19866881194872
ctgaagttacatgctaaataaaactaaaaatagcacgtgctatatatgaaaccaataactttttatagcctgatgaaaataaaatctaagtactcttcagctaaattatcttttcttacttttcaactctcaccttttattcttatctttccatctctttgaaataatttagtatgcccatcattctttttttctaacattgttctatcttaaaacctcctttttctggctaatcttatctactattcagaaacaagaaatgctatttggtatccggaaaggagaaattgttttcaaaatagttttacaatgagagagagaatctacttaggaacaggatccaggctatcaatgtggcaagatgaaaaagtatgctatgttctatctgagaaaatttgctaggcttaatttaattacacttagtggctgcaggggttgggtgtggatatgggtctgtatgtgtgtttggtttgtatatgatgctagtctttttaaattaaaaggtatcaggggattccctggtggtccagtggttaagagcctgtgttttcactgctgagggcaagggttaaacccctggtctcaaaactaaaatctcataaaccatgaagtttggccaaaaaaaaaaaaaaaaaaaaaggaaaaggtatcaaacattactttttgttataatttaaaaggagaaaaaaatacagattctattcagaagatatttatgaattgctctgtgtgcagcagagttatgttataaaattgtcataaattatatgaggtcacaatcattttttaacaaccatgccccaaggcatgtgggatcttagtcccctgaccatggatcaaacccatggcctctgcattggaagcacagagtcttaaccactgggtcaccagggaaatccctaggttaccatctttatgaaactacttcattatctaagttctgtttaccaagttttactcaaaatttcataatatagaaatatgtt

SEQ ID NO: 26544 - DNA, 723 bp, Bovine  19866881527433
tagagtgcaaaatactaagagaccaatagggcatgccttatgagatggcaaaggaacagcagtggaaattagtggttatcttaattattaaacatgagtagtcactggaccaacacctggttctaaccaatgatcaggcatcccagagtgacacaggagagtgggtttactataggtttatagagcattctttagagttcttgtttattcagttcatgcccttagcaaggatgcaatagacatcttttattttaaaaactcaaattggagagagattaaactagactcctaaaataataaaattcttaaacttgataatattttttgtaagtcctaaaagaatcttcttaaatattttattaaatataaactaaggtacattttctttttaaacagagctgtgccagttatcattaacactttagagaatgtttccaaattgttgtttttgttcagtcgttatgttgtgtccaattctttgtgacactgtggacttcagcacaccaggcttccctgtccttcactatctcctggagtttgcacaaactcatgcccattgagtcagtactgccatccaaccatctcatcctctgtcatccccttctcctcctgccctctatctttccccatgaaaagtttccaagttggtgttttatctaagagaagccctgaagccctgaagggttttttcttttttttttccccttgattttactaatcagg

SEQ ID NO: 26545 - DNA, 809 bp, Bovine  19866881644278
aatttaaaaagatagtttagagataattttaaaaataatatgtgatattttcaatgcagattaaaaatattattgcaatcttaaacagatcattctttttttcttaatgagaagaccatgaactcccattaataagaggtaggagtgaaatgtcaaaacacttaaaggaaatacaaacagttacatctttctctggttcctttagactatgaggaaaacattgacttgcgcatattatacacaaattgatcaccattccaaattatgttcttcttcaatagactgaatcacagggaggaaacccattcaagtttaattctcactgaaaccaagctggtggaaaattgattctctttaaaaaggtacgaatgttgtgaatctttaaaaggtctgaatgttacccttgcagactttcccttgattaggatcaaaagattagagtggccaaacatattcagcggaagtaaactcatgcataaagtagaagagaaaactgaaataaaataaacactgttgcaaaaatgttgatctcatggttgtaggatccatgaaggaaaacagggcttgatctaaaatcatcttttattcctcaaccataataactcacacacatgctggttgagataaaacagtttttaattgctacacagaaaccaccagtgctgatttttctaggcaatataaagggaaacacacttagatgtttcctatgattttttcatctacctcagtcaatgctgatacttgaatcctttctcagtagtctcccccaaacacttttcattttgattttatttgttaagcacaaa

SEQ ID NO: 26546 - DNA, 776 bp, Bovine  19866881819139
ggttaaggggaagctggaaaatgtgcccaggcctgtaagagatcgtgtacatgattaatgccgaggccactgccaacaggaaaaagagggactcccacagttggagagtgtgattgtatttacagtacattggctttgattaatgtgtgcactcagagaagtaatgtgtagaaggcaagaaaaagacctgttttcaaatgcttggtgcttgagtacagatttcccattatgtcctaaggaagtatcgatgaataatgacttaacagtcctagtgtttggtggtgatgcaggggttgctgctgccgcaggggttactttcccatgcatgagaacacgtacaaatggatttccgtgtcagttttcaccacccatgtgagtctggagagccaccgctgagaaatttatcccttatttcggtttcttaactgattgcttccaagaggtttcttaaatgatttcaatctaatgtcccaaaatgaccccttaacataagcagcaggtatagtttctgaatatcttatgaaaatatgtttcagaattttcaagacctgtaggtctgaaagaaacaatgaatatttataataaatcacctgaaaaatgttccctatctccctcagactaggacttctccgcttatctccctccatggtagacttgacgtactttcaggcaatggatgtgtgtgatttcatggacagccccaagaggcgagagagtgcactaaaattactgtgtcctgaatgaggaaagaacaacaccaggaacaaaaatagtct

SEQ ID NO: 26547 - DNA, 804 bp, Bovine  19866881943074
tgtagcaattggtccagaatgtccaagacttgagcgacaactaccaggccaacacctattttgcccctgctttcaagtcagtaaccatcagagaaagcaaaatgtgctacccaaaccaattccataagatgccctgcttcctccctgtgtaagtaatctccaattagagatactagaaatcttccctttttttttttttttttttcactttaaagctttccctgttccatgactgtctttttgtctctgccaaaagcaagcaatggaactgattttgctatggtgagctctgcatggtttctgtatgttttcctttggatggtctttgtttactcccatatttctaacagtttaggctccagtgttctaaaaccattcataatttaattctattctcctgaaatctctgcagattcatacaatatagaactatttggccacccggaaactggcgtagtcagttcaccaaattctctgataaattccatacagccatacattgaaatatcagatttcaggtaaaagtgccccctcactctatttttattaataatagacaattactaagatgtaatataagctgaatttttgcacattacttatcatattaggatgcatgcagattttatcatgtaaaaataactgacagcattattctcctttatgttaaagtatttctcattggcattactgaaaaatgtttccagtgattcaaggctccacaaagtaaaataaaccgattacttaaagggagcatattcttacaaaaggcaataataacagcctagaattaccctaacacaa

SEQ ID NO: 26548 - DNA, 849 bp, Bovine  19866880116361
tgctgctgctgctgctgctaagtcgcttcagttgtgtccgactctgtgcgaccccatagacggcagcccaccaggctcctccgttcctgagattctccaggcaagaacactggagtgggttgccatttccttctccaatgcatgaaagtgaaaagtgaaagggaagtcgctcagtcgtgtccgactcttagcgaccccagggactgcagcccaccaggctcctccatccatgggattttccaggcaagagtactggagtagggtgccattgccttctccgatttttctttcttagttgactataaaacctatataattaattatgctattagattagtttctcttcagttcttcaagttgtcttggctataaggtacagcttcagaaatctaagcttcagtcacaaaaaccattatcataatgctaattccttcaggtaactaaattggtttgtacacaaaaggcactcaagttattttctggtaacatatgtgaactcctacctctagcacatcagagactctgtggcagctcttgataaggaagcaagcctttgccacagttacagttgggcgcatcaagtaataacaaggtggattgttgtgaacaacagcttgccacatctcaaacaattttattattcttagagtcttacaagtgcaataaccacagtcctcacttctcctttgccttttgagtttttaattacacctggaactcattttctcagggaagtcacttgggtatatttgccccttggataactactggagaccaaaacatattctaagggaaggggaaaacttcttttttgaattgtcgactacttgtctacatggtgccaaacat

SEQ ID NO: 26549 - DNA, 3045 bp, Bovine  19866880120629
atgcttactccttggaaggaaagttatgaccaacctagatagcatattcaaaagcggagacattactttgccaacaaaggtctgtctagtcaaggctatggtttttcctgtggtcatgtatggatgtgagagttgaactgtgaagaaagctgagcactgaagaatggatgcttttgaactgtggtgttggagaagacttttgagagtcccttggactgcaaggagatccaaccagtccattctaaaggagatcagtcctgggtgttctttggaaggactgatgctaaagctgaaactccaatatttggccacctcatgcgaagagttgactcattggaaaagattctgatgctgggagggattgggggaagaaggagaaggggatgacagaggatgagatggctggatggcatcactgactcgatggacgtgagtctgggtgaattccgggagttggtgatggacagggaggcctggcgtgctgcaattcatggggtcgcaaaaagtcagacacgactaagcgactgaactgaactgaactgaagacttaaactgtcctttcctcattagaaaactctttagtaacatcagcaatatcagaagaatcttgctagaaagtcctagaaacccagttcttccaggatactgcaataggtgctgaaacgctcgcattactttctggttggcattacattgggccaataagaaataaacatacaaatttctctactacaaaaaaaaaaaggaggagattgaagataagctgcccttaaagtctggatatgggatggcaaagcataattctaattcttagactgacagaggtaccaatatgagagaaacagcacatcccagccattcggaagggtgttcacagctgtaaatccagataatagagagggtggcccaccctgctctccatctgccaggaccagataaacagtacacacgtcagcgtgaaagtgaaagtcgctcagtcgtgtccagctctctgcgaccccctggactatacagtccatggaattctccaaggccagaatactggagtgggtagcctttcctttctccaaggggtcttcccaaccaggtctcccacattgcaggcagattctttaccagctgagccacaagggaagcccaagaatactggagtgggtagtctctcccttctccagcagatcttcctgacccagaattgaactgaggtcccctgcattgcaggcagattctttaccagctgagctaccagggaagcccacgcgtgagcaggcaacccgacaaatctgaaggctcccctctctcagcccctctgtcctcaaagcctccaaggagattccagtttgtggttattcaagtataataatgtgtttggtacctgagcaatgcactatctcaaatcttttctatttaatgaaatgttcaagttgacagtcaattaaaactctgcatcatcaagcggctgacagatttcaacactgcctgcaattatgcaaaactgaaacaaaccaacagagaggggaagaaagaaaggaaaaggctaaaaccataactcgacaaagagaaccttaaaagggaaagttattcttcttgcctttttcacacaacatatgcatacctgaaaatacaaacatgtgcacacattcaaacccatacagacaagactgtcttgtcaatcactgatcaatattccattttgccagagacacctaacttcttacctagactccttaagtttcagtgagtcaaaggattgcaattccttcctaaaaaggataatgtttgtttaaatgcacacaaacacacatgggccttaactgctagtgaaaaaaaggccaatggtagccaggtgttgcaaaagagcaaagcatgccacaacctgatccttgctttctgctcttgaactcttgcattaattataacaaattacagggaatccaagtacagtttatatgtacaataagctccctaataatagcctataatttaatcaagcgttctttttaaactagaaaaactcattttctacaatacatcctagacagagaacgtcaatacgctgacagtacttctctctgtcctactatgtgctactgggtacagactgctctacggtaatcacatcaacggaattttaaagagctaaatacgtttccctgctgtgaactgtgatgccctaaagtagtgaaacaaggcaacagcggtagaaatacttcatctccaaaaaaaaaacaaaccacactgacctcaagtgtgtgatgttaaaacagaacctgagtctgtgttgccctggcggaaaaaacacaccgacttagaagagttcagcaattgctcagaacgtggagtcatcatctgacccagcaaccccactcctaggtgtacacccaagagaactgagaacgcatattcacacagaaactggtacacaaacagcaccatcgtctgtaacaaccaataacgcggaaacaatccaacacccatcaacccatgaacggataaaccaagtgtggtcgagtcatgcaatggaacaggatttggccacaaaaatgagccaggtattgacacactgctacaacacggataactccgaaaacattaggctgagtgaaataacgcaagacaaaaaaggccatgtattggataattctattcacacagaatgtccaagaacagacaaatccatagggatagaaagtagactagcggttgccagagtctgggagacaaggggagggggtatgactgctgatgttctgaaattagagagtggtgatggctgtgggtaactttgtatatatagtaaaaaccactgaactgtatactttaccatgattaaaatagtaaatattatattatgtgaattgtatctcaacaaaacgaaatatccaataaccctactcaggaggaagtcctgagacagcacaacaggctcttcagggttcactcggagctactttctttctagttttatgcctcagcaggcaccacacactgagttgccctgggtgtactgtgcttcccagtgccacgtcttgctgtttcctctag

SEQ ID NO: 26550 - DNA, 2892 bp, Bovine  19866880140512
acatggaagcaacctagatgtccatcagcagatgaatggataagaaagctgtggtacatatacacaatggagtattactcagccattaaaaagaatacatttgaatcagttctaatgaggtggatgaaactggagcctattatacagagtgaagtaagccagaaggaaaaacataaatacagtattctaacgcatatatatggaatttagaaagatggtaacaataaccctgtgtacgagacagcaaaagagacactgatgtatagaacagtcttatggactctgtgggagagggagagggtgggaagatttgggagaatgacattgtaacatgtaaaatatcatgtaaggaacgagttgccagtccaggttcgatccacgatactggatgcttggggctaatgcactgggacgacccagagggatggtatggggagggaggagggaggagggttcaggatggggaacacatgtatacctgtggtggattcattttgatatttgtcaaaactaatacaattatgtaaagtttaaaaataaaataaaattaaaaaaaaaaaatacacatgtatcctttaataatttgcatgttttgtatagatatggatagattaagaaatcaagtttctaagaatccatttcatggtaacttggtgtactctggccaggcataattctcagtagtgagagggaattatttttcacatgtccaccaggtattctattaaatctttttaaaagaattatgacagttaattcatttcctggtagagagagaacattttctcctctagtttagggtttcaggagataatatggtatactagagaatttcagccaaaaaaaaaattcctggttcagaaatgatgcagattttgagtcacttaactatatgttcaaataaaatagtatggctctttcataggaaaattttaaactgtcaaagtggagtataaaacataagaaaatgaaaatatgacatatgctgaaaacagaaataagaatatgaaaataaacagaatcttgttctttcattcctaaatacaggaagacttattagatcaaagagcccataagtactcacaggcatattgagagtatgaattttttactatcctgaatttctctcagattcatgaacatcagtctttgtgacccaaatctccccaaaataaagtgatcagagggtacaaaaagatcaacattagagttaacaagagccacttctaagtttcgctgatacctagtatcaggcccaggtcaaaggcacccggggcctctctcacgggcatataaatggcatgaatgccaccaccttccctcactactcctattctcaagaggttcccaggctgccaaaataatggccccagccataatcctcccactgctcatgactggggtcacgtagaggaaactcatttgcactgcaacctatcaccaactctggatattcactcaatttcttaaagaaatgtttaatggtgcaaattttactttacttgatttgattttagtttttacttcttattcagtccctcctcctaggtcactggcaaagctcccctgggaggcagggccatttgctactctgggtttacaccattaaccaggtatttacggctggctgagttgggaaggaatacagacaggcgtcacttttctgccccatcctcaatttcacattttacctctactcactacttaggtatttatttgcaatactaacagaggtatgggcttccctggtggctcagatggtaaagaattcgcctgcaatacaggagacctgggttcgagccctgttgggaagatcacctggaggagggcatggcaacccactccagtattcttgcctggagaatccccatggacagaggagcctggtgggctgcagtccatggggtcacagagaggtcagacacgactgagcaactaagcacagcagtggaggtatactcccaatttataggcaggagttgagggtcaagaaaaggggtaaggagagagcaggctggtgggggatggagtgggaggcatagcgtctcttccccaaaaatccgcctggactctgttggaacacctggcttggtcaattagaaggaggtgaagaggagccaggcttcaagagctgtggcctcggtgacatcctggctcttctgcttttccatctataaaattgctgtgatgattagatcattattttatagtctgataaatagtaagccctctggatagaaaaattaggtcttcagaacaaaatttttcctttgaattgcctacttggtaagttaatgtgaaaattgaaaaaatatcttgtagatcttcctatgatatagaatattgcctttctaaagtacatacataattgaaaactgtgtgaacagtgtcagaaaatcctcagttcttgctctcccaaggcctagttcataaaagagaaaacttaattgctggtttctgcctaaggaaagaaaagtccattgcaaagttgagaaatttttgcttaaaaagaaagtgaaagaaaaaaatataaggggggaaaaagggtattagaaagaaggcaatggcaacccacttcagtactcttgcctggaaaatcccatggacagaggagcctggtccaggctgcagtccatggggtcgctaagagtcggagacgactgagtgacttcactttcacttttcactttcatgcattggagaaggaaatggcaacccactccagtgttcttgcctggagaatcccagggacgagggagcctggtgggctgccgtctatggggtcgcacagagtcggacacgactgaagcgacttagcagcagcagaggcagcagcagaacactgttcccactatctcagattatcacatgaagaatccaagcaagccattt

SEQ ID NO: 26551 - DNA, 2976 bp, Bovine  19866880440461
tcgctttagtcgtgtccgactctgtgcgaccccatagacggcagcccaccaggctcccctgtccctgggattctccaggcaagaacactggagtgggttgccatttccttctccaatgcatgaaagtgaaaagtgaaagtgatgtcgctcagtcatgcccgactcttagcgaccccatggactgcagccttccaggctcctctgtccatgggattttccaggcaagagtactggagtggggtgccattgtactagaatgtctataatacatgtacagcagcacagtccacaacagtcccaaactgaaaccagtccaaatgtcctcacagtagaatgtgcaaactgtggtgtatgtctgtactggaatattaggcagcaacaaaaaggactgagatctaactctcctatactgttatatggatgactctcacaaaatggtgactgaagaagtaagagaccaaagacaatatattatattagtcactttaaaaagttttcttgttctggaaagatctcagatgaccagccattttcacatatgtttctggagggaccacagtgttttcaccgctggcatcatctgtgtcaacccactggcgaacatccatgggtgcagctgtcatgtcaggaaaagcctggtagcctttatgatcatgcccctggaggatatgaatgagttcatcacacatattctggaagtagtcaatgcacacatgatgctgagcaactctaacagccagccttcagcagggacagtacctatcagcaatccaggaatgggtgaagctgggagcttcagtggaaataacttcataccagcaaatggcctcattgtagcccagaaccaggtgctgaatttgatcaaggcttgcccaagacctgaaggactgaactttcaggatctcaagaaccaactccaacacatggtccgtagcctcaatcaagctagccgtggattttctaagcaacagggagcacatctattccaccgtggatgacgatcattttaaatccacagatgcagaataactggatctaattgggtatctgagatattttccagttggaccttttttttgcagcctcttgtctccagctgtgcatacaattggcgagttgacttctaggaagtagatttcatctaaaaatctcaactgacatccttttgaaatttactactactcttctgtgtttttgatggacttccctggtagttcagacggtaaagcgtctgcctacaatacgggagacccaggttcgatccctgggtcaggaagatcccctggagaaggaaatggcaacccactccagtattcatgcctggaaaatcccacggaccgaggagcctggtgggctacaatccatggggtcgcaaagagtcagacatgactgagcgacttctgtgtgtgtctgtgttaaaaagttttttaaaaaataaagtaaagctagcctatgttgtttgaagtcaggttaatggttactctgggggcatagagactgggagggaacaagagaaaggatgtgaggggctagcgatgctccaagttttgatctaaggactggtaaccgtacagtctgatttctgcacttgtatgtatcacacttcaataaaaatttacctaaaaaaatgactgatggtagagaaagaaggtagcaacatgacttcaagtggaagtgtctatgagagcgtggaggaatggcaagcacctggtataacaaacgataaaaggatagagagccctggatggcggtcgatttatgacagggaaagacagagctagctacaggaaaacgggatgtttagagaaggatttaaggtcaggagaaggtaggaggagggtaacagttcatcactgtctagctttctaggtcttgctaaatttggttgtgcaagagtgagcaaagtgccccagggagaggttatcaacaagcagtactgtcatcatcaccctgaggagcctaaagcaggactaccaggcaacagaagggcgcctatgaacacagacgctttaagaaaaagcctgtactctgcatacacttccagggccaggtatacaggagatactcaatatatgcatgaatatattctagacagtcctcagtagggggtcaagaataagatgtaagtggtataaaactaagacacatctatcagaaactacctgtaaaggcagaagatgttttaagttttataaagatcatagataaagaaaaatttagaagggcagagttctggcaaatgaaggatcagataagggaacaggactgggagtctaggagggagagaatttcaggagtggactctcccatgtctagtgttggtcgggagtgaaatgaataggaaaaggtccctggttctgaggtgggggttcccatggtaacctgcaaggggctcaaatgagccaaataaatgatgggcataatttctcaagggctccagatggaatggctaaacaaaaaatgatggaagcagtaagcagataaacagaatacaaacagaaacaccaggcacccaaaggtaatagaaatattaaatagtaattaagaagtaaaaatgtgtgacatgaatatttggggtgagtttttaaaatagaaaaaaaaaggttgattgaaaaaaaaaggcaaggaatctataagaagcagatattaaagatatttgaaaatcactggaaactggagcttgcctggggaaagcaatgacaatcaagaaaaaaaagtggaagggtcaaccttcttgcagacagcagacacccagtctgggacctgggtgaagggtaggagaagagaagcagcagctggaacatattaaacacagatatgggcacaggacgccactccagaagtagatgccagcctgggcttttggctctggatctgatcagggtggtttctttaaagaagaccctcatttgatggtctgtactgtcctttatcatataaagttctggtttcttaataaaatcataagaggagaat

SEQ ID NO: 26552 - DNA, 1472 bp, Bovine  19866880470646
ttaagtaactgtgaatagcaaacatttgagaacaaagacaatagaaatcaaagttaatgaaagcacatttagcagttgtcagtaatgacaccatcaaaaacaaaaacacagcagacttcatgaaattttcaagaggaggggaagggaaatggttagattaagagatgcataccactaaggcttccctggtggctcagaggttaaagcatctgcccgcaatgcggtgagacccaggtttgattcctgggtcgggaagatcccctggagaaggaaatggcaacccactccagtattcttgcctggagaatcccatggacagaggagtctggtgggctacagtccatggggttgcaaagagttggacatgactgaacgacttcactttcactttcaccactttgctcaaaatggcatatatccagaaatgatggagaacacaattattaactgaacttttaacacacacaatgtggatgattgaatattaccaatacatattgtaaatcactttgtccttctgcatttgaaaggtttagaaaatgatagttataatgctaaattcctttgtaatttgactatctcttcatgtaaagtatataaataaacatgtactatccgttagcttgggtcaagttctctggaaaccagatgcagagacacagagagtgtgtgaaggaaatttagtagcgggtactcttgggatcagcgcctatgagggagtgagggaagcaggtccgttgaactgtgatgcacagagccctcagctagagtctttagagtggcccagaatcagtgagtgacgtaaggcaactctggcttcatactcacatcagccagccgttggatacgaattgcccttgtcagtgggacataaacttggatgaggcaggtcctctgactcaggcagagtctcagctctgagaggtcagcagccaactgtctcggcagcctgtggaaagggtgccaagagcctgaaggggcatctgggtgacattccacagcactcaccccactacttgctatggagtattttctcttaggtaggacatatgtcttcatgttatccttttctgctaaagaataatatccattaacattagggagctaggcagatcatattgaaggagattttgttagggctatctgagaatagtgtatagaagaagaaaataagattaagaaaatcaaattaccactgtcctagggcagattctaataagtacttttctagacattcagtaatctgtatttattctttatatcaattactgtaatatccgacccagtgacctgagagatttaatgcagctactaaaaaatatgcctaattttcaataggcaacagttcttgcttgataatagctgtgctaatgttacatttgcttccttgggactctcagctttatcatttttttttagaatggaagtgatgtatggcccctcagacccctatgattatccttattccatag

SEQ ID NO: 26553 - DNA, 4071 bp, Bovine  19866880494938
ttttttttttccccttcataatatctctggtattcatcctgtctgtttagtcaggttctctagagagccagaattaaatagaatatatgtagatagccaaagagattttaggaaattggctcatatgatggtggagactggcaagttcaaagtctgtagggcagatgagtagtaagtcagagtggatgttttgaatttcacagagtaccaggctggagacacaggcagggattctatgtttcattcttgtggagaattccttctttaggaaagctcagtctttgctcttaaggccttcaactgtttggatgagactcatccacattcaggaggctaacctgctttacttaaagcccgctgataatattttaaatgttaatcacctctaaaaatatcttaacagccacacctagatgctgtttgaccaaacaacgggatacattggtttgccaagttaacacataaagctagtgagaagacttccatttctatttatatatatacataacttagacctatgcttccatcacctcatatttgaaattattgaaacacacccacactcaccccagactaatttgcctctttccagtttctccattattcacttttcttatgctattgctatattcctaaatattattgccttgaagttttccactgtcttacccagcctgtcaaattacactgactcttccttcattccattcatgatgttcttctcaccatctccacattgagtggctcagtttgtgctggtcatgtcatagctgagctgtaatgtttcctcctttaattttctagtactcttcttattatgggtccattcaatttatatctgctgcaattcccatgatgatcttgtatctctaaaacatttatgccgtccatcaccaatagcttacagtttaacagttagttgctctctcattgtttaatgtatctttgtcctctcaatcaaattgcaaagtacttgaattaacagctgtgttcatttctcttgtatgcaccacttcgcctagaacagggctggcaagtggctgcatgaaattgataattgcccctttcatgtatgtattgtggcaaaaaatcaagaacacggtgcaattcaagtttaaacaatgcatagaaatgacaactcagggccatctttgccatactgaattaggtctctgtggatgaacccaggaaactgtattcttcagaagttcctcaaagtgactttgattttgcaagtctaaatattggtattcaggaattactatatagacttcatcctattttttatcaccccattaattcacaaaagagttctgtgggtttttcctttaactagttcacaattatgcccttattgtcattgcctctggtaagaatgtaaggctttccttactcttacccgatttacatcagtgtcctcttagcttctatgcttcccgtcaggttcctctccagtaatgccttcaattagcagtcaaagtgtttgtgcttaaaattcagaagtttgattgtactgtttaagcataaattgctttacatttttccctattcagagtgaagttctgtcttctttacatgtcttgtaaagctgttcaaggaatatctgcctacctttatagcctatgcttcttctactgtctctatccatacaaagctacttgaaatagttttatcttttcgggagtctttgttttagtacatgcaaagaatttgtgctgtaatccatgccatttgttcacgtaatatttattgaattggtactatgtatagtctaggcactgccatacactgaaaattctggtattaaagatacagtctcttcctgaatcctactgctcagaaggaaaacaaaaactcatttaatgatagctactatggactgaggatatattatttaccaggactggactaaacattttgcatgaattaccacttttaatcttcataactacattatatggagctggcctagagtccaggtctttggaacctggagcctacattcttcactgctacacccctctgctgctatgttgaaagaattaagaggaaccacagtcatatcacaggaaacttaataaattactcatggtattgtctccttgattagcaagaaagaaaattaaaaataataaattctaatactttctttactccttctttacactgccctgtaactaatattttacttatttttgtagcatcagaaattaatgaagtgcctgtcatgtggcatgtaccaaataaaatttgaaagttcctgttcctttccttcagccttctcagatcatttcactagccctcagcatgtcaacactgacaaagctaagtatgaatctggctctagccttttattagtcatttcttcttaggaaagttatttagcctcttgttcttagttttctcctctataaaatgaaaaatgcaatagcttgtaagccatgctgaattttaataaaaggttaaagtaggaaaatgacataatcaaagatttgtgctttggggtaattaacactagtaaactctgtgtagttttctctgtaaaatactttaatggacaagactatgatgttaacagagggtatggaaagaagaaaactcatgcgtatctatgtaatgaagtcttcttgctgctgctaagtcgattcagtcgtgtccgactctgtgcgaccccatagatggcagcccaccaggctcccccgtccctgggattcttcaggcaagaacactggaatgggttgccatttccttctccaatgcatgaaaatgaaaagtaaaagtgaagtcgatcagtcgtgtcggactcttcatggtcccatggactgcagcccaccaggctcctccatccatgggattttccacgcaagagtactggagtgggttgccattgccttctcgggaagtcttcttacccaagtgataaaagaggtaagattcattctttacaactccctctttatagttacacagggcttgacataaactctagttttcaaacttattccctattgtaattctcaaataatttgaatcactctgtctcagtactgaaacacttatataagataatagctaaagtaatttcttacggattctgtaaggaagatgactaagggagcaaaaaatatttatgttaagggataaagcatataattgtgatacattcatggggaggatttgaagtagcctaaatcttgtcttttgagatatgtagctgagagataattaaaaattaaataagcaagaaatagtaacaaaagcattttatttaaaaaaactggtgctaacagaagaattaaatataaatgcttaacattggtctttttaaagactgaccccagaaggcaactagatctctgagattgaggcttttgataatgaagagttaggggacactattctgatttcttcaggcagctctcaactaggttctaaataggtgggttcctgggagacacaaacctacaaaggtaaaggaagccagcccgcaggaaagaactcccttccagacaaaggcagtgagttttgcagatatccaaggagagataccctactctaagagagcttatctatttttaaagttaaatacccttttaagttctagggttttacaacaggatagcttttttaattaaaaaaaatgtgttaattggagttctaattgttttaatgttatggtaaaaatatatatatatatatatataaagtcaaatttactatcttaaccattctaagtgttcaattcagcaatgctaactaaatgcacaatattctacagcagatttctagaaactttttttcttgcaaaattgaaactctatacctattgagcaataattctactttttcctctccttcagtccctggaaaccaccattctgatctttgtttctaagagtttgactactttgctgctgctgctgctaagtcgcttcagtcgtgtccgactctgtgcgactccagagactgcagcccaccaggctcccccgtccctgggattctccaggcaagaacactggagtgggttgccatttccttctccaatgcatgaaagtgaaaagcgaaagtgaa

SEQ ID NO: 26554 - DNA, 3428 bp, Bovine  19866880578558
attttttagatcattgcttatgaggccttgaactcacaggccttatatccacctctctaccttcagtctaaaacacttgcctacttgttcatggcattcctggacagccctcttcttcctctacattcaaatcccttcctactcccagcctttatccatgttgttccatctgcctagaacactctttctccagctctttgcatgactggtttcatcctcagaaactcaagccttccctgacccctcctgataagatggccaccccgagggactctgtgatcattaccccatttattttctttagaacattttcccaaacaaatacttatttgcttatttagtgtcttccctacaagaatgtatacactgtgagggtagacagcttgtcttgttcacagctctttccccagtgcctagcgcagtgtagaacattgaaaggagcttttaaaatactggttgaatgactcagtgcatattaagagaaggaacaaatgagtgaatgagtgaccagaaggaacatctggtttcccgatcttttgttggctcatctcagaaagtttttgatgatgacttagctatctgtggcactagtgggaaggaacctgtctgccaatgcagaagacataatgagacacaggttcaatccctgggttggtaagatcccctggaggagggcatggcaacccattacagtgttcttgcctggggaattccatggacagaggagcctggccagcgcctggattcttctgtatctggatttctttttctgacattctgggtcctcttacttgcagacagggtgaacgtgtgatgactgtttggctcttcaaacacccactctccccaccttgcaactgaagtacaaacccaggcttcatccttagctctttctttcctttcctccacacctagttaatcagccaccatgatgccttacgcctgcttcctaatatgagcttgactcttctgcttctgtctacgtccactgtcaccctgctctacatatcacaagtttccctgcctggactgctttagtagcatcccagagtcttgaagccttgcgttaatatttaatcaaatacatctctgacaccaaagccagtgatgtgaaaaaatgtagatcagatcgcctttctcctctgcttacattccttagtaacttgtcctgacactcaggtaagtcttcacctgactcacaaaaccttaggaagttgcccttatctttcacttcttttgtattgcttccccttctcccccagctggcatattctaaattctggctgtgatctttcagtccttcaggccccatggactcttctttcccttaagaccataggatgcctctgggtttgggatactgtttctcccccacttcatctggccatctcctgttcatgcttcaggctgcccaaaggggtactgctcccaggatttctctcctgtcctctctgcccagatgaggcactcttgctagatcctcctgaggcagatacgactttctctctcccaactcttgtcccttctagacacaagagttcctcagggaagagtcactttctagttggttcaccatttctggcatctggcagtgcctggcacataataagtgcttaataaaaatggcgctagtggtaaagaactctcccgccaatgcagaagacataagagatgtgggttcaatccctgggtcgggaagtttcccaagaggaggaaatggcagtctacttcagagttcttgcctggtgaattccatggatagaggagcctggcgagctatagtccatgggattgcaaagagtctgtcatgactaaactgaattagcttgcaaaaatgtgttgacatcaggcatatccctggattcttctctaatacagtcagtggaggttgttgggagaccttatttctctgtgctgttccactttgattctcacttttttctttttaaaaataattgtatttatttatggctctcctgggtctttgttgctttgcgtggactttagcgagtgggggctacactcgagtggcagtgtgtgggcttctcattgtggcggcttctcttgctgcaaagcataggctctgggtgcgtgggcttcagtggttgcagcgtgtgggcacaatagttgcagttccccgggctttagaccacaggctcaatagttatggtgcacaggcttagttgttacagggcatgtgggatcttcccagaccagggattgaacccatgtctcctggattggcaggtggattctttaccacggagccaccagggaagcccactgatacttactcttgacttcactctgtctgtaccctgcatattgccttggcacctgggtacccctccacccgcagtgtacccagactctggttcctcaaaagccaagttcagtttagaggcggctcttctcagcatactctgtcccactcacctttgctcaattcttttgttagatttggcagcaatcagagaggaaataagcatttttaatgcccattgttaaacagaaggaaactggagccccaaaatgaagtacttgcctcaggtagccattcttataataaagaagtcttaggtcacaggttgtccatgtgttaaaaacttttccaaattctgtaactccataacaagctaaacagaaggaaatgaaattctctgggatgacattcagggctttggtagattgccactctatcttgcccacccttgaaaaaatgcatgacaaaggatacttaatgagctccatcgcccctcccactcactttctctggaaagccctgatttgaggtgtgaggtccgcctgcctttggagtggttagtaaaactcctggaactcgtctgtcagcctaggtctcagcagttcgatctcattatgagaatctccctccccttcactcccactcagacgttcttttctgtatcttgcagtttgacacttacccatgaaacatcaagaaaagtcacttaaaattggatttttttttcagtcagaatgtcgaaaataacaagattcagaaggagactggagtaataaacttgacccctttcttacctcctctggccgttctttggcattcccttctcagcattgccatggaaaccgctgactcctttcttgtcagggtgattataccttttcagattttgacaactggaagatacaagtgaaagaaatccagactctttcattactgctcccccttccactgatgctgcttatgcaaattggagaaaatgggctttgttatgttttattttgtattctgctgacaaatacagtgcatctgtgaagtgcatgtgtgagagaagactggttgcccagacgtttggggaagcgtcggattttcttgcttttattatattactttaactacctgcttgacagatacagtaatcattacagattggaaatagctttgtcag

SEQ ID NO: 26555 - DNA, 955 bp, Bovine  19866880623647
acgaccatccaccaactgtacgagatgattgtgaggccatcaccacagggcctgtcagcagtttagtggggtcttaaccatttttcctacttatgagtttcttttccaatgagctatttgcatatccgccgtctccccactgtggctgcagacacggtttgtaagacagttagggtatgggtgcccttaatagattaaatacctgggaagcctgacctcatctagttatggataagtctgaggctaactaaccaacatgaggatcaaatccaaagttaaaactgattaccaactatagtttcctcaattcagaatcaagaaattgagtctggaaggggaggccaaagggtggactttggctgttctgttgggtttcagaaggagttttactagctcagattctctttgcccagtgtggtctctctccttacctcctctgtcttttaatggtgcaactaaaggtttgattctcctgcagctcacgggttcaagggaaatgtctgtcttctatattgctttctacttttaaaaaaaaaaaaaggaaagaaaagagtgccagtaaaactcttgtttttttccttccgatttccatggacagtaattttccattaagtcctgatccttcaaggcccccccttttaagtgtgctgcacgtcatctgaggtagaggcaacctttccagggatctgatctgttggccagatttactatgttttctgtgatgaaaagtatttagctgccttttaaaaccatacacttcctatggaaagaatatacacggggaaataatttccattcttttcttcttctgcttcagaaggtggtcctgggcaggcagttgggcagggcgtggtctgtcccataggtgcttctcaggacttctcagtgcctccttggtactgaacacgtatcaccctggttaggagtccttcctctttttcttttaaaggtcttc

SEQ ID NO: 26556 - DNA, 3285 bp, Bovine  19866880636939
ctcatgggagctgctgtagcacagggagctcagctctgctctgtgatcacctagaggggtgggctggggcggggggaggctaaagaggaggggacatacgtatatatacagctgattcacatcgttgtacagcagaaactgacacaacattgcaaaacaattatattccaattaaaaatagagttagttggagcaatgctgtgtagtttcagaagtgtcacatataattatagttgatctgcattcctcaaggaaaagaataatgacctcagtaatttttccatggagtcatatgcatttctgtaaaaggatttatctgtttcattatttcttaagctctaatggagagtaacaatattcaatgctgagaattgatacaactaattatctttttctgtgaagccatgtaccctcttttgaggaaataatgtttccatttagaaaataaagattatttatatattctaaataacacaataatactgatatctgagggaagtaaaataaaaataagatgtgatcacaaaattcagatggtaaattcctaagaaggtaggggatggtgcatccttatgtatagatgtggttcagtttgctactgctgactttctttgagtttgaaagaccatcagtatcattcttgtactgatgtacatgtaccacagtttgttgggatggtcttgtccaaatgtgtgacaagcaccacttcagcccctacatcagctgccactgttctctgtagtgccagtggcactctgttgttgctggttaatgggctaagttctgtctgactctttgcaaccccatggactgcagcataccaggcttccctgtccttcactgtctccaggagtttgctataactcacgtccattgagttggtgttgccatccaaccatctcatcttctgtcatccccttctcttcctgccctcagtctttcccagcatcaggactataagttggctttttgcattaggtggccaaagtactggaacttcaacttcatccaaaagtccttccaataaatatttaaggttgatttcctttagaatctattggtttgatctccttgcagtctaagggactctcaagtggcactgtagctagccatactgaatgaatacccaagagttgctttttttttaaccagtgtactgtgatgtgcttagctgctcagtcacgtctgactctttgcgaccccatggactgcagcctgttcctctgtccatggggatttttgaggcaagaatactggagtgggtttccatgccctcctccaggggatcttcccaactcagggatggaacccaggtcttccgccttgcaggcagattctttaccatctgagccaccagggaagccctttttaaccaatatcatttctttaacctctgaaggtgtttgtgcaaggaacattcacttgagtaagttgaccttatatcatattacaaaaactccctttgattaggaagcagccttgaaagactgttcttggaacttgtatttggccccagcattgtgcagggacctgagaatatggagggacatagttttcttctgctaatgacctggcaacagcatttggtcttccctggtcttcactcagggtggtaatgcctcctgatagtgaaagagctgggatttaacagctctttatcttgtctagagatggagaactaaagaatagttgcagcctgagccttgaaaagcttacagaagagtactttatcattattaggtcttatgggagaagtgcttttaatatgaaaggtttcatatgccttttgaaataagttagactttattctgaaaaccttagggagccattgaagaattttaactaagtggaatgaaatatcttgtcaacaggaaggcagatggattataaacaaagcctgatgctgataaatcagttgcgagattattgagattattgatggaatccaggtagtgcagaatgaagagtctgtggtggcagcagaatagagatgaaataaggatttcaaaattatttgggggatagaagagataggttaccctttagccgggggcaataaagagaaaggggggatggcattcatgattctagctttggatggaattacaaaacacaggagagtgagatattctgagtagacgagaggactgagaatgtcattttggacatattgtgattgagggctgtattggacatcgaggtagctcatcaagtgtagagaattggatatgcaagcctggaaagtaggaaggatgggagctgcagagagttggctgggtgggggctggggagagggcattcatcacacgacagtggaagttctgattatagatgaattcacctaatgaaaacttggaaagtagtcaaccatagagctaaaaacggaacctggaatacagtagttaaaagggtggatggagagagcataaagaatggggtagcaaataatatagttaaataccctgattcatggaaggtcaaaggcattgaggttttgaagagaggatggttcaaatgatggatcagactggctaaagacaatgggtaaagaaaggaacccaagggaagattgacacagtaacctaaaaaataaattagtgagagttctctgtgaggttgtgctccaagactgccactcctgtagcataaaatttaaatatttacccctggattcttggaggaggaaatggcaactcactccagtattcttgccaggataatcccatgtacagaggagcctagtaggctacagttcatggggttgctaagaataggacatgactaaaaaacaacaataagcaactaagcaacaacaacaactctggattgtacaatacactggatatatcctatgaacgttctttaggcacatcaagaacaattccaaagggtaatattcacagaatattttatggaaatgggagcgttggcgcacaagtaataaaaactgttgactgagcagtgcagcagcattgacactgggaactgctgagcatgcgtccgtggtaaatgtggacagtgtggtgggggggtggtgaactgtggagggacagtgtcaaagaggcagggaaaggaaagctagtctcgtggagaccagttagggagttcagttcatgtctaagtaagtgttcgtcacttagtcgtgcccggctctttgcgaccccatggactgcagcccaccaggctcctctgtccatgagattttccaggcaaggatactggagtgggttgccatttccttctccaggggatcttcccaacccagggatcgaacccgggcagatt

SEQ ID NO: 26557 - DNA, 801 bp, Bovine  19866880744592
ccccaaactactccaaggtataagcaaatatttagcattcttatttaaatcagaaaagatatattgtttgagttataataaggctaaaatttctaatgggatcttgagtgtaattagcagttactctgattagaggagcttcccaggtgatgctagtggtaaagaacccacctggccagtgaaggagaccaagattcaatccctgggtggagaagatcccctagaggagagcatggcacccatgctccagtattcttgcctggaaaatcccaaggacagaggaacctagtgggctacaatccacaaggtgacagagagttggacacaactgaagtgacttaacacacacacactctgattggaagctagatgttttctaatgtggtcttgaaattaattgccagagtcaggatccacctgtggcaactgatctccatgttctaaatgaagcagtggttaccactactgattggatacctctttagcaaagttttgagataccagaagtttaagaatttggaatcatctccatcatcagaatcttctctgtgtgttcatcgctcactcgtgtccgactctatgcaaccccacggactgtagcccaccaggctcctctgtccaaaggattctccaggcaagaatactagagtgggttgccatgcctcctccaggggatcttcccgacccagggatttaacccaagtctcctgcgttgcaggcggactctttaccatctgagccacaagggaagcctaggctactcaaatatgagggctaataatgaatgtaatatttttccag

SEQ ID NO: 26558 - DNA, 787 bp, Bovine  19866880765911
cttggggcagagaagcttaaaaaaaaaaaaatttgaggatttttagcaaaagagaattcaaatatttcaagatgtctggaaccttaatagcaaactgtcaagtagctcagcagcaggtggggacagaatgggtataagtgcattcttcaccaaatccacccatgaccgctgccccagagactctgagggccatcattccacagtgggaacagaagggcaggctaaatgtagtcagtctaaagacccccatcccctccccacttttactgttctgcatgcctcatatactttcctccatcactttgacttgttgagtttattgggatcagtcttgtgattaagagccttgtaaataaatacaaaacatttcaccagttcactcaaatgttttactgcctgacctcctgcttggaggttacacatggagccgatgaaaagaatgtcataagcattcttttctacccacctagactaaattgttatttaccccaggccagtgtctccttaaaggagctaaaatgccttccttgctttatgtaacacaagggaaaaataaaacagattcacagtggctgctgggtccacattccatttcacagaaggaattttagggaaagagagtcatttgttttcctaagtagagaataaaatttatctttgcaagtggcagtttaaagaaaaagagagagataaatgcatgtttgtttcaagtttttggtgaaaaggcatgaattagtacaaggtccatgacacatacgacatgttaacagagtaaataaaaagacct

SEQ ID NO: 26559 - DNA, 1407 bp, Bovine  19866880790097
ctctggacctggtctattttcctctatgacttgtcaaccggatcttatttgagactcaactggcttatcaggtacttcagggttaggactagtatataaagttttcatgctctatgcaatgagatgggaatggcaactcacgccagtattcttgcctgcaaatcacatggatagaggattatggcaggctacagtccacagggtcacacagagtcagatacaacaactaaaccaccacctatatgcaactcagctcatagtgtaacaagtattgttagcttaaggaaaaaaaaatttaatgtcttgactgtctatttacaagactgtgaacaattctctacaattatataaatggaagacatgctgagtattacctgtaacaaggtccacctgggaaaagatcaagatgctttcatacaatggaatattactcagccataaaaaggagcaaaattgggtcatttgtagagacatggatggacggagatagtgtcatacaaaatgaagtgagaaaaataaataccgtatattaacacatatatgtggaatagagaaaaattgtatagatgatcttatttgcaaagtcaaaatagaaacacaaacatagagaatatacagataccgagtgggaaggtgggaaggggtggcaggaactgggagactgggactgacatatgcacactattgataccgtggataaaacaggtaactaatgaaaacatactgtctagctcagggaactcttagtgctctgcggtgatccaaatggaaaggaagttcaaaaaggagggattatgtgtatatacatagctgattcattttactgtacagaagaatagtacattgtaaagcaaatatactccagtaaaaaattaatagaaaagaaaaaaaaaggatgctttcaaggacccagggaaccacccagccagacctactgagtggaatcttccaataactgtaggcagccaatgaagttgatggcctggtattagtaatatctcctctgggtcatgcccttgagcacatggcagccttgggatgacttatgataaggatattgcgccagaccacacccccgagcaactgaagaaacaggagcaaagacaggatatcactttcagtagatgaatactaagcagcttcatattactgaagcattacccagcaatacaggccacctagctaaggacaattttaaaatataaatgttagtatttgtcaaagtgtatacataaatctgaactgaaagtcaacagcaaattatcttttacaagttcatgtcctggaaaactgctttaccctgattcgaggacacaagcacttgttccagagtttttggaattgatatggcttagaatgcctgcgtatttacaaaactctgtcatccataaatagcggaaaacacca

SEQ ID NO: 26560 - DNA, 706 bp, Bovine  19866880881627
atcagcaataattatgtgttgtttaattttatctgcatataaaatatttctatcttctgggagcaaatatacctgacatcacctactgcaacaaggtttgcctcatgtctttttacttatttattttagcttacagttgagtctctgagcctccccagtaaggacaagcctagggcaacggctggtttctgggaccctttgttgttcagtcgctcagtcacatctgagtctttgccacctcagggactgcagcacgccaggcttccctgtccttcacgatcgcccagagcttgttcaaattcatgtccattgagtcatctcaccctctgtcttccccttctcctcctgccttcaatctttcccagcatcagggtcttttccaatgagtcagctcttcacatcaggtggccaaagtattggagctccagcttcagcatcagtctttccaatgaatattcagggctgatttactttaggactgattggttggatctccttgcaggccaaaggactcttaagagtcttctccaacacccagttcataagcatcaattcttcgacactcagcctttttttacagtccaactctcacatccatccatgactagtggaaaaaccatagctttgactagacagaactttgttggcaaagtaatgtctctgctttttaatatgctgtctgggactctacctattttgaatacag

SEQ ID NO: 26561 - DNA, 1453 bp, Bovine  19866880898871
atcaacgactggagcatgaaacaaaacgcagttagtagaaggggcagctatgggagtggcttggattaaagtgatgactgtatataaattcaagacacattcagggcacgggtcaatatggcttgataataggtgggtatggagttgaaggagagaagacaacatcaaagatgacttgcccaaccagatggatggggatgccatttgcagaaatagatgacactaaagaggtccaggtctggggaaagatgatgagagtcttcgctatgttgaagtgcttttgagaagtggagaaatccacttctggagttagctagatgaatatggaactcagagagaatccaagtccgagagggcaaagaaaaagaataaagaccaggcagtgagttttctgtcaatgcaccaaagtatcaataatttggaaaagaatgacagataaaaggaaaaaaaaaagttgtaaactgagaagcataaaacagtgaacgtattttgtaagattaatcttaggaaaataaacgttttatgaatcttcgatatataataagaggtggggcctagtgaataaatggtgttgagtcaaacaaaagagcagagtcaaaagtcctggtcattggaactaatccctgtcttttaagaaggggtagctgagatttgggtggggaagtaccatgtgtgacaaaagctgtataaacctttgaggtagggtgggatgaatgtggctcctggagttatgaagctttcctcttattaagataaccataataagttactctcaaaagttccaacccaaagtaaccaggttactccatgccatcttggaaccaacacatgagcatatgcaaaaccggtaagtttctctggaaaagacccttttaagtaaagtcatgctgaagcaaaaatcatatattaattttaatgcagttatgagtattcaaatagagacatcttttactttatacaaaagcaaatttatactcacactttgataaggaacgcaaaccacaaataagttatgatttttactagaacagcaaacattttttaaaggaaaacaaaagttgatctaggcctccagttcttaggcataaatagctatctcaaatcttcagaatgtctacatttcttttttctggtgttccatgtaaagtttttcttgatctctttgaactcctagccttcagaatcaaagcattctatggaattttttatatatagtgaggtgggatttagttcttcaatcatgtgttccttagaatctgagaaagaaaccaagccttatagcctgttatttttttgaaggtcatgacatattattcaattccctcttggctttagaagtttcactttttcctatattgcaagaatgaaatattattggaaaaaaaagactgtgtgacatgaactatggtagtagagtacagagatttatgtaacaaattaaaagaactccaaa

SEQ ID NO: 26562 - DNA, 1276 bp, Bovine  19866880946683
aaaaagagaaaaggctgttcaatcagcatctccaaggactaagatgatgtcaaccagactctcgataatacttcatcagtggagagttgagttgagttgagttgagttagacaatcagcttcttgagggcaataaaaagagactatcttatgagctttctctatcagcacctgggatagttcctggtccaaggaaattgtccagtaactgcaaatgtgttttatttcacctgcatggggttaaaaaatagtttttaaaaaggagatttccaatggacagaaaactcactggactggttcacagtggcatgcctgctcaggcttaccacagtctgcaccgctctctgttatatctccgtagagtccatttcactccacctccgtggccagtgtctgttttgatcgataaatgtcgctcccataacagtgaaacatcattaatagcacctctacatgtaggtcacctgccaattccccacaggcctttgagactgccacctctcccaaacattagccatctctccatctcatccacaggtgctcatctgagcttctgtgccctatgtatcttcttcttcctctgccccatatatctcaaaatatttggcttgttgacacccttatgtcacctgtagaacatggcttttttaatagcctcattcccctggaaagccctaagtaatttgtccagccttgaagcttaatcacacctcctagtcatcttcattgttggttagtttccatgatgtcttcgcagaaaaccccgcttttgctcacttctctggggctccgtctacccctatggttgccgtttattactggatttgaattctaaatgtttgggtactatttgtttacctaaaattcaggcaaaataaaacaagaagacaaagttttattgcagaaaaatatcctatagatcaaaaaaattactttcctaaagaaacttgaataatcagcagataagaaagaaaatcagaagcgtaaatttttggaccaattttctaagggttctgtgtaggccaagaaaatatctaaagtactaggagctccatcttaacactgaactcctgtggtggccagaatttggctgcatttcaaaataataagcatttggttcagaaggctgtttaaaggaaataaaaaggcataaaatctcagtcattcaatatggtttgtattagaataaattgattacccaaaacctaacgtgattagagctctgccaagaggctggcaagcaaccactgtgacatagtccaaattctaatcagtta

SEQ ID NO: 26563 - DNA, 1060 bp, Bovine  19866880955865
ttggctggctctgagtcaaaagggattgcagagcagtccacagagaacatagtccattcttgaatgcagagcacagatgctatgcaatcagcagttttgtgtcaaatattttaactgacactgcaaccgcctttagaggttgactcatctgcagaatattatcctcatctggtgtaacactggaaggcactgaaaattgataatgactgaatctcaattagacttgagaaaactggtttgtttgcccaaaacctcacagctagcaagtagctagcttcctaccatatgatgtcaattcacttctagcgacagagacttcctcacttcataaacaagagacttccgctaagtgggtcagtctttttgtttatattaagtcccagggctctcatttgtctacacagttgtataagggaggctctgaagggttaactagcttccccagtatcatacagttatttagaagcagagtcacatctggtataatcataaagaataatgtctttaaaagcaaataggcctaggttcagattctgatcttgccattgaactaggagtatgacttagggcaagctatggagcctgtctaaccatctgctttgtcatctgtaaaatgaaagtagtaactgtgctttctttataggtttaaatgttaaaggtaattgcaaatattatgtagcctcaattacatgccttgcaacaagtcttacaggtagacagagtattattttcctaactaataaaaggcagatataggttaaataagttgcccaccatcctataacagtaagtgaggagttcaaattcaaaaccagactggttcagaagcctgtgaccactataatactctgatataaagtagttagcacaggaactacaatatattaaacaattaactcagagctccttcaattacaccatgcatatccttccccatttctaaaactgtccaaagaatgacattccatactgttctgcaaagtggcacagccagattgctcagtcccgtgttaatcgtgatgtgctgcataaaatcagctcttccagaagaaaacaatga

SEQ ID NO: 26564 - DNA, 1523 bp, Bovine  19866880977078
ccaaggaggattcccagcccatcattgtgaacagaaagaaacctcacaatcaatgacacatcattctcttacaacacttattttagactagagattcccatggctggagggtattgccttggtttgacttgtcacttgccttttgccagtgtagaatctttgattatttctcgagtctagtggtggtgtgtgaaagttggatagactagcacttttcatttataagaaatgaagaaagcctcctctttatgttgtcctgctctgaagataggaaactgagttggagaagatattgatagaatcctggtactcagtggtctcccctttctcctctatccatactgagtttcctggtcaccagtaatgattagatcctatgggtcaaaccatgggacttaatactgggtggaaacttctgtttttatcatagtttctcagaaagtgtaattgattagttagttactttcattccatcattcattcaccaaacatttattaagcccatagtcagaatgtccttctcatttctggggcattacctcgttgactgaactggtttcttttgacagttgctgtggaaatgtggagctacctttaattaaggattctatccctaactatgttatatttcctcctcccactgcagtcactgatcttttggccattttcataggtttgcctttttgagaatgtcatgtagttggaatcagacagtatatacccctccacactggcttcttttgtcgagtgacatgcattgaagtttcctccgtatcttctcatgacttgatagcctagccacagggatgatcctcttgccagcctcctgttcgttgatttttactcattttctccttcaaaccaggcatattgctaacagcagtactgcttttccatctgctagctccccaacgtttgaaggatgttatgcaaactctttagccacaaagctggctctttcccaggaagacagatctctgggcagttgactcacccaggttccaggtgtaattgaagcactctttgtcccacagtgttgttgtaggtggtattacgaacatctgattttctttttcccacagtgttgttgtaggtgatattacgaacatctgattttctttttcccacagtgttgttgtaggtgatattacgaacatctgattttcggggcaggcagatgtgtagttggcgctgacgagtcaagacatatttattgctagtgttacggggctgcgactcccactctacagcagtggtgtagacgagccatttgcccgtgtcgagtgctcattcgaatggactttgttcctccttgatttgtgctgcttttgccaccaggaggatttacttcatcctgttgttgatcatagactgtgattcatccccaaattctttctttgcctcttggtagctcagaaagcagcgtaaataatttgcaggtaaacaaaggattcacatgctgaaagagtatttatttatttttattaagtctatttttttaagcagttttaggttaaacaaaa

SEQ ID NO: 26565 - DNA, 1489 bp, Bovine  19866881031834
tgacttcactttcacttttcactttcatgcattggagaaggaaatggcaacccactccagtgttcttgcctggagaatcccagggacgggggagcctggtgggctgccgtgtatggggtcgcacagagtcggacacgactgaagagacttagcagcagcagcagcagcagcttgtgaaaacagaagtatattcaagttagagggattcccaggtggcagtgggaaagaatccatctgcaatgcaggagaccctggaaatgccagttcaatccctgggtcagaaagaccctctggagaaggaaatggcaacccattccagtattcctgccaggaaaagcccatgaacagaggagccggctgtgctgcagtccatggggtggcaaagagttggatacaactgagcatgcacacatattcaagttagagtgatttttttgtgtgacccaattcaattgacaaagattaaagagcagtcaagacacagattgacgctccttagctttattgtatgggcaaaatgcacacacttagctccacatttgatttttacattcttacagatagtctcaaaatgaaataattaattactatctaatttatactttgtttttctttgggtacaaaaagcaggcatgttttcatttttccaacattatctgtccaacctaatttctaccctaactgaaatataaattctcatatatgatagcataatttcttccatggcaacaataaaagatgtgagagtattcctcgctgcaggtgaaaataatcataacatattgataagccatcttaagatgccattttcatgtaaatggccttataaccgaagagagaaaggagagaaatagaagcaaacgaagtggcattcagcaagcagaaatgcttggaacacaacatttttcagtggtttcaggaatgttgaggaagggtcaaattgaaagaaaatgtcagatcgtgatgcctcctgattagaatttttaaataaataatatttctttaaaatttactgaggaaaaaaggaaaagagctccctattccaagagtacaattaactgatttggcttctgtgtccctttgcaaattctttggggacaaaatgaaatatacagagttaaaaataagaagtgactctggagcttgactatagtactagaaatgctgtgggaatatttagatagtcttctagacaatgtttacgaactttaaggaataaaatttggaccctgaaatggaaatttggacaccttaacatataccaacttcattcacttttcaactcttatgctaccctaccatctcctgaaggaccagaagctgtcagtaccagcaagcaaaatataattaaagagcatgagtcaatgagtcataaatctgttccatttgaggcctgactcaaaggacatcactcatgggccctacatcaaggaactaagtgagggtggatccaggagaaggcttgatgttaagcccctggaaggcttcc

SEQ ID NO: 26566 - DNA, 1231 bp, Bovine  19866881111145
tatcgttctacacatagaaaatgtcagcatcctgatgtttggttttgcattattttacatgataggtatgtgggagtgagatgtgtgcagcgtatgaaaatggaatgacaatcaacatactttgatagtgtattaaatgcaaaaaataatctcagattcttcatgaggtctcaattagtatagaattgatgttatcagtggttgtttaaattttaatttgaatgacatagggtaggcagtgaatattctcttaaggaaaaagaagttgaaatctttcagttaatctttttgacaaaaagcaactgtgtagaaagaaatgagtacctgtaataatccgtgcttcccctctcctaagactcacttcagaattgttttcctttgtaatagcttctcttccctatgagtgttgattttcaactgattgttgctctcttaaacgttagctcctggcattactttacagtactcagactcagccaagagtacaaactcaatcccttcctagaggacattgtgacacatttctctgagatttataactgtacgttaaatttttatatttaccgtgtgcggtagttgctctccatgtatgttccctagtgaacaagggaggctctttgagagtaactccagaattctatctaggttcattctatctaggtttcatgcattccctctttaattagaatgaatataaaagagacagttaagcacacacaataaaagaaaccaatgactgtgttttgtgctgcttttccttttatctcccttctgtgtatagtcaatgctccattgttgttgtttggttgctatgttgtgtctctttgcaaccccgtggactgccacatgccaggcttccctgttcttcactagctcttgcagtttgctcaggtcgtgtccattgagtcagtggtgccatctaatgatctcatcctcttctgccccattctccctttgccctcaatcttttccagcatcagagtcttttccagtgagtcagctcttcacatcaggtggctaaagtattggagcttcagcatcagtccttccaatgaatattcagagttgatttcctttaggaataattggtttgatctccttgctctccaagggactctcaagagtcttctccagtaccacagttctaaagcatcagttcgttggtgctcagccttctttatgttccatctctcacatctgtacatgactactggaaaaatcttagctttga

SEQ ID NO: 26567 - DNA, 2618 bp, Bovine  19866881189778
tttggtatgaatatggatatttaaagatactagaatgttgatagcagaagaaaggttataggagataaggaagaatgagtttccccttttatagaatttaagtccatgtaaacaagtattacctttcatggatcactgccagtagtcatgtagggatgtgcgagttggaccataaagaagactgagcaccaaagaattgatgcttttgaattatggagttggagaagactcgtaaaagtacagtggactgcaaggagatccaatcaatccatcctaaaggaaatcaaccctgaatattcattgcaaggactgataaactgaagctgaagctccaatatttagccacctgatgtgaagagccaactccttggataagaccctaatgttgggaaagactgagggcaggaggagaatggggcaacaaaggatgagatggttagctagcttccgactcaatgaacatgaatttgagcaaactctggaagacagtggaagacagagaagcctggtgtgctgccgtccatggggtcgcaaacagtcagacacaacttaatgaccggacaacaacaaagcaagtattaatgcacactactcaatacttcagtattaactattcaaactcatttaagatcagcatcttagttaacattttttctgaaagattctataaaggaaattttaacccggaagctctttctctctcgcttgctaagtctattcttgtagacagcgcctggttagtgctgatggtacagtttgtactttcggtaagaagagctccctgctgtttaatttttaactttttcattgctcctacattcaactacttttttataaagtgattcctgttggtatcaaatccttaccagctggtcctgccagacatttattcgaggcagcagcacagatgaaaatcaaatacaactatgaggaaaataaaataagtttatggcaggctgtattcaataaacaaggagcaaagctagcattttcctgccctcttaaagcaataacagtattactacaaacacaaaaagggcacgctttagaacaaattctactttctacattggccatcctacattccactggcatcctggaatgtggaaacttggtttgagggcaaaattcaactcaactggcaataagaaagtctctgactcagaactcctgaaatgttcatgggagattttttgtaacttctggttgtctttgggtatgtaaaaagacaaggttgttttggaaatacccaaggcttggaaactatttttttatgtaatagtctggggtgagaaacatgagtgtagctactgcccaagcagtcagccagtccttagaactcataaaaaccagaccatttaagcgtgagtgccttttaggggatagtacaagtggttttgcaaggtttgctggtcatttacagcagacgctgttgtcaacctttcttctttgagggcagagtcctggttttgttcttaaaagggaacaactgaccatggcatgggttgtagaatcttctatttagccatattcaaaagcagaaatcataagtcagaggagcttttacttgttgtgtatgaaggagccataagaaccaaaagagcactttcaaataataacaatttcagtattatctttgccattacatgtcaaatatttggctaggtattttacatatctcgtttgtttctcttatgactattgtaacatcagttcagttcagtcgctcagttgtgtctgactctttgcgaccccatgaatcgcagcacgccaggcctccctgttcatcaccaactcccagagttcactcacactcaggtccattgagtcagtgatgccatccagccatctcatcctctgtcatccccttctcctcctgcccccaatccctcccagcatcagagtcttttccaatgagtcaactcttcacacaaggtggccaaagtactggagtttcagttttagcatcattccttccaaagaacacaggtatctaataattcctcattttcggatgagagtcacaaacacagtaatttcactaggcacacagtgagtataataacagtaataatgaatacctatcttgcgtgtgcgtgctgctaagctgcttcagtcatgtctgactctctgtgaccccagggtgctctgtccatgggattccccaggcaagaatcctggaggggttgccatgcccttctccaggggatcttccagacccagggattgaacccttgtctcaggcatttcctgcattgacaagtgggatctttaccactagcactatctaggaagccctatttattttgcacttactgtatatcaggatttcctaagcactttttgtgtatagcattagctcattcatcattactttaactctgtggagagactacttttattttcattgttttgccaatagggaaaagagcacagaaaatatgagcaaattttctaaagtcacactgagtaagcaatggtgtgtaactgcaaatcccacacccttacccttcccctcacaccaaggccgtgagccacagtctaggtgtgtccaaattctaggcctatgtttttccctccacgttgggtaaggatgacaaaatacgtttggttacctg

SEQ ID NO: 26568 - DNA, 1362 bp, Bovine  19866881191050
actgagcgaagaagatgaagccaggaatatgataacctttgaacttgtggcctcagccaggcctgaaggcagcactgtagattttccagttgtttgagccaactaaattccttcgcttaaaatagtttgaattggattcctggcagttttatccaaagaatccttattcatagactcctttggttttccaatttgtaaaacggtaatgagattcagtacatcatagagtaaggtttaaataaaatgatgtgtgccaactacacagcacacattacatccttcaacaaatgaactctgaattcacagcaggcaagctctctgatttccttccctaggaagaaatttctctctgcagtttctctctgcctggctcccagctgagagccgttgttcttgccttctccgggatgggtcacttgactgaggggctgcctgttcccgagtccagttggtcagagaggcttgcccggctcttggtgggcagatgttcttcagagggtgaagaaggaaaggtttctcccctgaggcgcgctggaactgagagagatctcacctagagaagacagcagctctcacaggaatgcccgaggagaccacatttaaggcccggatgagctgattttggtcctcgttcaggaacatctggaggaacagctgtgggtgacaagaacgtgtttatctctttcaaaaagaaaagtagtgaaaaggcagggactgcagctcgaccaaatagagatgtgctcccatcatcaaacttggggtggagaataatggaagaaaaacacagcttgttttttaatcaaatagtttaaaggggaatgagttgagggggtggaagagagaattaaagtcttcaagccttgatgcttcctagctgctgctaatggtagtaggaagaatctagaaaatacatcaacatctgacttcaaattttctccactggcaaaacctaaacgtcttcctgactattggaagattaactcccttgggattttatttgggagctagtattattgatgtcctgaaaaagtccctaaaatttactatactttcacaagtcagaattttctttctttcttttggcagcattaaaaagactactatgactttttcacgaacaaattcaatagtttgggcttcaaccttacaaatttatgatcatggcttttaaaagaattttgttttctaaaaaagtgcctgcctcatatttcccataactaggaaaaataaaatttaagcatttatgatacttggaaaaaagtagactagttgcagttttatggtctaaactctgactataataaccacttttttttttttgcagccaagttaccgagggttttttctctctccttataagca

SEQ ID NO: 26569 - DNA, 958 bp, Bovine  19866881686491
gaacacttctcgaaaggcatttgttaagtgctctgatggcccgaactgacattgaaattacagagtctcttaggtctgtgtcagtgccctcaccaagggcatctgatatcctttggatgttgaccaagggaccttgtacaaatagataaaataaatttatcagaatatttcagagaaaggacctcatggtagactcattctcacagtgatttgacatgttcctggttccatctaaagcttctgttgcaataatcacagctctgtgataactatttacaacccacacattgccagacattactgtctctaagtctacatatgcttcttttggatttaaataatttgtggaacttatccaactgtctgggtgatgctgcgaaccttgtcatcgacaagcaaaagaataaactaaaatgatgatgctggctatggatgttatattgtcagttgttggaggacttatctggcttctagggaataaaataattaattttacttaattaggtggaatctacaagacatgtcttatcttttttcaattatatcacccatgtttttacttccctgttgtctccccattgcctagcaccataaacaattggtaaatatttttgaataaatgaatatgttgaagatatactttttaattaaagtacagttaacatacaatattatattcatttcagttgtaaatcataatgattcaacatttaaatatattacagaataatcatcctgataaatctagtaacctcctgttctatacaaaattattagagtgttactgactgtattccttttgctatatattacatccttgtgacatttattttataaggaagtttttgctgtatattacatcctggtgacttatttattttataaagaagtttgtactcttagtccccttcatttacttcactcagctccctgcccttccccctctaacaaccactag

SEQ ID NO: 26570 - DNA, 1555 bp, Bovine  19866880123709
atggagtattactcagccattaaaaagaatacatttgaatcagttctaatgaggtggatgaaactggagcctattatacagagtgaagtaagccagaaggaaaaacccccaatacagtatactaacgcatatatatggaatttagaaagatggtaacgataaccctgtatacgagacagcaaaagagacactgatgtatagaacaggcttatggactctgtgggagagggagagggtgggaagatttgggagaatggcattgaaacatgtgaaatgtcatgtatgaaacgagatgccagtccaggttcaatgcacgatgctggatgcttggggctggtgcactgggacaacccagagggatggtatggggagggaggagggaggagggttcaggatggggaacacatgtatacctgtggtggatgaaaaaatttttagaagaaaaaaaaaaaagaaaaaaaaaaacctacaagtgtacataattatatattgactctgtgtatgaatttcatacatagaatatgaaggacttttttcttctttcgtcactaaaatagtatggttagtcattatagaatgagaagattgcactagaaatctgaaaattgggttcctatagttaatggaacatgccaggctgttttgggtcagttcctttgcagaaactactccctgtccaaaacatcctttccaaaaacctgctctggactacctgtaaattcctctgtaactttccaatttgattacttctatatggcacgaggatcctctttttccattgcagcagcaggagagaggggagaattaggtgcaggtaagtttgcagacagagtgcagaatactgaggaagtacctgttttctactttgtatttacaccatcaagaaagaggtgaaggcagctcctcagtaagatgaggggagggtatctggaaggggtaagtactgaaatggtcatcgtgtggcatgaaaaggacagcaggcaccatgcacacagaacaatgcgacgaatgaatgaacaatgggggaaaggaagaaagatggtatttttttattttaaaagtgggcacctaatggtgacataaatttcagtgggtactaaccacagaccacttgagagactgaaacaagacttaattattttcatcatattttatataaaatatacatttacataaattttattttggaaagacctaggcaaagtgtacataatcagacttagataggagaaatcctttatgggagatatatttctaactggcacagcaaaagtaacaaaagagtacatttatatataactgatcaaagcaatcttaaaaacatgatacaagtatttccatctaataaaaggaaggatgggtgagtcacagcaagtcagctgatttccacattataaaagcaggccatggtttctacagatactttaatgtctttggaggaaattttaatttttttttctttttcccagaaacacaacaaaatcgctaattttttacgtggtaaaagtggttagtcactcagtcatgtccagctcttttgtgatcccatggactg

SEQ ID NO: 26571 - DNA, 986 bp, Bovine  19866880362878
taaaaagaaataatattctttatttaaatctgaaaaccaacgctgtggcatttaaatgaacttggttacaatcaatgcatttcgtctagaattttattatgggaaacttgaacatatttaaaatgatgatcaaactgtatactctgagtttctaaagcagccttctttggagaaactcaagcatgttcctatctatttcactgtttatcctgcaaccatggtttggtgtctttgtaatttgaggcagggtttatctggtctaaggcagtgctatgaaacattgtaacattcatgatggcacctctgaactgctaactaaaccaggatctgttatctgtcattggattaggaagtcctaatagagtcaatcgagaaggcaatggcaccccactccagtactcttgcctggaaaaacccatggacggaagagcctggtaggctgcagtctatggggtccctcagagtcggacacgactgagcgacttcactttcacttttcactttcatgcattggagaaggaaatggcaacccactccagtgttcttgcctggagaatcccagggatgggggagcctggtgggctgccatctatgggtcacacagagttggacacgactgaagtgagttagcagtagcagcagcaatggagtcaatgaaaaggtgaaatttgaaagattataaaagaagcaacaatgaggttgcaaatcactagcagttaagtgattgcaaatatctaaaacaataaaatgcttctgatgctaagcaacagccatataaacccagaggaaactactggaaaagtcaaaagccagctaatctaatctgaacttttggtgacactattaacatatataaagtcatttgaagagttcaaagtttaaccttatgtctgaaattcaaggataaagccaaagcagagaatatatttcctttcatctacatgtcaaaataagaaaccaccttctaccgacaaggaaagtgagga

SEQ ID NO: 26572 - DNA, 1051 bp, Bovine  19866880397163
cttctacctgtatatatacacgcaaaggtatactaacgtgcagtgatcaattttaacagattttaggggttactgggattttgcgtgctttttctatctttctgctaattcttaactttttttttcttataataagtacctatcatttaaataagtcatttttatttttctgaaagttttcttaaaaggcagttcaagcatttctgtccaatctagcagggagaaaggtatataaaactctaccaaagcacatgaagacttcaaaaattcagtgcaagtaactgaatttcaaaatcaggaaacaatttctgttcactacagattctttacctgggtggtctcttgatatgatacagaaaaactttctggccatttccatttataaaactacaatctatggggacttccccaggggtccagtggctaagactccacactcccagtgcagggggcccgggttcaatccccggtcaggaaactagatcccacgtgctacaactaggagcctgcatttgcaactgaaaaaatgatcccaagtgccacagccaagacctggcacagccaaaacatcccaactactcaaatttatcaacttccccaagaaacacacacagcattgttttagagccattttattgagacaactaaaaacaattagatgttcagaagcagtgtacaataaaagagaaatcaaactgttactttatcatgtattccctcttctttataactaaagcaaaaaaaaaaaaaaaaaaaaccagctttctgcttttaagggacaagtcagaaaaataggccaatatattttccctcttcataataacataaacagctacaagaaatctaattgtaataagagaaattggatgttggcttacacatattcattaaaaagacaacagatcatcacattataagagcataactccacctgcttttagcggatactcttgtgttctcattcataggtatcaccaagtaggttagttccagcactggagctaattcatattcctcattatttactgctcatgttgctgtaagcagagag

SEQ ID NO: 26573 - DNA, 1285 bp, Bovine  19866880454558
cacaacaaacacatttacaattgctccttagtgtaaaattctgtttaaaaaaacaatttttaaaaaccactttctctctcaagactctcaactctaacagtttactgcatgtacaataatccttgacaccgtcttccttaaaacatttaggtgtctgctaagtcacaaacattaggaagtagaggtaccaaggttatataagatatgatacacatgagcagatgggaaagtgggtcattggcaagtcagcttaataatatattcaaaaggcaaaaatcagagtaagtaaggtccattctggcaacaatgagtgtaaccagactggggggcatggggtgtgcagtgcagatgatgatggtgaattaggatgggccaaagtgttaaagaggcaacaactgaaatttaacctttaggccgatgattaaaggctgcacatcagaatcacctagaagaacttctggcagggaaataaactgttgttggggactttaccgcccacctcccccctccacccccggaccaatatgtatatgagtattttaaaagcttctaataatgtacacccaaggtcatggatcactgacaaagcacaggtaagacaggaaaagcattagctagagaagtgacctgatatttgtgttcaggaagacaactgacagcaccagggagaatgaacagatgggaaacgactagtggtagggacctgaactaagatggcagtggcgtaagaaataatggcatcagcagacattctgctggtggaatcaacaaagatgatgataatctagatgcaaggggacaatcaacaatttagatttcacccttacacagaatgaagtcatttgagtctctgtgaacagtttgagaaccatttaagagaaagaagcaagaaggatcaggccggaattctggtgagatcaaacacggggtgttccatatggtagtaagaatttcacgagtaacctttaacgacgttttgatcatttcagagcacaatccacagagaactccgaaggtggccatttctggctgcacttacgctgtgaaatctgcagcggctgtcgctgccttggtggcatctttattcaatgttgcgccccaaacggcacccttatgacccaaaaatgttccaatccagtctcctgtatctccctggcgaagcataggcttaccatctaaaaaatattgaagacgacatgtgacttagaagttcggaggacttaaaatctaagactcaaacataaaacgatcatatgaaaaacaaagggaaacagtttttgttgcc

SEQ ID NO: 26574 - DNA, 3122 bp, Bovine  19866880478704
ctgaaactccaatactttggccacctgatgtgaaaagctgactcatttgaaaagacccggatgctgggaaagatcgagggcaggaggagaaggtgatgacagaggatgagatggttggattgcatcaccaactcaatggacctgggtttgggtggactcccgggagttggtgatggacagggaggcctggcgtgctgcggttcatggggtagcaaagagtcggacatgactgagtgactgaactgaactgaatgacaaaagtaacagaaaattaactgtaataacatcaataaccataatcataatgcctcattattgaggcatatatatttatgttattattaaaatgtcttaaaaaacacttttgaatctactaactcatttcatttcataaaatcctatgaggaaggcagggaatcattatttttctaatgacatcaacaatattagttgcatcatttcagttacattatggtggaaggggcatttgtaggataatcataatttatttatagcagtggtgtctgaagaaatgtgactcaggctgtaactggaacctcaggaaatcaggatatttccttgagctgcaaatccagtggtgaacaagagactccagcaggggctggcaaaaaaactgttttcttcccagtctaccaaagtaatctggccttatctagaaacatctagaaacaggacacggaagcctggtgtgctgcagtccatcgcgtctcagggtcagacacgactaagcaactgaacaacaacaaagaaacactgataagcttcagaaatagtatcagtggggacatccatggtggttcagtgggtaagacgctgccttccaatgcaggggttcaatccctagtcggagagctaagacctcacatgcttcagggccaacaaaaacaaaatataaatcaagcaatattgtaagtaaaattcaataaagactttaagaaaagaaatattatcaataaagtccttggactcttttgtttattttcaaaaatatttttaagaagcaaaaattaaataaaatgcaattgtaagaatggtactaataatgaatcctagtcatagaaagcaagtgcaggtcgctcagttgtatccaactccatgtgaccccacggactgtagccaggctcctctgtccatgaaattctccaagcaagaatactggaatgggttgccatttccttctcagggcatctccccaacacagggattgaaccctcatatcttgtgtctcctgcatttgcaggcagattctttactgtctctatacagataaagctctgtgaaatgaccaaggtcttttctccttttccagaattccttcttgaatttttcatatacctccaacttcatttgaggactgaaaacttaccataacagctataaatgacgctaccattattgagataaggagtaattaatactataatacaatccaggcacaaaagcgtaagtaccagcagatgcaatggatgtatttcaacttaaataagaccttggatgctcatgtctgtcttatagatgtcaggaaatggctaaaaagtaaaaggtactaaaactaattaaagcaaatctcagtagaagtatttctagttatcaaaaattactaaatacagtacatgaactacactagtttaatctaactcagatcctctcacttcccctataatgctcatgccagagctattttaatacttaaatagtctggtacgaaatggactccattcttgaattttagcaagtaatttaaagctttaatactaccaataaaatggcattggtagcatagcaattacagagtaaaaaaaaaatgatgtaaatgttaagtaagagtgaggatagttactgtttccacaaagtaactcctgcaagggaagggacagctgggcatttcatcccagacctgagggggcccgggggaaggccagagccaacagttcacccaccaagctgccatctggcttgggaccaagcagaacaacagagcctggcaagagagtcgctgtgttgtgtctccaactgggcattagcttcatcccagtggacactgtttggagacacagtttcacaccattcttctcctctgagttctctccctgtgccaggggggatgaggggaagattctgtcacagtaggtgttggcctgacctcaattaagacacttgtcccatttggaaaaagagagtttcaatgactctgttctataaactcccagagagtccagaactcaaaccaaaattgctggcagatgaaggaaaggatggagctggcagggatcatgagcttggccggaaaaagaagagcaggaatggaaatcctgaacctcttcacatcacaacattataaatctgaaataacaggggaaaacactcagggaggatgactcatgtaatagcacagtcctgtttcatttagttgctggtttgggaatagagcagttggcatggcttggtaatcaatgaggaatacatgagtagctactcctctcaaggtcctgggcagagtaatgtatgttagcagaggtaaagacatccaaataactctcaaactcttcttccataactgaagatgatttcctttccctgaacatccagtcccaagttttccaagaaaactgtctataaaaatttttttagctaaaaaatgtgaatgaaatatggggaaaaaatctcccattccacttcctgcaaagaaaaagaaatctctacaagcaacaatattaacttttttccccaagtgatagaggcagagatgcaggctggctgagcagctgatcatgtgatgctgtgatgtgacaatgccaggcaacctgccactcagtcactttttacttcgcctctcccaggtgtgacgggaaggagtctggcttcccctcggaagcctaagcctttggaaccgagttcctccctttgctgtcccctcgacccagataccacatgggtctgatgtgggcacaggcagaaaactgtcctgaggtcaagtctgctagatcctagaaggcaaagatgtcaggagaacagcttcgacaaatgctgtctatcaaaggtacaggtggacggcattactcacacatgagcacgttcagagccttttagggcctgcaagc

SEQ ID NO: 26575 - DNA, 2171 bp, Bovine  19866880486651
catggcgtggccaaaaaaataaaataaaatccttcttgagtataagaaatcttaaattcacttgaaatatgagcactttctcttggacaattctccagtctcacctatttgaaagcatgtctattcttaaagaagtgtatgtgtttttctggagggaggaaagttagctagaattatctgatatattatttgatgttaatgaactaaatattccctgtgaaggttggtaacagacttaggtgggcaggaagaaaaggaaaaaaactagattcacctaaaacatctgagctatatccttctgagtacaaattactgaattcaattgtttctaagccagactccattcatttgttcatttacatacttgctcacttatttgcataatattttgctctggggaaataaagaggtgtgatgatatgtatcttttaaactagatgtttgcttaagttttccatatcctgcttgtgattatggaagattaataagttttatcaggacatagaagcataaacctagagtactttttgatagtgatttacataactgaattaatctaacattaaaattcactttcgctttgaacctaagtgccttgaaaatgtgagtgaagtatgtaagtatataaattatgaacaaacaaatatttatgaattcctcatttgaacctaggcaccttcctatgcatatcccacttaatctcatgataaatcatgatttactaggtcaaggatctcaaaaataatgtcttatttgaattcagaccttctaattgtaaggccattgttttattatttgttattattattccacttactagctatctatagttcctttttattggagtataattgttttacaatgttgtgttagtttcagctgtacaataacgtgaatcagtcatatgtatacatatatactctctctcgagtctccctcccataccccgattcctaccctgattccacccctctaggtcatcacagagcaccaagctgagctccctgtgctatatagcagcttcctactagatatctgtttcacacatggtagtgtatatatgggagaagaaaatggcaacccactccagtgttcttccctggagaatcccagggacgagggagcctggtgggctgccatctctggggtcgcacagagtcggacacgactgaagtgacttagcagcagcagcagcagcagcatgcccagaatggagttgctggatcatatgatagttctatttttagttttttagagaacctccttactgtattccataatggctgcaccctttttcccccatccttgccaacatttgagaagtctttctaaatttcttcaggcagaagtaggtgtaccttcttttattccccctggttaatgttacagtcctaacctcattttggtaataccattaagaggtctgctcccctctgcatttggctataaactccttcacagtacctggctcccttttagaggatttcatccattctcagccctgggatttgggtggggtgcgctcttatccccagttatcccttagctactcagcacactggccacagtgactggttcaggcacgggttgttgttcagtcgctaagtcatgtccgactctttgtgaccccatggactgcatgccaggctcctctgtcctctaccatctcccagagtttgtttaaattcatgtccactgagtcggtgatgttatctaaccatctcatcctctgctgccctcctctccttttgccttcaatctttcccagcatccaaggttttttccagtgagtcagctctttgcaccaggtggccaacgttttggaactttagcttcagcatcagtccttccaatgaatattcagggctgatttcctttaggattgactggtttgatcttgcagtccaagggactctcaaggatcttcttcagcaccacaatttgaaagcatcaattcttcagtgctcagccttgtttctgatccaaatcccagttctgtacatgactactggaaaaaccagtacagtccatagagtcacaaacagtccgacactactgagcaactgagcatataggaggcactcagggatgggtatttgatccatttcaagtgaatgagagagtatgagtctcaggacttataaagcagtcactagtatgaggatgtgagt

SEQ ID NO: 26576 - DNA, 1577 bp, Bovine  19866880512526
gagagtgaaaaagctggcttaaaactcaacattcagaaaactaagatcatggcatctggtcccatcatttcatggcaaatagatggggaaacaatggaaacagtggctgactttatttttttgggctccaaaatcactgcagatggtgactgcagccatgaaatgaaaggatgcttgctccttagaagaaaagctgtgaccaagctggacagtgtattaaaaagcagagatattactctgccaacaaaggtctggctagtcagagctatggtttttccagtagtcatgtatggatgtgagagttggactataaagaaagctgagcactgaagaattaatgtttttgaactgtggtgttggagaagactcttgagaatctcttggactacaagatcaaaccagtcaatcctaaaggaaatcagtcctgaatattctttggaaggactgatgcggaagctgaaatgccaatactctggccacctgatgcgaagagctgactcattggaaaagaccctgatgcttggagggattgaaggcaggagaaaaaaggggatgacagaggatgaggtggttggatggcatcaccgactcgatggacatgagtttgagcaagctttgggagttggtgatggacagggaagcctggcatgctgcagtccatggggtctcaaagtgtcagatgtgactgagtgactgaactgaactgagatatatttggtatataatcccagctagtgggttctactggcatccaattagtagaggccagggatgctgcaaactatcctacaatactcggggcagccacttagacctttactgttgttcagtcactaagtctcatcctactctgtaactccatggactacagcacaccatgcttccctgtccatgggattctccagacaataatactggagtgggttgccatttcctactccagaggattttcccaacctaggggtcaaaccaacatctcttgcgtctcctgcattgtaggcagattctttaccactagcaccacctgacaagcccccaggttgggtattaggaacacttagaatttggatgcttgattggaagcaggcaaatttgaatttctttttctgtagcgttgactttatcaggggagacatttcctcacttgggtaatggagtccctataataattagcattaattgaaatccaggtaggcagctttactggaaaagctgacaactaaatcactcatggtggtgatgacctagggaactagtcctgtaggtccttgtttattggcatgaatgaaaaagtgggaggcaggactgagtgaggttattaagttagttttcatgaagcgtattcattataaataatcagcaaacaatttgagctaaatgccatgaaccaaacacacacacacacacacttctctcaaggtatatctgatttctaattgtggacagggatcagcgtcagcaagattattctttgaataatgtatagatcctgtctagtagcctggggacaagatcgcatgtgtcccagtcatgtccctagagtgtcttaatgtgactctgaacttttcttttatttt

SEQ ID NO: 26577 - DNA, 1572 bp, Bovine  19866880537152
cactcaccttggagaagatcaacaggaacacagtgcaaacacttttaaaggaccgccccttgacaaagggtgggatgtcttagttttagaggcattttattgagacaaggcacaacaattagaagtagtgtacaatgaaagagatgtcaaacccgttgctttctcatgtattccctcttctttacaattaaagcaaacaaacaaacccaactttctgctttaagagaagagtcagaaaaataaaccaatacatttcccctcttcataataacagaaacagctaccagaaatctaactgtaataagagaaattgaatgttggcttacatatattcattaaaaagacaacagaccatcagactacacgagtataactccatctgtcttaatctaatactcttatgttttcactcatgggtatcaccgagttggtaagttctagcactggagcttcttcatattcctcattatttactgctcatgtttgccttaagcagagagtaactcggaggctgatgcttctctctgcttgttttagtctgtaagttgtgtactatctgtggcatctgtctgacgctcaggccataacttcaggagttgaactctagatggaatctgaattctctgaagcaatttcttctatctcttcttctgttgtctctgaaaaactgatcctcagctttgccagctcatgactatcttcaggaagcacaccttttcaaagactataggttttcctaccataatctgccacagtctctatgttccatcttcagaaccactggcatagagttctccatcagacctaaacctcacagtgaatgggaccaaagtgtcctttgtaggattctaattcatcttcactatcataatcatatttataaggtttaaaaccttcacatgctgctacaagaaattctcagggcaaagagatgcagaattgatggctgcaggagcttcatacgatttgagtccaaactcaccgcaccatgaaaagcaacagatggtccatacatcattaccaggcactccctgggactacatcccatactactgaagacatcaaaacttagagagttcacctctgtcatagtagtgtgatcccgaagtagaacggttttatcgcccgctgaaaggatctgtttatcaccacagagcctttttaataccagaggtatgaccattgatttccttaggttctgtctggaagaccatcttgtcatcgtccttggacctgaagaacatggacacgaacagcactccgcaggcatcctgaatgcggaacaccggcctgctgcatcatatgtctgccagcataccagccaactcagttaccctcaggggctcaaggggcttggtgctcagtggccctgccagttccatctccacctttctcagtcactgcctccaagcccaaagggtgggatttctgcagtgcctacttcttgttggtgtaatgctctcaggtccaagtcaactctttatgacttctcccaggacacttgcaaatgtggtgccctgtatcagtcaagtcatagtttaaaacagtcattatatagccaatcatgaatat

SEQ ID NO: 26578 - DNA, 3952 bp, Bovine  19866880570459
actgtagcctgccaggctcctctgtccatagaattcccccaggccagaatactggcaagggtaactcttaccttctccaggggatcttcccaatccagggattaaacccaggtctcctgcatggagagaactgtctgtctactcgtgtgcatgttaagttgctttagtcatgtctgatactttgtgacccaacagcttgctaggctcctctgtccatgggattctccagacaagaatactggagtgggttgccatgccctcttccagaggaatcttccacgacccatggatcaaacccatggttcttaagtctcctgcattagcaggtgggttctttaccactagtgccacctgggaaaccctgtctgtctacttagtttatccctttgtttcttcctatcctcagctctggttctttacagaatgatcatgctctgaaatattcattgggtggtaaccaatgggattctccaggcaagaatactggagtgggttgccatgctctcctccaggggatcttcccaacccagggatcgaacccacatctcttatgtctcttgtattagcaggcgggtcctttaccactagcgccacctggggaaccctgtaactatgtgggtagactagtgatgtatatttaaatcagcaatagttagtttatatgtgtgactttgtacatcggtatattactcatggtttatggatggttatgcattgcaagtatatctatgtatacacacatacacatatatgactgaaatagctaatttatagcatattagatccaaggtactatcatgattttagaaagctgaagcagtaatttccttactgttctattatgtcatataaatatatacatttggtgtgggaaagacaaaaatgttgtacaggcaaaagattgtgtatgagaaagacagaatatttgaaagagacttaaattccatgactaaacgagagaaggaaatgacatttcaaatacaatgcccttgtcaggatatgctagaaaaaaatttatgtcactgacaagccaaagaaggaggcatttgtatgctactgacagttggtgcaatgtgtatgtggaagtacatttaagtgtgggggaaaaaaggaaaaagacaactggaaaaaaatagaccatagcgaaaaagcaattgaaacaaatgtttagccatatgtgatggacagcaaggagatcaaatcagtcagtcctagaagagatcaaccgtgaatatttattggaaggactgatgctgaagctgaagcttcaatattttggccacctgatttgaagagccgactcattggaaaaaagtcggctgggatgatgggaaatattagggcaggaggaaaagagggcgacagaggatgaaatggttggatggcatcacaaactcaatggacatgagtttgagcaaactctgggagataataaggatagggaagcctggtgtgtgaaagaccatgggctcacaaagagttggacatgacttagtgacagaacaacaaactgttcttaaatataattgcctaagattctcagtgatggatctatgctgacatgctgtctgagatttcagaccaagtactcaggttcactttgggttaaaatctttaccctagacttgaaccaacagctcacctccatcagggcaactcagctattagcatcatggaatatgagagtgtaagttgatcaggaagaaatcctggtttcaggataaaatggcaaagatataaagccctcatggagataatgctgtagtcagcattgaaaacataggctgaataggtggctccgacagagtttcatgcaaagaatctggataaatgctattaggagttaactaaatcaaggatatctaaaaatgtttcatgaagttgtagtatggcaattaatttattatactaccacccacagatgcccaggttcttaagacattgctcttcttgggaagttgtgggggaaatgaatcccctctaggatttatgtgactctacagcttgcagtgaggtaggctttgaatcagtggtaggaagaacttcctcccagaatccagaggaattcaagaaagatcagagactatgagtcatgtttggcagatacaaacagtgctgctggggaggtgggttttggaggccgaggcattaaggagattaagtgagagtctacatattccagcattggggattatttggctaacatacactgagctcaagcaagcttttcataaatattagatggatgaactcattgtttcaatactttctaagtattttgaatccctcgtgaactgtggaaactaaaactggatttggtatgttaatgtcattactatttatgtgttgtaaccctgagcaaaccagtgagtaacttttgttggtaagacatcagactcttttctaattgatagggataaaagaaatataagaaatgaccctgtcattaaaggcttatactttgggagacaagacatacccatgaagggagaactactaaagcaagaaagtaccagattagttgtgactacatttgtttcctcactctttccagagacttgaaaagcaaagctttagccctttgaacgagtttctctttttccttatggctcttctccaccccttttcaaccccaagtgttgagttggaaaatttagatcatctgtgagttcctatcagaatttaatttgagaaacacagtagaggcagtaaccgtggagggtggcagttactgggccctttgcagaaggtgtgtgcgtgctcagtcactcagtcgtgtccgactcctcgtgaccccatggactgtagcccaccaggctcctctgtccatggacttttccaggcaagaatatttgagtgcattaccatttcctactccagggggtattccaacccagggacccaacttgtgtctcttgcatctactgtattggtgggtgggtctttccccactagcaccacctgggaaatgtttacaagagtgaaaagtgaaaagaaagtgaaattgctcagttgtgtctgactctttgcaatccgtggactgttgcccacaaagctcctccatccatgggattctccaggcaagaatactggagtgggttgccatttccttctccagaggatctttcccaacccagggatcgaacccaagtctcccgcattgcaggcacactctttaacctctgagccaccagggaagcccactctcactcttacaagagtgagactcagataattagaaatgtggggtatggatattgcaggagggaggaagagcctgaaggggccacctttgaggaatgaatgaatacatctgttttactgaaatgggtagggcaggatattctgggagagaaaaaaaaaaaaaaaaaaacttggagagagatggggcagtatgcagattgtaaaagttctttaatagggactaatgtaatctataagtaatgaaaagtcaatgcaggtttgtacaattgtgtgtaatttatacaaaataggatttaagaagcattctagacagatgcatagtatggattgaagaagtgaggatataagaggtagacaagctatccagtggctttaaaatggctagaaataatggaaataatcatcttctaatgtgagagtgtgtgtatgtgtgtgttgcgtaaagggtcatgaagtttggcatcgagatatccttaggtcataagctaattaatagcagagacagactagaaaccaagtatccctcctcacaatttaggactatgtccattgtatcatggttaggcatctattgcaacacccagagctaataaatgaaggcctgaactggatactgccactagaaattgagatgaaaaggacatttgagaggaagcgtaaagtaagaaccagtggagacgtgatcggtggctggagagtgtatttgttacctcttgctgctctaacaaattaccccagacttgagggt

SEQ ID NO: 26579 - DNA, 2794 bp, Bovine  19866880579108
ctctgttttagtctttcagattaattagttgccttagtggatgaaaactgttcttgaacattctgtgactttcttagattagaaggttgctgtgtaattttatattaagtgttttactgtacatataattatcttaagagtgattttcaggccactcttgcacagtgttgaacatctttctggtactcaaaaaataattgcttagatatgttcgttaacaattatttttaagtgcctttgaatagcaggaaatataaagggaaatctactttatggcttttagatgggcgatacagtctttaaacacttgggttcttaacttcaatcataatttctatacatgaaagctttactaacagttttctgtgtctatgtgcttttgtgctcagtctctcagtcgtgtccaattcttggcaaccccatgggctgtagcctgccaggcttctctgtccatgggatttcccaggaaagaatactgcagtattggcagaaatggcagtttcctcttccaggggattttccagacccagggttcgaacctgtgtctcctgcattgacaggcagattctttaccactgagccatttggctagcccttttctaagtctacagtagtactttttccagaaagcttaacaggttgccagcagcctcaagatgaagaatctgttttccttttaggtaggagctggagaggaagaagagacttttagatggacaaaagttgaattcttgagatgcaagttcctgctggcacagggagccagcggccaccttgttttggatgctctttaaaaccaatgcagctctttaaaacctccgtccccttgggtcagcatccgagcctttcccagagtggctgaattatctaaatcctaccatggaccactcccactggctcagccccacttgtttctcccgctggcagggacaagcagaaggtcaggttatgacctccaatgtctcctcctcagtgcggcagcagtaggagggacaaggggggacagacaaggagaccacgcctctgctggttgtgccgttgtattgattaagcatctgcaatgtaatccatcttgggtttctagtacacccacttttgctactcctgaaaacctcattataagtcaaaacatttattatcaggtttcttaatgtgacatcactctgccagccaccgcttctggtgtgtgcattttgttaaattttgcattattctgagtaatttgagtaaaagtcgtggtatttgaattccattttcatttgtcagtcatcttttataatagctttccaaattattatttttctgatacatgcaagaattgttcttttttttttaaatggggaattttcagtttctgtaatgtttgaatttttaacagtgaatgtgtattatgagaatgtgagcagaaaaattaataaatgctttagggaacaaggtcatgatatattcagagatttaaccataaaggggtttactgaagtattgtttttaagagcaaataatgtgaaactttgactatccagtaagtagatggttgaatacattgtttagtgaccatgcagtggaagattatgcagccattaaaaattgttctacagacatgaatttggaaagatgtctatgatataccaaagggaagaaaagcaggttacaaaataatatgtaccgtatgtaatcacacattaaaaaaaaaacaaaacagtagaatagttggtaggttcaaaagccctcccgtgagaaaactacctggatgctaaataaactatcaacagtatagcaaatgtatcgtttttaacttttattttttaataatttacaacttacagaaagtttacaaaaatagcacacaaaactcccatttattcttcactcagattccccagttataaaattctaccccatttaaatttttgccttccctctttctctctctgtctatacatgtatgcagagagagagataaatatagatatattttttctgaattatttgagaattaagttgctgacctattgatatattactattaagtacttcagtgtgaatttcctaaaaacaaggacactcatatgaagccacagtaaaccatcaaaatcaggaaattaacattattgtcattaatgttaccattaaatctcctgcatcttctgcactggcaggcagattctttaccactgagtcacctgggaagctcacatgtctctttaggcttcttcaatcgggaatagtcctcaatcttttctcgtgtttgaagaattgaggtctattttgtcaagtgtacctcagtctgggtgtgttaaatgttttttcatggttagattcacattaggtttttttttttcccatcacattaggtatttttgataggaccaccctaaagttttgctctgttcttctcaatgtcctctgctttcaggagtcccgaaatgttgatctgttccatgattgatggtgttacacttttacttggctaagatggtttctgtcaagtttctccattgtaaaattaataaatattttgtattttagtaagtatttaacatccattatgaatggagatatggttaatatcctgttcttcatctaacttttactcagtagttttaagtgttcattggtaattcttcagttatactctgatagttggcaaatggtgattttttctgattccatcatttcttttatactcactagttagcattaccttcttctccctccctttcttcttctcttcaagaactcagtagatgcctgtttttttccaattggttagtaatccattactatcattatt

SEQ ID NO: 26580 - DNA, 922 bp, Bovine  19866880583162
ggagctgcctgtgaacggctgaggcgggcggagaagagatacaactgcaaacacgcacatgacacacaccaaaagttaactgaaacatttcaaagtgccttttcatgcctttaactcaaagatgaacacatttcaaggtgacccaatcctccagtgacaggcagtgttttaaaagggccgacgctctccacttaaacaatttctagtgacacgtctaaaccgcattcctccggggctctctgcgctgtctctctgactagtctttctttcctggcagaggcatcccgtttcacatgagcgcttgaagtctgtcttcccttctaacaattaaaactcacagagctcagatgctttattttttttaacttagcaggcaccatgcaggactgttaactatttaattataccacagacacaaatgattcccttatagtgctttctagttactaaaatcatgaatcacatgcgcttcctcagtcgtgtctgactctttgtgaccccatggactgtagcccaccaggttcctctgtccatgagatttttcaggccagaatcctggagtgggttgccatttcctcctccaggggatctttccaatctgggtatcaaacccacgtgttctgcgtcacttacattggcaggcagattctttaccactgagccacgtgggaagccgtttatcaaaatagtatcagaataataaaagatagccttatcactcgtgcttataagcaaaggataaaagacttttaaggtaaaatcaaagttcaagttcagaaaaggaggtcccatttaaaatctaaaagtatggaaattctctggtggtgcagtgggtaacactctgagctcccaatgcaggggacctgagttcagtccctggtcagggaactagattccactcccacagccatgagtccacatg

SEQ ID NO: 26581 - DNA, 1357 bp, Bovine  19866880614431
gtaaacttggaaatgtctttctgcccaatcaatggggcgctttgctttcaacacatgaagcgcatttctgatgtctaaatttaagggctgaccattatatatattagacataatacataggcacattataattttcataattttttctgatgaaaaaacacgttctttataaaatttttcaaagactctaagacctcgattgggcttccctcatggctcagtggtaaagaacccactgccaatgcagaagatgtgggtttgatccctgggtcagaacgatcccccggaaaaggaaatggcaacccactccagtattcttgccttggaaattgcatggacagaggagcctggtgggctacagtccagcagttgcaaaagtgttggacacgacttagtgactaaacaacaacaggtgctcaaataaggaaaattaaaattgctcataattttcccacccaggaaagtatcttatcagtgtctattctaactacatatatatatatatatgtatatatatatacattttgtatttggggaagtctaggatctctgcactttcatcactttccctagtgaaattttattatgtggcattctattgctatgctgaatgatttaaaacagtaacaaaaatatagtctgttttggtcttgaactggatgtcagcctatatttaaaagcaaaccacttttgtaaattatcaacattttattttctttgcctgatgtttaaggttaaatattcttcttcatttctatgaacacttggggcttacaaatgaactctgaggcatgtactgtagctatttgaatcgatctttcttaggatagcagaaactctgaatgccgttcttaccattccacaattttctgtagggcctcagcaagttaattatcttctttgtgtgcttaatcctcttggagtgcagccctcatcacttctgcgtgccatgccattctgtgcggatgaatgtttccctttatcctctgcatatagaaatggagaaaaaaaagaaaattaaaataagcgaacagggagcctcagttttgcattaacctaagaaatatggattcagtatccatggaactgataatgcctgcttcaatcctttaggacatttcagaacataatttgaattttaaaataagttgagaaaaaaaagaaaagaagtcaatattcaagaggaatattggtttctttcaattactttcctcttttattcaaataaacatctaaaaataacaccatctgtgcctattaattgctatttgatgtaagtgcaaagtgaatttcttaataaatggagctttaaatttctttcaaaatgttttcatattgattaattcaaagaacatat

SEQ ID NO: 26582 - DNA, 1400 bp, Bovine  19866880635259
atctctttagtaatcaacatataacagaacacaaaggttcttctttattacaaatctttttgcagaaattaagtgaatcttgtctgctctgtactttaaaagagaaataaaggtgatgaaggatggtaaatatcatgtacctggattcattttaataattagccatagtgacacctgggtggtcagtcatctgctgctttatgctgcaaccagctccaattacagaaacagtggaagaattttaacttcacaaactgaagagaaatagtttgtttactcaacgcaccaacagtttgtgctccaaccatcatttattaagccagttatttgtgatgtaagagcacaatttgccttaaaaacaatgttgagaatggtggttaattttcctgttcactcacagaaaaccatttaaaccaggcagtaattgagttaaataaacactgtttctctctttgttatgattccatgggtcaagtcaagcagcagagaacattgttataagtgtttgagatcccagttccaaattttgagagaagaggtttctcttctttctcaggatgccctgtggagaaacaggatttgtatagacttccttgctctggtggggatggacaacaagatcacatgaatccttcatagcagtagctagcaaagaagcaggatgaagggttctattaactgtttatttagaacttgaagtatgaaatcatgtttcatgggcagttttgggacctttgtgcaggggtggctgggagtcaggcatgtgacctcttggagaaggaaaagtcacgtggtgggatctaaaagcactgaatcaaatgttatcaactggaagactaggatgaagccacacaaatgaaaaaggaagatgagagaagtgttcatatgagaagagagttgaaggacaatatatgcagctttgtcagcaggggattgaaattccacagatgaaggcttattttcatatacttacactgtgggggctgaagcccctcaggagaggccctaaatgtgtccttccagaaagacgactctagtgtggaccaacatctttagtgtctctgatgggtaatataatagaggtgggaaagatataggtttcatggaaccaaaagcgtaaacagtttgttggcaatttagggggaaaaaaggcaaacttaaaaaatataaaattaggtataaatatatatttatttagataagaaagtaaataaaaacaatatatccacttttaaaagtagatgtccatcaacagatgaatggataacaatgttgtggtatataggtgtatatatatatatatatatatatatatatatatatatatatatatatacagtgaaatatcactcagtcataaaaggaatgaattttgtcagttgtagtttgccaacaaaggt

SEQ ID NO: 26583 - DNA, 1562 bp, Bovine  19866880646789
tgtaaaaattatctatgtgattgctaaaattatttaatgaaaaaatgggggaatagataacttcccccctgcccttaaaatttccattgaattttgcttaaagaatgaatggaaaaaaaccaactaatctacacatggtccccatttcaggcatatctgaaatgatctgaattactatatctccagggttaattttgcaaaggttttctcttaaagaactctgaagtaaaatgttaatgatagctttgataatgttaaattctaagggagcaaatattgacttgcccaagaaccactatgtggcaaaagaaaatgaagcaccccggaacttcccttgctcttccaaactacttcaggactaatttcctaatcactcagcacgaatttcctgccatgataatttgtctttaattttcacaacagaaatgctcttttactaattgttttgctaatgaaatatctgtcattttatatgaaactatggatatcattgaatatttttaatgaaaacattcctatcgtttattaaaaaaactttaaattgtagtaatacgtagggaaaagttaatctattaaacttaaaaagagattttatccatgactttctaagtctctctagtacagtccttgtgtctttgtctagatagagcacctgtgtacattattaacaagtaccacttacgtcttatattctgaaactttttcctgggagagtgaacaggaaagaaacagcagaccctaacatagtacttagtatgtgtgaagctctttatgtatatcaatttactttagcctttatttaatctcttggtatagtaaggttaatatagtaaggttttgaatcctcacaacagtcagtattgatgctatcatccttttatgcagattagggactgagagcttaagcaacttgccaaaggtcacagagctcagaattagcagaggcaagaatcaatcccaggcagacagtatggctcctgagtctgtgctgtcaccacaggtacgtaaaactgtcccccggcactcagagacgcatagccagagcccgcagtcagctgtggggaacagtaatctgctttgggggctactggttcgtttactcattgtctctctcagcgcccctccttccacctttgtagaaattaagttttcttaaatggtgattttcatggagagcatctttttttcctccctaaacaagtctccagctactcataagtggagaacactggactgggaatcggttttggttttgtcttttcatttgctgaattctaagcccacctcttcctctttctagctttgtgaccttagtcctgtctgttcacatgcctgagcctcagtttcttcatctgtaaggttaaaggagttggtgcaggtgataccaagatttgttcagacctcaaattatattaccctaaagataatgataacaggtctaaaataatggtttatggctataaagagaaaacacttctgtagcaacttaaattagaatttgcctctcagaagtcaattaggcacgtcactcaaagcacttctccaactgtgaatgacctgat

SEQ ID NO: 26584 - DNA, 1380 bp, Bovine  19866880668023
tttttctttgtctttaggcccaaaaaagcctaatgacatatttttgctttcttttcataagttaggaaagggtcagggtcatctgggttcatatcctttttctttattaccttttcccttttgtaccctactcctccttccacaggcaaaagttaatttaagtgtaagcagttagagacaagacataatgtttctttcacaatatgtcttaaacgatgtaatcattagtgttgtttcctgcaattctttctccattaacaattccttgaaacctttcctttcccccaattttctttcttttaggctaaacttttcctttcctcctcctctataagcaactggagtgtacacatactataaacatacacattctggaattcataatcccagaaatgatcctagactcgccttttccctctattctcaccacacagagccctttcagtgacacacattcctatctttttcatgcctttgcccagcttttctctctctgctgctgacaagtgctcagtcgtgtcaaactctttgcaacctaaggactgtagcctgtcagggtcctctgtccatgggatttttccaggcaagaatattgtagtgggttgccattcccttctccagggaatcttcccaacccaaggatcaaactcatgtctcctgcatctcctgcgttgaccaacggattttttaccaacttgtgccacctgggaagcctcttctatctctagttgctccttttctgatccacatgatatcagttttcagtgatctactagcagggctatgaggatggggaaagacgttggctatggaaaacacaagactcacttcttttctggctttgggatgtgttttcacacttacccaaattggtatatacccgattttggaaaatcataacacttcaaacaaagtaaagctctacttggaagacatgtctcaaaaggaattatgaagctatccactcagctaatctttgctcattttgattctgggcatgcctccagacaatggatgaatagcgttatctcttagacaaatgcaaataatcttcccagagagatcttcattttcccctctaaaacatgatatcttcctagctctcaattccctggagcaaggtgataattaaagtgtttcaggttcaaaggcagtctctctgaaattcctgatgagcgagcttcagagaggaggaagaataaacagaggggggggtgatatcataagtgaaacaggttacaatgttaataacatgttgaaaataagacgtgtctgcctagtatcaataattgactctgttcacattttcctgacacatgtgaatccaaatcccatcgttcataatagtctctattttggcaggcgtatgcaccaagcaaa

SEQ ID NO: 26585 - DNA, 1698 bp, Bovine  19866880706843
tatgtgacactgggctttattataggataaattttgaggtcaagaatgagaggactccagggcattccaggcagagagataaatacatgtgacgtgtgcagaatgggttggcatgacaggagcgatggggaattctgcacgttctcacagatggagcccccaggattattagaaagaactgaataaccagttacttttcatttttatgagtaacaatacaaaagagtagtcattacagtggagtaggagaaactcaaggtaccaaacctgctagaagaattgcatgaatgccttctgctaatcatgtgatttctgaatgtagtcctttatgtagcagataaattcttgtgttccttttcagccctgtgacactcaagtgattttactaagaaagaacacttgtgtgtttgggtgaaatcagaagtcctgtctcaaaccattctttttgtaaaaaactttttattttatattggagtatagctgattaacaatgtaatagtttcagatcgttcttttctttagtttacaatataagtttatacagcagagtgattcagttatatctgtatatatgtgtgtatatatatatatatagagagagagagagagagagagagacatacacacacacagatgaattatatatatgtatatacacacacacatatttttccattatggtttattagcaaagcattcttatatttagtagcatgaaagtgttagtgctcagtcatgcctgactttttgccaccctatggactaaagcctgccaggttcctctgtccatagaattctccaggcaagaatactggagtgggctgccatacccttctccaggggatcttcctaacccagggatcgaacctaggtctcatgcattgcaggcagattctttatcatcagggaagtcctatatttagtagcatagcaacataagaatctaatatcctaatgaagtgggatctagtcctgtttgagccaatccaaaattctaagaaccatgaacagttttttaccagaaccaaacacaatacttaggaatgtgctaaagtaatttgttcagtgaatcaattatgaattgataagaggtcagagttctgtagttgaaaaattgtgattttaatataaggagaaagaaaagaacatgaagctcaatagaaggaagagaagtttatatttaaatagagggaaaaagatatttttcaaagtcttctattaaaggctagtgatatgaatttcattttatttagaaagttttttattagcacaattagagtattacttctctatcaccattagaatatcattccttttcctagaaatatatgcatgttattgatatagtaaaccaatagtgacatattggtttaatgcaacaatagagtgtttcagtgtctgaaatataacatttgtgatcactgaatactctgatttttctgcagattctaatatttgtaatgttttataatattgtaattgtttctaatacttttcattaggaaataaatgtttaaaaaatataagcagcagaacaaattcataaagaaatacgtggatgaagtgcattacttttgagaagacattgaacatgatttaattttctacaataattttgacattttgagttaatggtaatcttagacatcaacacataataagatgattgtaagtatattgacttttaaaggagaaaga

SEQ ID NO: 26586 - DNA, 1017 bp, Bovine  19866880771730
tattaaataaaggtaaggaactggggattatttagcctaaggagaagactgaaaagtaattgaggtctaacagtcccaggaaaagattccatatgggatcttagtaaccaagagtcctggaaaggatcatttggtggtggttgtaaaaatatctattttcctttgagaagcaagactcttgagcatgatgaggaaagcaaatgcagaaatggatttcacctcctacatttttttctagtgctccaaagggcataacgtttcatttctcctcagtgaagaagtgagtttgtgctgcatgtgaagttaagttagttctagaaaagaactcctttaacgccctgaaatgtgtaattgagaaggtacaacttgctattccatcctcagaatttaattctcctctgattggagtggttgtcgttgtgctgccaaagaaggtggttctcaaacacatagaacaagaacaccaggagagtttataacacagaattctggaccccaccctgagaatttccaattcagtataattttcatttccaagaaattttcaagtcatgttgatgctctgatcctggaacccattttgagaaccactgtactcagcacctagattccaaagtaaatgtatccattcagcagcagaccatctttatcacaagatgccaggataaatgtgtattttttactgcttttcatagcggagaacaaaagggagaatggaataacattatctgttaatcctttcacagtaggcagtgaactggatcaaactttgggcttataagtaagctttggagcctagcataaacattttagatgagtgtagaatcatccacaaaatcttggaaaggatttcagcaagccaagatagtaagacttggtatttgaatttacctctttagaatgctttaacttctggtgattcttggataattgcacttaaaagcaagatgtattttaacagaatccattctttaatattgaaacagataccatgttctagaagagggacatttcaca

SEQ ID NO: 26587 - DNA, 2649 bp, Bovine  19866880847124
tcagcattaccaaccagcactttgtcatcccccagactcttcatgtggctatttttttctcatgttgttacccttcctgtccaccccagctaagacctagagaagtctcgttagtcccattcgagacctaaagccttcactttgtctccttttgcaaggatgctcctgatttcaatcagctactagaaatgtcagatgaaaaatggcacaaatgtgaattacgacaataaaagtttataagctactaaaataaagttatagtacctaagagctgagtcaactgacaatgttaaatggaacattttacaaccagtcctgggataatgataaaaaaaaaaaaaaaggcacacagaacatgaagaaatatctgacaggagatgggctcaagatcaggctcaggctccatgagtttgtatgagcacctctcaagtgaggcgcaagaaaggatagcctaatgcttatggggttaccctctctgtgtccaaccctcaacatctattatctctttttcttttcataccagctcagtgagagggggtactgctatcattttagagaggagaaaccaaggctgaagccatccatttgggcaaatcctcaacaatcaaactattaaataatagacttcaaaagtctctctgattccagcaatgcttttctatatttttttctatatctttctataggcaatgctagctctaaagaggagaaggcaatggcaccccactccagtactcttgcctggaaaatcccatggacatggatggaggagcttggtaggctgcagtccatgaggtctctaagagtcagacacgactgagcaacttcactttcatgcattagagaaggaaatggcaacccactccagtgttcttgcctggagaatcccagggacgggggagcctggtgggctaccatctatggggtgcacagagttggacacaattgaagtgacttagaagcagctctaaagagcatacatagacatgtaatctcatatataaagcaaagttaagcttcacaaagaatctctctctccaacttgatactagtgcttgctccatgtaatcaattcaggtgatggttttcttgaccttgaagcacaccatgtaaattagctacacaatcaaaggcttccctgggggttcagatggtaaagaatctgcctgcaatgcaggagacccgggttccatctcagagttgggaagatcccctagagaaggaaaggcaaaactatggaaccagaatgagatcagcatcaggaagaaagatgaacattaaaaatcatattttagaaagaatactcctatatataaaatagaaaagtaataagaacctactgtatagcacagggaactctactcaatactctataatggcctgtttaggaagagaatctaaaaaacgagtagatacatgcatatgtataaccgattcactttcctgttcagcagaagctaagaaacattgtaaatcaactataccccaataaaaattttaaaagaataaaggagtattatcaggagcttgactaggtggtgtggttctcttttattttttaaataattccagtcacaaaatatcttgtgttatttgcaaatttccactgcctttctctaacttttcaagtactacatcctcctgtcagccccatgcatataataccaggtgacactgtttctcttgtgtgcccaccccagcacccccaatgagagagatgcacgcacactaaccccacaccgggcgcgtgtgtgcatgctcagtctctcagttgtgtcgaactctttgtgaccttatgaactatagcccgccaggcacctctgtccatgggattctccaggcaagaatactggagtaggttcccatgcccttcctcctccaggggatcttcctgacccagggatcccagggatcaaacccctgtctcttatctctcctgtactggcaggcagattctttaccattagcgccatctaggaagccctgatagtctggtatttgctgtaattgtacaatttcttagaaatattatgttttacctttaaagatcttacaaaatttatattcttctccctcatctgactttgttatggaataaagatagtcttttcaattacttattacggagtaaaattcatgctccaagaagaattaatgtcatgttaattctgaggctttgcctactctgtgcaaactcctcttactctagccagagaaacacggtgataaaatggtataatcgcatgacatgcaaagtgctgatgtgaaatgaaaaggacagaaatatgattgggatattaattcgcgagaaataaggaaatgggactgtttgaataggcttagcaggatggtttagttcttcctgaaagtaagtgtgatgctatctcaacttaccttgacctctaccctgactcccccattcaggtacaatcaaatgtttagtttctaaacacacacacacacacacacacatgcattaaaagggttacaaaatacccaatagacagacacagacattcagtgaaacttctcctaaatatcagataaaggcagcatgccaatgtagcaataaaaccataaatttctattgtaatggaacacaaattaataaaatggggggaagtagaacttacaaaatagctttaaact

SEQ ID NO: 26588 - DNA, 1444 bp, Bovine  19866880852903
caggcaaacactttgactatgtgccagcagcaaggtcatcaatttccaccaaacccatttcctatctcttttattgggggacaaagatcaatggctgtctagcccaagacatgggagacttctctcttctcacatctccagctgtcactggctgtctgattctcaattatggttgggggatttacttagtgaataaatgattgacatggtaaatatatattcccttcagggaatacaccattcccaactgctgctctcatgatcgcaagagcatggtcacaaaatttagtctcatccaagtactataattaaaatggagtttgattctttccaaaaatatttatttatttatttggcagtgtctggtctttgttgcgctgtgtggggtctttgctgcctcatgtgggatcttttcattgcagtgcatgaaatctctggctgtggagcatgggctcagtagttgtggcacacaggcttagttctgaggtatgtgggatcttagttgccaacccgggatcgaacctgcatcccccgcactggaaggtgggttcttaaccagtggaccaccagggaagtccctggagattctatgtgattctgatgtgattcttagcttctcctcactaagggacaaaagaaacattgtcaaatgtggttaaagaattatttctgttttagtgcaataggtaagagcttgggtttccaagtcagactttaagacctggctctgtcacttactagactatgtgacttcggtaatttaattaacttccctaagacacaggttcttcatcagtaaatgggataaacaataatatctacactgaggattgttctgagactagaatgagataaaatatatagagttccagcacagtgcttgccatgtaataatcaataaacagtaatgattattattattattattattactgttatttataattttgtttcttccttttctactgattattttgtgtgtttcacattattccacattatgactttcataatataaacacttctaaacaatagcaaataaatttcattatgttgtgcctccgcaattgtttagaatgtttattatttccatttgttttttttctaatcatgttttctgaaaaatttctggctttgattgttacataggaaagcatctgatactacttatttaaacctgacagactgaattttttttttattgtgactggatttcaaagtgttactttatctgagtatttaattttaagccttttctctctcagagtaaaatgcagttctgtctcttaacacaacttcagaaattaataagcattctctatttagtgtggcttatcttcacattttttcttccacttatactacataacttaatcagtaggttttgtagaagttctgcaactatatgctgcggtaagaagtcagtttccctcaaagaactcat

SEQ ID NO: 26589 - DNA, 983 bp, Bovine  19866880860133
tgtgctgctgctgttaagtccttcgtcgtgtccaactctgtgtgaccccatagacggcctcccaccaggctcccctgtccctgggattctccaggcaagaacactggagtgggttgccatttccttctccaatgcatgaaagtgaaagtgaagtcgctcagttgtgtccaactcttggcgatcccatggatggcagcctaccaggctcctccatccatgggattttccaggcaagagtactggagtggggtgccattgtcttctccaagcatgtgctacagaaagcttatatatgcatgctaaaaaaataacacatagaattttagtgaccaaagtggatactattagcaatagaaatgtcctccatgatcgacacagatgaccgaccacgtgacacaaatgactcccatctaaagaaaatttgatacaaaatagaaacaaatttagaaaatacagaattggaataaaattttttttaaagaatttatttagcagaatttctacagtcacaattagataagaccctcagtgttgactgagcagaaacaccaatgaaagcctgctgctggcatgggcatgtacaagcgattttaacatctgatctgaaaagcagaagtttgggtaaaagtgcgcctatttatatcaaggaggttcagaactgactcagaggaaaaagtataatcctctgactaaacaagaccacttcctgaaacacccaatgtttttcttggaagcaaggatatacaagtgccatttctctcaaacactgattaaacaaaattgaagtctaacacaaaacagaagacatatattttccaaagccaaccaggtttcaaagtggagaccattccataaacatatattatctggtcatgaaagggaggactttaaatacagtcaagaatggataattcaaggtatactataatgaataaaccactaagtacctacacatatccctctttataccaaaatctcttaat

SEQ ID NO: 26590 - DNA, 741 bp, Bovine  19866880910428
ttaaatgcacaaattgaaagagaactcacaaaagtgaatctctgaggcatatattattaaatggataaatttccttctttaagatctgaggactgtaagcaaaaaatttctatgatttgaaaatactcagctgtaactatagcaacagcaagtatatcataatttcatgactgattacatttttttttcctccagaaaagttaccctttacgaggagggaaaattcattgtgatgaggtctgaactataaaatacagctagggacatatgtctgctaaccagggccaagaactgtgaggtcatctttttaatcacgcaattagagggaaaggcagttacagaattcaccccaaccattatctgcagccagagaaaaaagcagagtagaaaaagattattttcagagtagtatatttgctttatttgtaaaatttcagaatttaaccattctaacactatgtctattgtccaaagaattgattttaagaaatttaacttatataaatgtttctccctaaaagtgaggatttactttgatttgctatttcattccttgatatcaaagttgccacactgtaaatacccacagggatctgagaaaattaaggaattcaataaaggagatgaacaggacttcgaggaggatctagccatgaattttgtgtttctccttccaactagacctcatctgtctaactccttgggttccaatcacgctatttgatttggttccactttaaa

SEQ ID NO: 26591 - DNA, 1381 bp, Bovine  19866880931535
aatctggataaaaggtagaatcataaaaatagaagaaacataaatggacacttcttgtgaataaatacacacaggactaacaatattcattcttcacgtaagtcatttagaagaatgagatcataattcaatttcaggtttataaacagcttgtgctgtttatgcttagtcgtttagtcgtgtctgactctttgcgaccccatggactgtagcccaccaggctcctctgtccgtggggattctccaggcaagaatactggagtggattgccatgccctcctccaggggatcttcccaacccagggatcaaacccaggtctgccacattgcaggtggattcttcaccagctaagctaccagggaagcccatagacagcttaagtctctcttattataagatagaaaatactgatttgagaacaatgaactcattattactgtaaaataatataatggcatgtaagtgaacaaaatagcagttctgccttaaattggcaaagttttaggtatatacttgggaaacatcacacaaacttacctgattatggattttagtgtcattttcaacctaggaatcactgtagggttccaatgagtcatgcttttatttgacaatttcaattgaaaggccaacaaaattttgaaaaacatggtgaaaacaaaagaaaaaaaggatttctcatttctattcgtgtcctacaaccaaagagaagttggaaagtgtggtgacctcagctcaaagaaactgatcgcttgtgtttatgccctcactctgccactgaatagctctgtacctcagggagtaacctaacctccctctgctccatttcctcacccgtaaaaggagatcaatgagacccgtttgtaaactctcattcacgtctattctagaacatttacctaattcaaacttaaaaagagaaaatctactttattagatttgggctaagacgggttgcaaagaatcagtcacaactgagtgaactgaagacacagcaattggcagtttcactcttttcaacagaaaatggtaaattttcagaaaaataaaattaccaaggataaaagtgtgtgaaagtgttagttgcttagtcgtgtccaactctttgtgaccccatgaactgcagagcccaccaggctcctctgtccatggaattctccaggcaagaatattggagtgagttgccgtttcctcctctaagggatcttcctgacccagggatggaacccaggttgacaaatcaggaaaaaaaaggtgtcagttgccatgaggacagctataaattcacctcagaaattataaagaaatacttttacagagcctccgacttctgctgaaaaattcccatttgcacatacagactccgccaaaacacaatag

SEQ ID NO: 26592 - DNA, 808 bp, Bovine  19866880957911
aaattatttattgaggaatgaactacataaataagtgaaacagatcttttttgcttaaaatataaaacaattaaaaccaccaaaacaaattaaaataagcaagaaattaaatataaaatttccaacttacttcatttgagatggattcattccaaaaccactgggatgactggaaatatgaccattcatcgtgattttaatgcttgtgttctgaaaagagaaaggttcatggactgaaggcagtaaaaaggttgagacatctcagctttaaagttattcattcaacaaaatacgtgtcacttccaggatgacgctagaaatataaatatctccaccctttgaaagctcaggctccagaattaaatatggacatacaaacaaagattaaattgccatttaaaaattgttttcctaatatttatttacttatttagctgccccgggtcttagttgcaccatgtgggatctttggttgcagcacatgggatctagctccctgatcagggatcaaaccccaggtgagtaaaagaaaaattgtaaatatagttctgaaccctcaaactagataaacataattctatattttactcaattttatgaaatgttattttagtatttcattatgaaagtaatataaactcattaaattaaaaaaaaaaaacttgaaaaatacagaaaagcacaaaatacaaaatagactgaggggaaaagtatcacccaaccccatcatttaaagataaccatttaacagtcctgtcagtttcttccagtctttttttttttttctggatctagcttttcttccttc

SEQ ID NO: 26593 - DNA, 1415 bp, Bovine  19866880960608
tctccagtgtttaattcattgcccagaactgatgttaacttctgaatggcagaacaaggatgcaaaccctgatctgcttaagctcttatcatgacccaggcatggattagcctatttattctactgtttgaacgttttatacaattagtatttgtttttctcagggcctgctttgtgccaaacacaatgctgagagctagaaagggaggtgtgctgaccgggagtagaatgcagccttcccatcactcaagagctgccgcggaagcctgagccatcctgactgtggattgagagattaatgcttgtttttctcccaaaggctgatgagatgcaggatgtgatgcattttaactacaccgcatggcctgatcacggggtgccaacagccaatgctgcagaaagcatcctgcagtttgtacacaaggtccgacagcaggctatgaagagcaaaggccccatgatcgtgcactgcaggtaacctcctcaaaggcgctggctgttagaaatcatggaaggaatttcccatcattccataaacctctgatcagattgaattaactggccaatgagttataatttttaaaaatttaaacagtggagagggaggtggaaggggcattcaggatagggggtacacatgtatacctgtagctggttcatgttgatgtatggcaaaaactatcacgatattgcaattatcctcgtttaaaaaataattttaaaaaatttaaaaaattatgatgaacgaagtcttactaaatacatgatttacatataatatgactatcttagggcttccccggtggctcagaagtaaagaacccacctgccaatgcaggagacacgaatttgatccctgagttgggaagagtccctggggaaggaaatggcaacccactccagtattcttgcctggaaaattccatggacagaagagcccggcaggctgcagttcatgcagcctgcagaccctgcagttttgcagggtcacaaaagagtcatatacttagcaactaaacagcaacaacattgtttatcagaggtagcaatgagacaaagatgtcagaggaggcattggtagccaataagcctggacctagcactttgggctttgtgagatagaatgactaagtgtgtgtgtgtgtgtgtgtgtgtgtgtgtgtgtgtgtgtgtcaggtggaggggtggggggtgggggtggtagtggcagtatgtgtctccctggaaagaaaaatgcttcataagctaccaagtttctgactaaggaggctgcacttgctgtcagtcattcccaggccaaaaagctttgcttcacaggatgaggttacctagtctcaacatgtttccttccaagagcagaaaataaagctgctcaacccggtcaaacacgggcctcctttcatgcagggagcagg

SEQ ID NO: 26594 - DNA, 1620 bp, Bovine  19866880976583
ttggctaatcttaggaaaagtgggggaaatgtttgccaaaagaagagaaaagagccagattaaacaaaaaaagaaacactagctctctcagttctttccttcaatttgaagaatgagctctggaaatactgggttggccaatattcaggtttttccataacatctatgggatctcaaagagtagctataagatgttatggaaaaatccaaatgaactttttggtcaactcaatctttttcatttggtccagcccatcatgtgaaaaaagcaacagagcaacacagttaagcagtaaggcatgttcgagcagaatggcaatcagaaagcaatcacagtctcagagttagaaaatatctcaaataccccaaggggaagattagttcatgataaccatattccttgcagttgccttcccctcaataaaaattaaaatgtggccatttaaaacaatgccaaacagtgtgattcaaatgaaatgcaaggtagaaactctaactccataatccttgataattgacagtaatgtccctgggaaaatattctacgcagttatgccaaccatacaaagatatgtgttagaacggcatgacacaaacaagagtcctcaagttatgtctaatatgcccgaagtttcctttcatttctaaaacttaagattctttggaatgagttttagaactggaataacattagagatgagttaccaatcgatgcaaataatatctattttatagtggatctaaactgtgtaatttttcaaacgactttaaataatttagttttgcttttccaatttgataaaaggattgtttaactcaaatgtttacaaggtcatatcatcagtatttggggctacgataggcaatgggatacagcagaatgccttctaaactgagctctaaacctcctctgaggttttattattattttattatttatttaattatttatttattattattaattattaatgctcctgaggatgtagccatgtacagtcaacagttcagaaatgggctccctcaaatcatgctctcatagttcccacctcttcgcttccttctctgtcttctgagtaaagttgccaaggaaggagagtgaggggtaagtgagccctagatttgtcactaaaacaaaaggttctgaaattagatcactgggagtggttgcacaacttcatgaatatactatacatcccctgaactgcaccctctcaaagtgaatttcaccttataggaattacatttcaatttaaaagaaaaaggaaaaaatgaagttcacgcatgagggagaaagcaggagagaaaggaaaactaggaaaactaactctaggttgttgggggccggcgtgaggcactccgcccgtggcaaaggtcatgaggaaggaggctcgacacacacaaaggtgggatcgagcctcaggagtccccctggaaattctcaagcatctacccccataaccagagcctgcctactttactactttgtgctctcacctacacctctgactttacgggggggctgtcccccaccacctcttttggagaaggagttaacttagagctccagttaataataattcctgggcgtgataggagtgttccaacctacaaactcct

SEQ ID NO: 26595 - DNA, 1163 bp, Bovine  19866881006501
ttcccaattttcttccttcttgcttgtagaacctggagtgtttacccagtagatatttctacgtatttacaaaacacttccagcaacttaatacctaggagcaagaaattatatttctagaactcagcttttttgcaaatctgaaatataaagtataggttgcttctgaaatctaaaggaattttttttaatgaatctgaaatttttatcattatcttttcatttaagggaaagtaattaaacaaattaggcatgtttaataaaaatttaatataatagaggtgcctgatatacaataattatttaaagctccctaagcttaatcatatgttaatcaattctttagcccagataaatttgcttctcttttttttaattctcaggagtaaaaatggcttaaagaagaggaaactgactaagtaagtttttcttactatttcatttaaaaatattcttcataatgatcttcactttccaaattgaaaagattgtgtgtctttaatagaaggaagcttaagaaagaggcaaatgcatattatgtgttgctgttatgtgctggtgtgtttacacatatggatgtcagtgaccaccaagaaagtgtaccaacagaacacttttcaagaataaggaaaactctcactgcgtgaaatctgaggaagaatgggttgttaggaattatagaagtcttacagaaggatgtctactcttctacatctataaaaaatatataatgtttagctgcatcaaagtagtacaaaaacctttgccattttgtagcttcaaatttcacgcttattgcaggaaaaaggcttttattctatttgatgttataacaaatactttgataaatgctgtctcaggaaatctttataataaatcaaaaaggataattgctttagcttgcctgtggtttcacttagctactgcatggttaagtcataagaattataattctgaggggtgaaaatgaactatcagttgatttcaaaagcctaattagagtatcacctctaggcctttagttgaaaactctacacataaagagtcgatcgtttctataaatagactttattcttgatacttgcctgggacagaatattggtgaattcattaaggagccaattaagccaatttccatcagttcaatggtatctgtgctaatg

SEQ ID NO: 26596 - DNA, 803 bp, Bovine  19866881145630
attttacccccatttcattgttattgtcactaatgtattctgattttgtatctcttgccttgatgattgcagtagactcctcattgactccttgattccaatctcttctcttgaccagtaaccctccacattgccaatagacttgtctttctaaagggatatctggtcactttcttttctgatccaaaaaatttggatgcctcattgccattataatgcaattcaaatttcatagtatgatattcatggctttgatctgaaattagtcattaaataagtgttcaaaacattcaatatacatttccttctgctttacaccccttttgtttcttactactcactataggcactgctactctggctgcacgagttctttcctacatatgcaccatgattccctgtatccatagttttataacacacattcattttgattggaatagtcactcattctactcttttgtgtcaaaaattctattcttggcaaaattcaaatgaccattctgttaaaaattgttccagttgaaattagatagttcttccctgtgtgttcttttaattgtttttccccctcttatatcaaataaattaaatacttatttaaaatgcttatcgatgtttcttctattatatttgtatgaagtttgccaggtcaaatacaggttattttatctccctcagcccttaatcccctgtttaactagataattcctgctcatctcctgaggctttgtctaagtgtctctttataaatgagagtctcccctgaattcttagaaaatgtgatcttccaaaaaacattt

SEQ ID NO: 26597 - DNA, 2998 bp, Bovine  19866881169843
cagtagatgaataaaaatagaagtgaaccttgcaagatagtacaggcagaccttggagatagtgcaggtgcagttttagagcaccgaaataaagcaagtatcgcgataaaatgagtgacaggaattttttggtttcctggtgcatataaaagttacggttaccctgtattgcagtcaatattaagtgtgcaataccattatctttaaaagtacgtaccttaatttaaaatttaaggtacgtactttttaaaaacataatgccagataattacaatggtaacgtcaaagatcactgatcacagatggccaaaaagagtattacaataacaaaaaagtgtgcattactgagacaattatcaaaatgtgacagagacaagaagtcagcaaatgctgttggaaaagcaatgcccacagacttactcaatgcagggttgccacaaaccttcaatatgtaaaacacagagtctttgccaagtgcaataacacaaggtatgcgtgcactgcaaaatgacatgtcactaatcctagtctctcttctgcagaaaataataaaatctggatctggagccctcagtttgaggaataagctcttaaattaaaaaatcaaagagacactattaaacggtagcataagactcatataaagctgctgctttgaagtgttataaatggtaggtgttttatcgtcagtgtaaaagaaacatactaaatactttctaaatgctatgcagctgtttatatctataagtcatctattaacacaaactatttgtgaaaaaaatacctgcattgggtcaatgcagcattagttgcattcattagagacaggcacctaagaaccaggaaagatccctgcatggtttagatctggctcctaaaactagcccattgaggaatgaggcacactgtcctctcaccctccaggtctcagttttcacatttagaaacaagggcattcactctcaaagtctcctgcatttctaaaatgttgaggttctaaacttatggcaacttaagaaagtcctttctttcatgtacatgaagagagtgaatataacattttttttcaaaagatctaacccagtatacaagccggcaatatttcccatttgtattttattctcaaaagcatttcatttactcacagaaaatactttatgtatgagatgtgattattaagtaatgagactggcttttttacacgtggctagggaatcagaatcatagtatttgagtcactagacagaaaatttccaaaactgaagaactggaacaaaaaataaagaaactcaatacttgcaactttaatccatgatgggaaagaactgacctaaaaatgagactcagattctctctctgctgtttttcagagaagaatctcaattattactctgcatacacaattctatcacagattttattgttactatcattttcagcatccaaatcttaagtcttcttagattcagtgattgctactgtaaaaaaggtaaacaccagacagactatacacattacctttatcatgcatatttaaagcttttaagaggtcttcccggattggatacttggctttataacacagcctttgaatgttggaagctgtgtcatcacctgaaagtgtagtaagatctatacaggtaacagccttcaggagccatgcagcctggtttgaagaaaagtaaaaacaaggcttaaaaaaaaataattaatctccaatacagttagttagtagaaaaccattaggtacataagggtgctaaaatctcatgtctagggacttccctggtagtctggtggttaaaacttcaccttctaagggaagaaggggttctagttcaatccctggttggagagctaagatcccatatgccttggggtcaaaaaaccaaaacattaaaaaaaaaaaaaaagcaatactgtaacaaggtcaaaaaagaccaaaagaaaaaaaaaaggtccacatcaaaaaaatttttaaaacaaactgctttaaataaaataaaatctcccgtctatgctgttccgaggcatacattctgatgtgttcaagcttaaccaaaaagacgaatgttacacagagtaaaataaaaggggaaaaaatagcttataaactttttttcttccacagataccccaaatggaaattcctaatagaacaagtctccccacgtgtgacttttgcatctcaacacaaggagactcagaggtgggttgccatttccttctccagaggatcttcctgactcagggatggaacccacgtctcttgcatgtcctgcattggtaggtaggttctttaccattgagcgacctgggaaggttctaccctgataagggagaactcgggaacaaaagtttccatcttgtattagacctccagccctgggacctggaatgagacacgataaagagtctactttcttttttttttttcccagtttaatccaatttcaattttaaaacaatattcacatttcacaactcattcaaataaattccttttatcttttcaatcagattatttctaagaatgagcaaaatgcaacctgctaccctaaaggattcaatcacgatattttgcctcacttgtggaatgaactctgaattcctttcagtcctgagatgtatagcatgtctttggttagtacatactgaagaatatgctgaccactagtactctacaaaacaccattttgcaaattttgaaagataatttgggaaaattaattgtacattaaacatgtggagaaggcaatggcaccccattccagtactcttgtctggaaaatcccatggacagaggagcctggtgggctgcagtccatggggtcactgagtcagacatgacagcgacttcactttcacttttcactttcatgcattggagaaggaaatggcaacccactccagtgttcttgcctggagaatcccagggacgggggagcctggtgggctgccgtctatggggtcgcacagagtcaatcacactacgcga

SEQ ID NO: 26598 - DNA, 1339 bp, Bovine  19866881182729
ttattgtgagtcttgactctctgaagccacaactttgtatccacctatctctccagtcttgagggcagcgattttccctgtgaacttgtcttatggatccaagaagagttgttgactttcagtattttcagttttccacctcttgttaagagggagtagcaacttccaagcttctatcatgtcaaactggacatgggaatataaaggataaaaaaaaaataagaatggctgcattaaattttatgattcaaattgctgttagtagatttaaggaaaactgaagacatctgtattgtttatagtgtatctaactattttgcaccgatgttagtttcttggtttagataatgtactacagttaatataagatgttatcagtgcacgaagcttgatggagggttcccgcactctgtactatcttttacaacttcttgagaatctctaaccatttaaaaatagaggcttttcttaagtaaatgaaactagaaaaaacatttgcaacataagaaggaaaaaaaaaaaagcctcaatgtatagaaagctaaccaatcaataaaaaatacatcctagcagagaagtaggtaaaagacataaataggtactttgcaaatcatgggtacctaatttatgaaaatttgtttagactcactcacagccgagacacagcagatagaagacatatcactttctatttattatcctggtaataattaacaatgaacacaataataccaaccactgccaaagctgtcagtaattgggtgctccatctactgctcatagaagggttaattggcacaatttcataggaaaccagtttgataacacataaagtagcgaatagttgcagtttcatatacaggagtttattcttaggaaagcaggatgtacacagatgcatctatagacatattcatcaagcattatttattgtaaaaatcttaaggaacaataataggaaaatgattaaataactacagcagaatatcattgttgtagaagaatattaaatggcatgggaaaatgattccaagtatcaaaaatctaattaaaaaacaatatgaaaagatatgtacaatatgatgccagttctgtttccaaaggttatatgtgaaggaaaaaacatggaaataacaaaatagcaataatcagatatcccgggggtagtggggtcctgtatgatttattttcttctttgtgattgtcttagtttttcatcttttaatgttgatcatgtattacttttataaacaaagcaataaataaaatagatcttaataaaatctgtcagccaaatttattaaactcccattattccaggttatacaggaaaaatact

SEQ ID NO: 26599 - DNA, 1426 bp, Bovine  19866881182870
ttcctatgtttttcctattgcattattcgaattaagttaagaattctttttattgtgtcttaatgtttctgggatgtgaacagatcaatatttctagcctgtgcacactctacctaagggctgtgagtcatatctgctttgaaagaaatagcacttaaggactgtcagtcaagtcagttgtaagaaacatagaactctttaagaattactctgcctcctcctcacatctaaatataaccaactggttggagtgtctaaggcagatagctaagctgtatttttaaaatggtacaatcgcaattaatctacacaaataaaaagctcaatgtcttattacctatgtatagcaaatatataatctttgttaagctaaaaaccaaataacaatatgagtaaggaatataagtaagaaaatgacccagtttcctaaagtcgtttggacgtcaatattacagtatattgttttactaggtccttatacccaggttggaaaagcactggggcagggtatgtgaagatgagatttctagtctctgtttggtcactgcttaactgcgtgacctttataaactactgccttcaactcttccttcccaaggtctgagtctcctttcagactgcaggttaaggactacatattaagaatggactgtgtattttcagattcacttgctgcgtctttgtgagaacttggagttcatatcaatcagcttgatatagaagaaatccccctttaacactcaaaccggcttgcctcattaggatttgttcactgttcctggaagtaagtaaaagcaaaattgttcctctggtatcgaatatactaataacataacaagtatttattcagtgatgacttaccttaagctcatctctgtgctaggtctgtagttaattgtctctctgtatgagcttccatttaccaaccacataatttatatttgcaaagtgatatttggattcttctggcacattattgccaagagcgccgataaaggaatcatactatgccctaatatccctgattatatttgtatcagtgtcatagaggttgtatcagcagacagaacaatggactgtaccattaaattagcacaattttgcagcaccgtctggcagaagctcacacttaatccaagaggttattcaaccctatccaatatgattactctataaatatttgcccaagctcagcaccagccgttatatcactaatcacacacaggttggttatagcgaagacccccagtgtcagcaatttgaaaaacaaagctaattagttttgatttagggatgggaagacttattaagttgaaagtggagagttcgcacagtatagtggctatttagagcacataggaatatgaaggagatttactcttatttgcataggattttgagaaggaatggaaggactgccaagcta

SEQ ID NO: 26600 - DNA, 1296 bp, Bovine  19866881191822
ctaggcttccagtaccaacactgatccaaatatgtgaccttggctattctctagctttaccttcttgatctactaaatgagagatttggactagataatctctgaggtcatttccatcactataattagatattttatgcttctaagtgttgagagactaaaagacattcctgcactgatctttgtatgtaatcagctgacactacaatttaggatgtcagactatccttattttattgctgatttgattttggttagaggctgatgtgtctctagtgtacataattacaattgacattgatgggtatagagcagttcacaaggtttattaaagccagccatagaatttgaatgttctgggttcccttcagccttctcataaactataaatcatcctaatattgaaacttgaccttcctcagtatgaataaaggcttctggatttcaaaggcatttgtgagtttgcagtgtccctgaatacaatgttatcctctgagtcacacactgaaaacccagttctaaatagatcttattggggtgtttggtttaaaggtgaactcaagcaaatctattattgaaaatctcgttcctggtgcccagtaccaggttgtgatgtacctaagaaaaggccctttgattggaccaccttcagatcctgtgacatttgctattggtaagttgccagccacaagaaaaatacctttatcagagtactgtttggaggggtgccatgtctaagttctagtcattatcatcagttatgggaggtccatacttgttctcccaatattcaatcctcagagtaattaatgaccacaattgtatacctggaagacatccttagcattcattacttaggaaaaagaaaatctcaggcaaatatggttagttttcaatgattgcatcaaaaaagtgaaatacctagtcagtcagtaagtagagatgtgaagccattgttaagatattaaacattccttcttgactttcttttttcactcccctcccttcttcttagttccaactggaataaaagacttgatgctctatcccctgggtcctacagcagtggttttgagctggaccaggccttacttaggagtgttcagaaaatatgtggtcgaaatgttttatttcaaccctacaacaatgacatcagaatggacaacctactatgaaatagcagcaactgtctccttaactgcctcagtggtaattttccttaaccagctgtcacattttcctgtgtcaacatgcattcacatactaactgtgtctgaaaaaattattatgtctgta

SEQ ID NO: 26601 - DNA, 1483 bp, Bovine  19866881202350
gcctttaggagaaggtcatctttaaaatgagccgctccttgatttatcgtctatttcttcaagtcaaaaatgcccctagaaatgacaagcctagttaatataatgaatttcagtagtggcttttgaaaaagcaacataccacttgaatccataaccacttgaaggttgcatccagttccggtttcagcacagatgtcagatgttcatagttacgggacccttaatgagatgtgtcattgcatctctaccacctaacgatcatgtgaaatagtgtagacctggaagtctcaggcactgaaagcaccacttccgagtggagctgccaaatgtaggtgagaaaacctctcccagccaacatcaccatctggtactggattatcctcaaatatgtacctcattgaaagaataaagctaagctccctgaaatcaagaggcacagtaatctgccaacttctgctcgtgccatcacccagaactgaacctggctctttcagtattttccaaacgctgaggtgtacaattaagagttaccatactggagatcatatgagtaaatacacctgtgcagaatcttttccggaagcaaactgaatggtgaataattaaagtctgttcatgaccgtaatttaaatcctaccacagttaaacttaaatcttgctccctcacatctctacttggggtttccctggtggctcagatggtacagaatctgtccacaatgcaagagacctaggttctatctctgggtcgggaagatcccctggagaagggaatagcagcccactccagtattcttgcctggagaattccatggacagagaagcctggtgggctacagtttatgagatcgcaaaagaatcggacatgactgagcgactaacactcactcatatctttgcttacttcacctgataatttgcatcccgtctgcatatcatagtctgttgtgaaccagttaccagagtgaattctacatgctgtaaaggctcaaataggatattggtaaatttcttgtaaaagtctagagactgaattattccatccctgaaattttgattatctggtactcagtttgactctacataatatatgtctcctactaaactgttctgatttaaaatacttgctcaaatttaatattttttatcttaggaaaatactagaggtaaaaaatcattatcccacagcctttttttttcaaacctgttgtaatattttactaaagtattgtctgagagaaagtgaaagttagtcacttagttgtgtctgactctttgtaaccccatggactgtagcccaccagactcttctgtccatgggattctccaggcaagaatactggaatgggttgccattcccttctccagggcatcttcccaacccagggatcaaacctgggtctcctgcatttcaggtggattctttaccagctaagccaccagggagtattagagtattgtccgaaagaagtgattctcaaac

SEQ ID NO: 26602 - DNA, 1155 bp, Bovine  19866881244593
aaaagaaaaatccctcaaatcttgacattcaacttaaactcctttgtaaaccagttaatatcctagttctatcacagccatagtctactagctaaatattggcataaaggcaaaaattgttaggaaaaaaaaataattcaaaggtcatagccaccactgtaaagaaaaattatagtttgcacaaaatatcttgatttaaatcaacttaactttttctgttaatattttttctctaaaaaatgaaagccaatgacccaatgatgactatttcacttaccacatctctatcaatgcgggctgccatcatctcaggtgtttcttcctgctggtaataatttctctgtttctcaactaaagaaaagaaaatcatacatctttcaacctattgcttaagtgataccaatatagataagcagacatgcaagctgtctagaaaagagtgtcactggcaaaagtaaacacttgcaatggatacaaaaatcaaagctgtgctcatcacctctggcctgcaccctcgccactagcacctctgacacacatcttcaccaccctcaccctcacctctgacattcattcccaccaccacacttgacagagctgaagtaccagccttccatctgcatggtattgatttactctgtaatgtcccctctattctctctcttctaacgtcagatgcctgtggaaacaagcccaacttagtgccctttaattcctacagaagaaaaaatttacacgttttttaagcaccaatttcttaaaaggggccaactaagttctaagttttaaagctcctcattctcatactttctaacatcgtgataatagtaaagctttgggtcttctgatagtaaagggcttctaatattccacttgtaattaagcttaaagcccacaatgttgggctcattctcatttgaagctatatgctttaaaagcagaaatacctacaagaatttgcaaactgaagaacaaaagtcgcgagatattatgttagctcagctgactagggcatgataatcagtatcattatctgaactccttccagctacaagactgttaacactttcaattaacacagatactcattccaagatttctcagtagagaaagaaagaaaaagggaggaggaacaggagaactgcatcattacta

SEQ ID NO: 26603 - DNA, 1982 bp, Bovine  19866881245235
ggcttaattaataaggaaatggaggcactctagcaaatacaattatcaaatggataaaatcaattcagtgtggtgtgaagctgaaagctctgcctgttacatctcgattctaatcaattccaaacagtggtgcataaatcaaggtcagtgactcaggataaaaagaaatcaaggacagtaactcagagaaaaattgtattttaatttttaaaggctatcatttaaacaaatcataaactttcagaatcaagtatatcatcttccatgaacggagaaggaaatggcaccccactccagtactcttgcctggaaaaccccatggacggaggagcctggtgggctgcccatctatgggatcccacagaatcggacatgactgagcggcttccctttcacttttccctttcatgcattggagaaggaaatgacaactcactccagtattcttgcctggagaatcccagggacagaggagcctggtgggctgccttctatggggtcgcacagagtcggacacgactgaagcgacttagcagcagcagaagcagcgtcttccatgaaagtgatgttcaattggtcctgggtgaaggactggcattttctggagatgagccccttcagaactccctcaaaataggcatctgttctcatgggaccacttcccacacactcacctgttatgaagcttatagtggagctgtcacagcagctgagttctgggtctccccacgttaccatggtaactcgaaagttgtagtaccatgctggcaacagattcgctatcctctaaaaaaagcaagaagaaaaaggcccagaaggaaaatcatatttttggaatagagttatatatttctcttaggctatgaaaaaatgagtaatttttaatttcctttctgtgcctttgggaggcctccctggtggctcagtggtaaagagtccggctgtcaatgcaggaaatgcggcttcaatccccgggttgggaagatcctctggagaaggaaatggcaacccgctccagtattgctgcctgggaaatcccatggacagaggaaacttactgtctacagttgattttgtacttctcaaattttccattaaaatattctttttggaattaagtgagatgtaaataaaatgatacacataaatttaacacaatttaaaaaattatttgaagatatagatagtttgaaaatgggttttcatttgcagtttcttaaattacacaagtgaactggcacttatttgtaagtgactggacggacacatcttcctatttctaaaacatgatctttcacaattctacattctctcatcttggactgttagcatgtgttcatactgggtgacaatcatgagagttgtcaactgagtagtggacagttgtttgctttctgtgtgacctgtagataacctgtacttctaaaattattccagtctcagaaagagaaatctttacctgctcatttgaagaacattgctaatggtctgacattgcaggtatttaactgatttgttgatattaagaatagtcatcactcaagaagtatccactcactactgaataactaaaggaaaacatgttttctgttttaggagcagaaaggaacaataagcatgtgatgtgcttagttgctcagtcatgtctgactctttgtgaccccatggactatatagcccaccaggctcctctgtccagggggattctccaggcaaagagtattggagtgggttgccatgccctcctccaggggatcttccccacccagggatccaacacaggtctcccacgttgcaggcagattctttaccagctgagccaccaaagaagcaagcatgtgacaggtctaaattggggattagcaaatacactcaattaagagtgaaagccagtttcacacagttttctctttctctcaaaatacaaaaataaaattaagagctaaaacaatcccaaacttgaaagtagcaagttacctgca

SEQ ID NO: 26604 - DNA, 2780 bp, Bovine  19866881262779
ctgaaactgatggattctgcaagcaagcgttgctctcctgtaatgcaacccaacacgtatggaggcatccaggtaggcccacctgagttatcctgtggaaactggggggtgtgagaaactgacacaagcgaagagaaagctcatgttggctgctgtgcccggagtaataaagtccttagtctttgaccccagtctcaggtctcctgccagcatccagacacaataacaggcttgcttattaacctgaaaactgagtaagatcccaacccttcctcaggtcaactcccaccacccagaatagtacccagcgaagaggggttgtatgatttgttaaatgagtcccttacttaatgaatatctgaatttgctttatcttactattaacctcacttataagcattaaattaattgacatatagttgtgaaatcatgaggcctattatttattcctgattaaaatatcatgctaaggagacatctctggtgttccagtagttaagaatccaccttctaatgcaagggacttgggtttgatccctggtcagagaattaagatcccacatactgtggggcaattaaacctgcatgccacaactactgagcccacgagccataactaagacccgacacagccaaataatttttttttaaatgatcattcaaggtgcttactacttaagttcaaataaaatggagttggtgaaattccctttaagaaatgcaggcagcccaagcaatttgaaggtatactgtttgcgtttgtgcatctccaaggaattataaccttctgagggcaagaactgtgtcttttcacccttggatccccaacacttagtatgtgcctggcacatttaaagggcataataataatgatgataagataataacaactatcatttgttgagtacctactgcatgccaggccatgtgctcaacacttcatatttaatcctcagaaccataacttaagtaatattattatatctatttgaaaaatgaggatccaccagggactgagcccatttctcctgcattggtgggtgaattctttactgctgagccaccaggaaaccctagaggggaaggatggagtggaaggtgggagggaggctcaagagggaggggacatatgtatacctatgatggattcacattgttttatggcagaaaccaacacaacattgtaaagcaattatcctccatttaaaagtaaataaatttaaactaaaaaaaaccaacaacaacaaaaaacaaaaacgaggctccagaggcacagagaggggaggaagcttgcccatagacatacatctagtaagtggtgcatgtgatgggttgaacactgatgcccaaagatctccacatcctaattcttggaccctgcaaatgttactaaagagactctgcaggagtgattaatttagagatctcaacacggaagattatgcaagtttgtctggatgcatcctgaatgccattacaagtgtccttgtaagaggaagactgaaggagatttcacagacaagggagaagaaagcaacgtgatcactgatgcagatgctgcacagctggctttgaaaatggaggaagggatcacaagccaaggagtgcagctgtcctctagaagatgaacgaggcaaggaatggattctcccttaaagctcctggagggagcacagctgtgccaacaccttaatttcagcccagtgatgctggtttcagactttcagcctccagaactatgagagaataaatttctgttgttttcagccaagaaaaataaagaaaaaagaaatgctgccaataattcccaatgatatgtcaattcatgggctaatcatttataacatatttgagagaaagcatcaaaatcttagttacattacatatcatatattttaattttgtgtttaatatttttaagtgcattttatgaaaatagtgaataccaattaataaggaaatgaaaaaagacctcttgctattaattttacccagaccagaaatccagatcaagaagcctaacaaaaataaacagcctaatttttcccttcccccttaagaaagtcactggtttcagatcctctgaagctattgacattaagacctcatagataatcctctcacttctatctagaattgatttatcaatacataaataaccactgattaatgatatctgccaacagaatcttttccaattatatactaaaaaataaaacaattgagacttcaattctgtgcagcaaggcgtatgtggtgtgccagtctctgctgtgtactttcacatacacagcgatgcataatttctgagcaacacctggcaggtacgaagtctctgtaactggctcattgtatttttctcaataggttgcaacccttttttgcatgtgggctccacacctttctaaacacttggtaatttatgggagaggcaactttcttttcctggtgagaggctgtcgaatttgttttagctgaaatggagaacttcctttatattttaaaccgcgtccaactgtaaactaccagcagggacacaagaaacactggaacaaaacttcagtgtgcaaaatgggtcatcagtgtttgttcaagtctttaaatatggcggtcgcctaatcttctctagatgtctaaaaataaattgaagctgaaaagtactttattatgaacagaataaaatggggccatgagagtaagctcattacacttttttttttaccaccactctttcatctttcttcaaacaattcactcacgtaggattccagagccttatg

SEQ ID NO: 26605 - DNA, 1655 bp, Bovine  19866881265031
gatcttagaatccactctctcttgagtctcctgtattggcaggcaggttttttttttttttttttttaaccactagcaccacctgagaagcctctctggagataggatagtgaacaaaattgaagtccttctttcacagagcttaccttttaatttttaatagttgtaattgttgtaattgatttcacctatatttaaagttacgatttgagctttttcttcataataccaaacattttcaagaaaattacagtattttcacttttttctccatatgtccctaacaccctcaatatttggagactttggaagtactgatttctctcctggtttattaagcttttgcattgtactagttagggtaccaactaaacaattgaaataaaaaaattttttaagattgtggtttaaaaaatatcaacatctatatctctctcaaggtgcccaggactaaaagggtacctctgccatgagagattattcaagagtccagatttgttctattttgctgctccatctgccactgcgtatagtcatcacctgcataggttaactccactcacctttacagccacattccagcctgcgggaagggaaaaagagaggatgtggaggcccagcacttaaaaggtgtgaacaaaactctaagttgaccatgagacttcctctaacaatccattgattggaattgggtcacatggtccccactatcaatattagaaactggaaaatgtagtctttagttaagaagccaggtgtctgtggatatggctaagtttcctctgagcttctcagcttgggctgagcaatgttcctatttttgcaacccagtaattgctttttctaaaatttgctgtgaatgcaagagggacaaaaaaaatcgtagtaatacgtactccaaacaaaggaattaatcacaaaaaattgttctgatctgtgttgtgcttatttagagctaccttgtatttggctcagttgaggaatttgtatcattttcagaggaaataacatatccataaggtttaatcagctgtagactgcagcacagaacagagatgggagcctgtgatagccctacagcttgattttggtgatcttgcaggtaacgcgcaatgtcatgactgcagttctcagcttgcctcctggagatatctacaatctctctgtaactgcttgcacagagagaggaagtaacacctcccatgctccgtcttgtcaagctaggtaagaagagaacacaggtgtgtgtgtgcaagtaatcatgctggaggactagtgtttgtatctcttggtttagcatggtcttctcaactcaaagaaatggaaaaaattggctcagtgtcttttataaatgcaaaaaagactttacactatcaaaaaaagtacattcaacatatgtttctgtgaggacaatgtctactgtgttgggagaagggagttcattgttcataataagattagaagaaccacagagtcgggattttagagatggaaggaccttagctattatctagtgcgatattctcaaccctatcagatactgtttcccttttacataaataaagctgaacttcatacataaaataatccacatattatttttcaaatttgatgtagcatcctaactctaagataaaatcaagataaaaggacaa

SEQ ID NO: 26606 - DNA, 1762 bp, Bovine  19866881285946
atttgtgacaattctatgtgaaatgtgatgtttatttgcttcacaattaaaatgaaatgtgctaaaaaggtgttttgaagttcatgtagaataactgagaaacattttcatgaaaaaagtgatcttttaattagtcatatagtaattaagattgcatttgatacatgatttccatgttatgagctatggttacctgctaaaaaaatgagtgaatttaacactatcctgtgctactttacataacaaaaaaagaaatatatccttaaaatttggggagcaaagtgattgcaagcaatattggtaaaatatcaagtttgtttgataaggtatagagaccaagttgatgaacagtttagaaatttagactgtgaagttcaacatggtcttctagacacaaaggagttactgaagatgagatgaacacgtttgggaaatcttccaataaacaatcacagtgagaggttagagaaaacagaaaatctctggatgctggtctagttgatggagaagtatcaattcaggaaagagcataaaacaacaacaacaaaaaacctcatcgactaaataagagcacaaatatgagggaaggacagaaattaactccaagttgagctgagaaacttaggaaggtagttcatcaaaaccaaccaatgcagcagaaatgcagttttgggtgagaagaaagatgatgaggaagtgatgggtagcagatactcagcctatgtacatttatatcagatggccaagtaccattcactaaatcgatcagagtgtgattcaaacttgtaaactgcttcagttctgtgaaacataaactaagtcactgcatggcaaatactcattcaccattccacaaatgtttctcattgactactaggcattgttccagattctggaatgtaatagagaagaaggcagtctcttttcttatgaagctaactttctcaaatgggacacgagaaaatcaagaaatagctattttgttgggtggtaatgcacaatgatgaaaaataaagctgggggagtggacaggacagactagatagtgacaagcctgctcttctgtatcagggaatattttctgatgaggaggcatttaagcatgatttactcttttttacttggtaacagactacatagcagtgtacatacacatcagtgccaatcacctttgcagataagatcatctatatcatttttctagattccacatgtatgtattgatatacggtatttgtttctctctttctgacttacttcaccctgtatgatagtctctaggttcatatgtgcctctacaaatgacccaacttcattcctttttatggctgagtaatactccattgtatattgtgtaccacatgttctttatccgttcctctgttgatggacatcaggaaattaaaaaaaacaggggatatatgtatatgtatgtgtagacgtagagctgattcactttgctatacagtggaaactaacacaatattgtaaagtaactatactccaacaaaaaatttaaaaaagaaaaatataagcaattcacgttaaaaaaaaaaaccaaaagttttctttaacaggcttctgagttgcttaagatcatagcgttttctgtctctattgattaagaacaaataaccgttgtgaaagatggttttctctgaggggtgggagtgcagacatctttattatctcacatcaggtgtttctgaattgttttaattttgtttaaaggacttgatttgttctcccccaaacccttctc

SEQ ID NO: 26607 - DNA, 1533 bp, Bovine  19866881343290
acccttaatgtggtctttcctttcattcttgttccctttgggatgatgtggagagtgtttcacccaagtggctgggaatcatctgctgttggtgactattatgagtgtcttttgtagaaggggctggcactttaaaaacagacagaccaagtgcacatcttgagacatccactatctctgtgactcgattattcgcaatgtctcagagctgcaatgtctcctgtacgaaacgggcttgccaaaatgtgtctatttcccagggcggtgccaaccaaatgtgatgatacatgtgacagcagcttgtaaactgtaaagggtgacacagatatgagttgttattatgagtggttcctctaatttccctgttctctacaagcagacctgaatgttagcagcacctgcgtgctgtcatcactcagctgttgatttcatttaaggaccttgtttataagtctgtggctggtgattgtatgtcagcttttctagcagtggtgatgggctatgcccaccaccggactggttcaaggtgctaaggctgaagctgttttgtcatacagcaaagggatcctgtggtttttaggagtctccctccttcaatttgtaaatcatgtaatattaataggaagcattttggaatcatgagctgttttttggtgatactgttactctgatagtcgataaaacactttcagaaaccaagagaattagattttggccagggtggaatgaatgctataaatcaagattacctaaaagggatatgaggaagtattaagctgagtccaagagataatgaggggagggacttccctggtagtccagtggctaagacttaaggggcccaggttcaatccctggcagggcaactagactccacataccgcaactaaaaatctggcatgatgcaactaaaaacatcacgggtgaagcaactaatacctgattgattaattaattaacaattaattaataaaaaagagagagacaatgaggggaaatatccaagaagcttgaaaaagttcaccagcttccaggagcagatttctaactgttatctaaaaagtcactctgatgggaacattttcactggcagattcacatcataagacagtggttttcttaattttgtatacagttcaatgcagggacttttggctgcattggattgaagtgttacaagaagaaaagaaagaggaaagagatgtagctgtcagttgtggacagtcagctgttgtcagatgtgtgctctgcaggtcacaggaaacattttcaagtacctcatctttcaggtctcggtggtggacagaaataaagcacagacggtgattcttaggaaagacttcatcttcccgatgttttacagctgaaaaatggagcaaacgagtgtctgagttcagacccttggcaacaagtgactgggagtcagtgcaacactgcggggacacagaactttgcctgccactgagcatattactggagaaatactgtacagaacccagcaggcttctgcaaacaacacatccctttaagtta

SEQ ID NO: 26608 - DNA, 996 bp, Bovine  19866881352415
atatttgcctgttgagaggtcaatgcaattgcacagtttcacaaaaaacaaatcattgacaaggggaagatacttggaatttaacagaggatgcttgcaagtagctcatgctgcctgtgtatagcagagacagttctctcatgatgtagaggttactataaagaagtaattattttgatttgaaaaatacatttgggagatgtcagtgcttatggtcccctagacagaaaccatggtcttagctcatcctctttgttgagggacaggggctgtgctctgaaagtgggtggacaggaagctttttcctaaggggtaaaaacagaaccagatttactttgcctacaccagtcttgtggtacatgattttgatgtcaataagcctcatatctcaatctcaaaaactctctatagtcctttcttcaatagtttaaaggagaaaaaaaattttcagacatgctgattctgtgtgcatttcttacattaaagtcattaaaatccctccttaaagctttccaggtacttaagcggatttaaaaggaaaatgcaggacagtttgaatttcaagaattacattatacttggttggcttagtccatgttttgttttgttttgttttttttccaaacttgaaatggcccccagttccacttggaaaataatagtaatgctggcaggcacagcagtctcccattttttcagactgtaggattcctcgttacacacggctaagataatgttctacatggatacactgagagctccacaaacgtcatggcatttatgcaatacatccttttattggtgaggaaagagaaatttcagggtgggatcaggacagcaagagattggtctttgaagtgctatgacattatttcaccaactgcacatctccatccaaagatatttcacactatagatgctaaatttcaccccacttttttttttaagttatctgctaaggtgcatttccttttattcctataacattcgcattaa

SEQ ID NO: 26609 - DNA, 1580 bp, Bovine  19866881388971
aaccttgagcccagtgatcattctgccttttatgaatcacactcagcattgcccagtgagcagaggattgatgcaggtacaagtctgccagttccaatgcccccagagggcaggaaatactttatctactcacctcaaactgaagagaaaatttatagtcagagtctttggccatgtccttgatgtacgcatcaaaatcatccagttgaaccgggctttgtcaaacacaaagaaaagtacattttaaaaatcctgctgataggtgtcacacaatgtttaacgccttacttctcaaacatgaacaatttccttgcagaaaacagacgttttacttctcacaggttagcactcatatttttttagggttaaaattaccaatccctatataattaaaaaagagagccctatgtgcttaacttccttgagataggaaaaatctctagattttccattgacttttactttagcagcaacatatttcacacacacatattcatatacacacaggtatatgtgttgtttctagaaaactccaatttatagggaaaaacaaaggattagcctgaagacctgtttgaattatagttttactttatttacttaactctcctgagatttaacatgctcatctatgaaatatcgtagggacacttacatcgcaaggttgacatttgtatatcatagacacttgtaaatttaaacggtttgacaaaggcagggaattttgtctccccagagaaaaggctggaagcacatctccagggagttcccagtgcctcgctcagagagggctgtgttcagagccttgcacatctctagaagtctcaaaactgttcgtaaataaaataaggtagcacatccgactttacatttctgcatatgccacagaagttcccgccttgtttttgttttgtggaataagaattcagttctattttctgtagttgtctctagctgcttatctcttctagggcttacctgtcccaatctgttcttggagcttctgcaggacacagcactctgtcacctaatccaagcctttccaccttaccagggtccacagagttagcctttctctcagtcttgctgcaacttactcagcttatgtcatccacctgtagtcttatttcttattagtaaatacatagcatataatagatatttgttcaaagttgttaattagctcctctgatttatttatgttaagattttagtagattttaagggtattatgcctcctagataatgcaaattgtaatggttttatttaataataataacactgactggtacccttaagtgtgtgtgtgtgtgtgtgtgtgtgtgtatgtgaaaatcgcaccagggaagctctgtacccttaaaacatactataaactgtaaatatgcttatgcgttatcttgcttggttgatggttgaggttagacatggagaacgttagcctcatgcttgggctttccttggtggctcagatggtaaagactctgtctgtagtgcaggagatgtgggtttgatccctcagtcgggaagatcccctggggaggaatggctacccactccggtattcttgcctggagaa

SEQ ID NO: 26610 - DNA, 1241 bp, Bovine  19866881417205
ctagcatcacctggaaggttgatgagattcaattcacttgacatgcttagagtagaatacattttgctatgctatgctatgctaagtcgcttcagttgtgtccgactctgtgtgaccccatagacggcagcccaccaggctcccccatccctgggattctccaggcaagagtactggagtagggtgccatcaccttctccaagagtacattttacctattattattattattattgtctcttgttattgtatgggtcaactcctaacacctgttatatcagtgatcatgagagtcaatacaattcagccactcctttttttactgaataatttccttttatcctacatgaaaaatctagtgttccatagatttgggggcaaatatgttgaaggattacaggataagaggaatgtgagggtcaattcttttaaaaacacatcattttaagtcactaacatttctccatactcttaaggcataaatgaaacttttggtggttgataaacaatggaaagtttttggattccaagaaggaacaaatagaaaaatgagccttgggcagtgatccttaaggcagttggagctactgtaatggaactgaccagtcaattatttccagcaactaatttcactggcttttccatttaattgactggtagcttgaccactgtacagaaacgctctggaatgcaggcattattgaacaaagcaaaacaaagtgacctattaaagtagattgcaatgaaaggaacagggctttgctgagagctggttttaaataagctgccccattttgaataacggaggccttcttttcaaatcttcattattcgaagctatttcgcaatttctagtgtaaatgtaatcctggcactcttctctgttgctcggaacaatctcctctccatttctaagcttctgcgtaacatagttgtcgctgctgtccagtggttaaagtcgtgtccaaatctgcaaccccatggactgcagcacaccaggcttccctgtccttcactatctcctggagtttgctcaagctcaggtcggttgaatcgatgatgccatccaatcgtctcatcctctgtcgccacctctcctgccctcaatcttttccagcatctctgtgttttttaatgaatcagttcctcacatcaggtagccaaagtattggaacttcagcttcagcatcagtcctgctaatgaatattcagggctgatttaggatttttggatttaggat

SEQ ID NO: 26611 - DNA, 2449 bp, Bovine  19866881448446
atgtacatttatgtcttgagtccctttgctgttccctaaaactatatataacgttgtttttgtttttacatagcattgttaattggctgtaccccaatacaaaataaagtttttttaaaatatacctattcttactcttataataagtttatagtaaattaattaacaaattaagaagttttatttgtcttgaacttaatccataccttcctttgcaatgtagataacgagacaaaggtttcctaaaaattaacacttagtcataacgttttcatagatatttggttaatgaattgaagtcattgcttgaatcagtgaaatcaacatataatttaaattaccacaattggaaattatcatcagtctcttttaattttatgacacatggtaacattgatcattatcctggccctttcatggtagaaatgttggtttacaaaacaatatccaatattttggatattggatttaatggacaaagaattcaaagatttgcattctagatttggctttgcactaactagctttgtgattttgcattatttatttttaccctggccatagtttgttcattttaatggtaaaatcgccaaagtttcttttagttctcatattctataaggtataataaaatacatactatctaaataacttgtccaaatggtttctggtagaaattggcttgccttagcattttacttctgtttttcttaggaaaagctagtggggtgatcatgttttttctttctttttgtagaaattatgatctacaacccaagaaatatgccaagtccaagtatgactttgtggcaagaaacaacagtgagctctcagttcaaaaggatgatatcttataggtaatagaattttacctttttatactcttaataaagtcaacttgttttccttttccagtgtatatctaaaccttcctcaaatgctgaggtcaagaaattattcttcggtatattttacctttccaagatacagcatattatagatacctgtgtctgtttaggaaggggtatctgatgtgtttgttttgtggggaacgtggttggatttcttgacttactttgccctcttccttcttctggactttattttttctggaattaaggctgattatcacttcagatgtagctgcaccataatttttgtttttgtttcaattggaatataattgctttacaatgttgtgttagtttctgctgtacaacaaagtgaatcagctatatgtgtgtgtgtgtgtgtgtatatctcctccctcttgagcctacctcctaccgccccatcccacccctctaggtcatcgtagagcaccaagctgagctcccagtgtactgtaatctgtacactgtatctgtaatccactggttgtctgtttcacacatggtagtgtgtatgtgtcaatgctgctctctcaatttgtcctaccctccccttcccacgctgtgtccacatgcccattctctacatctgcatctccattcctgccctgcaaataagttcattagtatcatccttctagattccatatttatgcattactatatgatattttttctctttctgacttatttcactgtttgacagactcttaagttcatctgcgtcattagaaatgacccagtttcattccttcttacggccaagtaatattccgttgtatatacatatcacatattctttatccattcatctctcagtggagatttaggttgcttctgtatcctggctattgttaatggtgctgcaatgaacactggggtgcatgtatctttttgaattatggttttctcagggtatattcccagtagtgagacaccatcttattttaataagagaaaacatttcctccttcctgttttagtacgcttgcacaaatatacccagcagtgagtgtgttaatggtttagggaataatccaccatgaccaaaatccctttctttagttataactgagacatcatcttttttaatatataatgtggccaggtcataatagttattgtaaaaagaagttttttaatatatttcctgtctgttctaacagtggaaacaatagacctttcccaagtgactcgtcttaaacacttctgataccacaaatagttaaacattcttgggaagcaatatggacctggggtggaatggtaccatacctgttctatattagtcattataattcttagtgtaattcctgagaatcatttaacccacgtatgttagggttgagtcagtgtattagaagtgaaaccatttgcttggtctaagaataaagattgaacttccttcatagattagtttggtacagaaatgacatctttattttcttgcatgatgacagatccttgatgataggaagcaatggtggaaagttcgaaatgcaagtggagactctggatttgtgccaaataacattttggatattgtgagacccccagaa

SEQ ID NO: 26612 - DNA, 1327 bp, Bovine  19866881451665
aaggaaattccattagtgaagggatattcaagtgtagagaccttaaaactgtcaatatttagccagaaaaagaattttttaaaggagtaaactgaatatctcagttatcttcgggggtccagtctctcaactgggcttattattaacagaagctgaatagttaatagacacctggatctttgatgttgctaagaaaatttgtcatcattcttgcaaaaactgaaagttttctggtctgaaatgtaatgcagagatttggagtttgttttttataattattattaaactcttactacatgccagaaatgcagtaaatagcatatgaagtatattcactcttcagtgaaattatagtgccttttagggaaagcactttttgaattcagagccctcacctttgagggattatagtttgctgctattcaaaagcaattcgtggctttttttagaagtctcatctcattaccttctctgtgtctgctctatatcaggtgtgtatttctatatgcagactgtatcaggtgtgtatctattacttcaagtcagaaacagagaccatacattttgatacatgctggatctcttaagaagcattggtacatctaaaaaattgcaaagtgtgattttcagattgatgactatggtcagtgtcttacccgtgtttaatctatagagagcaagaaactataaaccatgaagatttgtaaattctaaagcactttgtaagtgcacgctggcagttacttctaagacgtacaaaatagcaaagactgtcctgcaggccccactgtgactcagtattacagatgatctaggtgggcaacaagctgaatggccacttcacagggaaagaaagaccaagcatctttagttccttcctgctttttctcttacagaaatatatgaggaaacgtgggaatgtaaatagaggagaagattagggagtaaaattaattttaaaataaagtttttatttcattattgcaatgaaaatactagtatattgttgacatgtctcattttattatattatataaaagcattttaaaattaccttgttaaatctgctaaatatcatttaatgattaaaggaagtgtttggtttttaaagaaagtttccttttaaaaaaatatacatgttcttgatagttggggagtttgggatggacatgtacgcactgctatatttgaaacagataaccaacaataacctactgtatagctcattgaactcggctggatgctatgtggcagcctggataggaggggagtttgagggagaatggatacatggtacatttatgtcttgagtccctttgctgttcac

SEQ ID NO: 26613 - DNA, 1280 bp, Bovine  19866881460150
tccctggtcgggaaaatctcacatgcctcggagcaactaagcccatgtgccataactactgagctcacgctatagagcctatgctctgcaacaagagaagccaccaaaatgagaagccctcaaagtgcaaccagagtagcccctgcttgctgcaactagaaaaagccttcatgcagcaattaagaccaagtgcagccaataaataaataaatacaaaaaaagaaagaaagaagggtttcagtaggaagaggtgagggcagcatgaatggcctgagcaaaagcacaaagtcatgagagtatcagacaaattttcacaatggtgagaaacaagttatttaggtgtcaggggagaagacagatcgaggtcagatcataagaggcatttcataaatttttaaggaattttcaaattactctgaagaaaatggaatcattgaagatattaaacacaagtgaaaagattagaattggcatttaggatgataactctaagagccaggtgctggttgatagaatgggagtgatactgaagatagctaggaagttaaaggctaaagtacgggcttcccaggtggcacgagatgtaaagaattcgtcttctaaggcaagagacagtcgtgggtttgatctctgggtcgggaggatcccctgaagaaggaaatggcaccccactccagtattcttgtctggaaaattccatggacaaaggagcctggtgggctacagtctgtggggtcacaaagagttggacatgactgagcaactgtacagaaaccgacctatttattaagtacagaaaaataaattatttctttggttttgcaatgacatacatattattattgtttaaaaatgttttttataatcatattattcaacaatattagacaaatgacacctaaagatttaaaaaaatgatttgcctctgggaattatgactgactgaatgtaaagaaagcaacagttggagactgttacttactgttaaaaaactttcaaaactattgattttctcacctaccatgcttccctgaatctaagattaacttagctatatgaggaaacattctttcataccactgagaaaggaaaaaaatgctgccaatctagcataatatgcaacccaatttcacacatacatacaatggactgaattgtgttccttcaaaattcatacatttgaagccataacctccaaagtcattacttgaagacagagcctttaaagaggcgattaaggttaaatgaggttgtaagagtgggacagtagcctaatatgg

SEQ ID NO: 26614 - DNA, 1718 bp, Bovine  19866881464342
acaaattcagctgtggaggaattcagagatgcagctttgaatctattaacctctgaccccagtaccacatttgccttctagagctccatatagcattcataaagcacctgaattgaaaaaatatatatatttattttatacacatacacacatatataccctcaaagcccattatacccaataaaattgagggggaaacatttcatattcaaagtaacagaatattagcaagcaaaatcagtacagtataatgagtattaaaattctgaaaaattatttaagactgtctattaccaataacaccaagcccttaccctgcatcagggtggctacatctcatttcctgaacttcagttattgctacactaccaggattagggtaataataaacattagggttaagagaagcattttcaatgctaaaatgagagttgtataatccacaggttttctaaagtacttataaaagactaaaaaccagtcttgagtcagaaaaataagtcaaaccactcgagtttttggtgtttttatttttgaggggtgatacgcgccatgccagacagcatgcaagatcttagttccccaaccagggatggaacccacgccccctgcaggggaagcatggagtcctaaccactggacaaccaggcaagtccccaaaccatgaaagataaagatggaacaaaacctgtcttctcaattttagaaaacccaaacttaacttgcagcaccaaggattctatcacaagatgcatgggaaagaacaatgtttgttgctcccaagaggtacccacggttttttctagaaagggcggaatatttttacaaattcctaacagtcagtagttgtgagtatcagaaatgacctgagatgccacactgcccaccttaccctgcgtgtcgcacctaaaccatgagaaaatcatatcacccacacatccaacaacgtgcaagactaggacaaacagagaaagacgatgtggagtaacaatttatattcttttaactcagagactgaatcttggatggaatgacagttcttgaaaatagaaagctgtcctctaagaactagtgacaaggaaacctcttgagctaaatattcaagaatgataatctggagatgagttgtgatctaattaaggattttttagcttcctagtacaatgagcaatctcaagggtcaaacaaatgtggatttaaaactcaactccaacactttctgtgtgaccttaggcaagttatttctcccagcctcagttctagccttaaactatcaataataatatttattttgtaggttatttgaggattaaaagataagatatatacagatagataggtatacacacacacaaaactttgtgcatcacctggcttattgtaagcattcaaaaattttaatcattaagttcagaattctagtaaaatgaatttccactaagtgttgataaaagccaaatcttggttcatggcctgacccaactttttgtactacactgaaattttgttatatgcattaccgcttacattcagtgagccatcagataaggcatgaaaatattttgttacagcatttgtgaaagggaactttggcctgtataacaaaattcttaaaacattgatcctgagcatatttacaagcaaaatcaccagcctttttctaaaatatattatcctttaatattcactgaagttctttacccgacagttaaaattaa

SEQ ID NO: 26615 - DNA, 1267 bp, Bovine  19866881528521
ctgtgaatagtcccagactccttctttactatacctcccatcatccttttcctctcaagcattcttcttcccttgccctgcagggagttgcatgtggctcgccatgttcactgatccccagtaaatccatctttgctggagaaatagctggcagtctacttgcttgaggtcaataaacccaagctagaaacttctagctaaaccggcctcccccattttcctcaccacaccacatccaacgaccaacagtcaagtctcaccaagcccaccctctgaatccctctccatacacacacacactttcctctcaactctccatacacacaaacgctttcctctcaactctccatacacacacccactttcctctcaactgttctaaaccggttccactggtttagttcagacttcgtcagtcctcacgggaacatcagcagaagtcccctaagtttccctgcctcggtcacatgtcacacagctaagcaacagccacacagagattctaactacatctgcctatcactctggagcccaggtgaccttgtaagagtaaggggaggtgagggtgggagaggtaagtggagggaagctatttattgagataaggcaaaaaagaaaaaaaaaatcagtgagctgatattagcatacatgttaatcataggagcattttctgtcaattaggcagtactgcacacagatttttctatataattctgttgtatcagcaagtctatttggcaatgctttgaaacagagtttctagcgtaagtttatcctgtctttttttaagggagagaatatggaaaacataaatctgcaatgaaatcggttataaaatatcaaatctctgcttctcaagagtgacactaatcatggtctggaaggcaacctattacattttaaaacagcccttaaatcaatgatgtggaagcttcacgtctaagggctgcctggacagcttggcaacacttttcaacactaggagaaaatgcccctgatttgcagctacacacatgggtcctttctttgtgaagtcaaatgtgatccagatgaatatgaactgacttctacctgcttctcagtaaaaccaggatgaacttttatcagctaaggaaaggggcaatagagttaaaaagaaaatcatgagagacagcaaactgttcctccctttctaccctgatctagatcattgaacaggtaaaatttttattgaaaaattcttgtgtaagtgttctttcaggaagggacgtgttcacttttaagataa

SEQ ID NO: 26616 - DNA, 772 bp, Bovine  19866881652061
tgatgtaagtaaatcagtacctttaactcacggtaggttaataagggcctgggtattctggaactcttaaaactaaccctacagagtctgagctaatgggccctaaagtctctacaaaagggatcaaatttggtacctaatatacattcccaaagaaaagtactaaggcatcaaaggtgttggttttaaaacacaaaagcactaaagaaagtatttaaagtgtcaagatgagtatttaaatataattgaggtcattttataatgacagttaaagtgattctacacatgagggagataggaaatcttcaatatccagtttgagcagctcttccttgctccttgctgtagggagaggcttttaagacatggtagctatttgcaggagaaggcaatggcaccccactccagtatttttgcctggaaaatcccatggatagaggagcctgataggctgcagtccatggggtcaagaagagttggacatgactgactgacttcactttcacttttcactttcatgcatcggagaaggaaatggcaacccactccagtgttcttgcctggagaatcccagggatgggggaggctggtgggctgccatctatggggtcacccagagtcagacacgactgaaacgacttagcagcagtagcagcagcagctatttgcacttgtgtcccttcatcaggaaaacaaggcaatcaaagcagggcaaagggaactcaggagcattgagtgtcattgaggagccccgagttttatgtgtgttgat

SEQ ID NO: 26617 - DNA, 1800 bp, Bovine  19866881720018
gaaatatagcaaaacacttaaagcttgtgtataaatttgttttgtgtgacaattttctatcataaaaaacttcttaacaaagacattttagtaagtttatagaactagatttatgtttactttccaactgtttacatttttaaaggtccttaaataagtgaggatatatatatatatatatatatatatatcaaaatagaggagatggtgatttgtagcatgcttagttgctcagtcgtgtctgactctttgtgaccacataaactgtaacccaccaggctcctctgtccatggggattctccaggcaagaatactggagtgggttgttatgcctttctttaggggatcttcccaacccagggatcaaacccaggtctctggcattgtcggtggattctttaatcatctgagccatgacaggaaatagtagattgtacgttacttctgggcaaggatataatttcttctttcattgtaacttcttcagactccataaatgttgtctggactaactgacattgattctaccctaaatacattagaaattgaacttttccttgaacatataattagtgtgtttcttgagaccggcaggataaacagactgctaggcgtttatagcaatgctgtcatttcgtttttagagaagttgtacaaataggaagagatgacaagccacagtttcacactgcgtgaatctacgcaggtatcaattactatgatgcccctattagtggagatacaattgtgatttgatgtcacaaaacattaccctttcctgacagatgttatgagccaaactgcttttaagaaccagtcagcctgaaaatgacagaagtcctgtatcctcatcagattccacattgggaagcatttcatctttcatctgtcacactcagtcgatgtacatgacatcagttgcaaggcctacatttgtaacaacaaggtatccaggtgttctgttgacatcaaagctcagagagcgcaggctgttgtgttctgggaaaggaagccacagggagaggggaaccagtcactgtgtaggtcatttcagtctgatgtgagacatacaatagtgccaagaggctgctaagttcagtttgaaagtacggtcaatagaaagatgaacatgcgggtgtgcatgctatgttgcttcagtcatgtccgactctatgtgaccctatggactatagcctaccaggctcctctgtccatggtattttccaggcaagaatactggaaagtgaaagtgagagtgaaagttgctcagtcatgtctgacgctatgcaaccccatggactttccatggaattctgcaggctagaatactggagtgggtagcctttcccttctccagggaatcttcccaacccagggattgaacccgcgtctttaacatcttctgtgttggcaggcgagttctttaccactggtgccatctggaaagcccaactaagagatgacacttgcataaactgtctccgaaaatcagccatcagcagaatggttgctgagactaagaacaatctttgagggacttccctggtggtccagtggctaagcctctttgctccgaatgcagggtgcctgcgtttgatccttggttagcaaaccagatcccgcatgccacagctaggacctggtgcagtcatataaacaaataattttttttaaaaaagaacaacctttgaacacaaagtaccctaaaccacccatgactgtttcaaaaaccagtgtagagtgcattcatgagagtctaaaaaggcatctcttttggtagacaaatcagaaaaaggccg

SEQ ID NO: 26618 - DNA, 1487 bp, Bovine  19866881784064
tctttacttgaaataatgaaaactacaagtagaatcttaggtgttgatgtaaggtgaataaaatattaatatttagctgaaatagtttctttgttttggcctaaagaatgagaatcatgacatcttaaaatttcagattggcagggtctgttggtgatctattataacccattcccaatgtttgtatgaattgtgcctcctcatgcttatcgaatacttaagcatgtttttggggaaaatgtcagttctattggtattggtgatgggtatttagcatgtgtgtatttattttacccatccattctttcaccttcctacccatctgtctatccatccattcatccatctatccatcctatgattaagttaagcactgccaaagttttaggtgtatctgaatcctaatattttcttttaataatcagataatctatactagaacatctcacatctgttcttctgccatatggttattatgtcatattgtagatttactgatgtctacttgattcagttaagttacttacttataacttttggtaatatcacatgctattttattcaaagattaaaaatctgtgatttcattgatatttaaattttttattgagtattttgctcagttcattttacattgatagaaaattcattttagattattgaaatatgtatttttttctgagttctggaacagaattttccttaggatgacagaaagaatatatataacaacaacatataatttaattattttttcactaaatttgatttttcaaatgacttaccagttctatgctgtttgggttcatgactgacaccgctgtactccacaagagtgcttttattaaaatttgcctctgataccagctgaaaggtgatattactatagcatattcctggcagccagtgattaaacactgtttttcccttaaaaaaatctgaggaataaaaacaattatattaaatttttggttttctaaatgccacagacttctagaaagttctgaacaattatgactatctgtcaaataatatttcctgtgacttctagtatagtcagtaataaaaatttgatttaaggcttgagatgaaaattgaaatttttagacacaaaggctttttctgcaagaattagatacaattgtaattaaaattttattataggaacatttgatgtattaagtggaaatggtaacatatagaaattgtagagattaggtttatgctaatcatttactgtaagaacccaaggtattttgccaatttatgacttaggaaaaaataattttacaagaaatgttttcactagactcacttgtaaaatatagcctattttttaaaagaaaatgatttgtcatttggcaaatgggaccttcctgaaaaaagaagaaaattttaaaaattgaattttatttagaaaatgttttttttggaagataataataaacttaaaaacccaatccaagtggaaaggaagagggaaagga

SEQ ID NO: 26619 - DNA, 1017 bp, Bovine  19866881902626
gactaaaatcccacatgtattgagcccccaaaataaaaataaaacagaagcaatattgtataacacattcaataaagacagaaatagtacacatcaaaaaatatattctttttaaaaactgccaagagttaaggcagaagtggaaccagagagtgtaaccatgagaggggagctgatgactttgaaaaatataagaaaatgtcacagagattggcagctcctagcaaagacaagaaatattaggtgatctaaccaggtaacatgaaattcaaagttgaagattttatagagatgagggaggaataatgctctgaaaatgttaatagcataaagttccgttttctagtcctgccatacttctccacatgttcaaaacaaacccctcaccaaatgcaataaacacattttaactgtttaagaacaagtgaagtaaaagaaatttccaagaatgggtctccagtaccagctgcctgaggaaggtagttatggctctgtagtttgtagattccacataaactgtgatggggcatctctgcaaacacttacagtctccacctggagacacatttcaacttgctctttggcaacaagaccagctttcccgtacactgtatattttttcactatgtcttcacagtaaaatgatcttccctggtggctcaagcagtaaaaaatctgcctgcaatgctggtgactcaggttcgatccctggatctggaagatcccctggagaagggaatggctacctttccaagtattcttgcctggagaattccatggacagaggagcctgttgggctataaagtccatgaggtagcaaagagtcagacacgactgagcgactaaaacttttcacagtaaaattaggattttagaatagtggcagacttgttgattacatctatactacagtatgctaaaagaaatatcatggaacctaaaaaaatcaagtcgatggtcaccgaagtcaaaaaagatcagaacacgcaagtagatgcctgaaatcggagcatcgg

SEQ ID NO: 26620 - DNA, 1236 bp, Bovine  19866882227560
tacgacaatgcctgtaccttcccatttgctaactattccgtcattcaatcctcttatacttgactgcttcacacatttatattacctggctgacatttgagtttaggcccctttactaagaggccaaagaaatgagggctctgtcttatgaagtcacaaagacagaaatggctgtatctgagcatgttaaaacatgaaaggcagaattggtatgaatgtggactcaggcacctggttagaactgatgtattccaaccgaaaagatacatttaagtgttagtcgctcagtcgtgcccaactctttgcgatcccatgaactgcagcccaccaggctcctctgtccatgggattttccaggcaaggatactggagtaggttgccatttccttctccagtggatcttcccaacccagggattgaatccgggtctcctgcactgcaggcagattcttttaggacccacataaagaagtctggcagtacagagcagattgtaaacatattcacccagaaagccacttagagaatgagcttatggttgccagggggaagggatagttagggagtttgggatcgacatgtacacactgctgatttaaaatggatagccaacaaggaactagtacagggaactctgctcagtgttaagtggcagcctggataggaggggagtatcaggagaatggatacatgtgtatgtgtggctgagttgctctgctgtgcacctgaaactatcgtaacattgttaattggctacaacacaatacaaaataaaaagcttaaagaaaagaacctgctgtatgagctttctactagcacataataaaaactgtataaattaatgttctttattacaatagggtcatcattgttgccattgtcattgctatgattattggtcagacacaattctaggaaggacagagtcacataaggcctgtctttctctttactcacaaattgaatatatccccaatgtcttgcacaattcctgatatatactggttgctcaaaacatttctgaagaataatcagaataaataatggaagattagggagaggccatccttagcctttgagaccaacatccaaattctcctctgacaatttctgaaagacatttgtcaatcattctaggaagttgtcagggcagctctaggactgtgatcttcctgaaggaaatgaaaggaaagactgtgtgtgctcagtcatgtctgactctctgtgaatctatgg

SEQ ID NO: 26621 - DNA, 1769 bp, Bovine  19866880275744
cagatggtgattgcagcctgaaattaaaagacacttactccttggaaggaaagttatgaccaacctagacagcatattcaaaagcagagacattattttgccaacaaaggtccgtctagtcaaggctatggttttttcagtggtcatgtatggatgtgagagttggactgtgaagaaggctgagcgtcgaagaattgatgcttttgaactgtggtgttggagaagactcttgagagtctcttggactgcaaggaggtccaaccagtccatcctaaaggagatcagtcctgggtgttctttggaaggaatggtgctaaagctgaaactccagaactttggccaccacatgcgaagagttgactcattagaaaagactctgatgctgggagggattgggggcaggagaaaaaggggatgaaagaggatgagatggctggatggcatcaccaactcgatggacatgagtttgagtaaactccaggaattggtgatggacagagaggcctggcatgctgcaattcatggggtcgcaaagagtcagacaggactgagtgactgaattgaactgaactgaataattagtgatgttgagcatcttttcatgtgtctgttggccatcagtatatattctttggagaatatatttaagtgttctgcccattttttgttggatttttttttcaatactaagttacatgagttatttgtatattttgaatattaacctcttattggttgcatcatttgcgaatagtttcttccattctgtaggtttttttttgttaatgttttcttttttctctatgcatgtgttgcttttatcctttttttaattaagtcatacctctctaattaacttcatagcaccttccttgccagacttagcaattctctttatcctctaacatccggcttcagatccttccctggcagaatttcctgaacacccacccatgatacaacactgctgcgcttgccattgatagagtccaggaggaagcatcctgaactccatcaggccaggaattttatcttgttcaccctggtgtatacccagactctggaacactggttggtgcccatctttatccgtcaatgtttccaaatattcgtctaaaaagcaaggttcacaatatgaagataaatgagaactcagattcaggtagaatgtttgttctatgcctctgttctcaagagctaaaggaagtccctaaaagtaagagggcaaattgaggagccttggtttgggcagcaaatcatgtttttctttgtacttattttcttagacacgtcagaaggaacccacgcctttgctttaagttttcttttcactcccctgcatctatctgtctgcccctaccagcagacttttgagctccctgcaagattcagtctgtggttgtctgttcttcccgattcagtcacttctccttggtcctttccttcacccccaaatctgcctcatcactttctcattgaatatgccaaaatttccatgtcccacagtgactgcccttctgaacattgggccagttttctaactggagcccagtctgttctcctgaatgttcttctgtcaatacacccatgacattaaaacaagatttagccttttccctgaagctacccaccccccatgactctcctgctttttggatggcaccaacattctaaatcgctcagccttgaagatgtagaatcaactttgtcatcttctctttctacacctcccacatttaatcagtaacagcagcccttttaattaatat

SEQ ID NO: 26622 - DNA, 1316 bp, Bovine  19866880380965
accaagcttcccgtccttcactttcctggagcttgctcaaactcatgttcattgagtcagtgatgccacccaactatctcatcctctgtcgcctgcctcctgcctcagtcttttccagcatcagggtcttttccaatgaatcagctctttgcatctggtggccaaagtactggagcttcagcttcagtagcaatcttccaatgaatattcaggactgatttcctttaggattgactggtttgatcttgctgtccaagggactcttaagagtcttctccagcaccacactttgaaagcatcagttcttcagtgctcagccttctttatgagccaactctcacatttgtacctgacttctggaaaaaccacagctttgactatccagatctttgttggcaaagtgatatctatgctttttttattcccactcagtataatacatgttaatatccattcttatttttataatctaaaaagtccgaggaataaggtaaggttactccagggcagccttatttctgatctatattgttgatcaacttggtgtagagggtgagaagcattaagtatagtcacacatgaagaatcacagctcaagatctcatgatggcttctgctaaggtaagttatttcacctgggtccttagaaagaaaactctgaggattgttttctatttcctaatgagggcttctcctcagggaggaagagacaaggatactcccaaggcattgagcccacattcctagttccccaggcttcaactcatccctttggagccagggtcagggccatcagctacatcagctccatgctgatgctggttgcccgcatccctccgacaggatgctctgccctcccctgctcacacaaaagaactttagtctcccaaagaagaaattcacaaggatttatgactcaatcaactcacccaaaaggagcataaatgggattagttttaatattgttaagttgcaaaaaaacaggcatatgtgcgtgccaaagcgaaaatgtacgcaagcaaaggaggaaaacatatgggagcccatatggcgaaaagcacatggctagaccttcacacacttctcatttacaacaagaaccaaagttagtgaacatgaatttgctttgcaaaaatatgagaggaacagcttgtttgcccataactgttccactgagcaagataggggtaaccttgatttctcaactcagacacctctttctcacactccggggattaattaggctcttcacacaacttcagattagaaacaagaatcctggctgcctcgcagagagacagagaagtgggcgcagg

SEQ ID NO: 26623 - DNA, 3692 bp, Bovine  19866880420784
cttgctggagctactcatgccagttctgaaggtccttgcttgatacactcaagtaaggattgtacacactgctaacccgaatgaaaagggaatactttaaaatattataagccaaggaaatttgcacttctgaaaagataagggagttatgttgaaagacgttctggacagaactggcatcctctactctagtcatttcaggggaccagtgaggatggcctgaattaaggtaatttgctgtgatgatggggaaggtagtacagacttgaatgcttttttcaccagtaaagacccatgggattcagtgactcatatggagagtaaggaaactgaagaaggatgggagaagtccttgattgtggaatagtgtagcataacggtttagcactgagagctgatttggctatgttaaaatcggactgaccatgacatgtgtcttaacctctctgtgtctcaatttttcacctgaaatcagaggtggtaataatagaaatgttatttcacatgcacttccagaaagttattggaaaatctgatactcttccttaaatcttcttaaaggcccatgaatacccgtttaagagcttttagaatatattataaaagggagactgattgggtttggagagaaaggtgattcattcagtatggaacttcacattcactttgtgtcatgtattcacatctaataaaattatttcctaacctgtgaagatgaaagagaataagaatatccttaaggaggatgaaattatccagtagatgttggagatgattagcaagggcatttgggaggcagagagaagttgacagtcatgttaagtcaaacatggcttttaaagaagctactaaacagtgatggattattattaaaggcagagattagccaaaaagtgaagcaggcaacttcaaaggaacaataaaaatggacgaaaatgtgtttaaatctttaaagtaagaggacaaatgatagaaattttatataactgaacagcttcccctaaacaagtagttctgatctgccctggattccaggaatgcaagctctaggtttcccaggccagaggaggaaaaacaaaaaacaaatcttctcataattttccaaaagtgtgtcctgagcagctggacacaaacaaaaggacctgagttcctaatttcttgtaaatctgacacctttatcatcaccaaagtacgagttcacagcaccaccttcatcccctgttctcctttgttgttcagtcgcagtcttgtctgactcttcaagaccccatggactgtagcatgccggccttccctgtccttgatgtctcccggagtttgcttaaactcatgtccattgagtcggtgatgccatccaaccatctcatcctctgtcacccccttctcctgccctcaatctttcccagaatcagggtcttttccaatgagtcagctctttggatcaggtggccaaagtattggagtttcagcgtgagcatcagtccttccagtgcacattcagggctggtttccttttgagttgactactgaattgaatatgggtaaagttctgttatcagatgtctctccgccgttttctgctgctaccagtactgggaaaacatgggcacctttcctggaaagagtttcagaaaaaaagaagaaggagagggagaagggagaaagaagaaggagtgggagaggaaagaaatgatacatttggtcctccactgtatggatatggtttatcatctgatgctataaattaagactacttattttatttgagaatctcagaataagttactcaaaatgaggtaaactcttcctctaaggacaccagtaatttcttagcatcaactcccagggcatcttttcagtattctttcggctgaaattgatgtctttgccaccgctcttttttgatctttttttctcatttttcatgaaacaactctctcctgacattcacctagctttgacccactccatctaagtcccctttgtttaataacctaaatccttctcataaatcaaaaatggggactctcctctgggtttcaactttgagcttcttcccttcgtgtttccccaggtgatgctatcaaccatggcatgagctggagatcctgatgtgggcagacatcagagtgtgcccacctctaaattcccacatgattacaagctgtctagtgaacatcttaacctgtatgtcctgaagacatcttgaactcaacatatttcaaactcttcttattatcttctgtatctagctgggttcttggtctcagtcaacagaaattgactcagtttgacttaacagaagagaaattgattgcaactatgttgtacagctcaggaaattgacagagggctgattaaaaaatgggaaagatgtcaatatgcaggaaaaaaatcacaatacaagaagagtcttgccagggccttgtggccaccatggccaacatagggactgttcttggcactactgtgatccttatgacacctttgagcaccaggcatcccaacaggaatgactcccacactgtccctgcctcttttcatcactcaatatagaggcagagttcttgagaagagcacctagcaagcagaggccaggcaatgtgcccattatccagctactggagtggaagagcacagctctttggtcttaccagatgtcagactagactcacactgtctagggtttctgatatttaggaaaaagcttcagagtccaagtaatagcttgaaagagtgggaaatgcacactgcatgttccgtaagataaatcaacccctctggtatttctcatctcaacaaatgacaccaacatgcatttggtcaacaaagctcagaatcatctgcaactcttttgtaaaaaaataaaaaagaaaaaaagtctcatcatttatttactggctacaccatgaagcatgtgggatcttagttccccaaccaggcatttaacttgtgcttccttctgtggaaacacagagtcctaaccactggaccaccagggaagacccaagtatgtctttctctttatggtatgcagctactttgttggtgttgtttgtttaagtcattaagccttaaaattttattgacaaaatagtccttaaatcattccactctactttttctatttagatcaacctatgccatttctagaggactttaaatgctttcaaccaatgatggggtgaacggtataaaggctgtggatgccgtgtgtacaaatcatacttctgtcagtcactagctgggtgaccttaagcactttccctcaccttgttctgtgttgtgtattgaataatgttaataatagtacttgtcgcctaggattgctgcagtgactggttgaggccgtcttgttaaagcgctgtgaatgcttacaaacaatagtcatgccctacaggtcaggtaaggctgaaagtgaagagtggtggtggtgagttgatgatgatgataataatggtggcagtaatggtagtaacttcctctgactagtactctctccagtatgcagtctttattgctatcagcattatctttccaaagtaagaatttgattttgctattgtcctgcttggaatcctttggtggctcccatttcctacgagataaactccaaacgctttagtgagatttagagattcctgcaaaaggggaccctgaattatttttctacgggaccctgaattattttt

SEQ ID NO: 26624 - DNA, 772 bp, Bovine  19866880425810
ctctttgcaatcccatgaactatggcctgccaggctcctttttccatggaattcttcaggcaagaacactagaatgggttgccattcccttcttcagggtatctcctaacccagggatcgaacctgtgtctcctgcattgcaggcagattcttctgagccaccttcccaggctctccgacattgcctttatataggaggaaatagaagctgaagtcaaggtgagatgtttctctcaagtgtaaggtgatccctctagttcctcctcattgactatagcccctgtgtttctgtccctgggttattctgcccactcccctttgaagacaacaaataaatatttcaacaaaattttaattttccttctacctgtttcgtctccacagtatctcccaaaattgtggagatttcttcagatatctccattaacgaaggcaacaacatcagcctcacctgcatagcaacgggtagaccagagcccacggttacctggagacacatctcccccaaaggtaagagaagcggcttgggacatcatgtcatgcgaggaagtgggagaatcgttggctgtggcagggaggttatggtgctggtggcctggtcacaaggatcccacattcttggtggcctgataacaatatacccgtagctccgcagaggaatatcggtgttctcaatgcaagatgggcataacctctaagattccagaaatcacgctgggaggattgatgcaaccccctgggagagtaatctaccttgtttctgggtgaaagg

SEQ ID NO: 26625 - DNA, 3328 bp, Bovine  19866880490014
gagaacacatatgtgcttggcactcagaatagccctggcacaaaataggtgctcaagtgatgtttcttaaagaatgaacactgactttagaaagatttagtcgtggagcatgattatttagattgtagtggaagggtctgaacatatgagaaaaaatttcccatacagtaaaggatgtaagatcactgtagattacatcgtacctgaccacacatgttcaggctttgctgaatttgcatgacagttttagaagaacatacatgtggaaggattaaaaagtgctgctctgttcttgaagactaaaccattgcatggaaatctacatgaatggggtgactaaggcagggttcccctgggacacacctggcatattgggatgagcagtcattaactgatcgattccacacatatctctttggccagtggcaggaactgtggtagacaaatatggcaggaatccagttgccaagagcttagcatctactggtgggaaaacaagtaagcattcaaattacagcgtggtgtcatgatgatgaacactattgtgctgatacatacatagggtgatgggaatagagagtgaaatacagtgattagaatttgtccctagtagtcttgtgcctggactgggtttcacatatggggaaatttgagaaaaagaagaaggagtcatttgaaacaaatggatccctacttgtgataacaaaggttcagtaaaaggcaacacaacccctgtagggagaggacagagttgagtgaaagagaagcaaagagaaatattaaacagctttggacaggggccgccctgggaggcagctagacttctcttgtgtgaatgcagggaaggggagtgaatcacagaagcagaatcacatttaagttttaggaacatcctcgcaaaatacatatcacacgtaagaaagaggggagcccaggccattctggaacttctgcaattaatccagacaacaaatgccgagtctagatcaggagctgatgtgacttctgtaaagggttagataggaaacagttcaggatttgcaggactctgcctccagcatgacgactcaactctgctgttgcagctggaaagacccacgctttttttttttttttcaattgagcaaagctttgttcttataaaactgtgtgtttcaggaacacacaataagccagatttggtctgtgggctgtagtttgcaacccaagggtctggatcaaggaaatgatctgttctgggtcaatgtcctataaactactggttgaccaaaaaggttgcttggatttttccataagatggtacggaaaaacccaaactttttggccaacccaatacattactcaccagtgggtgggcctagctagttgattaatcactacccccattaagagacttaagaaaggtgtgatgagtggaaatgctttttttttttttttttaacttcacaatagttttggaaagaatctaaaagacacatgcctgcggaggcaacaaacttatgccctcttccacacttctggctcttgacccagtggtgaaggatcaaggcggggggcagctcctcaaagaccactgctgagaagccaccagggagatcttggtaaacagacttgagaatcattgcttagtatgacttccttttagccaccagtacctcacactcatgctaaattcatctgtcatcttttgtcctgataaagttagcacttgaatttctacaaataggatagaccaccactcaccatgtgttgaggccaccttggttacctggaactgacaaagcaaactccttttgacaacagcttaaggaaatatagtcaggaaggaaaacagattaaagcatcatatttcaaacttacacaacctctaaatacatgtggacgatgatggaggacgaggtcattgccctgactgttctcctgtctgtagacctttgagggattagcttgcagtgaccaagggctctctggcccctggggtgggggtctccaggaagtggataatactgatgctccctgcactctctcacttggacagagccctcttgaaacttctccgtgtatcctattccatacagttgctctgggtgccattcatagacacactgaaagccctctacttgacctccctcccctcttcctctctgccttactattttttctaaacctagtaatgatttgggttcacactgcctttcctcgctcaacctttcttgtcaggaagaccttccctagactggctgagattcaacatggcggactggagggcaccaagccattggctcaatatggacacttaactttgatcccttctatttcatgcttcagaatgctgagagcaatagctccatcactctcactccttcacagtgtcacagaaattaaaagttaattaacgaaaagggcagaacacatttccattaagcatcataacacttaagggcaaatccatttatagaatcctctagagctactgttgatcagggttttcttctcagggtttcagtgaacttccttgaaacagtgcctaagatgctgtggtttacagccaaggatttcactgtatcaacgggctgagatgataccacccaaaaccagttgcaagacaaaccccacactcaggactgttctcctaagtccttctcattgtggctttaaatcattaacgttaaaattcttcctgaagtctattggtcaactctaccagcagtaggtaacttaagtcagaagaggttgggaaaaaaattctttcagttggctagtatgaagtacttttgacctccttctcataaatacctgcttgctcatagccattaagaggaaagaataattttttaaaaacctctcaaataataaagaattaaagcaagattaagaggtggctttctgattctaccaccataccattcacattggacaaaaagtaaatgatagaatcttaggattatatctgccttcatttggctgctgctgctaagtcgcttcagttgtgtccgactctgtgcgaccccatagacggcagcccactaggctcccccgtccctgggattctccaggcaagaacactggagtgggttgccatttccttctccaatgcatgaaagtgaaaagtgaaagtgaagtcattcagtcatgcccgactcttagtgaccccatggactgcagcctttcaggctcctccgtccatgggatattccaggcaagagtactggagtgggttgccattgccttagcattggtcgagttcaatagcttagcatcttctcctaacctgctaaaggggcatgagtcactgggccatagctgatggttgagaagttgctattgg

SEQ ID NO: 26626 - DNA, 1385 bp, Bovine  19866880500382
tcatcccactaccccaccaacatggatatgtcttctatactccagtctaatgtgagttactcagccaagaattctgaattatcccattactagttttcatttattttgtcacatgcatgagaagtaataaagttgctctggaaaattaataatcagtaaatacagaataaagaagcaaacagtatcctagattaagactgtgtctctatttttaaaaagtttttgaacagatgcccaaagcaactgggaattgactagaggtttttagctggttaggataagtatattggttcacaaccattaaggcagagagcctaatcgtcccagtattttaccccatggcccactggggcctcactgctttcaacaacaagattttcattagctctaagcattttgttagtctgcttggttcattgctcaggtgtggaaccactgaactcaattacagcttcttgcatagagttttgaagtacagcattactaagaagttgcttgttaggaaaaattcaaatgtcttctgaaatattctgtgttttatctgacttgctgcaaggtattatccttatgtttagcaacagaatgatagtaaggataataatataagtcatcctatcctgtccctgcagagaaggcaatgacaccccactccagtactcttgcctggagaataccatggacggaggagcctggtaggctgcagtccatggggtcgcgaagagtcggacacgactgagtgacttcattttcacttttcactttcctgcatcggagaaggaaatggcaacccaccccagtgttcttgcctggagaatcccagggacgggggaatctggtgggattctgtctctggagtcgcacagagtcagacatgactgaagcgacttagcagcagcagcagcagcatcctgtccctcactccactgtgtggcaacatgagtgcacagtaatgcattaacattctggtacttgccaggtggaatcgctaaagctacgaaattgagtcatacggtggccactggattggaatttacttctccaaggccaatggaatcagaatgaaagggagtttctctccatggttctgaaagaaattagtctcccacaggattcgatactgaacaagttcaaaggaatctcttaagttgaattgtgcatttattgtaatgtctctaataaatcaattacttcttggcagcaaaatgtcacagcatttcaaattctgataatcatctccacttttctgagccttaggctgttataacccacacaatctagcgaggaatgcatcaaggagaaggctaagcaacaaggaaacaatagactttagactcatatacttgactaggattcagaaagcctaaatccttcctcactcccagaat

SEQ ID NO: 26627 - DNA, 2192 bp, Bovine  19866880532944
cttgacagtcatgcttcccaatgcagggtgcccagctgacaacatgcagcaggcgcctaaccctggtggcttccatcgcccaggccagcccttcctcttctctcccgcccagaagacaagaacaaaaaggaggaaattaaaattccttcctctgaaaaggttaagtccttacaaaaggactcaagttcggtcaattgccataaaggatagatattcaaaggtgcttcctcagcacctccctcactcccatgattttctaattaatgtaggtgcttgattaaaattcccagagtaccccaagtagccatcccaggagggaacacataattgctattgcaaaagatattacagcgctcattgatggtgggagaaaaaaaataattgcatcataatggaaagtggtggatgtcctgtcccggggagcaggggtgcatacggtattaggtccaacctgtacagagaaagcagttcattatgatggagataaaccagtggtccatcctcaggtatggggcggagcgatccacaaactcgttaagtaaatggtttaaacacagatcaaggtggcaaagaaggaagtggagacagacatttatagatcactcttttaactctgtaattttctttaactgtaacattatggctacacagatacatttagggtaaaatttgccaatgtcaataagggttttgtaagtttaatatttatgatctggtttaaagcaatattagagccgtgcagcttcctacttcaaagaagagggaaatcataaaaagactagtggggaaattaatgagttcaatgtgcctcaattgagaacatatgaaatcaagcctccgtctagaaaccgagggcaggagtgcacaccacagacgctgtttgtggttttacccaattattttaaaacccttgaaaaatgtagactgagacgtccgctgaatgcaggcactgctaacagcatcctcccccacgctttcccgagtcttgggctatttatgcgggtacttggtgactgttaccatgcagaactgttttgatgaaacgaaaaaggaaacagagaagcagagagattgtattgtcttccccacagatgctagccgccctggctgggttattacaaaggccggttaaaacagcagcccctctaggccaggagaccccatctctgaggaccatacctgacaggcagctctttggggggtacagaagggcctctgcagggcatcgcctcccactacagccatgaaacctcctctccgaggaatcccgtagaccagatgagggcttcacgaatcccatagaccagatgagggcttcacgaatcccatagccaggactcaccaggagctgccaggagagcttggatacagtttgcaatcagattgtcctggccatgaggactttgctgtgttgctttgactttacagctgcttttccatcttgcatcttatcttgacctgtgatgactgctttttccctagagtctgaatggaagggtctctattatccaaccacaataactaagactctgaggatattaaaaaatatgctatccactcttctaaacatgcagcagagtcgtatgaactcttctcaacaacagtgtgagcaggtcctgtgatgagctgctttactgatgagggggccaaggcttggagcatagacaagtgggccaggaaacagggctccaagtggcagagctgaaaccccacccacggccgcagtgtctccagaaggcacgtgcttaaccactgtgctggacagcgccaccctccaagggtggtccctgggccagcagcacaggcgtcacctgcgtcgtaccccagacctcagatgggactcagaaatctgcattttggtaaatccccagggaattgtgatgcaaacttgagagccaccgctgggtgctgtttgctgtgtgccgggcactctgctttacataccttaatatcacttaactcctacagacgcccttacaagcaggcatcatttccattttggcgatgaagaactagagagctgataggaaaactggcccacagatattaaaaaggtgaagttcaactccaaaccttttgacttcaggattcatattctttttaaaaaatctttttaatttgtataatgttgtatttggttttctgctgtacagcaacatgaatcagccacaatataccttatatcccctcca

SEQ ID NO: 26628 - DNA, 866 bp, Bovine  19866880539639
cataaatcagtctacatgtgcgtactgggccagccacacagcagtctgcacggtgaagacctaggaagacgcttcaaagcctcatcgtctactttgctccaaggacaggaataagaaacctgggaacatctgagcactgcagctgggctcacaatgcggcgacacaaagtgtgaaagttaagtccaaataccaattgataaatctcgactttgtgctctgaagcttgacaggaagactctagctggtgatgccggtgccggagaggaaacgggcccacagcactggcttatcgaagactgttttaatgttttatttgagtaatgggccttgcaaattagcacccctgcggcccgaaatacatatcttttcaaggacacaccggttttcaattcgacaggtgatacggaaaaaatccccaaggggagctttgatttctgtacttttcagacacagttatattttattccagctcggatgatgtggaggatggcggagggctctgagggtgagctgagggcttgcagaggaaatggagcagaaaacagctctcagagcaagatgagggtggtggttcctgggacagcgagtggggagggaggccgctcccatcctagggaggaagggggccagtatccctgcccctggggagggaggggcggacagccagcagacaccatgtcctcaggggggacttttactcccactgcccctctctcatttcctcctcttgctctagtcttcttaatcacaaaacagttaagacgtgagtctagctcaacaactagtttaacttatgcacccacccactgatggagtcaacacatactcactctgaatctattatgtgcaaacaccatgttgaaag

SEQ ID NO: 26629 - DNA, 1186 bp, Bovine  19866880579102
tatatattctgcactaaatcatcctcgagtacctgagctggacactttcattacccactttatttgcaaagccgcagcctcccacatcccaagacccaaagtggcagagcccctctggcatgctgtgggcaaagtgcaggttcttagtcccctagttcagaacagccacatcagataaacgtgaagtcctgttacccagaaatatccatctaaggacaaaagacgatttgactatcgtgaattctgctccatgttcctcctcctgcctgacagtcacctccctctccagagtaacaatcatctgaacacaaacagacgtgaggcttttcaaaaagtaatgaactcacaggcgtaggagccaaggcgagcatggtttaaatgcggggctccagcaacccagacaggccatcaattatatacccctgccgtcgaggaaacaaaaataatatttcaaagagtcactgtcagaaagagaaaggagaaaatgccatagagatcacaccattctgagcaagcagtttcaaacgcagaaatgagtggataaatcctgccaaggcggccccttccaccaagaggggaaaagagggacacagcgaccaccatcctgctcagccttcatccaacacacctgagttcacgaggtcactttttcagcattgttttccgttaccacttagtgggtgtagaaaagcacattcttcatttgccaacccatctccaaacatttttgagagctcaatgtaatatataagtacaggattgactactttgcattatcagttcacatccatgatgcaattttattctatttgacttagggaatggaccactattacctctatttaacagatcacaagatcaaagcctggagaagttcaatgacttattcaaggtcagccatctgttcagtgcccagctgagggtttagaaagcaggaggccataaataaacatttttttggcaataaagcatgatgagactaaaccgttaagtatctgaaccaaggagttggtagtctagtagccagtggaagcctctatctcacatctctctctgttcaaggcaatctattaagagctgctgctgctgctgctgctaagttgcttcagtcgtgtctgactctgtgctaccccatagacagcaacccaccaagctcccctgtccctggggattctccaggcaagaa

SEQ ID NO: 26630 - DNA, 3811 bp, Bovine  19866880579321
tgtgcctgtgagcttacagcaacatctcttacagcttcagtttccttgtctgcaaagttgtgtctataattgtcacggcactgctgcgacgtggatgagggcagacactatgggaagaacaggcaagctaccagcttggatgctctgaacagggaggtggccatgcagtgagtctctttctttcactttcagctctgtcttgtcccttctacaaccaccacccccaactaccccacatgatggtcccaacatgtcgggggggaccatcccctaccccacagaacaggaagaatggctctacttagatatcatattctcagagctgtccttagggtcacaggaagtaacacatgaagagcgccaggcaaagcatccagcccctgagtgttaaataatgccactttctcccctctttctcctctgcttccatgtggtcctaggcggatgagcaaactgacttcaaaagcacagaggagttccctggcttccctgatgcctggaccccacagggtgggagatgctttctgggttggctgaggaggaagtcaagctgggcgctacccatggagcctgcttcctttttcactcttggcctcattccctgcaaggcgagcttgcaaggacggttgctctggttacaagaccaaatcactgctgtttctgtctcttcctccgtgaaggtctcgggggaatcagcttattagagaagcagtggctgagtgatggagtcggctaggacagtaaagggactccttggaggtcctcagatacaaagcccccggttcttctcttgatgaagccagagcctccatctcagggctgcctggacaaccctatctgcgactgctcccgtctgctgtcttccacttcatacagcggtgctctggtatcagagtcagtctgcggtttgaatgtgcccgctttgatgtcaatccttactgtagaggcagaagctccattgtccctgcccaactcttccctgcactctctctggtcatgggcagtttcatcgctcttcaatctgcccctctctttctcaaagttcttaccttaagaagctggaaattgctgaggaatagagtaagacgtgacggggatgtgcccagggtgaagatgcacaatcacggtgacatgctcagaagaaagagacactgtggctggcccagtgtgctttgcacagctgtgttatgacaacggcaatgtgtgtacagggaggagtcaggcaggatggagggagaagagcaagggcctaagggagacagcacttaatgtttattgagctcacgcatggacctagcagagctaggagctctcccatgcctaattcatatagtattcaaaccacctcaagcaagatgcaccatctccctggagaccagaggtaggtgctagggatctccatggggctagaagtcagcagggttggaaccacctccaccctgggtccctctggctccataccccacactcttcctggttcagggtccacggccccctgttctcagggctctgttgaccgaaccgagagcagtcacttaagtctgtggacatccaccttccctgtgagcttccagaagggaaagtggggtgacgcatattgagagaaaatggcaccaagtcccaggacgctctcttggctccaagggtcgggtctagaagatgcctgtgctctgcgggttgcccctttccattttgccatcagggagcaagccccagggagaggtggctcatgagtgcctgaccctaaaccaagcacaagtctgagagcctctgagaagcaatacacagagggaattgttgatcctgcatagaaatgaagggaggaaagtatttaattccaggctcccaggacacaggagagggtcatgttttctagtttgaatgaaaaagagagagatcaccaaaaatcactgcctaggacaacagattatggatgatggaaatacagacgctattcagccaaatgtgactccattcaggccattaggaaccactgacttataaatataagtgcctctatctctgtgagaatttctctcttcccccgttgactcctctgtctgtcacagagcttgcttccccagcacctaccacgggtacctggtgcattgaaaacctcagtaactggtgcataagtgactccttggcttttgagttgaggaacctgatctaaacagcccttgagcagaggctgtgtagagatgccctggagacggaaagggggcagtcaacaccagtagggtgaaacgggtgtgaggtccaccttttggtccccagcgttgatgcagtgaggtcaggggttaggaagaatcacccagaagcaaaagacgtcgagacgcgagatttgtcataggactcacctactcactccattgtctaaacgagaacgggtctgaacagaacaagtcgtctcttttcgcctttcttctttttgcttgttttgttttgtttgcttgtctgtctgtttccctttggcaggaatactaatcttgcatttttacaagcgttcatgttttaagcctggatctcaccgctcacatttttcagacaaagcccctacaacccagagcctgtggtgagccccagacctcccagctggtagcacccagacgagatgaaaatggggccgggctcctggcctctggtccctcactgaccctcttcctctgctgaccagctctgttctcattctagaaccaaggtatcttcttcccctactggcttcctagtggaggccaatcttcctcatttgtatattccttttactcataggcaagccttgtgacccccaaagggggacctgtgcccacccttgcttgcactagcttacctggcggcttcctgtcctagttcactgggaaaatgcaagaggagtgaaaagtcaccagcctccatgcccgtgactgagtgtgaggaaggctgagaagggcaatgcgacggggagtggattagatccgggcctttgcacctgtgggctccccacatccattacccagtttgtaatcacatatgatgcgccagaaacacactaagtccaataaaggacccagcgaaattaaatatggtccctatactccagggagtagatagaattaacatgacacacacacacacacacacacacactcacatgattaacatgttaatggtgggactcagaggtcgcatccctctgggggaatctttgcaggtgatccaaccccaggggttactttagatcaaaagatgcctccgtttcctgcacaggctgagaccagccccccagactcctgacctggtccccccagcagcccccagggctccatcatcctggcctcccaacaagaggctcaccacaaggagaaagaggtccacccgggggctgggaacacacagctgccaccgcccccaccccgaccggcgcgtcagtaaacagcaccaccgcaatcagtttggcttttttgatgaagacaaaaccatagaggaaaaccattagaagaggtaataaaggcccttcttgtacagttaatagagagcctcctggatggaacaagcccagctgttgctgctgaaaatttacttctgttttcaagttcaaatagagactaaaacattatcttcgcgggaattgattttacgtctcccaaacacatatgccaccttaattgtgatttgtgtgatagttcagctgctgaaagctttcgtttatctctacctggttaaacaactttaaataataacaagtcaatatatctgtctattgaccagggctcttctcacatcttcagagctccacacaagaagaaaaaagcgttaaccctttgcagcccca

SEQ ID NO: 26631 - DNA, 1798 bp, Bovine  19866880690038
tctcttctgattgcacacccagtggaccctatcttttgattaattaggtatattattttcccctgttataatatcacaaagatattccatgttcaaaaaaatcccatagttgattataaccataattgagacacacagggattaatttgaattaagcagtaactctacagatgctcaaaacagaactcagaagactgacttgccacttctcactctcagctttaggtaaggccatagaatataaaacacttctagcacatttttacaaaaagtcaattaacatgtacaaaataaagtgaacaccccaaaagaaatgtgattcaggaaatgaactggttagcatttacagtaattactagagattactaccaaattactagccaaattactggtagaatgatcatattattctcttcctgctaataatgctgcataccaatttcaagtgagtgtacataatttccttgccagggtccagacaatatttgaaaccaatacctggtcagggtctccatagctccccctccaacactgtgatgaagctgggttttgctttaacctgcagacaatgctccctgcccccaccagccaacctcagccccttgtaacttttggcgagagtaacatcagggtggaatacaaagtaaacaaaaatagccttgtcataagtctgacctgacagctgtgtggtcattcacgtgacctgatctgaaagaggttcacagagctgtcctcaccactcaggggccatgactgcctgagatgccaccatttaaacacgagctagggtgaagtactgggaagcatttactcctccacctacatggacatttgggagagaaggagatccctagctctagggggagaaaaaacaacttgtaaaatggggggaagcaggtaagggatgaaggtcttataacagatttgggtttgggaagcagtgctgagtggatgagatggtctgacagcatcaacaactcaatggacatgagtttgagcaaacgctgggagatagtggaggacggaagtgcctggcctgctgcagtccattgggttgcaaagcgtcctccacgactgaacgacaacaaagctgaatggaagtctggggtccaagatgttgataaggaacccatgcctgagaaaggaagcagagggaattaggatcaggggcatacattcagcacagttcagctgggacgcaggctcagccgcctggtgggagctcggaaacattaaagcccatcacatcacggctgtctcaccaggtgccgggacggcctgaggttgatactcccacctgcctcagtcactggctacgagctgccttgggaaagaggacatgaagccacaatggagaagtttcactgtagcagggagggccctgacagaggtgactagctgggcaagtaaaccacagtcacatggagaaatcccccataaacatttactccacagttttggttagtcctggaccttgtactaaagagcccggcaagatcccaacctgaaaaaaaaaaaaaagtaaaaaatgaaaaagctatctccagaaaacaagaaatgacaccaccagctctatcataaaagacacgccagtgattgcagaaatgttgttgtcttttcaaatcagcctaaactggatttccaaattagcagccccaactgtgactgtgcagttccttgcgttcatggtgctgaaaagttgtattcactgtgaagagagaaccatccgacagaaggctaccacatttcccccttctcagaatctcggaaatggactgatttgcatatttagcataca

SEQ ID NO: 26632 - DNA, 1473 bp, Bovine  19866880720229
ttcctggaagagcagcagttgttgtttggaaataattctgcaaattgcatttatctcacagtggtctgaggtcacaaattcaagagcaaagagaaggctcttcaattagacactgatcaaaagagatctgtcaggatgacattccatctgaacaatcaattgggatggagaaatggttcagctgcagctgctgttattcagctttctttattattatttcaccattggttggagtcagggagctggctgctgagtgccgagcagttcagggcacttgtcactcgatcagatagaaatgcatctctctgtgtcctgtgctcgtgatgtattaatggccaaatgaatgagaaaagtttcctaaaagggaagatagatttctgctgagctctgctactcaggattttgtccagctgtgggcaggcccatctcttcccctctccctccctcccccacaccgttcaggaggcccaatttgtgtttgccagcccaaggcgagacttccaagactcactgggctcttctggcccttgattcagtcacctaggattatagattggcataggaatgttataagataatatatttcctgaagccacacagccaatttctgatttcagagagagggtaccatccatcaaagatacatctttgagctgcagttcaacacaataccactttcatcagctactgccattggaaacacacacacacacacacacacacacccctctttgctccttccatgacaggaggaggaggtagaatagcagtgatggagagctgaggaaaggctgtgtctatgatgtttcctttgtgaccatgggaatgctctgctgctttaatctaggctgggggagcaggtgcgggttgacttcgaagccccagtttaccccttacctcctctcttatgtttctcaacagtaggaaatcataactcattttgaaacaaaatgtccacagtgctgggcgcagtgtctgtgtcagcagtcccttaagttgttcgtgccgtgtgttgtccgcacagctggagggaactgtggccgggagaggcagggcctcgcctctggcaccctcgtgttgacagcagcgcatgcctctgacccagaatctgtttgccagctggttctcctttccaccactgactgcctctgagaagccacacagcatttgactgcaatgtcaggcttctcagggtattcaataaataagagagaaatgacggttactcagggtggatagttactcaggcaggttaagcttcctgcataccacagttggtaaagcatctccctgcagtgcgggagacctgggttcaattcccaggttgggaagtgtggggaagttcccctggagaaggaaatgcaacccactccagtattcttgcctggagaatcgcttggacagaggagcctggcagcctttacagttcatggaatcacaagagtcagacatgacttagtgctatctttcttt

SEQ ID NO: 26633 - DNA, 1412 bp, Bovine  19866880727501
cgagtttacaccatcaatgacggctccaggccctgtgtaggggaaagagagacaggcttgttagcattagcacacacccagagggcagcttcctcagcccctccaagcactgcacagacatgcttctctgtgaacagcctccacccggcccctgacccttccacgtgcccataaacagagagactcaaaggggctcctccctgggtcgcctggaccctgcagcctgctctcaaacaccagggttaaagcacccacaaggaggtggagggaaggcagggttagacctgcctgctgacaggccagggcaggcccttggaggtggtgtgcaggacagacaggggtgggaggggaagcagaggaacggggagaggagagtcaggatggaggggagaggcgggaggagggagagggaaggaaggctttcgtgagacccaggagtctaggtgttgctgtggccgactttttgtctggcgtgactgggatgttgtggagcagctggggaagatgaataactacaccccatcattttaaagactatggtggcgtttaagccagcagtcaaccctacatcaccagggggtaccgagaggaccccgccttctcagacctagcagccacctccctcgagcgtccttctttcctcttccctctctctggccctttgtcacagttcccctgaatccctcatattccacatgagatgagagcacggactgacaaatgctgttcctttccctttatctacatcctcctccagaagacagactgagtgcactggggttgtcctcgcccatcctgaggacccagggcggaaggataagtgtcctgccctgccttcatacccgtccatcacctttgctgggcagcataagaatctagggtcataagcaagagcagtggccagcgaacagagagattccagggtaagcgaagctacatcttagtcaaaggtttaaaagtcctcaagaggcaacctgcagggccagtgacaaagggcaggagcagtgggaagacaggcagggcatcacggccacctttggtggtaatgtggctccttggaaatgaacttcactcccgacaaaagggttggtggagtcgggtctcctctgacagcacccaggtcccacagcttcctggtcagcgccatggcttggacccaggcctcgttgggccgacagttggtggtgacagtttagccaggggacatatgtgtctctagcttcagcgaccagcatctacctgttcccaccccagggttctcagcaggataccttctatttctccaatgcataacacaattctcttacttactaagaattcatatttacttgagagcttgagagtcctgctcacagttttatgtttttttggttatagagtattcacagaacaggacagagtccaggccttag

SEQ ID NO: 26634 - DNA, 1283 bp, Bovine  19866880739462
taggtaactatttaacaagtatttgctggaacaataaataaatgaatcagtaattaccttggaatgaacacaggtctctggttgctagcttcctaagtaatattgtatttttgaattatattcttggttttataaagctttccctccacgggccgtgtttatttttaaaaattaactggtatgaaacttaattttattttgagactattttaagacatagtggccccacagagatactctgggatattatgaagcaaactttgggaaattgctgacctagatacagtcgcaaggtgataggtgctacataaatataataaattatactgagggggtccccaggcctttcttccctgctactgcagatggcacagaaatagtctgaagaaacattgaagaatgtctaagggcagaagcaatttaacacctcgggctgctttgtctacctatattgaaattattttatttaatatgaaatctacttattcaaccaatatatgctgctggaatatgtatgttatgatgtgccagatgcagggcaaggttttggaaatgtgagagtgaacctaatttatcaggtccttcccccagtggaggccgtagtgaaggcacaggggataagcagacactaattaagcagacacttacctagatacacatgtgttattatttttttttcctcagtaaaaattcaggtagtaccgtaagtctgtcctatatacagtactgtgtgtaatacagatagctcgtgggaacctgctgtgtaactcggggagctcagctcggtgctctgtgatgacctggaggggtgggatggtggagaaggaaggctcaggagggagggggtatatgtatgcatattgctggttcactctttgtacagcacaaaccaacacaacagtctagagcaactatactcccaagggaaaaaaaaaattaaaaattcaggaagtgcagcaagtctgtcctacgtacggcatccttctttttgacactccttccttccttctctttcaatgcctgattcttctaaatacgattgaaatgtaggagcgaaagcttatatcccccaaacactgatccaggtttgtgttgtcttccccttagaaggaagcaaataaaaatcaaataaaaatgcctgccttcttcttgactgtacccctatagtaaaagctgaatcagtatttgtcaaaatccgttgaggaagtgactgggttgcaccaacactcagaagcaaagctgagagcacagagaggagctctgattttgctggtgccacacag

SEQ ID NO: 26635 - DNA, 1439 bp, Bovine  19866880744492
tcagcatgctccatcctccccaggctctcaggtaccttccagtggatctgtgtaccatcacctccgagagcagcagacgcagccccagcacgcacggcgaccactcagttctcaaaggaggcatcatcctccccagagcagcttgtgtgagcttcaggctctcttccctcccccgcccccccggaccatggagcacgcatagcagtgtggcagctgctctctgactcaatatatttcttcctcatgttaaatactatcattcactcacacaatggtatgtcttctgctttgattgttattattaggttgttttacactttaacggctttagatatgaaaagaaattgctggatgccaggctatgtttttcattatctgactccattcagttttgctccgtgtccttgtggcatttggcacacttcatcttcctaggggtgtaaaatgcctttcctgctggagccaggacagtcagagagcaatccgcagaataccaattcctgttcttccagatccaggggccagcctccctcggggctgggctgcacacgctctccagatgtcccatggttgcctgggtgtatggggtcagaactaggtagcccttcctcgcctaagagcatcgtcctaccctttactctaacagagggttgattcttctaccattaaccctctcccccagctccccaaaacaaatccttcttctcttctcttagcaagagttaaaaggaatgactttggtcttaatcattactttgacagattctggactcctcatgtttaacgggtctgcagcccaggaggcctcatgctccttcctaactccctgcatcactgctttgccctttacgggatggttcaccaggtcacaatggttgacgatatttggccagacatctgcgtgatcgagaaagacggatggcttcttccctccattgatttatttcttctgtcgcccatcatttccaaaagggattaaagcagagaaggtgacatggatttttgtgcccagaaaatcttctagacaaaacaatcttggttgtttctacattgattcaactatttactcaataattgctgttgagcacctgcttctctgcagctgtctcagaccatgcagatccatggcaggacaaagcagatggaatccctggtctcacagagcttatattctactgggagagacagaaagtaaatccaaggataagtgaacctgggagtgtatgatattgtaattactgtgaaaaaaattaaccaagataagaggcagagagattgtcaagcatcagtttggggtttgcagccttccatagagtagatatggatggacttattaagaagataccctatagaggttaggggaaggaggtatttgggactttgctggcagggctggctcttgagtcccaggccctccatcatgacacatccaggctgct

SEQ ID NO: 26636 - DNA, 1015 bp, Bovine  19866880861170
tgttgacaaatgtctctgctttttaatatgctgtctaggttggtctcaactttctttccaaggagtaaacgtcttttaatttcatggctgcagtcaccatctgcagtgattttggagcccagaaaagtagtcagccactgtctccactgtttccccacctatttgccatgaagtaatgggaccggatgccatgatcttcgttttctgaatgttgagctttaaaccaactttttcactctgctctttcactttcatccagaggctctttagttcttcttcactttctgccatagaggagacttagatgacaactaaaagcagtgtggggtggagaatgccaccctggacaccatgagaaaaccagggaattgggagtgctctctgcagatcagttagcgccattgtaccgatgctctgtcttacttttgagtatggtaccgtggctacaaaggatgctaagtgaagcatttccagttctctgtatcatccttgccactcttctatactctaacaattattttaaaataaaaagttgggttattttttaagaacatgaagaaaacaattcttcctgaaaggcttcaccttttatcagaaagcacactggcagctgacctgtttccatcagacgattgaaagggagcggaaggtgctccacccaagcaggtggagacactgggttatccgctgagcatccttgatgaacatctctgcgggaggtcagagcacagcttgtcagagaattccaagaagggaactgacaactgggggaggttccctttatgtttcttaaatacctgcctttcttatttgaaggaaagtgaaactatatgacccagaaggctaaaaataagtaacctcgagtcaaggaacaggtggccattccgtttaaatatgttccctctgaagtgaaagaaattcagaaaataagaattcattgtgctaacgtattgagtcttcctcattctcctgtgatattggtggcccttttatatgcataaagggaaatgtatta

SEQ ID NO: 26637 - DNA, 1405 bp, Bovine  19866880903110
tgtgactggagagacagaacttgctttcattgtaaggattacccccgcatggttccgtttgatctgttgtttttcaaattcccttttgttcaggtttggggtggggagggtctacggggcttggtgtctagaaattaaaagttattgttcctgttctcttaatcataataatgagtttggcttgacaaggtcaattaattattcgggattaggaagcaacactattatacctatcaggcaggtaagaggggagggctctgagcagagagacaatacaggctaaaagaagggctggtgttcgcaaagctctgtttattgtccgcaagtcaccggctgctgccggctattccctggccttttccctttctctctggaagggacagccacatcctggcttcctctgctcctttctgccttattccacagacattagtggaggccccgcttcacgtgagctccagagactgtttgactccaaaaggcaggtaattaactatcaaacaatagaaaggattttcagattaattctgcccaggaagaactacgaaaactcatttacaccaaacaaaagggaggggttgatttgatgctccagtgacaaaagagagacctagttagggtctagaaaaccgataaaggtccaaaagcttgtgttattattattattataccaatacctccacttttataagcactgtattctactcttctctatcatgcaaataggtctctaagtgagatttaagctcagcaggtagaccaccagtcaatttctgccctctgataagaagacaacagcagaggatgagatggttggatggcatcaccgacacaagggacgtggatttgggtaaactctgggagacggtgaaggacagggaaatctggcgtgctgcagaccatggggtggcaaagattcggacccaacttagtgactgaacaccaacaacgcggagaccattccctaaggttccctaagaccaccagggcggtttccctgcactaccagggcttttatagatacaattagggctttggggaggtcttccatgctgtcctgaatttgagaacaattcagtacaaagcgtttttgttcactctgctttccagaatggggcctcttgcaaggagcaatgaagacaagtgtagagcttttccgagaagcttgctttggcagccgaatccagagggggaaagagttaaagcgtgtaactgaactggagaagcggcctcttattaattacactcataaagcagggcaccctgaggtcaaagagatggaaatcgctagacccaaattttaataaatcgtagatggagctccctcactctggtctcagagattgcattccggctgcctaagtgggcacgcaaacccctgggggtcttttttactcttcacaaa

SEQ ID NO: 26638 - DNA, 922 bp, Bovine  19866880911941
tctctccctgaaccctccagccctgtaacaagggccctgccttcctatccttcctgtagactcactcacctttttgatggcatttggaggttgtgcttgccccccacgagtgtggattaactagccacttcctgtgaactgatcctgatggtaaatgagcctaatggatggtattccttgccctggtcgtgtgctgccaccaaacacagccatctgcatcccccaggctggactccagcagcccagagaccccccaacaagccgtgcactgaggcaggctttcctagaaattacttcaggggctgcacttgggggaaccaaggccccaggggctgactgaacacaaagccctaaagataaaacaaaatagctttatttaaagatttatttaagaggttttaaaaattgagtagaacatacatttttaatactgattgatattattgcaaaacattctaatgcgagtgcgccccatgggcccttgccggctacataggccgaatattccttttcatgcctaacatgagtcatagtccagccatgggtggatgtgctgatgcaaggtgcccctgtgctgtggggagggggcgagaggatgtgggagagcagcagggagaaggaagaggggaagatagtgtgcgaacctgacactgtagactgcatttcaatacagagggttcatgctccctttctgaaatgtattttgtagctgataaagtgcatgcacgcgagaagcccgctgaaggccatgaatgccttaattaaaccttgattcccatttattgagcaccatctgtgtactcggcgacggcttcctgcttttgcacacattaattcatttgattctccaaacaatcatggtattatgcccatcatacagatgtcacagataaggcttagcaacacttgcaagctcatccaa

SEQ ID NO: 26639 - DNA, 2933 bp, Bovine  19866880945119
tccgactctctgtgacctcatgaactgcaccacgccaggcctccctgtccatcaccagctcccggagtttgcccaagttcatatccattgcatcggtgatgccatccagccatctcatcctctgatgccctcttctccttatttacataccacgcacataagtctttgtatgacatcagtttctttttattgtcatatttattttctgcatcacagatacaggcagcattatggagaggttttatgccctgggggaaggactgtgcctcttccctccccctcagaatgggccccccacactgtgttaacagccctgatcctctgagtctggacctccaggaaaatcataagataactgtatagtgctttcaaagtgggtttcaaagtgctttcatgtaatcggcttatcatttgttcctccagacatcccggtgtgctctgtgatgacctagaggggtcatcctaggtcatcccccatccctagaggggtgggatggggggtgcctatctcagacccagagcctgactgcttggtgagattcggggagggtgaacattgacattattcatcacttactgaggaccggcaattctccagactatgtgcttggtccgggtgggagcattgtacctggtctgctggggaaccgaggacaagctactgatgtaagaggcagaagggaggcgggcaggggaactggcttccgtcctgagaatctgaactgagaataagcacagcgctctgcagacgtagccgctccacacttggtttgctaagtttgtgccttcagtgtttttcctcctatttcctcaccccttctcctgcagctgtgggctttgtgagtgaagacgaatacctggaaatccagggcatcacccgggagcagtcggggtactatgagtgcagcgcctccaacgacgtggcagccccggtggtgcggagagtcaaggtcaccgtgaactgtaagtagtctcaggcgcacccacccagcaccttcgggaggtgctgccctcctggccacagagagagctggaccacagtgccagccgtgactcggggcgggaaatggggcagcctcgctgtccattttctgctttcaagagcaacagttctaaactcttaaagaaaataaatgggtgctgaaagtaattttatataatccaaaacttgacttagagtcctaaaagatcattacatggcattcaatgcataatttatacaagcttgtctttgaatcccaatttttactcataatgtcaccaagcttctcattctctggacagtcatctccttaatagggagcaaaaataaaaagcacatgtatggaagaaatattataacttatgtttatggtatacttatgttatcttatcctcttctagttatgtatgttgattgacatggtatacattcacaattgaactatatatagataaacctacacatatccaatatgagagggtatatctcatacctatgttttgctaatagaggtgctgcttctgctgctaagtcgcttcagttgtgtccgactctgtgcgaccccagagacggcagcccaccaggctcccctgtccctgggattctccaggcaagaacactggagtgggttgccatgaaccccaaaagctggaggccacttctctggactcctcctcttccttcaccaacccaattctctctgacattgatgctgcttaatgtccctgctccctcatgcattctctctaggttccccgttaggtcccctgactcaggtctctaggacatccggaaagttttcccagctgtgctgatttcagatgttcttaggacagaatagaacccaagagtcaaaccagcagacaagaagagtttctccttccaaacttgggtggggttggacatagaggaagaataccttggtgtgatgtttactccttctttactttaatatgttgattcatgtcacaatctgagcctaattaacacaaagcacctgaagaatcaaggaaacaggtgaagcaatcatgccatttttgtgccctaccccaatttctgtttaaagtgacataattcacagttaataaagattaacctaaacagtaaggagatgtaagagaaggggaaaacctatgtagggaaataagagaagtctatgggtaaatcagcacatggtgtttatagcctgaggtggtcagatgcgggtccaggatttggctttgaggtgcaaaagcaaagagaggaaacatcattgggtttgaggtttatgtccataaaataaaagtgaatttgtcgcttgggagaagcactgcttttttctggtgctgagacttgaaaaataatttcacttgaaggtctctataaatagagcatgacaagcatcacttgaaatggccatgcaatggctggctgtggctcctttccataacgcatttcgtgcaactgtcggcatgacaggggtggtttggcaaagactcgggatgaaagcagccggagtacttaagtatagttgttctggctgtgttcatgggtccgggaagaacacctcccaagaatgacagatctgtgtatcccccaggcaattctccatgactattatttcttgcaactgagttttcgatgggaactgaatagctcaagcttatatactctggcataaacctggtgtgcagaacatctatagggctagattaaaggtactatcaagccatggggcatgcggtggatggcgttggctatctcctgtgaaagtggaaaagtgtaaacgggaaataggcctagatgcctgctcatcccactggcgtccaaggggagcggaggcagtgcacgcgagcctttccctggtgatgcgggatggcttcattctccggcactccgtggagaccagagttagagtggggcctggagaacacagcaaagggggcattaaagatgctgtcgaatgtcctct

SEQ ID NO: 26640 - DNA, 2755 bp, Bovine  19866881023373
tgtctccggcattgcaggcagatttcttttaccccactgagaccatcggggaagcccatagcactctgttacttacatcacttccaggacttacctcggggcacaatattttgtaactgaaagagcctctaatgctgcatgtgagtaagtcagggccgcactacagggtaactgacactgcatcctgaccagttcttaagagttgccctctctgggtggtcttggagggtcctgggaaactataggcagcatccatacagctacctgttcccccgaggctcaaggccctgtccctcgtggagtggcacacgagatgccctcccaacctctctttctgtccaacatcctttggtccaggcctccccatggaacccagtcacccttaccatcttcctgcctttatctcccacgtggccctcacaggtcctggctgtgcatgcacggggcaggtgtgggctgtggtcctgaagagtatggggcctcgttgctgctggccccttgcctgtcatccagcatctgctgtctggtcgggaaggattaggaggtgagccacgtagcgaaggaggggtgtttgccgggaaggcgggaggacagaaagcagagagcgctgtggtcctgcatttgaagtgaacctcagacctgggaaaatgggccctgagtcatctcagtggatgattagttatatctgtaagacattattccaatctgcccatcgaggggagggagaaaagaacagctacttgtcaaaatcggcgtgcatgggagactgggaagggaaaagaaataattaatttcctccattaatacaagacattacccccggacacacacagtccttcataattgtcagctcctctctcccccatcgcgaaacagccgctgcacagtgacagatgaggccaccttgaagtcacagggtgtctctgttctgaggtctgagtcatcgagaccccaggcccagtgctggcggctgggccagttccccagtgcacaggctggggtacagggactttctgatgtttcttcagaggccagtggccctgcgctcctggtgggaactctgcccatcaacacatggtcatcagtttccagaactcaaagaattatttagcgttctgggtcactaaccatactgctaagttaagaaacttacaaatgaccttagaagtcctctggtgcaatttttatttgataggaaaaaaaaaaaatcttgggacttggagtggtaaaaacacttagcccaaatcataccatgttagtggcgaccctgatggttgacccaggtcttctgaagtccaattcagtggtcttatatcctgattcctatgattggcccagagtcatagaaggtcccatggaatgttccttctacagtgatgaggctaagaagaggggccagggagacagatgccgttgatgagagatcagcttgatcagagtccagcctggatggtgggcgggagacccacttgcctagaaatagctcccggtgtgtggatacggagagtccttgtcaaaaactttccaagggcccccaccctgcaggaagcgctcccgtaccccgagcagaggactcgcctgctaagcgccggctcctcgccctcccctctcagcccagtcacagctgagcacctgagctgcactatctccctgcgatgcttcagagccaggtccgtgctccatgaagcagccactagctccggcgtgacttgcctgctgagtgctgcttggcttcgtgggtgttttgcccaggagcgaatcgaagtatttcagaaatattaatgaaggtgataattagcaccactgccatgaagctgtgcccttgggaactaccatgggaagagagaataaaggcgagaagaaaagagaagagaagaaagagatgaagcaggaggaattaggctgcatctgagcttcacctgcagaaaccaggctgtgctcttcctccagggagctgggaaagggcggccacagcatttccacaccagaaggctgaggtctggcttctgaccctccaggacttcggaccctgagccccagctgggtatctccccagggaatgcagggctgaccctcacttggcctatcaccctgttctccaagaggagaccaagctggtgcaccaagagttccaggattgcagagtccgggggactactctgcatctggtcccgcagggtctgacagcccagtcactgcctcttgctgggtataaaggtgtgagtgtcagagcagcccagagtggggcacttgcagcggccctggtactgggaccagacacaggccgttctgtgggccagagggcaggggccacggggtttgtcatccagaccagcatggtgttgagagccgaagacagcagtcagtaattacagtgggaaacagtgttaactgtccaggcaagcctaacagtatgattacccacctataaaagtaacaaaggccttgatggcattactacacacacacacacacacacacacacacacacacatctgtccccagggaactgagcatggcaggtggggtagaaggaaagttttaagtcccgccacaaagcaagtgagaggtaaagcatttgctatgatgttgctctatcatcagaaacaatttctggcttccttggtggtccagtggttaagaatccaccttgcagtgcaggggatactggttcgatccctggtctgggaaagattccacgtgccggggggcggcaactaagagactgtggaccagtgctactgagcccatgcac

SEQ ID NO: 26641 - DNA, 1279 bp, Bovine  19866881038580
agattgctgtatagttaagcatcaaaaaacatttatttctactgaatagggaagttattagtgaaactgtttaaaaaattccataatttagaacttcaggggaaagatgtgacacagacattctttttagtgatattagaaatcaccccaaacaagatggcccagagggcagccctggcaggcagagttggaaggcatccctccccaccatcctgcagcaatctgctgatggagtgaatgacgcatgctgattggccagcaagtacacattaatgaccagttagcaactgtgttcaggtcaattaatttatatttgtattttgcaagtgaaagttgccctgttagattattgattctttgtccctgtattcaatttgtttttaattgcaccattgctgggccagaccctccctcctggcagactggcaataaatctgccaccatctcaacaatcaacaataaatgtgtctcttcatgtcattattaatatgcctcttggatgggttcgttactacggctcacagtttgtaagagccggatggcacaccgccagaagaattccttttcccaagggctattttgtcgtgataggattgatgttctcaggcctgtgtgtgtctgagaaaaggggcctgggatttaatttaatatagctggaatgtgagctccctaatcctccccttatcataaacagctttagaagaagattctgttggaagagagatttttaccctctcttccgtttcttcctcttttctactcacttttttttttttttttctttttcttttcgagcttcttaattccttcttaatttctgctcagatagatgcttttcccctctcaaaaacaacataacagctacctgggtgatctaaaatccccagataagggagccatgtgtcccccagaaattggagggttattactggttgattgttagttggaagcagaggggagttccctgtgcttgatgagtgaatggtgattaacagagctgcagaaaagtggctctcataatgtcaccttaattggggtcagtattgaaaaagaataagaaggaaatggctacccactgcagtacttttgcctggagaattccatggacagaggagcctggagggctacagtccatggggtcataaagagtcgaacacaactgaggaactaacactttatttcactttcttaaagagataatcatcaattccagtgttgttattggttttttcagttattagaatttttcagggggaagcacagattttaagtgaatgta

SEQ ID NO: 26642 - DNA, 1428 bp, Bovine  19866881053228
gcaggtggttggacagtggaggagaagctgtggtcttggaatctagactgtgtccagaaagttgcagcaaagcaattgagggaggccaagggttggaagacagagctgtgccagcgtgcacagctcttgcaaccaggatgctcactcagctggggatgcactcagctgccaccagaaacctcagggttgtacacagaaggtaacccagggcctctgcaaggcctgggcctgagggtacggagcatctcagccattcagggccccgccctttggttgcatctcctaggtgatgggtagcttggagccacatcctctcatcttctctcctgatgcccaccaggcccatgactcatctcgggctgaatgccttcgccacagccccctgcccactgcctcccctcccccagccccaccaggcagcactgtgctggcccaggcagctctcatctctcctgacctctccccactctgagaatatgcacaaaggaaatgtgggggattaaaagcagctcagggctcctgcagcatttggaaaacaactcttccttagataaagcctgaggcaggcttcgctctcactgcagcttgatgagttgatattgctcctcgtatagcttctatttgggaccaacgctgtttacataacagacattttctgtatttctactctctcattttttactattaaggacacttgcctagaaacagaatctgtattttttttcaagtgttcatctcctcccgctgcctgctccccacctgagtgcatcacacttgattgctgtggcaaggaggcccacacgtttatccgacttggcagagcatgtgtctactggttcatctatctcccctcctatcctgatactcacaggaacacagacatgtctccggcaaaaggtatatgtgctaacgcttctcagaaatgcagggacgatatttccttttattgttctgataatacagaaaatcatactcagccgctatgcagcatctcgtcatgactccccaagatgcccatagagatgtgggccttactctgtccatttcaaagatgaggagattgaggcagagatgaactgacttgtccaggcagcctgaaaactcagcacaagcagaggattcacattcagaatcgcagatggctttaatctagtgattggatcatcagaccacaatgacatgtttccgacctcttttagagcttggagaatcaggtatttaatattgctaaacgaaattgatagaaaggtcaaacacaaaaagtacagagagcaagtcctcttttactctacaagtagtgaagcagatttctcagtgtttaatttatggcccattcagtgtatgaaagacatttctcaaacgggagagagggagaaaaaaagatgattccatgtctgggctccctgtatttaggattaataacaccag

SEQ ID NO: 26643 - DNA, 1647 bp, Bovine  19866881071452
agcgacttcctttccttttattttatgtattggagaaggaagtggcaacccactcccatgttcttgcctggagaatcccagggatgggggagcctgttaagctgccatctatgggatcgcacagagtcggacacgactgaagcaacttagcaactgtcaagtcttcctcagcagcaccgatagggagggcctggggccattggcctagctgaggtccctttagtgatgactctttaatctatgtgggtccatgaggatgtctccctcacagggtggggttttcccaaaagagagggccctgaggagagagctctgcattcgaagtttcccgaaggctctttcctgactttccgttgatttcccccttcatatgaatttttacaaatgcatcttagtagctgtattagcttgggttttccctgatggctcagatggtaaagaatatgcctgcagtgcaggagaccctagttcaatccctaggtcaggaagatcccctggagaaggaaatggcaacccactccagtatatttgcctggagaacctcatggacagaggaacctggcgggctacagtccatggggtttcaaagagtcagactcaactgcgtgactaaacacttagatttttcacttttgtattagctaagagccctgaggatggctttgccaaaggcccttccctggtggtctgctgtttggcgcctcttgttcttgcagggagttgatggtgcgatgggaggttctcatcgtcttgcattcagcagctgttccttctaaccaggtgccacgtcgggttccccttccaggccaagggaagacagtgggctgtgaatcacagtgagagaaatgacctgagagcctaaggaaatgtggagagaactcccagtggtcttgggtaaagtcttcttgggttaatattctgaacgtaagagatctattttagtgggtgtcggagcagctgatagactggtgacctgttggtttgctgagactgagctctcagggcagcccttgaaggtagcaagagggatgctgtggggccaggccaccactgaccccccgcagcgatgatgcacggggccctggcgctgcggcttcttggtcccagtggggagagaggcttcactgcaagccccgctgcaaggctcatcctgcagctggaagctcacctccacttactccatttatctgaagccctggcagaggctgcatgctgctgtgaccgagttgccatggagaacttgtatcctcttggcttcctcactgcttttacaggcagtattacagaggagaatgtctttgctgctaggaaatataaatattacccagagatgctcattttctccctctatgatgattattaccagagatatgcaagaagacttcattacagagcattgtccttggtaatgagcccgctgtagctgttccgaggatggttcaggctgccaggaacaaatcgtgttaaccctcaactagctactagatagatatctactagatagatatgaagtagaactatttatacatttgacagatttttttgtggagtacctactatgtatgaggccctggggatacagagacaaataatatactcttctgccttcagagaacttatattctagtaaaggaaaaaagaactgca

SEQ ID NO: 26644 - DNA, 1245 bp, Bovine  19866881073976
ctgtggtatacacgtgcaggagctcccctgcctgtattgcttgcggacagcacctatcacagcaggcaagcaagtgttaataaattcacgggaagacccaagaacatgcttaaagtagcaggcagggccccaaagtccagagtctgagacgacagtcaacattagcccatagagactcatggtccccaccagtaagcacagtggccttaattgtcacagtggccttaattgtctgtcactgctccctaagcatcttcaggggaaagagcaccaaccttgaactgatgaagggtggaggaaatgcggagaagaggcttgaatggagagctcgcgctcccttttacgttgtggttgtttacttgcacccaccgtgagcctacacgtgtcagatcttccccgctagacgctgtaattactgtgcagagcatcgcggacactcgtgtcacacttaatattcccattaattttaaatggtggtccttggtacatatgtgtggcaattggtgtcatattttaattaggcttgccctacaccatctgaaattaataatagctcgaattaccagtgtaatttataaattaacagtgctgtagcattaggaaataaattagctctggtgagctgtttctggattgagctccagtgtcaggacagtggctggtaggacctcagatctcctgggaggctgcgatgacaccatcaaagcaaggaaacaaaacgactcagggttcccgggtcccttgttctctccaaccacagatcacgcatctggtttaattctaccaatcaaacaggttcttgtgcgaccacagtaagacatacaggaaccaaactctgatgaacttgttatgtatgaagtatgaagtcagtcagtcgtgtccgactctttgtaaccccatggactgtagcccaccaggctccttggtccatgggattttccaggcatgaatactggagtgagttgccatttccttctccaggggatcttcccgacctagggatcgaacccaggtctcctacattgttataggaacttgttataggaacatccaaatggagaagttgaggcagagagggggatattgccatagggtgaaatgcaagtatgtaaatattagggcaatcatagtaaaaaaaaatattaattctcaagttttttgtgggaacattgggctactttatgtgaaatttacaatattaatatcaggcaattttatgtagggaaggaagctggatagtttaag

SEQ ID NO: 26645 - DNA, 3939 bp, Bovine  19866881076673
tgacagtcttatgatggcatctgatcatgttattcttccgttcctctaaaaaaatcttgcatctgtgttcagttctatagaaatagaagaatttcttaacaaaaacagaaaacaaaacaaaaaaactcttatgtgctgaatgtcggaggacactgcatgtttgaacatcgtataccctctctgttgctccctgctcactccttcccagcacgtgtgccttaatgcagatgcgtacgcagaagtgtatatgtgtccatgcacatgtggacctatcaaccaacctaccaacacacatgcatgcacgcattttctgcaggagacattgaagattttgcttttctctttaatgttcacttttcacttttcttcctcaagagaggaaattttcatccatcagagcatctctctgaaattagccttgcgtttataatgcatgtaaagattttttccagcgctggtctaatgaaaaatgataccccaaattagtgattgctgccttccaattatcccattgctcatgattctgttacaccacaaatagttatccgcttccctccccagtaacgacataaatgggctgttgtaatcgactccaaaacgaatgaccaggtctggctaattttgctgtatatatagttttatgtatatatagtttttaaaatgtcaattattagaagaagactgtctggttagtgtgtgtggtcccagtcatccaaggagcctccacatctctagcatggaagagggttggaatttcgttttccaagagcatggcttctctgagagctgggagagagcccaagagagggcaggcaggggttagggggctcaggagcattcatcactttcacgttatattgtggcttggattttccagtgctgaccctgctttgtgctcaggcaaatcacgggttgtggcacttaaaagcagacagctgcactggacttgattcatcctagtcacacataatggccacacttggctattaatctctttttccaccctagaaataaagagaaggggaagaaggaagtcaaatctaagtggttgtgccttagatgttaagaggactgttgaagtcagtcaaccgcaggctttggggtagcccactagattccagatgtcctggagacagaaataaagagactttgcaggagccctggtcaccacgctagaccctgggactgttcccaagctctcttctcacactgaggttgtcatcatgtcctgcccatggggagcacacatcacagcgagcacgggcaagatggaacaggttggactgcagaggagccagagatgcaggaatcagccaatgggcagcagatataccaatatgtcagtttgcctgtttccatcagcccagacctctccatggaaaccccatcaagtctcaggtgactcaggcagctttctgtctttggtttggctttggtgtcatggctccccgaggaacccacaagacgagagcaggtggagaccctgctccttatccaggtgctcactgcgtgggactgcccacttccgctccctcaccccaccctgacctttgggtcatagcatcacagccctgcctcatacttttttatttatttaattttttttaaattttattttatttttaaactttacaatattgtattagttttgccaaatatcgaaatgaatccaccacaggtatacctgtgttccccatcctgaaccctcctccctcctccctccccataccctccctctgggtcgtcccagtgtaccagccccaagcatccagcatcgtgcatcgaacctggactggtgactcgtttcatacatgatattacacatgtttcaatgccattctcccaaatctccccaccctctccctctcccacagagtccataagactgatctatacatcagtgtctcttttgctgtctcgttggaatttagaaagatggtaacagtaacttttttatttattgatatgaaaacattttcatttaaattgcctaatttgagtctcacaaaactctataaggcaagacagctatgatagtttctagtttataaataaagacaataatcttcaagatatcaatcctttggccccaagtgcactggcgctgggagtcctgtggttctaccccagcgattctgccctggtttcagtgctgctgtctcgggtgccctggccagggcttcttgtgatcttacatgggagggtctaagagctggtgtgactggctgtggactgcatacgtcatcctctcagagaggcgtggtggtggctggtatgtggacaaagcttcttgcttggtcctacatccagggaagcactgtgagtccctgaaggccactgtctacgtccaccagtctaaccttccccaccgtgtgcaggatgggaacggagctggtcaacctctggcctctctaccctcaccaggaaaacatctctggagaccttctcagagtcttgcttctcttttcttcattctcagtgggaaggaaattgctcagatggtgtaattttttttttaaggctctggtgccctggaaaaaaacagatgataagtctgcaagtatgttccatgcaccgtggctgctctcttgcgtcccccactgacttcgtgtttttcttagctgttctgttttagtttgtaccaacacagactccctccacctcacatatctcttcagggtgaaatgcctgctcagtaagctttggaaaggcagtatattttaggcagcctgataaaaggctctaatcgccccagattaatgcattcattcctagccaattgaaggattcattccagtgctcaggcggaggctcctctgatggacttgccctgggtaatgagccattcagcagctgctcccctgcactgctgggaacctgcagagtgggccgcgagagggagccaggcagtcgtaggtgaactgcaaaggagagcgggtgtctgggtacctctgaccctggagggaagtcgtgggagcaggaaggtgctggtagccatgatctctgcctctcaagcgggaggtgggaagcatctggtggggatgtgccaaggaatgtggccactcagatggcacacgagccgctaaaggctgggagatgaggttcacggtggacaaaggatgtctaggttttgaaagcaaagcccagtcgtgcaaccagagaagagtgtatgctggaggagcttctaaacaactgtgctctgtgcccctaactcacctctctacgtggacatttccaaagagggaacgagagacatagagacagaggaaaagttaggagacttcctaggggttggctggcctggagtctctaggagtgggcgtgtggtgtgtgaaggggagtttcccctgccaggacacttgatgatgtctggagacagctgtggttgtccagaatttcaggtggagaaagagagatgatactggcatctagtgggtgaagcccaaggatgctggtaaacatcctgcaaaggacagaatagtccccaacacaacagaggagcatccgctccccaaaccaggagtgccaaggctgggagccggctagcccaaacctacgctattgccagtgagacagaggaagcagggcgaaagcgatgggctcagggttacgcagatggagggtggaggagttgggagggcggcagcctgcggtctgtccctctcacctccatgatgcccctagatccaggaggcctgctttccagttctgcactgcactgataagtggtctcagaagcaaagtcgacctcccctcctggaccacagagcacctttccagcccctgtcccagtaaggaaaacaccaccgcctgcctttatgaacacacgtcggtgcctacccactttggtccaggcagatctcttctgggggattagcttattatctttgttatgcattttagaagcggttgctactgctataaaaataggaatgccag

SEQ ID NO: 26646 - DNA, 1034 bp, Bovine  19866881080637
ggcgaggagtgtgatggagcaggaccctagggaccttcccctatatcctctgctttagctcctctctgaagtacccagatatagtattctatgcacgtttcctgagttgttttgcacacacccctctccatcatctgccctttaaaatctctttgtgaaaatccttccagcagcgctcggctctttagggcctgagccaacggtctcctcacgtggcccctgcagtaagcctttctctgctccacactctgacgtttcagtttctttggactcactgtgcgttgggcacaggaactggcactaacaggagtgcctctagagcaactcgcatattttgggcatgggtaatgaggtaacttcccctggtagctcagaggttaaagcgtctgcctggaatgcaggagacgcgggttcgatccctggtcgggaagatcccctggagaaggaaatggcaacccactccagtactcttgcttggagaatcccatggagggaggagcttggtgggctgcagtccatggggtcgcaaagagctagacgcgactgagtgacttcactcaatgaggtaactagggcttccctggtggttcagtgaagaatccacctgcagtgcaggagacccaggtttgattcctgagttgggaagattctctggagaagggaatggatacagactctagtgttcttgtctggagaattccatggacagagaaggatggtgagctatatagtctaaggggtcacaaagagtcggacacaactgagcaattaacacttccacttttttttccattgaggtaattaggtgatataggatgacaaatgggacttaggacaggacggaagatgacacaagagcagaagggagctgggtgcaggggagttctgagctgaagacgacgcttttgtaatcattgcttgcaaatgacacataaggactctgtgtgccgatttcctagggtgggtatgattaaggactgataagtctaggatttgggggacatcaaagattaagtaggaggggaggtagaagg

SEQ ID NO: 26647 - DNA, 832 bp, Bovine  19866881112161
ggcggtggggcggggttgaagcttgttgggtctggcagagaaatcccgtggggctggagctttaacaagggggtgagagaaaaagatggaacacagagaacctgctcgggtatcaagtacacagcactctctactgagacccacgtggtcaccccagcacatcgaaagagataagacagcagtccgtgtcttctcacccttctcagtccacaagcagtcctgatgagacagtcaggacttcccaccaagactcaagtccccattcttacagggatgaggggaggggggcacccaaacaaagccaacagacagaggtgctccccaaacaccgggcgccctcatagctagaagacatcagagccctcctgcagccagcaaaggatgcagtgttgacttagtgttacctgtccacccgctgactccctggaatggaaaccccagagctgagtgctttcttcagcagggaagcaggggcaggagccgaacgcagactcctcctgtctcaggaattaacctggctgccacctgcgggctccctgtgtcctgcttcccccccatctcatcggtgtccttgctaattcaacaaagttattacccgattaataactcctctgatggaagagttctgggatgagctggagctcccatttacaatctgcaggtgatgggaaaattatgttcagttcaggaataattgatggaaatagtctctcctcttcctcagctgattggctttctaattgtgatttaataatgtaaatatcacttgttttcttctgaagatgaatcggctttgatttgctaagctcaaggctctttgggcttgtttatt

SEQ ID NO: 26648 - DNA, 1016 bp, Bovine  19866881154619
tgggagggaatgagtacgagagaaacgccatgcttctggctggtggcagcagcagcatcatttgtattttccccaacctgcaaaatgtcaacatattagggaaaaaatatgcagacatttcacatttcattcctgatgagactccttgtcactccctcgcaccctgctcccctctgtctgaatcactgacatctggccgtcagccagagcatttaggctttaacacagagtgctgggctgtgctgatgtcagcacacgctggagcttctggttcggcacagaccagagccttgcctctttcagggctgtgatgagctgatgggtctgatttaacttctgctatgaacttcctaggccttgggctttgtgggatggctgccattttcgcctctttatccccacgccttcctagagcgtgaagcctggttcatcttctttgcagaacaataccaggccctgtttctgctgtaattaaagacaatggaggaacagctccctttgatagcaagtgatgcaccttcatcagccagccctgctgaaaagaggtttacgtttccccaacaagagtaacacatgcatcgtctaattagatttcctcgctcctcttttaatcaccaagaacatcattatccttttggttcctcattaggaaggtcacatagttcacactcatacttataaaactcatctaaatttcagaacaaaagtgtatcttcttagatttcagatgcttccttgatctcactgtgctattaccatgttcaactttcctgtggtttttttttcctcttattgtgatgaccatactgctgctgctgctgctgctaagtcgcttcagttgtgtccgactctttgcaaccccatgaactgcagcctaccaggctcgtccgtccatgggattttccaggcaagagtactagagtggggtgccattgccttctccggatgaccatactaccacctgctattttagtaggattacagccacaccttgctatcgaatttcttgctgaaaa

SEQ ID NO: 26649 - DNA, 991 bp, Bovine  19866881212237
tgggtgtgaagatacactgaattaaggttacagagctgcgagtagagaagaaaaatctctgaataattttcttgacaccacattcaacctcttcaggatccgtggtgataaagcactaaagatttattttaatgtgtaaaaaccccactctgttcctctgggagatggtaaaggagtctctgggaggctcggggatagtttatatttatcaggtaaagtgctgtctgctcactaataagcttcataaatatttctcccttctcctgaaaggaactaaaaaaagatccaattttgcaatctttaaaaaaaaagggggggggagagagagaaaggaaccaattttcaaaggttctaataccttagtagaaaaatgtagctggattactcgctgccttcttcgcaaggttgttcggatatcctttatatcgaaccctagcttcacacaccgccaaccaacaggcactccagcacccagatagatgactgagtcaggctcatgctatatagtcatatattttttatctctgtagttgttaaacctaaaaaaagaatcagattttttttaactgcatttgaaacctgatttcttctcgcgactcttaagtaaccttgcaacataagagatgtacaaaatagcccttttaagtatgcttccttcttagttctgctttttcctgatcctcgcagacttgttgtttttcagtctcttagtcatgtctgactctttgtaacaccatggactgcagtacaccaggcttccctgtccttcacgatctcccagtttgctcaaacttgtgtccattgagtcaatgatgccatccaaccatctcatcctctgttgcccccttctccttttgccctcaatctttcccagaatcaaggtcttttccaatgagttggttgttcgcatcaggtagccaaagtattggaacttcagttttagcatcagtccttccaatgaatactcagggttgacttcctttaggactga

SEQ ID NO: 26650 - DNA, 985 bp, Bovine  19866881214844
ctgcagcactctcagtctgagaagtaaattagatatagtgttaagatgccctacaggaagagtgtacgattctaggggttctagttgcagttgtaaaccaggtcaactctgccatcctaactgtcatattgactgcatgtcatgttctcattcattggaatgaacagagaaagaggctggtcctcatcgggccatcagctgggacatccatcccttctctgagggtctccccctcctacacagggtgagggggccccagagacccgaatggcccctcgggagccttcatcctgccttccctccattctcacactgtcgtgtccatctcctcgtgcaacattttaccccactggccaggcccagctggttgtgatggtccgtgtgtttatgtgtgtgtttatttgccgagatttggcaagagggaactgtctggtaactaggaaggaaaggtgttcattgttcatatggacctcagaccctgaacagctttcagcgttgacatgaactaaactttgtccaccaaccatctgaaatgtgtgatctatgtctcttgttttctctctgcattgtgtgtgcattgtgctgtgtgtgtcttagaaataagcccctcatcagcagtggcaggtgggtaccgcatgttccttcactcctctgcctgcctgaatgcctatgcttttgatgttaagcctcgttccaagataggcttgcctgctcctcctccctgactttttctccttactggatagacttcagggggctggtgtgcacagtttaggtaacaaacatgtagaatatgatggcttttgttgtttttgtttagtcactaagttgtatccaactctttgtgaccccgtggactgtagccctccggattcctctgtccatgggatttcccgggcaagaatactagagtgggttgccatttccttctccagggcatcttcccaacccagggattgaacctgcatctcctgggttgcaggtg

SEQ ID NO: 26651 - DNA, 3625 bp, Bovine  19866881223497
acatctgtatatccttccttcttcaataaagtatgaattacctttgcttactaagaaaatcttatcagttttaagtaaagatgttttttgtcttattctttatgtagtttttaatttattttcctatctcattgcattggttagaattttttgatagttataacaggaagcccatgtcttatttctgctttcatgcaatcgcctccaggtttttccattaattgtgatgctcctttcaatttgcagtgagatctcacttattgagagatcatatacaaatgtacaatttttatttattctttcaagtatttctataacttcacacataatattggcacaccttttattcttggaattaatttcaggaacattttatctgttgaatgtattgtttgattctatttgctaataaatttgtgctcttataattaaagcactgtatgcagtagaggagacagtgaaatgcacatttcccgacaatgcatagatgatcaatgcatcctcgcaggagaagtaatggtaattactaccaccatgaatgcttcggattatagtttttcaggtactacagtggttcaatgcactaataataacacagagaacctttgaggtagggttgcaattttcctgccaccaggcttattccccaaagttacaattaaatgtcatccgcaaatggaggtacaaacattactttttatagctcaggttctttacctcgtctctgtaatccagcctttttcattagtgctgagatcccaattctggctgcgcagagtaggagaaatatccccaggtgattctatttaccagctagatcttgagtaagccattacaacttcggagcctctagttctcatctgtacaatggagccaattaaccagcccctccattccttagaaccattgctgtgatggtcagatatgatatgacctctgaaccagagtccacgccacacaggtacaaatgggtcatcagcgccagcagcagcatcagtggagttgtattaagctatggctcctccctccgtacataaagccggatccttttgctttcctgtgttattacaggcgtcatgaagcataggcttacgtttcttctggtttctgtgctacttaattacccttcctcatctcccagccatttttacatttaaataaaactctcatttcacttaacaatgaaagggctaaaaatttgcatattaagtgtgagtcagtggcatggatatctaattaaaacctgtggctttttttttttttccttttttccccttttcatttttctcccctgagctgctgacattattgtcactgtattcagtgtccccattctgtcagccctctgcgttctgaggagagcagccacgaggctatcagggagagctggagcttacagaagcaagaggaggttggggcaagagggaaaaaggacccaaaacagaggcagaagatgcagacacagggggcttgtgacggcaaaaccctgcagaagaagaggcacatggggaggggcaggatgaggcaactggattttaaagagggcagggtgaggaagggaggggctgaaaaatggaaatttaccagaaagaagagcaagtgtaagaatagaaagaccacgtgatgggtggagaggagcctatggcagatggagatggagcaagtgattcaaagcagtttgaacaactgggtatcggccaggacatgcaggaggtcagggtaacagatcgctggcctagttccacaaagagtgtctgtcttacatcaccacagagtggttataataaaaaggcaaatcagttgggtctggtttaagtactgtcctcccctctgtggtctcatttaacaatccacatccgctctcctagattttctttgttttccttccctagagtctaaaggacgcggaaacagatttcctgaaatcatttgtgcatcttcagcatataaccaaatatgaaatgagtgtcttctccctcctaacccctcaacacgaagaccaggcaagcataattcacaaggagtttgttaaaggcatccacccagtagatgcctttgcccactcttgctgtaaatggatggcctctttctagaagcacagtgtttatggggaaacttggcatggataaaggtgcaggtgaaaagcatggctgatgataggagccagtgcagtcacgtgacactgagatcatttctgctggagtcagtcacaccctccccctgagcacacggcactgtccctctgcctgtgtccagctgctcaggcaggtatggactaaaagatcctggggattggactgaacttagacggcttggcaggtgatagtccctacagggagagggaaagaagactttatgttgctgaagcacaggctgccacactgtggccccaggaattaaaatccagttgataaagaaaaccacatggaattctgctgagggtcatgtggcagcctggatgggaggagagttcgagggagaaaggatacctgtgtttgtgtggctgaatcccttggctatgcacctgaagctattacaaacaccagctatattccagtataaaattaaaagcttaaataaaaatcagttaatacataaaagaaacactgtcacggcagtctgaacgcacgttggaaaaggatttccagacacagagtattgcagaaaagaatgagtttgttaagtacaaagagtagaaataatgtgggccctgcgagtgcagtgggccaacctcctgacagaccaaggagaagccactctttttgtgggttagtggccaatttttatagcctcagacaaaatttctgctggaaggttggcattaggtgaccgtttagggttctatagcgtgagtactgtcatgggcattttgcatagtaaggagtcaggaagcctgctggtgatgactgggggcttttggcaatggttacaagaggactcattcagcttcagaggtgaccttggctctgggctctgcttctgtgaccttggcacaagggcccacacttgtgacctcgggcagggttccacatcaatctaagtttgtgaagggactgggcagcaagactaaaggcgcatgtggtcaatgtcttcaaaggccttgaaggttgaaggttggtttgggaagcagctctctggactcgtgtctaagggagggtcacctctcctcctgatgctgtgttttccaaattgcttgatcataagaatttttcagactcttgtccagttacccataaccagccacatcccaggcctatcaagtcagattttgcaggagatggtgctgaagattatgcatttaaaacacaatcagacaagattgcaaacatcagcttttagaggagttggacaatctcaggtcgggggtgaggtgtgggtgtcataagaccaaatcaggattctcccttgcaggtggtgtctaatgaggaaacaatttccctaaactccccacaccaccttgactttcctgttactgcagcatcagcatcatgactcaatcttgatgtgatgtgtgaggtaattaagggactccagatctgcatctcactgcttaataccttcatccctgatgctttccaaatgggctttagacaggacaggatcaatagactgctcttggctcttc

SEQ ID NO: 26652 - DNA, 1260 bp, Bovine  19866881245248
taaatgtggatggctactgcagcctggattaaaagacacattttccttgggagaaaagctatgacaaacctagacagcatattaaaaagtagagacatcattttgccaacaaaggtccatatagtcaaagcaatggtttttccagtagtcatgtacagatgtgagagttggaccataaagaatgctgagtgctgaatgattgatgcttttgaattgtggtgctggagatgacttttgaaagccccttggacagcaagaagaccaaaccaatcaatcctagaggaaattaaccctgaatattcactggaagggctgatgctgaggctgaagttccaatactttggccccttgatgcgaagagctgactcattagacagcaccctgatgctgggaaggacggaaggtaaaagaagggtgtggcagaggatgagatgattagatagcatcactgactcaatggacatgaatcttagcaaactccaggagacagtgaaggacagggaagcctggtgatgcagtctatggggtcacaaagagtcagacacaacttagcaaccaaacgaacaaaaacaaaacatagtttctacagcctttactgtgtttttctccaccttcctcagcagttcttggggtgaggacagatcagacctagactgactgagaaagccagggagactgcagctaaaaccccaatattccactacaaggcactgagagttctgtcattttccgtgctgctgtatttggagctgccacactccccaaaggcaagctgcgcagtctgagttagaactgatgatctgcacacatctgcttcagggagcctggggccaacacctgaaggacagcccgatgctgatcaactggaaacagaccagaaggttgggagagagatcacagatgggccagagtaaaggaatggacggctctataggttaggaggtgattaagtgacggcaggcgggaatgggcatttggctaacatgccttgtgcccaagactcaaaataaatgccaactagaacaatgaggaggcccagaggaagttgctaagttccttttgggatctcctatataaagcccaaatatacacactgcagatgccatcgcacccatggctaattttctgatttacattgttgagaaaggattagcgaaacctcccatttcgatggtctgctcctaatttacatttttaacgaggtgggatccaagccaggttctgtccctttgtgtttattttgtaggaactatgtttatt

SEQ ID NO: 26653 - DNA, 1155 bp, Bovine  19866881279715
ctcagttaccaggggcctctacagataaatcaaatgttcagtctggaagggattttaaaatcacacagcctaatctcttgctcctttatttatttacttaaaaaagagaaagcacaagttcagaaaagtttcagtgactttctcaaactcacacagttaattagtagcagaagcaagagtgtactctaggaagctggactttatagtaatacttttcctaaaccatcacgctgtctctttgtatccccatgcagatctttaatattgtttgttcctttttaagaaaattcttcactttactttggataaagatgcttcaaaatgcaggtgacataattagaggccagagaagctagaagatgaataaaaggtagttatacaaatctttaagatggcgatcaattatgcagagcagaaaatttgatacaaatctgtgtcctcagatttcacttgtctagtttgtagagctagattataaagtatttttaaaagcagttttattcacagtctgcccaaattgacttgttttggctgaagagctgcagcagaagagggtcaccagatgggacagcccttcgtccccggagcgtggcctgaagcacagctgagtttttaggggctggcagtgggacatggaacaccttctgttcaaatgtgccccataccctgcagtcatcagccacagtctgctctggaaagaggttcataagacctgacctttttctcctgctcatcgtgggtagatccatgttcttcaggagagagagcagctcacatgagcaggtatcacggtactttatgcttgggaatcaggatttgggttcattcacttcatctcctcattttagttgcttggcctgtgctgtagtgaatcacttcagttgtgtccgactctttgcgaccacactgactgtagcctgccaggctcctctgtccgggggatcctccaggcaagaatactagactgggttgccatttcctcctccaagggatcttcctgatccagggatcgaacctgcatctcctaggtctcctgcattgagcggagggctctttatcactagcgccacctgggaagcttggtcttacgcatgtctgttacctggatgtgaaggtgagacattttgctcatgtggttagctgacctgcactaag

SEQ ID NO: 26654 - DNA, 894 bp, Bovine  19866881283437
tgaatagcaggtcatttcctttttctattataaattatactctgatatcatctttaaatataactctatgtcttcatctctgattatttccttataatagatttcaaaacataagaccattggatcagaagcatccgataaagcttccactactcctgagagttcatgtgtctgccagccatgcagactgagtattgtgcagaattagtattgtttttgttattttttaatttttgttcattattatttattattatgacacgataggatactaatattttcattttgcttattactcacattggcggttgacatatttaggtatgtttactaattataaatcctttctgtgacatttttcatgccataaatttatccattttgtattggggtagtttaaaaaatagttgtaagagatagctcttcttctatcttggggacatttaaaatgctgtttaggtaagggacccatcttttgattctcaatatcaaccctatagtaggtacttaataaatgaacattttattttgtatctggctgaaaaattcattttaaattatggaattaagcctcagagtgctggagtgtttttttttttttttaaataaaaatcacatctacctctatgttgtaaaaaactaggtattaaatgtcaaatagtaacagcacaccttttgtagggaaattctattaaattggactttctagaaaagtgatttaaattaaaatttcctgataaaatttttatccatctacaactctttatgaggctcacactttcagggactttcaaaatcagtattaaggctattaccaggtatataaataaatagatagattttacatatatatatatatatatatatatatatatatatatacacacacacaca

SEQ ID NO: 26655 - DNA, 1408 bp, Bovine  19866881287967
atggataacgaacaaggacctactctagagcaaagagaactctgctcactgatatgtggagtctagatgagaggggagtttgggggagaatggatacgtgcatttgaatccttttgttgtccacctcacctgaaactatcatggcatggttaatcaagctatactccagtatcaaattaaaaaatctgaaaaaaaaaaaaagaacatgggggcacaaaggtgaatcagacttgataggagtaagacgcgggtgaggcttccttgttctgagcttgtgaaggttctgtacccacgttagaactaagagcaacttctgacccatcaaagcacacataaccttgcacctctgggttgaagtccttgtcttcctggtagggggcatgtagggggcaggcgtgggaggaagctggactttgaccactgggcccatcccctctctccagagtccagacagctctctccaggcctctcctggtttccacgtggaaggctccttattcctggatcaggttaacggggtagagagggagcatctgcttcagaggaggccgtcgagtgaaaggcagtaatgctgtctccaaaccagcttttcataggctcttacttatcatttaatttggctgcagtgtatggaattaggctaatggctgttaagtggctaaggcacaaacatggtccatctgccgagaaggctccaggccattgtctatttcaaaggctaaggaaaaaagatgagccagacatactgttacactgagagcctcatcaaatgcctttttattcaccctcagatcttatttctttcaaagctagtgattttcctggtaccatattaagagctcaaaatcagggcctagctgctgggccattaccacagtggaaaataggctatctttacctaatctgcaggatattgtgatagaaaaaaagcctgcatagcagcaaaatgatttagtccgttaaaaaatatatatatggagcaactgtaatgttcagagtgtcacacggaacacaagaaaagatccctgacttcaaggcgtttctcatcttagatggacaggagggaatagagtgtgtgtaggaagagttctaatgcatggccagcattgccatgacttccaagaggacagaaaggaagaagggaagcgtgtctgggaaaactggagggcagagttggcagagtgaaattttttgaatggggctttgaagagaaataatagctcatatttatgggactgcctctctgccaaaccattcatacataagattttacttaacaatatcctgataagacaggtgtcattattccctgacctttgacagatttttaaactaaacataagctcagggaagagctatccccggccaagcagactcaggacttgcccagattccaagttctttttaa

SEQ ID NO: 26656 - DNA, 904 bp, Bovine  19866881319303
agcaagcgcgttttcagtggttattgaaagaagatgaatagataattctgcagagttcacttgaacccatcagttgtcaggtcaaatgacaaaaagctggtgcaatcgtagcacatcaaatcaattctgggagtgaaataccttatggtcaggaatgtaaataatcatacccaataaggaagcacaccttcccagtcttcaagcaaaactccaacttaccaggagctctgatcacctggctcagccattaagctcctgtgctcagttacaggagtctggatgtgcttcccataccaagttgagtgagttggcatcctcagaggtgcagctccagttagctacctgtctttacctagcaagtcagttgactacattagccacttagtaatattccaaaatcatctgtgaatcagaagaaacacataccaattttatctgtaaacgaaacactctcatatctattctgaccataatcctttacaagttccagaaaccactttagtggggctgaactggaggagacataaaaactacaggatatggctctgcctgctaaagtgagtggcaataaatgccatgcaaatagcagataaaaatgtgctggtcactgtgatgctgcgtatattagtcaataggcgtttgttaattaccgtctgtgcgcccagcccttacaatgtgcacagccacagaggcacagaaaagaaccaccgttgtccccaaagcaaccagaatctcccagagagatgggacagtggagaatgaagtggtgaggctatgaggaagggaacatgggagaagtctaggaaaggggaggccagtaaaacctgaatcccagaaacgaggctctgagaagctggaattatgtgcaacatgtttgtgcatttccatcagggatatcccctca

SEQ ID NO: 26657 - DNA, 777 bp, Bovine  19866881358371
gaaggtagacctaatgatctgggtcccctgaggacctttttggtgcctgaaggtgagaatctggtctccaagtgttcctcccagatttcagtcatttttggtgagcctggtgtttgcatttgatgacagggagcttccaaaagctccgaggattaattcaggccgctgtgtgtgttctgagaactgcctcactgctttgtctgcctttgggccacagtgcccataaaatggaggaaatttggagaagaccgtaagtaaaggtcctgagtttcccaacccagacattcctgtcctcacccctcataaatcccattagacttgagacctaggctgaggggtcctccatcatcacagtgtcattccctcttccttacatccacaggcagaggcccgggccaccttgcctgtccttctctataaatcagaagcagggcaataggaagctgggggatctctgtgtctgcatggccagaggaaacccggttgctaggagagctttggaacacttgagcagaggagcctcacttggtcctcctctgtcagccagtcccaggcctggcctccaagtcaattaactgaaccgtttcaacaggcttgaattctgtcagcagctcaaccatccccttgtttactgttgaaataattactactttgccataatattagctctgagccgtgactccattaccattatcaccggaatattacccatttattatctcccagcaaccctggaagatgaatactgggcttcggagacccattcgctgttgggca

SEQ ID NO: 26658 - DNA, 1377 bp, Bovine  19866881412344
gcagctagtggagatgggtgggggaactgagtgaagaggggtgacaagcttggggtggggaagggatgaggggcctgctgccaggcagtgggttaacttgagaaatcagaccaagacacatgtgaggagagctccaccaccatcagcttcctttcagagccatgggctggcagatcagcccatctgaactggggaggaaaagggacacaggcattgcataagtcaggggagaaaacaggctctctgctgacacatacctctgttttgaagggacttattcttttcttaaataaatgaaccaatcacaaaggttacaggctacgtgagagaaaagctcatcctatttctgtcttgctctagttttatataattattatatcaactgtggctgatcaaagcattcattaaagagaaactatctctcctatgcttttgttacagtttggagagagttgacaggctttctatgtctctggctatatttcccctttcctttttcatggctgatttctctcttcttcctctcctcctcccctttttctataccggtgatttttaacacatttttcttttttttctctccacctggcttaatcacatctcttttaagtcatcaagggaaccatgagcgcaggcagctcctggttgtatctgtggtctggagagtgagcagatctccagtttgagagaatggaacctgctcttcactaggcatggccctcaccccaatcatccctctctggtatctttcctgtgactgatttttggtgtcaagcttactgccttgtcccagtaacttcctctcaaagacaggcacagatttgacatcgctttgtcaaaattaggagaatcctgtgctagcaaaggagttccatatggtcaactttctgtctttgcaaactctcactttcagcatcattttttgcttctcctcttttccttatttcagtgctattgctcctgtggagcctgctccaacttacttaccatagagggctttcccccagggatttcagcaacccaatcaattatgggaggatatgacttgaacttggagagcactgggcgtgagtgtgtgaaagtacatttttcatattagcatatgcctctatatcccatggtgtggcacaattttatctcactctccactgggctggctaatgacagactccttcacaaatttatgaaagagcttcggtcttcagtctatatttcatcctttatttgttcactggttcaacacacaaagcacagactatgcgctaggtaccatgccaatgtgcaggcacgtggcgataaataaaaacaattctgtcttcttgcagttcctaaacaaataaggcagggagaaagcacaatcagttacctgttaaccat

SEQ ID NO: 26659 - DNA, 1524 bp, Bovine  19866881413728
ggctggttttctaaaaccataaaacgttccacaggttccccctcccctcctccccaacaagtggtcaggcacaagcctgcttgtctccatggagagaatgaaggtcaccacttaataaagctcccctttggtggacgagctgtcagagtgaaatggtctgtattcattttaataaaagaaaggttgggttgcgatagtgtctgacaccgggcgcactctcttctctcttttaagctgcatcgtctaataaatatgtatcatctctaagggaaagcactgggtcagactcctaccccaagaacacaggattaagaagacgctgtgccggctgctcatgccagctccatgccatgtgtcaataaaagtccagggctcatcacatttcattccgcacaagcgcggccttccagctcatctccgagctgccacctcctgcgcagcgtgaaatcaggccccccaaaaagcaatttcagctcctgcttctcgcagggtttccagttttgatgcagagccctggcaccgggcagcctggcggtcagggaatgagacgagaaatgacatgcagtttacaaaaaataaataagaaaatagaaaaaggtataaaataaaattgtagatcctactggtccaaatcaactcagagcacactgctcctcactactggtgaaggagaagctagtctcaaagtgcagcctttaaacagctcatctctgcatccatccaggtgggtggggtccccacacgcttcccacacctcggcccgttccccctgtgtgtatactagtcactcagttgtgtccaattctatgtgaccccatgtaccacagccctccaggctcctctgtggaattctccaggggatcttcccaacccagagatccaacctcggtctcctgcattataggctgactcttcaccatctgagccacctgggaagcccttaaagaggcctgtatttctcctttccccttcttgctttcctatccccattgttctctctttcatctgaaagagactgagagttcctttaaggtttggagaaagtcactatatcatgctgcaaatgtaaagttgcccagaacaagatgatttatcataaaatgataatgacactctgctccgtaattcatcatgcactttatttgccgattcattaatgaacccatccaagattccgggataatggcctctaattctacaggtgcaagagtttgcggtaattgctctaaattataattacctttcccagtttccaggaagggtttagtaaggaatcatcctggttatcggcaaggtggacattttcatacaattttaaccaatatggcataagaaaccctatgcattaacaacataaataggctttatcattgttttgctgaaacctaatgtgcatttcctttatggctgagtcccttccctgtcacaacattgttaactggctatgctgctgctgctaagtcgcatgagtcgtgtccgactctgtgcgaccccattgactgaagcccaccaggctcccccgta

SEQ ID NO: 26660 - DNA, 1664 bp, Bovine  19866881515211
cagagagaggcactcaatctttccaggtggatctacgtgtaagatgtaagatctcagacgatggtcttatcctctgtgcccatcactgcatttaaaaaaagggggatgagcaattctgcagaatgagggcaataaaaacccacaaagaggacagaaggatggagtggaggtccctggtggtatccctgtcctatttttgaggccaagttgtagcctcacatgtactccaggaaaatattcagtgtttctaagcaagtttccctccttcctgagttggtttctacacataaattcaaagtagcacagactaataaccatggactttgaatgcttcgtgaagtcgacttctgtcttacttgtctaccatcatccccaactcttctcctccccagtgccctccacctccaccgtccttacctccttgtcatgaccactggtaccttcttctcctgcgcatgctaccgtgtgacacagatctacagtccctccctctacattctttatctgggcaattagccttctcatccaagaagattcagttcaaggaccacctcctctagaaaccccctaccgggatgtttaaatctagaaaaggcattcttttcccatgtcttagaagggcttgtgctcacatccaacacagcttttgtcacatggcatttagaaacattggttgacttgtctgctttcccgcaaggacttgaaaatgaagggtaaggggcctgctgacaaccttagctctctgtcatttagcaaagctctggactcaagagaatggcctcatttaatgtttattaaatgaagggctgaactgatttcattaacgaattagttattagttactaaataatcagaagatggtgccaaatgaagcaaaggtcagaaaagtgactgtctacggccagtaatgactcactatctgacttctaaaccagattctcttattctggaactattgctctcaactatgctgcagaggacatgaccatgtttcagtcttagtggggagaaaggcaggtcagatggaaaaaggctctcttaaaactttgactccagagcattgccccaagacagtttaacccatctcttcagggaggatgcctcagttctgggagggtgctgcatcttctctggggcacacactccagccccagttgcaccgcatgcacgaatagagctgaacgggtcacttgaccgatttattgtgcagtatcggttttcctcgtaactgaggccaatgtttttgctcagtttaggcagtgtgtgcatcacacctggagaagggcaggacaatcgactccaatattccagcctggagaatccccatggacagaggagcctggcaggctacagtccatggggtctcaaagagttggacacaactgagcgactcacacacacacacacacacacacacacgcacaaacacacacacacacatcacccctatagaatgtgatctatcaggtaactgggtctaggatttacccccacacattctaaaatcagacaaagattcacaacaaaatattctttttcttctttttgagtaaagtgtgcgtgtggaaaatagtttatagagctcagtctctgcctcataggagatgaaaatgtgatcctttgctagctcagacaaaatcctccatgctacattaggcttgata

SEQ ID NO: 26661 - DNA, 1492 bp, Bovine  19866881516026
aaatgaaaaatattagggtccttttggggaatccattctagaatagtttttttttttttttctttctgcaaaccactcctatctaagggtttcccaggtggctcagtggtaaagaacccgcctgctgacacaggagacaagagacaaagattcagtccctgggttgggaagatcccctggagaaggaaatggcacaccattccagtattcttgcctggagaatcccatggacagaggagcctggcgggctacagtccatggggttacaaacagttggacaggactgagaactccatctaagttggagaaacaaactaaaatgtagacgagatggcagtgtctctgcacatataagcgtcaactacttgttccacgattatgttccgttagacctgtgaccaggcttatgctttcatccacctgcctatccatggactgtcctcctctctaaacccatgggttatttttgtgatgttcataaaataggatatgactgtgctgccatctctgcatttgaacccttggtgggcgctgacctttcccggctctgagtcatgaaagctcttattaatttcctgcagggatgctggcactccgaggcagtggagtggtgggagttcattaacatgtggggctctaattagctagcaaaggatttgtttctgtcctcattctgataactaacgaagctataaatatagacgtacaagaacaaacaaaaagccgaaactgaaggaaagaggtgttgacatgtccagggcagatctttaaaccaaaataaccaccctgttttcttcctcgcactctccagggacctaatcaagctcttctagaaaacttcatgtggacagctgcacagtgtgggagaaaatcggaggggtctagataagggtgtaaagaattattgattggattggattgtgaagtcccttctgaacctgccgttctatgaatagcaaatctaaggagaggtaaaaagacctgaagttcccaggtgttgaaaacagaatgaagaaaatttaatcattgtctttgtgtctgcataggattttgatagaataaagaccacattctctgtttcccaaactagaagaggaaacatgtttagattgcagctgggagcagtctaattgcttaattaatatttggaggctctttataagataccttgttcaaagagttggtaggtggttagcacacaactcttgggggtacctcaaactgtgccagatgttgctatggaatccctgcccagtgacactgaaccaatcagttgaggttccaggaagtactctgaaggcttttaattgctggactgaattcccaactaggctgtggtagttcctgccccacttaagatcttaataagcaagaaggaagtctgtctacctgaggttaaggccctgatttgttgagatggataattggctctgtaaagaatcagcccctgggatgtaggttctccatcattagatgccatgcggtagaggcg

SEQ ID NO: 26662 - DNA, 1112 bp, Bovine  19866881743274
aggagcctgatgggctgtagtccatggggttggaataggtcggacatgactgagtgagtaaaaaacaactttgtgagacgagaggtttggaggcgagatggaagctttactgagaacatctgtggctctgtttctgctctcagtactgtccacccagccacagggcctctgagttgaccctgagttatcatctcaaagaagcagcttctccccagctggcatccacctcctttattacccagagctgcgcatctgaggtgagccagccctggagtctggagagcctccaagagccaggaaagtggttgggaagatggaggcaaaccccaaagaaagagaggaagctgccgaccattgtccttttcttttcaagacagcagtgccttttgcagacttttaaatggttgccacggaaacagagcgagggagcggagaaaggttacatggatgctggataaagctaatgcacctttaaaaaacatccagctgacaagtgcctaagactctgaaggggttggtaacatctcatgttcaaagttccccttcggagcctcaagtaccttgataccatcattaaccatattttaatcattcgtcaactataattcatctccatcaaagactcgtgctggtgggtttcatggaccgtggcctgcgaggctgctcttatggcttccttggaatgaagtgtctggcaagctgggccccgggtttcagaggccttggcttaaaggagtttgattccaaatcttcttcctcctgtaaacaagtgtgcaccccgaaaacacagcaacacaccgcgaagtctgtgtttacaggtcagtctcagaatatgtgcgtggccttgtgagtgtgaaaatggatggtggaaagaaacgctaagtgtgagccccagccgctcagtttagaacacttaccccagggtgtgattcccctcttctgtgtgctgtttatgagggcttcttcacttcagtgagctcgctcaagaatcctcgttccaactcagttctccatcgtggcctctagtgaatatttataactcccaatctctggaggtttgtcccactttatattctgctgtgtccccagaaagtttatttgtgcaatttgtg

SEQ ID NO: 26663 - DNA, 1219 bp, Bovine  19866881752920
cgacttgctttggccatgcaatgggaatagaaatctcttgtgtcactatgaaatgaaagctttaagagacatcatgtgtttctgtcactcttttctctctggagtcatactgcacattccaattaaacctactccttcaaactgtggtccaggaattaaagaaataactggatggggtgggggcagagaaagagaggggaggatggagcagtgtttgtgaatacatataaatacatacatatacatctacatctatcccatctgcctacgcatacatctgtatcagtaggcacataaagaatgtacacagagttgtaagccatcattgttgtaagccactgacatgttggggacatttgttattgcagcataacttagccaaagctgactaatacacattagtatccctcttaactaattttcattgaaataccccatcagattaactgatgctctctatttcctctgcaaaacataccaaaagtccaaagttcttagactaatacttagtatattagcacttttctgatcctacaagttaggcaaataattgccgagaatcaatttctttttaccatacagaactactgtaatttcatgctgtaatctcattctatgaagtgtacgttcagtacattgttaagacttgataaaaactaaatcactaaatacattaaaaatcaaatgggaaaatgtatatcaaagtgtatatcaaataaattacaaattgctgtgttgatatatgagttgatatcaatttgtcaattagcatgtttttgagcagctactctttgttagacaccatgctgggaataaaatgaagcgtgtaacacagaattaatttcaaaggactttagcccagaatattgtaaaaggaaaccagcatcctaaccagcaacatatctcagtgactgagcctagtaccaataaacagcactgcatccattaaaacaaacaaaaaaaattgtatagaatgttccagccccagtatatctgagttaacgaggtcaggaagacggtgcctctttctattttatttcatgtttctattatcttcgtttatttatccactccaaaacaatgcaagttcattacaacaggcttaaaataaggaaatatattaaagtttttggtgtaatgatttagttattgaaagcctacttaaaacagaggacttttgctagaagcgtccttgtcggagcacttttgccaaagacca

SEQ ID NO: 26664 - DNA, 3005 bp, Bovine  19866880209432
tcctgggtgttctttggaaggaatgatgctaaagctgaaactccagtactttggccacctcatgtgaagagttgagtcattggaaaagactctgttgctgggagggattgggggcagaaggagaaggggacgacagaggatgagatggctggatggcatcactgactcgatggacatgagtctgagtgaactccgggagttggtggtggacagggaggcctgacatgctgcaattcatgaggttgcaaagagttggacatgactgagcgactgaactgaactgaactgaactgaagccacctcaggttgtctcatagctcagtgatgctcttttcattttgttgatttttttctgcatttcattttagatagtgtatgttgctatcgcttctaccattaatcctatgcagtgtatttgtcatctcatatattgtagtgtttatctataaaagtttgattttcaatctttgtgccatctctatttaacttttcaaacatacagaatatagttaaaataagtattttaatgttcttgtctactcattctagcatttatgtcagtactgagtccatttcagtgactgatttttctccttattataggtctcaactttgcagtttctatacatatttagttatatttgattagatgctagacattgtgagtttcaccttcttgggtgctgtatttttttgtactcctgtaaatgttaagttttgttttgggatacagttgaattatttggaaacagtttgatccttttgtatcttgcttttaagattggggggtcggggtaggggcagaaccagaaccatttggtttaaacctaattattcttccctatcaaggcaagatccttctgtatactctattcagtgctccatgatttatgaaatttagtctggttgatgaggagataggcattatgcctggctttgtgtgagtaccaggcacttgtctctttgctcctatcaaatctttttttctacagcctcaagcagttttctcacatgcatgtattgagggggattcttcacagatctctcctgagaactctagctgccttgttcttcccaggtcctaggcttcatctcgtcaacttgaggggtctgcttgactccatctgggctctatctccttgtatcatagcctagaaattatttcagggcagtatgctggggcaatcatagagtgttctttgtttttctgtctctgagggatcactctttttcactgcttgatgtccaatgtcttgggagggagggagaaagttgtttcatatgtttcatcttaaaacttttctttttttttttttactattctaggtgatggggtaaatctgatccctattactccatcttggtcagaagcaataaagcttttaagttttcagtggtggttataaaaatgaccaatagtaaaacagggagtctctaaccaaaatatccatggtattttttcataactttagaaattggaaagagaattaatctcagaattatcattatctattctttcttccactcatatccatcacaaacatttacacaacaagattcgttgaacaaatagtcaatcacatcattcagggaggggaacattgaatctaagaggaaaagccatcacaagccactagaattataagtttcaaagaacatattatgtaaaaaggaaatgatgtcaagtgaattgagttggtatcatagtacagtactattttaatttctttatatcagtaaatagctgtgaaatttttggttttgtttgttttatttgtgcttcacagggaagccaagtgatttttgccaaaaaaagaagcagaaaaaaataagaaaatgctagagaaatgtaggttatctcttacatgttcttatagcccctataatgtcagcttagtcaataaatgtttgcaaaaatccaactagaatgtgataaggtagttgctgtagctgctttctcttttcctacttttgtaaaagtaggaaagttcatggataaatggtagtaattagcatgcaattgtgaatctaggttgcaatttgcaagtgtgagtttcaaactgactaggccctcagaacagaaagacccttctaagactggtacacaaagacttggagttcatctgcccagtttatatgactaattagcacttagggttttcttcaataggggctagtgaaataagacctaaataatatcttgtaagattttttttttttttctatctgtacttctcagaagaggggcttgttgaattggaatggaaaaattaaacagatttttaaatgaagccctgatatactggctgcttgcctgctctattgggacaactctggttccagggaaagagaatgctttttttgtttatttgtttgtttccagacaatttcctgcgtcatcacattttttgtgagagccaagtgtttgaggttgatgatgttgacagagcccttggagaatcgaaggagttcatctccacagagaaaagcttttgtatttcaagttctgaaatcccagaatatttttctatagcattgttattgctagctttttatgtctttttattggagaagactgatctcccttttatctagtcatcagctttttaggtggattactcttttaagtcgagaaggctttttagaaaaactatttctcttggtatttatgaaactcacaaccacgtatcttgctctatttgagtctgtctggctggttgtacatgttgtaatcccagaggcttagagtttcattgtaactataaattctatgtttattcatatttaattttcctataatagaatcattgtttaattaatgatattatctcttgaagtgtttgggaaaatataaaatatgtttgaactataatgaattataatggtttccatttatttacaaatttacttttctgaataatgtacccaagactattttcgacaattgaaaacagaaactttttatatatgtgtgacacacacacacacacacacacacacacaca

SEQ ID NO: 26665 - DNA, 3249 bp, Bovine  19866880436427
gttctgtgcccctcatagctgggcccctgtttttcatcctcctctccccaccccctcaccccccagctcatctctgagaagaagacctactacctgacggctgactcgcctagcctgctggaggagtggatccgtgtcctgcagagcctgctgaaggtccaggccattgggcctccagccctgcctcaggggggcaccaagcccaccgtgaagggctggctgactaaggtatgggttgggggatgggggaggcatgtgggcctcctgagagtcaggggagccaggagtgagtcccaggggtggcgggtcccctcctgacacagctttctgcagagggttcctcacattggttacctgtggtctgagccacataaggtgatggtgaatgactctctggaaaaacagggatcaaggttgttagagcaacagctgttctcaagtcagaggggggaaacgaatgtcttggacccattttgagctcatttgaagttgcccccactgctgctttgtacccaccacagctcagtatgaatagagggaagctgtgacctcagtgaggcaggcgtggccaaagattcataatatctcaggctgccctaaagatgttttttgattttttttttttttaagccgtgcctcttggcatgcaagatcctggttccctgaccagggatcgaccccagtgccctctgtagcggaagctcagagtcttaaccactgggccaccagggaaatccctaaagacattttaattagggcctttctggttgcagggagctgagaagcacttattgacccccagggagggaggttaacagggaagtgcagtaactaggccaggacactgtcaggagtaatacgtaagaagctccgtgctcggggctctccctctgcctttctgttcagtctgggttcacagccctctcctctgctcgggtgcagtgtttttacacttcatgattacatttgcccaaggacttcagcccacggtggccctgccctcccaactctagtccttgctgactagcaagttcttcttgtggtcacattcctgggacaggacatctggttggccaggtcgaccttttaatggcagttcatatgagggtgaatgggggtgtcgtggccatggacccttgctgtgaaagggctggttccattagtcgagaatctgggtggcatctgagtttgacctggaattgacctaagggtctgagttgaaccaggggttttgagatctgtctcctcgtggcttctctttgccagtcccagatttacttctggggtcatctgattctgataatgctggctcacttctgacctgcaggtcaagcatggccactccaagctggtctggtgtgctcttgttgggagaaccttctactactatcgaagccatgaggacaaggtacttcctggcctcccaatagcttcccccaatccgcattcctgtggctccgtgtcctgatggaaggctccaccccaaaccctataaccagtacaaagctagtggccctcttttgagtgtgtgaccagtgtgcaaggcccacaggttgtttttgtgtggcatgtctgtgctcctccaggcctgtctccccttccccatccctgtcatccatccacctccttgatccccagccctataagccctgaggttcagagagaggagactcctccatccctgccagccctcccattcatgcaaggctcctgtctgcagcgacctctgggccgtctgcctgtgcgggacgcgcgcatagaggaagtagatcgatcctgcgactcagacgaggactatgaggctggaggaacccggcggttgctgtcctcccactacacgctggtgatccacccccccggagcacagccccacctacctcctcattggcaccaagcatgaaaaggtgagggaggggctgggcctccgtggcaaagctcaaacctttgattctcatcttccttccttcttccctgagattcccaaaattcaaacttattttcctcctagacatgttggcaactcatatttcctgattgggaatattccttgtactgggttcattcccagcgaccaacatctcttcactggggccatgagatggaggggaccacaagcttaggaacttaggttcatattcattcgatcccaagactttcctcttagacaccagtggcctcagcttgtgccaaccaagcaggctgagcatcgccctgcacttggccccttcagggaagcgcccttggaggtcctgcctccgttctctcccagcccagccccatcagctggctttccgtccgcttccaggatacgtggctttaccacctcacggtggctgcaggtggcagcagtgccaaggtgggcactgcctatgagcagctcattggaaagctgatggatggtgaaggagacccgggtaaggcaagggtggccgtcactgctgggttggagggcggtggctgagtaattggtggttgggaaccccaagaaagcacgaccgtgccctgaagctgtttggaaagcatctgagccacagaagggcattcgtgtcccatgctccagggccttgtttctggtgaggatactggggagaccactcagtatctgggggagttgtctggggagcagacacttggtcaatgttttactttgttccctgcaactttgctggccagacagagggttgaggaaagaaggtggctggttaatctgtagttagaggtggttaataaatgaagttaggatcaggctgacttgagcctggggcatttagaagtctgtattttgctactggttctcaggaccctaaggacctaagggctcccagcacacacacactgctccactgctgcctcaaggcttgtttgttccaggctgatacacattccttcatccagacctgacgctgcaatgagggggcctcccttgcacacacgcgcacacacacacacgcttacagatgcccacgccttgcacactcactcctactgcagccccatgagcaaagcagccttcctgtaagctgtgcttctgagtgtgctgaataaatgcagcgcacacctgcccagcccacgctctgtgggtgtaaacgcagcacaacccgtgtgtccagactgaaaaccctgtgttccctgcagatcagagaaggggtggggtggggtggggggcgcgtttcctgcgcacttctgactgccgctgctctctggtgctgtgctaccgggcagactcccccctcggaggcaccccatgct

SEQ ID NO: 26666 - DNA, 2395 bp, Bovine  19866880437458
gatgctgggaaagactgaaggcaaggagaagtgggtggcagaggatgagatggttagatagcatcaccaactcaatggacatgaatttgagcaaattctgggagacagtagaggacagaagagcctggcgtgctgtagtaagtggggtcacaaagagtcagacacaaacttagtgactgctgatgctgctgctgctaagtcgcttcagtcatgtccgactctgtgcaaccccatagacggcagcccaccaggctcccccatccctgggattctccaggcaaaaacactggagtgggttgccattgccttctccattgtgtgaaagtgaaaagtgaaagtgaagtctctcggtcgcgtccgacttgtagcgaccccatggactgcagcctaccaggctcctccatccatgggattttctaggcaagagtactggagtggcttgccattgccttctctgaacttagtgactaaacaacaacaattatttcatgaagtgactgtatgatctggacacatgtcctggggccacagctaaaagaaagtttaggatgctccatggaactgggaccacagccctgctcacatattctaggagcagattcaagaagcatttgaatctttggtcaccttctaacagaagacaaaaaattcgttatcagttataccaacccaaaacctgtgatctctggaggacactctatcctttagggatctcactatagggcaaatttttaaaaaatttttttaaattttttaaagagccataataaagtgatagagacttctaattaactcctgacttcaaaatctaagatcattgtttccaggttgtgttagtgctaaaaacttagggttttcaactaagagtttgctcccactggaattcataaatcatatcaaggtcaggatttctgcacagccttatagatggaagccattattctgacactaaccttcagtgaaattccatcaattaatagtttaggtctaagtttcaatgctctattattcaaaaataataattatgttgtaatttaactgttaatagtttatctgtaattgatagtgacaccagatattgactactaaactttttctttttctctatcaataccaagctgaccaggcacataagcattgaggactgtgataaagcatctgttcttcagatgagaaatcagacttttcagctaatgctcttgaagagagcaaactcaacccctcaatcatgccattgtttcataaatgatcatctaggtgaaaagaaaagaaggtaactgagaagaccagagaggttttcagagaaggctgaaacactcaccgtggaactaatcaacacttcaggttggggacgctccgccttattgtacttttcaatggtccggggcctggattttgacagacactccaaaacaaatgcagctattcaaacatctcccgtgtctgaaaagtatcttgagtactcaagtacattgtgaaatgtgattaacacgctttgattttgaaaaaccccagagaaagaaaagaatgtaaataaaagaatggaaaatatatatacaactggacattatggaagagaataacagacagaaaatatacaagtaagattaagttgctacatctggggaaggaacatagccgattcctttaattctctgtgaagtaaatgggaagcaactgtttttattcttattttgcaaataagaaaatcaggcatgaagcataaaagttcacaatgtggaggggaaaagttacaggtttacagaagtaatgattgagtgagaacagtaaggttaagtcgcaggaagctatgttttaatctttcctttgaaagaaggacccgtttgttctttgtatctgtccttcaagaaagttgtgaactacctaataatcacggcgtaatacgcaatggtcattttcatgcatacagaatattattttagccagggagatcaaacaaatcaatcctaaaggaaatcaactctgaattcattggaaggaatgatgctgaagctgaagctccaattcttcggctacctgatgcgaagagccaactccttggaaaagaccctgatgctgggaaagactgagggccagcggagaagggggcggcagaagatgagaaggttagatagaatcacagactcaatggacatgaatttgagcaaactcagggagatagtgaaggacagggaagcctggtatgctgtagtccatgggatggcaaagggtcagacatgacttagtgactgaacagcaacaaaagaagtggggagaaagggagaaaagacagggtccttgaggtctaggagggtgtttatgtgtgtaaggaagaggggcaggggtgatgagagagagagtaaaaacacacctaaatcttttggaaacagaaatt

SEQ ID NO: 26667 - DNA, 1220 bp, Bovine  19866880446076
taaagcaataaattggcattctggtttgcagcactggtttatttatgaattttgttaagatgaagtgtgagaactaacccttgtcaactctgggatacagacaatgtcaagtttctgggcctgcaaggctggaactggaccctagctgttagttcgtatcgtcttaggttgtcatttagtacaaaaggggagataatatatacttggataatttagtctctagagtctgatttgggtttgaatgcttgatcagccatttataaaatgtatgaactaagcctttttccttctctgtaaaaggggagagagatcatcataaccccaacctcaaagggttgttttgaagatgaaattagataatctatgtaaaatgcttggctcagagccctgcacagagctgctctcatcttactaccaaagcaaatgacaccttgtgatgattattaaaagccagtatgagctcattaaagcaaagcattcctgtttccttcttttacatttcatctgattgcttataggaatgtcatggagtagagttgaggtgtttggcagagatttttattatatccttgatgtctcattgggttaattaagtaaactcagagctggttgaacaaacgtgaccaagtggttttgagcttagattgatgacaatccagagggagatcatcacagtaaagaagtgtttgctgatactattctatccaattttctcacttaaaattttgatgaaagcagagaagacatgtttgtgtaacatatggtggcctcaaagttgaaagagatggctcacccatccaataagagagaccggatttaaaaagatctgtgtaggttgatgggataggtttgcagctaacaaccacatatgcatttattgagcgcttaccatgtgccaggcagaaagctaaatgtgttccgtggattccctcatttaatcctcacaggtcaccctctgagttgtacattattaatactccatttgataagcagatatagaagcacagagatgttatttcctcaagtcctccagccacagaggcacagctggaacatggaccagttgtctgacaccaaagcccacactcttaaccattgtaataagctctctgagccagtgagtctaaattttacataagttgatgtaaagttccacacttaggttagcaaaatattgtgataagtcctaaaaagaaggcaggagcttagtttgatagcaa

SEQ ID NO: 26668 - DNA, 1013 bp, Bovine  19866880458577
tcggacacgactgagcgacttcactttcacttttcgctttcatacattggagaaggagatggcaatccactccagtgttcttgcctagagaatcccagggatggggaagcctcacgggctgccgtctatggggtcgcacagagttggacacgactgaagcgatttagcagcagcagcaggatcctgggacctagtttggcaggatctccctggaggaccaatgttaatgtttttttttatttaaaaatgtttttcaatgttaatgttttaaagaaggtgaaaaggcctgtctcttgtgcaactccaattgattggtagtgcatgccctgagcaccatgttaaggattctgggcctgtaccactcaatgagtaggcatgctctgattgattaataatgtctggaaagggtaatggtgacatacaggccacctgttgatgacacttgctataaaatatatagtagaaagaatttaagggctttatagctcaggaataacttagtggcttcttacccaatttttaaaaaggttcaagctatgcttttgaggcctggatcaacaggacccatgtctctaatcattgctccatttacttagaaccaagatccagaacaagttacccatcataccgcagcccaggaacgcttgggagtcactttcccctttgtgacctggaataagatcggaggggaaacggtgtgctctgggaaggctccaacctctttcctctccttcctttctttacagagtgatgtcatccggaaaccgcaaggccaagtggaactaaactcccgttgccagattgttcgaggggaaggtgcacagacattccaggtgaacatggtcctggcagttggtgttttagatagaagaggtgctgggtttggatatggctccgatgaaaacaaagatggggcaagatgagcgtgtgtggaagacatgacactgacatttgcatcgctcctcatttgtgggtttgaggaaaaagaggaggcaggatgtgagatggagtga

SEQ ID NO: 26669 - DNA, 1281 bp, Bovine  19866880494408
aagcgtctgtctacaatgcgggagacccaggttcgatccctgggtcgggaagatcccctggagaaggaaatggcaacccactccagtactattgcctggaaaatcccatggacagaggagcctggtaggctacagtccatggggtcgcaaagagtcggacacgactgagcgacttcacttttccatatgtgaagaagtatgggataagaacagaagaaaactaaaagaggtaataatcagagctagcatcactggattggcatgtatgagcaggccctaagacgtgcagggaaactagaggcaggaatgcagaggcaggatgtatgaatcaaggtgatctgggtagtaaccaggtaaattcacaactgatactcgttatcttctccaggaaacacagccaaaagtcattagctatacagataaaaggccagaatcaaaagctttaaccttttcaacttcctttatttctctaattcaaatattcctgtgctaaagacaggaatcttggctgaaacacctacatgaacaaataaaaaggaaaaaaaaaaagtttttatataaacatcagtaatttagccacagtgaaaccaaaactgtgcaaataataaactaaatcatagttttgatactataaataatcctaaaatacaaacctaaaaagaatttgagatggctgcaatgaaaattttaacgttctttttatattctaaccatgaccaaataccatacctatagctttggggtaagtaacaaagaggaggaaaaggcaatggcaacccactccagtactattgcctggaaaatcccatggacagaggagtaggctggtaggctgcagtccatgacgtcgctaagagtcggacatgactgagtgacttcatttttgcttttcactttcatgcattggagaaggaaatggcaacccactccagtgttcttgcctggagaatcccagggacagaggagcctggtgggctgctgtctatggcgtcgcacagagtcggatacaactgaagcgacttagcagcagcagcaacaaagaggagatctaaccagtccattctaaaggagatcagccctgggtgttctttggaaggaatgatgctaaagctgaaactccagtactttggccacctcatgtgaagagttgactcattggaaaagactctgatgctgggagggattgggggcaggaggagaaggggacgacagaggatgagatggctggatagcatcaccgactcaatggacatgagtttgagtgaaccccaggagttggtg

SEQ ID NO: 26670 - DNA, 883 bp, Bovine  19866880499792
tcacaggtggctcattccaaggataaaatggattgacaggttgctcacaggtccggccatctcactttctcttccctactcctctttctctttccaatgacactcctcagttcaacaggcgtcatcactgtcgccgctgtggccggctggtgtgcagttcctgctccaccaagaaaatggtagtggaaggctgccgagagaaccccacccgcgtgtgtgaccagtgctacagctacttcaaccaagagtgagtgtcccacagcggggccactgcagctggtgaccagtgccccctcccccggggtcctgacatacctacaagtctcatgagggagagcatctcaaatctgagcagttacagaaggttttctttccacattcacactgaaatgccattaagcctgcggtgtaatggtcaaccttggtcggagagacatcagagagaggatgtaggggtgcgtagaagcagagagcaagtgcgtgcatgatgttctgagatcagggccctgggttctttggcctgtcccctaactgaggccactgatctttgcttgccaacaccctcacctcttttccagccactctcgcttcagtcagtctcagctggactcaaaacgacacgctcacctactgaatgttggggcctcacttacatcagctctcatcaaccttatcattctggcttgttatccatgactcagagtccccacacactttcctacacacagttcacccagggacaaatctcagaaactgctcacgccactggcaaaacaggtcaagggatttttgccggctcagtgtcgctcagttttttccactacttctagcggcaaaagagggtaaaactaagtgcgtggggcatatagccaaagcagctatc

SEQ ID NO: 26671 - DNA, 2688 bp, Bovine  19866880540903
tccagcttgagtacaggaggtggtcctgctttaggataagtaactagaagctgggagtgcctttcaatgtcttctcaacttcttgcctttctctataaaggtagaaatttttctgaagctcctatactctttaacacaaagaatcaaaatcagacattttctcctgctccacaaggaacttaccactgttttggaaaatctcactctcttgctagttccatgacttggttatggtttcactcatactacctacaccgacttaccccccaaattcagcctcagtgtcaatacttcccttctgcccatggttctgctgctgttagcatttacctaaagggttttttctcaaatcaactccttgctaacaagacagaactcccaaataatggctgactcccataaagggcaagcagagccaaaatcaagtacaaagccaaagcagtgaaaagttttctaattaagtttttacaaatttatttccaggaatatcaagctctgttctcatgtgctgtcttctctaaggaatgtaaactggcatgaaaagtccttccggtggaccagttttccactgctccgaatcagagcagcatatatacttccaacaatggatttttttctgggatacttaactatgtgatattctttatttcttctgttctatcagtacctttgcaagtcatggtttaaagctttgacattctcagatgaaagattagaattaagagaaattaattgtgactaatttttgaaacttactttctggacattgagcggagaatcttccgacttttgctcaagttttcacttgtatttaccagctgagaagagaaaatagcaattatttccctcttctcacagaagtacacactgtagaactgaacattagtaaactggacggggttaaaggctttatgttgaaaaactcccagaaatcaaatcaatttaaatgatggcctctgtaagtagaagaaactggaaaggacaagatactttaatacttgtcaataggcctaggaatgattgtatcccaaggctgctgtgaggagacctctggggactgagctaatccttcactgtggctacacaacacaaagtcttcgagtgtaccttgccagtaactgaagtaactctgagcaacttaagatgtgaatttcatcagcccaaactccaggacagcctcctgagctaatgtttgtttttgtagcctggtggattaccacttttgagatctggttctttttccttttttctttaccctttaagagatacttatattgaattatgaaaggaattaatctttttttaaaagccttttttccccccttttggttgcctgttattaacctatatagctggaggatatttcaacagatgccacctgccatctgttcctgttcaccagtggccttggtaagttgatctctcagctcattcctcagctttaaaattcaactaatccatctagtaagttcaaaagtaaaaacaaaccatgcaatctgcaaacaagctgctttctctgcagtttaccttgaattcagtactttactgtgaattttcactgaggagggtgatacctgacttgattttaagttgtcaaaatcattctgacttgattttaagagtggagaattacggctattaaggtgggaaaataagggctcagtgtggggatttgagatgactttctcgtacctaagtcttgcccatagtatctgtgtttcatttatctacctcatgttcttaatacagcattccactggcagtttttaccattcctttgcagatggtacagaaaggaagaaataagttgtttttcagagccccttagagtgataagtgatagtagattagaggccacagtacagtcatcatttggcctaagtattttgttttctcacagtcatctcccttagtttgtagtagtagtagtgttaattgctcagtcatatttgactctgtgatcccgtggactgtagccagccacgtcctctgtccatgggacttcctaggcaagaatactggagtgggttgctatttcctactccaggggatcttctcgacccagggattgaacctctgtctcctacactgcaggcggattctttaccactgagccatcagggaagcccatgatctcccttaccttaggttaagaagagtccaggattaaacctctataaattgtcagtagtactattttatgacacgtggaaaatagccttggctctaaatgacaggaaagcttagaatcttttaaagtaaatgttgctttcataagaatagcaggtgttctactagatgtgtgagaaacagaaatttagttcataatacaggacctaatataggacctaataaaaggatggtatggctacaatcctatttgacaatcttcactaaatgtagaaactgggttttctgcaatcgcagtccccctgcccagtgacctctaaatcttacaagtaaaattacttccaagggatatgttttagtcaagcaaattacgaacagagaaaagcataagaacctaaaaaatcataccctgaatttggaactgcggttgcttctgacagcagcaaagcatcagggtgtaatgggcccacttactttccccattcttgcccttctatccacccagacttactctactcttggtacgttccaactggtcacgttgctcccccagctctt

SEQ ID NO: 26672 - DNA, 1073 bp, Bovine  19866880569977
caggcctgcccaaatttattagtcatggcagtaaataggaatggtctaaggaagtatactttttactatgggttagattttcggtttgcccttttttctgcatttttactttccctactcctaggaattttctttttaatatccaagctgctttcctaagggtctagactatgctaactttcataaggatatttgcaagctttcccacattctacccttggagcttttgctcatttagctccataaaagtggaatgttcttggcacacatctaacatatatcaaaatcctacttgaccttcaaaggaacaatttaaatatcatttcctcactcaagaactctatgtatttaataattcctgtccctgtatcctccatttatcctaaggagaaactaccacttccaagcctctactacatgctagatgctctacaaaagagtttcattttaatcttctcaatggttctacaaagtactattctctctattctgcagaatgggaaactaaagctataagtcatggatacgagattcaaatgaagcctatctgacttcaaagtccatggtctttacataattttaagctgcttctattatagctgttaccatagactgagctatgatgagttgtttatatgtcagtccaccctcagaggttatgagatctttgaaggcaaagactctgtcctgtctaggtttgaatacgcctgtcctagtatattgtcgattatgtagtacataaagcactctagtagtgctagatatgatatgaggaaattaatacaatgttcattttcctcatataattagctattgtaaggcctcatgatcataaaaaattaagtacctgggaccagagttgtcctcctattataagcagtgagaaccctggataaaatatacaaaagaattattgttacaccttggacaaatgtcaggataagactgtgtcccctaagtgaagggaaatgaataaggtaagcccccaaattacacaggatgtcttgtctgaaagcattttctggaatgcaacacaggggagtggtaacccaatcagagtacagatgtcttat

SEQ ID NO: 26673 - DNA, 1805 bp, Bovine  19866880580554
cctgcgtctccacaccctgtaagggtggggttaccaggactctgtactgctgactcacttggagatattcgagaaggtatgtctatttgtaaacttgcactggctaccattttggatgagggcagcagactaaaattaaagtaaaactcaagtttctttaattttatatgaaatttgctatgaatcagtttttccctcagaaaaacttcatgggacattcagataaaaaaagagaaggtcaaagagtcatggtgaaatggagttttgacttggcttaagaatcgctccaaggaaatcacacacttcacctttgcctcctgtgagaggagagcagaagacgtcagaggaagaaaggagagcatactctctcctcccgtaagatgcttggggccaaacttaggatctgtgtcttagggtgcctcctgggctttgtgatgacaactcagagtggatgcgcagttgggttagcagcaggacatagtccagggcaggtgggaagtgtgtggaaacagagagaagttaagcaatttgcccaaggtcacaccacgcataccaaacatcttgttccagagcccacattctcagctattatttagttctgctgtatgttctgggagaagggatgaagtgtgtcattgccagtgacaagggcaatctgggatccaggttaagacttttacatgctcgtccaaacatgatttgtgtagagagaatttgccatttgtggttttttttttttttggtcgtgccacacaactcacaggatcctagttccctgaacaaggattgaacctgggtcctcggcagtgaaagtgcagagtcccaaccactggaccgccagggaaatccctagaatttgccatttggacttgactctgcctgagatgatcctacagctgaaccctggggtagcgttaaggggggttattgctcccggaagctgggcaggccaagccaggggggcaaggcaggcactgcatgcgaggtgtctggggtcccaccgtgtgtagcaggtgcagcagggcctcccgcaggcagctgtgcctcacgtagaagctgatgatggccaggtgggtgctgtagctgtgcaggtagaagaggcattcttggtagtaggtgttgttcaggatcttcccttcaggaatcacttccagagagaggctctgggtccggagggttgcttccagctctttcaaggtggccaagaagtcatcatcttgctgccaagagaggacagagagggaacaagggacccagagagttctcagcagcctctggaaacgctgctttcaaaaaacacttaacaatatggaaaaatgctctcttgtatagtgttaagggtagaaaacaggcaggatataaaattctacacattataaaccgtatgccatgctgcgctaagtcacttcggtcgtgtctgactctttgtgaccctatggactgtagcccgccagattcctctgtccatgggggattctgtaggcaagaatactggagtggcttgccaggccctcctccaggggatcttcctgacccaggggctgaacccgcatctcctgcattggcaggcaggttctttaccactggcaccacctgtggaaccctatatactgtacagcagcaatttaattcagaaacataacgaagaaaagtcgccaaaatccaaatacggcttaagtctggatatgggattatatgtgattttcatgtctttaaaataattctttttgttgttggaaatttgactgtttatgacttatctaatcacacagatggtgagggacagggaagccggcatgcagcag

SEQ ID NO: 26674 - DNA, 811 bp, Bovine  19866880603473
aatggagggattcctggatttttttttttttcctggcagtaaaatgaattaagcagcaagctttgcctacatttctttcttcattaagttaatggacacgtttctaagaagttatgtaaggaaaacagatgatgttaaagagagaaacagagacaagagactggtaaacagtcaggcattagtagatcctgctgacacattttttatagcaaacacaaagaatgtgttatgaatgcagtgatagaatagaaagcagaaccaggaaagagatggcaataaatggtaataaaatccaagtgattcatatgtttaaatcaaagaaagaagaaggatggtagtgcccaaaatgtgaaagggtaataaaatggaagtagagacatactggtgaagaccaagagattagaaatttgaggaactcttcttacatcaatacaacattacatgttaaacaacaaacaaagagcatgcaactatacttctcaggtgcagtatctctagtaactttagggaaataaaagccagataagattagtgtagcatctttaaaaaaaaaaaatgtaaacttcagaattcacatccgctataaaaggattggaagaatttgaaaagatgaggaacagtggcaaatgatagaaatcttaagcagaaaaagtgattttaaatggtatggccaggttttcaaaaaggaaagtactctggttctctctgccctgagagttgggagaccaacatggcctaaagaagaatagacccacctcatgtttgccatatactgagctggatgctttacgttcacttctcatttaagcct

SEQ ID NO: 26675 - DNA, 614 bp, Bovine  19866880606346
tcctaaaggaaatcaccctgaatatttattggaaggactgatgctgaagctgaagctccagtactttgaccacctggtgtgaagagctgactcattgaaaaagaccctgatgctgggaaaggttgaaggcaaaaggaaaagagggctgtgaaggatgagatggtgagatagcatcaccgactcaacagacatgaatttgagcaaagtctgggagatagtgaaggacagggaagcctggcgtgctgcagtccatggggttgcaaagcgtcagacacaactgagtgacggaacaacaaccagggctgccatggacatctttaccctgatattcttgagcctcttgcaaggagtagtttaagccggcctgtgtgtagcgtctgcagaattcacatgtgttgccttgatgccatgttcatagcagggacgccgcagttatatctcgttttctctctggctgagcagatgcaggagctggagcagaggctgctggacgcagagcagagagcagagaacgcggagacccaggtaatggggaggagacggtgggagtgtgcagggagaatgacctttcctgacccttcccatggacactcatggacacatcacaccaatgt

SEQ ID NO: 26676 - DNA, 3320 bp, Bovine  19866880694976
attatcttggtcatgaagatcttttttgcatagcttttctgtgtattcttgccacctcttcataatatcttctgcttctgttaggtccataccatttctgtcctttattgtgcccatccttgcatgaaatgttcccttggtatctttaattttcttgaagagatctctgccgctaagttacttcagttgtgtctgactctgtgcaaccccatagacggcagcccaccaggctcccccgtccctgggattctccaggcaagaacactggagtgggttgccatttccttctccaatgcatgaaagtgaaaagtgaaagtgaagtcgctctgtcgtgcctgactcttagcgaccccatggactgcagcctaccaggctcttccatccatggaattttccaggcaagagtactggagtggattgccattgccttctccgaagagatctctagtctttcccattctgttgttttcctctatttctttacattgattgccaaagaaggctttcttatctctccttgctattctttggaactctgctatcaaatgggtgtatctttcgttttctctgtttcctttcgcttctcttttcacagctattcgtaaggcctcctgagacaaccattttgtctttttgcatttattttattggggatggtcttgatccctatctcctatacaatatcatgaacctctttccatagtttttcaggtactctatcagatctaatctcttgaatctatttgtcacttccactgtataaacataagggatttgatttaggtcatacctggatcacatcccaagacccaccacagaactctgtccaatccaggttgttgggttcataacactctcctttcttctaaatgtctttctttgcttgtataacttccacttaatctttaaaactcaggtagaatgtcatctcctcaatgaattttctcaaaaagtccaagaataggatatcttttgtttttccaaagaaatcttctcatgtaataacagcattcatcaccgcttaaaaatcacttatttgcacatctgctttgctactggactataaattccttgaggttatatcttttttttttttttaactgttttactaagaagtataaaatgtacatagtaaaggttatcaaattttcagttcaatgaattatcacccagtgtataactacctcagaaagatcaaattaaaatatgatcttgcaatttgcatactcagtaactggtatataataaacagtacgtatacaataaaagtaacaaatgacattaatcaggcttggagtatattaatcattgcaagaaatcattccactgctgtgatccaaaatttagatttttagatacaaagatcacatatcattgacaatgggaaaatgctgctgctgctgctgctgctaagtcgcttcagtcgtgtccaactctgtgcgaccccatagacggcagcccaccaggctcccccatccctgggattctccaggcaagaacactggagtgggttgccatttccttctccaatgtataaaagtggaaagtgaaagtgaagtcgctcagtcgtgttctgattcttagcaaccccatggattgcagcctaccaggttcctccatccatgggatttcccaggcaagagtactggagtggggtgccattgccttctccataccagtcataggctctaacatatatatgatcttgggagttaatgaatctctctagccccaattttatcatgtctaaaatggaaataaaatgatcatttacttttagagtaactgtaaggatcagagataaatgctcatagtaactagcataatgcctaacacacagtaaaaactcagcaaatagcaataataaaatcaattggcatactggcatttccattaaaagtactcctttcagagctaagacctttctgactgaacacagacctttggcaattctcacagtacagcacaccagataccattcatcctcaattaattacagaaatgatcatctaatttgtgaactgaattatccaatttatcctgacagaggctcattaaggcctctagaaaaatggacaaagaagtataatttaataatctgagttgcttctttggaatgctgcatctaattctgcacaaatgtagaagaaaaaaattctcaaataaaattcccagatagacagtggatttaatttactcatgctatctttaaccttcatacagacagataatttataatttacagcaggcggagaaaatttttttctccattcatgtaactgaaacacacatctggtctaaaaggcagacgtttgcaagacgtactccccagacgttaatgggttaatagttctggaacagtagagcagtacaaaacgagctgaaataggaatgggaatgaggagagaatgggaaggggtggtcctaggtaaggtaaaatgcagctctcaaagctggctttcagccagcacagctaagctcacatctcccaactttccaaaaataacattagggtctttttgaccacaagtagtaaggactacagttttaggtttcatctaaaaataactattaaaaacaaccaaaaaaaccatacatcagtcaaagtgtgatgagaattttttaaactctgtaccatgacccaataaatgctgtttctataacaaccagaaatagtgcctatccccaactccattatttctaaatggcatgcttggaacaggttgtaacttcttagagaaaaaactctagaatatcatagtaggatgctttcatttgttaagtaaacaaaaactcatttcaaagtgggttaaaataacacttcttcagtttttgtgtgtacatgaatcatccggacagcctattaaaatggagattctgattcagcaggactacagtaggccctgaaatttctttgttcaaacaagctcacaggtgatgctaatgctatcagttcacagaccaccatttccataccagcgacttaaaccacgaagaaatatatgtattaatacttctggaaacccagagataagactgttcaacaatgtgatcaagaacccatagctcgtctatctctctgagataccatccaaaatgtcacttcatcctaaggttggctccacctttttgggtacagtgtggatgacaatagtaatcagagctattaatacatgatttccttgattatttcccacagaagatacagagtggcttcccatggatctcttataagagcaaggaatactagccccaaaacttaaaacactttcctatttgccaggattaggtcatctgttcacacctgaaccatcaagcag

SEQ ID NO: 26677 - DNA, 1323 bp, Bovine  19866880883107
attggaatatgtagtattgtattataattaattttccctttagttttctttcgtttaggcatattgatttttaaatttatgtatacaggtatgtcatattatctataaattttaattggggtaatcgggaggcattacaaataattgttctaataaaaagggacaccatcctagattgtgcagtgcaagggaaattgcagtgctgagggaactggaggtgagtagaatcagggtggcttcatgtgatcaaccccagacaggaagttcaatggtctcttacagatactgacatgaagttcctgaatgatgggtacacggtgtgatcaaaccttggggccctgaagacaactatacaattgggggcctttgggaaatttcatctccacaaataatttaaattatactatactgcagaattttccagcacgtaataataggtagaagaccgcatgtcatctgcagggcccagggaaatgacaaacagttgaatgtctggaggcagaggtgtgtttagatgaagtcaaagaacgaggtgccaggcttggtctggtgaatatcttcctaatggatgagaagatgagtaaacagtaggtaagaggatgcttaaggatatttatggaaatgctatatcacgaggaatcgtgaacagaaatagggatagagaaatgatctcggagcacctccaatgggttagaaaaacaggccagaaatacttacagctcagaatataagaggggctggttacttaatggtaggggaaaggtgacctcaactcccataggcatgcccatcacttccaaataggtacgaagcgttcaaaaaaagtgtctttctgtgtatacctatggctgattcatgttgatgtatggcagaaaccaacacaatattgtaaagcaatcatccttcaattaaaaataaataaaattctttacaagtgtccttcaatcaagagatagctaactgattcatgtatcctccccatctgaggtcacctggggatgggaaaaaaggaaagtcacagcctgctggcttggatactaatggagggcctggaaacagggctttctgaactttccgcaaaccctcacaactctattatctctcctctcgattccctcatccaaaaatgaagaaaacacaataaaacactttagattccatcaccgtacattttcctactgttctgctgttcttccaggagcattttgtgtaatatatatattttaattttaaaatggtcaggttgaagcagctatagggattaacaagaagagtgattctcccttctcaaaagggggtagaggaacttggctgacctgggct

SEQ ID NO: 26678 - DNA, 1281 bp, Bovine  19866880889775
attgtacctaaatatagtataactatttgaatagcatctaccatataaagaacaaatttgattataggctttcgctttatttttgagcaagtgcatttttatgctgttgtatgcttcaaaagtctgattttagaatattaacaaatagaatgcttccgaagcagaaaatgtggaggaaatgatcagctttcagacttattgccatggttactgtatgtaaataattttttttctccagataaatctaaggctaatattgttaactagaaaagtaagaattttaaaatgaggaaataaaaaatgcattaaaaaaaaaattgacttgaattttttttttttttagggtgctacagttcgtaatgaaatggattctgtcattattagtcggatagttaaagggggtgctgcagaaaaaagtggtctgttacatgaaggagatgaagttctggaaattaatggcattgaaatccggggaaaagatgtcaatgaggtttttgacttgttggtaagttgacatgggtagaagaataattgatacagtctcaaaaattgtttcctttagtagacttcagaataaaatattttaaaagcattttaaaaataacttaagatatctatataatttctagcataattttcacatataattatttccataatatttactgctgctaagtcgcttcagtcatgtccgagtctgtgcgactcaagagatgacagcccaccaggctcctctgtccctgggattctccaggcaagaacactggagtgggttgccatttccttctccaatgcatgaaagtgaaaagtgaaagtgaagtcgctcaggcgtgtccgactcttagcaaccccatggactgcagcctaccaggctcctccgcccgtgggattttccaggcaagagtactggagtggggtgccattgccttctccgataatatttactagtagcattttattcttacgaggacactactaattttatttatactgttaggtacattttatttgcctctgaaatcactaataataactcactaaatcattcaaaatatatgtattaagtgcctcctatgtgctagctgctagggaaacagtaacaaaatgaagttcataccctcatgacttttttgttcattttctttattagtctacaattgattgttgtttttttttaacagtattagagtaataacaagggtagtagctctacactgttcactagtaagtagccattagctacatgtgctagttatttctatttaaattaagtaaaattta

SEQ ID NO: 26679 - DNA, 930 bp, Bovine  19866880897727
aacaagtgaaatacaatctgcctttgttaattcttcacaggtgattgagtgaggcacgtggaccagagctcaagtattgaacctttcctctccggtcctgttgactgcatggcaggaagcgagagatcccttacctcagctgattgggacacaggaccagcgcccaaagtatatcttccaccttctttgggatatccccttgtgcctcgtgtagctgaggtacgcatgcctttgccagttcccattctcctctccgaaggcactcacagaaaaatcctaaaagctgcttctgggaagcagcttcttcttttccaaatggatggtgcattttccccagcacagagtgcagggagatataaacagatgaattacacaaaacacatcggcttttttctcatttgtggactatctcctagaaacaatacacatccgagagagaagaaaaggaaggaataagacaaactagtaactattactcgcacgaggaaaggcaggacttacttttctaatttgacatgttaccgtctctctttttgagaagttccacctttccacaaggggtggatcccatctttctaggcgcatccaatatttgattaatattaatcgtcatattagcccgcgacgcagacccaaaactccacttccttatttcctcctgaactttatgcccaatccggccccgaatctccaggtggtcgcctccctaaagatgagaaattcagcaggaacctccctagtttgagccctcttttaaggcagagtactgatgatcaggagaggaatcggggtcagaactggagggcggtggggactggggcgcagggatgctttctaccgggatcgtggagagtgctcctgccttcttggggcgccttacactcaccagctcccggtgcccaaatctgtacatcttccagcgaagccatg

SEQ ID NO: 26680 - DNA, 1540 bp, Bovine  19866880916294
cagcttttttttcttatttttgctgttatttgttacttatccccaataagcactaataaggcaggaattgtcatttcttcattctcatcttcctgtatttttctgttctttggtcctattcagattttcctttattccctagatcttcagttcttattgggagtttccattgcttctcttttctttatccttcttttgtgtctttcgttctcttctgccctgtatgtttttatcttcaaggtaaaatgccaagaacactgtttaaatgaagagaaggttttttaaatcttgcttaaccctggtaaaagagtaaaaatacaaaagctatgagaccattacccaaatctttcaagtcccaccaagtccaaattggagaagcacgtctctaggaaatttccattttgtttgttcccctaggctgttataaaatattgtaaaataagtacgtgagtagatcttattgggatgatgttagaatgaaatagccaatgatattaccttccctgggtcagtttttgtgtgtaattaacatgaaacctttcttaatacactttctcttctttgaggccttttatttttaggagattagaaaaaaaaaattggcagcagtgagtaggagatgggtaggattgaaggataattgttaaaagataacagagcaaaagaattactaaaatctccatcctggttgtatgctctcatgttcgggggtgtgtgtgtgtgtgtgttttgtgtctgactctgcaaccccatggactgcagcccaccaggctcctttgtccatggagttttccaggcaagaatactggagcagattgccatttccacatccagagaatcttcccagtccagggatcgagcccccatctctcgtggaatagtagtcctaatgtcttatatttgatccatgtaagaactctctacaataaaaaggagagatactggtatctcccttttctaaatgaggaaacatattcagagaggttggtttgtcccagaattgacttgctctggatcttaggctataaatgctacactgtttgtgtgtgttcacccacttgagttcattgttatggaaaaggaaataattatgggaaaaaaagttttcatatggtaatcttttgttgttaaggagttattctaatcaaagtaaccaaaggtttgtttttatatgctgtcttctaaaatgtaaaaatatcttcttaaaaaaaatgtatatctcttatctttgaattgttgtgctcttcatttttttttctaggtttacagcattcttcgtcatgttgctgaggtcttagaatataccaaggatgagcagctggaaagcctattccagaggactgcctgggtcttcgatgacaagtacaagagacccggatatggtgcctatgatgcatttaagcacgcagtctcgtaagaactcctccttagctctgcttttcccttggtattacagctgctaggcctagcacacaggttgagagcctaacatttagtaacacaacatccatgtagtaagtcctgtcaaatttagattaaa

SEQ ID NO: 26681 - DNA, 3377 bp, Bovine  19866880945148
actccatgtgtcaggaattttccaatcactagaccagtaataactgcttcaacagccagggagtgaatcctcctggaaagggcagagggtaaattgggcaagtaataagtttttagggactctgtttcttcttctgtgatatgggaagctgtctatggggtcacacagagtcggacacgactgaagcgacttagcagcagcagcagcagcagcagcagtaatagttcagagttattatgaatattgcattatctgatctatataatgtgcctgttatacatgtgttcaacaaattattattataaaactctacctatcatagggaaatgttgtatcatatatgtaaataacaatttattaaaataggtatgttataattagcgagtctgagcatcatttcttcaatattctcctaaatttagcattaaaatatgaatggggtgcattgtctggaaatgaattcctgaaagttatttataccatgacagtgattcatgtatttcccttttctttatggctttcatctgtacttagctgcagtgtatcttgtccagaaatttttgtgcaagttgaacttaacttaggaagacatctggagcatccttgggtttggcccctggttttcatttagataaacactagggtataaatctagaatataagctatatggaatgttatattcatatttctgagaaacttgaaatatttactgttatcctgaaactcagagaactgtgtgatgaacagctttgatgtgaaattatacgtacctgtttggagaataggctgaagttatgttcaacataaaggggtccaagatcattatgttaaaaggaagtaaatctatgtttttattgttgttcttgttgaaccctatggcatggagaggaggaatgagttaggaaacaaaagctaagactgaattagcaaaggccagaagcaacaaaagaaggtttggaagcttcagaaggagtgattcaggggaatttcagttgagggcctcttgggttgcattgatgtcgttggctgactggaatgcacttaagtttgaagtggatggaaggacccttgagaaactagacagaaagaattttgcttctttaataaagagagggcttgggataaggagctttggcttagattttagagaaattaagtgcaactagaaagaaacactatttactttcctccatatggaacccttcattgcttaggtccttacaaatccatgtaatttggtctgtaactatgattagatacatagaagtgtagatggtttttttaaattgctttttcagtaaggagaaagtgaaagtgcaggagtggtagagagcagaatggatattccttgtgcatgttcctgtccagtgtcatatgttaggttaaaagccttagcctggcagtttcttaaaagtagacaagagtttggaggaatattataaccgaatatgagcaggaagtagaaggtgctattttgctctagtttgggttcatccagatgggatcaaaccagaggaatttggcaagcattgggactcaccacttagaaccgcactgaaatagttgtggtagcaaaagaatttctccaggagacttattccacttgaggcataacagccagagattcctgacccttaaggggagcgtgccaaagttgataaattttagtacaatcaactgaagtctataaacgcagaaatagttcaattagatgataccgggcctatattgtttccttgattttcacacaaaggacatatgatgagaaaaatatttctgtaatccactgtttagaattagctcctccctaatattatgtcctttccttgggatttattatattgcaatttaataaatgagacaagtctaaaagaatttaactttaagaatgtgtgtttgacttctgtatttgtgaaattctgacatattaaccttatcgttttttttttttttaagactttctggaagagctctttgtgatctaaaattcaccttcccgtttaattattttctgaggttttttatagtctggcaacatgaactacacttcatcatcattggtgttgcttatcccttgtcacctgacatctatccctgtattgtccaattgtatccccttcaagcgcccggtccactgacttaacatacattaggttttcattaaatatttttttatttagtggtgaatgaggaagtatttctttatatttgaaacaactggctattgtggagaaagcgcaacaggaaggaattactgtgagtaaagagtcaaacgagactaaaaatgcgagtgttaaaaatttttaacagctctattgaatcataatcgacagtaggcagcacatctttaatgcaattcaaaaagatttaacatatgtatacacccatgaagtcatcaccacagtcaggataatgaatgtatccatcatccccaaaagtttctctgtggctgttttaatccatttctctcatccttccccaccttaccctcttcaagcaaaccactcatctgtttttgtcactatagtttgcattttctagagttttatataaacagaatcatttagggtaaactcttttggtctagcttttccactcagcttaattattttgagatttatccatgatgttgcatgtgtcactattttactcattttgagtagtattccattgtattcatataacacaatttacttatccagtcacctagtgatggatgtttggggttcttttccagtttttggatattataattaaagctactatgaacacttggccacaaatcagaggtatgctgttttttgttttgtttttttttcatggataaattcccaggagtataatggttcaatcacaggatgatgtgtgttaagttttataaaaaactgacaaactattccagagtggctatatatacctttttgcatttctaccagcaatgaaatagagttcctgttgcttcacatgcttgccagcatttgataatgtcagagctttgcatcttatccattctaatagatgtaccgtgatatctcattattgtttgaattttcaattccctaatgacatatgaggttgagcatctgctaaataaatacttatttgtcacttgtgtgtcttatttggtaagaggtctagtcaaatcttttacccgtttttaaatcagattgtttaaaggttgtttgagtcccttgtgtgttttggatatgaatcctttatcactaagcattttgtaaggtttttgtctcagtcagacaagccatttcattctcttaacagtgtcttttgctaagcagaaattttcaattttagtgaagtccagcttgacaattttttctttcatggagagcacttttgctgttatatccagaaaact

SEQ ID NO: 26682 - DNA, 676 bp, Bovine  19866880968922
tgtttatttgttttacctattggatttctgattagggtctgatatagttttagatgctatatactatatacaccttgagaatatggataaatagattagtgacctgtctatggaaattttggcagccatgaaaattccagtatacatatattgaataaatactatattgtccctattggggataattagaagaaaagatggagctggaggttaataataaaaaaggaaggtaatatgaatggtaagtagtaatagtgatttttgaaataaaactttgtgagaaataaagtggataaaggagaataaacccaggtcttaggactgcaagtggatctgtgtgtgagaaaggctgaaggatctggggaagccggagatctggggaagctgaattcagggccctggaaggtggcgacttggggaggagggatatagaactggaactgtaagaggcagaagtggacattcctgagttgtcatgaaatcagaagagcttgaaaaccaagaagaaagatgtagtgcaataggggacgaagacaatcaactaatcacaaaaatgtaaaattataactattataactaagtatgcaaaggagaggtatatgttgtgttggtaccatgtggaagcaatggccaagcttagatctgaaaggaagttttctacttagggtgcaagtca

SEQ ID NO: 26683 - DNA, 1207 bp, Bovine  19866880978265
agactacaaattaactttccatgccgattacagaagttgacttttaaagcttcaagctatagagacagtatgaaaatcccattagcttaaatgttttatgatttagcttgttgcattctggtcataagaggcagacttttttttaacgataaaaacctatttctatatgcttaacttttcccctgcagtgttcttttcctaaaatgttcaaatgactttcaggtcatcttttccttctgatctcaaagtcaattgtcatgtcatttctctcatataatcttattccaatgttgaacaagtataattaatgaccatttgtcaatctattaaatattttattccaatgttgaacaagtgtaattaatgaccatttgtcaatctattaaatattagtatacagtacagcagctatattgatcacagaattccagtttattacctacatatataagtcatcaaattatactgtgttcatatataaaatgcaaaaaccgtcaaatgtgctgtgtcctctcatgtatgtaaaaacctgcatcttgaagaaacttttaatgatcaacagtttatatatgaatatctgccattcataaaaatataacttatacattctattgtactatgcagatcaggaaaaggaagttaccaaatcagttgtgacaatttaagataaaaattcaaaaactcattatacttttaaaaagatcagcatatgttgtctatgttttagatcagagtctgcaatgaagcctgatccacaaagtttgagctaaaaaattggtgcttctaatggaatgtttttaagaattaaaagacatataaatgaattcaaggctaacagagtagctccagaccaaagtggctccattttttaagaaagtaaagtcattctgatgactaagccagtcttctaaccaaatcctgtcgtcttgcccagtgcacagcacagttccccctcactcccaaattctcatgaaatcatttaaattaactgttaaataacatcaatatttactgcagtgttaaacacggaccattgtgtatatatacacgtttttgtggaaatatgactaggcagaaaagatttggttagatgaaaacagaattaaaaggcttttaccatggataaactagaatgggctctgttgaaaacttccatttaaaatccccatctgaggcaagaacctctaagccaggtacagagagagaa

SEQ ID NO: 26684 - DNA, 1675 bp, Bovine  19866881032376
tctctctcttttttttttttttggccgtgctgcactgcatgcagggtcctagtgccccaaccaaagatggaacccacaccccatgcattagaagtgggagtcccgaccactggaccacctgggtagtcccaatatgtattcatttttatgtgtgtagttctgtgcatctttatccattcttagattcatgtaactaccactataatcaggcatcaccgcaaaagaattcccccccgtccctgggactacctgtttgtgcattgattccttccttgtcccctggcaaccaatgttctctgtgtgaatgttgaagtccttcttagcagtgctattaacagttagtggtagaggagttaaacttcagtcttttccctcatttttccttactctggcaattatttataagaaagtattgtattacatatagaatggagatttacatgattcttttcttcctttttttttttcctttaaatttggattctagtcaattactgtctaaactactaacttcaaagaaaggcttatgaattcctgtaattctgttttttatgctaagtcgcttcagtcacgtccaactctttgcgaccctatggactgtagcctgccaggttcctctgtccatggaattctccaggcaagaatactggaatgggttgccatttcctactccagggaatcttccaatgcagggactgaacccacctctctaatatatcctgcattagcagacaggttctttaccactagggcaacctgggaagccccaatcctatttttagcatagagttaaatttttatgaactttctggtttctttgattacttgatatcagtttctatttcaagatttcaagttttctgtttcagatagctttgcttttatggcttttgatggaatattattttgttaaaaataagaaagactagataaggagatagagagagaattgagaccttttccctttttttttttaagtgaatgctgctagttctgttctgattctccctttactgatctgtcacatacattcaaaaatttctcattagggcgatgtcttatctgttcaggtgtaaaacagactgagcagtgaaatctaaattttggatcacaaagaagaaaaaataagtagaaactctttgtttagattttttttcttctttttacatttttcagatgtggacaggatatcagtcctcaaagattagcctgggtctggcttcttgtactggaaaaatggttggccctggaaaaggtaaataggtttacatttcaaattttctcctgaggccaggattgaaaagaacttggaaggagttgtgaaatttcccttctgtctgctgcttcctttattttgaggtttgttgtattcctttttcagtattggcagtgaggttggcttgaatatttattgatgtctccttacctaaattcatttattaatttactaacttgcattggcattgagtcaccaacctaccatttgaggtggtaccattgtgttaaaaaccactgtgactcttgtgctggaagagaactttggagaactcggtgaaagtgacaagactgtgaataaagtctaatcctcgtaatactcaaataatggagaatggctgaatcaaaacttggttgttgatacaaaaattgtattttaactagtccagtacagtgaaat

SEQ ID NO: 26685 - DNA, 760 bp, Bovine  19866881103858
ctagtcttgacacagcccaaggtggtgtcagatcaacctttagctctaaactacatggaatgaggcaagatcaagggaatgactagaaagatgctcacaggtcatcatcattttaagatgcccatggagtaagagaatggcagagacactgcagcagtaagcagaatttacttcatctgtcttaccccatgcaccatcaaggcagaatcttcccctcccaaaaggctgactgtgcagtagactttcagaaagcctggcagtgcattagcctccatgcaaaggtgtcaggtaaacataaccccagcaatctactcaggccaacagtgaagtgcacaattgaaaaagttcattctcaaaatcaagggcttcccaggtggctcaaacagtaaagaatctgcctgcaatgcaaatgacctgggttcaatccttgggtcgggaagatcccctggtgaagggaatggcaaaccacttcagtattcttgcctgggaaagcccatggacagaggagcctgaagggctacagttcatggggttgcaaagggtccgacacgactgagtgactaacacacacatgcactgtcaagatcaaactctgctgggattagaagggcattctcaaggatttttactcagatgtcataatagctccgtgttatttttaatgctgttctttggattttgccccacacagaattcccaagtcacaagaggatcatgaacaatgtccagatgtataaaatgcaaaaatacctccctccta

SEQ ID NO: 26686 - DNA, 766 bp, Bovine  19866881113733
aactccaaagggctgttcccgagcattactgggtgaggagacaactctgctcaccttgttgtcgtcactgtgtatcgcctggatcaggccctccagctcctgtgcgggacagagacacagcagttgtgagatggagcatgggagccggggctcaactccgtctcagcccagcccttctgactctggttggggatgcccgcctgacccttccttataaactcaactcctgggaaatcctggtggtccagtggttaggactcggtgctttcactgccgagagcccacgttcagtccctggttggggaaatgagatcctgatagccttgtggtgtggccaaaataaaaaaaaaaaacacctcaactcctgctatcagagcaatagaggaaatctaatgataacactaagcttgggaatctgagaatcaacaccagatcaaaagcttttccttggctttcatgaatgatgtgtctgttcatcccacaaagccatcaggggacagttttgcaggtgacatgccacctgcaggcccacactgacctcgtctacaatccctgggagaaactcaactccgtctgtccgcagacacttccaggtgtcaataacatcagacaacgggatgcttagggggcggcttctggatacgtaccatgaattttctttccagggaagggttgattagcgtaaggccattattatagaggggtcagaaagacagagggatcttgtagagttttgggtacatgatggggaagagaaaaataaaga

SEQ ID NO: 26687 - DNA, 819 bp, Bovine  19866881272578
cagttccccgtaagtttggatgtgttcctgtgttcctgtgcatttccgcgtacctctgcagaacctaactgtgtagggagttttcacccatttcctccaacagtgatgtccaagaaataggaactttgtttttaccatatcttttgagaattttctactaaagatagtcattcttgagtaccatttttctgagagtatggtactaattactttctataaatgaatttcaattttggcttcttatagtccactgttcagtatggaatcagctcctggtttttttaactgatgcagaagacagagctttagacctaatctctgagcatagactttctgtttaaacattgtatagtacctgatcttgtggaaaaattgagtgataatgttttaaatgaaatgcaaaatgaagtaatttaaagtgtataaaacatactaaatgtaactgttactaagatactaacaccacagttttgtttatttctcaatctagaaataaaaccagtcaatgttaaaacacacgggggtctaacatttccttaattcattattttttaatttgtattacaaaataaaaaaaatttttttgactagcagaattattcctcacccttgctctgatctgtgcttactaattttgcctgattttgtttgcctagatacaactcggaatcggcgagaccatgaagtagctggtagagattaccactttgtttcacggcaggcgtttgaggcagacatagcagccggaaagttcattgagcatgggaattgagaaaaatttgtaggaaccagtatagattctgtacgccaaggtatcaa

SEQ ID NO: 26688 - DNA, 1244 bp, Bovine  19866881274564
ctgatggtgtctctgcccttgatttagttctttatgcttaaagtttttcttgaaggaacttggtaaaataaaacattgattttctctctaaatatataaagacagcaactggatttccagaagctatgataggataaaaattttactccaaagtagttttgactgctttgcttaaatattggatcttcactgctattctatttactcatgaatctgtttttaaaatgcaatcatattaggaagtttcatagtggaataatttaaaagaaaaatctttctcaagtactttcatacccttcagaagttcctgttaatacataatgtatcaatcttttaagtatgaatctttgtatctacttattaaagcagattctataaagccctcctttcagaccttttagtgcagttctagtaaaatagatctacccgaaagcaatgaaaaggaaaatgcttgaatcttagtgatagttttgcaaagagaattcattaacctgaagtactcatgcatgtcatttatttaaaagccatttggttttaactttaagctcacccagtcagcacgtgctttcgtcagacatttagggcctaacagggatggatttatttagtatcacagaaaatttcccagggaacactcttctcatcttagggcacaaagtcagactccgagactcagaaccagaccgttggcaagtaaattacttttcatgtcatgttcctcttacctgcccagtggagatgcacaaactcattatctgcttgtcaatgagagaaaaatatatcctgtcttttttgtgtcagtggttatcaggaagcagtgataactgtggcctgcagtttttatagggaaggccctgtggaagatgggagacatgagcgaggcctgggagagtacataggatgttagtcattctgagaccattttttgaggacttctgatacagggacatttaagatatgttgcctgcttctgttttagattggcacagagaagtcacgaaggcaacaagagaaagggagtaaaagcatagcagccaaaaatctcatagtgtgttttgtattcatgaagcagtggaagatgtgattcaatttaagtttaaaaaaacagccattcatcctaaggagatcattaagaaaggagtataaagtatgtttttatgaatatttttatttgtgctatttataaaaatgaaaagttgaggggaaaagtctcagaaaactattaaataagactataagtagag

SEQ ID NO: 26689 - DNA, 1148 bp, Bovine  19866881317780
catcacgaatgttatcaaactatataacaggtgctgcttaaatgtttgttgtaagcagaggaattgaattttcactttgttcactggattttttaatacttcaaaagccataactgttgagaaatacttgtgatatccgtggtgagcggtttatatcctatgcaggccttttgttcagttccacaacaattctgcaaatttatgacccttgccagagaaaaagatcaatacctcagtgatgatggagagaactaagtaaactccctgctgacctaaaagtatcacttgcaaatatgagaacaagatcacacccagttctaaaaacttgaaaggatagacaaaagatcagtgaacagtttacccaaattttgaatctctccgcataaagactcactagaaattgacagtttcatctactcccagttctgtctttgaggtcaaatggttatcaactcataactgaaaattaacaatagtttgagtctcatttaggtattagttgaaaattttaaatggccggaaaaatacaaatatccaaatgatctttcatgttttctagtaaaacaagacaagccagtacttgaggataatgctcaaaaacttagtggaaacccccagacggccttgcctgacctagttaacttccacagtaaaagcactttaaatggttaggaattttaaaaattcaagtgctagtacccttggcaagaactgtcccatgatttgcctcaaagtaatagtcagctacttttcaactcatgatactgatacctaccgtacagagtggggtgtaattgtgccaatttacaatcaagaagccatcaaaccaaatgcagcttaattcagataaaaacctatattgatagcaaaaagcaataaaaaaaaactgaggacacagaccttggtgagatgccaaatggaaaatggtgctttaaaaggcagtctcttacaatgtaaggaatgaagtaaaacctcattagcttggaattcctgatctgaatgatcaggtattctagacaagatcaagaaaagatagttcaaactattgaatgaacttttacttaagcactttggaggtgttcacgccccttaaatgtaagttacatatctattcatgaaggaagtctaagcagttgtacggcagatta

SEQ ID NO: 26690 - DNA, 1261 bp, Bovine  19866881364645
cagggtggttgtagtcattacataccgaggaggagctattagattaatctaaggaagacaaaaattcaattatgaatgtacctacagaccacataacaattaggatgtttgagaatcgttttgctaatctgctgctttaaaaacaaatcatcccaaaatttactcccaattctgcagcacagcaatttgaggtagtttgttaatgtagcagaagctaattgaggctaactgatactatgatgtaacccagtagtagaagcagtctgctgctgctgctgctgctaagtcgcttcagtcgtgtccgactctgtgcgaccccatagatggcagcccaccaggctcccccatctctgggcttggataatctgtctctaaaataaacaaaaaagattcctatttggttctaaactaaaccgatggaagaaattcttctaagtgattctgattaacagccatccagttaattttattgctaatcaaagagtcaggccaaacctccttaaaactgtgtgtgaatataagagaatatattgtccttttcaagattctatgagcataatgggcactgtggctacttactgtaaaggaggtttagcatagctggttctttggcactaaataccaataggaatctctatccatagtgacagtagcagtagctacaacaaaagcctacacataattttaaacattccctagaagtatcaagaaccacttttagtaacacttgatatgaaatatgaccattaaaaaatctggatttaatttggattaagtggatatttcagtagggagggagaaaacaggctactcactttgatgggcatggtttctgtagaacaattcaaacccgctctcagagcttcttttacggcatcgatgccttcataaccataacaagccacttcaatatctaaaattataaaaattcaaaagcttacttcaaaatatgcaaattttttttaagtttaaaaagaaatcagagatatgacaaatacattagtactcaaatacttatgaaagctttcattaccctttcaactagaaatcaaccccagctattaactttcatatttaaaaatatctgaacatgcagtgatatcatatcttctcaccaacatcaagcccctgaatgatgaaaccataaaaaagagaaatttaacaaacatcttgaatttgggctattttgggttgaaatcataattccaacccctctgggcttcagttccttatttgtgaaatggttaggagtgtgatgaaa

SEQ ID NO: 26691 - DNA, 1190 bp, Bovine  19866881365787
caggctcctcccatccatgggattttccaggcaagagtactggagtggggtgccattgccttctcccacctcaccagctggtgaccttcaataagttacttaagtcttccacgaaaaggaggtaatcctgatgcctctatctcagaggggtgttgtaaggattaaatgaaaccatgcctgtgaagctatgattattactgaggaagcaattaagtgttagcagtcagtacattttagccattttgatttccgaggcagcaatactaccctcatcttcacagccatggtcccttcaacatagttccaaggagaccaacccccctcccagatcttttcagtgaaatggtgctttcttctcatggattagtctagagagtgtatttctgtttggagacagtgtacagagtagtcatgtgttcaggttcccttttttccatcctaggcaagaatgaaggcctcacttctggaccagaagcagacgtcataatggtttctagggcttacttgttagctgactgaaaatagcccctattgctggcaaaacaattcacatactgttgagtcattattgttgatatgattgtacacatttatttatcttttgcctcaattctcttgcctttaccacagtgtgaaaatgtattaatgctaaaacatcaagaggcacttttagaaagcaacttttttccctttttttttgaaggaacttaattatatttgtatttatcattttatgcctacatagaccagctcctggcatatcagatgtgttttataaatgcatgttgaatgggatgaatgagaatttagtagctttgtttttaaagcacttggtgtagtgaaacaagcactggacttaagtcagataatctgtgctctcagtttagccaggccaccgatcagctatgtgacttatatcaggtaactacttcctaactggcccgcacatgcagtttgacctttgtaaaatggtgaaatgtaatctaaatgattgctaaggtcccatctgagtctcagcttttgtagctttctgtagactgtggaaataaagtattcctttttttttcttttcagggattcatctggaatcccagaacctagccaatttggaaagaaaaccttgtgttctccaaaaatactacagaaattcttaagttaccaacagaataagttccaaaagtctacttgtt

SEQ ID NO: 26692 - DNA, 1692 bp, Bovine  19866881451933
cagatggtgagggacagggaagcctggcatgcagcaggtccatgggtcatgaagtgtaggacatgactaggcgactttcttggaaaaggaaccacatacactggaaagaaggaaatccaaactggacagctctgggccagggctgcactgtcattgggacggaagctgatcttcttcccaggccgttactgctctggggcctcgctgttcccctgagcccagcctgtgcctgctgcgctcttaccacagataggagtggcctcgctgtggactccaggtactcaaccacctcctgtaccagtcttgagccatgactcagctgattgaggtcgaaagggggcttcaggcagcggctgaacttctcccgtgcagcagtgaggttcccagctttgaggcaggccatgccccaagcatgccatgccccggtgggatcaaggccagtctttgtggagacctggaggaaaaaccgctccttttagggaagaggacttgcagccaggcctgagggtcccaaagactgacactatcccctggttgtcaatcatctccccctaccccaccccaccccacctgccatgactcccacactggcaaactgtcatgccctagacactctccatggccaaggaaaagaggaggaagtaactcactggggcagacatcagctctgtgcctcacctcaacacccagttggtagtactcagcttccaagagctggttcctgagcctggttaccgcagctggttgcaagatctgatccagagatggcacgtggcgataggcagcagcaactaaaatattcagcacatcgaccttgctgatgtagctaccaggaggaaaagggcatggcagtgaggctccccagggtcctcccagcaacagtgctgcttcaaggttccctatttcatttttaatgtgaactgggatcatgagaattgggaggtacatgggcgaataggtgctggagtcagacgttctgattctcaactttatctcttggtggctctatgatcttaggcaagttagctaacctttctctgcctcaatctactcatctgtgaaatggatataacagggggttttaaggataaaatgaaataactgaaggaaaagacttaggatggtatctggagctttgcagtagattgcagtagttgtagtgttagtcgatcagtggtgtccaactctttgtgaccctatggactgtagcctgccaggtttctgtccatggaattctccaggcaagaatactggagtgggttgctatttccttctccaagggatcttcccaacccagggatcgaacccaggtctcctgcactgcaggcagattctttaccatctgtgccaccagggaagcccccccaaggaagctttcaggaactcattaaatgttagctatcaatacgtggagtagggacgttctggaacactcaggtctatttgaggcaaggcctttacattgaatgttaggagctcacaggctacccattgctttttggttctctggaagcctatttgggagagcgcatacagactgtatcaggggtctgcacctccagtcagtatggaggtcacagcactaccatcctctggagtgctgctgggcaggggcctcctggccttttggattctcgtgccctggacttgacatcctctatcgggtcaaggaggatactgttactaggactg

SEQ ID NO: 26693 - DNA, 838 bp, Bovine  19866881820487
ctctgtccttctcgataagcaacaggaagggatatatggggtaacttctgttgtacaatttgaatcaactatttgaggcacatcccctctgtgcttgggcacccttgtcagaaagctgacttgggagaaggatgtaggaagcaacacatgctacagaattacacggatgctataaaatctgaacacagacttcaagtaggaacctaggcccccgtgtgaggtactctgccatgtattattaatacctcaggtatctgatcaacgacaactagacgtcaccttgactctgaatgcagcagcagctccagttccccaaatgggcaagctgagataggcaaccagtttataaagtcttctagtaagaaccattttcctagaagcattaaattgataaccaccccagtttgctggaccctaccccggctggggctcttctagatcacaattcaagtgagatcaagaccatgatgatcaggacagggcctgattatcctagagaggatggaggagaaagtgaggacacaggccaaggttctgcataggtgtgttcaccttggtgtcaatcgacacatcttagctcttttgtgttaggacattcatctacccaaatgtcagaagattattttctttatgaagtatgccgattagttgccaaggcaacacctgtgcatccactttttcgctatgggaagcattctaggaaatccatgtatgagatccgcctagagatcacccacccagtggcttggaatgcagtgtgaccaaaggcatttccagagagctcacaaagcacaatggccacgcatgggggatttgcggaggattagacaaaccaacg

SEQ ID NO: 26694 - DNA, 1465 bp, Bovine  19866880356757
cagtgttcacattaaactaatagactttgttatcaggctccaaactgttcctaattctcagtgacttcatagctaccatggaggcagcccaaaggagcttaagtaaacactttaaaattacgtaatgcagttccgaaggaggaacaacccccagccaaactgtgccatatagttttacagatgcaattttgctgtttgccagaatgcttattaacctatctacagaatgacttcatagcaaagataacaagtaaggaagctggaagtgagccagtctgtttctaggcctcttgaatgaaggcagggttgtggaaattatttcaaagtagttatccagagaatgtttttcttaaccgtatagactaagtatttcgaagcattctgaaaagttctatagtaaaaatggcaccttaagcaataaattcaatatgatttccataaataaaatacaagtttttattttacaacataatacaagatgttgctggttgatagtaatattgctctactactacattaagaattgaagactacatgtgtctcttccctcttggacctccctccactctacccctacctccaatcccagccatctaggtcatcacagagcattgttttgtggtcagaatatggcctgtacaatttctcctttcttgtactgtgttgaacttcctttatgcccaagaaataattaattgcatatatatttaatggaaatgtaaaaagaagcagtattctccatttctataatggaaaatcaatttatatacctattaagcttcttaaatgatcataataaaactttcctgtttctaaaaaaaaaaaaatacaatctttttattaagtaaaataatttggatccttttttatgttcttttttcctcacctttctgtgtgttcaaaatataatttatcttaaatgctgccaaagccaataacaaaatatattttcttcaatatcttggcaaggctctataaagaactgtaagtccctaaaatggtaaagttattaatatgagtgtatgagcaaaatgcaactttatctaaattacagaaagagtctttccatcagattggcagagactgaaaataagtgctaataactgttactaagaatgtaatttacacacccatctattactatattacctttctggagtcaaaaatgtctaaatctttgatacagtagtttcacttacaggaaccaatcctgaaaaaacaaaaaatcatatgaaatcgaagatttatatatgcttatgacagtatctctagatgggagaccatctgaatattcaatagtaaaggagtgataaaccaaggtacatcaatctaatggcatttttgtaaccactaaaatactgaataccacagaaaaatgctaatgtttaatttaatgtacagataaatcttttaggttataaaactatttctcctcaagggttgggggaaaatataccaaagtata

SEQ ID NO: 26695 - DNA, 3132 bp, Bovine  19866880366357
tctttcttctatctgtatgctttagaatattttctatgcccaggtttatttctctttacttatactatgaaggaccaatgttcaagacatggaagctacccagtagtgcatagcctcacttaagtaagatacaaaagatcctttttgagattagataaaaagactaaaggtactgaattgacaaccaaatgttggtgttgctggaaaaagtggctcccactctgagatttcatttcatggaaaactgagtccccctgacacaaagtgcagtggctcctagaagaaaagactcactggtttgcccctagtcaacaaatgaccgcttcctggacccacaaacaaactggatcagccgggagcaggcagaggcaaacacataggtagaaggaagtcagtacaaatgttttccgtggcaatgtggaagcaaagtggtctcaggtagcacgggacctaagacccgctccagagcctgaagcactgaagtgaaataaacacagatgctggtcgcctgctgtgtattaaggaggattgtttaattttgcattggaatccagagtgctgtaatttctaaggttccacattactgcatggacagtttttcttatttcatattttctttgttcacgtaagcgattttggtggaaggttttttgaatggtctctagtttctaagccagaagcccaagggcatttctttgtcccagagaacagagctccaactcaaagaatttgtacttaggattttcaggcactagttggcagacaggggcttgtgtcaactctccagtctgaattctggatggatctaaggaatcatttaaggtacaaacttaggtgacacctctgggtgagtttctgagaaagtattggggcagaccaacttaatccttggagccatgcaaaacatttgcaaaattcaagcacttttgtgaaacacaaatacgcattatgtagcaaacagaattgggatgggtcttgtggagctaaagacattaccaaaaaaaaaaaaaaaaatccaggattctaatagctagaaacagcttcaggatcggtgagcagcagctgcagtgtttaaacaaacacccagcctctgcacatgcatgcacggcaaggcctgtcagtatcgcttttcaaccacacctgtgctcctaggtggcgaccactgccagcaggctcagctctttaaggaaggacagtcccggattgtttcacagaggtttacagatgggaaaataactacccctcacctcaggccaacactgggaacattctcttgcatttcctttatcatgcattagaagaggcctcacttccccaccctttcccccccgaagacaccagttctgagaacttcaagtcttttgcgataagtctggaacacaaggccattcattggtgttaaagtggatttgctcagtctccatgaaaactgtcaggggcgaggtgggaccctgatggcctggaaccactgaagcagagctgcttctgggatttgaagtaagagccacttgctgaagtgcttgggctaaatctgaaaccacagttcagctgcccatgttctttgacttctggaaactctcttccctcatggctttgccagtaagcccatctattttaccttctctctctgtatgtgctttcttattcccttaatgctgactttccccagttcctaaaatgtagctgtcttcagagccatctccttggctcttatcctttcttcctccacatgttgtctgtgggttatccacattcctgccttcagtcccacacccacacagccagccccctttgggatatcttctcctgggtgtccaggagctcctcaaacttcccttgtcctaactgtgttctctgtcttggttaccaactggcccctgaccctcctgagaagacctatctttcttcacactagccttatcctctctctcttttaatttttctctgttttcagcaccagtgtgcctgctttctcatttggaaaaatctttattaaaaaaaaaaaagatcctgttcatagactaaaagctctgtggaactttacccagtcctcctccctctctgctggaattaattgctgccttcattggtaaaataaacattactgaggacctgctgggcttgaggcacagggcaggcactggggaccctcaggaggctggtgcaggaggcagactgtggtcagctagcatttgaagtggtgcagtaaaggtatgtgctaagtgctgtgggagcacaagggggggcgtcactcgcgctccattttcggaactgcccatggctgggagctgggagcagagtgcagtgaggatagagcattcccaagtgaacagctcggctcgctgggcacttccttcttgactgtctctcctaggctctgacctgtctctctccccccaaactcatccatccgttgtctattactgccactgggaagctctgcagagtgaagacagtttcatctctcccttttcttctttccagatctcagagtcaacttgtgactttaatagttgtaactccttcagtatgacatggtgatgttggcaaaaatagaacctgcaaactaaagcaaatcttaaatggtgcaaactcatggtgaacctccagggtctgccccctttgaaagcttctcattggagatcatcccctgccccgttgcctgtcgtctctttcctgggggctttattgtttgactcacgccattctgattgtgctgtcctgctttttctggtgaaaatgatcatgggggtgctgtctaggtagcatccctacttcatgcttcactgcttaacatatcctatcaaattgttattctgatgagcagagagactaggccccatttgagaactgagacagcaagggaaattaggcatcttggtaactgtcccatcgcatggaatctggcatggagttgatatataggatgaactcaggaatgatgaatttctgagacagaagattgtttagcaatcatctagttcaaaatgggaattaaaatatcagtctctggaatgataagaaattggggaggtgaaatttgtgagatagtgtatcgtgagatgggcttccctggttgctcagtagtaaagaacctgcctgccaatgcagaagatgtgggttggatctctg

SEQ ID NO: 26696 - DNA, 2769 bp, Bovine  19866880462756
taaaaacaactcttctatactacttgaaattacagtcttatttccgaaagattgagaattatcttaacttcccaaatactaatttcagatataagacattattttactaatacaaaaaagtaaagatttatgggcttccacctgtagcccaccttgtctgtatacacaatgcccaagcagtacagtttgttgttctttttagttacagtgaaataaaaaaaaaaattggccttgtttagactgggctataaaatataggcattatgggcttagaatatggtcccaaagtgaaataaacactcctatgacaccacagtcaacttttctttcctcagtgtattacctaacttgggttatcaacaaccattaataatttattctagcttaccagcttaaaagtgaaaagcatgaaacataccataaatactttcagaatcaagacagttttccattcagaacacatgtaaataactgaataaaataaaataaaataaaaccagagtaaatagtaaaatacaatgtcttgagaactataagcctctaactgttctatttaagttgttttgggaagaaaatacctttttgtcaaagaatgtattcattttactatatatgggtttcactgatagttgggcccttcccacatcgtctgtaaaagctgggtgggtgcaggctccattggccaccattattacatattgatgctattctgtacaacagctgacaagcagcagcaatctcccagtccctgctccaaactgtgaagagcaagaacaagggctgttggtgatacttattcactgttgctgctactgaagcagcaagctgagaaaagcacatgcaacttagcacacagaaggaaaaactggttcagctcaacctatctagcaggtctgcctgtatcactacatgataatattagtaagaagcaattttttctttaaaaagtgggatggagagagaattaaagacaaaatcggtgttttgattagaaagggaacctgtaatgtatctacatacatcattaatttttttccttaatgacacttcagttcctagtttagatttaactgcttaattatcaaaattctcagaagagtgtgaacaagcttcagggtgaattcataaagaatatctcccctacccgttattctagaatataagaaagtatctaaactttaatcaagagatgaaattatattatgcctataaagagctccagtctcccaggttccacatatctaatcagcatcatatgtttgacatcagatactattagcaagtaagattttaccccagaagcttttacaaaaactccaattattaaaaaaactttccacatgtaattaacctttgaatgtgtaatacaaagctaaaaacttagtaagtacataatatcaattgatgactaacagaaatatttgttctgtcaaattatctttaaacttaaatgtgattctatttacggactcataattttaaatttaaaaaaaaattttattctttaacatcttaagtatttctgattctgaaaaatacttaagtcagaaaaattaggacatttgtaaattttttagatgcaagaatgggctggtaagtttaaatagctagtcaagaaggctaggtgtgagattaaaataaaagtataagataaagtaatagttacaatttggatactttattaaaaacctcaatcttaatttttatcaaaagagaaaaagtaatttttccacttagcagcagctcaatattaataacaaaattaattttaaaaaattctgaggatcacaggataacaaaattattaaatatatttgtttagtatgaaagctttcaataaaaaagaataacagcaatattaacaatttttaaaaattaagacatttagaaacagtaataaattaaaaaaactattacccaatcagtcttagtaactacatttgaatcaggctgcatttttctcttccaagtgactctaaccatgaaaataggaaagtaaaactaagccaaatcacatatgttaatgaaatataaaaagtggtttgtggtgctgagaactgaaattttacttcaaaatgctattaaaaaaaaattaagtccagacattaattaaacagtgctttttgaaaatactcatcagaaaatacaattctgatacattaggtctatatgaagaaaataaacagattaaggatctatttactagtcaaaaaagaaaacatacacacatgtacaaaaactacttcaaataaacattaaaaattttttcattaagaaattctatctactctttaatgaatccttggcaacatggtagacctcaaagaaaatggttacagctgacaaactttttaaaatataagttatccttatataccagcattatacatcagtaacaaataatgaataatttcaagtcccttcatatgtatatacgttaaattgcctctattctagtttatccaaatattcttttcccctaaggataactctttcaataaaactagaacactgacagtataactgtattttatgaaaagctaaggattttccttaaaataaacgttatttaatcctgaaaatgcatttaaccaaaaatataaatatttcacaaataagacaaatcactgaaaaaatataacaggataaatccttttcatcttatcttgttataaagaactacatgttaaggtttagatagataaccaggtttgtaaatttaaaacagccaaaattcttacaaaatgtcctttcaggggtagttaaggg

SEQ ID NO: 26697 - DNA, 1366 bp, Bovine  19866880577304
agattttatttgtgtttctccctcccagctttttattgctaggctgacaccatgctgtgcctgctaagactggagttggggtggggatgtgggttggggcctaagaatgagcactaatgtaaggccaagctcatgcaaatgtttccacttcagagtgagttattttctactgattgctcatatcagttccttaaattgatgccttctagttgagttgttccacttactcttcagacaagacccccaccctgaattctagccatagaaacagcttaggctcaaagtgaaacccctctccctcatcatagccttctctcccactagaggggttaggtattcaaatctgtcatggtattacactgttcactgatgaatagcagtacatttttccttgtgtgagcatgaaaattctagctatggaggcaccgcatgggtattgcatgtgctagccagagatattctgattttctagaatatttatttccaaaggtaccttgtttataacaggggtattacacgaaatactggattatatgctacaactctaaacacagttattttctgaactgtattttcaaagaaacataattgttgacatgaattttatttttttggctttagattgctggtgatataataagaaaacaaataatataaaacccagagaaatctatataaaatgttaagactatcaactagttcttaagcctgcataaatcttggtccttcatatgacattgttaccaaaaagatatccagagatgtttcatcttaatgttttcacatgtacatcaaaagaatatgaatgcttccaagatgttagtctgtttcattgaatttcacagctttgcatcccatgtcaggatgctgtagcagagttgtgctgatacccggcgcagaatgccagcacatgcatatgctgacacagatgctaaatgaagagtcaagactgtagcactcagatgtatcccaccccagacttttctcatctaaatttaaagcctaggtggcccctgcaggctttccctaaacttgccctctggctatgactcgagactaaccatcttaaatctcagatgaatagcactgtccatattgtagaagcgtggcacttgatacatttcccaggcctgaggctgcagtctttattgccagagtagtaaaccatggggtgtagtcactgtggtcagcaagctgtttgtctgcctaatatctctgtggtcaccattccttcatgattcgtgggctttgaggttctgatggggctgactccaacctctggatccagaagtgggcccacgacccaggcctgggccatcaaagaactccattcacctggctgtagtaatggctcagagggactgag

SEQ ID NO: 26698 - DNA, 1946 bp, Bovine  19866880581002
ctctgggggcattgtgactggaacaccggtggccagaattgattcagtaatgaagtgcagtgattatcagcccagtactggagtcattcagaaaagtgtaggtgaagacaacatgacggggaaaggctggagctgagatatcagtcaagggtggattgaacaccattttcaaagaacttcccagaaaacttcctcaatacaggagtcaggtaatgcctgagcattgtcaagaatgagttgtggaaaaccatgatggagaaggctagatcttgtaggaagagaaaattccatatcatgtgtcctaaactttaggaaatcgcctagacttataagagtaggtggacttcagtcggtaaagccctgatgacccagtcagtaaagaatccgcctgcaatgcgggagacctgggttctatccctgggttcagaagatcccctagaggagggcatggcagcccactccagtattcttgcctggagaatccccaaggacacagacgcctggtgggctgcagtccatggagtcacaaagagttggacatgactgagcgactaaacatgtaagagtagataaatgtgtcatttgtttaggaaatgagttagttgcttgaatctcattatctcttatctgagaaggaaatgtaaggggtgttcagaaagataaaggtccacaaacacaaggaatttttccaatttgctagtatcctatttgtggagttaaattttcttttagcttcatgagttaatgccacaggtttcaaaactgtcttctgcactcaaattttgacttttcttcaaaggactaagaagtcactaatgtcctttaaagacagagaaaacacaccaaacttgagaagacaaggaaatgggaattttcacacttattcacacatatatttgagtcattttccaagtgaacaacacattgatcctactttataatttaataggctttttgtgcctcttctcatctgtaaagtaggaaaaacaatagtacctgctcatgggttgtcattaggattaaatgagtcgatgtatataaagtacttggcatagtggccagcataataaatgacaaataaaggtagctattactcatattccaatgagttctttggtttctataaatcataaaaggtgctccttgaacacacacatgcaagaagtttccaggggtttgctaggtctatgaaatttgatcttccttgccttaccttggcaagaatcttaactagctaaagttattgatccaggtagcaagatccacacctctacataactgtttccactcactgcaaatttccagaaagtaatcgtttcaggctgtaagtgtccatgtttggtctcaacccaggagaaactcacttgcactggaagatgggagcagaatccataccctgcttttgagcaactgggttgaggaacaaatagacttttttttttctatcccaaaataaggagtgtttaaaaattaccaaacattataagtttataagcataaagaaagccctgtatatagtaagtgaccacctactctgaagttcctattatttttaagatttttaaacctcctttgagacaaagtagacccaagttaaaatttggggtatcttttttttttttaatgtccaagtttttcagctaaaatactctacattttaatagtttcttctctgattttcctcttttaaatttcataacatatttcacagttctaaggtgctggtaaaatggtattagaaaaggattttagcatagattaaatgccaagagccatctactctacccaccagacatatgcagccacaagtcctttcttcatgatgccaagacactcagatctagtgtttggaaacatcaatttcccagtcaccagactgaacatgcccctgcagttcatgcccacccagctccaaactcagtgcccaccatgacagatggctgatg

SEQ ID NO: 26699 - DNA, 1713 bp, Bovine  19866880584868
attgttccattttactggtcaggaaactgggtcataaagaagaaattaacccaggtccctcagggttcattatgttaattaagtggcagtactgaatttcagatcttggtttattggcctgtgctctttctactatccaatagttctctaacttgacataattttttgtttgtttgttttatcggcctatgctctttctactacccaaaagttctctaatttgacataaattttttttttgagagatttgtttaaaaagcaaattctacccaatccaaggattgggttcagcaattaattaaatccaaggatttaattcatcaagagtggagtagggtcaggaatctgtgtttttaaaaagtgccttcactgattctggtgtgcagcttgtttggaaatactggagggaaaaataagaaagaaaatggggtgcaataaggatagatggtgggttccccactttgatagtctggggcaagcccactcaccctcaggctcacagcctctctagatctgaccagtgttctccaactccaaggacagtggtttcttctttgctagaggaacttgtaccaaggcaaggcttctaagcatggagttcaaagctggcgcagaagttccaggttagaaatgtagttcctattgtcttcttccaaaggaaggaccactcacaattgtactctaagcccagaaatgggatcttcttcatctctgggttcttagggtctggcacaagtgtgtatggtgcacagtgggtgctcagtgtacactgggtcaagaagggtggcaggcatgctgagtgtccagtcctcgtgagtagggctaaggggttacatttttcagtatggcctgtttggaggctacactctgtctgaggggccagccctctggcatgtaactgaggagggcatagtgagagtccagatgagccagatttctaaggtacgcagtgatgagggtgtgatagcttgttttccttcatgatgttttataagctggatctcatttacctgtgggaaagtcctgtggagattagatttctaatctagtcagcctgtaattatttctttcctttggacaattactgatatttcaggtggcttcctcccaattcagagtcagcagtgagtaccattgacttgccttctagcatttctcccagatcattagtatgagatgaacaatcaggagattccaagagcctgaagcttaatcaaagagtcatgtcttctggttccaagatagcatcctccatggctctaatttcccatgcctgccaacctcaagaactcaagtgaaagcctttgatgattttcaataatgtgattccatgttttataggatcctatgcctgcctcctggctccagctgtacactaaatttaaagcaagccactcatgcagagctgacgtgagataactcaccaacttgatattcaaaactttatcatttgtacagactccagacttgcctcctagcccatgttgtccagaaaactgaaaacagtccaggcacaaattactgaaggagttggatgaaaggcaacaggaagttgtagtagctacagtggcctggcagggaccccagaggaggctgtagtaatattttagcaaaataggggctccaaagagactggctgtcttcctccctccctttcttccttcctttctctcacaaaaaattcttaaactgcccccctccatattccagccg

SEQ ID NO: 26700 - DNA, 1168 bp, Bovine  19866880585598
cacacacacacacacacacacacacacacattgtttttaaccccaaagcttttctgaacaaaaacagaagaaaaatgcagaaaatataaagccaagctggagtaggtcctatgcagtgagctctttggggtccctagcagagacatacatcccagtctgttcacagtcatccagagtaagacagctcaacagggacgtgaagacttgagaagatttagtcttctcagcgtcgtcctttcaaagagctatcatcagactccttttgattctaaagagaaaaggataataacactgttcttcttagggagctaattctctctgactgaagtagtcaaaccacatagctctttctgtttatttacagtgttgtaattgtataacaggatagaagtaccaatgcattcaatagatagaatactctttatttaaaatagggaaggatttcctagaggaagcataaaattaagaatgttatgataattttgtaaactatccaggtgtaattaccatccaataaaaataaaatatttcataatactcttagttttcactagatattggtttataagtcatggttctattgtttaccttgtcacaataaagtccttaaaaccaatattctttatttgttgatatgtactaagtggaaatctttataatcctgggattttatgtgcaaaaagctgcccaggtaggccccagctccgggtgtgcagtacgtacaggctgcaggagcatccttgtgatccaggggcctatgttggctggacctttctcaagggacccagaaataacacagctaaaagtggagaaacagaagctaagatctcagctgatatgggccttgcatgaggtcagaggacaagtagtcatcagtaagagaacagtagtgattagaactggaagttgagaaaaagaacaaggctttatgagggctaaatcagctaaaacagttcaaaactaaggctctgaaggacaaagagtgtaagaatattccccatcccctgtttttagtcactggtttaggggatgatttagggggttcccaggtggtgctagtggtgaagaacctgcctgccaatgcaggagacatgagagattcgagttcaattcctgggtcggaaatatccctggagaagggcagggcaacccactccagtattcttgc

SEQ ID NO: 26701 - DNA, 962 bp, Bovine  19866880596090
ttctcctgcaagactatagatggatttcacattatgaaagaagagaggaaagccactccagcacaccgtagaatggccagggcactatttatttattctagaggtggtggcagctggggaggaaggttcaaaagacacaaagttgtgtatgaattatgatgtgatatgttcgcttttagctcaccaccgggcagaccttcaaagtcagtttccagtgggtttttctcaagggcccacaccagcatcttccaaatgtgagtctgaagatgcttcccatcttacatcacttacaaataactgccagagcaacaagaaacaaaaactatacaatttacagtttagcctctttgatgtgatgtgggatggggatcagaaagcaaaggcctctgggttgattgccatagagagcaaactcttatttccttaagagagcaagctgcactagcacattaaaattattagaaagcctttaccagattaaatgaagcttgatttgggtcaaggtgggggaggggaagaggaaagaaactgaacagtgtgcgccaaggatttgctgaacatggtttttttttttttttttttttaatgctgacgggcattaaattaagtaacaaccaaagattacacaagagtaaacactgctgctaacgtttgattaaaagctaactgagggctcgaagtgactccagttaatttatagatcatgccaataacagccccaggggaatggggctgctcagggtagaggagaagttttataggcagaagccacatttttaaatgtcgaaaaggaaaaccaaagctgaaggaatgctttataaacttcagggaaggagagaaagacagagaaagaaagagagaaaagaaaaggggtgtgggagatagaaagggaattgtctctgtgactgctgggcttggggtaataataaaaaaaaagggatgtgtaacatttaaatattctt

SEQ ID NO: 26702 - DNA, 1420 bp, Bovine  19866880648014
tttgcaaaagatttggtagtaattactgtctgcaactgttggaataagaaaccccaaaacctttcaatttccatcaagtttttcccagagaagtaagtggttattctggtctggtggggtcccaggtagagtctgagtgagattcaaagctgggaatccagcatgtctgacagttcttgtggaagagcctcttctctggttaggattgaggagacatttgagagggtgctgatcctgaagggagaaggagccagacaaatgaatttcacccaagaactgaatctaggttatcaaagaagaggaggggtgagtatgatgtcagtcattcatacccctttttgtccagctcccactggatttataaagagttgcctagagagagttgactgtatgttaaaacagaaagggtacttttactcgatattctgccaaaaataaaaatggagccaggggccctccatcagcagctgggagcaggaaccagtgaaatttgagttattactgttaatttgcccctttaagaacaccctggctagtgaggtttgaagaaatcaagttacacgggggccaggttagcctggagccagctgaaactttatggcgcttcgttagtaaaaagagtccttggcacaaaccaattgtccatcagaaactatcctgaggccagaaactcattttaccttgatcccagaatgtccatcagatggtgtggctcttgcctgggactcatatttttctgggctggtactcagagagattgacttgaggtccttacattttgcaacgagtcatacgtagggccaggtttgctgagacttaatgtggcaatttgttgctaacctgaaggcgttgtgcagatataaaatgattaatctgatgcataaaatgaaagacaggtagcggaggtagggcgggggaagctatttccaatgaacatagctctagttcataagatgaaatctatatttcactcagcagaaggtacaaatctgtattgcattaactctgcaattctaaccaaaacaaagacaggatggcaaatatttaaacagtgattaaaacattgcccaggcaataggaaatgtctccttttgccaactgtttgcttggacggaatgaaatgaggggcacacaaaccttgtcttcctggttgctctcagggacccttctctgtcacaaagtcagcaccctcaatcattgagtccaatggatcccacggaaagaccctatttattgagaaagaattctgacatctgttaaaggctgaaagggtcttcaatatatatttgtcttttaacatattttacttataaaaatggcagggtgtaattagagcagatttctctaccagaagtttgaatgcttaattcaaaacaaacccatattgatttggtagtataattctcccccacctccctca

SEQ ID NO: 26703 - DNA, 1950 bp, Bovine  19866880678624
gtagagacagggaagaggcacccacatggcagaggcatcagattataccacagcgaggaaacaagtcactcgttaggagccgagtaccgtgctaaatgagggtcaaagattaccaggttcagatgagaaacttggggttgttcccaaagggatcagacccccggaactgttctcacactgcctggctctcaccaaacaccctctacacatacacacacaagagaacaaacaaaaacatccaaaactatcagccctctcattaaccagataggtttgggcactttcacccggctagtgaaaaccttgctttggttctgtgtatcacaacacaaaatgagtaattctggatctcagtgatgaactactacttttgggacttgttgcaacacatcctcatacttcgagagccttaggcctatctttttctcctagttgggatctgtgcctatattcactgacagtcacagggtacaagagtatgactgtgcattcattcacatcaggcaacatgacatttcagaaaatgggggcctagaagggccctcttcctcagtttctatttcaccagacctagatataaaatggataattccatctgaaccagaaagagacactgagaagaaaacccagataatagagtacaaatacctttccatagtcagtcacagtctcacttcacaatactcctcaatttagtgtaaaggaggaaatggccaaaatattcctttatttatttaagcaaacagatactaaaacaatggggggaaagaaatgacccacaaatcacaattattatttaacttttaaaaaataaactaaccagttcatgtagctagaattttaaaaaatatgtccttcaacctccttttatgagataagggcaaatgaatagtatttcaactggcaacaggatattataataggcaactgccagcttataccaactaaatttgtatgtattaagcccagtccccacatttccatgtctgatgctgcacaatagcaactgttgcttataacccattgaaattcacagtaataactgtgatgtgctaaaatggctactaaataaatcaactagattaaatcctattagtatcatcatgctgcttgagagaacccatattttttctcagattttaattgatcataaactggcaagccacatacgataacaaagtcctattagtttaaaatagccccgtcctgaacatttaaaaccacactgacttaacctactacgaatatgacaagtaaaacagaaaagagaccaaaccacactgacaaaccaggaagctctattcactgcactgtctcatcatctaatattacacgctgaaatatttaagaatgtcccgacttttacatctgtccagatctcatatccgtaaatagacataaactattttccaagtgcagaaatcaagctagtttcctttattctagcttcctgagaattctgaccactactccccacctccctcgactactcatacattttcaccacttgagacattgcagggtgagggaaagagaaagaaagagaagtctcatgacttctgaaattggaaagaggaattaagttctaaaaaggagaaagagagtggcagttttgcttaattcaaggattgagtagaatattgttgtttaattatttttcaaaagatacactccagtgtaacagataactgaaataattacttttttatttcaatgacagtacttttcatttctaagatttataatcaattctattttgtatttacctattttttttcatttttgtctggtgtcgattaataatttgttggtgtttaaaaatggggaaaacaagatacactctttttggccatctctttatttgatttataagaaatgaaactgtaatgtaatgaaacttgaccacacaaaaatcactttgcttcacatacctgacaacatcctaccccc

SEQ ID NO: 26704 - DNA, 1982 bp, Bovine  19866880710237
agaaggaaatggcaacccactccgtgttcttgcctggaagaatcccagggtacggaggagcctggtaggctgccgtgtatggggtcgcacagagtcggacacgactgaagcgactcagcagcagcaacagcaggactttaaattccctaactatctcacaaaaggataagcattgtttttattttaccaatggagaaaattgagattctgagaaaataagtatattttaagtattaatatatacttattagtatacttctttgaacatcaaggacaaagtaaatattccttaaattcacttaactaactggatgttctcatgaaattgtgtggaaagtaaacaactgtatgtgagatcctgatttctataggaagcctaagagatgtcctagttctcaggcagcaaataaatttcaacccatgtgtagtctccagttaattggtagtgactgcctggtacactgagttgcaaaggattctgtgcgtcattatcaatgtctgttctgtctgtgaagggagcagccaaaactctattagtaaaataacataactttgcacacacaagggatttaaaattctgatttactcccagaaaaatctcagagaagattgagaaaaataagtctatggtttgtaaatctttgtgcggacatggatttgaaataacttctttaattcctttataggaatattgccttcaggattccagatgctgagagaagggtttaccattacattattatggtttgaggttgttgtatgaactgctctagagtccatcctttccctatccgtgcatcattaaaatggaacgtaccaagggatcaataaatggaagcctaaatagtgcaggaaaaattgtgtgagcacctttgggaataaagatctttgtacatttttaagctcttttaggaacatttaaattgctaagtgcatctttgtgttccagccaggactaaaaaagcggtgcagaaatcaacaagaaatcagtgtggtctcaataacaaggcagaattcacctccctacactttctctctcaactcatgctccacattcgccacttgctgatttaataaggcatttagaatcatttctttgggaagcttcacatgccctgaagaaagagtctagtgtcaccatgtatctaagcatttggccaaaaaagactaggtgggattgggttacactaatgagcgggaattcccagggacctgatcatatctcagttttgatctttttggagttgtgagatacagtagaaaagaaacaattcccagaaactctaattagagacagggctggtgagacgttttcaggttttcccccaaatgcctctaaatctacctgctttgtacaaaatgtaatttatgtctggttcctagtcagaacaagcacaggaacttcttgaggattgactttttaaaattcccttttaaaacaacctcagaaagtacccaacacccaggtcttggcatctcttctcattccgtctcattctggaatttggctcaaggttctacctctctttgtatgttatttccctccatctccattccatcacttggcgctaaagtcctacctttcatttattcatagagtcacctaatgagtcattcaattctattcactcaacaaagatttgttggaacaagtcaaatatggttccaaaccacactatctgagaatctagaacacattcaaatttacataagacatggtgtaattacagctgtgttctgtatcttacaggagaaaggcaggccactcagcctgagagatcagggaaggcttagtggagacagcaaccttttatcttagccctgaagaatgaagagaattggtctaggtgaagttggaagtgggaggaagcgaggaaaaaagggaagaccattccatgaagaaggcactgcctaggtaagaccacaaggccaggagggacatgatgcagaagaagagcaggccagtgaagccagagtcttat

SEQ ID NO: 26705 - DNA, 1594 bp, Bovine  19866880771801
caagcgtggcactcaatttgagtccaggcctgtctgattccacagcctctctgctacaccatatccagtttgatgtttgtagcctcttgtaacggagaaggcgatggtgccccactccagtactcttgcctggaaaatcccatgggcggaggagtctggtaggctgcagtccatggagtcgctaagagtcggacacgactgagcaacttcactttcacttttcactttcatgcattggagaaggaaatggcaacccactccagtgttcttgtctggagaatcccagggacgggggagccggtgggctgccgtctatgggattgcacagagtcggacacgactgaagcgatttagcagcagcagcagcagcagcctcttgtaaatttacactagcgccataataattgagaaagtatgagttgtttggttctacattttaaatcttaggaaaccaggtctgcatcagtgcatgtttaccaagtgccaagtgactctgtacttagcatcatacacaactctcttgcacgctctaggtttccaagttatttcatgaactattttggtcagatgtattttggaagaggactttaagagtaaaacttatgttaaattcccaattatccaggatatgttgtttgaagatgggaacagctggctattttaattccctaagtgttgaaatattgtggaaaagagaaaccccaaaccagcttgctaacaaatgacttagtgaatgaatcagcaggattgagctctctctggttcttctttggctgttctctgtgtgtccccacaatctgggtgtagtgtgatgagctgttctgctgcgaaaccagagttgaaagaataaacagggttgacagaataaacagtaaatcctgattgtcagggaaggtttacaagtcagcttccttctgcagctttaactcgaatgtctggccttcagggaacatgccgaagctttccctttgtgaactggtggaaacgactaagtgcctctgatttgtttggtttcccattgaccagtgcagggtcctaggcaggctccagtggatggaggctgccattggaagagaccagagagctggacatcacacagtgaacaaagcatgcagggatatgctggggaaagagtgggacacagcatagtgcctgcacacacacacacacacacaataacaaaatggaaaacaaatgaatttattgattatagatcattatggctgatacctcaaatgaaatgtcgtatttgtctaaaacgttttccattttatatttgtcacctgctctcctctaaggagctttaaaggcatgcaccgcttcctatgagccgaccacttggcactgttaaatgagcaagttgggtgaggatgggcaggtaagggacattgaagagggagttgaaaagaaaagggaagcacaaacctcaagtgctgacggtggtcactcagcatcaggaataagaatgtgaggagagcaatgagtcgacagtagagctccctttatcaccagggcagcctgggcacctgaggggcctgggcacttcttgctgttctcagctgttatctgggagtgagttcctaaaccttaaagt

SEQ ID NO: 26706 - DNA, 730 bp, Bovine  19866880857717
actttctttaatttttatggtgaattgacatgatgccatggaatgctgattaagatgaaatattaaacccaactgcattttaaaatccacatcctttatggagtcagaggaaaactacgtctgtctccaccaggcagtgtccttcaaggccttacataatgcccacagtcagagtattttaccatctggtcattaatttttcagcattataaaaatgcagaaacttcattcatttgcaaaaacatttaactgagcctaatactgaactctacactaaaaacaaaaactaacaatgtctagaaacacgttctgttccattacatcttccattgttgaaataagcatttccttggaacaaactgctgttgaaattcaaatgctccttagagcaaaagaaatcattctccaacataggagccctctcttggtatgatttatttcacagcaaattaattcagtgacgattttggaggctgtaaactggggtgctccttccaaaacccaaacaaatctcagatacaaaaacactggcaacaggtagagaaaagaggcatgtagctcactaaggttgactgtttgcaggcttttgttttgtttttcatgctttccttattcttttcataaagattggactttgtagcagcaggtataaccaaactcaacccactctaaagttcaagtctttctagttcatactgtctcctttcatagaatgacttcagatggtccg

SEQ ID NO: 26707 - DNA, 1074 bp, Bovine  19866880992011
aatttatatcactcctcttaaatttctgtagaattcaccagtgaaagcatctgggccagtagtttactttctagtttttaaactacaaaattcaacttttgatatagatataggattattcaggttatctttttttttttcccttgagtgaactttactaatttgtatgtttcatggaatttaccctttttaacctatgtttttgaatttgatggcataaaattgcttgtaacatttccttattattatcttaatagctgttaaatttataatgatgtcacttttctcattcctgatattgttaatttgctaaagtatatttcttgtaagtggtatgtagttgagttcttttgtccaatatgacagtctttgctttttaataagggtgtttagctcctttacttttaatatgattattgtggttagaggtatatctgttatattgctgtttgttttctgtttgctccatcttttttgttcctctttcctcattttgatcgttaagatactgccaagctttaaaagtcttgtctaggcaacacgagaatttcaattttatgttgaatctaaagcttctcccctctctctgcacagatctgacccatggttcaagggcccttttatgttctttgttgctcttttacttattttttttttttttcttttacttttcttcccctgctctttctgatccttttgcacttctccatggttgaggtagggtgaagctagattagggtaaaaaagaccatgagtcttttattcaatggtagcaatagccaccaaaatctttgttttatcttatttatggaggtctttggtgtttagtccacagaaagctttagatattgaaaagtatactctggtattagtccatttacaacttttgcaagcctgttggatttaaacacagaagataatggatgttagagattggtatacagttgcttaccttaaacagttattagtaacaattattcattgagtcttatcattcagaactaagataggatgtttattaagacaataggagctactataacaaaaaatcttaaaaatggtttattttatcat

SEQ ID NO: 26708 - DNA, 1779 bp, Bovine  19866881015343
cagaagcattggtgacttgccccatagtcctacagagcgtttgtggcaaggccaaggataggacaggagctttaagattgctggctcagtgctccttcttctaggcactaagtctccgtgctgagttgccttgcaacgttaattaattcaaatatgtctgcttatttcatccaaaacaagacttgaaaaattaccagtggttctcagcttgaacctaattttgaatgaagggaaagaactgttctgcaaactctccattttccttgtaacacatgacaagcactcgggctctttgcagaggtccctcatggtaaaaacaaaacaaaacgtagtgctcattccaataaacttgcagtcaaccctagcccagaagcaaaatcccatgcagagaatataaccccttgttcctcacaaatctaaaagagagagagatttgtgagtagcactttcagctgtgcgaatagaccattgttcgtgaggcttctcgttgaaaattctgctttagaactttttttttcccccactgacaccctaaattttttccttgtgtacctatcaatagcagaaaggagggttcaaaaacagaaaggaaatgcagagaatgagaggcacagagtggcaaagtcagggagagggggagaaagagagaggaaaaatgcaccgtgaagttcaaatgaacctggagctaatgacatctgcactttgccaactccagttcgttcatactctataaaaatgccacatttaggagtgtaatgaaccttgattccttgtcagattagcaaaggtttcgctatctgactctcacgtttctaatgcttacatcttgaaggctcagagttgagcaagacagggatcgtagacgaaaggccccaggacacaaacccttctggattgcttttctggattctaagaccccaggtggaagtgcggctgactgctacctgtgtttccaaatctcttctcccacctttagctgagcacttggctatccaggcaacgacttcattttctatcctttctagcggctacatgaaaccggtgactgggtccgtacaaacaggatccggtctgaactggtgtgcgccatgcttggatcctgctttaagataattaggtgggcacgcccccagatgacttcctcctactcatcctctgcaaaacaatgagaatggagtagtcccttcaaatccagaaacggaagccatgggttaagaatgtcagagtctcctcactggccctgaatcattcttgtctgagcaataaagtgagagagcaataaatttccatcttatttacaccacagtactgcgggtcttctttgctatagcaccttacctcctccctaaggatcccactgtttgagatccaggaccagcctatagatctatctgtgctttctcagggacatagttccacttaggcattgagagtgggcaaagcagaaccgagccagtttcagagaagttaccacatgaagtattcatttttagatatctgcctaaggaaattccaaaatcagaaaaaaatcaacatggcatgtattctttatgaaactaagaattgaacttgatcaccctgaacaacaatagggcggtaatgaattaagatataggccatctacctaacactttatcttattccagaaaggacataaagtataaccagtgaggagggacatgtttctgtagaatgtgcttgtgtatgtatatgtatgtgggggtgggggtggttctgtgtgtaggagtgtgtgtgtgtgtgtgtgtgtagggagagact

SEQ ID NO: 26709 - DNA, 813 bp, Bovine  19866881032128
cttgaagctaacatgtgaacattggtgatgaattcagtctttctccgatagtccacatagagatctaatctacacacatgtggaaactcacaggagatccataaactagcctagaaataatgtcttcgatatagacagtgtcacttgattatgcaaaactgattttttttgactgattgaaacaaggcacttggagattcgagatgattggtgaaataataaagtgccatcatctcttcaaagaagtaataaacaagaggcaaggaggacaaaaccatctatgatgcacattatggaaatctctgcaaaatatatcccaaaagggagccatctctagaccttgagacatgcatcattgactgtaaagtagtcttttttctagctcttgttgatctctacccaaataaaataatcatacttgagtaaactatttctcacactgtgtctcatagagaacactgaaatcactgtgaagctgaaaaattactgacagacataggggacgtgctactctaagtagcctggaaaggtttctaaacaggtgagtgacttagtgtgattaatgagcctgtttgagtcaacagtagtggctggagttctgaggtcagtttcatttccttcatgataataagcatggaatggggactagcttagacttgggaagttgaattagggtctggataatttagagtcatgatgggatagctcgaaggaaaagttttgccaccttcaaccaattgccagcttggacctttttaattgagtgactatttttggggggagataaagggaaaaatagcattaaaataaatg

SEQ ID NO: 26710 - DNA, 941 bp, Bovine  19866881094787
tttattagtaatgctcaaatataacagtagaatcaactcagtgtgtgtgctggaaattccagccccttttccaaaaacactcacttgtcgtcacctcagacactgccattgcaatcagtgtcgtgctccagacgataaaacggcagaggacgaggaagaagaaaaactactgctcagaaacctaaccactaccaacaccaacatctccaaattagggttcttgcaaagttacccagctccctctggggtgaatcactccagtttgggactcatctgcatgtctgggtgaggacatttttcaaatgtcatgtcataggacacatcagctgtctacgtttcttcacctcccactcactcccccaattcattccagtctggccttactaccccaccaaaacagctttcacaaaggccaccgagacctgagatgaccatgtgtccactcctcatctcactaggcttctcagcagcgtctgaccttagtgaccactcctcccttgaaggcttctcttcctttggtttctctgacatcactctctggattttcgtctcagttctttgctgctcctttctctccctctcactctctctctctctctctctctctctctctctctctctctctctcgatagctcctccttctctgcctggcctttaaattttgaagtaattcaatatttgatcctcaaagctaaacttccttctcgctccatattccctcaataggtcatccatggccatcatggtgcacaattccaggagacactaggcacaccactgtctgtgtaactggctcaccctcaatctgtacaatgcatggcttgtgtggccaaaagggcagtttctatccactcctgtggctttaattaccatatacattagacctttacctggggcttccctgggggctcagctgatgaaaaacctgcctgcaatgcag

SEQ ID NO: 26711 - DNA, 722 bp, Bovine  19866881152964
tattcttgcctggagaatcccattgacagagaagcctgatgggcttcagtcttgggctcacaaagagttggacacaactgaaacaacttagcacggaagcaaaagaaaatggttcagctgatggactgacagccaatagtgtctgccccaaacaggcgacaggaaggtaagaaagaaaataggtgcacgccaaactctaccaaaaaatgctggagaagtactggtgagctgtagggagtaatctgacatatactccagtagcagacacttggtaggtgcccacagacccaaatccatcccttctggccgcctccctgacccccgccatagggccctcccaatgctggcccatcctgtgtgcaagtgagcatgtgtacagacatgccaggacccctacgcctgtgctgggaccgcttctgccagaaaaaggaccgtaaaactaccacccaccgtttttcagaagttgccaccccctgctgtaaagactgtctgcaaagccataagctccagcttcagcttcagaaagccattcctttttgctcatgggtttctgttcaactaggatgcagagaatttccaagtgtgctctggagctgccatgggttatgagatgttaatcaaacacccactttgaagtgctttggaagcacctctggtttttgggttattgatgtactcatgttgagtgaaggtatatttctggtccaatcatgagttcattt

SEQ ID NO: 26712 - DNA, 1987 bp, Bovine  19866881273953
ttaaaaaagcacaaagtagagaaaggaattgatatggggactggccaacaatcaactgaaagaactttaataatacagcagtcaactcctgtcaattcttttcttgatcgtaatgaattcaatagtagttatatcatagatggtcctaggtctcccaaattagttgatagcattaacataatactgtatttatgggtaggctacattatgcagggaaccaaacaagccctaaacctcagtagctttcaaaaattttaagtacttattcttcttactatattttcttttcttttcttttttttttttagggcttagtattggttgctatatattttttttaacaagttgcccatgagaggagcaaatggcaaagtcctctggtggcagtgaagtactcaggtaagaaagacatgcaacaaaggacagcaaaacccaggtacataagccaacgaggaggaacagcaagcaatttaaattcaaagcaaattcacaagtctcataaggaatattttaaggaaacacagctatgaattaaaaatttgtggtaactgttgagaagatagtgaagtggtaacggaagaacctgctgagaaaagttctccatttcttttccctctttcatcttctctttgacaatgaattgtctcaggtttctcttgagctccttatcaagtactgctctttgctttatgtgcctggatatggctgcagcttgaattcgttcttcaaaccatcctctggcactctgaggttgtgtgtcatcaccagacactgtcatggccccatttactgtagggacaactcagaaatgtgattgagcgtgaagcaaatacccacatggtgtcagggagcagtttatgtggcttgggcccatgagattaccaggtcaatatggtccagctgcctaaattgatagaaccactgtgtctcccaatcatttcctcatgtagagccaaaacttaaaactaccagcaacagggaaatatctgggctgagcatggaatcaagccaagtgtgtccacagtcaattgagaagaaaatggcctaattggaagctcaggtcatctgtcttcttcagatctaatgtcagtcaccataacgtccactgtgccttgacctgagggaatttcctctgctccatgtgtgcccaaattcccctgagactttcctcccacccccagtctctagtttgttagtttagctggtgtattttcactggtatattctgtcctctcagattccagacctgttcttcaggagtagggctggaaaattgcttcattgcttcactcagataaacctctaggaaaaagttgcctctgcagatcaagctcacgctcttatgcatctcattcactgggtctgtttctccgagtctctctctcacacgcacatttatgatgtttccatgttccatgttttctctgtctttgctctctccttatttttataagtgtttcctcctatctttcacacacaagtttcctgctaactgttattatttcccttgtattaatattaactttcattatgggtcctatgctcatggtcatcttctttcattgcctcaatctattttcagtcttgctgaaactatacttgtgtgtgcgtgttcagtcactcagtcttcctgatccagggattgaacctgcatctcttgcatttccttctttggcagacagattctttacactagcgccacctgggaagcccgtatgtatgtgtatgaagttattaatatatatatatatatatatatatatatacatacacatattatatcggagaaggcaatggcaccccactccagtactcttgcctggaaaatcccatggatggaggagcctggtaggctacagtccatggggtcgtgaaaagtcggacacgactgagcgacttcactttcacttttcactttcatgaattgaagaaggaaatggcaacccactccagtgttcttgcctggagaatcccagggatggaggag

SEQ ID NO: 26713 - DNA, 1103 bp, Bovine  19866881352339
tgaaataaatacatatgtaagatagataggtagtgatagatagatagtgaagtcgctcagtcgtgtccgactctttgcgaccccatggacaatagccaaccaggcttctctgtctgtgggattttccagacaagaatactggagtgggttgccattgccttctccaggggatcttcccgacccaaggatcgaatccgggtctcccacattataggcagacactttaccgtctgagccaccaggaaagtccaaatatgtaacacatatgtaatgtacacttcaaatatcattagcactcaataaatgtcctaagtaaggaagactggttaatcaagttgtagtccaattcagaagaggaaagagataatgaaatatttaataaacactactagcatcctgccatggaaaacaatgtgagttttaaaaattacaggcagacccatattcatgccatagaaagacattaacacagcacaaggtattattcaatattaaaggtgaaatgaatttgtaaagcagtatccatctttgaaaagatatttgtaattatatttgtgtacaaaaatgtctggaaataagcaaaacaaaaggataacactggttatctctgaactgtggaaatgttttttgaggttcgttttttaatccatctgtgtttcctaatttttccacaatgagaaagtatttctgtataatttttaaacttttcaaaagcatgtagggtggataagtatctggagtacagaattccagctccttattttaatagcaatgtgacattatgtacttaactttttaaaaacatgttttttcatctgctgattaattacatggaaacaaaataacccacccactggtgattccaaatcaataggtatttactctccttaaatccatgggcaggggtgcaagagatggggcatgctgacatttgctcacactagcaaaatttttatgttgccctagtacatattcgaaagactggatcagatactgaaacttgtgtggttattttcaaacatctcatgacttaagagaacaggtgttggaggaaactgtgtctacatatttgctaggaaagcattctcaggtttctttcctaa

SEQ ID NO: 26714 - DNA, 1213 bp, Bovine  19866881390602
atgcttgcttaaccctaattaaaataaattatgtatgcgccttgaaatcctgtgtcggtttcattatattgtagaacactgccaaattagtaattaaacatgccacccttggttagtaccagatgatttctcttcgttgttttttaatatccaaagtgctccttttctctcttatagccagttcctacaactttggaatttacagtattttcatatttccataatgacacctgctggtaggagaagaacggatgaactgcaggaattttattcaactagctgtagccagtcatgctgcagtctgaagtaactaacattcctgaacatacaaagagtagagctcagtgacttcaaatactcaagcactaaaaatttgacaatataaggtaagtactatttcttttccaaccagaattaaaacttatcccagtaacctcagctcaaagcaaaactgctgcaatcgagagtagttattattaagggccttaaaattatcaattaacttctgttccatagtcaaaatttaaaatatggctgtctgaaacaatcattcttttaaatttttctgttgttttatatgagtaattaatagatcaaggtttaagtggcccagaagacaacgaatggggcatttgtctctggtaacctgcatgtcttgtcagttgacagagcaaacccagcaacctctggacacactgctggaagcttagcattagccccaggtctcctacaaaacccaataaagagatatggctgcatggtcctatcttctgatcagggccaaggtgatgtctgctcacgcccgcagtcctccgcacacccttgccacaaggtgtacatggataaatattcttaaacaagtgtgtgtctgtctgtgtgtgtttagcagccaaatagactagatcccaggtagatctcacccagacaccatgtcaaccagattaagtgggttgactttgacaacctgagtgagtttatttcactcagtagttcagaaaacaggaaaattaaccaagattgtctcaaacaaatttggataagctatatgcacccagctttctttaatatgcagagggtaaacaaataatccattagaacatatattacatagactctttcttacttgaccaacaattcctcttcattagaaatcagtcatgtatgacagttacagggggacagaggtaatctcaaaaaacaagtttcctttcta

SEQ ID NO: 26715 - DNA, 1226 bp, Bovine  19866881424019
actcgctcttatgttcttcttttcttgatcaagcatccttaagatctaattccattggtactcccctgctcctgtgaataaaatgctagttaatttttgcaactgtcttggagtataatctctttctttctttctttttttatcagacccaacatgaattcagcagggctattctgagggaggtgttcagtagaaaggtagggacatgtcctggagaagagtttctttcccctctcttttctttctgcaggggaaagtactaacttttattttatttttttttattttttttaaataaattcaggacgaggtgggtccctacccccacagcaatcagtcccaccgcacaggccaaatgcaaaaaaagagaagtttctagtaagccttgatcccaggacacacatgcctcacaaagagcaatgcttcctttgagcctcttcctatgcacctccagggctcccagaattgccctctcactatcagtactaacttttaataaggaggatgagggatgaattacctctaaagctccaagtgtttcagggaattctagagagccacagtcttcgacaatatctgggcttcccaggtggcacagtggtaaagaaccctcctgtcgatgcagagaagctggagactgggtttgatcccttggtcaggaagatcccctggagtaggaaatggcaacccactccagtttcctgcctgggaaatcccatggacagaggagcctggcgggctaaagtccatggagtcgcaaagagtcaaacaggaccgagtgacagaggatacacgcatgacctttgcactgcattcagagctcctgctggcattaccactatgacgggttgctgggctgcttgggcagccgactctgctacattgcttgattgtttccatgatatgggctgaaatccacaatagctaggttggcatctttgcagttactttgtgtgtgtctcttgtagatggtcatgatctagcccttcagatggtgctttacactcagcatcttggtctcactctggtgaagtctttcctttgctttataacataaatctgcattggtgataactaactctggaatttttattatttttcattatggtaaaaaatatataacatggaatttaccatcttaactatttctaagtgtacagcccaatagcattattcccattgtttgtaaaccaatttcaaggtcttttccatctgcaaaactaaag

SEQ ID NO: 26716 - DNA, 1202 bp, Bovine  19866881580841
tgctgtacacctaaagctaacataatattgtaactcaaccaaacttcaattaaaagaaaaaaataaatatgtaggctagcagatagtggatagaaaaacagaaggactaaaacaagccagtaacaatgtacaatgtacaggtctgaaattggggtattgatcgaagtttgtctgtttttttcaaagaaaatgcattaaagcaatgcttttgctgggacttccctggtggctcagtggctaagacttggagctccccatgcagggggcctgggtttgatccttggtctgggaacaagatcccatatgccacaactctgacctggtgcaggcaaaaaatacatatatacgtgtatattttaaaaggcagtgctttggaattaaaaatgaaaaaaatacccatttttttaaaaggaaaaaagaaagggagactgcagacaatctggtggtgaaagcaaagggtgcaactttaagttgtcttttctgggagagcaactggtttagaagactaaactatgcatatgtaaagcaaagattttgaatcattttctgggttacacttacatctttagtttcacgaaggatgacttgaagcagccacatttgtgatgtaaaacttattcttcagtgttattttccatttgcaaattggttggatccacttgagtcaaactgtgctttggtagatgtcattgctgcttttggacgtgttctctcaaattaggttacagaaacaagagctgaattatacacacagctgcagaaatagatttctacttgcaaatgtaagatgaaaaataggaaacttgagagagctcctttaatgttgaaaccaaccgaccaactttctgggtaaagttctgtttcttaacacattcagaaatcggtgggttggtgtccacatggcctgaggaggcaggcagtccccttttagagcataagctggggtcgcacagatagatgtttgaatccagttctgctcttcctagttgggtgaccccggtcaagtcatttaaccctgttactttcctcatctgcaaaaacccctgtgcccagagctccctcatggggtggctgtgaagattaattgagatgactgagtgatttgcttgataaatggaagtcattgtaaactgttagcagactccttcttgctttcatgcacttgtggtttttgttcttgctctgttcacaggcagcatgaa

SEQ ID NO: 26717 - DNA, 1515 bp, Bovine  19866881595443
cagagggaatggcattggcaggtgtctgaagggcacaggacttgggaggaactgaaagaagacctctgtaatcctgaggtgtgggcgcaggtgccagggtggagggagaagattgatgtacgattaagctggagaagtaggaaggggccattaggaagtcactgaaagtttttaagcctggaggtgttttggtcagaagtggattcaaaaaataattctctttgcagtgcacagaatggatgggggagcaacagtggagtgggtaggctggggaggaggctaatacaggggctcagagagggagactgtggtcaggaacagtgaatcaagctgagaaaaaactgggaggtggaatcaacgagaagattatgcagtgataaagaacataatttatacatacaaaaaacacaaatacagttttactaaaagatatcaacaccacgtgtttgttaaaaagcaaaagacaaagcaacagactaacaacacaaggaaaaaggaaaaccactgttctgatctgaaaaaccagaagtccagatagaataatgaaatgcttgtttttttttttttaaggcacaattattctttcaaaatagacacaacagtgtttttcaaaaagttggcttgttccttatcaaattatgaaatttgtcacatatgatttgtgtctgttttccactttgccagtggtttggggagtcgtgatgtgtcttacgaagttagactgaagagagtgctgatgtgaaaggaacttgctgaggcaggcctggcccagccgatggggtcagcgcccagtgagacagcttggggacccggtcccagcgagggtgttcagtgacaagacaggccccggggcagggtcagctgtgactgcagacagactcacacccacagcgtctacaatacccacagctgccgccgggttgcattacaaaggtgtcttggcagaagcattttggctgtctgaaataacggccttcacacaatccttagactatattttacaagttcgttttctaacacacaggcacgcttttatggcagctggagcattttgctgaatgacttgtagtgcactgctgaccagacagggcatttccagatttagattataagagaaagacagcaagtggtaagttcagctgcaggtcagtggacacttgcaccatagttccctccccaagcaccgggcgcctttatcccagggggacgctcactgtaaagcacattagacagagacggtcctgggtggtggcttttatgactgttggttccatttgcacagggactgtgttgttatcacattgtaaacattgttcttaatatcaaagaaagactgggcagagtgtcgagaagtggcatgcaaaaactagaatagaatcgccagtggttggttttaactctcttccgagcaccgatgagctacaaggggcaagtgctgcttgtgaaaagcagcgatggtgacagaaaccgatgtttactcattttccttcaaattgtgtgcatcctttttttttt

SEQ ID NO: 26718 - DNA, 744 bp, Bovine  19866881772716
cctgacattctcttttgctgccgaggtatcctgcccgtctgcagggggcagggcacggggaaatgcagagaaagcatatatttttcagcaggtccatatgtgagatgagcacgggaagaagtcaggcactatttaagctcatgtctcccgatgtcagctggtatatcataatagcttgtctgttaagagtgtcaagtaacccgtaggaaagaaaacatttctccaacacctgtaagtccactccagggggcagatatggcatcctctcccaccagggaccactgcaaagttaaagtcaacaattaagaacagctgcagccttgcaaccagctgcccttgctaacccccttggagggaggagagggaaagttctaagagtggtaatcagcagaggagactgaaattactctttctttgcattactttctcttgtaaaatgtgttgaaactgcccctgtatactgaagggagtcgcaaggctgcttttcaatttaccaaatgccctgtagtatttccaagccttatagactctggtgatatctaagaatccatttcacagagttggagctcacagcttcaaattgctgcaggagaagattcaaatatgcaaggaaattcttttgcatttgaataagttcctttgggaagaaatcacaaaaaagtgccattcagtcacaagctgtgggacctctcaagagctaagaagggcccaacagtaagggtccaatataatgataaaattata

SEQ ID NO: 26719 - DNA, 948 bp, Bovine  19866881776467
aatccttctgtatacagtagagctggatttaatttctaaaaattcccattattttatgtttttattattttggtttcaagaggccataacatctcccctattccttgctctatcaagactaaagtcccctaatttgcctaatatctaggccaaggcccaatgacttagttctaacctagttatctaaattcatgtgacctttgccttgggtgttaaggcaaaggtcccaagttacttttgggggaatactgcattctattttggcttaggatcttacccacaaaccagaaaagtccagtacttgacaactcaaagcatcttaatttacaagcgtacaggccacaaattacaaaatgaagacattttttactgagtcagcagagacatctgtctaatgcccctgcaattccctagttacttacagttttgaactgaggagatcatcacatgtggcctttattgccttttactagaacgagctgttgtctggcactttgctctgtatggacaatgtctgttttctgcttctggtgtcagtcctttctccacatggtctaggtacacaagatacgatttttttttttttttttgatgggggcagtggtgatgtcaaaataagtgcctagaaaacaggtcataatgcaaatcagtataaaggggaaactgcttcaccatgggaatcattatttaattgctggttgaattcctgactgctggctaaatatgtctggtaaatatgtcaacctccctcaaagccaaatcaaacccaaaagcaacattagacttttcaaaaaaaatgtaatttatatataggttttggaaatcagacaaaaatgtcctataggttttatataaaagctctaagggtacataaaaataaatccttatcacattataacttaaatgtcctagcagaaaacaaacaagttccatattgatccacaattt

SEQ ID NO: 26720 - DNA, 2666 bp, Bovine  19866880362633
tgctcttcctatcagaaaaggcaatggcaacccactccagtactcttgcctggaaaatcccatggaggaggagcctggtgggctgcagtccatggggtcgctaagagtcggacacgactgagcgacttcactttcactcttcactttcatgcattggagaaggaaatggcaacccattccagtgttcttgcctggagaatcccagggacggtggagcctggtgggctgccatctatggggtcacacagagttggacacgactgaagcgacttagcagcagcagcagcagctcttcctatgccaggtggcttgccagtattgctatttatttgtgctttgtaaacattaaggaattgcaatcttggatttgaaattcggctctcactcttttttctctaaatacataccaaagcatctggttttcaccttggttaggcatgccacagttccaacagacccacctacagagtttcgttcccctcctaactttgcagtcttcagaaagggtgagggtagaaaccttctcttattctgatatcacattttaaagaacttgcaaagttctgcaagtctgcctgatttgcatgtgcctaaaaagctgtggtttaccctttcaactcttcttgatcatccaacacagccacagcatgacagggtcgattcaagttttgaatttatggatgattcagggtttccaagtttcaaaaagcacctttgatgatggaaatatcgtgggcaagggatgtgggcagcgggagagataagaatttctgtgggctggagctcaaacagtcctgttcatgcccatgttttgatgtggtaacttcacttgctgctgcatctacatctcatttggggctgtaggagcctattggcagcctgggtaaacatttttttttttttaatgcattctatggcgctaaaggaccctttcttccctttctcagacacaccctagtgatggaggagaccagagcctgaattagcctgttggggctaccatatcaaagtaccatggactggcactgttttctcacagttctagagcttgaagttcaaaatcagggtgctggtgggattggtttcttgtctcttctgatgcttctgtccttgacttgtagaagctgtcttcccttgtgtttccatattaccttccctctctatgtgtctgcacccaagtttcctcttcttataaggatgccagtcactttgcattcaaatgcaccctaatgccctcattttaacttaattcactctttaaagactatctcaaatatagttatattctgggatactggggttaggacttcaatgtacgagtgttcagaggcagtcaaacagcccattcctgcagctttgttacaagcaagaatgcagtcaatcaaacacatccaagaaggctccgtatacttcatggtggccattagcattcttcagtcttggtttagttcttcattacaccttgcgggcctggaagtgaggggcaattctgcttgcatttgctacaaccacagccaggctcctccgtcatacaggtggccatatggggtgatcttggtgccatgggataccccacaacattcacctcttttcactcctatgctctgttgtgttccttttacatagttctgtggagggaaattgctgtctcccaatgatataagccccccatctgcaggaaatgattctcaccctgttcctcgtaatgcatctaatgctccacttcattatccaacttgtgctgtcagtttctgagagttcatgtttttcaagaaagtcaacatagattttctaggtcttggatcagagggcaataggaggggctgttgcattattactcgggtattgtgaggccaagaaatcaagagatgctttccaatgaaaagattgtttgttacagttcccaagaggaatgggaatgccacactgtgcgaggccaaataaggaggcaccagggctagactagggcagagtgaacaaggggaaagtgtgggcaaggatgtttattcgtggtttctgtagacagaaacaggtgagtcagggtgaggaggcttatggttggctggttcaaatcatttcagtaggctccgaggtgcagtgactatcctaggttgtctagtacctggccctgggcgattaggagagggaaagcagttcagttcagtcgctcagtcgtgtccaacccctctcaaccccaaggactgcagtatggcaggcttccctgtccatcaccaactcctggagcttggatctccatcgagttggtgatgccatccacccatctcatcctctgtcgtccccttctcctcctgccttcaatctttccccagtatcagggtcttttccagtgagtcagttcttcacatcagggggccaaagtattggagtttcagcttcagcatcagggaggggaatatttgcctggaattcaagagtccaatagaggagaaggttgggtgtgggctttggattagttgggttgcatgtaaacccatcccattagttgggatgcacttgtaggacagtcctttactctctaagaatgggctagtcctgggaagggcagtcttcccaaggtcagtatgaccccagaggctaaacagccatctggagatattgatgctgcagtggcggccatgcagttgtttatgttcactcataaatac

SEQ ID NO: 26721 - DNA, 2480 bp, Bovine  19866880581501
gaaccccttaagggcaaaaactcaggtttcccagagaagaaggaattctacctcaagactgagatgtctaaattgcaatgggtggtttcttgtgaaggccacattaggttcagtccaccaggagggaaatgtctgttctaccatagacacggttaaagggtggggattagggatttcttcctgggggattgggagaattgggagaatcttctgtatttagaagagaggccacaggatggaaggtttacaagatgtctgagattcctttccagctgctcagcacccaaaagaaaatctgtctatatatctatctatctgtctacttgactgactctttggaaaagaccctgatgctgggatagattgaaggcagaaggagaaggggatgacagaggatgagatggttggatgacatcactgacttattggacacgagtctgagcaagctctgggagctggtgatggacagggaagcctggtgtgctgcagtccatggggtcacaaagagtcagacacgactgagcaactgaactgatctgtctacttatgttgaattaagatgaaaataaattatgagactttgcacattaactggcccttcaggatggaaaatggtcacctcttttagaaacgattaactatattttaaagtgtgagcatttgggttcaggttcatgttagagaatatcttttcagttacaagataatcacttcaggaaacaaatttttctctttactttggatttcagttgattcaatcatttcatttgcttttgtttccgcttgtttaagaattcccagattttgtttgtttttgctttttacataatctactttttgttcaacttggtggtaagcaaattggcctatttcagtgcggttttctgtatttaatgattggttcagttcaaacctgtgcttttaaaatgttgaaattttgcaattaagtagtaaaataattgtttgtttgcttgttttctaatttagatttttgtcaggttctttgatagataatttcctttgattaaagtttaacaaatgtactctcatttaaagaatatttaagtactaatcactgatttatttatctactatgaaaaaagcacttttttccccaagaggttcattttatctgttcatccagaacaaggtttccaagcttttatcataaccataccagatagatggtgtagaaatgccacaatctgatattgccagagggatattttaatggcaatgagcagaaatgtcagggcatttatatttttgcccaagactgatccatttatagcttggactaccaggagagtattatcctttctgccaaaaagggtttgaaatgtttattccttatttttacagacttgaggaagaaaaagcaggctctgtctgagatatagatatggcgatgaggttaaatagacaccagaaaatcacatcgctattttcgctaagatataaattttgccagcattttccagatcacactggagaagggaaagcttccacagaatctgagagtgatgggttcatgggttctgattgcgtgattaatatacactcatggtatttttcggtgtgtcagcaaaacgtacaggtctctgagcctgacatttaattattacacggatggttgcatgaactagaggagtgaacacagactttggagtcccagttcatcattaatggtgaggattccagtctccatttcttccattcagtctccatcactcttactatctaccacctgtaatccttttagagccagtataagaggaggaagggcttcccaggtgccactagtgagaaagaagctcctgccaatgcaggagacatgagacacaggttcaatccctgggtcaggaagatcccctggaggagggcatgaaaacccacttcagtattcttgcctggagaatccctgacttcccagaggagcctggtgggctacagttcacagggtcataaagagttggacacaactgaagcaacttagcacacacaaatccaggagaagaggagaggaaattaaaaattcataattattaacaaatatttgaataacaaaacaaagaagaagctgcatgtattttaaagtcttattctgtttgtttgcaactgcagtgaggctcctgttgttcagaacttccatcttgcactatctgacctatgacccctttgccctcagcctgctatggtttttctctgatggagggacaaaatttccctcttgtaatgtgatcctgcctgtatgtactcagtcatttcttaaggtattctatacagaatggaattacaagacacctccccgcaaagatacattttcctagatttcagatagatacttccttgatagatactccttggaacccattcccacacatatttcttcagtatctaccaacactaatgaaaacaatattattttggtatgtaaactcccctccccaggtcagaccttgtacacatttctttttttt

SEQ ID NO: 26722 - DNA, 3482 bp, Bovine  19866880674466
cactactgagtgacttcactttcacttttactttcatgcattggagaaggaaatggcaacccactccagtgttcttgcctggagaatcccagggacgggggagcctggtgggctgccatctatggggtcgcacagagttggacacgactgaagcgacttagcagcagcagcaggaggctttttcaggctcttctctgcaggaagctgttagcaaagcagtgggatcagccagagggtgttgctgagattctccttggggaccacatgtatgcccagagaccctctctctctttcaagctggcacccaccctcccctgtacagtaagagtcccctgcaactggcaggatggtaaagcagaaggtgccttgtcttcactgtggctgcaatatctgggaaggcttttatataaataactgtaagtagcttagtacttttccagagagacagcatacccaggacagagaacgattttctccgacttgaaattatagcatcttttccatctgtctctttccctcaacacctggcctcctgtttagtcaatgctgggcgcttgttaggtgaatggaactgaactgaaaccgggatttctagaagagttggatattttatgcccaggagctgattggaagccagatgtattagggggatgatctcgaccttgactctacggcatgaccctcccgggaccagtccagctttgtccctctgcacccactgctcacgccccgcccttctgttgcaacatcagccatccggttcctcccctgagatgctgctcacaacctccacccccggggttctgctcggggctcaagcctcctctccacccagcccctcactaaatggatctgggcctgagtcccttggcttttccttaccattccccgcctccccgtcatgccccaacctgatgccccaagtcaaatgagaaaacaagcccagcaagaagattgcagacctcttcccttgaatctttagaggagtcaggcaaagaaatgttcaggagcccatggatgggtaaaatatatgtttggaaaaggataggggaggagtttcatcatttccctccattccagctaactgctgctgtacagctaaaccatgccaaattcagtggccccaaaccacaagtttttattatgcttacaggttctgtgggacagaaatatggacagattcaatcagtccagaaacaactgggttgtttctgctccgtgacatctgggacctcaactgagaagtttccaatggctgagggtgagtccagtgggctggggctggaatcatctggatgcatttgttttgaagtggctgggagaggatgacttagaagctgagtatagctgagctcagagtatccaccagagcatctccctatggcctctctgtgaggcttgggcgtcctcatgacatggtggccatgctgcttacatggagcctaggagttctaagagaaagccaagggtatctgaagaccacagaagaccatttttgccaaagactcttcgtcaaagcagtcataaaggtgtctagattcaaaatgtgaggacatggaccccacctctcagtaggaggagtgtcatataatctgtgtattagaataatttgtgctttagaacctcccaactcccctacagttttttgttgttttttcttaaatttatttaaagtgctgggcacaaactttttttacttgcaatgagcaggagctaatctttgctgaggttctcaggcttctccttgtgcttgtttctcttgctgtggagcacagactctagaccatgggctcattagttgtggcacacaggcttagctcctcacccgcatgtgggatcttcctggaccagggatcgaacccgtgtcccctgcattggcaggtggattccgaaccactggaccaccagggaagtcccaccccacaaatcgtttgttgggaagttgtctggtggaggagagtggtgtctcaaggagcatcagaccaaggccctttgtgacccttacgttcccttctcagcacctccctgggagccctccacggcagcacatgagaaatgtgctgctgaatttcaaggggagatacagagtttggatctcaaatcccacactgagatattttgatttgattctcttcttggcgatgaggctcctgcaggggcaacttggagaagaatgctgtcctgggaggatcagaagtgtggcagcaagctgggtggaagaaggaggggctgctgtaggcaggaagatggatgagatgaccacacgaaggctcagaaccttcacagctggatctgtgtccacagagccgagagaaggaccgtatctcaaaggccaaagaacaagatgtgggagagacagctgttttcaagaaacagatcatctggtcaatcggtcctgcggctggactccagggcgaggtcaataaggatgtgtagcatccttacgccatcccatggaatgactttttgagtgacagctgcagcatctcaggcccatagagatgccatccaaaaccagccagctgttccaaagctcttcttgctaatgagccccaagtgcaggggtcctggcccctccacctccattgtccttatgaatttttaaacatacagaaagcacgttgtttgtgattacattagaccttccaaaggcagcccgaacataaattctgagatgaacagccgagggctggaagcctgcctcttggtttcacttcagtaacttgtctcaatgaatccccagcagaaagcatcttacatacttcagttcttgagaagatgagacgtgaatgccagggaattataagacagaggggctttattgcaacagtgaacaagctggaaattacaaggtaatggaatctcagtgggagggccctgtaccctgccattagctaactcagacagtgattgcagcaggatccgctcaggtgatgcaagtgccacacgggtttctgcactttgcaccctcatctggtgaagcccagacacaatcatacttgaaggcaaagggtacacctggctgctgggagccctgatctcacaggaaaagtctagggaattacctgccctgggaatcctttattctacaggagatggtttccttccgagcccttgtggtgcacaaatacttgctgactttaaaaaaaaaaaaaaaaaaggacatgttacttgcaagttaaattttatctggggcaaaatgactgcagctggggaaatagcatctcagatagctctgagagaccattccaaagaggaaggagggaaggtcagaatagatgtgattttggtgaatggggagtacatgcaatcaagcacgtactttttcagaaggtttctgcgagttatgaggaacaggcaccaccatgaaggattttagcgtttttctatatatgagaagatacaagaatcaggctcataaaatcggctcctgaaactatctgcagaagacctgtcctgccagtttttttcctagtacagag

SEQ ID NO: 26723 - DNA, 1723 bp, Bovine  19866880831021
attagtgcccttataaggagggactagggactttcctgatggtccagtggccaagactctgcagggggcagagcttgcatccttggtcaggggactagatcccacaagttgtaactaagagttcacatgccacagctaaatatcctgatagcacaactaaaagatctcactgttgttgttgtctaatcactaggtcatgtccaactctctgtgacaccatgaactacatatagctcaccaggttcttctgtccatggatttcttcaggcaagaatactggagtgggttgctgtgttctccccctggggaatcttcctgacccaggggttgaactcgcatctcctgcattgtaggcagattctttaccactgagccacttgggaagccaaaagatcccacacgtagcaactaaagatcccggcacagccaaattaataataaaataaataagtattaaaaaaagaagaaaaaaaacacgagggagcagaggagttgtttgccctcgcgcgctctctctctcctctgtgagaaacagaaggaaggcagcttcctgcatgccaggaagcaggctctcaccatgaacagcatctaccagcaccttgaccttgggcttgtaccctccagaactgtgagaaataaaagtctattttctaagcctcccattctgtggcattttgtttttgcagcccaagctaagacacttccattgttggcagagtgaatgaattgttgaaaaggtaagtaaggtgcctaaatcagagctggcatatcattgttgttcaggcactcagtcgtgtccaactctttgtgaccccatggactgcagcacaccaggcttccctgtcctctactatctcccggagcttactcaaactcatgaccattgagtcagtgatgccatccaaccatctcatcctccatcatatccttctcctcctgccttcaatcttcccaagaatcagggtcttttccaatgagttggctttttgcatcaagtggccaaagtattggaacttcagctttagcatcagtccttcaaatgagtattcagggttgatttcctttagggttgactggtttgatcttgcttccaagggactctcaagagtcttctccagcactacagttcaaaagcatcaagtcttctccagcaacacacctcgaaagcatattataggtgctcaacatacagtaacaatgatatcatcgtcacaatcatttccacccttgtttttatcaggtaacccctgccctcaaggagctcacagtctggtaagggaaacagatatggaaaacaatgcctgggggcataatgacaaacgcatgcgccagcacttcagcagccctgggggtttcagaaataagagtagggactcctgggcaggcgggtgaagctgccaaatgcatcctgccccttggcttcacaactcgctgggtaccactcccggcagacacagcaggcacggagaagccggccacctcccaagttgcggtacacgatggcacccttctgggtgcacaagctgtctctgttctgacgccagaaacatagctgtggcgatgtcatatggagatgggtttcatcccccctccctctccactatgcctggcaaaaagttaactgtgctttatttcacttcaggtccatatggcgcctcaatttccgatcagaggtattacaaattacagtctgtctctacagaacattaaagtaggctcattt

SEQ ID NO: 26724 - DNA, 924 bp, Bovine  19866880844510
ggaaggatatgccctggaagatagacctggaaattctggtctttccctggccggggaatagactgtcactcagacttatacatcaggctcttgtgagtttgatccacatgaatcaggtctcctaagactcactgtatctccctgtgacctgaaacaaccagatagaagaaccaaagctaagaactagactctaaacagtggtaaccccaacacacactactgtagtagacccttctgattcttttctggcccccttgtccctatctcacattgccaccaggaatctacaggaatattagaaccggaagcagtccaacgttggagaaagagaattacttttagacatagacagatgcagcttaagttccatcgtaccacttacttcacaagtaattctgagcaagttgctaacctctgtggcttccatcttctagtctttaaaatgggaatattaaaacctatgtcccagggttgggaaaaagaaggcatcacacaaagtgcagagctcagaacgtgtatgtaacagatgacagcttcctgccccagcttgtagatggtcctgggattggatgaatatatggctcactctgttcagttatctcctcttaccagtagctgatggttgttcagggaatgaaaattaatttttacattagcccaagaaaaacataattaggaagtcaaatctgttgctgtaccagccacaacagttaaaaaaaaaaaaaaagactctgcatcatagataatggtgtactagcagctttgaagtgtccatgtatcccaaccctcgcccagatggctgaattgatgggcgatctcatggcacaaaggaaagagcctggtcctgcttctgtcatcttgctggagaccttgagtatttcacctccttctctgggcttccctttccttctcttaatatggcag

SEQ ID NO: 26725 - DNA, 1283 bp, Bovine  19866880900833
tttttacacagaattaaaatagattgagtttccctccacagaagaaaagagtcacttgtttggaatcacattaagggtagaatgggatgtattccactcccagagccaagtcaccaaccttgctggtgaacaccctccccagcagcctttcccagttggcagagcatggtagaagagacagaaaaatattaggtatgtttcctatgagctgaagtgcagccaaatagcatacttccagggtatactcttgcaggctggcattctgaaagatgcaatttctccatttccaaaactcaacaatttttcagtagcacagcatcgttccaataaaacactggtattttattcatctcttcctgaagtaccatacttttattttgtaggcgtctctaaatcacatcaattcacaaaagatcaatttcttgctgctatagtcaaatcagatgttacatgcacacacacacacaccatgggttttttcccttgcttgtgccagttattcatagattagaaatttgtagtcggagtcacaaagctccctgaggcagggaacagggctaataaatgcaggctacctatccaacagccctatcctacccagactcaggctgcttccctctacccttcttccaggctcacgggtttaactgtctcttcttcagggaatgttgtctctgttacaggaactcttgtctagctcatctttgtaattattatttgtcagagcttatacaagtgtgaaggtactgatatcatcaaaacatatttcacaagtaactatcttttatagttcctgtaaaaccttagggcttcccagatggctcagtggtaaaggatccacctacaatgcaggagacacaagagacgcgagttccacccctggatcaggaagatcccctggagaaggaaatggcaacccactccagtattcttgcctggagaatcccatggacagaggagcctggtgggctacagtccaggggatcacagagtcagacacgacttagcaacttaacaacaggatagttcctgcaaaatctgaggaaaagagtagctccctctcaccgcaactagagaaagtccgtgggcacagagtcagacacgacttagcaactgaacaacaggatagttcctgcaaaatctgaggaaaagagtagctccctctcaccgcaactagagaaagtccgtgggcaacaacagagacccagcacaaccaaaaataatttttttttaattaaaaaacaaaaacaacagactgcagacaggatttgactcaggggcta

SEQ ID NO: 26726 - DNA, 1436 bp, Bovine  19866880905860
agaggctcaggggaggtcagcgaccatcacacagtactttgaattggaaaaggaagctgcagagtcagtagcttcataagcaagagtggaaagaaagaatcacagcggtgttctgtgccaacgtcaaatcagaggccgttcaccctggatgagaattttaagagtttccaagctctcggtcgagataacgttaactcaaccgagcatccatttgcctttctgctgttgttctgtatggtcacagaacctgatgatgggagctattggagggaagccacgcagagaaaggcacatggtcataaaatcaagcagtgttagtacagaggtgtgggggctcaggaagtgcctgtcctgaatgcatcatcattttctgttcaggtcttgcctcgccctctttaagtttgcttttagatcttgcccttgtgctgtaggtccattggcatgaggcagttggaacagaagttgtaaaacatgctttgggcaaagtgaggatacattatttgaaaacatcattcattttgagatcctgtagcatttcaccaaaatgaacattagcgatcatttagctgaaaatacactacccattaaataaaaaaaaaaaaagagcccaatatcctgtgcccagatagacttgggcagggtgactgctcagctttgtgtctaacctccaacggctagctacctgcttaaccaccaccgtggctcagacacaaggctgagggccagacctgtcatattctggaagaggcaatcgagctgcctagcaaagaaaacagaggcagcgagaaggcgtgatgccatgaaataaattagaacgaacatcccatttttatctccatggcagtcagcccattccattctttgcatgctattttcatatgttaacaacagtttgagagctgagtagaaggagaagtggaatgtttaatggaatgagagtgagacagagacagagaggaagaaaaacccttgctgactattaatccagacccagtaaaacccagttgtgtctgttgaaaccaaatagactggaaattgattcaggggctcactgttgaaatgaataaggcactgccctcatccttcctggccctgtctgctctctgttgaatctggcttccattgcaacagtcttcattgaaggagacatgacccttgggttttccccagtggtctggtccagttgaggctatggaactctgaactgggggcttggaactctcccagaagaagggagaggcttctccaagctcggcggtcctccggtgcactcgtccttcttatctcacaagctggtgcagcactgcggaaagcatgatgcgtatgatgggcctgggtgccaggcactgagatcgcgttagaaaatggccagtttcaatggcagattttatccattaaaacctattactagttccctcccagagcccagctggttc

SEQ ID NO: 26727 - DNA, 694 bp, Bovine  19866881008390
ggtctcctgcattgcaggcaggttctttaccatctgagtcccagagtaagccccctacaaactctagagtgtcctttctcttagactccagagctttctttctatacaagtattgatctttggcagggttgagattgctctttacattaagaatgaacttgttcaccaaaatataattagcacaagaagacggaatattattaggggcctcattaatttcaccaagtttatttaaattgcagcaggatgtcaaatcaataatgatggctaattaagaaaaacccatctgatttccttaaagtacatggagggggtgccacaaaggctgcagtggggaggaaggtgagaagtttctgataaacagagatggtacctcctctcttaaatggaggggaccgaaggtgagctaggtaggtgtccttgctgaattagggaaagggttgcctgcagtaggtgtgaaatttgaagtgattaactccagaggcactagaggcttgagaccccatgtcatcatgagacgtccctcttcccctctcagatttcattagaagactgtgaattagggtgaaaaataaggaatcagaaccagctggttttgaatcctggtccttccacttatcccttgggcaggaagatcccctggagtaggaaatggcaacccactccagtatccttgcctggaaaatcccatggt

SEQ ID NO: 26728 - DNA, 1814 bp, Bovine  19866881014463
ccttttatagatgacccgactaaggatggtgaaccagccatcagtagaggctgcagcaagaattccttgtgagacaagcgtcccctcccctctgtgtgcaccagaaagatacaagagggcacgtggtgaggccatactgcttgacaagtgagggttattgttccagctgactcaaggaaaaacactgaaaatgaccttaattagcatcgagaagcttgtagagatgaacagaataaacacatcttaacctcaacataacatctactgatgtacgattcacttgatgagaattatacatacaaagtattaaggggtgggcgggatgggcaggaagggatgctggctcagcatctagtggatgatctcattcagtggttctcaaaggagtagtgaaatcctgggactttcaaaagatagctgtgccctgggccccctacctggagttctgattcagtgattcaggatgtgtcctgggccagtagagattcgaaaaagctatgcaaataaggctgattcataccccaggtggtgtgtgtatgctgctcgtgtccaactctttgccaccccatggactgtagcccaccaggtttctctgtctatggaattttccaggcaagaatactggagtgggttgccatttcctactctagggatcttcccaacccaaggactgaacccatgtctcttgcatctcctgaactggcaggtggattctttaccactgcgccccctgggaagcctgaaattgagctgctaaattaagtcttggacaagtttacatttcctttctaccttttctatctgcttctgtctgcctcatgaccatttaaaagattttttttaacacatcactaagagaatgccagggaaaagtacaaactccaaaggatgctcagattcttataggcagttcagataaggtttcagtgatggagactgaggatgatgaaaccaatgactcaaggcctgtgtattgtgagtacgctttcatagtccacttaccgaatataaccaggactcactctacagaaggaaaatggtcttaaaaattaaaaaccatcgaaatcaaacagtggtactattcggaaacgtcagttgatggataatgagtgactaagtggctgtttcagaaagaaatggaggtatagacttttacttcctctatcccattttttttgttgttgctcggtcatccagtcatgtctgactcttcgagaccccatggactgcagcataccaggcttccctgtccctcaccatatcccagagtttgcccaagttcatgtccattgaatcagtaatgccatccaactgtctcatcctctgttgccctcttctccttctgccttcaatctctcccagcatcagggtctttttcagtgagtcagctgttcacatcatgtggccacagtattggagcttcagcatcagtccttccaagtagaaagagtctcagttttctaggatgggagcactggtaacaaagttggcgttctgtttttgtaatgacttagtgaggacaaagaaagctggaacagtaagccgttttgcagaagcagacccagatatggactgtcaggagagtatctgactggatcacaaggacatctccacagtggatcatgacatcatttggcacttgaatttagacatcctggaggtccatgccacatcagacaaaggccagcttcttggtgtcacctggggccttgccaactagccattcctgtggttctgggaggcgtccttctgcatagcagtcagttcacggaatttatatttatgtaaaaggcaacgggctatattactcagtc

SEQ ID NO: 26729 - DNA, 1210 bp, Bovine  19866881064972
cctgtgtgacagtgggccagccacttactctgagtctcaaagtccttatttagacaacagccacaatatgtctccaatacttggccacctattgcaaaaagccaaattattggaaaagaccctgacgctggggaagattgagggcaagaggagaagaggggcacagaggataagatggttagatagcatctcggactcaatggacatgagtctgagtaagctccaggagatagtgaaggacagggaagcctggcatgctgcagtccatgaggtcgcaaagagtcagcatgacttaccggctgaacaacaacagcaacaatatgtcatcacaggatattttggagactcacattctgcaccattaattttcttggaaccagcacagttagagacactcaataaccattagccctctctttcccacaccctcctggcatgtgattgccatgcatttgatgactttggcctgagccaactcccttaacaaatgtttctaccttagattgaaattaattcaaagacagagaccaggaacacatcctgtaagggactaagaaaatggcattaattttgtaaattaataaatatgcaaatggaagctttgtatggaataggctatataagcaggaagtaaattgtgttgtaaattatgcattgccatatggagcggatccccttgacttagcatgcaaggcagggaatgctgaagcggaccctgccataatggtttctgagagtgactggcatgctggttcaacagcagtccctgggtgctgagtcacgcagctggctccggggatggctaaggggcagtggaagccccgcagtgagcaggctgctaccctgatctagggactgagaatgatctagggacgaccatcctgctgccaccaagaggatgggcaaccttgagctcctgggggatagctccgggtgcaccgagcactctgcccaaggctacaggctgggagggctctcctgggctgccagagccttggctgatggcaccacagtcccaactctgaggcaggtgtgactggcctggggagacgtgcctggctgctggattgatccatcaatcatgaagaaacaaatagtctgagaaccgtccaagtgttccacgtcgcactacagagaggctggagggcagtgcttccctctgatgacgattcagcagaatcacccagggagcttttcaaaaatagattcc

SEQ ID NO: 26730 - DNA, 1224 bp, Bovine  19866881201331
agaggagcccggcagggttacagtctatgggatcagaaagagctggacacggctgagtgactgagcatgcacctgaggataccctctcccctttccaacagcgctgtcggagaagtggggctcataccaggtcttcctttgaccctagagtaaggtttccatgcccttccgttgaattcacagtccatggtgagttaggagatagcttggatttcagaatcagacagacttgggctagaatcctagctcaacctacgttttctatgaacactgtgtttcgtctctcccagccatctgtatttgtcaaatcgggacagcagtttaaacctcttagtgtggtaaacatgaaggaaggcaatacgtgtaaagttcctaatgtcattctcccagggccgctgtgtacagttgctcaggttgcatattgctcaagagcacccaagtccaggggacgactgggggcagaaatccagccagtgctcagatctgctgcagcctgaaatgaagaaggaccttgtagtcatttgtgcaccaatactggatactttctcctaagtctgagaaaggctctggatgttgtaagaaggtccttccttcttttccatgccttccctttggtcatttccccttcaatgaacctgggtggtgaaatatactacccgaagctgctcacaattctccaccagctgctcagcccccatggactggactgcaacttcttccaagcaaacgagaggaggaagatttctcgttacctccagggccttgacaaggattggttctgtctctaaatgaaataccctttaaattgccctgaaattgcatcacttgtctcagttaagtggaatcctatggactataaatctgacttgaaagggctgtttaatttgactaagatgttacaaagggtttaccaaaatttaaagcatttgtctatggaaaatcaattatggtctaatccatctccctgatgacaggagtgttctcattttcgaatggtgcttgtgcacaggcacacatgtacacatgcacgcacacaaacgtacatttggaatgcagtggctggagtctcatgttgcagaaattccatgtagattaagtagggcttagtgactaatgagaagttatcaactgcagtgattttagcacattgctcattgtttctagaatgctgggagtttacccaccagccacagaccaggtgtcagctgcgtttagaggaaaaaa

SEQ ID NO: 26731 - DNA, 1111 bp, Bovine  19866881256276
tagaatggcccacccaaggtcacctggaagcacatacctatgggctcctaaacccttggttgggttgccccacatctgtgctgagcatgcgtgtttgatgagtcagttcccactgacgtcaggggtgtcagagaaacactaggggtaggaatcaaaggccgttgtgggcacttggggtgagctactggaaacccactcaggaaattttcattatccctgtggttaaaaatgaatagggagcaagagagtgtgagttggggccctgaaggtgtgtgatacactctccagaggtccgttggtttgcagactgctgccttctcgctctgtcttcacatggtctttcctctgtgtagaggcgtgacagtccacagggtcataaaagtcttggacacaatttagtgactaaacaacaacacatttccaaagaacttgttctatcctccttactgtttccttctgggctgtgttttagacaaagtgtttcctgcaattaggtcgctggatctgtgccttatttcctttacctttaatcttttataaactatgacatttacaaacctccccatgaccaatctgtgaaacccaccatctctcgctgctgttgactgaacgttgctgcttagagatgctctaccgataccacctgaacgatttcaatgactgtttctctcctgctcattacaagaatgctaatcttcagatctctctctgtgagtgcattcatgaaaggactccaggctctccacgctgcagtggaggtgaaattcagcatggtatttgctgacattactgtggtctgctcacaaggaattatctgatgatgcggtgttaaagaattaggtcaaataatctggataaaccttcaggattaaaagatctgtggttgtctcactgaccaatattttgaaaatctagttatagtcagatgcagacagtatagtcattgttcattcattccacagattgaaacgtgcgcttgctgagtgtttgggaactcttctaagcaccagagagatagctctggcattccaggaacttgcagccaagggaggtgggaggcaaagcacattgatgataacacttagatggggatcagtggcaaggggacctg

SEQ ID NO: 26732 - DNA, 851 bp, Bovine  19866881407085
cttagtgatttgcaagatatgtgaattagacaataactttaatgagctttatttctttcgtgtgtatagattcttcagggttggaagagagcttaataatcatccaggaaaaacattttagtttataaatgagaaaactcaagtccaaagagctaattgggcacaggaatgagagcaaagctcatatccctggatgctgaatcctgttggttgttccctgatgccagcatgtgggcaccatctccacattcttgactgcctacaagctagccatagtcaaccccattgccatattcagtatgacttgtcttctatggaacacaagacacagtgtaattatactgtgatttacattatttatttatctggctgtgtgagatcttttgttgagatgcacaggctcttcacttgcagctcgaaggcttagattctccaatgtgggatcttagttcctggaccagggattgaacctgtgtcccccacattgcaagacagactcttaaccactggaccaccagggaaatccctgtaatttacatttttaaaagatacaggaagtcaaacggatctgagttcacatttggcactgcctcataataaccctgtgaccagggcagtgcccagcttttatgaagttcagattcttgtctataatagagaggaagcagtacctgtgtcatgagttgcttgtgggaatttagtggatcatttcccacgaagcacccagcatagtgggctttcctggtggctcacggtaaagaatctgcctgcaatgcaacagacccgggttcaatccctgggtcaggaagatcccctggagacgggaatggctatccactccagcatactta

SEQ ID NO: 26733 - DNA, 782 bp, Bovine  19866881920836
aaatgctctgatgactgaggaaagaatagacacgcctgcagtacaagacattatcttaaagccactacaaaagacctcgtccagctttattaaaagtggcagacaatgccagagcacccgagcgctgggccaaggagcttgcaagggcaatcctcaccaccattcagtgttaacaggtgacaagttctgatagcccaagaacgtctaattcgtggctgccttcactttcctagagcagatacccaaattgattctgcctccttcaggctcgatgtgtgaaaaggctgattgacagaaacacctaagggtaatacgcctgccaagtgattggttaaacagctattcattttgaaatatatcttcgagaggcagaataacagagggccgctgtagtgtgcagcccattaattattcagttgacaagaaaattacccttcggatcaacattagtggaggcttgtcgggatggggtggggtgggggaggcaagtggaggacaacattccacagggttatctgcacagacagccacgaggccctcctaggtctggaaggagtgggtttgtgtatacagcggaaagagtgtgaggatgaagcctcccacccaagttcctgtttgtgtgatttagtggaattgattgaaccttgttaaacctcgtggtcctgatccataaaatggggatgccaaaagcagcctcaaggggacttccccggtggtccagggataagaacccacctgccaatgcagggggccgggttcgatcctggtccgggaagatccca

SEQ ID NO: 26734 - DNA, 1214 bp, Bovine  19866880581701
tgctaaggctgaaactcccaggtactttggccacctcatgtgacgagttgactcattggaaaagactctgatgctgggagggattgggggcaggaggagaaggggacgacagaggatgagatggctggatggcatcaccgactcgatgaacgtgagtctgagtgaactctgggagttggtgatggacagggaggcctggcatgctgcgattcatggggtcgcaaagagttggacacgactgagtgactgaactgaactgaagaccgcagaacaagggacctattgctagggaggaaagggagttaaggaggatgccaaaaacgcccagataaaatacaggctttgctgaaggccccatttacttccttgcccttcagatccagggctctctctgaccagatcccaggtttcattcccccttctttacttcatttccattactgtgtcctgtgtctccaggatgttcacatggaattctgtgaaaactgtcttttgtgtgtctttcttgctttacgtcctcttctgggactgacggccacctgtccagggttcttggtcttttcacgacaaacgaccctcagcaggtttctctgaggcctgtttacttacaggcttccgagtctttgcggggatgcagaccagactctcctgctctgcaacacaccagtcatactgatacattggaatgctcttggtacctggtgtgtttcccatgtggtggcagggaagaacagggttctttggttattttgtgaacctggagccagcgcccttggagaagattctgtcacttgtgctgattcaaaaagagagttgcctaacgaagggggaaaacagttatggaccaaggcttgagctgggcagttccaagatgcagccttagaaaatgtcccccaagggcaccgtgtgtacatcaccagtcaggaaagtttcctcttcccctgtcttggtgaggtgagcagcacattcgatttcagctgctggggcctctgctctactccattcctcagctgtgtttgctcctctgctctcagagcatttgcacttggtataaactgtgaggcacggtctgagcagacatactggttactaataaggaaactggcactgacagctttttagtctctgatgagagaaaagagatgtcttcacatcagaacagttaactctcagtgtagcatatccatggtgaaatttaaagagaaagagagaaa

SEQ ID NO: 26735 - DNA, 1790 bp, Bovine  19866880614167
tggtaaagaagctgcctgctgtgcaaacccaggccctagttcgatccctgggttgggaagatcccctggagaagggaatggcaacccactccagtattcttgcctggagaattccacggacagaggtccatggagtcgcaaagagttggagatcactgagcaactaaccgctttcatttccattcatcactaagatattttgttaaaatgaaggttctgagtcataacatctgggctaaggccagagattcttcatttctaacaagctcccagatgatactgtactgctggtcaacagatcacacttttcgagtatcaagaatctggaacacattgcagagaatatgtgtgtagtcttagagccagagtttagatctctcctgctcccacacttcctggctgtataaccttagacaagtcattttacttctctgagcctgcttctgtcatcagtggaatatagtgaataacaatagccaacacttactgaatgcttacaatgtaccaggaactaatgcttcatgttcatcaacttatgaataggacttaagttaaacaacctgaccaatgtgggtacaagaaacccagatcttattctaggtagcttgattcaagaacctggtatttaatcactgtataagactgccttttcagcagagttcccagagccatgatgagaattaaataataattcgtatttagctcacatttattgagcactcatatgctcaagaccccagtgtaagctcccctgggagcatattaactcatttatcttcacggcagacctgggagggaatatttgcaatcccatcttacaggtttaaaaataggcacaaacaagttacacagccgaaggtcacaacaccagagcggtcaaggtcggaacccaggcggtttaacagctgagccccgcgctcttctgccatcagccaggagaggaagtggccccggattccggggaccagatcgccgggatgggggcacagccgcgccccttcagggcggactaacctccaggcccgctcgctcccaaagaaaaccaagtctccctctccacttagctttctgtacatccccggggtgaagtgcccacacccaggggcacaccatgaacaggtgtcagggctctggtgaaaatgactggctaaacatcttgagaactgactttctacacacactaaaactaacagtcgctccgggacccccttaatccgcggcccccaaacttgcccagctcgcacaggaccactccctcccgcagctgcatcctgggagccaaggtcccaatcaggcgtcggaattcgtagattcggctccgcctacctccggcctccaccccaaaggccgcctctaatctcatctgctctctaacaccgccctctgccggccgttcctcgggtagccggctccttgagccccttccggggtgccccggaagcggaactttctcttccgggtcgagcgtccgggaagtcgcacgtgtttgtggtgcgcggctttaacccgtgtgggaggagacgtgactggaactgtctcccagaggcagcgagccgaaccggagccatggagggccagagcgtggaagagctgctggcaaaggcggagcgggacgaggcagagaagttgcagcgcatcacggtgcagaaggaattggagctggagttcgacctgggtaatttgctggcctctgaccggaaccccccgaccggcctgcggctcgcgggacccacacaggaggccgagctgagggccctggcgcgggacaacacgcagctgctcatcaacca

SEQ ID NO: 26736 - DNA, 1159 bp, Bovine  19866880661173
tgttttctatctattcttccattatttctacatctttgaccacaccggggtagaccttagctcttgctatttagctcatgctatgcccttacttggagaaggcaatggcaccccactccagtactcttgcctggaaaatcccatggatggaggagcctggtgggctgcagtccatggggtcgctaggagtcagacacgactgagcgacttcactttcacttttcactttatgcattggagaaggaaatggcaaaccactccagcgttcttgcctggagaatcccagggacgggggagcctggtgggctgccgtctatggggtcgcacagagttggacatgactgaagtggcttagcagcagcatgcccttactaggtgctgaacagatgtttcttggaccacatataaaatgaaacaggcaaaagaaagtgcatgtattggcgatgatgtagcagtgcagcaggacagctgccaggccaggtgaggcaaagatctaagagcaaatggcctcagaccacctcaaagcacacacgctctattttccagaacagaatctgctggcagcttgctagccctgtctgcctcctagaggggacagatttctgctcccccccaaaccttttcctttcttttttgagacccaggcacctgcatccctctcatatagaataaaggaagaattggaaataaaagacacgcttaaagaaaagaagtactaattttgaaagattatgctgtggttaggttaatcttacaatcccaggagtttagttttgatcactttctgcttatcatttgcttaaaaaaaaaaaaagacaaccatcatatttaaaacaagctataggaccttgtgggcactaagccagtgtcttccacgcttggatgagcaaacaccccttcagaggattcactaaaacgcaaaacctgaaattgcctgctccagtggttagaacttcatgttgccatttcaccgggcatgggttctaaccctggtcagggaattagatcctgcaatcatgcggcggggtcaaaaaagaaaattgcagaaggtctgggcagagtttatcatctttacaattctaacaagctcccgggtgacgcctgtattctggttctgtggactacaccttgagaagcaaggatttatacatattttcaa

SEQ ID NO: 26737 - DNA, 2776 bp, Bovine  19866880717074
gtctcagtggctatggtcccatcaagattgttcgggtgatcaggaactcttatttgtttgctttagcttttagttcttggttatatcttcaaatatgagagagctcagaggctcctgctgtcccggcaaaggaattaacagcaagcagactccagttttttggaataattacgagtgagtatcttgaccaaataaaccctgtagccagaagagtagcttcagctgtgctgagtttttctgcaggtctggccatgccagctggttcagcgcacaccaatcctcattttgtaattggagcccagaaaaaaaccctgtgggaccggctgggtggttgtacaatggcctcaagttctcagacaggaggaactcccacttcatcaagaacctggttgtaggtggcctgcaggccctggatgccggcggctgacatttctatggatgagtgatcatgggcagccttgtgggagagtggccacatgcttgttcctagctggcggtgaagggtagctggtcatttcctccagcctcaatgcttcatcagagaagtcaatggcaccccactccagtactcttgcctagaaaatcccatggacagaggagcctggtaggctgcagtccatggggtcatgaagagttggacaactgagcaacttccctttcacttttcacttccatgcattggagaaggaaatggcaacccactccagtgttcttgcctggagaatcccagggacgggggaacctggtgggctgccgtctatggggttgcacagaatcggacacgactgaagcaacttagcaacagcagcagcaatgcttcatgccctactctcttaggggagagtagggtgcccttcccacagctcagcctgccccttgccgaccaccctttagtttgtgctcagagttctcagtttatcatgctttctttgatagagtaaagcaacagattctcatttttgcttatgctcatttgaattacatttctgtcaaatgtagtcagaaaaacgtgcaggcactaagctatgtaccagtgacttaaagagaaatatactaaggtctttatctccaagaacccatgttctagtgaaacagcatgttttaggccaatgattacttttgtggtcttccctggtggctcagatggcaaagaatctgcctaccacacaggagacccaggtttgatcgctgagttgtgaagatcccctggagaagggaatggctacccactccagtattcttgcctggagaattccatagacagaggagcctggcaggctacacattatatctcatttattattttagcaactctgtgaaatagatattatcattgtagtagactcctgtttttcacaatagatatatggagagatcgtgggaatcccaaagttgaaaatatagcagagaagtagaccttgcattatgtatcttaaattaacaaatggaagattgaatttgatggtatactcattcatgttatagtattgcaagatgcaatcaaattaaacacccttctattttatttattcaaaacttttattaagagctacatttttttttattgaatgtttttctctaagaaaataaattttaaccaaaccatgaaaataactgacataacattaaggagaaaactaagctctattgagttgtatgcagatgttgataagttgactaggtacagcagcctctggataaacataatttaaatggatacctcagccaaatggcacagtatttcatgtcacgaaccttcaggatgattctaatataaatgtagccatgaatcttaaattatggagtattcatatcctactgtatttataaatgaggaaacagacaatcagagaaagaaagtgacaccaagataataatacatcagttaaggaggctagacttgggcttcaatcatattggtctgtcttctggttcagaattccctgacctgttacagtaaggagagcaaagattcagctctaaggtgggttaaagatggtcacaaagatgttggcacttctcccactgcaagtgtctcttccactggaacctaggtgggctctgtgactgctttaaaggacagaacatggtgaagatgacactctgaccatcttggggcccaggccttaggaaactgatggcttctgctttctgtcgtttggaacactcattcatagaagccatcctccaggaagaagtatgaccaccctgagagcaccatgttgtgagaagtcgaagccctgtggagaggacctggagaatgagacaccacatggtgcatgaccaagaagtgctgaaacgctaaacatgtgaggagatacatgagccggcttgtgagtggacactcaaccttagtgaccccaactgacagcaaatggatcagaaacacaagttgcccagttgaggtcatccaaattctgaaccgccgaattctgagtacataaaatagctgtttgggatacataattttgtggtagtttgtaatgcagtaatcgaaaacaggaacggatgtagttgctctcattataaaaatggaaaatatgtggcattgattttgaaactggacagtgggctgagactgaaaaagagtgttaatggagaaagacaggaggttagtattgaggtttggcaagagggcaacctctgttttgtattcatagtgaagtgaggtggctcagtcaggtccgactctttgaggccccgtggactgtagaccaccaggctcctccatccatggaattttccaggcaagagtactggagtgggttgccatttc

SEQ ID NO: 26738 - DNA, 749 bp, Bovine  19866880756045
cccgtgaagctgcctgcggctcatccgtgtcccgggcagggacacgaacaagctcagccagaccagcagcagcccacagactcagggctccgcacacatgtgttgcttcaaaacactaactttggggcggttagttttaaagccatagctgatataactgagagaaaaggtaacaagttcccgtataaatattactcttaaatgtaaggttagaatcacttacctaaaaatctacgaagtttcatcatatctaaatggaagtactcaattaatccatggagactaaataaatgaaaggttaaacttactagactatttcctaaaaagaaaggagaggagacattagtaggaatacaagatattaataacataactgcactgtgcttccaaataagggtttgaatatacaacataaagagtaccaagtcctaccttgttgtccatctaaaatttacatcttatcttcccagttttgaattttaaatatcacatctttttttccattctaagaaaaaacttttttttggttttatttttcaaaaaccaaacaaatggatgataaataattagaattgatagaaaacttcgaaaattatccacactgcagtaagtttaattcaatttcccaaagcacttaaaacctccttgcaaccatccccctaactgagcaggtgtgtcccagagcaaagcgtcttgactacaaatgctgtattatttaacaattaaatagactctatatttaaaggtgt

SEQ ID NO: 26739 - DNA, 1144 bp, Bovine  19866880789375
cgatataaatactgataaagatttaagtataaaattaggattaggacttcccctggtggtccagtggccaggattccacactccccaatacagggggcctgggtttgatccctagtctgggaactagatcccacatactgcaactaagacccagcacagccaaataaacaaacattaaaaaaaaaaattacgattgaggattattaccattatttagtgaagcccaaatttatcatttacagcaaattaatgttttcagtgttgaaaagcatcaaattttatttttgaaagagacacactttcagtattatatctgacaccaaaagcaggatgagtttttctaataaaagttgtcttgctgaaatcataatttagctgctatgttttctagaaagtaaatgaaaataatctgtaccaggtatccaggtcattggttttacttaaaatgtaacctttctgttcccacatgctttagtaaatacacaaacttgtcatcaaaatgatgcaaaacccagctattaagtctctcccttaaaccccatccaaagtttaaagagagaaaaaaaaaaggctgtttaaaactcattcctagttttcacagattctttccctacttcagatgtccttaaatacaacctttaatctccagccagagttttggttgtggttaatacattaatgtgtccagtccaatatttacatatcatcttcagaggagggtagtcctggccctttaacctcaagctcaatgaaggcagtggccaaatcttgtgcatctgggtactgtatctagaacttagcataagtacagttcttggtttaggagaaggtccaaggatgaaatttacctcctcctctttcctccttggtgttgccccccttttctcttgccactcaggccgggaggcccggaattcatcttgcctcccagaccccctttcctcttccctccttggctgggagtgccccctttcctcttactcccgggaccctgtcggcccccctttctcttgcccttctgactcattttcctccgcttagccgcctcctcctggtcctcctctctcatctgcttattggtggccctcgtaatgtccatctgaggctttttgctgttcatcactcgcagcatctccaactggct

SEQ ID NO: 26740 - DNA, 1982 bp, Bovine  19866880801414
cgaaatcaaattaatgcaggcatctttaaagtcagatattatgttcatctacaacattttcatgtttaaaaagtacaaaataaaggaaaagggatattttttaaccttggagaactgtgaaggggtggacaaaaacaagcattttcgtggaaaaataaacattatctgtgggaagaaatcctaattaaagaaaatggaaaggcaaagaaagaacaaaattccttaatgtacaaatgctttgctgagtctttaataggtaaagagtcagggtcccaaactgtgtttcctggttctgtgatagtagaacttcctgttctactgtagaactgtagaacttcctgttcctgtagaacttccaggtttctgggcaggattctcaaagcgatgtcctgaggcctcagaactggggttcttgagggcagggctggtgatctgtgttttcacaagccctccagactctcttgggcttccctggtggcttagctggtaaagaatctgcctgtaatgcgggagacccaggtttgatctctggtttaggaagatcctctagaggaggagatggcaacccactccagtattcttgcctggagaatcccatggacagagaagcctggtgggctacagtccacggggtcaccaagagtcagatacaactgagtgactaacactgtcactttctttttcaatcatttctctaagtttttatgaagacatttaggaggttagcaaagaagtatttatgatccatgggaataatttcttcttaatttctcaaaggactgcttaatggaattgccctcaagtgtgttcatggaccaaaggacaattcctcccatccccacggaagccctatgttggggaaaagtttggttggaagatctggtttgtagttaatgttacccttttcacgtaattagctttgtgatgttgtgcaagtcacaacctctgtaagctataattttctcacccataaaaatgtactaaaaatacactgcctcaccgagctgtgaagatgaaatgaaatgatgtatgtgaaggtggcttgtaaatgctaaagcatgatataaaacgttagtcgttggtattagaagagtgcaatatctcgtcccaccttgagagatttcgaaagcacaattctctagcttcacagatacaagtcgtttcgtgcaatgaatgcaggtaatttttgaataccatatggggacagtatctagagaaagtgaagagtatgaaaggaaagaattccagtgagagcctccctctttatagctcattccttcctgtgcccgcctcagcaaacactggggcctgatttggcactgcagcaacactaatcccgggcttttgagcttttctccttatcatcagatctcatgggcaacgtcgggtcacccagaagtcacattactggttaatctaggattggtctgctagctcaggatttctgagttcaggctaggatgagaatttgttatttctggcagcctatacattgttggaaaaacgaatgattttcactgagactctgttctctttctatatttcaaattgttcgaatggtctctttctgtgagtggattcgggtaagaattagccccattaggtgcttatcagaaaatggcgatgctgacaagatccagagagtacagcctagagtgaaaatggcatgtccagaagggtaggggacaaccctgaaagcacccagctttgagatgtatctctgacacttaaccaccctgggccttgatttcccagcttcaaagtcaggcagttagaccaaaactgagtcatgaggtctcctacatctctgcccacatttaagattctatcattccgtgggtcagtttagagactagggggtgtaccttcccaacctcctaccatggacaggagaggaagtgctccactggagggtcccagatgggcctttgggaggagtaaggattccactctggacatcacaatgtccagcccaggctcaa

SEQ ID NO: 26741 - DNA, 2162 bp, Bovine  19866880949355
tttttgctaaataattagttcttgtaaagcatttaatgggcttccctagtggcactagtggtaaagaactcccttgccaatgaaggggacataaaagattcgggttcaatccctgggttgggaagatcccctggaggagggcatggcaacccaacccaccattgttgcctggagaatcccatggacagaggagcctggtgggctacagtcccatagcgttgcaaaagagccagatatgacggatgcgacttaggacgcatgcacatacaatgcatttaatatataatttacaaaatttcaattgcactagaaacacttcagtttcaaaattttaactgacctagaaacaatttctttgtacaaagtacatgtaggaaaccactaactttggattatttgctgctgctgctgctaagtcacttcagtcatgtctgactccgtgcgaccccatagacggcagcccaccaggctccccgacccctgggattctccaggcaagaatactggagtgggttgccatttccttctccaatgcatgaaagtgaaaagtgaaagtgaaattgctcagtcgtgtccgactccgtgcgaccccatggactgccgcctaccaggctcctccgtccatgggattttccaggcaagggtactggagtggggtgccattgccttctccaggattatttgctaggtctcatgttttcgttaacagaaattgttgaaactaaaggtctttgttcagacttttcactttctcttggttatttgtgcttctcttggaaactctagctcagcttttaaggccaagcataattctccaaagtaggagaaggtgtaagcaatagacctcattttaggatgattcagtctgggcgagagagcacaacctctggagtcaggtattcctcaggttgtctcgtcttcactcactaccacggagttcaaggaaaattttacttctctgaactatgtccttacaaattaatggcaataacaacacatctagctcacaagtgtggagaaggaaatggcaacctgctccagtgttcttgcctggcagcagcagctcacaagtgagtggtgagaagaaagtatatgttaagtacctaatcacaaagctcaataaatgatatattccttaactcctgagccatgattgtgtctgcttcttccacgggtgtaagcagtagtgaagaaggaaatggcaatccacttcagtattcttgcctgggaaatcccatgaacagaggagcctggtagggctgcagttcatggggtcacatgactgagcacacacgcgtgaggagggtggaggaagatgtgttggaaataatgcgctggcagtatacaggtagaactgaaaaaaaaattggaaaaattttcagaaaaggtgccttggtgagaaaattagatcaatatcagccttagtttttggagatgtagatcttcacagtgtgcctttatatttggcttaaagcatttctgaaagaacaggttgttatgccaaaatgggattacacaaatacattacaaaacaaaatatagtttttagaaatttcctaagatgtctgtgttattggtcctgtatataactttctgttcttcaaaaagagaggagtcatatagcaaaggggatcctcaaaggatcaccttacaggatctacactgaggagtccctacaacttgagttatgacacagtagaaaatgtctctgctaatgacttgagcgttctatttcttggatctgtgatcatttattattttaacctttcaaacccagtaattttaaagcattcgactcagctacagtacttttattggcctggaaatgttttattgcagcttggctgacattttcccttactaatgtcattagcactacttaaaaatgaattatgtaggggtgtacagtactacctttgttttgagaaaatcttacaatttttatgagcacatgaggtgggtctcgtgggagtaaacattagcaacatatatctttctgattcttcaggcatgcttacatttctaagaagcacaagtagtttggcttggaaaaaggcctggagttagatttatttttttcaagatcatgttgattctcataacatcccttaaagaaaagtccagctttcagggtcactaaggcttaattaaaatctctagca

SEQ ID NO: 26742 - DNA, 1285 bp, Bovine  19866881001228
aaaaacacacacatttctttgtccattagctattttttcttgttaaatgatatggaatgaagtatgactaatggacatattcataatccagcccaaacgtcccttttatggttgcctttcctgctgctgctccatacacacagtgtttcctaagtgttgaattattcttctgtttcttgaatatatgatatactttctcatttccagatcttccatcataaagtgggagaaataagaatgaaagtattagaaacattagacccaagctgacattgctctagaatctgtctcccaaccacatttttaaacgaataggaaaactgagtctggttcagggttgcaggacttgttttagttaatgtgaggatgtggtgggatatgacttttgacaggaaggagtgagatgcagagaacagcgttgacagggaagccctaccagtgagatgcaggaggaggggccaggtgcttctgagagtcgtgagttcattcgttcatttagtgtgtatcagtctgaatgtcaccaggtgagttaggcggtgacagaacagaaacgggtgaggaatattaaatagagagcagcttcattgaagattggaaatgtgaacatgcacggtgcgtttgggaagacagagcagttcagaatggctgacacatttgcagggctagcggaaatgagactgtgatgatcaggggggccagcttgtggaggggtttgcttatcatacttggttctctatttgaccaacaattactgaagacctactgtttgccaggagctatgccagcactggagacagaagagtgagaaagacagtgttcctgctctccaggagctacaggcatggaggaatggtgtgggttaaggctgtagactgatggaaagttcagtctcatggcacccaagccgaaggggactggaggcaaggagtccagacagataggaaatagcttcctgaattcaagggagaaatgatgcaagcctggactttggagagtgatggttgatggtaatggaaaggcatcatgggccagggagaaggtcaaggaggcaggacccagagagggaagcctgccaacagcctctgactgcatccatccttgtctggcctgaagatggtaataatgttgttgcatattagcttttgtttctgcttcttatgggttctcagagagagagtctaactgcccatccttcttcccatggcttgaagcattgcacctgtatttccagtaaacacagaatattgttagccacgttcacagtcaactagttcatcataattga

SEQ ID NO: 26743 - DNA, 1265 bp, Bovine  19866881126049
tggttgggatatgtaaacttagcctaaatttcttgaatggatatgcaataaatctatttataacattttctctgtcctacttaacttatgactaatcctaaacaattagagagtcagatggctgagtatttaaagcagccaaacattccaaacaaacaaagggtaatttctactgaaagctggagacctgagcccccgtaggtatatgtttatgggacaactcaggaagagctgcaaatggaaactgcaaaaggaatctccagaatgctgcagtctcaatataaggaaaaaaggaggtgccttaaaatgtaagtggcatggtcaccttggtggcagggccaggaggactctccacttaataactttagaagcaactttcactgttttctgtgcatctcatgaaattctaccatgtggacctttctcttaaaaattttaaaaatagaaacctttatccactgctgtctttttaattgtgccaacatctctaaaatccctcaacacccccctccaagataaatcttttataaagaaccctaagactatcatttcacgaacacttgaaaatattttcttaacactgtccaacagtgctcaaaaaccagcctgatacatatagagcctcctttgtggaataacaagattatttttaccattttccgaatctcacaaatctgacctgtcaccagagaacttctaaaaatatcaggattataatgatatccttcatcacttccctcctagcttgtgccttcattactagcgttgagtttttatgtatttcctgagagccctctctgatcacagcactcgtcatttcactgcttcaagatgtgggacagaatagctatcttgggaaggtggctgattttttttccccacctttaaagacaaggtgtttttgcaaaacattcagttcagttcgctttctgcctatctcttaaatcacgtgtttgagttggaagtgtattggaaaggatcctggaaaacaaatgctgactgaggaggaacttgttttttcactgcagccaattcaattcagcagcaacatttatcaagcacctactatgtactaggaatgtaaagatgaataaaatactctttgccctcaagtagctcacagcttaccaggatagacaatcccagtaacaagtaataacagcaagccgtgacagggcaataaatcacactgcacactgctgtctgtgtaaacatatgagaacacctgtaagggagcagcaaatagtacgagggaaatcagaaag

SEQ ID NO: 26744 - DNA, 1531 bp, Bovine  19866881165181
tgcacattagatccccaaattttgttcaataataatacataccatagacttatgatcattttaaaaaaactgaacacctcagatttctcacccaaattagattcgtttccagtgcatacaaaatctgattgaaataatcccacgtgaatggcaccccactccagtattcttgcctggagaatcccatggacagaaggagcctggtaggctgcagtccatggggtcgcagagtcggacacgactgaagcgacttagcagcagcagcagcagcagtgctgttttggcatgctaccaatatactaactcaacttccacacttaataagcacctacctatgaaaagcactgtggccacagtggtgaacaagataatttctggtctcacatttttgttttccaaataacaaaggtattctgcgagagaaatgtttaaattcagctaacaaaaatccccaaaatggccacacacacacacaaaaatctattatccttatttttcaaataattcaaaaacctcattatcaaccattcaagaaagtagtacatgacctgttttaaaacaaaaagttaatgcctcatttacttggcatccttgggagaactggtgctccacataaatgaactttccagataactcatgctttcccatttaagcaccaacacaaactggaggttttgtttgttttaaacagtatcaatctttaaacttttaaaaacagattctattaaatactattttgactaatgtcaaaaacatgattgtgctgtagacacttaagatgccaaactttttcaaagatgctggttttgaagagtgtttcttgcagtcttgagcttatggtgcatcagttgtcaacctttgccgctctcagtgtaaacctgactccagaagcctccaagccccctgcaaatgtgccgttacttggaaaaggagtttgtcagaactcagaggatctccaaatctcctttggctgctcagagtcttctgatttcctgaatctgttaaaaagtctacagttacaaactccaaagcaagttttggataaatcagttactgctagacctggatgaaagtctttatgttgatttcctattttcaactgaggctcagtcagtgataactgcattagctattcactcattcaaccagtatttactaagtccctactatgaactgggctccaatatgaaagtaaaaattgaaaaatgaaaagattgctagttgtgaacatattttaaaatagaagtactctaaaaaaaaaaaaaaaaatagaagtactctaaaatgacttctacttagtacctaaggaggaaaaaaacaagaacaggtttcctcaagtcttttcaatgaaactacaaaaccacctaaactttttataattcctgtagctctagacttagaaactcaagattcaagggtaaatgaagcttttgatttaaccaaatatttactttagaagctctgattaagggtccaagaatttgtctctttttcagtctattacaaattcccattggcctaaaacaaatca

SEQ ID NO: 26745 - DNA, 943 bp, Bovine  19866881323458
aaaaaaaaaaaagtcctggtttcaatgtggattggaattatcaatagaaacaaaactgcaaagagggaactcaagagatggaattatatcttatgctctgtctccataggaaactaagctaaaagactataattcctggaatcttgaaattctgggtgtaccaattgcactgaaatcgaaatgggtatgataattaaatgacagttgggtttgatcaattagatttcaatttgggggttgagaaaagaggttttgggggacccacgtataatatacaaaattaattctggtcaatagtttgccctttcttccattatctgctactttataagcaaactttgttttaggcttctgctatctacctgaccaaggccacagtctagtgagacaagcccaggaaagacgagggggcacaaatagacgctgagacaagaatgctggctgcattccttggcctgagcccttgtggagggtgggctgagctgaaacacgcactagatcgggcccacacacagagagctattcctttgcaaacctgaagggaactaaaatccactgcttttctctttttttgcttttgaatttatccatcctgtgaagggggaggtggtgcccactggctcccagcagaccacagagtctgaaactccagtcccagcagcaacggacactgcggagcccttgctttaccctagttggtataaaggccagacccggaaatccaccgccaacccaccttccgccccagggagcggaagtctcgcgcgcgtagggccttcaggttccaaggatgttcatgcgcggaaggctgaaggggcggaagccgcagccagggagagggcagcagtgagtggtaaggatgctagctcacctgcagctacttctcaggttagtgtcaatgaatgctctggggtctgaatgctccctgcgccgcctggtcctg

SEQ ID NO: 26746 - DNA, 849 bp, Bovine  19866881379749
caatttgtaaaataagataacctaccccccaactggggcctccttggtggctcagatagtaaagaatccacctgcaatgtgggatacctgggttcaatccctggatcaggaagatcccctagagaagggaatggctacccactccagtattcttgcctggacaatcccatggacagaggagcctggtgggctacagtccatgggattgcaaagagttggacacagctaagcgactttcattttcacccccaaattgtggaatacctgaatataacaacataatcttaaaaactttaaataattgtttttccaacttaatatccacagttcataaataattaattttgtcttaacctacctgctttctaatggcatatgtgagaataaaccagattctctcaataaccccactgcagatctccagtggtgattttccagaactgaggtattctaccaaaaaaacaaaacaaaacaaaacaaaaagggcagatctgaatcagcaaagggtaagtctttttctgaacataaagcaatatttctaagtaatatcaagctggttaaaattctaacattcactgagaaccaatttacttttactcctttaaaacgtgacccattttctagaatacaagaatattaaacttagaggaagagcttgcactcaccttgtataaagttgccaggtaatggttagttttaatgaggaaaggttgattaacacctggatgatccagatcatgagtggcagctgcaattaagctcagcaagacgtcccaaggagttacagagttggcaagctagacggtggcgaggaataacgattacagacgtgtctgcaacgaactgtac

SEQ ID NO: 26747 - DNA, 646 bp, Bovine  19866881403630
aattcttgtttttgtaggttgaaaataattatcaatttcatagggttcaacctaatatataatattatgctttccttcttttaatggaaatgtcatcatcaattctattatcaatgtcaatagccttaaaataataacatgattatgacagctaccatttattatatgcctcctgtgtgccaggtgcgattctgagcacttcacatacattatcccaatcttcctatcaactctgagtaggtggcctttcccatttagtagacacagctttaaagcagttaaatgacaagtctgaaggcacccaacccatagctggcatcatgggttcaatgcctatgtggtatctactcctttctacagaatattcagaacatagagaagatccaaggctagtaaataaacttcatcacaaatgctgctgctgctgctgctggctaagttgcttcagttgtgtcagactctgtgcgaccctatagacggcagcccaccaggctcccctgtccctgtgattctcaaggcaggaacacaggacataaatgattggcacaggctgcgtggagtgctgtgtggggctggaatctgagataaaggaatggtagtgatcaattggtaatgtctgcctgtggagctgattaatgggatgtgc

SEQ ID NO: 26748 - DNA, 1251 bp, Bovine  19866881461895
tagaagacaaggtgtctttgaataacttgcctaatttttcttcagtttgagtagtgttttttttttcctcccccagatctttctctaaggcggctctatatttcagtaggaaatgccaatgttgatatgttattgttatgtatttatatcatccacagggctatcagaaatcctgatgatcttgaagcaaggtctaatatgcacttggcaagtgcttttgctggcattggctttggaaatgctggtgttcatctatggtgagcaaatctgagattttatttcttcacctaagctattgctctaaaattttattttagtgtctatcatttgggatgtgttgtaagattttaaacatgctacagaaaaaagaaatttaacttagggtcccataatattttcttagctcaaatgcagtttattgggtcatagattattttttctttttggtaacagccttattgacatattattcataccctataaaatttgcccattaaaaatttataattcagtgggttttagtatattcacaagttgtgctaccattacaataatcaatttagaacattttgtcacctttgaaagaaatcccatatatcttaactgtcaccccacccaatcctcctatacccccagtcttaaacaactactaatctactttgtctctatagatttgccttttccagacattttatagaatggaagcaaatgatatgtggtcttttctgtctggctttttaaatttagcatcatgtttccatggttcatcccatacacattatcagtacctctttcctttttcttgccaagtaatgttctattgcatggatataccacattttatttactcatcagacgatggacatttgggttgtttccactttttggctattattaatagtgctgttataaataatcatgtataagttttcctgtggacatacatttcacatctatggggtatatacctaggagtgaaattgctgggtcacgtggtaactctgtgtttacattctgaggcactgccaggctgttttccaaagaggctgtactgttttgcattcccaccagcagtggatgggggttatgatttctccacatctttggcacctgttatggatttttcaaacaccaaacgtaggattttcttcttctgatctctctcaaaaagaaaggaattagaatatttgttgatagcccagaattaatctgttgatcagaaatgtatggtatgtgctttaaaattaaaac

SEQ ID NO: 26749 - DNA, 1241 bp, Bovine  19866881626145
tccattaatataccatggatctcatttttaaaatttttacagaggaattccctgacgattcaatggttaggacttggtggtctcattactgcgaccctgggttcactccctggtcaaggaactgagatcccacaagttgtgcaatgtggccaaaaagaaaaagaaaaaaaaaaatctttcaggattagctcatgatggtggacaaaatttttcaaaattctaatactcacttgaaagtttgaaatttatcattgacaacaaacactgttgttttccttgaagaaagatggccacttgggctggccaccacacagggtaatagacatttgttgctctattttgttgcccagcatctgaatcctcttataaatataggtattctttcattttatgagtcttttggagaggcaatcttgccacctcctatgaaagtcaaggaacaagtaccctgtgaccttgaaccctgcatataatctgggaatagccaaatgtacatgcctacctgagactttagacctggagcaagtaacttaagatgaagaggttgtattggcttgttagttcagcggcagtggagtatagtgataataaaggtggtggcatccatgccaaatgcttctgtctagcctgtaggttaccctgcccatttccaggctccgctccattttgtacatctccatctcatcatttgaaaaattgtttttgttgtcctctttaaaatagtcaaatttgtttgaaaagaatcatgactgattcagaagtctgaaatctgacctttgccctctgatatggcaattgccttgtacagtgaagatactgactatggggtacaaggacacttctagagaagagaattgcatgaacaaaggtgttggggtgggaaattcactcgtttaatctttcagtgtgtatttgctgattttccactttaggtaagacatcattcgagatactgtggatacagtagtggacaacatgagacattaatagttggttagggaaagggaaagggggtgagaaaaaagggttaaaatgacaatcatattacagaaatgaaattggcaaggctttgttaccgactggatctagacagtgaggagagcggagggttttgcacccaaatgaccaggaagacagtggtgtctttaccataaggagaacagaggaagaaagttgggtggggaagatgaccatttccactgtagatttagtgagtttaaggttaaaaggggcaacttgat

SEQ ID NO: 26750 - DNA, 2217 bp, Bovine  19866880182519
caggagaaggcaatggaaccccactccagtactcttgcctggaaaatcccatggacagaggagcctggtgggctgcagtccatggggttgctaggagtcggacacgactgagcaacttcactttcacttttcactttcaagcattggagaaggaaatggcaacccaccccagtgttcttgcctggagaatcccagggatgggggaacctggtgggctgctgtctatgggatcacacagagtcggacaccactgaagcaacttagcagcagcagcagtgtatgatccttgctgatgtaaagtattaagatgttatcagggttcattttgggtacgttcactgcaaaccaatggaatccaataagtcttcatagagaaagaaagactgaaattggccttgaaggatgccctcaattttcaaggggcaaaagagaaacagggaccacttctctatatagagaaaatgtctgtctatcttttctgctcctgacatgggttggcttgtggggcaggttgtccccgtgactcagaatagaagcctaatattgctgacttgggttttcctggtggcttagcagtaaagaatctgcttgctaaagcaggagacatgggtttgatccctgggttgggaagatcctctggagaaggaaatggcaactcactccagtaaactggcctggggaaaccccatggacagaggaacttggcgggctacagtccatggggtggcaaagagctggactccacttagtgactaaataacaacaattgctgacttaactgagttctacaactttctcgttttataaatgaggaaatcaagattcagggcacaaggtcacagactccaggtcttctgactcttgatctgttagtcctcctttacattctgtgtttaaaacctcctataattacactactagttctcgattggtcaggagttgacttcagaccataattgaattatgactaatgcaatgcaaagtgtaagctttgcatgagccataattatacaagaaacagttgttgattttaatttttctctactttggaactttctgatttagtgaaatccccgcagtaaataattagttggtatttgcaatgcttactctcttgagaaaggtgctatattaatacaaagaaaaaggccctttggtttcaagctcaagtacctctgagcctggaagtatcaattagccagcaaaataaactcatagaacaaaacttgatttgttgatctgatatacagaggagtcaaggcaaagacacaataatccaagtgattgggcctgggcaaaagagggaagactccatgaaccaccagaaaggactcttgattttcactcaatttttgatgatagttttagcaatatctgcggaggggggactatggtattttgagccacttttgtgtgaagataacaagctctgtctgtcatccctgtgcctcattgagcggatgctgtaacattgcagcgaagaatactatcaccaagttctagtaggtggaacctcaaggcagataaattgtcttttgaaataaatggaaaccatttgatcatagcctgagagattgcaaaaatcaggcatatattgaaaaagaagaatgggttttctcatagggcaactgggagctccaggaaataatgtgtgttacagtaactaaccgaatctcattcctcactctggaaccttcttccttgagtaaatactgtatattagctcttgcttggagctgcgtggaaaggcccagtcgtgtttctgggcctgagcctgggactgcaattctccagaagctgatttcttactgtcggccttgatttactaactggcccatctcctgcaattccagccatcaccctttggggttcatttcatcacagacctgcttcctccagccaaatgccacttctttcccgttattccacttctagtagaaattccaattttttttttttaggttaagggtttgaaaccatcaacttagagaaagtatttctttctgtttccaaattgatctctccttttctcttgaggatccacatccttaagccatgtactgagaggaggctgtgtgaatactggtgctcattcctggaaccctcaaagaaactgggaagtgatctcagataaagtatcattgtctctatttttaggatgaaactaaagaagcccagagaacttatcaattggggtcagagccatattaacgtaaa

SEQ ID NO: 26751 - DNA, 2580 bp, Bovine  19866880357450
cagagaccctgattttaaaaaaaacaacagcgagttttcgtgttgagatagaaaccacagcagcgttgaaagatttatttcctgcctttataacctcaaggccaggcccatctctgcccagtagcccagttgcatgcatgcattagtgtctgcacgaatgccaagttgttctgtgatctcctccccttcagctcatgtaacttgtttaaactcagtgatgagggggctgaagttgggctcctttttagcagtgactttgggaggtagggaggactttggtaagacacgatgctgggctcagctcccctcgtgagtgaactgagataagaaatccaatagaaccagacattagagtgtcactgtttgtgtctgggagcgaagggttttatttggagacttgagaaggagtctctgctctttataaaacaacagagggaagtttagcatttgcgtgggcagctttcatcggggagcagatggggctttcaagacccaggaaagttgccagatgccacatgtgccttggaaggcaaaggccatgttctgtaaggagctgaacggaacaccggttgtccctgggccttgggagtcatgatccttcccaagaaggcataaagctcccctgtgtcccccctgcccaggaccaccctcagccaacactgccgacaagagcaaatcaggtaggactgatgtctcagaaggacagctggcagggagatagggaagaatccagatcagattaatgatctgacttgtcgtattgtcagagtggaagggcatgggcctgggggcatgcaacaaccttggtgcagcctgagtggatcacctttttttcttttttttttaaatattattttgatgtggaccatttttaaagtctccattgtatttgttacaatattgcttctgtttcacgttttggttttttggccataaggcatgtgggatctcagctccttgaccagggacggaacccacatcccctgctttggggggtgaagacccaaccactggacaaccagggaggtcccctgagtggatcacctttaacctgtgttaagacttgatcattattaccttgaactagttctgggagaggctgctgatagttggtaacttagctctgggctcagatggacacttttttggcctgcgtttgggctgtgtgtggtttgcccatgttgcgtcacgaactttcaggttcctaaggagctaaagacttccaggtggtgttacctgtctagcgttggggcagcagcaagcctatgatattcctctgatggtttgaagtgtgtagcagggctgctggaaaagacatagcctgagagcctgattcaaccttcacatcctgcctggtttggcagaaagaaaattaagggtgttctttgtatggccttagtcaccctccctggctacacgtgcgtgtttgtatatgtgcacttacgtgtgtgcgtgtgtatttgcgcctgcatatgcttcgtctgtttctcattatggcattaagggagaatttgtggagagtatgataatgggtattttccttctatacaatgaatctcaaaagtttaagagtgctaaaaagtataaaagaagttaggcatgtggctatgatatgagtaggccctgcagtccatctggctggtttgactctcagttctactccacacaccagctgtgtgatttgttgttgttgttgttgttatttaacttccctgagcaccaagtttcttatttcaaagacccggttaatcatgtaacttaccttaaagggttatggtgaggcttaaatgacataatccacggaaagtacttggcacactgcctgtcccattgtcaaggatttataaatgtaaattaccactgtgatgaatcaatatccctattaaactctcagtgttgtattatggatgggcatcctgtgtttaagtctttgctgaactcatgcatacttgtagcttcactagcctttggagaaaacttaccccagatggtgttcctgggcagcaggaagcccctgtgaacagcagcccttgtcccacatggcaaactgagtgcccgctggcttgggattttgagtgcctgtcctctcctggcctcattccaggctggcactgctggccaacgttactagagctctattctcaactaaaggatcaaagcaacccccctccaggatgaatgcacttccctccatgagttttaataagttaattatctaattgaaaaagccatgcaaatggcaagagatgttgtgggagagagtgcatgtggtgtgcaaatgtgtgtgtgtgaatgagtgtgtttatggctgtgtgcaccctcatggagtgaggtgaaggaaaatgaaaaccataaatcccacactgctgttcatggagcatctttggagtttgaagattatagtcgaactctgccagttcattcattattgaatcctttaattgacgaccgtggtggaaagacgacagcagcacatccttggcagggaggcaaattccatttgtttgtttattacagttgcacaatttatctagtggagagcgagggatgggaggtcacccgtgcttcatgggtcaatat

SEQ ID NO: 26752 - DNA, 1637 bp, Bovine  19866880556628
ctttgtgctggggagagtgcttgcattctcttaggggacagaaaccacctcatgtggagacctgctgtcagtcaaggagaatctctctgctgctgagcagcctctgtctgcacaaagagcctcctgctgaatttttgcagatttttactcctcttggagctgggagggaaagtggttttttgagtaagattgctgatcaacatgtgaaatcttcctcaggccatataattaaagtctctacatcaaatagatcctataatcatttcttagcctaagcagattataggagctagcaaattaaggcatcaaaagatccacacacaagagatccacaaacatcaggtttgccctcatttctagataaaggctaatatgtataaggtctgtagggtgtgatttgaatggaagttttcccttcatttttttagatcactgctcagagtctactgacagaatacagggagacagccttgattagattagaccagattggattaaatcaaatagttaaagcctttggagcctctagcttgtaggagacaccataatggccttcatagcgtccctaaatcctattaggtaagttaatcttattgaagaatttaggtctgcataaagtagcattgctctttatggggtggtctctggctcttaaggtgagctgttggtaactttcttggaataggttggttatgtgggtttggggtgagttattctaaacagcttgaaagtagatcctgcagttgatagaatatctcttgtagaaaactggtctgtctcctggctgctctttggcaaggttgctgttagtgtctgtgccaggggtgtttttagccctggtttgggggaaaaatgggcttcactggtggcacagatggtaaagactccgcctgcagtgcaggagacccaggttctatccctggtcacaaagatcccctggagaaggaaatagctcccactttcagtattcttgcctggagaattccagaggagcctggcaggctgcagtccagggagtcgcaaagagtcggacacaactgagcgactaacacttggaggtaaagagagtcaggagagatgtgtaaatagttgtaaaatcaactgctgtggcatgtggggatggattgatgggtgggagctttatttttaagctttgtgaaatcatcttttatagcctgtatccgttttagaggttgtcattaagaatcatgtgctgagtatatagcatggttgacatattgtattaaatgttgggaataaaataaagaatcttggaacttgggagctggaagcatctttgagatttttctggctgtgtttgtagttttattataagtttaagttggctcttggctgtttctacagatgcagtgaccatatttttctgaagtaaaacatctttttcatcacagaaatttttttttcaatttgtaaattatggacaggcaaagttttacaaaggcacataaattgtgtcagattttatcttagatttactatcttttggaaaaagaagagagtataagaaattgagactgtccaactctgagtgtgtgctttactgcatccagtgaggactatggtgggggtggggggagaagtaaattagacttacatctttgttacaggttgtctag

SEQ ID NO: 26753 - DNA, 1117 bp, Bovine  19866880562813
cattttatttttcaagatgaagttgcagtcaaagtcttttcactctttcacactgagattttggcccctgttatacgtggattcttttaaagtagctcatttccattctccgatgccagtcagagccttctgtgcacgttgctctgcactgctaattgtgcttccacgggtgagggggctatacccaggcaactcactcaaagtgcgcttcccagtgacttggtgaccataaccttcaggagacaagacctgaacgtccacttgaattaatgtgctttgaacttttaggattctattagccttgactgtccagctatgcttattaatatggtttaatttatattgcttaactagaaagagtcaaggggggaggtttggggattccccttcctggagagctttgaaaaagaaatagaggagcatcagttctagactccagagactttcatctgcttgtaggtagagggtggaacttgtctgacgtcttcgaagcatcgtctggttatggcatgttcataagagccctggcatctccgagctgggactttcaacccccgacaacctctctttgccatttgcattgaccaggtagaaagggaaatggtacggtctacaatctttggagttggcactgattctcctctcctttggtttctgatgatgggctggctagtttacattcagtggttgagctaactgctatgctgtggatgcagaggaacctcttagccctctcctgtccacttattcttgctctgaccaccatgctgctgggagctttcattcttttctcatttatgtgttttccaaattagtagtttgctcttgtgtgttgacctttttaatattctgtattttgattggttggtcttaccattctctctcgttttcagcctggctaaccctccagggaagaggtgaaacagctatccaataaaaatacaaaatactgaaaaggtcaaaatgcactattacaataaattaccataactcaaacagggaagcaggcattaaaattctgatatgtacaaggagggagattggcgtaagagttgaaaatggcattgcattaatgcgctttggatggtcagagttcacccaaaagagagtaaacatt

SEQ ID NO: 26754 - DNA, 2392 bp, Bovine  19866880833056
tgttgtattttatagatttggatacattagctagtggtcttgcttatttagcaagcattaatttgaccatctgttatttgccaggttctgtaagtgaagcactggggttactgatgcttagtacctgacctcattctttcagagaatcatgctaccagctgcctcagggcctttgcacaagctgttctctgtgcccagactttcaaatctaggtcaagtgccagtcatctcctgagccatggcacccctcctccagacagaccacttccccctattgtagcacctgtggtctttcttttaaaacagcttagtttgcaattacctgtttgtgtgattttattagtgatttgattatttgttccctaatttctaaattccatgaagttggggtctttttgccccacacagttgttttctcagcgcctgtaggatagtgccgagtttgtacttggcatataaagggtgaacaaaaaatatttgttgaatgagtggaaccctgagaacattgctttgcatcaccaaatgttctcctttaactggcaacattgggaggtggggtgtccttcaactagaaaagggaggaatatggaagagtgggcttttgaggtttaggcaaagcagatattaaaagtccaaggtccccaaatttggccatggttaaactggggaagacatcaaggagcactgtgtgtgttagttcgggagtgtggagatattggaaagatgtagaagagataactgcccccaagaatgctggctgttaagaaaagagagagtggtattttgagaatgagaaagggatgaaggggaatttttgttttggtcttactgtatttttaaatgtatgttcaggatcatagaaaccgagaaattgtgtgcagatgaggctccaggaaggaacattttcagtgtaaggaggaacacatccgtctgtgcgtgcttagtcactcagttgtgtctgactctttgcaaccccgtggactgtggcccaccaggtcctctgtccatggaatttcctaggcaagaatactggagtgggttgccatttcctcctccaggggatcttcctgacccaaggatagaacccaagtcttctgtgtctcctgtattggcaggcaaattctttaccgctgagccacctgggaaaccccaggaacatgttcacttatgaacaaatgattgaataccaaatcatttattttattgcttaatgtgtatatttctcagggttctgaaggactttgacaggtgtcaatcagcccatgaggaaaatgggctcagagttgcagggacttactctgagttttgtagtgaataatgtcagcgtcagaacccaggtcttcagcatctcaggatgccctgacctgcctgcaggcacagagctcacctgtgtcctgtgacttggaacacttgtctgtagttcctataggtgctgtcccctagtctagaaaatccattacccttttcccaccctctcccctcccccggccacagccaggaagaaatgacgagttactgttgatcttggtgatatggttgttacatattttgcaaaggagatgggaattaaggaactcggggtaagaggaacttggggtaaaaatataatgcactaaggaaatattttaatcttgtgaattgagtttctttcactctggctcacctccacctggccctcctggtatgttcagtgcatgcacttagtactccttttctgaaacatagttggtgtaccattttgagaagcaagtgtattaagcctgctagaggaatagtgtgtgctggacccagagcagaatcaaatggaaagctgctgtcccaggcagcagtgaaaccacttctattggacagatactttgtgctttgttgagttccccatccgcattccccccaacaagattagaaaggatacatctgtggtattacggattcagaaaattttggtttagtttcaggtagtctcatacctcactttcttgcctttaccgggctcccttctagtaaccccatttagcctctattttgggtgtgacgctagctacctatgtaaccaccacttccctttccttctctctcttttttcctacagaaagatgtagcacttaagcctcaggaacgcgtggagaaacgccagacccctctgaccaagaagaaacgagaagcacttaccaacggcctgtcctttcactccaagaagagccgactcagccacccgcaccactacagctcagaccgagaaaatgaccgcaacctctgccagcacctcgggaagagaaagaagatgccgaaggggctcagacaggtgagaacgcttagggcttgttccgtcctgtggctgctcttcctcaggtgcctacttgtctgggttcttcctaacaggggagaggagatc

SEQ ID NO: 26755 - DNA, 1378 bp, Bovine  19866880854867
catgagaattatagtgagcttagaaaagtaaaatttcaggctaatataaagaaaaaattacctattatactactactcagaaataataatgactcataacttgttgaatttcatgtatttatacatactgtacatattatataaaaatatacaaattggcatcatctgatataaaagaaacataatattttgcctttttctatgcataaccttcatcctagtcaaccttcatcagcctctaaggcccatctacctggaggggtttattagagaaagaaaccacagaaactaaagtaaaattcagcttctggaattcaaaaataggattttgccagataataccttgcaattccaggtattatctaaagaaagctttgtctaaacttcttaatctccctcactccaacacattccaaaccaatgatttttatgatccaaattaaacgtatatttaagagaagcaaaacaaagtaatctcactgggctgacagaccactagctcagtagttctcaaagtgtggtccttagaccagcggcatcagcaactccagaaactctgggaatgaggcctggtaacccgtgttaacaagccctccaggcgattctgtcacaagtgtaacaaccacccctctgacttgaacttgactttgacctgagccatagaaaagtgccctgtgtctactggtagcacttcattttagtggtaagcaaaccacccaaaaggaatatttgaaattctgacttgaaaaactaaaaacatagagtgatgatattaaaacttttgatacattctctctctgtgatatatcaaaatgatgatcagtgatgaacacagaatcacaaaatctctgatacagaagggatctcagagaccatcaagtccactcacccattttataaattggaaaactgaggtccgggaagagttcatgtggtcctaaggtgccacctcggtgggagagccagaccagaacgaacgtgagaatccagattcgtggtccagctgtctttttcatgagatcacatttgtgaaactctgaaaaatataaagtgtaaagtggttacattatatgaatattgaattgagttcagatcatttgaattccaaatcctaaagagccaaagttaaatgtatgtgcaaatttgttctctaagccctgtccaaatgcaaataaaaaatgaatgaacagcattgccttagaattacagaacacttcagaacattgttattgatattaagaaatgtaatgaaaaagcgtcaggcagtagcctccaatatcttcttttttgtgttttcttcccaaaatgtatgtgatgtcatagaaatctgagtgaaatttcctctgcctataggatcgatagacctgagtagagaaag

SEQ ID NO: 26756 - DNA, 1588 bp, Bovine  19866880877716
ttgtggttgcttactttatttttattgttaaagtgtcctatttaatgtgccaaactttgctctatacaccatcgtgtatggcttttagggaaagacattaaaaaaagagagagaaacatgaaccagcttacattagggattcctgagaaactgatggttatgagaacatgtagaacatttacactttatggtcatactttgcttcgtacttttcaggatgctcctctaactacaatatgttattctggtttcttcagatcagcgtctgcagttgttttctgtacctggttctggtctgcctctcatgctggaacactggggcgtgagaacagatccttcttctttgctgtctccccagcacctagagcaacatccaacacagctgacacagagcaagcattcaaaaaattttagtcgagtaaaatgaatgaaaaaatttatcttccaaatatcagtaatgactatataaaatttggtgtgctaccatttatgtacatttgcttttgctttgtgaccaggttttcacccaggttttatagtagttggttatccagggagaagttgatgggctacttttatttttaaaaagaggggatactgccataattaggttgaaactgtaagggcacttatatacttgtcctgcatcagtggtaacttttttgttttataataaaaagccaccataaatgattattcccacatctgaggcagacactctggcacctacaagggcttggctgagatcctggggccctgccaggagaaagggctttgtcctttcccccttccccacttcattctactgtcctgccccaggctgcagtcccagcagtaagtaagctgtggtagcaagtaattttggcagtggcaagtataacatattttggtgatttctgcatgatttgtatgactttctatatgacagtagtcacaacaaaaacatttcatgacttgtgtctaaagttatcagtcaactggagctgtgaaaatcagtttgcatatgtcaacaatttaatcttctaatatacttgccaatgaaaaaccaacactagaattatttttctgtatttattgactagaagaaagatatggctatcaagtgcactgattgaaaaatctttaaaatcccaatctttaagttgggaccatatgtgtgttttctttccctagccaaatctatttgcacatttatccacacatgtgtatatgtacacacacagcatacagttacactgatgagtgtttgtgttacattcgtatgtgcccacgcagagcacatgtgcttcatgcatatgcatgaactttgaaatgtaaggatgtcagggaggttcccttttaactgagaataatacaattatctacattccaggctcctagtaaggattaaattggttattgtgtatatagtccttagaacagtgcctagcatgtagtaggtcttttataaataccagctttctttattttcaagtatatcttcatctgtcagcctaagcaaaagactactggtctctctgtcacttcttcctgtaacagtttagcttcaaaggcggagtggtgaagtctcaaaattattgtgtaattg

SEQ ID NO: 26757 - DNA, 1687 bp, Bovine  19866880911911
aaatgttattcagccttaaaaaaaggaagggaaatcctgatatatactaaacttggatgaatcttggggacatcatgctaagcgaaataagccagtctcaaaaagacaaataccaaaattccacttatatgaagtacctcgagtagtgaagtacatggagacataaggcaaaatggtgtgccaggagcctggcagaggggagagtgggaagttagtgcttaacgagcaaagacttttagttttacaagatgaaagaaattctggagattggttgcacaacagggttagtgtacttcacactactgaactatgcatttaaaaacagatgagatggggcttccctggtgactcaatggtaatgaatctgcctgccagtgtgggagacactgattcgatccctggtccaggaagatcccacataccgtgagacaactaggcccatgtgccacaactattgagcccatgctctaaaacctgggagctgcaactactgagctccctcgccataactatggaagcctgtgcaccctagagccagtgctgttgacaagaaggcttcacatcgcaactagagagtaacccgcaaagcaacgaagatccagcatagccaaaaataaataaatatttttaaaaataggtaagatggtagattttatcttatgggcatttttaccacaatttttgaaaaactaagtaactggctggacttcacacatacaactgagaactttttgaaacccagttaaagcatttcccatatgatgcagcctatggggaaggtgtggatcaaagacaacataaccagcaaggagattttggcctaagcagaaaccaaaacagtatgcagtcaatcaagagataagagcaacatttctaaactatcaaggaggtccttctatcctccccagatccctctgaggaattcttaaaatctctcagaagcaatattagtacaattacatgagcagcctggagagagggacaggaagaccttgttgggtctgtgaaggacaatgaatcctcatctatccttgtctggatcccaggcccagagggaagtaagcacccttgacaaagctgcagtcttaggaccagagctgcttcatacttggcaagtttaaactcaaggagctatttgttcttccagagcccaaagtcaaagaactcatcagcttctcaacactggcttcccacaaccacatacttgtcaggccaacaacactctcctaatgtggtagggtttggctgataagtgaagtgcaatcttttgcatgacgaagtcagacaagttttgcaggagtcaaagcacttaccttgggaaagcagatctaacctggctggaaagttcttccccacacactcatcataaggtcttccccacacactcatcatttgtatattttaattacgtactttcaaccaaggtgtgagcctgccagaatgccctaaatcgcagttgtctctagaactgctgagggaaagatccacaaccagctagttcagtcctgcacctctccattcatcaccattcggactcccttgatggtttaaagggagggacgggagctcttgggaataaaagcagttcctctgaaaggcattcattattccagaagcacagctggtcttccagtgttcatcctagctagcaagggcccatgttacctaaatcacattcctgccacta

SEQ ID NO: 26758 - DNA, 1579 bp, Bovine  19866880940890
cagacacaggagacacaggcagctgaccctctgatgcagctgtgactagttctgctctggacaaatgaccccagctgctttggcaggaaagcaactccaagtacaaccccccttccccccttcacatccagccctagccactttgcacttttctagatgtaccaggaagactaaagggggagaaagcctgctgcttaagtggggaagaaagcataggtttccttggcaggattagaaaatccagcctagatggcaacatgagagtcactgggttacagtgaggccaacgggagaggcttaaaagctgtaatgactggattaggaatcatttcctagcctctgttaagagcaggatgttgacagaaagcaccacccccagggaggtactgatgaaaaccacgactgtctgtcgaggcggcagtagctcgcacaggcagatgtggaatccatcctgtcattagccagcaaggagacaatgttctgaaaaggaaaggagagaaaggtgtggtcaaacaggagacagcaaataacaccacagtgcaggtttttatgacccagcaaaagaagcaacagcttctaaggataaccaagtaatattctttacaacattacccaacaaaaaacaaaaatttatttccatgaggggataatgcacttaatggtttctcattatatattgtttactctgcaagtacttatctggtaattcataatttaccataacaagtttctttctgcactgattgctaacagattgatattcttaagaattcacaactagtctagattactctggagagatgaggagttcacaagagccaccagcagcctcagaatcacctgaggcattaattttttgttgttgctgttgttggacttcatcttagatctactgaataaatctccaagggtgaagagtggccccatgcactactgtaaatcaacttgggtcacttgctcagccgtgtctgactctttgcaaccctatggagtgtagcccaccaggctcctcagtccatgggattctccaggcaagaatactggagtggggtgccatgtcctcctccagggaaatcaacttgactgtaatatcatttacttagaataaatacacccactccaggtatacagtttagctattctcacaaaatgggcttccgtggtggctcagacagtgaagaatctgcctgtaatgcaggagacattgattcctggtctgggaagaatccctgaaaaagggaatggttacccactccactattcttgcctggaaaattccacggacagaggagcttgatgggctatagtccacggggtcgcaaagattggacacaactgagtgactaacactttcactttctttcactcttaaaaaggcatacatgacaatcaagttatgaaatatttccatcattccaaaaaattccatcatgctgggcccatgaactttttctgagatttcccatttttcccatttgtttcaataataataacaattgcttgttgaagcatttttgtgatggctgctttgaagttctttcagaattccaacaccaggttcatctcactgttgagatct

SEQ ID NO: 26759 - DNA, 872 bp, Bovine  19866881056818
aaatggcaacccactccactattcttgctgaaaaatcccatggatagacagggcctgggggctacagtccatggggttgcaaagagttggacacaactgagcgactgagcatgcacacaacatatagaaaagcaatttaaaaataaattttcatccatattgtcactaaactttatatagagaatatataatttaacaatttaaaaaagcaattttagtcacacatacatacaagtctatgtcactgattaacaaatgcacatcctcacaaaactgtatgtataattttaatgaatccatgaaattataacatatttccatgttatattacttaattaccttttattgtaggacatttatgttgtttttctgttttttcctcattacaaatgataatgttataaatatctttgtatatataatattcctcttttaaatttaagaaatataactttgggggaaaacatacctatggtagaattgtattgacaacatataaacagttaaaattataaatattttcttctgctagtttcttatcagctaccctgctatttaaataactgtgacatgaaaattcctggtcatatgagcctattctagaaactggctactagtcttatttggctagttgaaacaatgtgtttatttgtttgttctgaatgtcagtaaattttcattacaaatgaaaatgttgtttcctctttttaggatttttcaaaagaataattgcacttggaggaaaatgaggtcactgggtaatcacaatttcataaagaaacatctactgtgttccaaaattgacagaggcatcgaggacacagaaatattaccaagtcattttgaaaacagatgtttggtaggagccaatt

SEQ ID NO: 26760 - DNA, 1145 bp, Bovine  19866881059794
taaaaaacagccttcctgtggagaactatccttactttctataatgtatagcccctgttagaacattaatactattggaagaaaaaagtgagtggttttgggatttgctgctaaggaaccccaaagaagataaacaaaccacaggaactgtgttttaacaacagtgaatgctgagaaactccctggtaccaaagtctaggaacactttgctgacaggggcaagaagaggatgatacagccactctggcaatgataatggtagtttatctgtgaggctcgtccttaacactgtctgctgtttacacaatgtagcaaagtttcatggatattgtgtttttttttctaactttttaaaaacatcccaatagggtgctctcttctgctacccaaacattttttttaaatggtgtcaggctgcagccttgactacttactcccttctcagagaaggttccactagggtcaccacattcaaacgtctttaccaactgggccgaggggacacctgggaaatatcgtcaaaatattgacaactggtcatcacttttatagacttcataaaatcaaagactcttaagttgaaagttcctaatgcaaatttcttctatacttaaaaggccacaaagagttaatcacatagggactacatcacagctttacaaaaacagttttcctttctgttctgttatcaaatttgccacccagtgatgacactgatgggaatgccaaggattcctatgccctagttcccaacagctattatctgaaagcctgtcatctctaccatcttgggagggaaatgacacgtcacctgtgggcacctcactgaaccaaagccaactccccacatcccaaaagtataaagaggaccaggcagaacacactagatgaaaacacatccagccctccataattagcaaaacccaagctgctaagtagaactgcctttgttcttcccagagacatccttaaatggaaactaaagcccaatctatattcaaggaaatagcactctcaccgttctctatacaccaggacttctctgccccatgagaaacaacatcctcttcctttaggcacaaatattaagaacaaaaactgtgccaagaaaaataaatttatattaagcatcatactttctggac

SEQ ID NO: 26761 - DNA, 1180 bp, Bovine  19866881068750
aatgaacatatcttaatactggagttaagaattgtgtccattgcctccacatctctctccaaccccaaagaacatacactttctaagcctcaacactactgagctaggcacaatgaggtatgggggggaaattgcaatttgttatgcaaagcacgtcttagcacatcacttaaagtaatcctcacgaagaatctgattcctattttacagataaggaaagggtggccttggcaagccagagactgacttgcctaaagtcacttaaataataaactgtagagctaaagctctaatattgaagggtctggaccctgtgtcacagtgctgtgtacaaggacaacccagctaaataagatacctttgtactcacacagggttttagagttaaatttgggtaagacgacactgatataaagatacatcacaaaggccaactaagtatacacagttgtgtaggtacctaaaaggaaacgacctcttgaggtgacaagtaaaaactccatggaacatttaaaaatccattctatataaagcacccagattcacaaatgaaaaccaccacattaaagggctctagaggtgatgaacgttacataaaggttaggttgataaaggtagtaaaaccagctacaatttactcagcatttcctgtgggtcaggcaccatgttgagcatttcacatacattttcttacttaattaaatggctcaccaaaattatttccattttataactgaggaaattgaggttagaaaggttaaaattacttatccaaagtcacataagtaagtggtacgtctaagttaaacaagtcaaagcccgtgttttcaggccgcttatatgtactgcctctattctatttccccaagtcatttttgttatagcgtccccagagtcctcactaagtactcagatctggggcacatactatgtatttctgatggacatcctcaacttgcaggtttttctatacccaggtccctaatatccacaaataataagggcaggggttagcttcaaaaaactccaaagatcccatgtgatctctaactactgagaaaaatccaagaaatgatggtacacacattcaatcaaaggttacagctatttggtattttaaacacttctagctgagattcttaacagtgcttaagagaaggcttaagtgcattaaaaggaa

SEQ ID NO: 26762 - DNA, 1376 bp, Bovine  19866881083215
gttgaaacctatgtttaagctgatcccatttctccctgagatatctctcaagatctgagcattttctgctcacacaccaactcctaaataatctcactcacttactatacagtcatccttcagtatttgcaggggattggttctaggaccccacatacacattcctttggatactgaaatccacagatgctcaaggccttcaactcacttttggatcattctattcagttattcccataatttaacctaatattgcataccacctgcatacagaagacttatcctcattctgcttaatctgttcttggacaaacaccaccaattcccaatgtttgaacccatcttctatatatttctaaggaacattgtctctgaatgggaaaaacaaaacaaaattaaacaaaaaccagagaatacagtgaaatttaagtctattaagtcactccacaatccacatactaaaggcattttacaccaaaagtctgcttattttgaagtaagctttttcaagaactcagaagtttgcatctctgccaagcccagattccagctaatcagaattgaggcacaaactctctcgtgcactgagatttgctaatgaaaaccagacctactcttaacaatgcaaatttcttcaggagcctaaatcaaaatctccaacttgtgtgcatgaactcgcctcggtctgctgcagaacaaccggtgttagtgattgtaaagggtaaatggaccagacgccaaacccttgaccagcattgactatggatgccattattccatccctgctacattcctagcagaatccagggcttcaaatccctctctagccaaaagcctggtgatcaaggcagaaccccacatgggactcaaaagtcctcccatctctttactttaaggtctttaccttggaggaccatctgctttccttcacatggcagagaagagagacataccaagacacacccagggaggagggcttgaacctttatccctccccttcaatatccctgaggtctccactttgtgttggacccacagcagacctccctttccctgaggtctccaactgctcccctagatgagaccgtgcagccaacttaacgcggttctagctttaagcatcagacaacaaaaataatggaataaaacctctgacagtcttcccctctcaggagttcaaaggaaataagagatgtgattacagccactctaatttgtccatctgattattggtgctggtggtgatgtgctgctatttactgattcatggagtgataaggagcaaaagcagagagtctgagaatgtactatatatatatatatatatatattcctggagctgtgttctctctatgtagccactgaatcgagccata

SEQ ID NO: 26763 - DNA, 1912 bp, Bovine  19866881106351
caccacgtgaagctccaattctaaagacctggcactgagggtcagtcccttctcttcctagaaatcagtatacatctacagtggtatctgcaatgtcagctattaatcctctaccaagtttgactccaccataacagattttcaaagaaaggagaaaattttcgttccttacaagccaaacctacccagatcaacctgtataaagatatataaaccatgtaagacattcccacacaagtcattctcaccagcaatgttagagcctaactgccgggactcctcaaatattcccaaatctctttctttttctcccaaagtgttcacctactgctagaagcaatctcagtaggttgcttctctctgggaaattctgtccttagatgaatcacttttgggaacttaaaattcaattaggagggagactctgggatttattttggtgatccatcctggtatctgtttgttaggaaagttcatataatctaaaaattcctcctagttgatttaggcctatttcctctgcttcagttcatactagagagagagaggacagactaatggactaaatggagatttagaaatattcactcagagccaaatctgagagttctctgaacccttatcaacttttccctatcgcttctctatttttaaaaccccctggctctcagtgttttcaacgacaaagtattaaaattttaaagcatcccctgtggtctggaagtcagacatactgaaagaaaactaaactcagagcccttagaggagttaagttttcccaaagattaattagcttctgcagaacttagggcttgggtggaaagtctggcagcccgtgctttccttgtgttctttggtagtctcccaattaacagagtaaagattcttatgcagaggacctaacaacctctgttttgattttcccactcctaagtcaaattgggggaggggggacctaccatacccttattagtaagagccaaaactttgcaatataatgtctgagtactcacattgtaagcaaataattctgcataggataaacataagcacagggagatgagaaagacatgcactcttgtgtgtaatggttaacttgtcccttccttcactttttaaaacccttttgtaaagttttcaaatttgccatataaaaaagtggaacccttttataagacagctgctagttcagtatcttctaagtcagtatgtatttatatttaaaaacataacccaacaggtaagttccacgggggtagctaagtgctagttaaaaacactttcttttaacagtttggaaaagtttcatgagaagtgaggttttataatcaggcaagagaaggaaaaggggtttaatttcagaactacacacctctcttaaaaaaactatgtacttgcattctcacagtaaaaagattagttgccttcaatgaagtttcaggaaaaaaaaaaaacacacacacacacacaccttctattttctctgcactgaggagtaacatcttcccacagttacggaaagctgcacattaagtcccttgcttgctgctgctgctaagtcgcttcagtcgtgtccgactctgtgtgaccccatagacggcaagccaccaggctccccgtccctgggattctccaggcaagaacactggagtggttgccatttccttctccagtgcatgaaagtgaaaagtgaaagcaaagtcgctcagtcgtgtctgactctacgcgaccccatggactgcagcctaccaggttcctccgtccatggtattttctaggcaagagtactggagtggggtgccactgccttctccgaagtcccttgcttagggagtaccaattcctagtttcaaatctaatccactgtcaccaagtcaaaactaaagaataaattctcacctcctgctgctct

SEQ ID NO: 26764 - DNA, 1404 bp, Bovine  19866881239706
aagtagagtggagtatttctactttattcctggagtagaaaatggcaactcactccagtattcttgcctggaaaattccatggacagagaagcctggagggctacagtccatggggttgcaaaagaggcagatgtgactgagcaactgagcatacatattatacgccagatactatgttaggcactggggatacactggtgagaaggaagatataatagcctctgctctactttgttttttcaaaccgttgcagagatagagtaaaataaataaacatgtaactatatactcaaaaattttatattggcttgatattcaataaaaacttattaagcatctccaaatgctctaaactctatgataggctcttaaaagaaaaaacaccttacctaattcctgttgaaagtcaatggtttgtagtttacaaggaataaactggctgtgttaggttatagaattgagtaaaaccatttgatccacaatagctttagatactggtttagcacataggtctaagagcagcaagacagcattctcacagaatgtgtagttacacatctataaacctgatgtatttactgaagatattcctatatatccctgttcactggtattttcacaactttgggttttaagacctggtctgcttctccctaagtgtgtgaactggaaaaattagtcaacctatctgaatacagttttacatctgcgtactggaaatagttctactgctttgtgggattatgaagtttgaatgcagtcatgtatgtggaaatacttgggtgagattgtattattttcactgtcattcagattttctagagggaataatatgagagagaccacctatgttccattctcttaaatcagaaaaaaaagtcagaaaatagtccttagttcatgtagaaactggaaatcatcaggtctttcctctgtcagaggaagcatttgtatatataaccttgaagttagggtggaaatgaggttggataacaagcatcaacaagaatgtactgtccttggaatgtggtcttgtggcagcagtgacactaagctttgctatcttgaatttgttccccctagaaaagaatgaaattgaaaagagttattatgaatgcattctcagtgactgggttctgacaccttggccaagaggttcatactctgcagcattgaataaagtggtataattaaaagaagaatgagaaatatgaaactgcacaagaatagtcattatttaaatggtgaaccttcatgtgagattacactcggtgatactaatctgcacagttgtattttctgggtgaaaatcaatatgaatgtaacaagaactcagtgtgcttcctacggcgcgtgttgtatcttgtatgaaccgtgatgtgatctcttggccttttgaatcg

SEQ ID NO: 26765 - DNA, 1167 bp, Bovine  19866881254666
ctatttcaatgcattcccccatgccctgaatgaaaggaaagcaggtatgaaagcccatgttattccaaggagggcagggaaagacttaaaaactctccagaaagccttcagcactgtaactaaatgttaatgtttaaagatataccaatatttcaggaagccattggtagtgccacactaaaactcattctagttttgaagagaaatatttgacttggagggatggaccccatgctggctccaagataaactttcctagttctctcaggccaattttaatgctaagagcagctccatcagagtaaaagttcatttttgagagccaagctgtgaattatgctacaggctgagctgagcagttggtcttttgctgatgatggcagaagcctgaatatgatacagaagtagaggggggagccagggacatccgagggggattatcacagaaggtcagactaattaaatcgagagaagtcaccagagagccagagctcccacacacgccgtcttcaaatgctccgacacatgcagggtttgataagaaagaaagagttgaattgccactttcatcggcctggaaggacaacagtcaaacaaataaaactgtttagtgttggtttaagcccaggtggggagggaagaattgaaagtgctgccaattcctaattatgcagctgaatcacaaacagtaagtggaaagagacaaagtacaactgtctctctggttagccatttaatgtgtgtttgttgagcacctactatgtgccaggcagagcgctgggtgagagggacaaaacaaatatgaactgttccttgtcccctcaaggaactcacaaatagacatttatgtaacattattacgtagtgtgatcaatgttccaacagagtcatctaaagactgcacggagcactctagggcagtccccaatccctgggccatggactggtacggtccgtggcccattaggaaccaggcttcacagcagaaggtgagtggtgggtgagccagtgaagcttcatcggtatttacattacggcctgagctgatcagatcagcagcggcattagattctcttaggagcgcaaacacaactgtgaacaacgcaagtgagggatccagtttgcacactccttatgagaatctaatgcctaatacctaaggtagag

SEQ ID NO: 26766 - DNA, 1388 bp, Bovine  19866881285563
aaatggaaatgttgcacaaataataacccttgagagccttctgatttgaagaaatgcagacaaagctgggctcctggggttaagagatggtaccaggctgtagatttttgaaggagattagctgctgtgttactaggcagagtcctgttaaaggaaggttaacagaccaaggcatgcagggttggagaaggaaacatgcgcagattattgaaggaagtacaattggctggaccttaaaggaaaggtcttgaggaagggtgaggtgactggccttttttgccctttccaaagtctgttttcttaggaaaaatcgagcttagtatcttgatgaggttttcccttcttatgagtattaactttgtagggggtggactttggacactgggcagggctgactggcacactaggaaggctgaagccacatgggcttttttgttcctcctttattttattttttctggtggcctaattccttcactgaactaatatgaattccttacctatgattggtgataacaacatggatctagactacatgagatgttgattttgggaaacattatatccactagggaattgatggtaagattgtaaactactctagtggtcatatttggtttgaggattaagtgcttttttcctaaatattgtggaaacgagcctcatgctattgtattgtgtttccttgtaattccctgaaatcctggaaagatcaggtattcaagagattgggataatcacatttggaaggtgttaatgttcctgtgggaaatattccaggctgtgagaaagctgaaaaggaaacccaagtctcaaatgcacttcctttggtcagggttgagtggattcagaaggaaaggaaagaaatgagataactctgtgggttgggttggtattaaagctttaattgctctaaagtcacctgaatggatgagaagggaagataaacatacacagacatttaaatgttgcatcacaaataaaatggacaacttggaagaaatggacaaattcttagaaaagtacaactttccaaaatagaaccaggaagaaatagaaaatcttaacagacccatcacaagcatggaaattgaaactgtaatcagaaatcttccaacaaacaaaagcccaacaccagacggcttcacagctgaattctaccaaaaatttagagaataactaacacctaccgtactcaacggagaagacaatggcaacccactccagtactcttgcctggaaaatcccatggacgggggagcctggtgggctgccgtctctggggtcacacagagttggacaagactgaagcaacttagcagcagcagcagcatcctactcaaactcttccagaaaattgcagaagaaggtaaattgccaaactcatt

SEQ ID NO: 26767 - DNA, 978 bp, Bovine  19866881447456
acctgacttttctgataagatattaaaaatttaagtagacttgtgaaatattcatcttttttatttaatattaaatatggtctatagttgagatacaacacacgtttttgccatataaatgcaaaaggtcttcctaaatgaaaccttctgatctgtgtggagcaatatgccttcttctatttcttgaaattcttgttatcatcagggcagagagcaggtgacttgttgtgaagcaagtgcaagagaagcaagaacaagaacccccgagctacaggaccttagattgaaaaacgaccccaccagtcaaagtcaatcctcaaacacccattattccagttacctctggaagaaattcaacaagtgagaaacagaaaaaggtcaaggaagatgcttagatccaagaattttaacttaagctggtttttcaaccaaaggagaaaaagaaagtctacctttacctgtaaactctggattctacagaaagtactgattccacacagcttttggaattgaatacacaagaacatgtaccagatcccctttcttacctccttcttctaacctccaagctaaataagggaaagtaaaaggagagattgttttcaataaaatgttgataaggttacacaaacaccccaaggcctgggcctctgtctatagtctaaatggttaaaaggttatgatgacgggtaggaatttattacaaggtttaccagcaacctatgaaattgaaagaaacacttctgaaaacaggaaaaagtagattaaaatccctggattcatgacgcaaaaaaaaaaaaaggtgtggtctgaatattaactactaaagaattgcaaagaaaactcctttcctcttccttctttcttgagtgagacagaaaacacagtgaaactccaggctgtcaaccactggtaccccactgctagccatggcaacagctgcacggctctgctgtaataaactggaacaatttaata

SEQ ID NO: 26768 - DNA, 1930 bp, Bovine  19866881498657
tagagaattaacaactgttttcaatcagcaatcagcagggtatttcgccaatgtgtactgaaaccatgtacactatcagacttaaatttattcttatgatggctttgatgtacacacactcgcaatttaagaacagatccagctttctaattaggtgttttctccccaaaatccacgccacattagccccttaatatacaacagaaattttcattgagttgtttctaaaagcaatgtatttgtttaataatgcaactcattttgactcagattgccaaaagaatcccagtctgcagctccaaccattatagcaacatgtaaaggcaaccatcacaagaacactgaaagatgactagacatagcacattctcagatctgacaggttaacatgggatgaccagttaccattaagctgcttaataatactgtacctgctgctggggccgctgctaagtcacttcagtcatatccgactctgtgcgaccccatagatggcagcccactaggctcccccgtccctgggattctccaggcaagaacactggagtgggatgccatttccttctccaatgaatgaaagtgaaaagtgaaagtgaagtcgctcagtcgtgtccaacttttagtgacctcatggaccacagcctaccaggctcctccgtccatgggagtttccaggcaagagtactggagtgggttgccactgccttctctgaatacggtacctatttgttttgctattatataattttcccccaactgtacataatgtatccaactgaattctcacataaattttctggggtaagcaaagtaaactgtaatgtgtccccatcacaggacaagaaatgaaagttcagacatgagtgacccgaccaaaggcacctagagagatggtgataagcagagttacttaccaggattcctggccactggctgaatgttgcgtttactgtccctaaggtagtgtcataatctactgcactaagctactggttctttacacgacaactctgaggcagacatgattgttactatttaaggttaagtaagtggaggcaagtgttcaagttaaacagataggaagaggtagacctacagttcacaaccaggccttttatcctagggtccatgtgattccataatactacgctatcctccagagtatcattatcattcattggcaatgcagatatattttaaccaactgcaatgtgaccattcatctgggcaagtaacaacaataatttttagtttagtgaccaaatattttagtgggaacaattagcaaattagctataaatattctgaatctttgtaatggaaaaaaataagtaaatgttatcacccatcttgggttattttaaattatttaattttttttccagccttacctcaaggtgtgaaggatcctagttccctgaccaggaatcgaacccgtgctccccacagtggaactgtataatctcaaaacagtggacttccagacaagaccctatcttggttatttttatacctgtgtctctcaattctgaacaattaatacataatctaacgtgaaagtgaaagtcgctcagtcgtgtccaactctttgtgatcccatggactatacagtccatggaattctccaggccagaacactggagtgggcagcctttcccttctccaggggatcttcctaacctagggatcaaacccaggtcttctgcatagcaggtggattctttaccagctgagccacaagggaagcccaagaatcctgcagtgggtagccaatatcttctccagcagatcttccaaacccagaaatcaaatcagggtttcctgcattgcaggtagattctttaccaactgagctatcaggaaagtccataacctaatgtagctaaatcctaatatattaaaaatattaatctatgagctaaattctata

SEQ ID NO: 26769 - DNA, 795 bp, Bovine  19866881507069
tgtgtctggcttatttacttagcatatccttaggaattcttgacagctcccgggaatttggcaatccctatgtcttggctacagatttctggagtatgtgatgtaattcttcaaatattttctcagaggtttttgctctacccgctcttgaaatggtatgtagaagtttctctccaaagaagccaccttacacacttttaatacaactttggattacagcagttgtgcgatggtgatcctggtgatggtttcaccttttgaattgtggtacacagctatgctgatccaccatgaaggcaccctatgtcatgtactcctggccagagaggggcttctgagaatccttcattatgtgatggaatgcctgggcttccttatcctgagtaattgtgacctggtcctgtgaacacatgtcacatgttgaaacacttcttcattttaatggctttaataaaattttgttacaagccccagttttttattattagattcacagacataaaactgctctgccaaattgccttaaaaagtttctgaatgcttattcccgatttccataattatctccttggggcccaggaatacatggtccccagaccaccctgagtaacacccctgtaggagatatcacatgtgggggcaggtttcttggaaacacactgaaatagagttttttgaaaggtattttctctcaaggaaactttccttcttactgacttttgactgtgggagaggatgagattgcttgaattaatctccagctattacccagcttctggataagaggctgccttc

SEQ ID NO: 26770 - DNA, 603 bp, Bovine  19866881686200
ttaattttgtgataaatctcatgtttaatcctctggttactctgtaatcatgtctctattgatcttttctgaatgactgcctgcagtttaataaactttgccattaacccagagcttctaaagggagagattgattccattatcaaatctgatagacccaataagtatctaaacatcactaaatctatctataggaagctttggtatagagacaaggctgtgacttgttcaacaaactgagtaaaagtttgggcatctttgcatgacataattgcctcaaacttagcgtccaggtctcttgtgcaaactgacactgcctctcaggtcaatgggtacctcttaagtacttttctgggttctgtgaaagcctgcagggtagttcattgtattttccctcatatgatgctaaaggaaaaaaaatgcttctggttaaaatctgaaatagaagatggggattgatgggaaaggcagtggaagggagagtgcattcagaggctggaaccatgtaaacaagctcccagactcgggaagtcttgccatgaaacctgggtttatgtctcatttagtgatagagcatttgcaatatatgccaaacaagaattt

SEQ ID NO: 26771 - DNA, 684 bp, Bovine  19866881777743
tgttgaacccaggtatcctgtattacaggcaaattctttaccgtttgagccaccacgaagccctcaatacatgtgcaattcattcttgttaatagtaatggttgatatgattattattaatatcctacatgcaagtcatacctataaatagccacaatgattaattagcttatgatgtgcatggccagatacctgctatggaataagacacatttctcagatgattcaggttgaggcggaggagggggagggacaattagaaatccagaatgtttctaaattgagcattttgttttccccaaatggctcttttctgtctctccaaagaattctgctgttcttctaagaggagtgggtttttcttggtcaaaaataaatacaataacttgataaaggcaatgtaagactacaaacataatggttgaacgctctgagcatcatttcagctggtgattctgagtggggctctagcactttagccacacattccattaaaacactgagcaaatcatgtgttttaatcacacatgccagatttgggggaactgggctctctttaattatgaaacagtttgcacatttgctgggtgcacgtgaggtgatattttataaacacacaattatcagaaaaagatttaaaaaaataacacagagagagatgaatctggagcacaagaggagagg

SEQ ID NO: 26772 - DNA, 799 bp, Bovine  19866881907926
acacacacaccccttgcttcactgtgcttaaaattatgggaccaatattaacagatcaagatatcccttaagagcaccagagcagatcacccggggagaaaagcttgccctagacactagttctatgcataactggactaacagtttttaccagtttacccaaagtcactgctcaaagttagggaaacagaagcagctgaaagaaacacctcactctccctcccctttctcaggtctgtcctagcttcttaatgagcaaggccatgccctagaaggttcccctttaaactgctacacaatcacaaaacgtctgatctgtgtgaagaggtgaagggaaacactgcatgctgatccagctacagaaagttcccctggtaccgcatgaatttttgaagctgtctcataaattagttgaaccaagaccacttaacttggtcttgttacaaattctcctgccacagtggacagtgtcagaaattgtaattttaaaatgcaaaccaaaaaaaaaaaagaggaaggaggagagacccttccaccaaagctggggtgaggagctaacagtgccatttctgaaggttctggatacacagtttgggatgcccgagaactcaaagatgagaaaatgttgttctgcgagttaacaagatgctttgtttcacttacacccatagatataacgcggagatagtctgaggaaagcttaggccagtcctcagagcataatctaagaacccacccctgacgtctccaccagttttgtgagggtgtacacacacactcagtcacgtctgactctttg

SEQ ID NO: 26773 - DNA, 3366 bp, Bovine  19866880186010
ttcctatttggaaccagtctgttgtcccatgtccagtctaactgttgcttcctgacctgcatataggtttctcaagaggcaggtcaggtggtctggtattcccatctctttcagaattttccacagtttattgtgatccacacggtcaaaggctttggcatagtcaataaagcagaaatagatgtttttctggaactctcttgttttttcgatgatccagcggatattggcaatttgatctctggttcctcttaccttaacatacttcttttttccttagtgctcatcaccttctaacgctttatattattttttgtcaatctttcactaggatgtaagctttacaggggcagagatttttcagttttatccatgatacatccccagttaaggatcccagtaatgcaataactcttaaaaggaatgagagaaacagtgaatgggcgctttctcccgcagtttgctggagacagatgcctgaagtcctacaatgccggagaagctgggtctgcttttctgtcccctgaccctgctttgtgttttccaggttcaagacaggaaagagggagaccagggatagagcacagaagcctaattacttggaagggactgtgtgttgatctttctagactcctaatgctctgtcatagcagcttacaacttattgatcagttctcctgtggccatcacggtaggtggccagaagttcttttctcttctgaaaatcaggacaaattgtttagaggttctataggtttagacattgattactcaatagacttttttttttcagctgcacaattcctattttctcattccttgaatttatggccatctctccctataacatcttctgatatttatatgctggaaggactggaaaaataaaaattgaatggaaatattaaaaatgcctttcacaaagagggtctcctttcatctctacaattaacacatcaaaactgtaaatatgacaaattagttgttggaaaacacaaatggtagacttcagttaatgatatggactcctgtaacagttagctgtggctgtgtaacattattagggatttccttctctaccactctcctttgggacatttctttcataatctctagcacccagaacatcctttttccagttctgctggccagaaagataagagctcctctggagtttgctgtcctttatatctgttgtgctgctctgtgcagctggggcagccctcagggcaatgttgaggagagagagaaaaactgacagagatcctccccctacttcatacaagtgtccctcttcccatctcctctgaccagagggataggttttctatcagggtctaattatccatgtcactgtactatagtaatgaagtactgtgactatgaaagctccaggacagagaagggagaaaaaaaaaacaatcatgaattttcacccctttctccacctcgtagcatccttttcatattttgtccagaggtttaagaggtaatcagtggcagacataggctgcaatggaattactccattttggccagaaccagaacttatcaatttaataaatgaaaaaaaagtattaatttatatttctcttattatgaatgatgagacatatgcatttcatttgctacaaattatttatgtattttggctacttttctactggatatagaaatacttcatataatcataaaaataattcctttcttagaaatgaatgtcaaaacttgttctcagtttgacatgccttttgagttctcttatgctattttacttgctttgttttttcccctttgattgttttggttttattggccatgcagacttttcccatttctaattggtcaatttttaccaaacttttgttttactacttactacatttagttacattatacttagacctacacctctcttgtattactctgaaaaatccttctatggtttcttcttcttctttttggaagaactttttattacttttatgtacagaaaactcaataatgtgcacttgaccaagtttggtggctagttctttgactttgccttctccggcttggcaatatgagctactgattttgaaccctggacactgcctccccaatgatggtagatctcaccatatctgtcattgtaattgatcctgatgacttccaccagtttagccagtgtgcccttgtcttctgagttgacttgcgtgaaggccacagtgtgtacaggtcttcccatggaccagacgctccagcctggccttctccttgattatgaaatagggaaccccaccttacaacacagggcaggcaggaagaccacgatctggaaaacaacattaactctagagtgtattttgagcaaaaacagtaacttaaaagctaatgtagagaacctactgtttagcaaagagaactctactcaaggatctgtggtgacctaaatgggaaaaaaatctaaaaaagagtgatatatgtataatggattcactttactgtacagcagaaactaacacaatggtgtaaagcaacttatttccaataatttttttttttaaagctaacatggtagcaattgctcagggttaaaaagctcatgtatttctacttgaaggtttaattgagaaattcacatgattgcaacatggtttcttcctaatgtttcatcatctcattttttttcctttaaaaattggacccatcaggaatttatttttgatccaagttacgtagtatagatccgactttacttgatatcttgatagctatgcatctgccctacctcatttactaactaatccatctttccctgatagattttaaatgtcactgttaccatatattaaatttacttctgtattttttgactttcacaatacatcattttgtttctttaaactctccaatataacccaccccgtcttgaatccctcattcccatcatgactgtctaggagagcagccactgaaggctcccctttagtaaacttgttcattccaggcaacaatgctgctgctgctgctgctgctgctaagtcacttcagtcgtgtccgactctgtgcaaccccatagacagcagtccaccaggctcctctgtccctgggattctccaggcaagaatactggagtggactgccatttccttctccatcaggcaaccacaggggattatttatgaaactttttccactgcatgccctagatttgctataacccatttcccctggtagctcagctggtaaagaatccacctgcaatgcaggagaccctggttcgattcctgggttgggaagatcccctggagaagggataggctacccactccagtattcttggactttcctggggctcagatggtcaagaatatgcctgca

SEQ ID NO: 26774 - DNA, 1686 bp, Bovine  19866880414848
ttgttttgtgaaagcctttctctttgagataggtttggactgtgaccttgtctagctcctatggaatttgtgcaattaataaaatctatattctgcttacctcctagtaagttgttccaggactccccaaaggctgaggcaggaaggttctgttagtggtagcagattcttgaagcacgggagtcccactgggtttataggcacacgagtgaggtgactatatttgtctttaaagtggtcacttgggtagtaatgtagataaaagatctgaggtagaaatgcatgacttggaactgggagaaccaggccatcgaaacaccttcccgtgctgctaattttgcttgaacaagtcctttgagatgtgaattgggaaaaaagaagaaagaagaaagtaggtgcatctttgacttttccctgtgatgtgaatggatgcatgttatttcttaagtaccatgcactgagcattctggctgagaccagaaaatacaacttgcagccaatttcctccagaaaaaaatgggaaaagaaagaaagactttttgctctttagtctgtaaaatgaactaatccccagcaggccttcctgtcagtgctaactatcagagcagaactgcggtgggaaagagaaggcaaggacgagaaaagaagtattagcattatcccaactggcccatttctctcccctcagtttttaaaatagaaatcccatatggttccatatgataggacatcttaatgtagtgttatatataagtctcttttctgctacagttgaattttttatttgtttgtactttcatccccaaataattgatgatgtataaatgtgaagccagagtgctaatgccagcagatagaggattcagcaggaagaagtttaaagtatgaggtcaagtaatagcagcctcttagcacttattcttcaatattaaaatatacatatgttttcctttaaggacacggctgcaacatgatttgtggagctcaatgcaaaatgaaaatgcagtgcctggtactgggattggggttggatgagaggccctctttgaattgtgccccccaaactcactgtggtttggaatgggcattgctttgtcccacccccagatcagcccctcctggtaccctcccctcctctgttcccaggctcctcaaaggagatggagaaaagggaccaaagaacaaagccttgagatgcggtaatcgttgccctgggtgaaggtttgtttccgagtggaggtctgttagcagccaactggggtgggaaaggagggagcggggctggggagtgaggaggcaatgaagcttctgggcacgaagcctaagtctccttgggaggtggcaagaggcaggagtctgtgctgtgtgatctcaggctccaggcctttccccttctgcgtgttccatttcatcagacatcacttaagaagcacacatagacacagttatgaagaacctcaagatggtgactaccgagcattaaactccaagtgcaggggcctttctgagcctggaaccctgcagaagtgtgcaggttatgagcccacgaatctgatcttcctggagagacactcctttggtgctgaccgggaagggcaggacagagttctcatcgaaggaaatgaaaaccagtgaaacagttgctaggcttgggaagaccacgggttagatctcggctccaacatc

SEQ ID NO: 26775 - DNA, 836 bp, Bovine  19866880557536
tttccttatgtttgctcttcaggaaaaaaaaaaaaaagaaaacaactgtaacctttttaaaatcgaaaggatgatataaaaatgcccagcatcttcttccgtaacgcttacaaccccatcaagctgtattattaaaatgacagggaaccctgttatctagtagatgaaaacctcgccatgagagctttggagcagagggaaacctaatccctcttgttgccactgtgatgacaggtattgtattccaggtgcgggagcgataacacggttgcctcaccgtgtaattatcattgtttccgttggtgttatcctaagtagtaattatcactaactcacatatggcatttggtagtaacttggaaaacagcctgccactttggcttcatcatttggggtggatgttgatggcattatgctggaaatcctgagttgctagtagttgcttctgtgaggctcccaagagggctgtatacactggggactctagcaggttgggaagcaaagtgccgctttgtcattagctgtacgagtacctgattctccaatataaacctctggtaatgttcaggtagggggttcggcttcagcttgagaccttaaccaggctctcagcacccctctggctggctgcatgggcatgtgagtgatgtatatttttgttgctgctctttgtcgctctgttgtgtccgactcttttgcgaccccatggaccatagcccgccgggttcctctatccgtgggatttcccaggcaagaatactggagtgggttgccatttcctcctacaggggatcttcccgtatcagggatctaacccgcgtctcctacacaggcag

SEQ ID NO: 26776 - DNA, 930 bp, Bovine  19866880561786
gagtgaggtgaaggtgcataaagaaggtattttctctgcggaagcaagtgttgctcccttcactgaaacagtgatctatagttgcccttccctttcttccccaacccagggccagcgatgcagctcggagcccggccagctgagctgtggcaaccaggctagcagcttcactctgccaactcagcactgctgaaagaagctaacagctcgaagccttctctcagaaaattacagggagctgttccggagaagacactgggggtaggggtaggggtagtcagcctgagctatgggacctttactgcataacttattcattcattgactcaatagccattcacctggcacccactgtatagtaagcatcatacgaggtactgcggacagaactgtgaaaaaggtagatgcaatctctctcattgtggagcttatagtctctctgggcatgtacttgggccttttcttcaagaaaaattgggtatttaggaggacccactgtggtcaatgcaattagaattcattgactatgtattggtctccttctatgtactcaacatactgaatactgaaatgagaaaggaaaaaaatgtccacagtccatgtcctcaagaaatgaacagagtaggcaatggcagactagttaacaagctcatcagtattcaatgtgataagtgttattacaggtacatacagtattcagaagaagtggagactagtttattccatgtggaactccttggccctgactctgagtgagatgggaaccactgaaaggttttgagcagaggagtgacataatttcacacattttaaaaagcttggaggatggatttaaggagcaaggtaagggaggaaacagggatgctggttagtaggtttaatgcaacaaaccaggtttgttgtcttggaccaaagaaccaataatgtagg

SEQ ID NO: 26777 - DNA, 721 bp, Bovine  19866880623483
tgcaaatggaggtgatgttaccactttccagatgatggaaaggaggccgagacatcctacaatctgtcccatgtcacacagctgctcagagtaagagctcaggttggtatgacctgaatcctgtgttaattccaatctctcaccctcctaggaatgtgacagctcttcagctgtaggtgttttattattctcaaattcttcaggaaaaagaaaaaagacagttccaagagtaatgtattttggagacacttttctaaattggaaagcgaggacacacagtgacagaaaatcttaaatttgcaagcatcccaagttttgtaaccaaatatttcacaaaagaaaagctattataaatattgcagcaagttaaactttctttcaggatagttctgaattccatgcccatgaatatctaaaacctgggaactgcgaattagtatccatatgatgtgttaacagtcactgttcattctgtctcctgcttcactggtggaaaagattaatatatcattcagttaataccaagtataatttatttccgaagtggtatgtttcctttacaacatcaaatctggcagctctatgctgtgctgttctgtcagctggaataatgcctttaatgaacttgtctctggaatatcaaatgtgtaatctgctacatgacttgcagctctactgctcagaccctcgtcatcggcctccggctcccgcaatcaagaga

SEQ ID NO: 26778 - DNA, 1529 bp, Bovine  19866880647508
ttccacctgcaaaataacttgcatccttgcaacgctggtagatggctctttattggtcttcttaaacaaaagtcatgggtcttgcatcactgtggtgagaaacattgagtctgggtgagactttctttgattcctttggatgagaaatcagagcacaagagctagcctcctctttaattgactgcatgatgtgcatgagtcaaaattttacttttccactgagttaaagcaaaatttttagaggtgttgtgttctagttcctgatggaatccttggtgggttgtgactttgacacatcagggagtgatgtagggaggtgattagaagatggaatactagggtagaggtgaggagtcctagaattcccttgaattagctgtaacattatgcaaagcacaatctcttgagcatccatttcctcatctaccagatagactaatagtaatatacctgtcaggatcattgtgaagattagataaattgaaagtactgaacttggtaaacagtaagcacccaaatatttgttcttttctccttgatgaagagcagactttggatggtttgatacaagtctagatcctttgaacaaaacaaggaaccctcctgacttcagaaaaacaaaaacgaaaactctgtttctgaaagagccttaaaagaaagtcatgtatttaatccacttttctgccttagtgcataactgttacccaagagactccacttctttacctacttcaagaaaggtattctttctcttccaatgggcaattccagggttgtaaactcattatcaggaaacttaaccttattactgaaatacctcacagtgcaatttgaacctctttcttcttgatcccatcctccatgagaagaaaaattggttgatcctgtcttctttttaaagggccatgtttgccatttattattacccttttgcctcattttaaaaaagctgacagaaaaagttcattaaggtgataattattatccccttggggactgtcaggattcttatcgatagtgatcagatttagatcacaaacactgttgtaactcttcagttagtattttcttctttagttaacatattattgataaccaagtgtgcttctgaagacttattctggttgtgtggctcttgttttctcctcttggtaaaagtggagtcacgaatcccagctttgtcaactacttttagaatgtaatttcatatgtgacataatttgatggacataattaccaacacctaatattagcagggtttcttgccttttctacattctgaaataaaaatcagaataccaaatgcctaataaagcaaaaattcttgcacagaatagcaaaaggtaagaatctggtctgctagaataatttgtcactagttggttgaatggtgcagagcttttgtttaaagttacacagttatgcctggattaaataacaatagcaaaacttgagaagccctctgaaaaacagctgctaaacatactgctttctggaaagtaatcattaagaagtaaatattctcttgt

SEQ ID NO: 26779 - DNA, 724 bp, Bovine  19866880701401
atttaaactccaatatataaaacaaaacaaaaacactaaagtgaagtgcaaagatgtgtaacaggaattatattttaaaggatgaataggatgaatatgaaatacttttttaccaactattatttttccaaatttcttatagtcatttctttatatgtatatgtcacacacacacacacacatgtatgtgtgtttctgtgggtatctgtccaaaaagaaactgcaaatgaagtatctaaatgaactttaaaagatctgtacctaactttggacaaactgaagtctcgcaatagggggagaatatttaattctaaatcttaagtgctgtaaacactatgtttcaggctctgattatatcttgattagctcagtttttctcagagtgcgtttcatattatactaggcctagagaattttctgtgatcagataagtttggcaaatactgcaaattctatttccttattggagattcacagcacgtattagcataataaaggttttgcatttttctgcagttaaacacacacaggcattttaaccttgctgaaacctgggtttcccaaatgtatcaatatttgactatggaaacttgaaaaacatgtatatattagggtatgaacattctgtactcttcctgaattttaccaagaatatagacatttatcagaaacatgatggacacacctaacagctaatttacatgtctcagcacaacttctcttg

SEQ ID NO: 26780 - DNA, 1172 bp, Bovine  19866880710734
aaataccatttttctaatcctgtcattgcttctgcattagctgacatttgataaaacagagctattttcatcagttgggactatttagtaccctgaaatacaattctgttggaaaggcaagttaaatgttgagttctctgcttttttatttacaacttctaaatgaggagttggcttaataaataaatggtgaggaataaatatttttcttgctttctcttttttgatatccttatggagtaatggattttcatgaatcaattaaaatatggaatcaaatgttttaattagctacaatcattattctttttatgttccatttgttttatgttcaattaattaaaacttcagccaatgatagtcctttgaatagcatgaaataccaagatcctggcccttggaatgtcaattgttattgggatgatagaccttttcaatggtctttctagtccttgaatttcaatattgaaagtttcaataatgaaaatttaagtagtaagtaatgtctgtattttaaaaattgctaagttcatatactatttccaattcaattttaacattattatgtttttaagtggccacttgattttataattgtatattttacactgaaaatctcaaccaataacattgctttatcttaaaatatgaagaaaatgatttcaaaataacatcaatattactactactaatgaaaccaaatgaagtttgacatttttttatttttgtagcatagcttgatttgaatggaagaataatatatgtactttttagtttttaattactttcctttgaaatatgtcgtctgtttcttttttgtcataggttgatcactttggatttaatatcgatagaacttttaaacagcggtacctaatagctgataactactggaaggaagatggtggatccatacttttctacactggtaatgaaggggacattatttggttttgcaataacacggtatgtgcagatgtgctcaatttcttttttattatgatcaactagaaaaaaatcttttgtagtatatatgaccaaataattctgaagtttaaaaaaaaaagataaactcacaaataatagagaaacagcaaaagtatgtgaataggcagtttacaaaagaataaatacagacatccaatgagcctgttcagccttaaagaattaca

SEQ ID NO: 26781 - DNA, 1637 bp, Bovine  19866880844769
agatctagtgatagctgccagaatcctggaaaataatctttgtcatggggctcaaaacaagaactgctgtcagggccacataagctgctgagatcgctattcgaactttctaaagcaagtaagtggctattaggtgtctgggagccacagcgaagtttcctgacagcagaaagcttcaaaagtcgacggaaatagtcaatgacagtgaagcctacaacatttgggtctggtggaatgatctggcaagctacgagtgctttaactactctcttgcggtctgagcactgctctgagaagttactggaacctgaaccttttccatgctggttttcaaaattctgtggaagaagtaaatgaatttaaatgagaataaatttttcttcctttgacttaaacatgaaacagggatttaaaaggttaaaacagatgtagctataactcccacccccataattcaattcctctagcatgatagggttatatggaattataattatggtgaaataaaccttggagtaaagagacttgtcttcaaattctgttccaaacatttcctaatgtggggactttggataagttattaggagcctcagttttttcatttataaagtaaggatacatagtcaggattattatattagcaataacacacaaaaaattgtggtgcttagcaaatagttgttgttcaataaatggtagttactattacatttctcactagcttccataaactttgaatgtttaaaggaatgttcttatatcgctaaaaacaaaaaaggaaaaaaagaggcatctaagattttaacacagaaaacctctgtagctcctagtttcaacttccctttgggttttctcactgttcagttgtgaagtgctgtgttccctttttaaagccctgatcgcaatacaggcaaaatattcatttgttcctgttagcatacaagagacagaaaaagattattccttaagagtcagcacgttctttagactttttctacagtcacttttatataagaccatccttcctaacctattctaagagttatcagtactcagttactttgctttcaatgttacttccctcctttttgtagataagagttgatcaaagttttactatagaatctaaaccgaatttagagagcacagtaaataccaaatatcaaaacaaaatacctaacgcttatgaatttataataaatttagatttctaaaactctgaaagcctttcaacagggctcgtctagcttttgaaagaggaacttgtcatatacatgatgttttaaaggatcatctatagcctatttttatgtagtttaaagggtttctacaggccctcacatttatgactcctaaaaactacttagaaaattaaaagtttcactacaatggaaatattagcataatactaagaacaaactagtctcaattaccgtcactccaaaaacaaagttttgtccgacaaagcaagtttccactgctttagttaataggttttgggttgtatcactgcccagagtttctggtatttcactgggatcctgaatgtaccttaattgaaaagaaaataaaaaatgggagagcatgaaacttttaagttacatataggaaaaagaaatgtgactttaacagctagg

SEQ ID NO: 26782 - DNA, 1631 bp, Bovine  19866880919848
taactgctgctgtaagcatagtctttaaatttaactccttcttaattaagcatttaccagttctttgcttgccatatttcagtttttttcttggtaactcattttgatcaggagaattataagcagcgtggcatttccttagacccggggcccggaatccaagcatatctgaaggaaacactttttgtgtggtaggagggacccactcattagcgtcagtttcaaggcactcagtgacaggatggttgttggagacctctggtggtgtaccagatacagtagggcttctggatttctggccaggtgtctttatattttttggacagacaggggtggcctgcagtgcgtcatttgcagaagaaatccttgtttttttatagttagcatcaaggtccaaataaaaggcaggtaatttttggaaagctcctttcattccatgaatcctactttggtggaatccagtaactggagttgactgtgaacacggaacaaagtcttggctatattcaatatcatattctgaatctgattgaaaatgaggtggagagggacaggttcttggatagagagaggcagatgtgttttgcaaggataatttttgtgatgaccggctggagttttcagaaagtgatctcagggaaaaatcagattctgtatgatgactttctgccaaagactttccccactgtaagaaaatattctgtgaccttttggtcatttctgttacaatgtccatctctttaggactatcatcaaagagatccacagaagcattgtaactgccttcatgaccagtagaacagttctgtgttgggttattaccagtgtgttcataaagcatttctctcaatatattcatacttctatttggagtactgtgaagagcttctaaaggatatgtgagtttcctgcaaattgtcaaactgttgccctgattctttggccgcctacagtattgtttattttctaagctgggaaacttggaaacaacattatacctcctagaatgcaaagttgtcaacttttcactcatttctgaaagtgatttttctccacatccattattatatttgctgctgagacaagaatggtcagcctctgaagtattgtgcttacatgaaatttcagtctcacatggtagaattctcgtagacttaagagcaactgttgtgcctgagccttttgaagatggaaacagagctgacagatgaacatttggtagagaatgttcagaaatatctcttttattaccactaaaagagagagcctctgctctgttctctggctgtgattccttatgaatgctaggacttggatttgcttcatggttggaaaggaagttctctctgctggagtttgctttgactgttgctggtggtgaccttaaggctatacgtggtgtatgcaaggctccaggggttctttgtggagtcagtgataacctgctgtggtccacatgcagtttactgatgtcattatctagacgacatttcctgctgctggcatctgtctggtttacagcgatttcactttcgatagctgccagaaatttgtttaggctttcagagagtggcaggtcatcccagatctcaaggtcacagtcctgggaaccactgactatttcctcaagt

SEQ ID NO: 26783 - DNA, 726 bp, Bovine  19866881164642
tttgaacttgctgtcattgttctgagctttttggtttcagctgaggatatccttttcctttcctttatctttcttacagtgcccttatcattcagaccggatgaatgctgaaaacaatgagtagtctatagagtatatttttaaggtgatgattaagagtctctagagcccattttatagtgacaccgggactgaaaattggatgttggagctccccggaggaaaactgctgctattttcttcagttgcttgcttttgtggaggatcttcatgtggatatattgtaaagtttaatttggaatgctaaaagcctttaaagccatgtattagtcaatataagaaaaacttattttaagcaatctctgaagagagaatgctgtaagttgtctgtttcagcagttcttacagtgttattcacagaagatcctttgtggggcaggaggagttgtattttagcattgtgtagtagtatcttctttgtatgtattacttaaaacagtagtttattgttttgacagaggtaactaggtagagattgtggtccctgatgtcttttgtctcaccagagagaaacagagactgtcaagtttgagaacaattagattctcactttgtataatttcttgaaataggttttggataaaaagggtagaagtaaaatctgctttgttaatttccattaagtgctactgggagcctgatggccttggaactctttcaccattt

SEQ ID NO: 26784 - DNA, 1635 bp, Bovine  19866881310972
aacatacagatcctaggtactgatgtaaattacaccctttaaaattttgacctaacagaaatgattagctaatttacacatataagagccattaagaataatgtaaaaatactgcttttaaaggctgaaataattaaatattattgtttgtaagatgctgatttgcttgacctaggagagacagattcattctacacatcagcactcgggtgaatactatgtaattgtgctgtggttgagactcaaggtgcccgtttattgtggaaagtgaaagtgttagctcagtcatgtccagctctctgtgagcccatggactgtagctcaccagtctcctctatccatggagttctccaggcaagaatatgggagtggattgccctttccttctccaggggatcttcccaacccagggatcgaactcaggtctccttcattgcaggcagattctttaccatctgagtcaccagtggctactaatgaaaagttcaaggtgggtcttaaaattaacaggctggccacattcttttagagccatgtttcaagaggctgaaaattttctcctgcttagattattcaaaggaagtgaacattaaacattactgggtttttactcccattttatctcattaatatgttattttaataaggattagatgttgattagctgtaatgacagctaatgattgtatatactaaatttaggcagatgttaaggaatttattctaaaaaataccttccattataaatctcaggagaagctagtgagagaaagtcagagccttctgtgttcaccatgataatgaattaatcgtgacctggaaaggcaaaatgatatctattgcatatgattggctcacccacaggatgggaataacaggtgctctgagtgctttaaaattctaatgaaaaatatttttagaagcactgacaaacttgagatgaaagttttcagagtggaacaaagcagcctttggttgccatcatatatttgttttagaactagcagtgcctccatagatgtattagtccaatcccacccagtgaaatttccaattgatctgaagtcacatagagcgtgttcaaactagataccaagtctgtgtttttcttttccaaatggtccatttgcttgtgcaagtttcttggatatttaattcaacattttccattttgtaccactttatgtattgagcatttatgtgaaagcacagtagtgagtactgaacccctgatccatgtaaagaaattcctttgccactttaaaagtattctgaagactgaagtggaaaacaaaatggatggttaaccatccagtgcaggatcaatattaatatctttgaatttgaaggcagcaacacatatggtatatgataatccctgtatggtgtgtcaactattgtgagaaaactccagatctccgttgtttaaccagttaaggctcaatactcactcaggtcccattctctgtggggttgggtaagtagtcttcctcacaatgtcttgcaggcccaggtatcctcagtacagtaggtttcctatctaccagggctcagcatcctccactggattaaacgttgattgctcacaaggctaggaatttgagagtcacagaaaagagtttaagggtcagggtg

SEQ ID NO: 26785 - DNA, 859 bp, Bovine  19866881340608
tgcctagcatgtagtaaagtgaagttgctcagttgagtgtgactttgtaatcccatgggcagtatagcctagcaggctcctccgaaggattaaaaaaatacagactaaataaaatagtgacagtttcacatttaattcagtctttattgacccttcttctgagtcaaagcccacagatgctgctgggttaactgattatctaccatgctcccagagcaacgtaaaatgtaatatccattaaaaaagttccatcattgtgttaattgtattgtattgaaattgtctattatatttctgtcttacctagtagactaaaatcttttgagatcagtgatcttgtagctttgtatcataaacccaacagtagctggcaggcattttctgatctaagttgaacaactaagaaagactacattttggtctgcaaaagctttatttctgcatgtatgtgtgatttaacaaatacttttaacaagcaaaattaacaatattactttagtacaatcaacaatacaagataaagtgccaaattatctgaaatcagagcattctggataaaacactgggaaaaacaatggcttccccttgtttataggcattaatagcacctcttttctatttgcttcaagtcttcaaaatggtaagtgtgctttccatgaccctggaggcagagtttccagagacacacctttaaaagctcagaaattgggtttaggtgacattttgtgagaagagttcaggagaccacgcacttttactttcaggtgctgacggtgaccagttttctgaaaatggaaggcaacatttgacttctgcacaagaaccacgtcccaaaacgactctttagaaatccagccta

SEQ ID NO: 26786 - DNA, 1278 bp, Bovine  19866881361858
attaggcccttctcctactgatgccagtctggttgagacctgagttttccaagtcccgttctttttggactgctttaaggtctagcatgttttgtggccgaagtttctggcatgaaaggagaggaacaagaggatgatgggagaggccttctgcaggtttttaaggtttgagcagctccatctggatgaaactgaaacaaagaaaaattctgatcataaagacaatgccttatgcactttagggagatggatatgtcaacacaatagtgaagaagaaattgaaccatttgagaaattgagacatacagtatttttgagtaagtcagccattctcattcttcttttggacagctacagggtcatgccttcttaggggaattttagaactcactcagtgggctggctttaatcagactgcagccatttccttttctgttgccttgtcataaggaggggtttggtcagatgctgtctctccagcccataagttgtaatgcaggtttttatgcatggtctgaacacagaggtgatagatggtacccaggatgcttgggaagattgccttatgactttgccctcagcaaactgcccttcataagctgaaggcatcaccttcacaagggcagcttcagtgccttctttgaaaaagtaattttcttttgtgagtcacatgctgtgtcatggtttatcacaataggaagaactgaaagctatagaacccaggaggcaaaaaagagctgtctaaggaataacaagaactgattttattctctgtcacgcagtgataaaaaggcattttgtaaaagcttttagtttggttttctttttttcctaatcatgttcaggaatgcatctaatgcattttgtattgaaaggaaaaaggagaatcattttaaagaattgccttcctttaaaaagattttatctgactagagttggagatgtgggctccttatgaagtatacaagtcaacagaatgctatgggaacatggaaaagttagtacggactctgcttgagagaatctgggaaggtttcatacaggggtgaactcaagctgggcctcatagggtgtgtaggagttttctttgtgaaaatggagaaaggacattccaaacaagcaaaaaaccatgtgcaaagacacaaaagcatctctcaaacctctacacaatttttttttttttttggtaagcactgactatttttgctcctggacttggtataaaagaaatgctgcttaggtttacagaggagatatgaattccatatcagtaataat

SEQ ID NO: 26787 - DNA, 1859 bp, Bovine  19866881375917
aaaaaaattcccaggtatccaaaatgggcctaaactcccaaagagtgttgtgagagtttagattctctgcgttgtgttcttttagacctgacgcgttagaaaggtatgtcctgtggcgaatgcaagattgtgtgttgtccagtaggttgacagcacctcgtactgtgttgtatgcagtagatagatctggggacttcaggggagttggacagcctctctgaagtggggctagtaatagggcttaagggtgaattaaatgagacagtgtaagtcagacgtccagcataacactagaggttaaagcatctgcctccaatgtgggagacctgggttcgatccctgggtcgggaagatcccctggagaaggaaatggtaacccattccagtattcttgcctggagaatcctatggacggagaagcctggtaggctacagtccatggggtcacaaagagttcggacacgactgagcgacttcacttacttactgaagtggggctagtaatagggcttaagggtgaactaaatgagacagtgtaagtcaaatgtccatcgtaacacttggcactcagacatctgtagtgttggttctccttcccagctgctgtacctcaggagagcttaatagatatttttcacagatttttttcttcagaagctttaagggagtcagacttgactgtagcatcaatgtattttattttgttatctataaaatatttaggagtattgaaagaagtgttttcttatttcaagggcatcttgaattatttctggagattggctagctcagctggctatattcagcaagccatagccaacacttaagctatttattttagtatatttgctatgcacctgtgcctttcctgttggttcagatagaatggatttattttcaagtcaagaatgaacgcttatgtctaagactcagagtttgatgcagaattgcaagcattggtagtttaagagcgtaaatggtgctgcaacttgtctgtgagatggaaagtaataacttctctcatccattgcagtcctatctaaaaaggtctttgttttactattgaaaaatgtaacaattctttccatttctctaccattctgtatgttatataacatgttcacaggaactgcctcaaccaaatcttactacatttccttgaggaattgagattcaaaggcatttattattaaatcctcccctgtatgttagctttggttattagacttctgcataacactctcttgtgatctttgtcttcaacacttaatgaaggacaggtaattggaaagcagagtaaccaggactgaaacccaggtcttggatgcccagtccagtgctttttttggtaacagtcttgttcccctgggagacggtgtgatgctgtagaaagaacaccagcttgagtcagatgacagggcctctaatcacagcgacctgcttatggtggttcctttagggagtcatgccctctctatgggcctcatgtaattcaccagtaaaatgaggagtttagacatgatgacctctttggtctctccctaccctgacaatcaatccatttgcctataggacacactcttatcatgggaagattccaaagaggtgctttcattccaccgctggcctgattgggaaagaagtttatgaggcttccctggtgtctcagatgagaaagaatcttcccacaatgtgggaaacccagatttgatctctgggttgggaagatcccatggagaaggtaatggctacccactctagtattcttgcctagagaattccatggacaggggagcctggcaggctatagaccatgggatcgcacagagtcagacatgactgagagactaatactttca

SEQ ID NO: 26788 - DNA, 789 bp, Bovine  19866881385418
taattttatcagcctgaaaatcaaccattataaactagctgatatttcagattttatttcattaacctattcattcttcatggtggcaagggatctggttacatctagtagattgaaacctgagtcagtgtttattgggctgggcctcttctcagatgaacatttacatgttaaataagaggcattgtaccttccaagtttgcactttacagtgtggtatagatcgagatttgtttccatgccatttgatatactggttacagagtgatccacctccaattctttttacttgaatgtgccctattatcatttcatgattagtaggatatccagaaggttcaggcctcaggagattagagactgagtttatacacacaactttccattagggttatgcagatcatctatcattttgtcacaggttgttggattcgatgtgacttactcactcttctctgaaatcaccccttttgttaaaacatataaaaatgcatacaataatttttaaatacgacatgtatttaagtgaaatcaccatgtccctaattataagcctaattaaatacttatcatggtttagtatactcgccctacttaaattttcacactctaaattttattttaaagtttatatacttaattacaatctcatgttttttcacatatgcaattcaatgttattaattataattattttttagatatacaaattattacagtgtatctattagaaaccacatttagttaaatcctttgccttttaagataccactcagaacattttaaaag

SEQ ID NO: 26789 - DNA, 1288 bp, Bovine  19866881866419
cttccactgagagattcaaatagaatttacagctccttatattaaaaatccctacaaactaaacattttaattgttcttataccacccaataaaagtagataattttgctatcatccccatttcattgtaaaagaaacaaaccccaagaaaatgaaatgacttgcccagtgtcacacagccagtatttggcacaagaatctagcctttaaaggcactgttctttcttcaatatattctatcatggtttttttttttaaattgtgtaatatataaatgtctatccttttcaaatattttaagcaaaacactttttttaaattcatttttcagttatataattagctataaagtaatttttttttctttctattggcaagcaaaagatcctcaagctcatataacagttgttagccttaaaatatgtaatgagttccaaattatctagccaaatgagttcagcaacaaatgccctgatggtcataacattaatataatcataaaagtaccattacattaattagaactttgtaaatgctgtaattaagatattccgtgacagctgtctttcctgtccctgagcgttcccaagaaatctcccaacaccacttatttctgaaccatcatctgcctagagttgggagaagccatctgttagtgtatttgaaatgttaagtgacaaaggggtttcaaaccattatatcccttagaatccttaatgggggagggggcggggggagaaatactcaggaaccatttcaaagtgatttttttgctagacgtggaaggaaggctaacttaatttacttatttttaatcttgcatgaggattaaatagtggagacattctggagttctgagtcaggtagatccgactttgctaagaaaagtttcttaaactctctgagcctcagtttcttcctcattataatagagaaacatcagaaacaagagcagacttatctatttttatcactgttaagaatataaaaggataaatgtcatgcctggtgtcttataaaattgtcactgaaggctaattgtatctcaaaatatcattagaatgactttaacaatgatacactgctggtctttttccagctattttatgcagctttggaaaatgtgattagtttagtcctcagaactactttttacggtggttatacttattttttactaaaactaagaggttgcataaagagtcttaaagtgtgacaaagaggtgttccatttctactataatccaccactcatttgattttaagcaaatcagttcactggacccca

SEQ ID NO: 26790 - DNA, 782 bp, Bovine  19866881958329
ctatggggttgcacagagtcagacacgactgaagcgacttagcagcatatatatatatatatcactatcatggaaataaatatagcttcacagttctttcttaatcagactctgcatgcttcactagatagtaagcttaattaaggttttgaattatttattgttctttcagtgtccactatggtggtggtggtttagttgctcagtcatgtctgactctttgcaaccccatggactttagtcctctaggctcctctgtccatgggatttcccaggcaagaatattggaatgagtggccattttcttttccaggggatcttcctgacccaggattgaacccacgtcttctatgctgtaccctaatgttgcctctttgttgctcgtaaatcctgatccagtctctgttaccgcacttatcactctgacttgtggtcttcctctaggctagttggctttccaagtctgttgggtagagtagttggagcacacttctctcctggcctgggcaggcaggagtgggaggctggcctgctgagccagctcaggaagaaatgctcccggagcacccagggccgaggcagttaattcgtcccagtggtgaggaggaaatttcttgtaaaagctagttcgcctcagaacaatgtggccttttattttttagctttggaatggagcctagctgtccgtggaaacaaagagaggagagaatcactgaaccagtctcgcacataaaaaactgaccatgtctgtctttgaagtctcctttatgtcgttttgaaaa

SEQ ID NO: 26791 - DNA, 613 bp, Bovine  19866882231982
tcttttgtttctctgaagcaggatttctcttggttttgaagttgaagtctctttggtccatgtgtcactttccccttttctaccctcccaaaaggaaaagaagaagatggataaaaatgatgtaattgcagctggtaggaaggatatccaatgccaaaccaggaaatgggagtcgtttcttttgtgcttgattcaatgactttgaactgtgctgtaaataaataataggactgaaccttatacctgtgtgttgcttctgaagcttgctccagctgttaggaatgctgtgtgcactgggcttggctgtttttaaaggaaagtcctttaattttctctcttctatttggcagcttttcttattctgggatatttgccactgtggtactgccagtaagaaatctggccttttctgccccatttatctttgtttctaaggtaagttttgtggtaatttggttacattttgccagtttaggaaaatgactctgttctccttttctttttacatctaagcaagttttatattctccagtcgccaatgatacttcagtaagaagcctttaaaaattgatcaatcagctattcagaaggtaaaatgtagtagtgttcagtg

SEQ ID NO: 26792 - DNA, 1780 bp, Bovine  19866880397580
cttcaaactccataatattctttttcatcactgttcttaatacactatactataatttcttggttgtgtcctggcatggccaccgtagcttgagctgccaggggccagatggctttgacgtttactttccaaagttggtttgcgcataacagacatgaatgaatgattgaatggatgaacaaatgaaagaatgtgagaccttctgactcccagtccagtgctccataccctattttctataaaccaccttcttcatgtcccttaaatggtttttctcttgagattttcaacaaattgagtagaattaacatttcctcatgatgtttaggactaatcacagtcattttccctgagatctcacaagaccttgaccaagtttacaaagcaaacaaaagacatcccagtttctttcttatctcttgaggtacaggcaggtctttcctgtagtgcaattggtagaaaagaggggaaaaaaaaaaaaaaaaaaacacatggtgatgctctcaggctatttgaaaatattggacaaaatgtcatcttaaatgattttaagcaagacatataaccctaggactgacattccccagtgatttatatagttaggggtgattttcccagagcaactacttaatatttctgtaacagcctgagagtgtgggattttgggggctgcttgcaagtatcgctgtgaattacattagtctaaggggtgtgtctttaccttgtccttttctgatcattgtcatagaaatgcactcataggatttagttttgtctacagtgcttttccatcaacatgtgtaacataagcattttccagggggttataaagtgctcgatgccttaattttaatggtccctaacattttccaagtgagtgtatcataatttattagctaaataaataataagaggctatttcctctattgtagggcatttatgttgtagccaatattatgatcctacaatatagcaatgtgataaataacccaaaggagagagctttctgtgaattctctccttggaccatttccttagggtcagttcccagcagcctgccatttattcttgataactggatttgtgggcaaaagatgagctcatcaggggacatggatcaagggaagaaagttaactcactattccctgaacactctgatgattgttctccagctgttgagatgtatgccctattccagggaaaaccttgcattttacattaatatttattttctaataaatttttattcaaaagcaatcctcttaaagagggatgcagaataaatatgtagaaaggaaaagtcaataactcccttttacagcccctttgttctcacccctctgatgacagatttttacagcttggtgtgtatccttccatacatttctccatgcccacacaaattaacacgtttttgaaaatacgaacaggctcctttataattctggatgacttatttatttattgcaattaacaatatatcatagaagtacttttaggtcagtaagagctcattctttataagacatgaataatattccataagaagggatatgccacaagttatccaactatttttgaattaatagaaattcaggttgtttccagacaaatacaattgctaccaagcttttagaagaaatgttgaggtaaattgtctttaaatatcactaggatcattttctctttcagttcagttcagttcagtcgctcagtcatgtccgactctttgcgaccccatgaattgcagcacgccaggccctgtccatcatcaactc

SEQ ID NO: 26793 - DNA, 1479 bp, Bovine  19866880438844
aatgatatgaaagatcgaaccaacaacagagtcagtacttcatgttcttgactgcaataatcaaaatggaccttgccatttcgccagactgccagaatggagtcttaagaaaaggctgtataaaatgttactgtctactacttttttgtgtgtggtgggaaaggagtattatatgcaaaatctttaattcttccaaagcagtgcataaatgctctcaaagctttacccgttactgcagtggaatattttagagattttacagtgtttttatgcattcaccaaagagctacgcttcatttttacacacacaaaaataagctttaaaaaaaaaatcttctaccaaattctttttgtcaccgactcacgagtaaaattacctcaaaaaagaaataggagggtgatggttaataattagcctgcattgaaatttagcattaataaaattaatttcccatcaagtatctctaaaaagatgactaatcaaacttttttaaaaaaagaaagttccctagaaacagaactcgtacatacaaatggcaactggtgaagaggaagcaatataaaaaaatgtgcttaatcatttatttcttaagtttcatcatgtgtgtggtatttggcatgtaaataggggtggtttgttgtggaaacagaacaaatgtggattgaattcatggccaaaaatagcaaacaaataggaatttttatatgctttaatgtttaatcacagtattatctttgaatgtaaatatatacatgtgtgtaaacaagcatacacacatacatatttacttgtgtattcacagagatagtttaattttgaatctccttttgctttcatttaaaatcaaaaaaggaaacaacaagaccctactgtatagcatagggcactatattcaatatctgtgacaagccccacgatggaaaagagcatgaaaaagcatattatacacacatatgtgtaaccaagtcacgtttctgtacagcagaaattaaacactgtcaattaaacattgtatacaactatacttcaataaaaatgttaaaaatgctaatcagaagaaagctgtagttagatggtgttggaacactagattgctatatgctaaaaaattaatcggcatcttacatcatatatatatatgtaaaattcaaagtagattttagatgtaaacggatgcatttttcaaacttccaaaataatatacagaaaaaaaaaaacaccaaaaaaaccaaaaatgtttagttaacatatcagattaaagatcagatttttataagtttaaatatcagattttttacagccagaatacaaacagcaagagggttaaaaagcagttgctacttgcttgcctgaaaagcatcttatctagagctgaccccattggccaacgccgtcttctcttgttcattgtacttgatttggtgtgtcacctgtctcttgttgtctatagattagcacaaaaagtcatgcaaactaag

SEQ ID NO: 26794 - DNA, 1342 bp, Bovine  19866880467365
aataaaaattgaatttcgtctgcctgttgacaagctgattgatctgggggctcttgtgactgaatcctctcctaagcacattctcatttatcatgtgcgagattgtttcagaatcgatagcagccctgagcagacacgtctctgctggggacccgtcagggcccacagccttccctgtaacactgctaatttttttgacagaattatttcaacagttaaatcgttctaggcctgttgttcccagcctttcactagaattgtttgttaaggtcatactttttaatatacttcctgtaaacactggaccttgaggagtttgccctttttctcatgaggttaatttctcacccccgctctgaaagtgaaagtgttagtcgctcagtcatgctaagagtcagtcatgtctgactcttggcgaccccatggactgtagccctccaggctcctctgtccatagaattctcgaggcaagaatactggagtgggtagccattcacttaatctgtggttgagcgatgttaaattttaggatgcccctgaggtgcaactctttatatacaacctgtgtcaaaggataagagcaagagaaagcaacttaactgccatcctagggcttcatggcctagctgtgtggctttggcaatgatctttccctctctgagcctcatgttaagaaattgggtcagatgaagtcttaagtagagtctatcttggatactctctttgtccaagtcagcagttgtgaaccagaggttcatgggtagaatttggtctgaagatggggttcatttagcttccagagtatctgctttttgtttgttaaatttgattcccttttttcttactttatttaaaaaattaatttgttaatattttaaaattacataaatacaattcattctttctgtgacacactaattttggtatgagttttgacacatgcgtaaatgcttgtacccacagtatacagaacaagataacatcccaagaactccttcatgtttctccctcaaaatcaagccctgcccccactcttaacccctgacaatcactaatatgttctctgttcctatagctttgtctctttcaggatatcacctgaatgaaattatatgattatataacctcttgaaaccaagttcatgagcacaatgcatttgatattcacccatgatgtatgtgtcggcgatttgctccttttatttctgaataatattccactggggcttcattgtttgtatgtatgtatcaccatgtgtttatatgttcatctactgaagggtatttgggctttttcaagtttttgatgatcatgaaaaacggtcccattagcatttgtggg

SEQ ID NO: 26795 - DNA, 3893 bp, Bovine  19866880493623
tgtgacattttgttacagagtttaattacatgaatctaaaatattgctacaattttccaaactgttaaaccttaattaatatgaacccacagggaccaccttgatcgttctaaatattctgaggcacaactcctacagtagtgcttccatccgcctgaagtgctttgtaatttgcaaaaagtgattaattattagaaatgaaaccagacaaattaatttaatataaatgaggctgtacatgatttgattaattctttttaattacctatatgttatttttttcaatagctgaacaaaggactccattcttctcctgcatgttcatattcattaatctcattagcagagagtattaatataattttatcgcacgttccagaagtacggcacattgacaaaccgtaatgaatcgcggcattagtgccctatcactacattaatttcaagacatgcctggctcatctgcaatttactttgaggcttactttaaaatgagctgaataagcgtgtaattatgacatctgcttcttttcaggtacctcctttgtaaatcagtgacaaaggaatagcaggtttaaatatgtgttaacacctggatagcatgtataattgcaatatggcgatgtgtaatgaagattaaattagaccatactatacctgacatatgcaagaacataattgaactattgtcattattgcagtagaagcagctgcaaaatgctaatattggcattgaggaaaatgaaaccacgctggaaaagaaggctgaagaagatagtctcaaaaaaagtcaccaagcaaaaaaccgtatcaagattggatgctgcaaactctaggattttagcctcttccccctttgtggctgatgacagttggtcatgaatttcatgaaactttccaaaagggtccatttcggatgtcactggggcatgacctcacactgcatatcttgtatgctcagcacttctgctctaggagggccatggggtgggcaccctgcccagtgctcctttctagagcctcaggcaggaactggaatcctgggattgaaatccagactcttggtatggttaaccctagatttcccagagcaagacatcgagaataagagaatgctttgagatcacctgggaagcaaggtgaccttgggaagggttttaggggtttgcagtcatcagaggcccccagaaagctgggaaagagaagaaaattgcatcttctctctcaaatcccccctatcttccctgaaaacaaattgttaggatagcctttaggatttattcagtttcagataagaaattatcacaagccacatttactgtgaacctcatatcctcctgggccaagtgggtcgggggcgggggggacacttaaccacatctatggtttttccctcttggaagcacagtccctgggtgtttgcacatagagcttgacagcagccctgaaatattgcttttgaatttaacaaatactctaaaggaatttggggctctatctcaaaacagtgttaaggaattggctttctcaacaaaaatccccatgccagcctttttaagttgatggtaagggaatgtgaagagaaactaaaaagagatgaaaataagactacttcatccgagatgctggtgctgaaagaccaacacaactttctggcagagttgacaagaggaagtggggagcattacgttaattgattgagatgttcagctactcaaagtcatttcataacagcagggattgacatgacacctgattgaatgaaaaatagtttctgagagaggatgtgatatttataaaataattgtaataaaaccatttaaacaaatgtggtgcattggaggccacttaaaaatcctatgtttcaaagtgtggtttcagaagataagcatggttggattgtctgggaggtttgttaaagcatgagttcttaagatccaaccccagagcctaaggatcagaaactctggaagagccatttgggaatctacatgtttaaaaagctcctggtgacttttaatacacaattcctgatctaatgtagccacctcttttgacagaggaggaggaaacaaagaccctaaaaacggggaccagagcccaagcagcctctctcccgtgatgctgagtgtgcgtggaaaggaaaaggtgggatctggctttcagcagtcgacaggtacttgcacagcatcacttggtccattgagtttgtgcttcaccagatgtagcaaacagatgttataatgctacctggtttcatccactgaggcctgtcacagacccaggacttcagagcagctccactcttcagggctgatcagtagagagaatgatcacaggagagttttctgcaaagttttagaacaagaaagaggattatgacttcaacttgcagtgaggactgtttcagtgtcaactttcccccacagtcattcatttattccctaatgtatccatttatcttacaacccttatcaagctcgtccgatatgccaggtattaatgttaagcacctaggttacaaccttaagtaagaaggaaactgttctggtccccaataggaatcaattagatccaacctgtttggctttcaaaggagatgtgaaatgaagtgatcgtactacatgggttgtttcccctcttttctgagctctgtatgtacctagagttccaggtatataaaggatcattgggggatattcattttctccttatcctcttccttcttactttccctttaatatgagtgagaaatcagcttgtagaacaagtctgagtaattgatcctgtgctttgtaagtcctccccacttcctctcatcagctcttgccaggaagccccgatgtcagcaattccccgcgagcatcttcagatgaaaccgtgttcctttcatctccttttagttcctcttcacatttccttacctattactgacatgattgcttgtttaacaaacgtataccactgattggttaaatattaaataatcggtgccaaactaagtacaacattttgaacgacatggttttcattccatattatagctccttgttggaaagaaagcctattttagaatctctagctccatagggattgaaagaagtcggccaggacacatttaaagaagggtgtcagctgaatgaaagagcgagtgtatcaactagcgtagacaaggctgtattgcagtgacaataatacacctgtcttggtgacagcaaaccacaaaggctctgttcctcatttttagagcagcctccatcttaagagatgctgttaccatccagagactaagagtgagctctgagaccacaaattaaagctctggaatgaatggggcccgtgtcattttcactcataactcattggtcagagtcagttctctgatcctaccgcaactggaagggccaggaagtgcagtcctcccccatgcctgcagggagatggatggagagatttgagagacagcgctgatggcagcacaggagtaatcgaatgttatcatccttgctcgagcttcaagtcagcctgcttagaaggaggctgcaaattaggcaaaacatgtagcccccagcctgaatttcttggctgaaaattgagcacctcacctgcccaaataaagttacttggctgagctattctctgtctttgataaaagtggagtttcttggagagctgcaaggaaaaggcaggtccctcgtgttcctaactatgaattagagcgaaggatgtgaggaaagtgagttccctgttggctttaagtcatctcttcttatgtatgaaaactagagagagccccgactttgatatgggacatctcttgagtgataactagtcttgtcttgcagatttaggtgacaaatcagcaggtcagatactataaaaatggtgtgatg

SEQ ID NO: 26796 - DNA, 1558 bp, Bovine  19866880501025
aggaaagttcactcgccctggggtgaatgaagggtgagggaagacatccttaatgtcttccaatatcatcctaatgacatctcagaaacgaggaggatggacaggagtagctgggcaaaggatttactgatgacatcacagcactgagataagcatgtctaaggggagaggtgtgggaagcctggctttacaatggatgctggtacttccatttgagcgacatgtagactagactgtggagggactagttagcaagaaggctagagaagcaagcaggtgtcaggtcgtgctaaggtgaattttactggcaagagccagtaaaaggtttgaaggggaagagttttgagttttagaaagattattccatactatgtatggaaaacagattagagaaaaatagtactgaggacaagaaggtcaattaagacttgttgctgaaattccgtaagtgattatgaagacagataaagggactagaggcaagaacagagagaagggaatgaactcaaatggtcgagactgggatgcctaggtgtggtcaggagtaaaggaagggtccatggtaacccctgggtgtaatacttcagcttggacattcaacctcaggaacagatgtttagtccgcaactggataagaggcgatataacctattgaaaaaagacactcacactaattaattttcttctaaacaaaaatagaagtcaatagaaatgggacatattaatgactgttcacataaactgttaaaggaataagataatcctttaagattaagtattaaggactcccagcagactttaaaatgtaagcaaaggaatttctcacaaaaattaaagttgacaatatcacactctggacaggatgtgaggaaatggtaacttaggttcacttttgctggcaatgcatattgatacaatccagaaaatctgacctttttgtataaaccttagaagaactctggtgtacaggtacatgtacaggatattaattgaatcactgtatataaaaaatattcaaaagtgaatggataaaaatggtggtatgttcatataatagaagtggataaatatcaaaaagatcattttaactgaaaaaaatcaaattgctgaatgatattgaagcaatccattgtattacttatggatacttatgttagtagtaaatacattacagtagatataaaagaatatataaaagaattcctagggacacctaactcagggataaaggagaaatcaaggatggatattgaaaggtttccaaaatgtctggtttattaaaccatttatttattttttcaaccattccactgttgacattttgcaacagataattctttgttgtggaggattttcctgtgcatggcaagatgtttaccagcatctctggcctctacatactagaaaccagtaccactgccccttatcaaccatcaaaaacatctctagacactgtcaaattggtccctgggggcaaaaacatccttgtttacaaactactactttattagattgatattctttacagttttctttttaaaataatttatttatttta

SEQ ID NO: 26797 - DNA, 1116 bp, Bovine  19866880546047
caggtgagccaatcagattatctctttctggaattgccagttgtactggagccagaggaccaatagagcagaattcatattactacttctcagtgtctcttgtttttttctgttaagtatgctgattctaggctactccctgaaaattgagttgtttttgttgttatttttaaaaatttacttattttttaaattgaaggataattcctttacagaattttgttttccatcaaacataaatgtgaatcggtcataggtatacatatgtcccctccctcttgaacacttcctcctttaacaagcactcctaggtgagtcctatcaacccattgatgtggaatatactagttaagaaagagtctaggaacttctctatgggatctccatagtaggctgggttcttccttcccaaattcttgtgagtactcaactcttcactccatcaataagcttaatgcattctcttttgtctttaaattgatcagagatagtttttgttacttacaatgaaagactactaatatggaaatacacttggtgcttgaggcaccaaccaaagggtatgacttgctgaagtcagagttaccgatgagctaatagaataaacctgctagctggttgaagaagattctattctatagtatacccttcattcatttgccctggaaagaagaaaaacatgataaatgagggactttgaccctttaagcaaatgaacaaactgtagctattgttttgcagacctgtgtgacctactgttctgtgtctgctgccttattttgcttcctatcattttattttcagaaagtagccaattccctgggctctcttggtcaatatcccctttgtgtgagaatgaatgttcatctttggatgtaacattgatgtatgagataaacatgtggcgggaaaaaaaaagaaccatgatcccctgtttgacagctgggtcaagaaaggccaacaggccaaatgctttgacatgagcacatagtcagtggagttgttctattttcattcaaagtttcttaattcccaggcactggggaggtagcttctgccttcttaagtgaggtgagtctgctaaatggacatggatatgcttcccaaaaggccaaa

SEQ ID NO: 26798 - DNA, 1628 bp, Bovine  19866880558487
tggctttaggtagtgcttaaaactgcccatcttgtcaacactgtgactagtgatgagggaacaaatgttccagggtagaaaccagagaatatccaagtatatgaagaactgagtggggctggaaaacagaatactctacacctaattcaatgtgacttttatatatacaacattgactctgtgccagcttttgtatgcagcattgaagatgcagggaggagttaaacatcacctctgtccttgggggagatcccagtgtggagggctgggcaaaaaacacacagcaagctagaccaggaacagtgttataagaggcatttgacgagacatttgttcttgatagtaattctcaagttagagtgagattactcattgagcattttcatgtgttccaaaaaaggaaaacattttcttgttctgtacagagatgatgctacagggaagggataaagttttctttcttctcttctcttttgtaaaacactgaatttgaactgctgaggtggcacaactataacagctcaaagtttcagtcctggtttgaagatgaaagccaaactgtgtacatgggttctttattcctttgctaaataaattcctctgtgaactacgggaaatgaaaggccccactgagggaggcagtggggtcaaagatggcagctcccccaccctctgtacggagcagcacctaatgctccttggggggtccttttctagactcctccccatcgctaacttttaggaactctctttatttatagacatgtcggccttgctcagtgctggagcttgtgtgtggcgttgaaggtacaggaagaattaaacatgacccctgtcccagtgtagagggcaaggtacaaacaaacagcgagtcagactaagaacggtgttccgagaagcacttgctaagacatctaaccggggccttagttagatctttgggactgcacttattaagaactaattttccactctttgcattaactgagaagccagagagggcccacagaagagggtgggttgaaaggggtggggttcccccctttagtatctagagtaaggctattattgtaagatatgtggatttaggaagctaccctttccttaatctggaatttattggaagaccaaggactatacctcttatggacattttgtttcaatctggctagtgtccattctcctgttttcctccatctgcactggattttatgtgggcaaccattagccctcacttgccttctcctagagttcaagctctctggagtgtaaaccgtgactcagagtttgatatcctcaggctactatgataggtgcagggaagacacaaggcctggactggaccagtgagagcaaatgggactctattctgagacttttgttgaaactactgggggaaagcattctttctcttgtatggtagtcaggggcctgagagataaacctggggctgcggacatcttgccaccacagagggagaagttatcttagagttcagccgttctagactaaagaagaaaaattggtgccagggtcctaatgatgttgtttttgaagcctcttatatgcatgaacttttcagttgtatgaaccagtctctttctttctggctggtggtcaagtcagtg

SEQ ID NO: 26799 - DNA, 929 bp, Bovine  19866880588053
aaataaaataataaatcaaattctacttcagacatctggccacttgttaagaagcgtgcagcctgccatcagcaactttaccagctacacctaaagggaaaaacatcaatttcaaatcagtggctactgtcaagcatgtataaatgtatttcattgcttctttgcaatcagagatagtggaggcctgaactacaaaggcaatagctaaagagagggtctcttctcacacctctgctactttctactgctgggacgttcatctgagtcccagtacaagtgcctgcacgcacgcgcgcacacacacacacaggccctttcaacgtttcccaattttttaaaaatattttccccactccctcccttccctgttataagtattaatactgcattaatttataacacaaacctgctaggtaaacccaaaaggaagagtaaatgagtttaaacaaacaaaaaaaatatacacacacattatatatacacacagacacacacacatcccactgaaagatacccacaactgaattatttctctctttaaatagcaaaaacattggtctgcccataaagaactaaatgttcacttgttttcctttagatcttccagaattggctctccaggaacttctcccatattggccaaagtagctacattttataagctactgctgcctctaaggcatgctccaacatttccactggcttaagtattctcatacttttttcaagtttgtagttgcccaagtttaattaccccagaacaattccgtcatcgacaactaactaaaagagtgtggaattccccacccccatccatctattcattgagattctaccatgtctggaatgtccagggaaagattcaataatcaagggagaaatgagttgcagaaactcaaagagcacagaatagccaaggcaggagatta

SEQ ID NO: 26800 - DNA, 1679 bp, Bovine  19866880646109
tttgcttttcttttaaaattatatgtgttcttatgtgtgtgaatgtgtgtatgtctgtgtgtatgtctgtgtatgtatgtgtggtaaaagagtatggaaaataaaaggaaaatgtaccacaaatccattgcctacacatggacatgacatgaaaatacacatgtagtagtaacataagatgaaaaggaatagatttcactaatggtatttgtacattttcttctgtatcctaccaataacaaagtattctgtaatgacttgcaaaatacatgtatttcctcctccatattttgttttgtttgtttcctcctccatattgttcttcattcatgagacaatccaatatatgcaattgtaccctagcttttattatcatatattatatcctggtgctattttcctatatgtatgtaaatatgtatttttaaacaatcatttagtattccatcaacttatttaactagctcccaataagctaatttagattacataatttttttctaatgaaaaaattctgtgcaatgaatattcttaagcatatcttctgacatagttctgtgagtatatatccacagttttgtgattatatagcagtcagatatttttagtcaagaatcctatgcattgtttaaaattcctgcagatattgccaaatgtccttctaaagagcttgcatcaattcaccctctcgccaccagactgtgaccactgctttttactgtgtctgctaactttcacattcatgtcacccggtgatcccacgaaagttatgatgcaggttcaatatgggtgtcacccttgtttctagcatgaatcaaggctatgacccagatgttctgattctaagtacagaacgttttctcggacaaattaaagatgcaaagataaattgaaggttggtaccctctttttctgcctctgacagttgaagagagcaaatacaatggggaatctgtggttcagagctgtgggataagggctttcaccaagtttggaagctactaaaacaccatttacttagagtttggggttgagccataaccctctattgttgaaaggcattttcctttgtaatacttccatggaaagaaaaaggacttgaaagttgtatttattaaaaagccccaaaggcatgtgaacatcaatttacatttttcttttttatagaaaaaaataacgtagttaagtgtaaatgaatgtcaaacatgtggtttatatttcctttaagacgcatgtgggctttaaaaactaatggaaataccttaggagaaacacactccacaaaatggtgaatctaaaatatatagaacatttggagcaggttggttctggtagaggagatcctctgacgcctcacatgagatttcaaagagggaggcagtcctctaagctcagggctcacctctgtttgggttcatgacttagagagatgtgagatacttcaaagttaagaaggccattaccatttctccctatccatttaatgaacacttcttctgttccgggaatcagagaaatgaagacaaattagagacagccttgtcttcaaggagctgaagtcctagtaagaaactagatgaggagagagataacaaaaatggaatgtgattggtaaaataaaacatagtcaggacactacagagaggaaagttcactcgccctggggtgaatgaagggtg

SEQ ID NO: 26801 - DNA, 1043 bp, Bovine  19866880651367
cttcttatgtgcataaactggtctgtttatacctattacttaaccaagagaagctcatcttttcttctttcccggaaaacaatctttaaaagcaataaaaagcctgccctccatgaattcaggagagataggagcctttagggagaaaagaagcagctgtgtaagtcagaaatgtcatttggagaacatgtcattcgttctgcccagctcagtaatcttgacacttaaaggggcaaggcatgctttgccccatgataaaacgtgaaatgaaatcgtacatttataaataaatgatctgactctaattggcatttccaagccctctctgggtagtagctttcttgttaacaagctacagcatttgacactagtgatataggagcctcagaagagaaattgcaagactatttctaaactcctatttagtaatagaacctggaaactttcttttaatacctgcacctctggactgacatatggagaagttaacaataaaagtttttgagcacagctagagctgaaaataagaagcaaaacattctcaaggaagaaaaaagtagatttttaaaggttccatatcttaggagaagtatacatttgggataagagatatacaaaatgagcctggagcatctcttcatagctgaaagcaaagatgtactaaaaaactaaaaagcatagaaaaacaaaaaatctacactgatatggacatatcaaagggacaaaggagccagctgaaagcactcccaactgacaatgctggaacaattaggcagcaatataaattaaataatattagattataactcaaagtatattataaatatccattagttcctatggacatagttgagcaaattaaattaggggagaagtgatgaatttgtcattcagaagaactgcaaatatttctatattattttctccttcatgggtgtgtgtgtgtgtgtatgtgagctcagtcgtatatgactcttagtggcaccatggactgtagcccgccaggcttctctgcccatggaattttccaagcagggacactg

SEQ ID NO: 26802 - DNA, 1589 bp, Bovine  19866880719714
aagggcaatgatgatcctaatagaatctgtgaggggcatattacatctggagtattgtttgctcagttctgggtgaaagagtgagcaattatatacagcagggatttgcaatgcatgtcacacaagaaatggttatcagcgctggggacaaatgagaacaaaatgataatattttcggggaataataatgacctcgatctatttgaagagcattcaggtgtaaaagggagtaaacctaatctttgttgctgtctgttttagtctgctattgccacattaatgctgcggcttattactacatttatttacctcataggtatctgcaggagaactggagtttgtctgatctgatgtaggcttgcctgggcttggctgcaggtcctgatttgggttcagttttgttctctatgttcctttttctttgagaatcagtaggtgccctggggaataattttttcatagtgatggaagaagcacagaaaggcacacaaaaatcagagcctcttctggtatcacatccaccaattctccaattgcccaaatcaaaccatctcaaagtcaaaggtcaagaaattactatgaggccatgggaaggaaactggatgtattagtattacagagtagtaaaaccaatcattcaacacaacccacccccagactaatagggcaaaactaagttcagtgggctaaagaacattgattctgctttaatgtaataaaaatggaatgatcgttgaaactgtccaatggtaggtgtaaactagcaaaacccttgtcccagatgaggttagagtccagtgattcactttctgagagcgtcataaatggaactccggcatcatttaggaattcagacactgaggcaactggtatctttccaactctaacatcctactattcttgatcctattctaccccacacccttctttccagactctgctgtcctgaggctatttctccccaagccatctgctgggaagtttatatatggcttttttgcgtccctgagagtttcacatgagcatcccttatcttcccaattgctttggaagcatttcagtggcacagactgggtcttaaacttcttttgccactgtctatagactagctcagggtcaggcaccaggttcttagcatggcattgaacaaccatccagcacccagcctggccccaagccatcttgtcagcttcatctcctacttttcacacactgtgctccaaccaacttgagctacttgcccttccttgtacatagcctctgcttctcaggattttgctcactcaaataccattctctcttatcctcacaggcacagatcctatcatctcacccagggaaaataatatgctatgttctccaagatattttcccactgatactccatccataaagaagtttcttactattctgaataccctaacctttttttgtgaaacttaagattttcatgggatataaaagtggttctcaattctaaccatattagggtggtttgagagtatatgaaacatttatatccagttcccatcccaaagtcatctcatattattgacctgttaagagaaactccaagtaacagggtttcg

SEQ ID NO: 26803 - DNA, 1247 bp, Bovine  19866880787252
tgattgtttttggagatagggcctttaaagaagtgatcaagttcaaacaaagcatttagggtgtgttcataacacaacctgactggtgtccttataagaagagattaggacatgcagagagacagcatagaggctctagcacagagagatgaccacgagaagaggcagcgtgagggtggccatccacaagcaaaggacagaggtctcagcagaaaccagtcctgccaacaccttggtctggtgcttccagcctctgttgtgtaggccacccagtttttggtatttcatatggcagccctgaccaaccaagatagcaaattaagtgggtttcactgctctcagttgcaaggaacagaagacttcaacttaattgactcagaagatagaatatgtattatttcacatagctagaaatcaggaggaaaagagctccggggctggttaattcagtgactcatgacattgtcaaggatctgtgttctttgcatgtttctgcgttaccattcttatctcagtatgtcagctctgacctcaggctagactcccttcacgttgacaacatttccagacatgacactgtccagaagaagaaattattatatcttcttgtttccttttaagagcaaagaaactcttaacaagccctcctgcactcttttgcacgtctcatcaaacagaaatacatcacagccaaagactaaactaatcactggccatgaaaattggggacatcatgatagaatctactctgaatgaatacgagccagtggaggaaaatgggcctacataaaataaaggcggggttaagcagtaagaggaaatggatttgggccaggaaaacaactgtgtctttctggttccttttactatgtttcgtaggccacaaggagaaggaactggcaccccactccagtattcttgcctgggaaatcccaccgacaggaggagcctggcaggctacagtccacggggtctcaaagagacacgactcagtgacggagcacatgtgctagaccacaattctatgtacaagaaatttgacaaatgcattgcagaattagaaacacttctttaatatcactcctctaatctgttgatcttgttaatatttacccacagaaacaaataagtttggatgttgatattttcataaccttgcataatttaaaaaatttgtatacgtgctacagatcccttttataagaatgaggctcagagacttaaaataatttcctcaagaacataca

SEQ ID NO: 26804 - DNA, 1224 bp, Bovine  19866880825531
gacatgaggaaattggaactactcaaaatatataattcaattccaagcaattgtttgtatctatgacagctcagatccagccaaatgaccaataactgcctttgaattagagacttaggtgattgttgcagttttgaaaacccagtcttgggagaactcaaaagaaaagtgggggtgttttttaacagaaaacctaacctgcctgactgtccctttcttctgaatctcttcttcttagtctacactgtaaggtgttaatgaaaagtaatgtgtacctacagcaacaagcattttccagagcatagtcccaaaaaagctgtcaagagagagaggtttgttgataaagaatttcatgatcaaatatgtctaggacattcaatattagcttccctttccaaccatttgaaaatccaccaggcatcttggcatattaaaggctctgaaaagtcctacagtaaagaaaacttttaaatgtgttccagcagcatttttcaagcttaattaagcacggggatatttgcttcccctacacacagatcgagtgttccataaagcatagttttagaaatattaacaaaaataaaaatactgagaaaactaaatatgtcaggtaaatatatttcttatcctaaaaaaaaaatggaaagcatctctcaatgttattatttgtcaagaaagaagaagctaaaggaacctttttcagtctcagcaaaaggaagctctccacatatctgactcaaatgttcttttctgtgcgtaggtcgtgtctgtgaacaaacgccagacacacactccttgcattgagtggcacatgccagagcaggcaggggctaggtgcccctcccactaaaaagtacagcttcaacactcattaacccactcagaaggaccttgtgcaggtattactacaggtacccagggaagaattaatagcacctttgtctgtgtccccaaaaggaacataaatgctcctcctgttcattcccagcatctaatccatcaagaaactgtctggaagataaattggagctaagctgacttttgttaataatgtaacaattttgaaagtgcagctttaatcaagggggaaattttctagaatttgacaaccttttccattccctttggtataggctccattcttttttcaaaactgtctaatgctgtttcttaaggtggggttcaatagaaaccagtctataatgcaatgcactctttttatgt

SEQ ID NO: 26805 - DNA, 900 bp, Bovine  19866880842749
taccatcagtcacatttcccatttcaggaccaaagttgaagcagaagtttctatctggtcttctggaacgaaaaaagaggtagtgaaaacatctatggctcttgaagcctctgctcacatcacttccactcacgtttcactagtcaaagtgagtcagataatcaggtggccacgcctgatgtcaatggggcagaaagtacagtcctccataggtaatggtctgatatggagggctcacaatattttgaaaaaatgaagtcagtgacaagggaagagttttttttaagagacttatcaaacgtctcaggcaacgagtaaaattatttagctggagcagtgagtgagtcttgaagagcttgatgagataagatgccagcaagttgtaggggggtggggggagaggcaggctgaaaagtgaaaggtaatgaagttttgaagtccctgcagctgagttagatttgatgcaagagtctacatggaggatgacatgaaaacatggctgggttctctgatctaaaatttgctttgactcatattcagcagactcatttaacatttaatgagtttatcctgtgtgccagttgtggtgcaatgtagacatttgcatatgtatatttaaaattttaatcctcatgacatctctctgaagtagatagtattattccgtatttttttttaagttgaagaagtaagctcacagaggttaaacgacttgcttaaggatacaaaaggagtacatacgagagccatgatgcaaattgaggtcttttctttctactgcatcactgcagggcaaagaaataaaaatgccacctttctttagtattgacttgttattctttatcttctccttatacccagagtctgaaagcaaggttaatatgatactttttctcctca

SEQ ID NO: 26806 - DNA, 1122 bp, Bovine  19866880857666
tattactcgaaaagcaaacactcgtgtgtttggcacacacggatctatgtaaattaggggagattattttgctgctagtccttggctgttcggggatcaaaatgtaattgtttcctaattcttaagaaacagaatctctactggactcagttctttttttggtggtggtttttttttttttttttacaattttattgttctatggttattaaaaataacatgtcctataaattcaacctagagacttgggtgcttatcaaagaaaggatatcatcagaggctccaactatgggaggaatatatgtgcattggtatatagacctgttgtggaaggacttaatatctgtgtaatgattttttttgccttaatggccctatagctgaagaataaaaaacggactgactgccacccatcgctaagagagtcctgggtcttcagctttcattgttcagtcagtaggctttgtgggcgaccctgcagggcccctcttgctggaaaccctctgagcttcctgatttctagtcctgtaaaaacctcctcccccatcactacctttgtctctttggggggtggggagtggggaaaaaacctttttcacttgagcaaaataaaaactacccagtatttgtttctggagtgtaattataaacttcattgtacattcttcctggctttgatgcttatcttgaagagttcagtgaaaataaattgtttttatgaaagcagagaaaccatttgataaacacgctgtctctgaaaattgttcctgcaaaagaggtcattctttcactttaaaagaaatagaatatatttcagaaaacaggcaaggcaacagtttaggatttctgtgaatacaggacatattttttttaaaacagggtgtaaacacgttgaaaattgcacacctcctggttgtatggagtgtattggtttttaaaacagctttattgaagagctacttaggtcacaagcaaatactggctatatttcatatttctgggaatgaattctcagctcagtacttttttttttgctactaaggttttggggttactgtttcataattactgtatatctgtggaacctataggtatatctattcctagtaaaagtcaaactta

SEQ ID NO: 26807 - DNA, 1327 bp, Bovine  19866880914041
ttatgatctgaatagtgaacaatggtcccccaatctcttttactttagtgtccagattttatggttgaggaatctcttcctagtcttatactaagtctgaacaggccagttgctagattaaacctatctcccacctcagtgtgtggttgcttattcattcatccattcaataaatattattggacatcagctatactcttaactgtggagttccaatggtgaccaaaagaagctcttacaaaacttacagtcttatggtaattaaaatattggcttcataggtcaaaccagtgtttcacatttggtactagagttaaaaatgatttgggtcaaatcaacttaaaactcaaacgaaaggagaaataaaaagcaacgtgcacacacctgatgtgaatcagttcccgcaggccttagaatgctgcttggctcacagcccagtaaattatattaaagtagaagggagtacagagaaggcaatggcactccactccagtactcttgcctggaaaatcccatggacggaggagcctggtaggctgcagtccctggggtcgcgaagagtcggacatgactgagcgactttactttcacttttcacttccatgcattggagaaggaaatggcaacccactccagtattcttgcctggagaatcccagggatgggggagcctggtaggctgctgtctatggggtcgcgcagagtcggacacgactgaagcaacttagcagcagcagcagcagaaggaggtacaggaaaaagagaaaagctaaagaatggagaaattgccaaagaaggaaaaaaaggaaggggataaaaagactattcatgtgggtaactgatggttgaaaattttcctttttcacatagaggatggttgaatagagaatcttgcttctaaatgcatacatactgacctgctttaataattcaaatcggagtacaggttcacagagcttccagaatcctccataaaatcaaagatacataaggcaggaaaggctcagcctaattagagtttgtagaagccagccagcatgagttggggtgggagagtaaggtggggtcaccttctgcagcaccagggagagagagccctggactatgtcaggaacagctgggtacaggtaagaagtaggggaatctgaggcacctcaaattatttttactgtctatagattcctacgttagtggagtctttgaaaattttcagggtaatccatttgtcatcaaggcagataaagcacatttgcagtcagccaaggaaaatttagcaatggcctagttgtgtactgggtcggattttgagtactaggtctatgcagaa

SEQ ID NO: 26808 - DNA, 1228 bp, Bovine  19866880966608
taaaaatgaaaaatgcttagcctttggaattttagttgacagcttttgaaaattaaattataagtcaagtcctgataggtttgatatcttcccttgcagctttgccaatgatgtattgcagctttaatggaatatcatttatcatctgataataacaaatgtagtatttctgagcttgtcatctcttctgtgatgacaaatagtccaacttgtagcggtgataatggaattttataatgatctgtcctaaactgactcaactgcagcctgagctatttttcttaaatctcataatgcctattacatatagattacaacagtcagcgcctcccatcttagcatgggaacagatcagtgaatccagattttaggcaaacaacctcaaagtatcaaataatatttacttgtttatcaaaattatccctcttaggctaataagcaagcttgtcggagactgtcggaaatgggaaactataaaacctaatagttaaaaaaaaaaagtgatacaaactctgtttatctcttaaacagtaggtaatgcatttagttttcagctctactccttcaatccatcattttctagagatttatttaatgaaggcctacgtagtgctgagaacacaagttagagagcccaggtgcccttccactttatcttgaagcaggatttattttgtgtcttaactctcagcttgtctgatatcacagccttagttgataacatagttgcacctgtacattctgtagtcaaaaatctcttgccctcttggctctcttctgaaacttccaatcagcctgagacatcatagaaagcctaggtctggaggatgtgagcttcttaaaatgctctgatgatatgtggatgtaactgtagccgccatggtgctctgggggctgcctcacagaaagggactttgtcaacacagccaggggaggcatctcagtggacaggagggtgcactgtttctcctggcagatctgatgttctgtctgtggtcacagcagaccagcatatgacaaaggaacaggcccacgtgaggtctcggttttgaccctgagggagcagagaacactgttagtggcacaaactgatatgcagatcgatgtccgacaggtgttaagtgttccctggtggggaccgacaaaagtactggggagctgtgcatttcagatgggctatgatgacagagccagtagggatatttcatagctactcagtctttgatcg

SEQ ID NO: 26809 - DNA, 3475 bp, Bovine  19866880982483
ctgtaaaatgaagaggttggactgtttggtgctagcttgttgcttaccagctgtgtaccttgaagaagtatcagagcctctctgagctagattcccatctctgaaaagggcatcgttatttctgccttgcagggtggttaagaagaatatgggagaccatgtgtgaacagtgtggggccctgtgcctggcatgatagtgataagcgatgatggctattgtctcttcctgagagtgcctgagtctggagcggtttggaagaggactcacttgccaagcgagatcctacagggccttgcaagggcattctgatgacactgtggtgaggatgccacactagcataggcaggggataaagagaactttcagctaaaagggagcctaccaactgtttgagctgctgtttattaagctaccgctcttctctagatgctttacaaatacttcacacaaccttgactcagtctaatagggctgacattaatggcatccccatggccagtagtgagtggaagtacaagaattaaaaactctgctctttctcctttatcattttgctctgattatgcctaattagatctttaaaattacgtgcaccaattaattgattttttgattaaaaaatcaatttttaaattaccagtgaaatagttttttttcaggtgtacaccaaacacatgtgcaatatagcaaatacaagaaatacaagaaaaatccagaaaaatagacaatccactagcaaatctactatccaacatatagacacagctgtgactcaacatttttttctagatcttttttcttttttaaatttctttggcagtgttgggtcttagtgcagcgtgtgggctgttttgttgctgtgtgagaacatctctctagttctggtgcacgggctccagagtgcatgggttttgtttccctgcagcatgagggatctcagttccttgaccagggatcgaacctgagtcccctgcattggaaggcagattcttaaccactggaccatcaggaaagtccttagatctttttttctttgtatgtttttcttatattactgagatcagggaatggtaataggtttttaacatcagtgaaataatgaaataacctcagatgataaggaccttagattagaaagtactgaagttactttattgcaggaggtctcaattgtgggtcattttgcctccaaaggaacatttggcaagatctggtgctatagtatgggtgtttgtgttccccctaaattcatatgttgaaatcttagcacccagtatgatggtgttagaaagtaggacctttgggaggtgcttcggtcctaagggtggagcccccatgaatgggattaggccccagagaacttactgctgccttccaccatgtgaggacccagggataaagtgctggctatgaaccagaaagagagccactatcagaacaaaaccatgctggtaccttgacctgggactttccagccaccagaactctgagaaataaatttctgttgcttctgaggtacctcatctgtgatagtttgtaacagcagcctgaacagactaggcctccagagactgtttggttgtcacaacttgggaaggaaggccactgtcacctagtgggtagagaccagggatgctgctgaacatcccacagtgcagagggcagccagtccctacaacacagattatcctgctcgaatgtcagtagtgcctagatggggaaccctggtctgtctgatgcctccaaacacagtggctttgttggtgttggaaagcagttgcagcctgctcatctccatggcaacgcaccaaagcacaggggggtccagcctgattaagtggtcggggagggctggtagctttggctgcatttctgaggggctgggatccaggtccctgggggttggatttcagcacctccctctcaaagatggtttcccatcccggcagcattgcctccactttcacaaccactttgtcagtggtctgtagtgaagccagagggctgggagtgaagctggagtaccattcccactaattatgagaccctgggatttggcgggtcagaggtcagagacaggtggaaattaagaggaggacatcaagaccccagccaggagaggtgtcctgagtctgcccacgtggccatcagggccgtcttttgtttccttctgtcctgagggagttgggtcaggaacacactgctggtagagactgggtgggagaacaggcagagactttgccctcatgttagttttcggggctgccgtaacaatgcaccacaaatggagtggcttagtcttccctgatgactcagtgggtaaagaatctgcctgcagtgcaggagacagagatgcaggtttgatccctaggtcagaaaaatcccctagagaaggaaatgacaactcactccagtattcttgcctggaaaatttcatggacagaggagcttggtggtctacattccaaagggtccctttttcttcattcctgaattattcttatatactaaatgtgaccctaagctcccttaggatgactttgtttcatttatcttcctatttattccctgcaaacacatctttgggcaagaaagtaatgtaacttgaagtttaaatgtaacctggcttcaaatcatagtatttccaactcttagatgtaaccaggagatggtgcgggacagggaaacccggcgtgctatggtccacgggattgcaaagagttgcatatgattaagcgactgaacaacagcagctgtaaccctgagcaaggtatctcattctctaactgttagggttataatgtgatttaatgaaataatacgtgtaacatagtaagccttcaacaaatgttggatattattattttaaaaaatcttctggacagtatttctctttggtttgatgactcagcagggaatctatttcaacaataacaacaagtcttgtgtaccttggggatctttcctaagagcaatgataaaccatcgtccaatagatgagctaaacttctggtcaccagaaggttctggtcaatagattcagttttgtttcctgaatacttttttaacttcaattcatttccccttttcctagatggggaagaattggaaatacagcctgagttttgattttgcacctgtggattctctttaacagccacaagactactgggatgaaatgattttccagagctctctcatccttctctctgcttgccagccaagcctctgttcaattcatctcagaaaagtgttcatctcaaaacaatagaggagcttctgtaaggttctagaactctgaacttattaaccaagaactccaggggaataagctcttattctgaaagaggaaacagagattagggaccaaaaattatctttctcactctctctcactcacacacacacacatacacacatcctgctctgtttgtgagctataggattttttatttataagagaaatgcagcagt

SEQ ID NO: 26810 - DNA, 722 bp, Bovine  19866880982512
aaaaggaaaaaggatttgtattccaataaggacagtcatcccttagaatgaaaaattggcaatcttgtgctgacaaagagtggggtcctcgggcaaactgtgtaagccccatcacccaaagccagtccttctcctggccacgaacaggaagcgctgccctcacaaagccctctactccttctcattcaaggaggcagaaaagcagatccctcttgagacctgtttccatggtaaccagctagcaattgacaatgtggccggcagttgggcctcctgaaggggaaaatcttcaacggagaccaggccactgagaggcccaagaagggacagctcagacccaggcctcttggggaggacccaggaatcactgggctgtccctttcttgggaaaggccctggtgggttttcaaagaaatagatggagaaggaagaagggcctctctgaaggaggctggtccataaactagcaacaggcaaggtagtggtggccagagaaagaatgtgggcctgacagacaccacccttagaatcaacacaacttaaagcaacttccttgatctccataaggctcagtttcctccaaaagatcaggtaatcctgggcttctgcattgggtaactccagagggcatcactgaagttacagtctgtttgcttaccttcattccaaggagcgtgtgcttgccttccactctgcgctgagaaccaaaagggcaggagcag

SEQ ID NO: 26811 - DNA, 1780 bp, Bovine  19866881007570
ctggtttaagcttggttcaaaggctgaattttcatcttggttttgataagaattcacgtttacttaagacataatccagggacttccaaggagctagtggcagctcttctgtgaagctaagatattattttttatgtttaaaatgtaaatctttaatccttctggattttatttttctaatgtgacaacatgcctcaaatttaaaatatatagagtttttgtcccagaaatccctggtatggtaacctatcctaatgaaatactagctctgggacttttatgaacaagggcatttgtcaaggaaaaaacaaacaaaatgcatgatgtccatcaataagggaaatattgaataaatcctggtataatcatattatggaaaattaaatgtttcccaaagtagacgagttaaatagctattgatccaaagcactgtcaataatgtattgttatatgagcaaagtaccaaatgacaataacaatctcaaatcccttatatcagcatttactttttaaaagtagaaaagacatgactagaaaagctagacttccctggtggctcagacaggaaaacgtctgcctacaatgcgggagacctgggttcaatccctgggtcaggaagatctcctggagaaggaaatggaaacccactccagtattcttgcctggaaaatcccatggatggaggagtctggtaggctacaattcatggggtcgcaaagagtcggacacgactgaatgacttcactcactcttcactcagaaaaacatcaggttgggatattttacttttgtgggagattaagataggtaatattttctttacaagaatttatgttctttctctggtttcagtggttgtggtgaacacatgtcaattttgtaatttggtaaaagattatatctgacaagaaaaaattttaaaacataaaacaagtcaacaaactaaaaatgctcattctctccttgggaaattggtgccatttttggggggagccacacacatgaaaaaagagcaatcttatgtgattatcttataattttcttatgtgattatcttatcttataaggtatcttatgtgattattttataagattgcataaagaggagtctcatgtgatgttttgcctatagtcagtctttctgatagctgggacagttcaggcaaaggtgagagccccaggactgaactggtgacagaagggatcctagagccagtcatcttgaattctgatgacttgacttttatttttccctcaatggagtcccacgggcactcactgccctgctgactcatctaccacttaacccactagatgttaagatgatttcaatcaaacaatatcacagcaagtttttaacccgcccctttctgttgccttctgattttgagttgttgctctgctttcccgagagaaaaaaggattagacttggaggaccaacgtccgtgagttgagcctccctagcaccatgtatgtgaccttcaataaataacactacgcttaaatttctcatctacacaatgaagatgccttcagcagccctcacgcaggattagttcagttcagttcagtcgctcagtcgtgtccgactctttgtgaccccatgaattgcagcacgccaggctccctgtccatcaccaactcccggagttcactcagactcacgtccatcgagtcagtgatcccatacagccatctcatcctctgtcgtccccttctcctcctgcccccaatccctcccagcatcagagtctttcttagaaggagcctaaacaaatg

SEQ ID NO: 26812 - DNA, 1134 bp, Bovine  19866881090754
catgtgcttggttgctcagttgtgtctgactctttttgactcccatagactgtagcttgccaggctcctttgtccatgtgatttttctagcaagaatattgtaatgggtaaccatttcctcctccaggggatcttcctgacccaggcattgaacccatgtttcctacattgcagctggattcttccccactgatccaccatggtttttaattcaggcccctgcctaccctgagactcatttcctgcattggagtcatatcctcctttctttgccttaaatgtgcaaagggccttccttctgctggatcttttcacctggtacctggaaggatgcttttcatgggtgtgataacatatcagagtccctccctgtccatcctcgataaagtacttccttagctcctctgcccacagcccagccactctgcaccacactcccagtctcattcccttctcagcacttctcactctctctctgaattctcttctgtaggtctctgctttttggtgaattgtcagtcagcttgtggctcagctggtaaagaatctgcctgcaatgcaggagacctgggttcaatccctggattgggaagattcccttggagaagggagaggctacccattccagtgttctggcctggagaattccatggactgtatagtccatggggatgcaaagagtcggacatcactgagcaaatttcacttgactagaatgcctactccttaaatgtacatcagtatccctaagataaatactgggtacttactcaatatttattgaatagatgaatgaatgattgaatgagagagatttctagctcaggtttatctaaatctaaaacctgagcttaatgtactccacaacgtagtctcttttaatatgagcccagaggctctgaagtaagtgatacctttgggacaattgctgtgatcatgttctggaaggttggtggggagtttgttagcactttttgcctggctagaatttctgtgagtgccatgtgaccaaagagtccactctgaaacacaagggtaattgggatgatgaaaaaaatgtcacctagagacaaaaatcttttgaggaagaagagaagggaaataagaaaaagaagtaagaacgcaagaaagatt

SEQ ID NO: 26813 - DNA, 1332 bp, Bovine  19866881251389
caacaagcagccattgaacccctagttgacccctgcattgcacttttgaccatggctcttccctaatgccctgatcatgggtgggtaggggagcagaatccacgggatacttgccttccatcaaaatcaaccttccctgctccctttttttcaagaccctgtcttatcttctacttgtgatgagttaattggatgagataaacagtcagggggagagaaccaactaagttccctaaggcactggtagaaggataatctgagcgtaagtcctctctgaccagctgagttttgtggacaagcccttggcactagctcctcatctactccataaaggagtagatccgctggcccctcctgccctttgtctatgctcttcatgagtcaaacgtggctactgtgggcgacaagaaagcccaggagaccacacatctctcctagatgtggcagtgggtcttggttatccacctacttaggtacgtgactattttctccagcatcattggaagctggcccggtcaactggatgaaaacagaaatcctctgaattgcaaaattgatcctgaaagggcagcatgagattaagaaacatggatgccttgggcaaggtgctaattcgatacctctgtaaacatgttcctgataggcatatatgaggggcatgttggagaacctgatacatacaagaatgaaaattaattacaagtacaaaatccatatactttgcctttatgttcaaatgagaggcttattaaggccctgaaaaagatgtttctttaaagcatatgtttgttaaaaatacagatacagaaaaacgtgaaaagaattcagaatttcaccacccacataaactctgataatcccccaaagtaaaaatatatccctgcaattagaatatataaacaggtcagaaaggaagacgacacagagaaatcttatgtctggtctcttttcacaactatgttttcagtgattcttccagaaacattttatgtatttgcgagtacatttatgcctgagtgaacatatacatgtatgcacgcatacacatatacacatattaattgcagaaaaagaatttaacaaatgtgttacttccattgaatataatcttctatttcaacttttcatctcatagtttttctattactcaacacagtataatgtggatcccttaccatcgtcaacataaagggaatttaggcagatacattttctaagttttgttcaagcgatctctaaagtctctttatctggccttacagtgctgaatttttttagtaacccttgtcctctcctaagttctcttttgcaattttccaaatcagacatctt

SEQ ID NO: 26814 - DNA, 915 bp, Bovine  19866881574863
agaaaagaaagggaagggaagggcaatcgagaaaaggagggaagtcaggatgggagcaggggaagaaagaacagaaaaagttgaagaggtttaactttgtgctgagtatgtgaaatgtaggtcttggatctaacttgcaacaaaatagagttctgtctctattcccaaggcctccagggattgagggaatatggcgtcaaattctactcccaactcaaggggaaataaccttggtggaaatttgctgaggcctccgtggaagttgaaacagcaactttgaactccaggtttggaaagaatccaggcttcctgcactggaacttcgctggtggcccagtggttaagattccaccctcccaatgcagggggcctgggcttgatccctggtcaaggaacaaagattctgcatgccacacatgcacagttaaacaaataaataaatgtgtttttttttttttaaatcaggtatttttgatataagtaagtgaggtaataattaaaaaaaaaaaaaaaaagacttcctgccatgggatgggctcctcaaggagcttggttgggggaggaggggtagagaattagggacaaccaaccccctctccccactgtacttatgtacccaagagtctgaaaggaatggagttatttttctgtgcctcattgtaatgcagccctaccaccacctggaagctttcctggattgctatcctgtctttctcttagaggtgttgccttgtttttcttccctttttgtttttcaaccctgtgctccaaatggtatctcccagagatgcgcataggaggtgctcagtaattactatttgttgagtgaacagttgaaggaagtactgcggtacaggtgggaaagcgcttgggactctttggaattctgtatccatttccagttgcaccattaat

SEQ ID NO: 26815 - DNA, 1019 bp, Bovine  19866881743865
aaaagtagttatgctgtgaacatgaaggatttacatacaattaagaaaacatacatagttaagaatctgtatctgcagtgaaaaatgtgcctcacctactgctactcttcctccttaaaggcttcgcttaggatgcagaatattagtataaccccggcaatcatagaaaaggctagaacacattcccactggctattagatttattagttcatcttgagcctctaccaacagggactgtctgctgtgtcaatcagtgatgagtgacatctggagagaagagaattttgatgtggtggcccttgtcagcatctatttgtcataggcgttattctctactgtgattcttgggagtagttctagtgctaaagaccatgaaagaaattctttgttaactgtgcactgccatgcccttgcacacctcagaaatggctcctgcaccctctgcagcaaggagttttatttggttaaaattatgtcttccatctgtcagaaagaatgactgttcattacttattcaaagagagttcctgatcttacatgatcggatcatggcattggcaatatggaaacaaccacaccctgttaatgccactggtcccagggaatgtcccacccccaacttacaggtggccacctctcctcccttcaattttactttaaaatgatatagtcagatcaccgaaaatccttttttaatcaatagtggcctgcaagatggtccttattttatgaacaaatagcttgtcaaccttttcattttccaacattgaaaaacagagaaaagcagtcattcaatggtattgtatatgctttcaggtatagcattataatttttgtttctttttcccaggtggtaaatctccatgttgtgtgctgagttacagttataacaaaaaatactttactcttatgatcctgctgctactttgaactaaccatttggggtggcttggtagtcacaaaattaggacagtatttatggagtccagtaactcctgtttaaccggaggaataaaat

SEQ ID NO: 26816 - DNA, 847 bp, Bovine  19866881782218
tgaggctaggacccccagtcctagtaaatggatttgtcttaccgtactttaagaaatactttctgtcttttgaaatgggatttaaataacagatcaaggtttgctattatcataaatgtataaagtgctttgtgaaaaataaaatggatcatggattcaggataataaaaaaaaatgttttaaaattattaacacatgaaaaaaaaagaattactttcaagccttaagagctaatactattttctggtgtaagaaaagataaatagaccaactgagcaaaacagacagcttagaaacaggcttatattatatttatatggatatttgatatatgacagaggtgacatccaaatcaatatgaagaggacggaataattaataaagggtattgggacaacaggatatccattgtggaataaatttagatttgtaccccacagctcaacacaaattaatcctaggtacactgaggatctgactgtgaaagaaatcatttttaaaactcttagaagaataatgctacaacatagatgaaagacatctgaaataagccaatcccaaaggaaacataccatattattccactcatatgaagtacctagtcaaaattcacagagacaggaagtcgagtggtaatcgtcaggggctggggaagaggacaggacagttaatcttaatgggtagagttgcattcagttttgccagatgataaaaatcctggagacagatggtggtgatggttgcacaacaatgtgaacgtccttacagcccctgaacacatgtgaaaatggtaaaatttatgttaggtacattttaccacaatttaaaaactcagaagaaaatacgg

SEQ ID NO: 26817 - DNA, 1554 bp, Bovine  19866880387340
tgcataacctaagggaaagtctcttcatttctctgtgctccaatttccctagttgtaaaattaggtgaaagggtgaatgatccttagcatccattattcatctgaaattctaagaagcggttgttatatacctttgagaatatgtttatgtattttaaaatttcatctgaaattatagtgtaatcaatgctaaagatcattgataagtgatacctacaggaagcacatgtaacttattttcatttgtccttcatcttctttatgaacaatatattactatgtctttttctagagaataactaatccaggagacttgtgatgacagataaccctgtgatagtgactattttttttttaattgaagtatagttgatttataatgtgttagtctcacatgtacaaaaatgattcagttattcatagcagtagtattagtcactcaggagactgtagccaccaggctcctctgtccatggaattctccaggcaacaatactggagtgggtggccatttgtgtgtgtgtgtgtatatatacagatttacatacatgtatatttcttttcagattcatttcccttatagattattacaagaaactgtctatagtattgtatgctatacagtaggtttttattggttatctaatttacatatattattacatatattttcatcacaaactccttatttatctctctccttctttccactttggtaaacataaatttgttttcaatgtctcttagtctatttacgttttataaataagtttatttgcatctttttttagattccacatacaaggaattacggtatttgtctttctctatctgccttagtaatttctgctgctgctgctgctaagtcgcttcagtcgtgtccaactctgtgtgaccccatagacggcagcccaccaggctccaccgtccctgggattctccaggaaagaacactggagtgggttgccatttccttctccagtgcatgaaagcgaaaagtcaaagtgaagttgctcagtcgcgttggactcttagcgaccccatggactgcagcctaccaggctcctccatccatgggattttccaggcaggagtactggagtggggtgccattgcattctctgtagtaagctctaggtccatccatattcctgaaaatggcattttttgtttttatgctgagtaatatccctttgtgtatccatacttcatctttgtatctgctcacgtttcagtggacatttcgttcaccccatgttttgttttttgtaaatagtgcagcaatgaacattggggtgcatgtatcttttcaaattatgattttctctggatatatggccagcaatggtattgctggatcctatggaaattccaggtattttaaagagcctccatactgttttccatagtagctgcaccaatgtgggactaaagtataatcttgaatttactgttttcaacaatatattgagaatatattaaaatatagatgaaatatgttacgatagatgatatgtgtcagaatttcagattatactgcagtaagattctcat

SEQ ID NO: 26818 - DNA, 1710 bp, Bovine  19866880479431
tctatgggatcacagaattggacacgacccagggacggcggggcctggtgggctgccgtctatggggtcgcaaagagtcggacaggactgaagcgacttagcagcagcagcagcagaagtgacttagcagcagcagcagaagagaagggcaatcagggagctaggactttcatacccccataagctgataaagaggcttccatacacagcataaatgaaaactaccgtggggagccagaactcgcactctcacccagcaataagaaggaggcccattcgtgggtatgaacagaggtcccggagggtacttggacttcatctgcctagcagtaggaggcagtattccccctttccctgacagaacaggataagagaaattcagttaaagcaggaagtttgcataagatccagaatctcataacataatatgaaaatctccaggtatcaataaaataaaattttaaaaaaccactcatcataacaagaaccaggaagatttcaaacttaataaaaaataaacattgataaatgcccaaactaagatgacatgggtgttacaattatctgacaaaagattttaaagcagtcatgataaaaatctgcaatgaacaactacaaacatacctgaaacaaatgaaaaagcaaagggaacaaatgaaaaaaaaaaaaaaaaagagtatcaacaaagaagcagaaagttcaataaagacatcaaatagaaattttagaactgaaaaagagatcaagaatgagctcaacaacgcaaggaaagagacagaggaaagaatcagtgaactggaagacaaagcaataaaattatcagatctgaagaacagagacaaataaataaataaagagccatagtgacctagaatttacatcatctgagtccttaaaagagagtagaaagagggcggatctaaaagagtactagaagaaataaaggttgaagatttctcaaattttgcaagagacataaaactgaagatctaagaagtcaaatcaaacctaagaggataaaaaaagtgaaacaaaaaaattcatgccataacacatcataactaaactcctgaaaactaaagacaagagaaaaaatttttgaaagcagactaggaaaaacagtgtcttacttaaaggggaaagataattccaatgatgtaattctcatttaaaaccatagaggctagaaggaagtggcatagtttatttcaagggatgaaagaaaagaactattccagaatgctatatctggtgaaaatattctttagaaatgaagagataaatgagtacattctcagatcaatgaaaactaagagaatttggcaacagcagacctacattacaaggaaggctagagaaagttctataaacaggaaagaaataatgataaaggaaatttgaaacatcaggcgggaaaaaagaacagggcaagaaaaagtatggataaatacattaggctttccttcttcacatgagttttctaaattaggaattacgattgaaacaaaaatcataaccctatctaaatatgtctaaaatgcatggagaggaaatatttaagataattatattataaataaggtagggcaaagggatataagaagaagtgagatttttatatttcacttcaactgattaaatgacaatagtaggctgtgataagttatatatgtgtggctacagtaaccatgactggcccggggggagggg

SEQ ID NO: 26819 - DNA, 1478 bp, Bovine  19866880530078
atgtgctataatgatttccagtgttagaggaaccctagactttgagatatatttttaaatccttgttcctcatttacaaactcacagatattgaacacaccacttaagctctgtgtcttcttatcttaaataagacagtaatacttaattaactggcagagtttctctgagaatcagttcatattttatgtgattacttaagaaaccatagttttcagtaaatgttaattccaatggaatctcactttgaaaatcttaaattctatatcatttagcaaatattaaataaatgctaaattttctcattactcctattgctcagtgagacaagaatccaagcaaagtattcctgacctaaggttagaattcctttatatagtcaatccaattgggttaaatcagactgtcttgagatcctcaacaaattaaacaaaaactaatggaagcttagatttttcaattcaatataagtattctccacttaaaccatcagatagtttctagttatttaacagattgaaaagattccctctactacatggataatgtgaatagacaaaaatcgcgctaagtttaatatctattatatggcaatatataattaatcttttaatgagaaagtttcaaaacccaaactcattttcccaattatcataaatatatgaaagacctaaaaccatgcttatattttcaagagaatgatttattgatttttacacatattttataaacgtgtatacatatgtgtatgtgtatatatataaagtttacaaaaccattcaacatgaagccattactttcctaaaatcatgagaatctaaactgttttgaaagctgataccatgtaatgataatcgtgtgagcttcagttgtatgagttttatagtaaaataaataaaggctattgatgtctgttgatgtaggattttatgtgtctatctggaacactaaattcccacttgaagatacacaaaatgaaacaacatgtcaaaaaagagcatttatggaaatacttttaaggtattgtatcatttttgaggaatagaattttctaaccggtaaatctatgcccttgccaaataaagttgcatttgaaatacagcactgtcagatgctttatttgagaagaaacagaagatgaatgttgcataatgttatgaaacctttgctataacatggaagtggtctttctctcagatagatagacagacagacggacttagtatttgttttattgaaagtgaaagtggaagtttctcagtcgtgtccgactctttgtgaccccatggactatattccatggagttctctaggccagaatactggagtggatagcctttcccttctccagggtatcctctcaacccagggatcgaacccagatctcctgcattgcaggcagattctttaccacattctgaaccgcaagggaaacctaagaatacttgagtggatagtctaacccttctccagcggat

SEQ ID NO: 26820 - DNA, 1103 bp, Bovine  19866880557986
aatgttggaagaggaagctcaatatatcactatctgtgtcctaaatgataaatatagattgaagttgattgcatcccttgatgtgcctttccacattccttttgtgtatgataatgccaccagcaggtagtggaggcaaagaggagatctgaataggtaatgatgctaatttgccacatgcaggaacattgcaaaagtgcccttctgcatttaccatgttagagggggaaaatgataagaagtttgctttagaaatacattataaaagggaaaattgatctttgtctatgtttgtcctcttttgttgttgtgggaacaatattgaatgctttcttgaaactactaatcaattgctatcttcctgccaacaattctttctgtcactgtttgatactttttatcccgtttctcagtacatgctatattaggactattcattcactgaaacatttattgagtgcttacctgtagtccacactgcattaggtgttatggagagtaaatataagtacagaagagaaaatattgtttctaccttaaagaagacattagtctttctatacccaacacaatctgactgttgattgcttttaaggtggttatgagaaatgaagtaacgatgcattttgtcatctaagtataaatacataacatctgtatttaaaattctaccataaacctctcttccacaatttttctacttttcaacacattttcctcatttctttaaaatataatgctaaaatgccacattccttaagatagtgcaatgcttttgccacatcaactccattattattaatcatcttaaaacaatgtgttgcatttcagtaaatattttatcctttataggaaagtatgattgattttactaagcattacttttataattgagacagaaataaaataattacagatttttttcactcctacttatagaatctaaggagattttgagattttcctgttctcccctggctcttaagaggtaatggggtaatctcaaaggaactttgacagtgattcatataacaaagaactgaatcagtagaaaaagtcagggcaaaaactgggctggtcagaatttgagaatttattaaatg

SEQ ID NO: 26821 - DNA, 1477 bp, Bovine  19866880558543
gaacttaataataagcagttgactagaaggaacagatctttccagaacaggagcttcaaattgtcagatatgattgaatgtgatcccctttggccacaaggttccaggttgaatgctttttctatgctttttgagaatatgaaacagtgagtagtaacacagtaaaatctcaggagacaatgtctttgtgaatatctaccttccctgtatatataaaatttaaatagtcaaattttgagagacccacaaaaggaaccagtgttcactagttctgtcctctccataaatccagacaaattggtggcctcttctcaaatttaaactaccaggaatatgttcatgaatttgctacagcaaatgaatagcaacatagaaaaaccatggaatcttagagttaaaaaaatcttacagaccatctaattccaaacattgccttaggataagtgaaaccaggaaccagctattaaaaggacttagacaattacccaacttcctagttttcctagttcatatttatttaacattattctgtagtattattgattttaagtacatggtaattaataatttcatacatagactcttcttcttttctccaggagctgtactacgttcatccttcctcgtatatctaatagatattatcttaatttttatccagactccataccagaagaatgaaattgtacatagaattgataacccaagttttgaacaattttaatcattgactccatgaaccatagatgaaggtaagaaagacaaaaaatagtaaagatgcaatagagttatttcatgatacttgaacctaagtaattgctcttcttactttctaaatttgtgttaacgtttccttactcatttagtgatgatacatgctacatttcatctctgaaagaagtggcagttttctgtattgttttttattttagtttcaatttaatagtgcaaaagtcaagtagttggttcccagaattaatgttttattttattaatgtttgatcttcttaatatttatatttctaccattttttgatgtaattcaagtgagtataatcattgcctggcaatcatttggatgtgattgaaatatgaagtatgcagattgggaaaaggttgaattaggaaatatatttatcacattttcacttcagcatgacaataaatctctccattaggtgaaaccagccatgtaactatctgcttcctttaagaggaaagatataaaatctaatcagttttatgaaacagtcttgcatgagactaaacaacaattcaaaactgacaaaatactaaatatcacccactgatgctcactcagagaaaacactccagacaattaaaatttctacattcatgaaatatttccacagcaaatctccatatcctagggttcagatttttctatatctcttcactgtggccatacatgactggtagtcatatattcttaactgcttacttgacaagggagaag

SEQ ID NO: 26822 - DNA, 922 bp, Bovine  19866880590598
caaagttatatttccttaatactaaggataataagttttagatgcagatattaatattcagtagaggcaaatctagacctctgtctgcacagaggaaatgctcaacaaatatatatctaataagtgaataatcatgggtgaattatttttatggcacaattcagaaaatttagcctctgtttgaagcattgtttgtatgaataaattaattcattactactgatttatcaatttttagttaaatataatcatagactaaagtcagtctttcagtaactgtaagtaagaatgatatcataatgtaaaaaaatcccactgaaatcgtagacatatcagcaataagaaggagaagaaggaagctgtcatcagcggatgtttgtacctgtgacttgggttacctgagtagagcattcaatagtctttgaataatgcaaatatatgccatgggtattttacacatcatagacatatttggggttggagaatggggttctagactgatgaatacaaaatggcattcaaaaatattaatgatctgtctcctgcctataggcctctttcctacttatatttctgtagtaccaaatttatgtatttacccaaatgaagcttatgacatcatgactttgtgccttgtatggtacatgtcttctatcgctcattgtcatgaactcctatttatccataaaaaactcagctcctgtgtctacttctttgataaagcctttcttgatcctattctccaaaagagttaaccctttccttatctttgtggcatttatatgtttaatattatttctcattatactcatcaaactatatgataagcatggtcagatgtttttctcctcaagccgtgtgcttattggccttttcatgaggttgaagtatatgaaactaccatttttttcttaatcagttt

SEQ ID NO: 26823 - DNA, 1225 bp, Bovine  19866880705243
cattccttcgactgccacagccagactgtgagggtatgaaagcccattgccccactgcatccaggggaaattatagattttctctctagactactcagaactctggtgctgccaaaaacaaaaacagctacttcgaacaaaaggtacatgaaggtatttttattatcctgcccttcacaatgtctgaaatatatttattgtaggagtaaaaagtctaaatttattattttaaattttactctctgggttttttgtccctttcctttcatgtctactgttcagttatcatgatttcttcacctgaaattatatttgaattaaaaaaaaaatgttatggctaatagattaaattggtcaataaagacagagatgcaccaacatatatcaaaatgcatttaaaaatatgtcattatccagttacatatgcatgcatatacatacatatatacttacatacatacacacacacacacacacacactcatgctgtgcaagagccccaaaatgttcaaattatttgtatctttcagcatcatactttccttgattgtgtcttctaataacctttagtgtcaacgatttgattccagtcatacatctgatttgttaaaatagctgttgcttttctattattttcctctgaaagaggttttacttttaaggttaggaaatataaccctgtgcccacaataagtataaagggcacactgaaaagcatatctcagtggaaacccctctgcctaatagggactgcctaaatgtttaatgacattagctccctgcaaatgccattcatttcctgtatatgcaaatttccttaatgtgcgccccccataacaggtagaatgtataaagttaatgaagccatgtaattacaatcactatggtgactgcggtcccctgagaacaataatgcgataatatacatcagttttgactttctttggaaacaacagcttataatatgaaaatagtaaaatattttcattatctccctctaactcctaaggcaaaagcaggtacaaatagattatgctctttattaactgaaaataacataagaagagaaagcaaaaatacaatgttagtaattgtttattttcaactttcaatgccttcatttgcctcattttaaagcctttttcctatttaatcaggaaagcaccagggtccggcagattttttttgtttttttttaatctgatctgtaatcccagaaagacta

SEQ ID NO: 26824 - DNA, 1400 bp, Bovine  19866880748659
tacttttaactttgttaacagtttctttctcttaaaaattgtttaatatttatgtagtcaaatacatctatgttttgctttagggcatgtgcttttgcagttagacttggagagtctttacctatttcaatattatataaatgtcatttacatgttctcctagtttaacattgtaaactttaaagaaaattttaattacagatactttaataaaccttatgaaagataaagtctctcactcagaaatatgcacaaatgtcaaacacagaaaatttggcctgtcacttcaggaagttcacagaatctttgaaaccaatgcattgaggtcaaaaggatactgttttagttattttaaaaatccgttaattcttttgaaatacattttacataggcttcccttgtggctcaggtggtaaagaatccacctgcaatgcaggagacctgggttagatccctgggtagggaagatcccctggagaagggaaaggctacccactccagtattctggcctagacatttccataggctgtataatccatggggtcacaaagagtcagacacaactgagtgactttcagtttcactttatataagtgttatgggctgaattctgttccccccaaacatgtatgttgaagtcctaaccctcactacctaccacagaacgtcactcagttcagttcagttcagttcagttgcttagtcatgtcagactttttgcaaccccatggaccacagcacaccagctgtccataaccagctcccagagtttacccaaactcatgtccattgagttgatgattctatccaaccatctcatcctctgtcatccccttcaatctttccagcatcagggtcttttcaaatgagtcagctcttcggatcaggtggccaaagtattggagtttcaccttcagcatcagtccttccaatgaatattcaggactaattccctttaggatggactacctttggagataaggctttttcaaagaggtgtttaagataaaatgagattataatggtgagctctcatccagtgggccttgtgcccctgtaagaagagaaggttagggcactgacacacacaaagggaaagctatgaagaaacaggaaggaggcagcatctacaagccaaggaaagagacttcgaaagaaaccagtgcagctgatacctgatctcttacctctagaattgtggggaaagatgatttatgttgtttaagctaccagtactttgctatgaaaagtcctagcaaaataatatagtaagacatgggtctaatttttcttgtttactttttcttttacaaatgaatttttcatctcaataccacttattcaataacacattgtgaacttattaagagaagtcatttgaatcatattcaagtctgta

SEQ ID NO: 26825 - DNA, 945 bp, Bovine  19866880811182
aataaaaaaattaggaagcaaataacttggttttgtatagttcaaggcattcttttttgtatgtcaggcaaaaaataaaacagctgagcttaaaatctggcaggcacacaatccttaatctagaacatttactatatttaaaacataaattaaatttcttgcatctggatacattatgagaaactggatggaatcctaatgtaacttctctgggaacaaatgaattccccaaccaactaaatcagccaaatgatttttttccccaaagatttatctttgctaataaggcagaacaagcattttccaagtgtagtatattatttttttgctacacatttttccctcctacttcttactcctgcatacacagcatatacataagcattgaagttctcataggaaaagctttatctaataatggcctactggaatattcacaaaggcaaacctcagcatccacctcaccacccatcctaaaatctaggatactcaaatctctgacagataacattaactagttgacaaagatgcacaaaagaaggagtagctaaaccacaggaaacaagtttaagtccaggattcccctaactagctaacatgcaacaatatcttctacatatctctggaaatgtaatgaaaaaatactttttcaaaacactcagtagggtttgtttatttgtgtgtgtgtgtttgtgtgtgtgtgtgtgtgtgtgtgtgtgtgtgtgtgcatccaattacacaatagggctaacacccttgaaaaaataacctagaaatttaaaatatagaaaatatcagtaagataccattgcctcctaactagattcacaaataaaagtaaaatactatataaagaaacattcagataaatggctacattttaggagtgattgtggaactataaatagcagtaatgctgtagggtaatttattaaataaaatatg

SEQ ID NO: 26826 - DNA, 1223 bp, Bovine  19866880883289
aatggtttgtctttcacatgaggaaatgatatgccaataattagggaaagtctaaaaaaataataatgagcttgacagatcctaaatttcagagttagcaagaacatcacacacacacacaaaaagcagcaattgcaataatgttccaatctaacagctttcaaatgtctctgcagacaaaaggttgataaaaataaaaattccaagtcggcacatagaatgccaaaattataaaagctcatgtttgcaatcactgcagtatcgttttaattttgaatgtactgtcaaaacgtagtaccacaggaattgaagacaaaaacttgcatccaaagagaactagaataatttctaaattgtataaactttttctccatgcatggtgctgggcctgtgggttagggatgactgtataaatgggactactccaaatgaaacttccatgttaagtataatttcaggaacaattttctgtttattaaaacaaaattaacaaaaatatgctaatctgaagatttcctacctattaccacaatttagcaataacggcagcaactgtttggaactcagatggagaaaaaaagatatactctaccaaacacattgtttagaatggctgatgcaggaggatgataatgaaaagcagattgtctttcagttcagttcagtcactcagtcgtgtccaactctttgcgaccccatgaatcgcagcaggccaggcctctctgtccatcaccaactcccggagtttacccaaactcctgtccattgagtcagtgatgccatccagccatctcatcctctgtcgtccccttctcctcctgaccccaatccctcccagcatcagagtcttttccaatgagtcaacccttcgcatgacgtggccaaagtattggagtttcagcttcagaatgagtccttccaatgaataccaaggactgatctcctttaggatggactggttggatctccttgaagtccaagggactctcaagagtcttctccaacaccacagttcaaaagcatcaattctttggcactcagctttcttcacagtccaactctcacatccatacatgaccactggaaaaaacatagccttgactagatggactttttttggtaaagtaatgtctctgcttttgaatatgctatctaggttggtcataactttccttccaagaagtaagcacgttttaatttcatggctgtaatcaccatctgca

SEQ ID NO: 26827 - DNA, 694 bp, Bovine  19866880962361
atgcctgaacagactttctgtgactgacaaggagtatgtacactttgacaaggattagagctgactgcctttgagaagaaaaaatacacacctcagctgactctgttatagtgattgtgtgtcatatcagtgattagggaggatgcgtataggaagacagaaggactagttttctcttaataaaaataaatagctctggatggagtgattatcgtctgctaatatggattccattgctttaagtttaattaacatttttcttgaggcagtacaattgtgttgggaccatggaatcttctccatgtatcttatgcagttcttatgaacccacagctagtgttgagctgaggtcatgtatgtcccatttaatcttatttgacacctgttattttattactctttcatccactttgttgtagacctgcgatatagcagcttttttcttcaggtgtcaaatatgtcctgcctttgttatacttgaaggctgagtgtcataaagtcagagctctgagtgttctaggaaatgggaaagtataacacaattcctgctatcctcagataactgtttaaaacttacttgctggctgagaattagaatctgaataacgagggtggggatcccacagtggatcaaccacttacttctgccctgcctccacccatcctcttctgctcagtgatgaagagagaatga

SEQ ID NO: 26828 - DNA, 1871 bp, Bovine  19866881024363
agtttcacattaaaatcatctcaagtaataaatttaaaattgaatatgttttagaaactattaaagtcacaaaaattttcactgctcttggtatggaagaattttaaaggcataaggtaccatttccagccaatcatgagccatttattgagttccaactgtaagcatcattcaaaattaggcacagaaggaaaactgttagtttagccaaggtcgcacggcagagagggaaagcttcactgaaacacacattgtgtgctgaaatcacaaacagaacaatatttgaaacctttcttagcatcagtgaatttaatatgcttgcatgaggaaatcatctcaaaagtcaaaggtaacgtgtattttcctgttttcctaataattttacataatgttaacatgcagtgtttctaccaagtgtgttaagtagcacacttcaagtatttcagtatgcattcacaaaagcatatgtttggagatgccagtacatatgaaagctcattcagtagaaactaatggtgtcgagcagagaataaagtaactaactgaattttgtaatgcagttggtaacatgattttcagagtatgggatatttgcaggcaaagtgtgttattatctataatgtcaagagagatcacctcaaagaggacttagatctcctttcataagtttctttcttcatgactgctaatggagaatagataggctttaatgcttttgatgtaaacattttgagtgacatttccctcagctttctctttgtacccagcataagttattgctgatacacaatgatgacagtgagataggagaatatcttgcattattggaaaatatgtggatacttcatgatattggaggaattcagagactaagactatcctgatctgtattcctcactgtgatattaggcaagtcttttatcttacccataacaattttactttctatgtaatggaagtatctatatctacactatattaccccttcaaaaaaaaaataagcaagcaaaaacaaaactaaataaaatttaaaaataagttagtacctactgccttaaataataggtctttgtgaggaaacatgaatggatctttgtgaggataaattattttctatagccatttatatgtctatacatgtatttatatctatttatatgtctatttatattatttatatgtctatatgtaaatggttgtagaaatttatatataaatagctataaaattaatatataaatatatgtaaaaattaatcttctctatgtcaagagtctaagatttttaccctacttgcaaatttgcctgcctcagttcatatatgctgacagaagaaacaggactcatgcactgcaaacaaaggatagtttagagctccagaaatagcatgatccagggtagaagcaatttttatttatttactttttattgaagaataattttttattgaagacttttgctgttttctgtcaaacatcaacatgaatcagccatatgattcatattcatatgaacgctcccttttggaaactccctcccatctcccttcccatcccacccctcttggttgatacagagcccctgtttcagtttcctgagcaatagagcaaattcccattggccatctattttacatatggtaatgtaagtttccatgttactctttccatacatctctcccacttgtcccctctccccatgtccatatatttattctctttatctgtttctccactgttgccctgtaaataaattcttcagtatcattttttttagattctgtatatatgctttagaatacagtatttatctttctctttctgactcacttcactctgtataatagggttctatgttcatccacctcatta

SEQ ID NO: 26829 - DNA, 1337 bp, Bovine  19866881144767
tacctttttgggttaattaattcttcaagagagatgatgtatgtcagtattgaatgaaaaagaaatcacttaatgcaggcaattcacatagatctctacaattagagttgaaagcaatacagttaacaatgccagggttcataggtagctgaaaaaaaataaacttttttcccatcaaattattcccatgtcttctgaaattgtctctaccttattaagaagtttacaaaatttatgttaaatattttataagaatgaatacatcaagtaaatgaattaaaatacagtttttcctctcttccatccaaagaattttaatcttttttttagggtaagctttcctagggtaaagttaatcaccttttggatcaaaataacaaccttatttgctggcacaacatcatgtaagctaatttatgcctgcttctaaatgaaaatgacccaaaatcaattggtctcctattaaatggttgtgtacctgctattaattgtggatattgcaatcagtgcctgtttagatttgttggaaagaaatccacaaaggcttttctagacttttctttttttttcaaaatagaactgaggtctatgatctcttgccaagtccatcaacagttatttatttggtattgtagaagaaaggcagctctttaaatcttaacaatgtgattaggtgtttttcatttcttcttttttttttttttaccaagagtactgaaatatatgggatgttttattcaacaaatgtttttgaatgttgactgttatactctagagcttggcaacccagaatgtatctgattcatctaggaaaccagatgtggtgattattgtagtggttattccactatatatatagtgaataatttagtaaattaacatatccatcgcctcacattgttagcatctcctttatttatttatttatttgtgtgtgtgtgtgtggtgagaatatttaagatccacccttttagcaagtatgaaatatagtatttttaactgtacttacattacaagtataaaatgtattttaaactacagtcacattatgttagatctccagaatttattcatcttgcataacttaatctttgttcccattaatcaatcttcccatttcttccatccctagcacctggctgctactgcttctgctgctgctgctgctaagtcacttcagtcgtgtctgactctgtgtgaccccatagacgacagcccaccaggctcctctgtccctgggattctccaggcaagaatactggagtggattgccatttccttctccaatgcattcagtgcatgctaagtcgcttcagtcaatgtccgactctgtgtga

SEQ ID NO: 26830 - DNA, 2538 bp, Bovine  19866881222597
ataggcgggtgaggaacacatagagtctggatacttaactaggaggagaggaagggtgggagaatttttaagagatagtgtgtgtgtgcatgttgtggtgggaggatgtgtgttggggggaatcttaggccacttgtgtttgctaattgctcttacccaaaagaaaggtaaagttgagagaaggtagttttaaactcggacaaagacacccacaggagttaggctcctaccctcccacagagactgggagataagaggctctattttccttgctaatatttcaaaaggatggctcccagtttcttgagaaagatatccctggcttgtgaaactggtaagaggctttttaaaagattacatttaaaaatgaaggaaatgaatgtacagttacaagttgtttttgttcagtcgctcagtcgtgttcaactctttgcaaccccatggactgaagcacgccaagcttccctgtccttcactatctcctggagtttgctcagactcgtatccattgaattgatgatgcccttccaccatccaattacaagtagtctaaagtaaatgctgtaagaaaagggaagtcaggagcctatagtcagaacaaaactggtctaaagtttagtcaagccaagggagggaactgtgctggtcaaaggttattggacttgctaagatctcatttgcccaaagttacaacccaagaccccaccatcgccgttctccctcaaagtcctgacataaaagtctctaagtcaaaaaaataagtctctaagtctgtctcctatgttcctccatgaacatcacaaatggaagtacatagtccatttatataatgattcagtcatataactttggtcagcaggatatgattctagtagtagcagtaataatagtaactttgtattttaaggaaaggtgatttctttttaaacaaataaatttggagctaacagagaaggtttcctcaaatattagataatatgtaaattcagatcttaaagcctaatcactagctctttcaattgtgagaattttcaggaatcaagggtgatgaccagcagggcttgtgcccagcttctccccagttctgctgagatacttagtcattatctccttagcaaaccccactccctctagctatttaaatttagaacttttccaaggcagaagtggtatgtcttcctagatgttgtattactacaatagaattatcttgcaaatctagctcacgtttattcaatggctactttgttctaggtaatattgaatgtcagctattactattccattcaacatgaaggggactgagactgttgtagccatgcgttccaggaaacaaactcactcagaaggacaatgcaggtagtggagtgcagtttattacactggcgggcccaaggcagagtctcctcttagccaaggaaacctgaccagtttttgtgaaaaacttttataccctaagtgcatgtgcgcaaagctgtgcacaaagctgcctccccaaattccctgaaactagtctgaacaaaggaaaaataaagatacagtcaaagttacctggtgatttatatgccttacctaggtagttaacagtggacaattatcaataggcctgtggtcataccccaataagcataatagaatatatgattctattcggttactcaggtagttagggtattattttaggcgatggagaatctaagtatgagccctggggctcttccttcagggggcctagctttccagttggtatgttgtttccatagatactgggcatatagctcaaagtccacagtctggcccaagatggagtcctgctttcaagacagagcctgttctgtttcctccttcaagacaaagaaatagcataggtacaaacagaagcaaaagctcaatcttgtggaaagagccatatacagcagaggggccagcccagatggtccagaaattagtatgaacaaaaagaatgaaaacaggatttgagaaatcatctgttcttcagagtggagtcactgagaggtctctgcagtgacctatatttcaaaattttgggggcttcccttttggctcagtggtaaagaacccacctgccaatgaaggagatgtgggttcaatccctgggtccagtagatacccttgagaaggagatggcaacccattccagtattcttgcctggaaaatcctttggacagagaagcctggcaggctacagtccatggggtcgcaaagagtcagacatgactttggcaaccacacatgcaggcacacaaatgtgaaacagctccgtaaggtccataagctaggtttaaatatatcaaactcagcttgctgatgaggaggggtaatttggggtaaacaacaatagaaaggtcttaagcaacagttttgtggatgggtaaacttcataaagtttaggagttgcctaagcttcatgggaaatagatgggaaaacagtggaaacagtgtcagactttatttttttgggctccaaaatcactgcagatggtgactgcagccatgaaattaaaggatgcttactc

SEQ ID NO: 26831 - DNA, 843 bp, Bovine  19866881507184
cacatgtgcagcaccatgaactttatgtgtgagctcttctgaagagctttcaggggcatggggcactccaagcaggtagaatccttgtcagaagagccttctgaagggtcctggtgcactggcagcaattaatgcaggtggtattttagacaagggagctaatgagctttaatacgcatgcaggtgagggagtgctgaatcagtagagccattaatgaaccgatgacagcctaattagctacaatttaaaatctatggaatctaatcagaggagctgaacattgctgaaaatctgtttatgaatgagtctttctaaatactccaatctgttgcttagtcactgattgatagtaattgctttttttcctctattgtgtataggaaaatgcccaattttgctctgataggggaggacacaacattgaagttaaatgcctaagatgtttggctgcttaagtttaatcagtggatgttttaaaaaaaatcaaagtaaaattaattttcaactctgaatatagatgattaaaaatgtaccaccaacttcttatatattgtgttggcaaaggttctctagttgtttatcaactccaaatagcatatctgaaaaccaagcaaagacagtacaacatgcaaatgcatttattaatccataatttgtttaaaaaggacttatttatgttagttatcagatacaagagggcaaaaacatttttactgtatgcttgagataaggaatagttttctgaggttaatataatctattaaacatcctattttacatcagctgaactaagcattctttcaggaaattgagaatactttaaagaaggtgggaggtgatag

SEQ ID NO: 26832 - DNA, 1226 bp, Bovine  19866880397121
tcttaattatttagaacttaattattttatatctcttaattattattttatatcttaactattttctctctctctgatactctccaatatatactgagaatcatcaatgccctttaaacttgagtgaatgtctacctgtcagcagacagaccaaacttcctggacatggtctgaagggtgctcatgcctgaaaaggataaaagacacctgaaagaagtttctagaacatctctctcccataacaatactttggtttggaagcctttgctgtgttcgccaatcccttgtttaagaatatgttcctctggaataggaaatggcaacccactccagtattcttgcctggacaatcccatggacagaggagcctggggggctgcagtccattgggtcaaaaagagctggacatgacttagcacatacacaaggaaataattactgtatatgtgtcattttctctttatctgcttataatttataatatatttgtcatgtagtagattagctaatgatatgggctgtagaaatagatcacctaggtttgaattttttctccctctaaatgatcactaagtgtagtcttgtataaatgtcttaatttctctgtacctcagtcttttaatcagtgcattagtgattatactggtactgaatacatagactgtcatggggactgagtgtgcacatgtaaaaatatttaaatggtttctgatacatagtaaacatcattcaataaatgttaactatttttctttttgaaaaaaaaaataagaagaaagtgttcctcctttctgtcaaaagattttctcctctgttaggactctagtcaattttcatcctattttgcatggatccaaatgttttcattgggtatcttattttaaaatactgcttcaagttagtggggaagactatccactgaaaactaaacccaaccgggtaggctgaaacggtaagcacagacaatgaagagtcattaccatcagtgcctttgtgtaaatatccattggcaggaggcataagttgctgatgactgcctgcctcagagttgctgtagccttcttgtggctcagacagcgttccttgggaagacaagtagctgggaatgtctgcaggcaggttgagttcctctgtaaaagagacatctgtaactctcaaataaagttaggtaatttatttacctaactcagaagactattttgcaaatgtattctacttctctacta

SEQ ID NO: 26833 - DNA, 1994 bp, Bovine  19866880559996
gcctgagaaaatacttgagataatagttgaaaacttccctaaaatagggaaggaaacagtcacccaagtccaagaaacccagagagtcccaaataagataaacccaaggcaaaatacccccaagacacaaattaatcaaattaacaaagatcaaacacaaagaacaatattaaaagcagcaagggaaaaacaacaaataacacacaaggggattaccataaggataacagctgatttttcagtagaaactcttcagatcagaagggaatggcaggatatacttaaggtgttgaaagagaaaaacctacaacccagattactgtacccagcaagaatctcattcaaatatgaaggagaaatcaaaagctttacagacaaacaaaagctgagagaattcagcaccaccaaaccagctcttcaacaaatgctaaaggatcttctctagacaggaagcacagaaagggtgtataatcgtgaacccaaaacaacaaagtaaatggcaacgggatcatacttatcaataattaccttaaatgtaattgggttgaatgcccccaaccaaaagacaaagactggctgaatggatacaaaaacaagatcccttatatatatatatgctgtctacaagagacccacctcaaaacaagggaccatacagactgaaagtgaagggctggaaaaagatattccacacaaatagagaccaaaagaaagcaggagtagcaaaatattccaactttattctatgacacaaaattatattaggttaataatgtaattatgttatattaggtaatataaattgcattttaatccacttaaatggaaatttctgttgagtgttcattgaactgttgagaagcttaaatggattttatgaaaattaaacatcttaattcataaagaacttaataaactttaattctggcttacataaaattaaaatttaatatttaagtctaatttatatgtttatctttttggaaaatagatacatcatattttaatacagacctcctgaagtttaatgagaaagcaaagacattttcatgcttataaatgtacataaaatgatagttcaggacttcatttttacgctattcccaagagtggttttactgattcgtaaaccatacggcttatacaaactgaaggaaacaactttaagaaagttggagtcatgcctctgaaaaatcctgtcactccttgtcttttataaattttataaaagacgctaatcatatttagctgtggaactcctagaaaatgaaagggaagggaaaaataaagttaattttatgttttagctttctttcaaacactaactcaggtaaaacatgctaaaatagataataaaatacaattaattaaattatttcacaagcagtcccaaagaaacatctctgattcatagtcagaatcagagactgtaatggaacgatttgatgctcatctctatttaattttctttcattttaggaacaaattctgtccactggaagtgaaatttacttgtaattatcatagacttataatttttaaagactatccagacatacagaggtatctgattcagtatctcatgccttaagaacatctcaaaatcagaaacaaactcaaatgtgtttctcatttgatatttttctcagggaatgattccaccattcatctagctgttgaaactggaaatctgaaaggcatccatgacatttccctcatgtccaaaccagtgcccatcgattttaccctctaaatatctctcaaatccatccatttccttccatgtccactaacatgcctccagccttcaaactaccagcattcttctctcaactattggcataatcacccccttcatttttttctgcatactttaaccagagagaactattaatgatgcaaatttgattatgttactgtcctgcttcagtgattttccattatgcttaaatatagtatgctgcggcctctgtttccatctcccacctcacttg

SEQ ID NO: 26834 - DNA, 2263 bp, Bovine  19866880611661
aaatttaggtgtaaggtgactcaggaagaggcatctggagatcaaccgtggaaatgtgggtctgaggaggagagaggagtttggagcctgacacagatttgggatgcagctacccacaggagagctgacactggtgggagaagctatgacattgtttgaaaaaatgacccaccatcaggatgtgggaggaaatataatgcccaactgaggaaaagacaggatgacaggcttgggggagttcatgggaatgttgctgactcacagaagtcggcagggaggggacaggtcaccaggaccagagcacgcaggagtgaagaggggctgctccacaggtcagctgaggagttgaaggtgccttctgggtcctcgtgggacagtgccgagggtgggccatgctgcaagaagccagcaagtcagcaaagtaaggcagcaagtgcagtttccaagaatttcagaagtgaaggaaagagagggcagtcccatgaaagggcagcttggcacaaaggaggcattccttaaatatatctatttataaaaatgtgtaatcaatatgtatatttatttttgtaaatatatatgaatatataggggagacagaaacagtttgttggcagaggtggaagaactgtttgcagtggagtgtttgaagatgcaggcaagccaggtctggataggagaacatgagctccaggtgggggctcttggacttggtcaagaaacaaacattcctggaagacaggaatgatggcatgcagggagggtgggaaaaaatgtatattttgcagtgaagggatggcttccctagcaagtttgccaaaaacatgaaataactctgactctctatttatgcagagtcattttgatggatgtcagaagctcttgagcctcttatagaatgcaggatttctgtcattagattttaaatgtctaccctagaacattatagctctagcctagacagggcatttgagggcaggctcagaaaaaggagataacactaaacaacactaccaatgagcccagaaaaccaaaatgtctctttcattccaagcaaagaggtcagtaataaaaaagcatttaatccacagcctgaatgcaaaggttagaagcgggggggaaaaaaaggcaaccctaaactatatgattcccactcttcctttttacaaccctgacaaaagtaggcaggagacaaatcccatttgtaaggacagcaaaatcttgatctcctctctgacccaaaccgtctccatgcatcataaatatttccatagtcataaatatcactgatgaggaagcagaaggctcttaattggctccaactcatttcatggtggaggaagctaggaaaaatgcactgaataagaataagacaggatgagagatctcctgggaggaaattaaaatagactcttcatccaaaatgatgctcaatctatgtgctgatttacgccaggaaagaattagctgaagactcattgtgagaagtgtcttttcccactatcccagggccttttctatcttagaaatgccgattctcttcaagctgagttttatggtgggttgatttcattgaaaatgagccactgtaaggaaagaatggagcttgctagcatttattaaaacctcatagcaggatagtggataaataaacagtagtatattcatacaatggaacactattcgacagcaaaaaagatgggccactaatcacacgtcatcagggatgggtttcagaaacattatgctgagtgaaagaagccttatatgaaagagtgcacactacaggttccattagtattattctctctaacaggtggtctgtggtgggaaaaagtccagacaacgcttgcctctgggggttggggaaagatgggaagggatgcgagggaactttctataatgatggaaatgctctctgcatcttgatgggagttcggattacacaggcactcacatttgtcaaaactcagcaaaagtacccttaagatctgggcatgccattgtatctaaattttacatcaaatgaaaaatctaaacaaagaccaagctttagtaatgatatgcatgctgaagtatttagggaaaagtgttctgccgtctacaaattacagtgaaaagcgccactaaaataaaacggattcatggatggatacagaaatggataaatacgtgagaaagcaattttagtaagatgttaatggtagagtttaggtggctagtagacagctgttccctgtaaaattctttccactttgctatgtgt

SEQ ID NO: 26835 - DNA, 2634 bp, Bovine  19866880639193
aaatttatagaactctttgctgtgggccattttatggctcaatccttgttttactttattgagtcttttaaaatttgcttctaatttaggttattgatttgttgttttgttgtgtagttgctaagttgtgtttgatttttgtgacccccgtcgactgtagcctgctaggctcctctgtccctgagatttcccagggaagaattctggagtgggttgccatttccttctccaggggatcttcctgacccagggattgaatccacatatcctgcactacaagtggattctgtactgctgagccaccagggaagccctaagttattgatactatacatatatttttttaactgcttcaaatcattttgggattaatatagattgttaaatttttttatgattttagaatgtgtaccaaactttgctaagtgaacaagtgtttgctttttcttttttcttcatgataatttctcgcaaaatagctaaaaactttaaatagcaagacaacttattaaataacttaaaaatctttgatcatatatatataatgtgcttttaaaatgccttttctgattgcaaaatacatacctattcatagaaagttggaaaataaagagatgtatagaaagaaagtaaaaaaaaaaatcacctttttctaccatgaagagacaactgctacctagtgtttccatcaagactctcttctatatatgtgtatatagaaacaaaacttgaacatcataatatatgaaattcaccatatgtgaatttcccacagaatttcttcaaaacgtgaattttaacagttgtactatattttattgtagaggtaccatatataacttacagattatagttcactgttaacaattactctagaaggatatttttatatataaatatttattcacatatatgattattttcttagggtagatttgtagcactaggattactgagtcaaaaggtgtgaacagttttttttcttccctttgaattttttcttcttttaatgttgaaaaatttcaaaaataagcaaaagtagagtggtaaaatggaattccatttgccaatcctctaactagatgtgaatatttttaagcctcttttgaaaataattaattaattaagttttgcttacgctgagtcttcatagctgcatccaggctaattgtgggaagtgggggctactcttccttgcggcgcacaggctgttcatcgctgtagcttctcttgttgtggagcataggcgctaggcatgcaggcttcagtagttgtggcgctaagactcttgatacttcataattgatttctgggaagagaaatgtaaataccaatttataacaggaatatgtgtgaatcgatatcccacttcactcttgatgacatatatttgccaattttataggtgaaaagtaaaaatgagttattttaatttattagccagcttgttatctgctattaattcctgagggttttagggtgttttcttctagcttctttgtagttttacttttcatatttaattctaattcactgagaatttaagtatacttaatgaggtatatatttcagtcaaattgttttatccattcagattcaattttgaagcactgtttgttgaataatctagccttttcccttttggttttagatgttttattattgtactctaagtagtttgtgtaggttatctcttttgttttattgattacaataagcttttgaaatgtccttaaataaaatttgtagtagtaaattttgaattttaagtagtgtctattatagctgattgatgctctctcacgttcaatttacatattttcttgtattttggtaaagatacacttgggtgactggtaaagagccacttacatactatgacatgaatttgtcagctcaggaccatcagacctttttcacctgtgacacagactttttacgtccttcagatacaggtatgtgtcatatctgttcttggggtcgaatagtagtcattaaaattattttcaaagttttttagtgtaatttattatacagagttatttggcttggagtcgtttgtatcattgataagaaacccagaataaattgaaactaattatgattgtaaactaggttattattatagtctcttgtcttatacagaatttaaattattttatacaaattagttgcttcttttacaacttaaaaaacctttcagatcaaatccaacaatggcttatgcagagaatagtgtacccagttttggttggggaaattaacacctgaaatcatacatttaaaaaaaaaaaagagtaaggcagagttaaacattggggcacagcatgcggagaaaaattgggtatattttattctagtcataattcagagaaacactgtaaagttgtggaagatcatagaagtgtctgagtttagttctctctaatcttttctgtagaagtgagtatggagactcttaaatatttggcttaaagttgttgttttgttgctgaattgtgtccgactgattgacagggatctttatcacaactattttgcccttttccaccttatctatgcttctacttttatccttcaaaattaaaagtattattctttgggaagccttctctgatcttctctgcagttcaa

SEQ ID NO: 26836 - DNA, 1111 bp, Bovine  19866880677311
tgttcagaagggagtttcccttcctctgagttcctagcaggaaggactgtcctattcagtcctggggaccaatgtccagtacgggccaggttagggccctccccggggctgctcccgcagacccctgggcatgactgtgaatgacacctatcatcctgcctcggaactctgggtataagtgccagtcgcccacagtcagaaggaatgactcagaaaaacagagtaggaattactttttttgaaagggaaatttacacttataaaggaaatctctatttgtgaggttgtctccctcgctgcactaggagaaacaactagatagtaagagaatcttactgatggggaaggcagagacttaatctgcataacaagccttaccctgtttaccctgctcttcctggcaacctcccgtaactggctggcttcctcaccctcacctttatttcgtctttggctaaagatggtatttaaactgctggtttaggccacgtagggcttcccaggtggctcagtggtaaagaacgcaggagatgtgaattcgatccctgggttgggaagataccctggagaaggaaatgacaacccactccagtattcttgcctgggaaatcccagacataggagcctggtgggctacatggggtggcagagttgggcacaactgaacacgttagaccagctaggtgagttcactcattttccctgggtgtctctcaggtttgtgagatatacccatgaataagcttgtttttctcctgttcatctgtcttttgtgacatgagtctcaggcaagaactctgaagggtaaagtggtagttatttctcacctcttcctggaggctcctccctctcccatcactggcctgcttctgcaggtgaaggagctctgcaggttgtaccctggtctgctgtctcacattagggttggtgaaaattaaacccagggtgggagcctcagggcagtaagctgaggcccggggcagtgtcccagagcaggggaaagacagtcagcttctcagtgtccaatgaagaggaagagcaagccctggttgtcccagggtcccaaatcaccatggggactagagcaagatgtgtaccgcccagaagacac

SEQ ID NO: 26837 - DNA, 3044 bp, Bovine  19866880711877
cttgacccggtccaattccaccttgtgcacaaagcccttgtaggtgacggggtcctcgtgatgtgtctcggaggacaaaagggcaaataggtggtccccccgcagcactgaggggcggctctcggccaccccaggaacctaggaagcaaagcaccagcaagcttctagcccgagacgaccagtggagggcccactaagaccccctcctgaaacacaaggtctgatgagccacctctaccctggggctcagggagctttgcttctttcctcttccaccagacagggcaagagtcaggggagatggggaagggacaagtttgcccaagctgctcagagatgctgagtccaggagtcctggcaaccctccagggcacgatttcaagaccccggggtcaggttcccagtaagtccagctgccctcttggccagttcagtttctactctgcctttaaaatcttgttcaaaactcagtttctgcaggaaaatttccctgatcatcctcacttgctgtctcttgtcacttggtgcctttctcagcaaatgggtgcaggaatccgtcctcatgtgcaattctggacttatgtatacacattcaacatctaagagctggcgaggtctctaagaattaccttccagacttccctggtggtctagtggttaagaatccactttccaatgcaggggacttgggttccatccccagtggggggaacgaggatcccacatgctgcagggcaactaagcctgcatgctgcaatgaagatccagtgcagccaaaaaaccccaaacagataaacaaaaaagaacacgaatcatctagttcagctccatgcttttcaggtgagcgaactaaggcccagagataacgagagacttgcccaaggtcacagagcaaagtctgggctaaaacccctgtgttctctattaccctgctctgacgcctcttttggggggcccagatccctactctgctccttgctgagccctctgggacaggaacagcatcattatccttttgttctgcccacagtctgtgggttggctaacttgagtccattctccctactaccaatccaagccctgacctccaacgtgagcagacgggggttccgatctatggggtcccaggtcatgggcaccgactccaggtcatagtgccggatgtcgtgctccatctgcagctcctccaagtgcagcagcagccggagcttcacctcgtagttcctccacttcagggttgtctgaagctgggccctggcagtgacgggtggggaggtgggaggggaaggataggaacaggatgggtcaggcaaaccctgtgtcccggagcacctctccctctgcagccctgagactatgaaaacgtcaggaatcagggaagactagaagagcagagaagcagatgggggtcagagacctctaagaagggagtccctgcccgccaacctcagacctgcattgtggatcctggagctggaaacaccctctctcaaagatcctcccatgacttacaccctcacttcattcaaatgtcactctccgctcaaatatcacctcctcgaagaggccaggactagctgtcctctgcaaaacagcacagcccatcctttaccctgctttaactttagttagttcttcatagtactcatcactacataagataagatgagaaatgcaactacaatgtcagggccatcatgtgagtgattcaccttgaatgcagcctggcacatggtgtgttggccagtcaggggatgaatgaactgagcatggaaggctgaggacagaggcatggggcagaagcaagaagtgagcagagaagaaacatataaagcagtgtgaagggtgcagaaggatggtacttacttgatctcagcaatctcctttggggcagtgaaaatacttgttccccgaagaaggacgggaagcagctgtctgaggcggggaggtggatagtatgttcccagtggcaaactgaactccaggtcatagttcttagcactgcaggaggggaacaagaaaagccattacaaacacagagacccttcaccttcagagactgagaaggcccttccctgggggaggcacaaagccctgcttcaatactattgttgaaaggggtcagtagcctttgccctagaagagaggactcactgtctcataaggctgctcatgccaaggctggaccattttcatttttagaaagcatgatacttgaaagcattaaaaataataataataataatatatggaattccctggcagtccagtggttaggaccccacacttccatggcagaggggggtctgtctttgatccctggttggggaactaggatcccacaagctgtgaagttatctatatacatatataaataatacatgttcattagagaaaaaaaatcagaaaagaggtaattaacaaataaatgggtaaataaacaacatgctcaccatccagggataaccactgttaactttttgatatgcagccttccagacatttttctttgtcaatatgtattatacaaatatattttaaattaattagccaattaattaattaacttcttggctgcgctgcatggtttgtgggatctcagttccctatgagggatagaacttgtgccccctgcagtgaaagcttgaagttctaaccactggacccgcagggaattcccctatacatgtattttcagcagaaagagcacagtggtctcacagtttgcttttatagctcagtattttgtgaacgcctggacatattaaaaagagatgtctacacatatgattccattcatatgacatgtccagaagagggaaatctatagaaagtacaagagtggttggtgagggctaggaggcgagggggcagaggggccggggggcaaaacgggtgataactaaagggtatgggctccttttgggggtgatgaagtgttccaaaatggattgtgatgatggtagggcctaactgtgaatatgctaaagaaaccacagattgtacactttaaaggaataaattgtatagtatgcaagctgttt

SEQ ID NO: 26838 - DNA, 1434 bp, Bovine  19866880744850
tctatttcttgactatcactcatggataaagtctagttcagtcttaacggggatttttcatacctctagaagtactacataaaactttgcaatgaccaaaatgggacacataattttaagagaatcaacctctaaagcttcaactttatatgactctttactgtgtctgatctaattgaagaatgttcctctgattagcctatgtgttacgctggtttctctttccacaggctccttgcctcaccctgctcctttaaagatatattacctattcctacttcataaaagaaaagcttacttttcacccatcctgaatctttccaaggtgcattgccctagagtgtaaaaatatacaggtgcctcaggaacaagtttgggtttcggagcaactgtttttaatcaagaaacctataatagagatttgtgtcttcacttatttaacagggaagctcagtattagaaatacaaggggctaccctcatggctcagctggaaaagaacccacctgtcaatgcagaaagagagtactctggctgctggaagttctgaattcaagtatattgtagagtggggagggagtaataatttttaccagatccatttatcagcaccctttctccccttactatcaagcatgcactgtccctaagggaaggttctcatagcaaggcaaagaaagcattagtaagggataataaaggcagtagaatcttgttttggccaagtgataagctcaaggcaaggctccaagacttacctatcttttcatcttagaatctgaattcagaagagagatggttgtcatagggatgaatgctaacatgtctctttgaatttaaaaaatgaagtcagacttctctgtcagaaagtatgtctgactcggttgacaggaatgacaatgagaactcacccagccaaataggttatatggaggacctttttcaaagctggaagaggcaaacatgtagctctatgaatttgataaacatataaagaacaagattccatttagaactatatggtcaaaagaaacttacatttttaacaaaaaattacacaaaactgttcaggactgggggaaagagactcttggagggcacaaacaaaatcttgtgtgcaccagaacccagaggaaaggagcagtgacctcacaaggctgagccagacgtgcctgtcagtgtttgagagtctcctgcagaggcataggtcagaagtggcctactgaggggatggggcactggcagcagcagccctgggaggtgtgtgttggcataagtcctttttgaaggttgctaatagccctacttttgaagaaagtagggaaaaccaccagaccattcaggtatgacctaaatcaaatcccttacgattatacaatgggaagtgacgaatagatttaagagactagatctgatagaaagactgcctgatgaa

SEQ ID NO: 26839 - DNA, 2729 bp, Bovine  19866880859939
ctaaacctttagacaggaggccaactcccagtggtcagttccaaacaggttaactttgggctgaagagattaaaaaaaaaaaaacaactctgtgactttcaaacagacacgtgtgtgatgtcactatacttgactttgctctcccaaggtacatttcagagctggactgtgggtttaagagaaaaacttgaatgggcaatttctgtccagtagtgaagtgaggagtgcaattgatgaagtggtgacccacagatttgggttggaatggttagacctgcaggtgggaggagaggaagtggggagggaaagtcagtacagccgtgttgtgtgcctccatgatccttcatacacagtcttcttctgattcctgaatgtatgtttatatactgtggcttcccaggtgacttgtggtaaagaatccgcctgccagtgcaggagacacgggttccatccctggactgcgaacagcccctggaggagaaaatggcaacccactccagtactcttgcctgggaaatcccatggacagaggagcctggcaggctacagtccatggggtcacaagagttgtatacaactgaacaactaaaacaacagcaacatgtttatatattgctttttcagtatagggtcaagggtaaggttataaaggaaaaataattattgtcttaaaagtctcattcttgtgctttagaaaactaggcttctctgagaaaactaataacgttcaaatgcacacttcatccaagtaactctggtatttgagcagccattagcaaagaataaagatttctgcgggaaattgcctggcagttcagtggttgggactcagtgcttttacttgcatggctcttgttaaatccctggttggggaactaagatttcacaagatgcagggaacaaccaaaaaaattaaaaagggtgtttttttggtccaaaatgggtggtaggacaaagaaaggagactgaaaaactgtttgaaaatgatcaagttaactactggtaaaattcatagattaattgattgatttttgtaatttcacacttataggtaagtaatatttccaggacacccaagtatttggaacacagtgcagggaatagatataaatgagtaaatagccatcaaaaagcacatacaccttgctccttaggagtttcaaatgccttcatcagttcagttcagttcagttgctcagtcatgtccaactctttgcgactgcagcacgccaggcttccctgtccatcaccaactcctggagtttgttcaaactcatgtccattgagtcggtgatgccatccaatcatctcatcctttgtatataaatatcaaaatcattgcatttaagaacccccaatgtacttcaaggataaaccagtttattttatagattaggaatccaagaaatacagaactgaagaggattgcctagggtcacactcaagttagcagaaaatataaaactaaatagtgaccaaaatttctgaactataaatgagaacatatgatctgactaggttttgccatcactttcagaataaagatcacccgaaaaacagaatttggaggaggtttaaaaaaacaacaacctggcaccatcagaatatttaggttatgaatggagttagtaggacacagtattttaaagtggtgctattcaaagtaaattgttgcaatgtacataaaactttctttgctataaacccctgctcttccttttgtgtttcagagaaatatattgagcttgaataatttttcacacatgattctctcatcctttcacttccaattaggccatacattaatagaaggcagggattttctcttagcttgattattttccttcaagaattctccatagacatttacttaatatttgttgatttgcttctgtatacagacccagacagttgaaagaagcaagaattgaagaaaaagtagaagcatgaggatttctttttttttttaattttatttttaaactttacaatattgtattagttttgccaaatatcgaaatgaatccgccacaggtatatatgtgttccccaccctgaaccctcctccatcctccctccccataccatccctctgggtggtcccagcgcaccagccccaagcatccagtatggtgcatcgaacctggactggcgactcgtttcatacatgatattatacatgtttcaaaggatttcttttcactgtgattccaactttcctactcaatgtcttgagaacttttaccgactgtgtatttgaaaggtgggtaaaatgggtgaaaaactactccagctttgacacctctgtgtgccctctggaaatagtgcgctaaacacatccttaagcctgaggccaagttcaaatcggccattatagggcacattgccccttttttacactctgtaaattgtcctccccgccagggttaattgaggggaagggtgggtccagatttgtcagacagctgccaagctcacagccctcctcagcagcatagcccgtccacctgctcttgccgccacaaggccggccagcatgaaccctcattttgttcttgttaacagctaagaaccacagtgattatgatttattcaaactaagcccaaatctttcatgagggaaaaaaaaagggggcctggttaaaaaggaagaagaaagtttagagctagagttcccataaggatccttccacaattttaaattctgactagatgtttatggatctcaa

SEQ ID NO: 26840 - DNA, 4018 bp, Bovine  19866880878664
catgggttagctgggttgtcttttcagggtatctccagacttaaagtgtcagctggagatgcaatctcatttaggctcaggatacacttcagggtcactagttgttggcataatcaaagaatcaagtctgttttctccttcaaggccagcgggcaaatctctctgacttcaaagaggggcccagtctcacttctaaagagttcacctaatagggttattcccacccaggataatctccccacttaagttgattaacttaaaaaaaaaaaaaaagcctaattatatctgaaaaattccttttccttgtaatgtagcaatcccaggagggattccatcataccacatatcctgcccatactcaaaggcagggccttatgcagggctcatatgccaaggaattgtggctgtcttaggagccatctgaacattctgcttatcaaaatgatgacaagagtgtgatcccaggagtcaggcagtcctgggttcaacttctgtccttggtctttcctgtctgttaagtaatacttgttttctgatacctgacctatcaaatgaagatagtcatattactgtgcaatcttgtagagatttgaggcagtttgtgtaatcatctagcacagggagtcccccatcagtaaggatattatgataagaagggaagatactgctcttggtcaaggagaagggggagtagataagcagtaatgctgatagttacgagcttagttgttgtggaaaagtttttgaaggcctttggaatattgaactacatctgcaaatccatgtaaagaatgggaatttaccaagtaataactgggcagtttcacatttatgttttcaatttgttcagcctaaaccacaaaattcgaacaaagaagatgtgaaagtctggcccagacattgcaaacttgcagcatctgatgataagaatagatagaaggaaaatgtttttcctatttttgtaatagagctaaatttttctatttatgaaagtgatatatgcaaattatataatttgggaattatgtataaatacaaagaagataaccaatataggaattagtttgtttccttccagtcttttctccttgcaaagtttatattattagtatctttctatgcatacagttgggcttccctatggctcagtgataaagaaatctgcctgccaatgcagaagacacaagagacatgggtttgatccctgggttgggaagatcccttggagaataaaatggcaactcactctagtattcttgcctagagaatctgatggacagtggagcctagcagactacagtccatagggttgcaaagagttggatacaacatagtcactaaataacaacttgtgtacaattacacatccttgttatttgtcttaacattagatcataagcaagtttctttttttgacaactgtcaaaaccatcatttaaaatggctacaccctttaggggttgcacttttgcattagtttatgtggctatttgataatgtctctctttgccaactggaatataaattccataagaatatgaaccaagtctcttgtgcatcactgttgtatccctagcacctaatgatacctggcacatggcagataaacaataagtatttgttgaaaggctgaaagaatgaataaatgactatatcttgtgaatgtgttataatttgcttgcactctcttgttgttaaacacttgtttcatcattataaatgaagttgcagtgagtactgcacataaagcacttcccatgaataaaatggttccccaaatgcaatgtacttaatactagtacccacccatgaatgctctatcattcctgtaagtgtcaaaaaatagacaaacatctataatatttttgatgagagaatctggtctcattatgctctctgggtttgctgggtataacatagaacatactggctatggattaataattgtatctataggtaagacccaaggtggggattttgcaaaggtgttctttgtttccctggtggcccccaagagcttgggtggcatctgggtgtagtaagagatgtacttgcagttgacagaattctaaaaatgggtcccaagattctatggttaatctacaggacctatgaatataatgagctgttactaccaaaattatgttgtgttatagggcacggttgactttaagatagatagattaaaagaaaaagctagggaatgagatgcccataaaggctctgaaaaactcctgcatgtttcttggaatttagaaagtcatacatatgtgtagggctatgtgcatgctcagggctgtgtgagtgctgagaaagacctgagataaatgtccgaagctctcacctctggctcaccttgaagttctatataaatctgaaataaagctttactaaggtaaagttgtcagctggctggctgattgttaagatgtgccccaacatgcacgccaagattctaaacaaaggctgagacacctactgctttcaagagtttaaagaaatttctgtttaataattagcaactactaagctaactgagcagacatttcatttaccaaataaaacagataatacaaattttataaaaatagttcagaaaagtcactaaacaaacaacaatcagcaataataacaaactctgggaaggagggagaacagtttccacatatgttccattttcaacaaaaattatgagacgtggaaagaaacaagagtggatagcccaaacagaggaaataagcacatgatagaaacggtccctgaggaagcccagatggtggactaagtagataaagattttaaatcaactatttaaaatatattcaaaataacttaagaatatcatgtttatgaaatcaaagaaaatatgaaagcaatgtttcaccaaataaagactaccaataaatatataaaggttatttaaaaagaaccaaatagaaactgtggagcaaaaaaaaaatacagtaagtgaaattttaaaaaacttactagaagggctcaaaagcaggtttgataaggtggaataaagaatcattgaacttaaagacaggagctgtctttctgttcacttgaggaacagaaagaaaaaggaaagaagaaaaataatgaacagagccttagagacctgtggtgtattcaaatgtatgaacacacacaatgggaatcccaggagggaatacagcaagaggagtagaaagaatacatgaagaaataatggctgaaatatcccaaatttgttaaaataaaaacaaaaacacttatccacacatctaagaagctcagtgagctccaagtaagacaacctcaaagagagtaacacctagacaaaacataatcaaattgttgaaatgcaaaggcagagagagtcttgaaagcagcaatagagaagtaactcatcacttgcaagattaacgtgatttctcatcagaaaccatggacagcagaggcagtggggtgatgtattcaatgtgttcagagaataagaatgtcaaccaataaatccattgaatctatccttcaaaaataaaggagaaattaaatcattgtgacataaacaaatttgagagaatgttgtatacaaaaattaattcaaaaatggatcaaagacctaaatataacagctaaaatataaaacagaaggaaacacaggtctaaagcgtcatgaccttgtcttaggcaatggtttcttagcaatcccacctaaagtttagggaaccagagaaaaacagatcaatgaatagcatcaagaaaatagaaagatatcccccagaatgaaagaaaatatttgcgtaaacacacacacaatggataatatactctttttgatatatgatgtaataaaatatttatatataaaaaaaggaaaaaaaaggtaaattacctagatgggctttatttaatcacatggaacccctttagaagcaaatttttttttctggttggtggcagaaggaaatgagaaaatgctatccttatcttccctgatatgcagaatcttgtgtaaagattcaactgtgag

SEQ ID NO: 26841 - DNA, 736 bp, Bovine  19866881052122
tttttcttataatgttcctaagaaatgtttttaatatactcaagagccttgagagattatagaagatagggaacgcaaggttaacctgaaatatcacagatggctttgctcttgaatgtaaatcaaagccaggggaatttgggggcctgttaagcatatttgtgttttaccagaaggcagcaaatccactcagacaatccactgcagatcatcactagattgctccatggtttgtttggagggctttgccttagaatttctgagacgcataggcttatttccaccagacacattgaatgttaaagctcttttctttagaatttgttgcacattctcttgcttcttgagattccacaggctcccacatgaacgtgtagggagtgagctagagtgtttcgtcaggaacttgcagggtgcggtaggcacagcccttcacttgtttctcagggcctgaagagtactccgcagctcgcactttattttgagaggaaggttgcattgcccagttcacccctctgtgtctgtgacttgcttcctctcttctacctcaagcgtttttgcttccttttactgaagtctggtgaatttcctctctgcctctcttggcgatacctaagagaatgtcgctttttgtaaaataatccaaatctagaacaaactaaaagactctttggtctaataagatgtgagggaatcagaatgagggtaaatttagtaatgaaataggtctgctggt

SEQ ID NO: 26842 - DNA, 1318 bp, Bovine  19866881210147
gcgtattctgatctttgggatttgcatatatacaagcattttatacacattatcagtaagaccttcttgtcgtttcaactagcttaatgtttgttttttaaatcaagttaactttatgaaatttgaatctacacttttgtggatgtttgaatttaacataatttttcttttttttgtgtgtggtgtgtctatgtgtgtatgttatttttctagtatttactagagatgaaaagtctcattttacctccagaacacattctgaaacggggtgatagtgaagcaattgcctatgctttctttcatcttcagcactggaagagaatagaaggtgctcttcatctgttacagtgcacgtgggaaggcagtaagtattcttttccaaatgcagtgctaatctttctgactattcattgcattcacaggcagtctttttttaatgagattgtctgggtttcgttaaggatttattgttcagattggtttgaaagtgaactctacggtgttcattggtttattggtagaagaaatgtgtaatgtgcttatattaaaaccacatttaggaaaagcaggatgaaaaactgggtattctgctgtatgttcacttatattaaatatttataaggaaaaatattaaaatttataaaccttcattttttatgtggcttgctactctaatattttttaaattggactttttttggttttgagatgtgtacaatatgaaactcttttttcattactgaaatcaacttaattctttaaaaaaattttaaaaaatatttatttttaaaaatttatatgatgactgtgccaggtctttgttgtggcatgtaggatctagttccctgaccaaggattgaacccatgccccctgcatcgagaacttcgagacttagctactgaaccatcagggaaattccccccaattttttaattgtggtaaaatatatataacataaaagcattttaaacattttaaaatgctcagttctgtgaaatgcatgtacattgttgtgcaaccatcaccatcatccatcctgagttttttcatcaacccaaacagaaattctgtgccaactgaaatataactcctcattgtttactccttcccagccccctggtaaccattctattttttgtctctctgagtttgactactctaggtatctcatataagtgaaatcatacatttgtccttttatatgtggcttatttcatttacatattattgaagtatgtgtaagagttttattctttttaaggatgaataatattccattgtaagtgtatacaaaattttgtttatccattcatccat

SEQ ID NO: 26843 - DNA, 1209 bp, Bovine  19866881234265
actgtggaagaacagggttgcccttgtggtttttatcctcagagtttagcaaagttcagttaaaaaatggcagaagcccaataaatagctctgtttttaccttcaacaagtgcaagaagccagagacctaacgtgaagattatgaaatgaggatttgtatctttggttgttgctctagcagcctgttctgttgttcagttgctaagttgtgtacgactctttgtgactctgtggagtgcagcatgccgggctcctctgtcctccactgttttctggagttggctcaaattcatgtccattgaatcagtgatgccacacaaccatctcatcctctataaccagcttctcctcctgccctcagtcttttccagcaacagggtcttttccagtgagtcagctcttcttatcaggtggccaaagtattggatcttcagcatcagtctttccagtgaatattcagggttgatctcctttaggattgactggtttgatatcctttcagtccaagggactctcaagagtcttctctagcaccacaatatgaaagcctcagttcttcagcactcagcattctttatggtccagctctcaccagaaccatcctgtcactcagtgaattgattttgtcgtccctaaaagtctctcatagctctcctcctttccactatggcctcggctcactcagctctgatgaatgtgctagcctcaaaagtccaatatgccaaatgcggtataggagaccagtcaagtttaagagtcagggaaagaagcatgtattttctatttttaaagaatttcttttttacattctaatttcataagtgtttggcttgatttacaccaagttctaggcctgttagcctacattaatgtatcacagttctggataggatatttgatagctcttatttagcccagaatctcaaatgatagggagctagagtgaacaatatttagcattttgttgggtttcacagtgtagctctcttcatagtccctctgtctgtaacaaatggactcatccttgtgttttcccatagctgccctggtgcttactgacatagatcaagatactgtgtggctctgtagggaactctgagccatttgacaatctgggcacaggtagtcacctcacattatttaagccctgatctcagcattctaacttctctgtattccccagtgtatataatatgtactgcttaaatt

SEQ ID NO: 26844 - DNA, 1649 bp, Bovine  19866881307074
aatataattgaatgaagagatattttaatgagatacagtaatctcaaacatagagcataataaagtaagagtaattagtagaatttgtagattgttaaggttcttcaagaaccttaggggactctctggtcatcaggtttagttgataaatggacttaaaaaagaggcaagttccaaacctggggacctaaccatccagtgacaaagcatgatgattttgtgaaggcgtctgtgggtgcacaagtatgtgtttgattttttttttaacttaatgaaatagtcctcctttagatttgaccttgaaaaattaaaaatgcttattttttctacattatcagaggttaaattagatcagtgcaatctcaggaatttatttctttaggaatttatattagaagcagctgtagccttttggcagtgcatgggatggcagacaggttcttttagtacagcactgattattacttttagtattaaagcttaggaaagtaattgcagcagtaataactaatgctacaaagatagttaaggcagaattaggaacagatctgaaatattctggctttggatcaatgctcttgtcagagtagatatacttgttactcactttggtgagtgagttctgcggaggagtgcagagtgctgcagagttgagccatcagttgtttattctttggtaaaataagatcttttgtagctttcacttcaagtaaagacatagctaaatgggaagagtgatctatctctttactgttattcacataactttacatatgtcttacaaagcaaaagctttgtgctttgttctgagatgacttaaggaacaaaagtgactaaatatctttgactggatttcttccatgaggacaaggtgcagtgcagttgtaccttctgagaatggaagaatgaatttttaaaagactcatattttttcttttaaagaaagcagagtgatcactctagcacatgggtatatcattgttacttcccaggggtcgtgtttaattgcttttgagctgtgaagctctctattgacattagtttttgtcaggtttgaggtctcaggggaaggtgtgggtcaccccaaatcccatcagtctgaaatcagattggtaagccatacaccttgcatcttgaattcctcctgctttttgtaggtccttgattaatttctaataaactaacacagttacaggctattaactaggaagattaatactcttagggggttgcttaatgtatttatcaaggttggcttaattcttagcttatgagaattagcgcttacatgcttatctcagtatttttcaaaaagaggaatgtttatcataaataacctttaatataagggtcaaaattagcattcaggatgatgcctgatggtgtgatggtcatgctgactaaaataatctgtttatccttgacatttttgcagaaacttaagaaacaatgaaatttcatgggccatagaagatgctagtgaagcctttgctggactcacaagtctcactaaattgtatgtatttttcacatttatgtatgtttacaaaggtcaagaatcagttgtaaatgtgattggattgtatctatttgctatggctagaaagtcagccttctgactcatccactaaaggaagaagctttgttgt

SEQ ID NO: 26845 - DNA, 1480 bp, Bovine  19866881353471
ctggttggcgggctgtggtgacaatttatataatagaattcatgcttaaataataaggtaacagctttggactgtgatgttttaaatgttttattgaaatgtagactgattaacaggcaagattcttcttctaattattttaattataggctcttaatgacaagaagctgtagaaataaaaacatgttaaaatttcatttttaatgaagtggcacctggaagtcccaacttctccaaagcaagtagggataatctattgttacatagaaacaaaccacatatacagagaggttaagatgttcgttgagggaacaggattatttatgccccaatttctctgaatgtaagtagaacgaacaagacgtatagtgggataaaaagacactggactcagtcaagggctgatttttagccatggccctggtaaactgcttgtctgtgtgactatctcacctcttttggtcccagtttttcacaagtaaaatgcagaagttgaaattaatgagcttttcaatattcatagcagcactgtttacaataggacatggaagcaacctaaatgtccatcaacagaggcatggataaaagaggatgtggtacatatatacaatggaatattgctcagccataaaaatgaaataatgccatttgcagcaacatggataattatgctaagtgaagtcagttattcaaacatatcatacttatcatacttatatgtacatacgtatgtatatatggaatatgtatatatggaatctgaagaatgatataaatgaacttatttacaaaacagaaataaactcacaaacatagaaaacaaacttatggttacttttctgtatacctgaaaataatgcaacattgtaaatcaactatgctgctgctgctaagtcacttcagtcctgtccgactctgtgcgaccccatagacggcagcccaccaggctccccccatccctgagattctctaggcaagaaacactggagtgggttgccatttccttctccaatgcatgaaagtgaagtcgctcagtcgtgtctgaccctcagtgaccccatggactgcagccttgcaggctcctccgtccatgggattttccaggcaagagtatacttctattaaaaaaaaaaaagtctttggactaatgctgaatcaagaaaagaaagttttatatcatggttctacaatctagatgagttttttggtgtattgtatcttcattaatataaatttttctaaatttattttcttctccgaagattttcttttttaattatggcatcatgctttcattactaataacttaattgaggtttcactcttcctattttggtcaagtacaattgcttacagtttcttggttgtgatactcattctaatgtttgaacatttatacctgccaatttccctttctgaaatactgtctgagtgttttcatatccataaccttatcagatcccgcctgactctccaagga

SEQ ID NO: 26846 - DNA, 1034 bp, Bovine  19866881507203
aataaataagtgacttggctcctgccctgtatttttttccctcttagatgatttgctcaagccacagataagaactcatcctgaaaccacagttgctctgagaggcgtgaatgtgactctgagatgcactgcgggtgagcagcagtgattcacccatgtctgctctgtggcgcaaagacagtgaagtcttgtatgatgctgatattgagaattttgttcgttatcagcaacaggctggagaagctctggaatatactagtgtcctacatcttttcaatgtgaatttcacagatgaaggaaaatatcagtgtattattactaatcactttggttctaactattctcataaagccaaactgactgtgaatggtaagaaattatgctccctgatggttttatagttagaaggatttttcatgtttaatttttgaacttttgaccaagaagattacattaaacctgacactgggtgagggtccttactgtttctgtctttagggttatgatggtatacaggctggattgttaatttacccacttgctgtccctaattagtgtttgactgaggggtaaaggtgaattccatggtttcaggagatgaactactctcttttgtgtttttgaaaaaaaaattatttttaattctccattttctttctagaactgtaattctgctctaaaaactataaaatttattcctgacactgttcccagggccgtccagtaactgggagtattaacatttctgggaccattgatcattatcattgtctaaaggtagtcaatgaaaccatttttgaaaataatgctctttttctttgtgtctgttgaaaaaatatacaacagctcgattggtctgttgcctattagattgaataactacagcacttcaggctttgtgcaacgaaagatgtacatgtgtcttgcttccgggctgttttatgagctgtttgaaggcataaaatttttttttatcatgcatctcttaagtaaggaatagtaaatattaaatgctaaaatataggttcagaaaa

SEQ ID NO: 26847 - DNA, 816 bp, Bovine  19866881571540
attggggatgaaatcacatttaggtaaatgtgcccacgttctgtcccaagggtgtttgacataatgcaggtatatttccccagcatcatctagcccagcatctacgatgatgagaagctggttggctgcagcaaagaagtgccgttctgtcaccagcaaaggtccatcatctttggtccagttgaggcgaggggcgggactccctccagctatgcattgtaatactgcagtttcacctcgagttactgtcttgtcctccaggggtctaataaatgagggtgtctctaacagaaagatgcattaaaaaaaatatcaggcaattttatccttaaaattctactgaattagactaacgaggttatgatgaaataagcattttcataagctcatgggaagatcagaagtttttcagaaaagcaaaagcctcaaaaaatctaaatttcctcttaggaattctacctagagcaagcgatcctaggtgaagaagtcaagattcatatacaaaaaatgtttattacaaaattaattgtaatttttaaagatgaaaaaatctagcagaaaaatgagtaatttaacagtacagtcacgtatttcatgaagacttaatgacaatgtaaccctgtgatacaatattaagtggaaaaaagtaggtatacataaccacatgaagatgagtaattttaaaaagtccagaatatgtcaaaatctaaacagggtttgagtgaccttccttttttcaaattttctgcatatcttaaaatttttaaacaataaatttattttccggttacacaagagttaaacaaaccaacattt

SEQ ID NO: 26848 - DNA, 1441 bp, Bovine  19866881852555
gagagagggtaggagggaatgggaaaatgaggtgaaggaacaggaggcagtggctactacactgcctttgacagtctcttcatccccacagaaaaggctgttccaggaagtttatattctaggcagagtgaaaaggatgagtagaaatcatatatattctggcccaacatcctaggggaagaaagtaagtcttgtgacaatatgagtatctttgtggcctggtaccagcccaaggggcttcccaggtggcacagtagtaaagaaactgcctgccaatgcaggagacacaggagacacatcccagtccctcagctgggaagatcacctgggggaggaaacggcaaccagtccagtcttcttcctggaaaatctcatagacagaagagcctggtcggctacagttcatggggttgcaaagagttggacacgaatgagcacctatgagcatgtaccagcccaaggtccgcaggtctagaaaacttaaaaacaaaaccaacaagagtataaagtctaatatagagaattagaagtaaagagaggaggcgaacatttcccaaagcagggtttccatgagtgccattaagtaacctcaggtcaagagatgagagcctaaaatccaggaagggcccaaggtccacgtataggacaaggacatcatatgtcttccacaagcacacctcaaatagtggcatgaagaaacatagcacacagacagctctaacactgggatcctggctttctagataaaggaagtaaaaaagatgttttgtcctccagtaaattcattttttttctgtatcattgcctttgctatcctttctcctattcctatcagttgtctttacactatttaaatattcatgtttgtttttgtaaaaactacttgagggcagggataatgtgtacctttgcctttgatggaaactagctcagtgcctgttcttattaggtcactaagaaatgctgcttgatttaatgttataggagaattagacttcaagggtcaacagctgcaagggctggcaatccatagaatttccatgaggcaaagccacatttggcaattacaagggcataccagtgaagtgaagagaagcgtcagattttgcaatagttctgaaaataagatagattttctggagtggctgtattctcagaaaattatgtgctgaatgccaaaaagtaatccagtttctcatttttatagagatcatgcaagatacaatctctgccagattcaaatggaaaagggtgacatttataagttttcttagcactatatagcattatgctaggtattgcacacgtagaatattttaaaaagtaagatgttattactgccttcaagcttaaaatcttaacgtagaatcagtgtgaatacacataaactaatcaatgtttacactggagaacgaaatggcaacccactccagtactcttg

SEQ ID NO: 26849 - DNA, 953 bp, Bovine  19866881919691
tctgagtcttgttttttccttgttatatttgctagtttgtatttagattccacgtataactggtaacatacagtatttgccttagtctgtctgacttatttcacagcaataataccctccaagtccatccatgttgttgcaaatagcaaattttttctgttctttttcatggctgagtagtattcagttgcatatatttatcaattgggcttccccagtggttcagcggtcaagaatctgcttgcagtgcaggagatgaaggagatgcgtgtttgatccctgggtggggaagatccccagaggaagaaataatgctgtgatgaacagtgggtctcttgaggtttcatatatattttagaatttttttgttctatttctgtggaaaatgtccttgggattttgatagagattgcactgaagatgtaggtttctttaggtaataaggagattttgacagtgttgattcttccagtccatgagcacagaatatctttccattttatttttatctttttgaatatatatacctcttattttaatttctttgtctggttaagtaatgcaaaatatgtctctgacatttattgtaatatatgattctttttttttcttctccccaggtcttgggcttgccttcaacttaaatccggctttgaccatgattggcaagtatttctataagagacgaccgctggcaaatggactagccatggcaggcagccctgtgttcctctctaccctggcccccctcaaccaggctttctttatgatctacggctggagaggaagcttcctaattctcgggggcttactattaaactgctgtgtggctggagctctgatgagaccaatagggcccaaaccaaccactgcagagaaagagaagtctaaaggatcccttcaggaagcggaaaatatgagacgaaaaagggggcaagtatgcaaatacagat

SEQ ID NO: 26850 - DNA, 793 bp, Bovine  19866880373526
tgggtggcaaaggtggtgcagggtccctcttaatctaggggagcaagaaatcctgccacttcctgaaattcttggcatctgaccagggcagtggttggggatgggggagtcagggtttgggtgccaaataaaaaaagaacctagggaattccctggtgatccagggtaggacactgtgctttcactgctgagggtgctggttcaatccctggtcagggaactaagattccacaagctgctgtgcagggtagccaaaaacaaacaaataagaaaacaacccaagagaaggtggggaagaggggtgtaactggaggcaagaatcccttgtcaccatcattttcgccctctgcagtgcgttccaaccttatccccagccctcccacctacaacgtagcgcatgactacatcagctgggagtccttctccaatgtgagttattatactcgcattctgccctccgtgccccgagactgtcccacgcccatgggcaccaaaggtaatggtgatggggtgagggggctgagcctagggtgggtcacaggagatgctccgttccctttgggaaaaagcaatcagaagagcaatgactggcccatttcacagatgggtgcaccaaggcaagacatgcaagaaccagggatgaggacaggggtggggaaagaggacagaaagaggttgtgggagggtcttgtctgaggtcagtggcagagtcaaactaatgctcccgtatttccagggtgcctcttcacccaaactttgtctactaagtgggtgggatcctgctgcgatgagg

SEQ ID NO: 26851 - DNA, 1059 bp, Bovine  19866880560072
gcttcatagggaaagatatttgcctacccagatcctatcccagtctttggcataagtgggttctgaagttgctctcttgggctcaaagtgagaagtgtgactcactggtcacaaaggacgttagaaaagcaaggctctagaacacttgcggccagcacaaaccttatctggtgtttctgggtatcagcctcttggaaattcaagtggcaaatagttactgcacctggtaacatgctttgaacatggaggagcctaaggcaaactcaacagcaaattcacttgatcttggttctggctgggtctagagtacctcaggttcctgtctgctgtctgtaaacctcagtttctcccctttcttccacctcaaacaaggacaagggacacccagcccgtgccaggggccgggaagagcccacctcatccctccagagtcagtcctaacgccagcctgcagccctttcactggtgcctccgccgtggaccgcagcatcggctccaagtccttctgagcgcctccttgacctctttgttgcggaggctgtagatgagcgggttgagagctgggatgacaagggtgtagaacacggaggccatcttatcagtgtccagggcgtagctggagctgggacgcaggtacatgaagatgagtgtcccgtacagcatggccacacccgtgaggtgggagccacaggtcgaggctgctcgccaccggctctcggccgagcgcatgcggatcacagcgccggcgatgaacccgtaggacacggcgatggccgacacggtggctgtctggatgaagccacagacggcgaagaggaggagttcattgagactggtgtcgttgcaggagatggccagcagggggggaatatcgcagaagaagctgttcacctcccgggagccgcagaagctcaggcggaaggtgaaggtcgtgtggaccacggcgctcactgccccgcccaggccggaggctcccagcaagaccaggcacagacgccgggacatggccgtggtgtagagaagagggtttccgagtgccacgtagcgcgtcataggcca

SEQ ID NO: 26852 - DNA, 1222 bp, Bovine  19866880565901
agaggaatgaattgaaatttgttgaattaaaatttttttttactatatatttgaatatatgtattggcctatgcaggaccatggagagagttaaccaaaccagcagtgtctccgagttcatccttctgggactctcgtcccggcctgaggaccagaagccactctttgccctcttcttcatcatgtacgtagtcaccatagtgggaaacgtgcttatcattctggccatccgctctgacactcagcttcagacacccatgtattttttccttagcattttatcctttattgatgtttgctacacaaccaccatagttcccaagatgctggtgaactttctgtcaaagaagaagtccatctcctatgctgagtgtatgacccagatgtatttcttcttggcttttgccaacacagagagttacctcctggcagccatggccattgaccgctatgtggccatctgtgaccccttccactatgtcaccaccatgaaccgccaccgctgtgtcctgctggtaaccttctcctgctccatctctcacctccattccctcttactggttctcctgataaatcgtcttctcttttgtgactccaatatcatccaccacttcctctgcgacatcaaccctctactgaagctgtcctgctcctccacgcttgtcaatgaaattgtcattaacaccgaaggactggtaaccctggtgagccctttcatatgtgttatcatctcttacctacgcatcctcattgtcgttcttaagatcccttcggctgctgggaaacataaagctttctctacctgtggttcccatgtcaccatggtgaccctcttttatggaagcattatttatgtttatttccgacccctgtccacctacaccatcaaggaccgagtggcaacagtcatctacaccattctgtcctccatgctgaacccttttctctacagcctgaggagcaaagatatgaagagagacctgaggaagctgatgagcaggaggatgtcctaggcagcactcctgtgggcatactcaggggtaagtcttctcctgaggcccctcgcttctaattgaagtaagttactgaaggttacactcctaagccaagagtccattaaaaatggtgtagatgactgacaagactagaatctacagtcttatttttagtataattatagaagtatacaatatattcatatatatatatatatatatatata

SEQ ID NO: 26853 - DNA, 867 bp, Bovine  19866880569853
attcaccagcatcctggggacaatggttgttgagaagcaaatgtcaatgaaagacaggaaactcaagaagaaatacatgggggtgtgcagttgggggtcagaacagatggccaggatgatgagcaggttccctgttatggtgaccaggtatatgatgaggaagaggataaagagtggtttctggtcctctggccgcgaggaaagtcccaggagtatgaactcagagacactgttgttttgattgagtctttccattgactttggtctagctatgtacaagaaggtttgttatttatcatgctccaattccacagcccaaattacaagaacccagcaagtctttgttgtcctctatttaggcactattagcagctgtgctgggaaagcttattaccctcttggtcccttgatgtggtcctcccttcccaaatccatgtgatcataaggccttatgatgaaacctaaaggaacagaagggttttcctttagaaaccatcacagctggaccccttgattcaagttccttagttcctagtctatgaaatctgtgtccctgctgggaatacagcaatagaacagaaattcttgcctttgtgtaattcatgtagcttgggtgataagtcagatgatcacaaacagtatatgtaatacagtatcaggtagtgatacatacacgtagcagtacagaatacatcaaggctgtatattgtcacccagcttgtttaactcatatgcagagtacatcatgcaaaatgccgggttggatgaagcataagctggaatcaggatttctgggagaaataccaataacctcagatacacatatgatacaacctttaggcagaaagtgaagagaaactaaagggc

SEQ ID NO: 26854 - DNA, 1590 bp, Bovine  19866880606112
ctttttaagttaacttactaaatattggtagttggatgtttgatgatacagtctaaatacagaaaataaaattgcaaaattagaatcctattcagtaaatatcctattttcttaagggttttaagcctaaacatatgtttttctgcttagaaaaggttacatttagtttaaatattaaaagtaatacctttttattctcagatcctatgtaaaatcagaagtagtgctcaatttagaaaaaatttttatcacttgataaataatgtgttttcctctttaagataaagcaaaaggagagaaagaacaatactgacactttatacgaagttgtatgcttggaaagtgaatcagagagagagaggaggaaaactacagccagtccctccattcgcctgccacagtcaggatctcagagttcaatgataccttctcctccagaagatgatgaagaggaaggtaaattgtagggagaacttaatttctattttgggtggtgtacacagaccattacagttttatcagggaagtgataaagtgacatagtgttttgaatacttttaataaatgtttatgagagtctatgcaaaggactatgggagataaaaaatgattgccattggactttctttgaggtaattatagccaagttagaaaaaatgagatttataattagtgctttttttaaaaagaatcagtctctgctagcttagtgaattaatacagcacatttttagagcaaatttgacacagcttctgcctaaataaatgtttccatctcaactgatttatacattattggattttcacactgataaatactaggaatcaaccagttcttttttttttttttctcctctctctttttcatgattatgtctgtgaattgttctgtcagttctgtgtcagagtaagaaatggagggaggaatacaggaaaaatgaaagtttggaaggcattttgtaccagagctttatttttaagggcaaaaccaagctgattatgaaaagtcgtaagaggtatgcatctatgtgaggttcacagggagtgttctggaaattcataggagagaattcagttttcattgtggagtatgtggtggagcaccgtgactctttttagctggaacttcaaagtgcagggagaattcagagataactgtgctggtttggacacttctggctaaaaaaagtacattaacagaagcatcagggtgataggaatgtttgattggggtagaagaaatatgtgtccatgattatatgtactttttccaagtttagagcaagtgctgacttcccaattcctgttcttccccataacttctacttttcctataactaatcaacttaggatcatttattggcaatgttaatggccaccagttgctagatgcttagtgtggtagacagacactttgtttatgaagtaagataatactttgtttatataatccacacaaattcctgaaaaataagacttattttgaacataaggaaagtgagtttgcctaatgtcgcaatatttagaaattggcagggaggattttaatccaggtttggaattagcagtcgagctctattgtgttatcat

SEQ ID NO: 26855 - DNA, 1957 bp, Bovine  19866880617869
agttggacacgattgagcaactgatctgatctgaaatacactgtaggggtcttaaaatgttttataaatttattattttataaatgaagaagctaatgtctgaaagactaattgatgtgtccagtgttcatagacaagtaattagtataaccatccatgttggaaacccaagcttctatctgtgcatgtacttgctgtgtgtgtgtgtgcatgcgcatctgtgcgtgcattcaatcacatctgactctttgtgaccccagggactgtggcctactagtttcctctgtccatgtaattttccaaccaagaatagtggaatgggttgcaatttcctactccagggaatcttcccaacccagggagcaaacccaagtctgttgcattggcaggcagattctttaccactgtgctgcctgggaagcctgtgtgtatgtattcgtgggcatactcactcatatgcagtatttcactgtacctctcaagatagaaaatgatttctgtgctagaactcttgaactgctagatcaggacccacaggttactgaactattcctgagatgtatgataacttgttaagatggtactactaggtttctcttttgtaaaagtagatttttctttttgtatttaacaaatcatcttgactccatatttatctgacttccaatggacaggattgctctggtcactattactcaaaggggagttcaaggtgaagtgcaagggttgttaacgtttatatagtttctggggaaaaaaatttttaaggtaataagttatgttgatctttgaactattttagaaagaaattaagtaatgttttagagaataatttaagcaaaaacaaaagtaaatcctttgaccaatctaagcagaatatttgaaagttaaaaatcataattgcaaatttagaatgaacatatgtcatagattttaatataattcattaagtaatgagggaaccagtaagatggtaaaactggttccaagtatttgaggaacttgaatttatatagtcttttcttagggaaaaaaaattagaacaagattgttgggatagaaacaaaactgtttaatatactgtaggtaacctttgggttactcttttctgttgtacagaaattatttgtttagctattggtcacaaacctagaggttaatatgtaatttcacagagtctgggtcctttaattaatagtaagtaattaagacatttgttcatcttgaaaatttaataatcctttgtacatgttaaaacagtcagcacatctgatctgtgggtcaaatctggcctgactggtttgtataaaaaagttttgaaacatagtcatgctcactgtctatgactgctcttgtaccgtaatggtagagttgaggagttgcagcagagactactggcccacatagactaaaatatttactgtttggccctttacagaaaagtttaccaactacttaattaaacagtgcttcaggatgctgttgaaaggacctgttgctactatgttagccttctaggattggggtagtttttcttaagaatccaaataaacattaagaagatggtaatatctgctctctgcctgatatttctaatgaacctcttattgccctcccccttctgtatctttaattcatgcatgtgtatctttctctttggtgttgctgcctttctgttctagttttctctctttattttcctacagttctgtcttttcatcctgctctgtatttcactctttttttcctcctccttaaactgactgtaatatggaatattaatgtatgtaaatattgtactggtaaaattttgtattccctactcttaattttttttagatcagtttaaaatgttatgtgcttacctcaagataaacccaaaatacaaaacaatttcagttatcaaaaattttgtgaactccattgatctcttttctgtcatttacctctcctccca

SEQ ID NO: 26856 - DNA, 1020 bp, Bovine  19866880652653
ttccctccctctgctagaaatctgaggagatttttctaaagtattttctgtgggaatatgttcaaactcctcaagtaaatattgttgggatcttgtatggctggatctcccagacaatttttaactctcaaagttgtccacactgagcccccaccaattcatcaattatggttcaagttttcctaccctggcactgatttctgcagcagtttctgtttgtctgtgctccagtaaacagtgataacatatttttccttctctctaatcttttttgttgttgttgttgacacattgacttatttttttattttattttttaactttacaatattgtattggttttggcatatatcaaaatgaatccaccacaggtatacatgtgttccccatcctgaaccctcctcccttctccctccccataccatccctctgggtcatcccagtgcactagccccaagcatccagtatcgtgcatttgccctttgttctcccctctcttatggatttaagaaaaactgtttattttgcagtctgttctactttttacttgttgctaaaatggagtaatttcatataaattctacagttatatgaatttcacctcccttttaaaagttgctttataaggtaattttaaaatattttgacccaaattattttgaaatactgtgtatgtatataattttgattgtgaggcaaaaaacaaactttcttgtttgttcagatgtttaactatttgtaattatatgtatttatccacttttgttttgagaacccaatttattatgggataaaagttggatctctttgagccctttaaaaatattataatgactgtatctttattatcatgaatatatatattcaacagcacagatttcctacctagtgaaagtgttagtgctcagttgtgttcaactcttggcgaccccatggactgtagcccaccaggctcctctgtccatggaattctcctggcaagaatactggaatgggttgccattcccttctccagaggat

SEQ ID NO: 26857 - DNA, 931 bp, Bovine  19866880668954
ttatagtttcagaagtaggctgtgaaagtaatcattcagacttttatttttagggatccaagggggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcaggtgagtacagtttaattgtacctctaggagaatttgtgaaaaggtaaaaataggtagtgatcttcattaatttaataaaaagaaattgataacgtaaaaggtaggtacagacggctactctgggtctgtgcatcatccatcacatctaaggcaaacttctggtgattagtattcaaagtacagtcttaaatttttcagacgtatgttgctgagagtcttcatgttttccagagtaggcccctcaatgttataaaactctctagaaggtttgatatagggtggaaaagaacaaaaagagcctggacaactggaaactttgatagatgctaattttttaaattgacgactctgttaatttcatttcattcattcattctgttaatagaaactcactattaattccttgttttcgagcctttgtcatattgggatgcatttagagaattttactgttgtcatgtttcctggaggatgctgccggaggctgaaggctccccagggctgaaggcaactggttggtccagggctgtggtcactttaggacttgctctaccagcctgctccaagggtcagttgaaaactgtgatcacctttcattttcagatatgttacctttggtataattagattacatctttttgagtgattttatatcagttagtccttcaatccagtgttgcagtaaagtagatatcagtacacaaggctgaa

SEQ ID NO: 26858 - DNA, 1099 bp, Bovine  19866880761488
tcctgtttgtctactgtggatacagagaatggaacatcacaggacgctccctggcctcagcccatatatctgtgcttccagtaaggtaagagtacagggagtggagctaaataggtgaggtcaagttctagggattgaggaggcaagtagaaatagattatcttgtctatggtgtatgtcaaggggtgggtgttgggggaggggcagcaaaaggaagatcatgcatttcctttttacttggtgagcaaaagtgacttttccaatcttgcctttaaggatatgctcaattcttatctcctccaatttccaacatggacttctctggtcaaactgatcactttcctaaggaccctattatatacagctatgaaggcatggttcagtttgcatgggtattggtttgcctgttctctaaagtcccatgtgtgttttctctcacatcataatggcatccagagattctcatgggcaaggaccacttctttttttcctggaacagtttgggctacacagatattatctgtgaattgatctaatacttaaatattgacacgtggaagggttttatctgcacagatagcaaaactacaaaggatgggaaaaccaagcagagtgaaccaaaccaccctttcagacttcctccttctagggatctctgagcggccagaggagcaaactctcctgttcgtcatcttcctgggcatgtacctggtcactatgatgggaaacctgctcatcatcctggccatcacctctgaccctcacctccatactcccatgtacttctttctggccaacctatcaataacagacgcctgcttcacttctgcctccatccccaaaatgctggtcaacatgcatactcagagtcagagcatctcctattctgggtgctttgcacagctgtattttctccttgtgtttggtggccttgacaacttacttctggcagtgatggcatatgaccgctatgtggccatctgtcagccacttcattacagcacagctatgagtccccagctctgtgcactaatgttgagcatatgctgggcgctaaccaactgtcctgcactgacacacacactattgctgaccccgt

SEQ ID NO: 26859 - DNA, 1960 bp, Bovine  19866880772123
ccttcccaggcagaaatgtgtacctggtaatcagatactaccagatactaagatttttatttacagaagaagccaatagctgcagtttctatctttgctaaatgttgctaactaattccctttttcagtgtgttctaagtctatgacaaaatatattgatgggccatgtttgacccatgggccaccagtttatgacttttgcattatttggagtagtgctgtgctgtgctgtgcttagtcactcagttgtgtctgactctttgtgaccccatggacagtagcccaccaggctcctctgtccacggggattctccaggcgagaatactggagtgggttgccatgccctcctccagcggatcttcccaacccaggtgggttctttaccgtttgagccaccagggtagccctttttggagcagaccttccaggaattcacattcctttgggactcgactgaccattgcagaatattgcccagagcacagtgcttccagggctggaaggtgggttgcattagatcattgcaacctggaggctgtgattttaagtctggttgaggaagataaataggctgttccttcctggtccagtaagaagtgacctggattgggactccttgaggacctggaatgtggtcccacctcttgccagctggctatgtaggttgcgtcattctatgggtctccatttcctcatctgttcacctgaggtgaaggaatctgaagtctctattccactggtctctttcagtaattctagcccaaagacagagaccaaagttgaacctgctggatttgacaaaactgggttagagataagagtaagcccttgctacaaacaaactttcacatcagggggctcttgcagccaatgtgcccatatttgggggggtattactctctcctcccctgttgtgttctccatacttcagccagagtgaacttgtaaagatattaatatctattggattatgccattcccgggcattgagttcatcagcggcttcaagtaatctctaagaagatgactgtggcctagacggctttgtgtgaaacagcccctgcctgtccctgcagatgccccggtcttgtgcactgccacccttgcacactgctctgcccacgagcctttcagttcctcaaacccttaatatcctcagggcctttgcatatgctgtttcctttgctaggatcacccttgtctggccgattactatccgtattttggactacagctttcatattgctttcttagggaagtctttcctagtctacgcaaaatctcaattattcctctatattaaccacttttatacagcacagttctttttcttcattgtacttattaacagttatgcccttatctacatcttagttttctatctccctttccctagatcataagcttggaatgtaggaatcgtatccaacttgctcattctgtccagcaccaaacaccatgcctgacacatggacgcacccagtacatttccctcaagtgggtgaatacttgtcattaggttgatggaagggaggcactcattcgtggtgttcctgaggagcagagaaatggacagaaagggaactcttagctctttccccttctggcccctctgaaccactgaggcctctctgccttgttcatctgatcccacaggcaccgcgggccaatttagggaacagcctcctaattacacagcttgaagacctcatcaggcagattgcttttcagagccagccacttctgttattaaatagcaaaaggcattcacagaagaagcacctgattggccaccagagtgtcttaggaggcaggaggaggtactaacagcttaattttttcttaggaaatggaaatatatcttcattttccaagcaaggcatctttgccatttctccaagttgaaattctgtgagtttgaaaaaaaaaacacaacacatctacagttaaccttagtag

SEQ ID NO: 26860 - DNA, 1787 bp, Bovine  19866880787174
tggactgtggaattgtacatggaaaaggcctgtaagggaggatgaattttatgttaaatctagtactgagagtcctaatctagctaataacttgaactgataaaatgtttaccaaagcaagacaccgcatctatttttttcataatggccacctgtttggaaatgctaattctgtgggttagggtatcatgggccactgggtaataggaaactagcagcaaatactctttccttatttagttttccaagattatcctgaaatgctttacattaaagttaatggtgggggggggtgaaaagccattaagtttgaactgaacataacaatgccatcttgcatattttcacctactaattttgaagtgtttcaaattattccagaatacactttatagttttataatatcccatatgtgttactaggtttaagaacaccaaatgtttttatataatactgagaaatttaatttctggtagaaatcaaattagtatctttgaaagaaaaagaaaaaaatatgccaaattctccttctgttacgtgtcagattctttctgacagaaaaattaaaactgaactttccttataagaaatgatttgaccttttaaaatgtttttcctcagtaccactgtaaatatattctagatgtctcgattacaatagacaaaattttgtctaaaacactaaaatgtttagtgatgacaaaattggcttttcattcctttcaaaagcacttagtaaatgtctacctagaaaatatttttataattatcaaaaatgataaaaagcctactgtttttataatttatttttaaaaagtatctaaatgaaccaatgcaaactaagatatacatagcaatttatttgaatctgtggaaatttaaattgctaataacatttatatttaatagtaaagtaagtatccatcctaaagatactccccaaacacctcaaattgagataaaatagctttaaaagcccatacctctagatatataaagggactacttaagaaaaacaagttaaattcaaattaaactatttgtattaagtaatttcagttactaaaactgaagaagaataacaagataaagcctaggagtgagaaacactaagagagaccttaaacggatttttactcaagtaagttttcaggctataagttccttgctatgaatacaaacttataaaaaaggaagaataatagacatctcttatatgatgcaaattagaaactgctttattaaaagcaaactgtttatcagctaagtactttcattttctgttaactagtctaccatgttattatgcaagtagtccaggactacgaaacttgattttaaaataccaggttaaggtttatgcctcattcactactgtataataaaaaaataaagcattttacaattctctttatgaagatgtaaacattagggctcagatatgttaattaaaacattcattgttttcattttagttcacccatgtgagaaattcaagctactttaatggactgtaatagcacttctcaattcagaaaccttaaaaacagtagttctggacttaaaaaattatatttaaagcatcataggtacaatttagatcttactctataaaactaacaaaaccaatgaaaataatctctaaattctaaaactcagcattcaaacatacgaaaaggactggaaaaaaggaactgtattaccattttaaagactgctattatatgtgctttagtgtatgttagaaaagacatgacccaagttttacttctaaaatccattgttg

SEQ ID NO: 26861 - DNA, 702 bp, Bovine  19866880839023
taggttcccttttaattcctactctccccttagctaggccccttctttttaattcctattctcctcccactagctgtgattagaatgactttgtatcccaaataaagtgtttaagtaatcttttttccatttttgtatttgtcaaacttgaagttccggtaggaacttttgattaacctgagaaagttaatgttgctacactaaattgatacactcaaaagcagagaaagaaagattttaggtagcttttgtgcagcctgtttatagttaagcatagaaatttagttgtgggttcttgaaacagtaagacaagttcatggatttttaaaaatctgcttaaagagctacaccactgttttagcataacatccttttcttatgttgtttacttccacattcagttcttgaagaagtcgatgccattacatcctgtcaaagaccatctttcagtattgccatttttgttgatttggaaattgaccttttccaaatttttagagtttggaaactagctggaaggataacacattaaacatatattttagacatgtttagaaaaagcagatgttataattcaaatttgcacctatttgagaacttaattgcagtcatattcgttagtggattctttgagttattcttgatctgttattactgttgggttaacctgacatgtaagacttatgtcctttgttcatatgt

SEQ ID NO: 26862 - DNA, 1693 bp, Bovine  19866880906226
cggcttaagcagaaagactgaggatagtacaggagctgaggctgaaaaggtaatgcaagctacgtaaagacctgcaagataatttaaggaccaactgagagaacatttttaagtaaaagaaaaacactatgtctgacctatgtgctgtgtgcttagtcgctcactcatgtccaactctttgcaaccccatgcactgtagcccaccaggcccctctgtccatggggatcctttaggcaagaatactggagtgggttaccatgccctcctccagaggatcttcacaacctagggatcgaatccaggtctcccacactgcaggcgggtaccatctgagccagcaaggaagcccaagaatactggagtggatagcctatcccttccccaggggaacttcccaacccaggaattgaatcgggtctcctgaattgcaggtagattctttaccagggaagctccacctgatctatagcagatgctaaataaatgatagcttagtattattacaaataatctacagtattgtattattggatctaagacgccactacctgcaagagacaccattatttgacgcacccttaagaaaaaaattgctaaattatgacacattgttgaatatagacttgtcttgatttcacagcctaactggattataaacagtgaaaagaaattgctttaaaagaaaaacctcaagtatcaagacactaaaagaatggagtattttaattcactgaattttctaagaagtgattaatcagaaaaatccttactttcttgctttcatatgcagtactaaaattgtagtattaaaatatgtagtacatgatgtacagaatttcattttcctcctcacctgtaaaatggggataataactacctgaagagctatgacaagataataatagatgtggactgtttaccagcatacctaaaacaaagtaagcccttattcaatagaaattattgtaaatctagggtcttgctgattcaataaaataataagaaatgttatttttatagcatatgcacataaccagaaactgcagaatttgttactgacactctaaaaattagttttctatatatccatcttatatatgtatacatatctatatagatctattttcttattataacatcatcctaaaagtcaagtgaagttttaaggaaaatcaaaaaacctccacttaagggttctatctagatggttgatctctggctaaagctttgattatattcattttcatatcacctaatgactaaatatttatacatgcttatacaaaaatgtttcttatccaccaaaatcacttaaaaacataagtagtgttgacacagtagtgaatacaaagacatatataactaaatggaatttctagttttgcataaagatttatgacattatctaaagaaaatcttttatggaataatgcaaatcaggtatgtggagtattttttatgccttgaatatccctaaacatattttgtatcccataatgaacaaagttctataattattacttatttcaaataagtaaaatcctgaaaggttacctgggctccaactaactggagaagtgcgaagttgacaggaagcacatcaatgtctgtgttgatggcagtctggtcaaaaggacaagcttttcgggggaagtttattcaagcaggtcttacaaacagtgtgtgaacaac

SEQ ID NO: 26863 - DNA, 1036 bp, Bovine  19866880940231
aggtctaacgtcaggactcctctggtctgctctgtacccctacccaatggaaagaggcagacaggagctgtcagttgctgagccaggccccgacagctgccccgtcaggcacgcatcagcctctctcacttttgaaatccaggtggaatattcccctccccaaatcttttgtgaatacagccattaaattaactaggggggataaaatctctttgataaatgaagacttacccgaattttctcaatctccactttattagcagcctgctgcttctccaatctttcactcaactgagagcaaatctaaggaaacaaacatggtattcacatgacagccttcttcagcagtgtcagaatctgcacagtctgggctcgtggtgtattccacagtagaggctggaccatggattgagacagtactgagcgggagggagcagatgacaggtgggcagagggtgccctggctctgtcacctccgcatccattggcccaggacctgcgagaacccatcagtgccagagtgcactcgatggtcaatatcacaaacacgccagactccagagccagcaagagagcccagtactgaaggcacaagaccagttcagttatgctgtcagaatggaccagctgggggacaggtggttccccatcaggaccacacacgagcagccggagtctgaagtgctcccaagaactagggtggcctccagggattaagtgcctgcttgcgtgagggacctaggccagggccacaaacataatctctggactcctcacaacaattctctgggagagtcacgagtccccctgttttacagctgaatcagcacggtaactcgaccagaagcacagggactcctgcagggccagtggccgagtgggcacacgttggggtgtggaaaggaaacctctcacgcaggcgagcagagcgcccagagcgtgtggcccacttccagggcacagacccacctgcttgtagtcgccaatgatagagctttttttttatctcggattctgcctgtccagttcccgacgg

SEQ ID NO: 26864 - DNA, 939 bp, Bovine  19866880975912
tgagagttgcatagaattgatcagaaacgtgagtgatgccgaaccaaaacctgtgcattgtagagtttaacaaaactaggtggcttcaactacaagcatgaaaccctcctatttaaacaaagtgcttctccatgtctacacagaggaccctctgctggcactggagcaggtacttgagttactgatcccctgctctacgtccccctatatatatatatatttatatatatatatatatttgtatgtgtgtgtgtattttaaaaaaaaattaaaggtttagaaaaaaaccaacagcctgaagatccccaaactctgataacgtcaactcggatgctgggctggatatgagctgacctaactgggaagaggccggaggtcacatggaggagtgacgttcggagtgtccagagcggcaggcgagtcagcgggcctgttagtatcagcagtgaggagggcctcacgagctctggtccacagtgacctcccgacaggcttctatggatctgacttgcggacattctgtcctggggcatgtcacagaatcacacatctggccaaagaaggcaacaaaaggtgtcatgttttccgaagggtctggaggcagcagctgctctcagcaagtctctttcccttgaaccccagttgctgtctttatggagctcagtgttcggttaaaccacgtcttcttggctgcctggacctcgttgagggcaaggcctaaatggtgctccaagtcctggaagagcaacaatggacatgaggatgctggtctcctgtgcaaaggacgctgcctccccagagctgagccaaggcaacaagtgtaagtctgtctcctcctgagacaactctgggaacagccaccacccccgctccccaccccagctctcaaaactggcacagaaagatctggagggccaaaagctttggcacgttttctgg

SEQ ID NO: 26865 - DNA, 1207 bp, Bovine  19866881057836
gtgagatgggacccacaggtggagactgcacggtggcgaccgctgctgagggcaaacgtaggatggtggccccaatgcggatgtaggagagtacaatgagggcacaagggcccatcatgaggaagcctccctccaagaatatggccagctcattgggatggatgtcagagcaagaggcttgcaaaagtggcccggtggtcacaaaagaagtggagaaggcgaacgttgccttcggcatccgcagcccaggagagaggcaacaggagtcccacatgcagcatggtgtgcaccacagacaccacccaacagaaggccagtaagcgggcacagcattggcgattcatcactgaatggtagtgcagagggtcacagatggccatgtatcgatccagagccatgatagaaataacaagtgtgtctgtaacgccaaacacataaaagaagaataactgggccaggcagcaggcaacaggaatggctgggtcatgagtgaccagatgggccagcaactggggcagaatgactgtggacagccccatgtctataactgagagaccacggagcagatagtacataggtgagtggagcctggagtcccgggagatgagcagcactaaagtcacattccccatcatagtggtcaggtaaatagccaggaacaggacaaagaggacaatgggagggacttcagctcctgagaacatgagaagcaagaaaactggagaatgtgaagcattaggggcacagcccatgatgaatgacaaagagcccacctgaaagagtttgaatcaaaaaccaagtcgtgggtcataggttacagctcataacaattttagttaatttatgtacattcttcaagctccttaaggacttaaattcaactgagcactatagcccttactaaatttactccctgaatttgttatagcattttttcctttacttcttccttgccgtccactctaatgggttcttctacgtaatccacataccctgataaagttccttgtactataaaaacccttcattcaatattatcttttcatccaactactatttatctccttccagtgacaaacttcacaaaaaaatttctatactcactgtctctagctcctcatcttctagtcacacttcatcacctggccatcttcatgatttctttgtagaacctgtaaggaacagaagtattatttaatatgtaaca

SEQ ID NO: 26866 - DNA, 817 bp, Bovine  19866881090000
aattttgaaaatgagcaaaggacatgaacatatcctttaaaattagaaaaaaagactcgtcactcccaacctagaggagtggaatagaggttcaagagggagaggacatatgtatacctatggttgattcatgttgatgtatggcagaaagcaacataatattgtaaagcaattaccctccaattaaaaataaataaaattttttaaaaaagacttgtcccttctaaaaagataaaaattaaaactacagtgaagtgccatttgccatctatcaggatggcattacggtatcaaaaaagtttggtaacacagcagaatgtcatgtatatgggaactgtcacactcctgcttaaactacaaaccagtaccagctcaactgacagcaatttggaaataagaaaatgtagaaatgtaaatatcccatagctaggaatttatactaccaatatactcatacccatgatttatgggatatcaaacacctattcatttgagaagccagactcaaaacacagatcgggctatttgaatcatcagcacactgccatgcatacatgttagtattggcgcagtgcaatggctagaagcaccgtgaaatggtaacactggggttgtctctagatgtgtgactggaattcaggagaagtgatcatgagacttctgatacatttttaatgatcatgagacttctgatacatatttaatggacattttttaaacctattcccagagcccaggatttccagtacctgtgttaactgagatgccttcacctgccaagtccgcatctgcgggcatggaactgccagccagggca

SEQ ID NO: 26867 - DNA, 538 bp, Bovine  19866881203075
acccgccatgaggcttgcttaatatcaggtgtctttccagttggaccttgtaaaggctaaggtttcttccaggtatcagttctgttctcatattcgttatctatactgctttaaaatttttgttttcttgtggtatgtgcatgctggggagaagagatgtgtctggatacaatcatacagtcttggggcagtttctgtgtgatacatttgcagttcatatgtatttataagtaaccttttcatcctggcctatttattgcaacatttaatgacattttgtttaaataccagtcttaactggttgagaatgataaaaagtattagagtcagtcaccctaggctttggcaagacagcctatttaactttatatggtatatgactaataccagaggaagtgtaagctttttgtgattgtgttgaaattatttcataggaaatttaaaaatgagactatactaattatatctgtaattaattgtgtttttaatacaatgatttcactgaaagtgtgttttttgctcttagagggaaaagcca

SEQ ID NO: 26868 - DNA, 896 bp, Bovine  19866881207546
tttgtgctgtgactttttgtttactaaactaactaccactgtttactaatcaatcactttgtgctgggtattatacaggtcatattattacataaattctctcaaacaacttctaaagtattcattacccacattttgaagtgaagacatatgtccaaggcacacagtaacagttaatggagttaagggtcaaacacttggctgccaccaaggtctgtgttctttttgctatgccttctttagcaggaagcatgtagtaatgcatgtatgtgcatgttaggtcacttcagtgtgtgtgattcttcgggactccaaggactgtagcctgccaaagtcctctgtccacgggattctctaggcaagaatactgagtaggttgccatgccctcctccagaggatgttcccgacccagggatctaactcacgtctcttatgtgtctcctgcattggcaggaggttctttaccattagcgccacctgagaagccccatatagttatagggaatggttattctacagggccttcaagtaaagggttagaatatagaaagaaggctgacagcacaggaggactcttacctgtgaaacagtaaataataccaaagaaattcactatagtctggccactgaaaatccaaacagcaataggaaatgagtaattagctagagccacttctgtagaaacacactgagaagaaaagtgtggtgctctcaccagattcagtcctccagttctgcctgctctcagacatttttcctttttgattttacccaaatatgtcccaaggaaagggaaacacatgaggtatatactgtgaacagccgggtttgttctgtgggaaaagagaagttgatattctgcaggaaaatctctccccaaaaagtatttacaacg

SEQ ID NO: 26869 - DNA, 1602 bp, Bovine  19866881233841
actccaccaatagatgctatgctaagggaagcaattaatctttttctttggtagaaaataagctgagatataaggtgatattgctatcagcctgaatatgtgatagaacttctagttctatcagaaccactgataattcatctatgtctgataaatgagtgaatctacttatcctggagctggctataaagaagtattttagattattctgtactcttttcaacagtttatggcccagcttcatgtgattgaagttgacatagaccagagtacagtatttccatcaatacctgcagacaggaatcatcactggggagcataaccaacaaagggtagtagttgtacaacagtacttatttgggaggtcttcccccgaaagaagtcaaatgcttataattattctgtagcttacttggtgatgcttttggaatcaggattgctccaggtacacttaaagtgtgctaacatataatggtttctctttaaaaaggggctatctggagtcagtctctagactttgttgtagaagttcgctattgctaaggtgagtttggccttcagttttgtccagcatattgtaatagtctttgaattctcatttccttgtgtaccttaatttctaaagtggatgaaaaaagtgggtcacagaaggagcagtcagatttttgcatttagatgttcctataatggtacacagtcccacctcatcccctttgacagatcaaatacaaagttgattttccgttatggaaaaacaaaacaactgtttttcctaagcacatgttcagaaataaaattttgagtcttacttgtttctgaaccatgagttaaatttagataataggagtgtttgagtccatagagaattttaagaaatcatttagcctgcctttcattttttaagttggggtatccaaagcccaaagaggtagcctggccaaggtggccaaagtagactgagtaggctacatatgagctaaggtctcctcacttctcactgtcccttggcttaaaaagatttagtacatgatcaagaatactttagcaaaaagttcctagtttgtgcttcccctccgtgcatccttgtgtgctttctaagacagcctcagttttgcaaacagaacagtcatagaaggatttatttttgtaaggtaattattttttggttaggatgaatattacattcttcgtaagcaagcaactgatttgctgggtgttgattaggaacagaaaggacaagataacagtgtgagaaggatccaaatgtgaaactaattttttctggaaacagtgtttagtttccatcaggatttcctgatttttgtttctgagctgtgagagtcccatgtatagatgaaccaaaaattaattttaacttgagtcctgctaagtcacctcagtcatgtccgactctgtgcgaccccatagacggcagcccaccaggctcccccatccctgggattctccaggcaagaatactggagtgggttgccatttccttctccaatttaacttgagtagtcagagggtattcttaaagttgttataatttgatgcatttacatgtgaatctgatttgaagtataatttctaccatttgtt

SEQ ID NO: 26870 - DNA, 1613 bp, Bovine  19866881242742
cacacaaaggaaatcaacgaaaggcaagcccgcttcagcagccagagtggggagactggggaggtgcaggcttgttctgataagcgttatgccatggtcctattccgaattactagtgtattttacatcctctggttgccgtacatcatctacttcttattggagagctctactggccacagcaaccgcttcgcatccttcttgaccacctggcttgctattagtaatagtttctgcaactgtgtcatttatagtctttccaacagtgtcttccaaagaggactaaagcgcctatcaggggccatgtgtacttcttgtgcaagtcagatggtagctaaggacccttacacagttcggagcaaaggccctcttaatggatttcatgtctgaagtggttcaaatattgagttgctgtgtgttttgtgtgtgtgtttcctttttatctttttgtatctctagttctccgggaaatatgggacaaaataatttaataatttgattctaagcaatagctgacaagtgatccatccaaaataccttgttaagtttgcagaaatgatttttttaagtgcttttgaattagaaaaatcaggaccacgaggataaattgctgttcataatgtcatggaagtaactgtatttctcagacttaaaaatgaataaagccatatctaacacctctccagctggcatgactaaacctggttgtgaaaagcgtcagcatttttcaaagtctttgttttcttgttgcttttttgggttctttctagctgtttaggcttcatgtacaattgatttaacagggaatattaaaatacagtgatgaattaactgtatagtaattcagtgatgaattcctcatgtatgtcacagtgtaactatgctgcaggtttccatactgccattcagaaagccgaatgttttgtcttattctcttgagaaaattctcaatgcagtgaataatgtgaaaacttaagcatgaattttaaatttgtgtgttgaatcgtgaagcaaaagtgcagtcaaattatataatttatataaaaaactaaaatatattttgtgccatccttcactgagacctaaagagatgtatgtactaaaagtgattgtgttctagtattcttgcccatgcctttgtgtatgtgtgtgttaagaatatttgagttagatttttcctttatagccaaatgcattttaataacctgaaaaataattaaatgacaggctgatggcctccacttttataatggtgaaaatacattaaaatgtatctttagtttctctgctctttttatctagagaccttttgaaatattagaatatcaggaagaaaagcgtcctaagcaacttgagtcagaaaatacactatacatttagctagttctttttttttaaatagaaggcgttgattgaggtgttctctttgtagttaaatggaatcatctaatcaaatagcaactaattctttttaaaagcattctttcagctagtgttaagaaatccatatttagtgttaaggaatgagagaagttctgattaaatctccattgctattctctttctgggaaaaaaacaacatcatttgggttacagttcatttgctcaaatag

SEQ ID NO: 26871 - DNA, 1048 bp, Bovine  19866881292312
agaacccaccttctctccccaggctgagtcatctgcaacactcgccacccctggcaccatgctcccacacccctcaaatcccacggtcacagggctggccacatgtgaccatggatcgccccattctgtttcctcgaggtcttcgtcacttcagcatgagcccctggagggcaggaatcgtggtcaggaagcagctgctcacctgtgagctcctggaaagaggtgtagggcttcatgccaaacctcttgcggtactcattgaaaggctgcagcctcagctcccgcgattccttgatgacatccacggccacgtgcaggatgtggtggtctatgttcctacccccaccgatctgccaagagataaatacagtggtggtctgagagccaagacatgttgtcctggagaagaatttcaggtcaggaatccttcctgagtagaaagtatggctcagtctagcaagcaccaagctatgaaccctacctaggtctgcatggccatgcttctcagcttcctcatcttatttagttatttatatttgtatttttgggcacatggagtggcaagcaggacgttaattccctgattagggatggaacccatgtacccctgcactgggagcttagagtcttaaccactggaccgccagggaagtcccagcagcttcctcatctttagactgtagagtggtccaggaggacttctctagtcactcactggacacatggttccccagccctttgaatttaggtgaggacctccaacatcctgttaaggaaggttctggaggtattagatacaacaactaggactctgcagaggagatggccaacatggccgcagtcaagagctcaaacagaggggactggcatttcagatctggaaatataaggcagaaaggtttctgagcttttaagtgatggaaactgatggatggacaaacactagtttgaggggccaaaactgtatgacttccctgggatattttttaaactctacctggcagaactgacgtgtctgtcatcccccaaatcagttcttatcacagaa

SEQ ID NO: 26872 - DNA, 1809 bp, Bovine  19866881345912
cttcaccaaggcgttgggccacggggtgagtacctaggaggggctctggacttctctgggccacacgtggcacaggtaggctgctgctagtggggcagaacccagggatctgaatagactctgtctctgtctttaggtagacctcgggccacatttatggagacaatctggaacgtcagtatcagctgcggctctttaaggatgggaaactcaagtaccaggtagcactgggcctggggctggggcattgggaagggccttccacagtctcccctggcagagggtgttggtggggggccttggtggtgtcctatggcggaagctgtaggtgcatgggaggagaagcgacagtaaaccctgggagcaggtgccaggcaagagaagcagacagggagcagacgtgggctcttgtgttctcttgggaggtggattttggggctccacagaaaatggacagttccagtctgcatttattcgtttaatcattccacaatattaattgggcactatggtgtgccgggcaggtgagcagtggccatggtagttgtaagccctgccctcaagcccacagacacaaaccctaaggtgctagttccacgaggacgttttgtcggaactctcactgtccaggaatgtgagggccacataggtgattatctcatgcgctcctcagatctactgcataaactaggtaccatttgccctcttttatagacgtgagtcacatccaagttattaaaatttttctagtggtcacattaaaaaatgtaaaaagcaacaagcaatattgattttaataatatatttttgaatttaacccagtatatccaggatatcctcatttcaacatgtaatcaacacaaaaattgtcaatatctcattttttgtgctaaatcttcacattctgactcatatcttacagtacatctcaatttgggtgccaagttttcattggcgattctgatcagcatttagatttcataaaatttttgcggttgagaaagtagattcacatgttcaagttgttctaagcataaagactttccgatagctgggatcttgatttaaaaacgtgaatctaaagtaaatgaaattgaaaatcaagctctttatccacatcagccacatttctagtcctcagtagctgcacgtggctagtggctcccattctggaccatgcaaatcgaaacaaaaaccgagacgggaggttcactgctgaatctttcgagctaagaacagtatctggcatataggaggtcctctgtgtttatttactgagtgaatgaggaaactgccatatgattaattacacctgtgatagctgccacaggcagaagccaggagagtgtgcagaggctggggaaggcttccttaggaattatgaataaaccaagagttgcataaaggataaggaggaatcaaggaggccaagaagggcccagggctgtccagattctcaggtttcaaggctggagaggggcagtcgcttgagtgacgttgaggcagtgaaacaagggatatgctgttggacatctaatgagcgtgggtcgtattaaggatttctgatttctgccaagagcagagagaagacttggaaggttctttaagccaggatgtgattctagatttggatgttttaaagcaagggtcccctacctttttggtaccaggggccagtttcagggaagactattttcccatggactggtgggagaaggggatggtttcaggatgatttgagcgccttatatttgctctacattttatttctattattattacatcagctccacctcagctcatcaggca

SEQ ID NO: 26873 - DNA, 1348 bp, Bovine  19866881367428
aaagtcttataattataaataattttgcatcctgccgccctttatatgccatccaaaatggaaatactggcacgcctggtgcaagtccctacatttttatctatatttagtaacttacataaatttacccctggcatatttcaggtactaataaatacttagtgatggatacaggaccctgatgagttacaaagctatgtagtgaaggaaagtaaagaccaacgagtgagcaactgtccttaccatatcacatataacagagacaatttcacagcatttacagctgtctgcctttcagactacatcacacaaacaattaacatttaccaatcattgtccttcatatttactattcaaagacactgcagccgatgaggcaattttctatgtttggctgcaaagcctatacattattaataattaaaattagagaagacacagccatttcatcaaaagaaatctgttttaatactgttttaactgaaacagcttgcatcttccacatgtttttctttaggaacacacatacattgttattttaaccaaatacattcttttttaacttcaggtaataatggggggaaagtgctcacttcagcagcacatatactaaaattggaatgctacagagaagattagaatagcccccgagcaaggatgacacgcaaatttgtgaagtgttccgtatttttataaaattcattctaatccaaaaaaaaataataataataatggggggaaagcacaaggcttaagaattctgtcctagaacttccctggtggtccagtggttaagaatccacacttccactgttgggggcccaggttccatccctggtcaaggaattaagattctacatgctgcacagtgcagccaaaaacaagaacaaaaaaaaaagaatcatccctccccccccaaatatgaattattttgaattttaaagcaattacaaaatcctctctgctcaactctatctcttcatcacagaatgcaggaaatgagcaattttccagaaacgtagcggttctcatctctgcatcagagtaaggagcacaggaagctctgtgaactagaccttgtgcggttataccaccaaggaccaatttaattggtttggggtgggatgtaggttaccaataattttttttaactctccagaaaatcctaacatacaaacaggaaagcgaactacaaacctaatctaatcctttcatcagcagcccatacttcagatttcatgtccaacttactgccttctacatatctccatctggaaggttgcatgcacaccccaaatgcaaatgtccaatcctaaagtcagcatctttttcccaaagcatatttttt

SEQ ID NO: 26874 - DNA, 3037 bp, Bovine  19866881371809
ccttatctaaaaatctatcaagttgaatgctgtcagagcgtgtctgattctaaagtctattacacaaatacacccctgtatattgtacaaccttcccccatggggcctggagcatttaaaaaaatatatttttatttatttatctggctgtgctgggtcttagttgcagcacccaggatctagttccctgaccaggaatcgaacccaggccccttacattgggaacatggagtcttagctactggatcaccagggaagtccctgggggcattgctcataatcaaactcattcacatttttttcccaacaaaatatatgaatattcataccaggtagtgaaatgaagaccaaaatagtgtctcctcctcagttcaggtcaccaagtgtctgtaagaccttttggtcactgaagcttatagcattgtggagacaggattgaggtcctggagtatgtacccgcgtggggctgacgtgtggataagatgagttaccacactcaaggtgctcagagccacacctggcacacagtgagggctcacacgtgctatgcaatggctccctcttctgccccaaaccctcccgtggctagcaggtcctcagggtgaaatggaaacaattttgagggaggccctttgtgatagaagggcttccctcagctcagttggtaaagaatcggcaatgtaggagaccctggttggattcatggcttaggaagaccccctggagaagggataggctacccactccagtattcttgggcttccctcatggctcagctgataaagaatctgcctgcaatacagaagacctgggtttgatccctgggttaggaagatcccctggagaagggaagggctccccactccagtattctggcctggagaattccatggactgtatagtccatggggtcacaaagagtcagacaggaccgagtgactttcactttgtgaccagaactctaactccagtctctgggctgaccctgcacaccctaaacttttagcttcatcaacttttttctgttcctcaaacacatccggttctctctctgcaggctgttgcacttgctgtgacttctgtttaaaatgcctcccttccaggccccctttcttaactgtttcatcctgtacatctcacagcctcacctaagcagaaatcatacgctgggagaattgccggtctctccgtctaggctgagatctctgggaaggcgtggccatatgcacattcttttctggcctccactttgtgtcaatgaatgaacctcctcacccaccaatggcattgccactaacatggaacctgaatacgtgttagttgaatgaataaatgaaacagctctggaggtatgatctcacccctctatgcaccccaggagaagattctgggaatgttcttaccttcctgcctccctccaaacttcgcaaatgatttttttaagggacccagtccatgcagggggatctctctggtggggggagcctccaggattgaagggtcgggggaggtggcagtacattaggcagaaaccacttgtccaggggttagtagaggcctctggagccaggggagctggaggcaggggggacggggcctccagcactctggacaattgctataaaataaactccataatcaggtaaatgcgttcgtgccggggatggttcccccgcagctgcaggcgtcccccacccccccggccccggaggggacctgtctaatctcagggtaatgaaaacatgggtccaattaccgtggagggccggggcctgagccgcggccggagtggggagctgggccccctggcagcggaattagaacatttaagctgtcaggccgaatccgggaaaggcctgattacctggcctgagaaggggccgctttggtttggtgtcgactataatttcctggccgccggccgtgaagccaggggccacctttcctcctctgcgatgggggtccaagccctgcatccctgacctccatccctctggacctgcttagagagactggccttgggcctcccaagctgcccgtgtggggcagaaagaggaacaggtacctgagcgacataagccgggtgtgtgtaatacctggacatgagttaaggagggtgtgcgcatcagccacgtgtgaacgacctcatgtgtgaggtggatacggaacatgtagtatggatgtcctgagtctgtgtgaatgacatttgtgctctttggactatgtgcagctgctccagcacagaggtgtgtgggagactcatacatgggggctgtatgtacaggattacctatgcagacctgtgtgcacggcagggctgtgggtacacaggttacatgtggtgtgtgttcacagttgtaggtcctgggctataagcactgtgagaacaagaaccaagttcaccacgctgactgctggcccctcagcactagctgggtgcctggctaggtgaatagatgttgattatatgtaactgttgaatgaatttacatctgtgtgacagatacacactgggagctgggtgatgtatgtattaaattatgtatgatgtatgatgtatggagccgggacatccctggtgatccagcggttaagaatctgccttccaatgcgggggacacaagtttgatccctggcgggggaactaagatctcacaggccacagggcaactaaatccatgcgcctcggcttactgagcctgcaggctgctatgaaggcccagtgcagacaaaaagaaaaaagaaaggaagaaaagagacaagtcagtctctgaaaataaaacaaaagtaggagcagagggaggctgtgtggtgtgtgtgcctgctataaatgttgcctgtccccactgtgtgatgtgggggcaggaatgatgaatactgtgagggtctgaacatgaactgtgtgaccacatagacctgtgctccaggcgggcctcctccccttagagactgtgtgatctccagcaactcatttaccctctctgagcctggcttttctcatctgtaaaaggataataataaacacagcgaactttca

SEQ ID NO: 26875 - DNA, 768 bp, Bovine  19866881402011
atgtccctggagagaggtctttcagcaactgtcagcatgatacccttttattcaccaaaacactgcttttaacattttaaactatagggcagtagcataggatgaaatgagagcatgatactgaaatctctttctaaacttagtgttattcaaatgtcaggtattaggagcagttgtaaatgtatgacaattatgaaccacaaatctgtatgatactgttgaggaaaagaacaacattaaatctgtaaggcacagtgtaagaacctaggtggtcacttcaggatgataaatgagctcggtcatctggacgcttagccaaaagcattgtttgaagaaccagagattggtttcagttgtttccctaaggacacaatcaaccactgtaactagcaggcagagagtgtccaactctcatttgtgaagataactcatttgaacatattttcatcaacaattaacctgttacctcatactaagcagtgcacacacaaaaaaatccctctttctgcttatatcgttatcactcttgagctataaaatcagcaaaatagcttaaataagccttggtttcaaatccagaagttttacttttatagaagccaatgggcctttctattccaagacgtggtccctttgctcaagacctcaccagcaacttacattcctgtatcatgcaaaaactttaaggattcagccttctttccatgtctctcagtacctgtcatcacccataagcctatctgacaaggaaactacattttgaaatag

SEQ ID NO: 26876 - DNA, 2471 bp, Bovine  19866881580524
cccttatagctagttggtaagaatcccctgcaatgcaggagaccccgttcattcctgggttgggaagatcttctggagaagggataggctacccactccagtatttttgggcttcccttgtctgcctgcaatgcgggggacctgggtttgatccctgggttgggaagatcccctggagaagggaaaggctacccactccagttttctggcctggagaattccatggactgtactttgtacactttgtatatatgatgctacatcatcccttagccctctgtctagaaaataaaccataaataaatttgcattaaatatttgctgggagtccgattggtctttgatttcttaacataacataggatcccagagaatgtacaaccaccaaagaggagggagtctaaatgacatcaaatggaaatctgtctttccaggaaagatggaacagagatgtcagcaaggttgaggatgatggggatgaggaagaagagattggaaatgtaggagacacacatagatttcttagggtctctaaaccatattaaggttgtttcacttcatcataagatccatgggaatcctttgagaatttttaaacagggggaagtcatctaggttttcaaaaaaggaatataggtttttaaaggaatctctctttggctgcaggagggagaatggattaacataatccagagtttcttaaggacgctctctgaattgaaaaaaatacaaaatatgtgtatatgatgagtgctctttagcaaatacaatacttttttttatcctttcatatgaaaagtataactcccatacaaaatttaacagtgtgttgaagtcaattcttctaaaggttgctgtgcaatggttgatgatcctcaccacagagcactcatggggcagtaaaatggctgtgtcatcatgtactcaccctcagcgacacagataatgaatgctattttgctagtgaatcaagaaaagatggctctctttaacgtccctcgttggtaattttttctaattcccttatgtgtcaacgtataaggagtatataagaaatacgttgtttcctacttcccaaaatcagatatatattttttacatgactgataaaattatttcagagaccttcatattctcaaccattcttcatctgcagcagacaggagaggagcatgaggagggagaaccagagcagtgcgaccgagttcctcctcctggggctccccatccagccagagcagcagggcgtgttcttcgccctgttcctgggcatgtacctgaccacggtgctgggcaacctgctcatcctcctgctcaccaggctggaccctcgcctgcacacccccatgtacttctttctcagccacttggccctcactgacgtctccttctcatctgtcactgtccctaacatgctaatgagcatgcaaacccaggatcaatccatgccctatgcagggtgcatagcacaaatgtattttttcatattttttactgatctggacagcttccttattacctccatggcgtatgaccgctatgttgctgtatgtcgcccccttcactacaccaccatcatgaagcaggagctgtgtgccttcctagtggccggatcctggatcctgtctggtgccagctccctttctcacactctcctcctgacccaattatccttctgtgctgacaacaccatcccccatttcttctgtgaccttggtactctgctcaaattgtcctgctcagacatcttcctcaatgagttggtcatgttcacagtaggcgtggtggtcattactctgccattcacatgtatcctggtatcttatgtgtacatcggggccaccatcctaaggatcccttcaaccaaggggatctgcaaagcattgtccacgtgtggcgcccatctctctgtagtgactctgtactatgggtcaatatttgggcagtacctcttcccaacactgagtgatttcattgacaaggacatcattgtggctctcatgtacacggtggtcacacccatgttgaacccctttatctacagccttaggaacaaggacataaaaggggccctgggcaaactctgcagtagagcaatgtttttcttacagtgacacccaacttttatttaaatcagaacctcattttgattcatctcttgtattggatttttccatttgaatataactcaaagctttaatgtcgccaaaccctaagaaaaatgatggcatgttgtatttacttgacaaatgttcattgaccagaatttcattcccttattagcagtactctcctggtgtggagaaaaaggaaacctctgcactgttggtagaaatgtaagttggttcagtaagtatggaaaacaggatggagaatttccatatgatttagcaatcccactcctgggcatatatccaaacaaaactgtaattcgaaaagatatatgcacccctatcatgttcatagcaaca

SEQ ID NO: 26877 - DNA, 1190 bp, Bovine  19866881906188
aaggaagtgttccggcacgcttttctgcataagatacattgttttaagaaacagattcacaggcgagatttgttacaattataatcattaacatagagtctaagaaaagtatttccatgagtaagctttgttctgtgtattcatttgctcctaaagaaaggccaggtctgaaatattcaacatggaggcggaggtcggtaagctggaactaatgttccagaaagctgactctgatctggactacattcagtacaggctggaatatgaaatcaagactaattatcctgattcagcaggcaagaaaaatccagttacacttttaaaggaattgtcagcaataaagtctcgatatcaaactttgcatgttcgctttaaaccaattgctgtggagcggaaagagactgagagccgcatttgtgctactttcagtaagactatgaccttgatacaagaactgcagaaggaaacagacctggagctgttactgctgactgaagaagagaaaactgcggcagagcaattaagagctcacatgtcaaacttatgaggaagaaatggacttgcaaaaacgaactctaatggggaagaaatcaatcccagaaatttaggaagacgtcttgttaacattgatgactattggtcgggagatgaaaaggagatttggcttgggtgactggttagtgatgccttccacaggagagggggatacgagagaagggtagatattgtattaataaaatttagccaaaggggcagaatggaaataaagagattttaaaaatatatggacacatgcttagtcatttcaggcaaggaagtcccaacactattttgtgtctggttttgtataactgggataacatagatgtcctaactgacctattgcaaaataatattatgtactatcagtcagtcagatgtgaatgaacatgcttgggaaattaaaagttagaataatatttgtactatattatacatatgtaaataggcttccttggtggctcagatggtaaagtgtctgcctgcaatgcgggagacccgggtttgatccctgggtagggaagatcctctggagaaggaaatggcaacccactccagtactattgcctggaaaattccatggccggaggagcctggtaggctgcagtcccatggggttgctaagagtcggacacgactgagcgacttca

SEQ ID NO: 26878 - DNA, 1176 bp, Bovine  19866882242522
atggagagtaacatgctctacactgtaaatttacatgatgttaacatgtcaaatttatacagtaaaaaaaacttttaatgtaaagttattttagattgcacaactgtaaaatatttacggccctgggaacctgattacctaaaaggtaaaaggctagaaaaattacaagacccaaaaaaaaaattactaatttttcatttgaaacaagagtgtcaggctcttggatggggtgctgaatataatgcagtctcactgaggagaatcaagtctgttgtcttagctatgaggacaatgcgttgttaaaacagaaggtcatgtttctgtgctccaattctttagcacatgagcaaataaaatttaacaaagggaagctattagaaatagctgggtgtttggcatattttgtgcattactgacattcatttagttttaattacttattgtagaagaggaaacagtttttctccattggtaaaaaagcaagggatattttcccatagcccatttgaatcccttggcattttttttttcttttttcccttggcatttgatagtctagtttcatattgagtagacggctatgtgagtttttatgccatttgcccctgggtaagttccaatccgggaacttgtgttttccctttgagaacctggcccgttagttttgtgccataggatcaattaaagcagcaatttttgtacccagtttttctaacaggagcattttgcctctttcttttgaggttagattgagtgttttcctatgggaaatccgctttgaaacacattttccttcttaacaatagaaaggttatcacctgcacttccttgcagcagagatggaatatacatgaggtgtatacagtgaaacgggtctcttttcttttttttttttttcccctcttagtatttgcttttccttccctgaagacgcaggcatgcatgtgtgtatgtatgttcctgcagcattttaaagcaggtaaattagaagacaaccttgttgtattagcctagacaagtacatccatcactgactactgaaccttctgcttcctggtgtttccacaggagtctccccaggacagtgctatcactcgtgatattaaccggacattcccagcccatgactactttaaggacacaggaggagatggacaagattctttatataaaata

SEQ ID NO: 26879 - DNA, 1311 bp, Bovine  19866881611582
catttggatataaccaagtcttaaacaaaattttgctaaaatttttaaactaaatataatacttagtaaactatttatatcataataaatataaagcttccttttcatgtgtttgttagccatctgtatgtcttctttggagaaaagactattcagttctttggcccattttttgattgggtcgtttatttttctggagttgagctgtaggagttatggggagggaggagggaggagggttcaggatggggaacacatgtatacctgtggcggattcattttgatatttggcaaaactaacacaattatgtaaagtttaaaaataaaataaaattaaaaaaaaaataaagcttccttttaaggaatctttaccagagcaaattcatgcaacattaaaccttactgtagagctttctggaattggcccgataattctgtttacagaaattgtggaactttggtttgtttcattacagaattagaagttacactaatgactaagaaattgccctagctgcacgtgagtaaaaacattataaaacaaaaatgactgcttagcctggaggttcccaaaattttttgcacattagcatcactttggagtctttaaaagatttcaaaactaaagacccaccctagaccatttaaatctctgatggtgaaacatagacatgcttttttttttgtattttacttttattgtggcattccagctgattataggcaagtttgtgaatcaatggcttaacatatggttcaagtttctgtcttacattagcattaagagcaggcactctgcaataattttaatactccaccaagcaccattaaagctttattttcatgtctactaaatctgctatggagaaagatatatctttggaaatcctaatgtgcatatttattatacttttagtattgctgtaacaagtggcaaaagtgtatttatctgtcatggaaatagccacatctgactagacatgcaaatgtatatttacaactgtttagcctcatgttgtaatactgtataaataaaccccatgaatatacttaagtattccagtttatagtccagcttaatataatcacaggttacttttttttttttttttttattcctgtcattctttatctactctcttcatgtaacagtgtatgagatctcactccatgcatggggaaagacagaaaaaaaaatgtaaggaagaaggctggaaggatgcctaaggctactccagctggaccaaaccacattttcaaaggcaagaatgtttaacaagatcctctaaaatatcttccacaatcaacaag

SEQ ID NO: 26880 - DNA, 1881 bp, Bovine  19866880418410
cttgtgtttgtaaacatttgagcacttcaagatgaataactctgtattaatgttaagcatacctcctaccaagtgggtttagttttgagtctgccagaatcagctgtcttcttgcgtctgttgtcttcaggtgaagtttttggtagtgaaagtgatggcttgaacactgaccataacaaggtttattaacagctaaaccttgacagaataagggagcctcagagtccaggagcagggctgtaggtgaaactgatacaaaataacttggcctagagaccgtaggctggcatcctgccctttcagtcagagttccgcacggccacaaccatgtgctgcggagtttctaattaataagctgtagtatatgggggtaatttttattataaaattgtgttaagatctgactgatctaaacgtgtgttttgaagatttccctccgtctcctaaattgaaatggccacacctcattcgttgaaaagggtagtagtttgacattattttgagttctgtatgttttgtattgtagaatgaaaatattggaaaactgtcttcccctgttctactatttaaaatatttttctaactttagtttctaaaaactgtgtagataggtttgaatgtagttgagaattttagggtacaacaataatgtaagcttaaagcatgttataggaagcgtgtgttcatacctaaattcagctttgttatttcctaaaactacatgcctaggttattttatatgtaatagtgggtgaaagtgaaagtcactcagttgtatctgtttgcaactctttgtctgactcagtccatgaaattctccagtcaagaatactggatgtgggtagcctatcccttctccagcggatcttctcaactcaggaatcgaactggggtctcctgcatttcagacagattctttaccaactgagctatcagggaagcccataataatgggtacatagccttattcaagttcattctttgaattttatctctctttttgcatattttgtagacatttttaggaatagaattttccctttctgaatgaaatatagctccagtttatatcttacattgccttttccagtcatctgtcaaacccataactctttgatcattgcattataactttgatattgcagaggacagtgaagatgaaaaagaagatcataaaaacgtgcgccagcaacggcaggcagcctctaaagcagcctctaaacagagggagatgctcatggaagatgtgggcagtgaggaggagcaagaagaggaggacgaggcgccgttccaggagagtgcgtaacgtgccttgtatcttggtcgtggctgtggtttgtgacctcagttttacttcagcagttttttggatgctcagtgttaaaatcagccccttaaattagatactcagtgtcattagagatgattgtttgatatgtatttatattttaagactcagagattctcatgattattatttgattaagtacatcaaatagtactcaagtactgattaaatactcaaatagtgataaagtatatcattcattctcatatactgaatgaaccattgttagaatagcagttacctggtgggtactgtgattaaagatctgtattttgtcctagtggagaaaggtgtagacatctccttgcaaaaaaggtgttaacggaatttagatgtttcacgggttactcagattaactaatcatatgtgtatttgctttgtaggtaggtttcttactttgtttatagttgagccaaacacaccaaatcagttcacctgcattttcctggtcttatcaggactatatgggaaacgtagaactaccaagattatttgagacttcagtttttatccacattaagcctaatctctt

SEQ ID NO: 26881 - DNA, 1454 bp, Bovine  19866880421302
tggccgtcggcacttccgtcgatttagctctgggtggtcctggctggggtggggctggcctcttttatacgtgtttattttctatgtgtgtcctcgcgtgggggaggtcgttgtggctgtattttttaaggctctggagtgttgtgtgtggtttctctccacatcccagtctccccaggggcacttctgagaagagaggggatctctcaccagaggagcgagaacctcctgggaacaggggaggggagtgcctgccagttgctgtggaccttcccgagaaataaatcctccagattttcaaaccaccctgtctagtgttgatcgattaggctgtttccatggaaaccaccgagttgctcccaacattccagcattctgggtaacacagactaggcctcacctgtgggcccgagaccttcttccttcctctcagatctgacgtcggacagatccagccttcccgtttgctttctgcagctgaagcgctggccttggtgataggcgggtgagatgatgcccaccctgtctggcccccactgctttctaggaggaggggaatcagagagaagcctctggaggcccggaggacagcagtcatgcccaggcatggccacaagagggcagcggtgtccttactcagcacttccttgggtttcagtcgcagagaggagcatcagctggagttggcttggccttattaatgctgtgtagccagagctgaggttcccctgctcaccaggagctggagcatagaggccaagccctcagtgtctgccttgacagggaagggcacccatggaaggcgctggattcccatctggaaacctgtgggagcttggtgggcccacctgagtccccttgttgtgagcaggagacgcccccggcttcatgcaagtgggaggggtgtagcaaaagcacccccgccccaagacctggctcatagtcagtgctcctgtggccagttcctgtctctctgggcctcagtttctgcatctgtaacatgggtggatgaagggctctgacatctggttctgaaggtctgagaagtcaagtcacagctgtacccatggccgtgggcttcaggggcctttaggggtgagggactgcgcccttaattggatcagagtgcgtgctgggctggcacctccaggagggcagccagacggctcagcttcaccttctgtaaccaggcgggagtctcaccccgtgaccttgcagggccttccaacaatgccattcctgggccccgcacccaccttctcttccggccacacatgcacctcccttggtggccacgggctgctgggccaggaacccgcattcctgggccccaggtggggggggctgccaacatttcacacattcctccccaaggtcaggcgccttctctgcactggttcttcaatgtcactgccagccgcagtccacacagagtggagggggaaagggggaca

SEQ ID NO: 26882 - DNA, 1015 bp, Bovine  19866880447548
ttagctcatttagtcttcccagtaaccccacgaggccagcacaagtgagaaaacggaggcttccaggtggaaaactgaggtttacaacatgaaaagcaatatccccgagctaataagcagcgagacagggactgaagcccaacctggacttacgctagagcccgcgagcagttggtccagttctctcgcctttgctgggaaggctggaggtcagagaaaagaaggagatggatcctaacctgagaggccgagagggacaaaattccaatacggagtcccaggcagtgtttcctccatcccagggaatccctgcctctatgctcagggggaagaaaaagcttattttatgagatgggaaccgatgctgtcttaaattagatgttcattatggattttttttgcattaattttgatctttaaaagtattacattaaaatattcgtcttggtgactgagtttcttggcaccccattaagtacggggcaagtatgttactcacctcgccctaatcctggcttccagagaccccgacactgaccaccacccacattccctcactcagcccctatttcctcatcacgtgggaagaaatagctatctcttctctgcctgacaaacaaggccaaaatgagaaccaaggggaggagaggctgaacaagcaaaccacagggggccatttcttccaggaatcatgccagatactcccagacttcagtcttcaccctgccacaccagcaaggatcatcatcccctgtcacagatggagaaactgaggttcaaggtcagagttactcacctgaggtcatgcagccaggctggactggcagtccaaggcttcacgcactgccccaccctgcttcttggccctgggctcctcttgtctggtggagagcttgggttaaggtggtccctgaccactcactcctctcttcaggagtctgaaagccacctccttctcgggatgtgaaagtcaatccaatccaatctgtagcaaaagcaaatggactctttggag

SEQ ID NO: 26883 - DNA, 1824 bp, Bovine  19866880480884
tgctctggatcttctagctctgagtacattcctggtatccacatgacatttcctcctgtgactctcctagctctgacgccctcccccaggaagaaaagcacctcctgggtgcctggaatggtggagtccaccacagctgttagggtggtctgcatagagttcttacctgcacgagcagaggggagtcccaggggagagtgatctgggccaggggagcttctgtctcatttttatattggattattgcatgggatttcaaaatgtttgaacatgaccgagatggtctgatcccttcactgacagatggggaaactgaagcccagggagggcaggtgacatgtcctggggctggttagtggcatgcctgcaacatcggctcctgacttgaccacccagcgtgagatgaccaggactgagtctcagactgggagctggctctgggctgagcccgggcttgcctcagtttgctttgtcattccagcagctagctccgactgcccttcccagagctccaggcacactgagagtgggaagagtcttcgagaacaacccgcacccctgtgtcctcactgcctgcgcccagggttcctgagtgggtgaactacactacattcgaggcttttcctttgtcaggaaaactgctcagctcatcatcagggtgcaagcattcaaaatcccggctctgcttgcttccgagccgtgtgacctctctgcgtctcagtttcctcatctgtaaagtggggattataataactcctaccttgtggggttctcccagggttaaataaggtgatgtgcatgtcagctgccacacattgtcgtgttaccctagtagggctggctttgtcacggtcctccttgccctctcctggggaaggggggagtccctccatcctgggtctgtcctgccctgaggaggagaacggcatgtgcttgatttcctaagccctttggtctctgcctcgttcagagtcccagtctctcctttagcccctgatccagagaagggctgccacctggccacgtgccagaggcctcttctgtgtgatgctgccctcccagcgcctgctgcacctgcctgctcagagcagggagagagactctggttgcaggcgactcctgttcctgggctttggccaagccgtgcaggagggctgggcagggaagcgctttgtctggcagagtgggccagagggtgtcaaggaaggggtgggcacagcataggatttaggggaggcggcgccccctcccctcagaacccattcctggtccctgccgggttctctggaaggcttggtgggatggtgagccaccccaggcctatcctcaccctgccagcccagcgcagcttctcctctgtaatctaaatgggtcatcctccagctcctcaacctgccttccagaggcagctgctccgtgaaaggccaaaaaggagtcaaagatcttggctccaactctggctgatagctatgaccagagatgcccagcttgtagcttctctcttgtcatctgcagccagtacctgtaggtcatctttttctaaaatctttctgccattctctcctgaatgcatattattcttgatctgagttcctatggggattagaaggagagaaggcagtgttttaaccaattgacctcagcacccatctgtccaacatgtttgtctatctgtaagtgggttgatggtggctggtggtgcacagcccagcccaagccagggtgtggggcattcccttctccaggggttagaggcaggccagaacatctataaggaccttttgtcttctgagatggtagcttctacacgcagcaaccctccat

SEQ ID NO: 26884 - DNA, 1636 bp, Bovine  19866880485048
gatctgagcttaggacacggggtctgagtggtggaggccccccaaagagttggggcagggtgctcagtgcctcgaggccaccagcctgagaatccagtctccccgctcctgtctggggaggcctgcgcatggaggggcaggggcatggatgatgggcagtaccggattcttggatctcagtcctggaggtggtggcgggactctccgtggtggtggtggtggcggtggaggctgtagtggctgtggcttcggtggtggcggtggtggtaggtgcgacaggtgggacggtggggactgttgtggcttcggtggcggcggcagtggcagtggcatcggtactgctcaccgtgccaggcgcgcccaccgtggtcgggggcgacgtgggaggcgctaaggggaaatgtaaaatagccgcgtctggtcggtctggctgtcccaaggctggacgcacagccctgcgtgcaaggcaggcagcccatgggcctgatggagctgagtgaccggagggctccccaagcaggacagatgggtcaggcaggtacagggccacgggaagggaagagaatgaatcctgagtgtttcattctcttctcccggcctgtgtggctcaaagctcccagcatgcacccagccaagggcagtgatgaagatgacacatgtagtgagtcgctcagaccccagggatgacatggagtcccaggccaagcgccacccagcagaggccaagcagcatcactcgggtccaggcctggggcctgggccttgagatgggcagctggcagggccccatctgcaggggcaccaggaagcctgccattcccaaccgttcactccaaaacgacacttcctcccgcctgcctgagttctaataccacccaaacccaacgacagagagagaagcatccccactctgcgggcaagccttgtcccgtgcttcctcttttctgcctccactgtcaccccttccccaggctctcagctcatattcatttcctgcctctcttcccgtcttctctgcccagggatggtccttcctgcaattaccccaatccatcctgggggcgacaggggataagatggttgaatggcagcactgactcaatggacatgagtttgagcaaactcagggagatagtgaaggacaagggagcctggcgggctgcagtccagggggtcacaaagagttggacataacttagcaactaaacaacaaccaccaccctaacttgtagtaactgcctttctctctaggacatttgggtcctgggccccgcctccccagtccacagtaaatgcagaaatcccaagatatgagtgaggcacaggcggcctgctttttcgcataaatcttcagagggcttcacatctgccgtaactcttactttctcatctcccattcaaagctaccttttgacaggggtgagccgtagcgggttaagtctatcgtgacaatgtgtccatagaccctctttctttctacagaagagccgtggatgctaacaaagggctggcctattactctttagttccagtactgctaatgctgagaagaatgatgggaaatcaagagagccagggataccgctccttatcttctatctcctgtgatctgaccagcctactttctggtaacagg

SEQ ID NO: 26885 - DNA, 1126 bp, Bovine  19866880493943
cacgctgtactgcataatgatggtgctgctttactggaattagaaatactgtgctcgaacgtttaatatcttgggcactgaacgtgcctcggttcgtttaatctttctaacaactctaagagctaatcgtcaccattttataggtgaagaaatagagacttatgggctaaattatttaccccaaattacacaattagtgaaaggaatagctgtaatttaaattcagatattctggcttcgatgcctatgtttcctggtctttagtcttggaatcatattgttggggaaattcattattacaaatacatcaaaaatatttctgaaaactgatatcattaattgataaataatccaatcatcaactaatttcctgaagaagtaacacttgtaaccatcagatctcttcttaaatatttcagataaattggctttttaataagctttttccaggtagactattttgtgctaattctggcctacttatctatcaattcagtttagttgctcagtcgtgtctgactctctacgaccccatggactgcagcatgccaggcctccctgtccaccaccaactttctcaaactcatgtccatcgagttggtgatgccatcaagtcggtgatgctacttatatatgtgtgtgtgtgtgtgtgtgtgtatgtgtatatatatatatagatatcatattgaatgtgaaagtggattgtgtatgcggtattatgtcatactctgttatggctaactctaaaacactgggctgttttctagagccagaaagcacagtaatcattttgtatcctcattaaatcatcactcatccaaaaatgtactcgcttttgaaaataatctaccctgactaaagccattcatacttgcccataaagaaatgcaagtttgtttgcatttccacaagaagtgtattttacagtgcagacccaaacctagccaaaaaggtcataggctgacacccacaattacaggcaatcaaaggggtgccacacgctgggtttcccacccttttttcctcttattctcccgtgacttctaactgttggactctggggagtctagaggcagtgaagctcctgggggtggggacgaaattctctccaatcactaatgcaatt

SEQ ID NO: 26886 - DNA, 2424 bp, Bovine  19866880518817
cttcctcccatctcacctggcctggggaggagacctccaggactcatcctgcactagtcctttgctcaaagcacacttgccattaaaatggacagatgacaattctgttaagccagatacaaaggcccgtccagacctgagcggaagcatgggcgcaggacaaaggcagtagccggacgttgcggcccggcctccccagttctgtactagctcacagtggggagtgcatgaggcttggccaggtcacttcctagtccgggccttgggcctcttgttggggacacgggcgccagaacaaatgctgtccaaggcccattccaggctgcagcccagagatgtcattctaggtcctgagggaaaggcccagaacatcgctcccttcaccctcctgtagttgagtctcaaatataatacaactgccccgtgtcatcatcattttcagggctggggtggggtacaggcagatgggaagctgagagcagagctcattgcacagcaagagggagcctggggctcgctttcagagcaaaaaggtagaaacgcacatacaaagaacacaataaacctgagttgtgcagctggatgaataaaacgctgctcatcaaatgagtgtgagtgtgctgggcggtgctcccgccacaggcagagctgatgggaggacctccacgcggtggcctctgagcccagctgtcagccctgagggcaggaaggaaaacccaccagacaggggtgctgtgcgtgagcaggagtgaaggggaccccgcacctgtaatcaaaggagccatcctcttctttggggtcttcagggccgaggggcacatccttcttttctcgcacttggtcaggaagagaaacaaggacacagaggtgatgactggccccaaaggaacagccaaagacgctgcctctgggttcaatacctctttctcgatacagcaccacccacgccctctgcttcttgcctcccgcttttaagcaggttccaggctaattctgcctcctcgccatcatctccactgatcactgaaatcttccccaacctggctcgcctcagcctctccatgaggtctttcccaaacacctggacgccgtcctttccttggcaactttcctttttgccacactgtgtggcaggcgagatcttagttctgtgaacagggatccaacccacgccccctgcactccttaacacggagtcctaaccactggattgtcaggggaattccttggcacctttcttaatcctgctctgtgtgacaattacttgtgcacatttatgacgcctgtaatagaatgccagttctttccttgagggtgggaactgtgtgtctcttcaaagctcctgggagagtgtcctgggcagagaggacacgctgtacacgcctctggaatggaaggcgctctcctaactgggaccccacttgtctgcgtgactcccctttcccacaccgcccgtgaatggccagcactcctccaggccctgtctggtgctgtgcccctcctactgcaccagctgccctgtccttgacggagcagtcacttcttctagaaccctttgcacccagcacaagggctggtgcaccgcagacactcaggtgaatgactgtgcttctttttgaggcacaaggcaggataaccaccccctttttcgcggagggaagctgaggcctggaagacatcgcataacaattagcaactaaacaaaatgtcgaatggacactggagccactggagccctggtctcatggctcctggctctttcatcttttgatgtaaggaaaggggcataactggaagaagaactttctgaaatgggcagaggaaggtccagagttagctgatcagttctcaggtgtcccagttccacctggaacaaggagtgagatcagagaggccgcccttcctcagcctttcttacagaagaaaagcaatcccagcacagcacaacaaagtgaacaaatcgttcaccaatgtgcatgctaagcgctaagtcgctcagtcgtgtccaactctttgcgaccccatggactgtagcccgccaggctcctctgtccatggggattctccagacaagaatactggagtggactgccatttccctctccatcattcaccaataatgaagtataatttcctgccgttcctgacttgaaggagtcctttagaatcctagggtctgagagcacatgggtcagaggaagaaaatagaatagaatctcctctctctgagttgagttttaggagatcgtggagaaggacttgttcacagagatggggagaagccagtgcttggagagcacagggtgtatctggtgatggctctgggggcagggagcaatttcatcctgcagtccagctggacttctgctctcagggtcatccattatcctgtctcctgtcaccctccccaccccatcacagaca

SEQ ID NO: 26887 - DNA, 1600 bp, Bovine  19866880526114
ttctatttagaagaaggcttaagagcagaaccactgccatggtcccctggcctgaacctgtcccatgaggagcccaagcaagtggctgagaaggctaattgtatctctgtgtatatccccccaggggagagtgggcagatgatagagtattggttaagccaggctaagcttggtggttggtgtgtgtatgtgtgaattcttcccccgaccagtatcccccatcccgtatctccagctaggtctgggaactattctttaaagcttaggatgtaactgctacatattgcaccttcagattcagcggatgttggggcatcatagttactatgtaactggcagagctctcccagatccatccccatccacagacttcaagagatagggactaaggagaaagctccagtcctgggaactgacctctaacatagctgccctccagaatgtgccctggctggctcctgacccccagctccgtggcacagagtttacacacaccctgcagggttgtagagacccacagggctggagtctctaggcaggccccagaagtctgggccacagtgctctcctgggaaaaagcacagtcttcctggccagatgcccaactgcttgggagctcagactttccctgggagtagcctcctctctcaactccttctcccaggctagacaggaatcgctctggggttggctgagcaagccagactcataggacccgcttgacacaaagatgcaatgtcacagacatgcgtgttttgacacacacccagctgaagggccagtttgatgaaccagccgttccctgcttttccaggagaacagacaaggcctgtggtggcaagcgggccgctcccacacgtggagatgagccagctggaataggctgaccgccaggagcccagccagtcaattaattatcaaatatgtattgattgtttctgcgtacaaggcccaagcctgaatactctggacaggaaatcaaagaagttgagagtgatgagtgtctcagctctctgtggattacaaaccactttcctatgctgttatccctcttctgatcttctgggtattatttttcaagtctatgcgtgaggatgctagtaataaataaacagcggattccgtctgttgagtgcttgcttgcttgtcaggctccgcaccagctcgctcagccagcccgagagctgtcacttgtttctatctatttctcgccccagccctgtgaagttgctgtcattatccctcttcatatgaggaaactgaggcgcactgattgaataacttgccatggtcacccagctagtaagtgttggggccaggattcaaatcccaaacttgtgtccttactgaggtatctgaaagagatttgccgaaggtcaccaggcaaaaaagtactgagttctgaaccagggagcctgacttctcattcttatccagtgatgtcttggaattcataggctagttttaagaaggctcagaagcctgaacttccaaggagagggaggtgagccagtcctcttggcctgaactcattgctcctggaaggtgccgggagcaccggcgggcagcatcctgcccccttacagattctggtttgggg

SEQ ID NO: 26888 - DNA, 1746 bp, Bovine  19866880554968
tgggactaaggcccttaatgactgaaggacggctctcagttggagggggagaggcaacgtctcatgtcagtgccaagggcctcagaacacagttaccccatgggctggggttgccgccccagcaaagggctcatctgggcccacatccaggcaggaagtggtggtggggctggggtcagtccaggagatctgagaagccacagtgaaggcagagcaaagattagggccatcattatggcccaggagaagcaatcttcttacaggacctcctgagccctctgacactgagggtttgagggccctcaagcccatcttctcgctcctcagagagacccttcctccagctctcctcagacagaggctgagacctatgcccttttgctcccagccttcctccccagcagagggtcatgtgtgtccagggtggggaggagctgtttatgaactctggctccttcatttatgggttttattggcctcttatcaagcagttacctactgacgcccataacgaggcagatgactggtacagatgggaaagttcatgcctgcctggattgtgtgcatttactggctctggcctccccctccctggtcagcatcaaagtcagccccacctactccggtaattggaaaggagaatgaactcagggcacctcagggcacaggtcaggggccactggggaagaggctgtgacctgagtttgggaagattctaaggagggtccaagtgcagagtcagagccctcccaggtgtctgcagggcaggctcttgctgtctgccccttccagccctgagatccgagcttatcacatcaacacgaacttctcagacctaaatttaactacttagccatgggaattcagcagcagaaggaagcaggaagctggcgctggagtgcttgctgtggtgaaaggtgccaaagggctccttaatggtagcagattaaagtacacacacatgcgtgtgtacgtgtgcctgtatctctgtacacacgtgcaggtggggcacacgcaggccacggcctctccctgccagttccaaggctgtgagcagcaaccgaccctagatctagactccttcaaccttgtgacgttgagggagttagaagactggttccagctgaccttgctagccatgggaccttgtgcaagacactccttatcatgaggccgcagttttcaacccacagaaggaagtgctgacatggaggacggctgaggtccttaccgggactcaactcctggaacctcctagagactaaaagatgcttagctggggccagtgcagacggtctggggaggggtgggggagcaggtttacacaagaagtgaggctcaccttgatatttccgttggcatctaagaggatattctccagcttgagatcccggtggacaaccccgttctgaaagagggagggcaggggtcaggggaaggccatcaggggagacggacatgaagacctagtctggacagtgaggaagcagcaaaggcggggtacgcacagataggcagggagcccatctttatcggtacaacaaaccataggtccttccaaccccagccaagagacttgaagccagagatgccaacactcctgagtggagaagcacacctcgcctttatttctgtgtccccgtgtggtcctggcgagccgcggggcctctctggggaagccagccccggccagcggctcacctggggcagtggtgcacggcggagacgatctgccggaagaagtgc

SEQ ID NO: 26889 - DNA, 1484 bp, Bovine  19866880561302
atcttcccgacccaggggttgaacccacgtctcttatgtctcccgcaccggcaggcgggttctttaccactagcgccgcctgggaagcctgctgtgtacatagtcgctttcttgttgctgttaaaatcggacagggctggacacacggggtggactgagtcattgttgagaatgagtgaccttgaccctggggaggagctgggagacggggagccagggctggtgtcatgtgttttccctcctgcaggtacgagcggctggaggaacagctcaacgacctgaccgaacttcaccagaacgagatgaccaacctgaagcaggagctggccagcatggaggagaaagtggcctaccagtcctacgagagggcccgggacatccaggtactatggccccgagaggaagctgggagtgggctgcttccgccccttccccttaatcaagacttccacttcccctcagcctctccaaatagtaagcattaaaggaccagggcccctagctgcagctgaccaccctccggaggggtgcgccctgagcattgtcacctcccgaggggcaggtgggggttcggacccggaggtctccccatcctaagctcacccgccctgtgcccctgcagatggccgtggagtcctgcctgacccgggtcaccaagctggagctccagcagcagcagcagcaggtggtgcagctggagggcgtggagaacgccaacgcgcgggccctgctgggcaagttcatcaacgtgatcctggcgctcatggccgtgctgctggtcttcgtgtccaccgtcgccagcttcatcacaccgctcatgaagacccgcctgcgcgtctccagtaccgccctcctggccctcgtcctccttctgctctggaagcactgggactccctcacctacctcctagagcacgtgctgctgcccagctgagggccccgtgctccccccagctccccactggcccctgctgctccaggggggaccctggggctcctgagtctgtggggcgtcttcacgtgtccagtttgacctcctgcccaaactgtctgtcctggcgacttctgcccccttctctgtgtgtgcttcttctgtctgatgccttttccttgttgggctgaagggagcgttgagtgtatctcccgcaggaggttggggagatgcctgtggccacgcggagctaaggacccggatggactgtttacagtcacagcagaacttctcccagcagacgcctggggtcaggaaggccgaagagagctttcctggtggggagcccacgctggagacagctctagccccggctcgtggagatggtcgggatgaaggcaggagcacgggtggcctccctggcccaggaggctccccagctcacccctccgtcctccagagctgggtcctgggtggggcccttctgggatctgaggatgccggctctgtaggccgggtgggtgcggctttgtgatggtgttttccctcttct

SEQ ID NO: 26890 - DNA, 1473 bp, Bovine  19866880586325
cacctccaccttccgcactggccaccttcctcccagttctggaggagtcaccttggtaccctgacctggccaactgtaaggcttggcagccggcacgagttaatgacatggtgtcagtcgagttaggcaaactggggttaggacaggcaaggttactcccaaggctaccacggcgactcaccactgtacatgtcagggtggtttcttaaggacgagtcattataggggtggtctgcaataaacaaaagagggtgagcaaacaggggccacggagaggtcaaggaggcaaaaacgggggagaacaacagaaatgcaaagccacaaaacaaccagggagcaccagtggtctttcgcaaaggaaacacacagcatattcggaaaggaaatacgcttggtgaagaacaagcaacacaaaacagctcccagaagggaagaaaaggttaaaccctgcaaaagaaggcaatagtaagtttcttttttaataaagaaattaggcatgacctttaattgcttggtcatactataatttcaaacaaatgagatatgaattagtggtatcctgtagcaatttgaacaactcttttccaccaaaatcctctgttcccaggactctgggtcaggccagcttctggggtcactaaagagaaaggaatgttagtgagccctggggcaagagcaaagccccaccccagcagaagccaacttgcaaggggtgggaggtaaatgaggggagaagatagagacagatcatcaacagaatgggacaggaggacccttggtagtgcccagcaatcatgtgctgaccagcaacaagaactccccagatgggcactatcctggtctccagattgagtctgttggcagaaacgcctctttctgcggaggtgaggagtgattctgggagagggggacagctaggctgagcttcggagtttaggctcagaaagggagccagggacaggagagagtgcgtgagctgtgagttctacacttagaacagggaaaggcctgctaacaagatagaggttcaaagctctctggactagcttaggatgaagccatcccttatggaacaagaaaccagagggctctgatgttgggtaatgaaaacctttgggcattgaatcctcagtgagaaagacattttggaatggggcatatgatcatgccaacatccttaaggagcttttcattctcctaccagcgtctccttccagctaccggttcaagttttgacagcaccaacagagggtcgggatgggagcgccgactggaagccaagcagacgccctgagaagcctggacccagcccagcagcctgagggaggagaggctgccagagcatttgcatcttggaagacggatcaaatcctgttataactcatggcggggaggcaacaggagcaccagcattgctctgcatcccagagctgcttaacgtccactagaaggggtttcatattcagaaccatc

SEQ ID NO: 26891 - DNA, 2135 bp, Bovine  19866880644764
ttaatgttttcagctctgtgtttttaaaaaagcaaatcttactattttcaataatgtgaatgctgtgttctggggaattccactgtgacatctaagttctgtgtacatggaggtattattgcagtgcttccctactgattaaaggcgggggtggggatcttttgtaaatctacatgtcccactgcactatctggagggggtctctggctccctcactccacgccctgattctgtctacctgatggtccctcttccctcctgtgactagaaagaaccaccccattaaaaatgagaatggtgattggaaaatagcttcagtcattctgtttggggagtgggacacaaatctttgagttttctcctaacacacttccttggagtcgctggggtgaaaaatggagaccctgcttaatgaaagcaaaacacacaataaaaacccggctcttagctccaaaagtctcccggctatacctccatcagcagttctgcccttgtaagcgcacagaggggagagagccctggactgagcgtcccaacttgccctttctgcctttagcactgaagagctgggtttgtcaaattatagagcccttccattcctccccatccagctctgtccccggctgcttgaaggcacccccgccaccttcattctctccttccaaagaaatccttttccctttagtgcagggcagcttctcctttctctgcgcccaactgcctggctcccggaggatgtaaagaatgcctggaatgcccccctcattggccagccctctccaccccctgcagagcattccccagacgcctgttccattgagaaactcccaaggctctgagggccaggatgaaagggaggataagcacaaagtgcaggccagcaaccggctggctccggctccaagcagactccctcccccatgccttacccacctctgctgtgcacaggcccccaaacagcccccagtcctggccagctccagctgcccgctcccgtgcacacctgctctcccaccagcgtgcagtgcctgctggcgtggaccacctgccctctcctcccctttcttgcttgtgtgaagctggcaaagttgctgagtctgggaaggaagtgaggaggccaggtaatgtggggtcaggatgggagaggaagcaaactgttcaggctgcaaatgggatacttcagtctgatatctttgtttgtggtccaaatggatgccagagctctgggccaaactctgggtagacacaggaaaagcttaagagaaaatcattacccaagaagcagagagttcagatgtggaatcactgtgttcatttattcactgactcaggaaaaaagtgaaagctctgtgaaagacagaggtgattgctctgttgctggtgtgacacagaagatcgtaaccctaaagaggatgcagactgagcagcaagccagcatgtattaaaaataaagttcagtagaaaaattgtcagttcagataatggtgaaggggaaatgggggtggtggaaaagaataattgcaatttaggaggtaacgggctaccatttaagtgcttatgtatcaaacacttggtgatggtggtttaaccactaagtcatgtccaactcttgcgaccccagggactgtggcccaccaggcttctctgtccatgggattcccagcaagaatactgcagtgggttaccattcctactccatgggatcttcctgacccagagatcaaacagtgtctcctgcattgaaagtggattctttccactgaaccagcaggtgaaagtgaaaagtgttagttcactcagtcatgtcccgttctttgcgacaccaggttttccatgggatttcccaggcaagaatactagagtggattgccacttcctcctccaggggatctttccatcccagggataaaaccacatctcttgaaatccaggtctgggggaatgccaaatctcagcaggagtaggcgatgtgggatttatttagtctagataggctgtggagagttgggagaataccagtgtatatcagtgaatggaactacaaatgtacaggccccgctcttgtctaggcacaatggaggtagcagttatttctgccccaaatgccttccccttccctcgaaagcctcaaaagg

SEQ ID NO: 26892 - DNA, 3305 bp, Bovine  19866880657918
tttacaaacacaagagattcaaattagggtttacaaggtaaatgaacagaagtgtatgtttacattatcacagcattactagatagtgcaaaaagttaatacaatttcttttcagacaatcatttagcagacttgaacaagtgaaagcaaaacagctcagtggagtgctctcctggtgactcagtggataagaatccatctgccagtagaggggacacgggtttgatccctgatccgggaagatcccacgtgctgaagagcagctgagcccctgcaccacaactcttgagcctgagctccagagcccgggagccgtactgcggaggcccgtgtgccctagagcccgcccgccgcaatggaagcccgagcactacgacgaagagtagcgtccgctcgcagcaacgagagaaaagcgcagcagcgaagagccagcacagcccaagataaacaaattaattaaatgattagaaaaaaatagctcagcagggcgaattcagtggaactttgtctacgctttacacattacctaaatagcatgggaacgcagaccaaaactaaaatgtttgggagcaaggtggaactctcaattcttgaacgaattaaactttaaaaaataaataccaacaacaaataatcaggatttaacatttaatctagtcagaatctcttcaattgattcttttaagttaaaactcttacaaaaaagctttctctgtggctactgtttcaaaggacctcttcccagcttaagaagtcagactaaaactaatggtttgtttgcttttcaacccatcatcatttcctgtattttataccttgatttcacttagtattatatatattctatatagtttgatatcttttatttgttcatgtaagtggttttcaatttccattatgcacaatttcaattatgcatgagaataatctgtaaatactttaaaaaaacaaagccccaacatcccacctagacctactgaatcagaagtcctgggatgggatggacataagtatgctaaaaaaaaaaaaaaaaaaaaaagctttcataggaaacggtaataagccagctggactaagaatcatcgtgagctctttgcagatggagacacttactgtttgtaatgtggtatttaccacagagcctggcattactatgaaaccgcttattaaaatgtccaataaataaatagataaatagaattacagctactacattaaaaattgttactacctgctgaatgagaatcatccttcttagtcttcacatctttttcttctgagtcctcactgtaagaagagggaaaggtttaaaagtcttagaccaaaatccaagtgaacataaatctctagaaacctgaccagagaagaatgctaaagaaaacctgttatacataaaataattcagatgctgaggagtgaaactgcttccagtatttccctaatacacagagatactggtgattaagaacaattttatccacttttggaaaatattgcttcctttgaagacccaaaggaaaaaaggaaggtatctcaacacaggctaaaagttttcacctatgcataagccctggttcacaagaacatttactaagaaaaaaacttcattgtcagagacagagtatgaatataatgaaaataaaccacgtaatgtattgacggtggtcaagaaggcaaattagtggattgcaccaaatataaatgcagaaaatacctttgtaattattaaaggaaactggagttatataaattacaaaatgccagaaatttatctaaagcaaaatgaaaataaattatctcctaatattaatatttaggagtatagtatgctgtacatcagaaatctcaacacataggcctgccttacatcatggagaaaataaaagcaagctaaagatcattgcagggtaaaagttaaagagtttcaaagttaaatggaaaattttataaaataattttttacgtcacaaagatgcacattttatatcctcacaaattttaacttagaaatctggtgtctagtgttctgtctttgtcataaattaattagctgtatgatcttaggcaattcacttggtactcttcagtgctaaaattttatgattccatgagaaattctgacaaacaaccaccaaaaaaacatacataaaattgtcttcatagccttctttttttcaacagcagatcctgtaaatcttttggtattcccataatctagatcacactcaaatgacaaactattgagcccaagattcctaagcaaagaaaaaaaccaaacacatttctttactaagcaatctgatctaaatatactgtaattttgaaaattgtgactgttctttgtattttatgcaaaataagcatttaattcacaagtctattacaatgatgaagaatgaaatcattttctctatttatcttattattgaatttatagagaccattaatccttgagccccttaaaatgaagtcaagtaatagctaaacttttaagtagagaccaacagaaaaatcaacataatactggtctgagggaataaacatatgagacaatacaaatggcaacaaaaactgtatttcaaccattcttggccccataggagagagtaataaaaccaaatgattgcaacaatgaaaaacgtagtctagatatcaattgtattgatgagacatgataacaggcaatgaagatgctcattcctagggaaagtataataaaataaatacaataaaagacagctctaagttggactgctgtatgaaactggagtgcagacttccctgatggcccaatgggtagaacctcgcattccaatgcatggggtgtggaactgatccctagccagggagctatgatcccacaagccttgtgaccaaaaaaaacccaaaacatgaaacagaagcaatactgtaacaaattcaataaagactttaaaaatagttcacataaaaaaattatttaaaaaaactggattagagagatatattaatgaaactatggaagagttatcttcctacagtaaaattttatcttaattttcctcaaaaattttccacatttctgaaattctccaggaaagaaaatattagaggttagtgattcaagcaaacagaaaatgctaggtgaatgtattaaatttagctttctgtgaattcagaatgaaagacttttactcagggctttattatactgattttagtgctcaaaagtaaatatcttagacgaactaatgagaactatcattttatttctttgaaatgctcatacttaatagtattgtttgggaagtggtatagtctaacgg

SEQ ID NO: 26893 - DNA, 857 bp, Bovine  19866880682258
tccagggcagggttcgcctttctggccacccaaaggaggccttctggttacagtatcacctaggatctggtttagcttctgcggagcacgctgaattattcactaattatggatattggcccagctcggggtcccagtggtggggcacctgaagaggctgaaaaggacgcagcgagcacacttcccaaatctttggcctgaaggaaggccaaagagacgaaagacgcaggcgcagcaggctcaaactgtggaggacacgggcataggggctgcagcagtggaggggtagggaggcagagaacagtcgggcccgccgcctgtcacacccctggggcctgtcactggagagggaaggaggtcagagaaggctcctgttccccggaacttcgcccctgcccccagcccccgctgcagcttgggggagccctgggttcctcggagcctggaaggaatgcagtgcggtgtgtgcagcctccctgctcccgtttcagggtcctctgccctgcagcacaggtagaaagcctaaactgtgcctttgaagagcaagaagaggaggagcagggatcaggtaaacaatactgtatttccattgcctcatctggcaccagaggggaccagggtcaggtttcgcatcccagggatgggctggattcacagaggaatgtgcccggtggcggggggagacccgggccagctcctgtgacccggcccacaccaccagtgccggctccccatcagcgggagccgaagacacagcctcctcttgctgctgtcgtcagcgcaggcgttgggggctgacacccaagccctgggcacaccgccccctgggcactggccgggtgcaaggggctaggctc

SEQ ID NO: 26894 - DNA, 1809 bp, Bovine  19866880708345
taggtaatccacggagctgatcagcttgttagccactgcttgattaagccgggaaatgatgagctcctggatctgtcggatgcagcatttgatctctctggtgcccactggttctccattctcagggacaatgacatctatgaaggcacagcaaaaagctagttggttgtgaggggaatgggcaggtacactgaataaagtcggacccaaggagctagcatgctgatggctacaaaacacacatggctgactacctcggactctcagcatgcggggccactcgatcctcaaccatttcaggcatctaagagtcctgaaggagcacctgttgtacagaatgaacctcctgatcctgtcagctcttacaccacatttacagaagggaaggaacaacactcactgagtgcaggctatctgaaatgcacaggaagtattttacatatctaatctaatctaaccctaacaacacgtcagaagggtatcactggttatatttgatacatcaggaaaaagctccaaaaaaagaataaactgggcactgggaggggatgctggagttagggaataatatacctagcatttgaacgcaaagctcatgaattccaaagcctctaatctttgtaatatttcacacttccgagcaaattaatgagaaaaatccaagagtcaacaattcaattctaatcaattactagagaaataaaaagtaaaactggaatgctgtcattgcctcaaggatacaaatgtgcatccttgcattggaagtgcagagtctgaacgtctggactgccagggaagtccccatgctgaggttttgaagctggttcccaggaagatggtaacatcaataactgggaatagataaagacgaagtaagtgtggaaattgtgagcatgagctcaggaatcagactgtctagattcaagttctgcctctactacttagtatctgtgtgaccttgagcaaattactgaagctatctgagccttgttgctgctgctaagtcgcttcagtcatgtccaactctgtgagaccccagagacggcagcccaccaggctcccccgtccctgggattctccaggcaagaacactggagtgggttgccatttccttctccaatgagtgaaagtgaaaagtgaaagtgaaggggctcagtcgtgtctgactcctagcgaccccatggactgcagcctagcaggctcctccacccatgggattttccaggcaagagtactggagtggggtgccattgccttctccataaagaagttaggctcctaccctgcactgaaattagaaggcaggggccttatctttttcgatgatcacatttcaaaaagatggctcccagttccttgagaaagacattcctgggttgtagaagatctgtctcaaaaggatagaatgaagatttataattgtgaattgtctagtgaattctctaagaaaaaggagataagaagctcatagtgaggacttgactgaaactgccagcaaattcttttggagcattgagctttctcaggcaggcatttcaagggagctggactcattaacctagggacatgaccttgaggagataggagccttgctagaatttagccaagaagagagtgcttgtcaccacattggtgtttgactttctcaaggtcatattgacttgcatgattcagatgtgcatgcaggtgataaagtagcaagagtggtgcataaacaagtttaagaaatttcatagaaagctctctagactaatcatataaaaactgactcatcatataaaaactgacagaatgttcagtttagagcaa

SEQ ID NO: 26895 - DNA, 2289 bp, Bovine  19866880712371
cggtaaagtacagaaaagcacagctccctgtagaggacgcacacacgtgacgatgcacgccagacacgtgaactaacttgtgtggttggacgtgtgagcacatgtttgcactctgaaagttcacggcttgaaggttcctgtgtggggaactcagcgtacttcatctctagcaggtgtttcagcacattatggtgcacatttaggtgcagcgctgagaggattcagttagtctggaataatttctttggaattgtaaatggtgctgcttggtataatgcgctgcagttttcctttggcccgttccactgtggctctaaggaattcctcataaagacacatctgaaaatgtgcctcttatgggtgtgtctgaacaatgggaataatgtttctgtattggacaccagataccagatgaaggttcaggacatagaatgtttctgactctcttcttgatttgagttccctaccttcaaagactcggggcaatcccctgcagaaggaaatgacagcccactccagtcctcttgcctggaaaatcccatggacagaggagcctggtaggctacagtccatggggttgcacagagtcacacacaactgagcgacttcgcttttgtatatgggggaagacataaaattcaccattgtcatcattttaagtgtacagttcagtacattcatagtgctgtacatcattaccactatgcatttccagaaccttttcatcatctcaaatggaagctcagtatccactaggcaatcactccccatcgcctccgcacccccaccccagtaaccagcctcctgctctctgtgcagtgcgtttgtctatcctagttactcagataagtagagttgtgcagcgtttgtccctgtgtgtctggcttctttcactgagcatgctttcagggttcgtccgtgttgggcatgcatcggtacttcattctcctttgtggctgaataatactccattgtgtgaacatagcatattttgtctgatcagtcatccgttaatgggcctttgggttgtttcccaccttttagctagagactgtttgtagcaaagtcgagggctgtggtggaaaaagtatcagacgtgggtcaacagtgcaagccaatctgtgccagtgagtgcctgtgtgatgttgaacaggaaggaaacttagcctctctaggagcgcgcttccttacctggagatggggatggtggtgctttccacgcctgcctctcaggctggttgagagggccagctcagtgacagctgcaacaaatggctattcagtgcctactgcgtgccaggcgccgtgctcgccacccagtggggagcaaaagaggcccagtcgtttcctcgtggtggaccaagataaatttgctttgaatcacaaagcatcggccttacaagtatagattgttacctaccgtcttcacctatccatactctgagtgaggtcattgatttatcctcattcctgatacataatccgcacccaacccaggcaagaatcttcgccagagaaggttctctctagcctctctgctacctgccccagtgaagggtggagaggcttctctgggtgcaacctatggcctttgtagcagctggaggcagatcagcagggtcagggctcccccagagagtcctcagggatgcctttgcctgccaggccttcctcctcactgtcctgcaccctctgttcccaggtggccatcaagtcaatccggaaagacaaaatcaaagatgagcaagatctgatgcacattcggcgagagattgagatcatgtcatcactcaaccacccccacatcattgccatccacgaaggtacagaggcagagcatttgaagctgagtgtgtgtgtgtgcacacgcgcagtcggaacagatgacacacaggagtagaaaaaggcatgggctttaggcttgggcaggagctggatttgaagcccagctgcatgactttgggcaagtaatgtaatgcagtctctgggtctcagttcctcttttgtaaaatgagataatctcacctgcgtcacaaggctgttgcaaagatcaaattgaacgtcaccaagtactcagctcaggacaggaacgctacagattggaggcattttcgttcttaggttttccgtacttaaacactgcctccccaaacccagtgagagccttggcactgtgggggtagctgaaacatacggagacctgcacctgtctccggcgtgtgggtgctctctttctttgtgcgtctcaagagccaggccccctgtcctctgaatcattcccgccgtgag

SEQ ID NO: 26896 - DNA, 1181 bp, Bovine  19866880717660
gcgccgtagtgatgcttatcatacacgccttttttgctctaacttcgcacattataacatctcttcggtgaggaagacgcagatcctaagacccttgatctgaaacgcggacagattgctaccttcagagctgcaaatgcaaagggaaggaagagagcgggtgttctgccccatcgcctcctcccctatttttctgaagagtctcagctttgtgctcagaaataagaaagtatctcatttttaacacaataatgtatgtgagagtttttgcaaactgtgaagcagcttttaaataagaaggggttttaatggcaggacattgaaacatggaagagaggaaaggaattcaatctttcccccccataaatctcagcaaaactgggctgagtaatctggaggcagaagagagcaaatactggggttaccaagagatggagctgggtaataataacaaccccatccgagtagctaccttgtggttactgtggataccatgggttttgcccacccagcaggctaaatgaacagttctggaagtaggtcccaggaccagcacatcagcatcacctagaaacttgatagaaatgcaaattattggacaccatccagacctattgaatcagaaacagtgggtcccaagatctgtttcaacaaatctttcaggtcattctgatgcatactaacgtctgaggacctctggcctagaccctagtgaaggggccacttagtatgtgagtcacagtgatctctaaagcgttcacagtttcccaagctctttcacacccatggtaccattctagcctcacttcacttaccctttcagtcctgctagtctgtgagtttcctgactgttctttttcccattccaaccacttgttttaatgcgtgtcctagaagagcctaagttgtttttacttcagccaagcagctactttctaaacaaggcagctccatttttagaacacagaaatttagaatgggctagaaatgtaaaagccccctccacttccactactcagtgtcaggcacaacgtggaaaacgaggccacaagcctccagcattttcagtggtgagggaaaagcagaataccagtgaagtctgtggcaggacacggcagaaccagtcggggccgatgaccctggtgcacgatggtcgctgtcctctgatggctcaccccaag

SEQ ID NO: 26897 - DNA, 3745 bp, Bovine  19866880721875
ctgtgctgtttgaacctgagggcagggcagctctccactggcccaggccgcaggaggtgtgcgggcaggaggcctgaacgggctctcgtggtcagagggaaggggtgaccgatgggctgaggagccagctcaggggcgccttcccgggcgttcaccccctctacctgcctggatgccgctgggcgttcccggagcctgagcagggaatggcagggaggtgtgcctgtgagctggatttcttggaaacactctggatctgagcagagcagtcgtttctcaggccttcactccacaccgcactgtctgcgctcaccgcgctggaggcgagctctgcaggcagggtgggtgccgagctgtggtcataccatccccctgcctcagaaagtccttcacaagacccatgacgggaaggggggcgggacctcagcctgtctccgtgtcctgccaggcttgcccctccttgtgtgtgaaggcagtgccaccagcccccttgtgcgctgctgtgctgagagccacacaccacgtgaccgccgccctcctggcaaggcgggggccaggtcatccccgagcgaagacagcaggggcccagagggctgtgtgggccgcagggttaggccgaggagcgtccatcttccgtggagcccgcgccagagcccacccagctcagccggagagcagtattgtccaacgctccctgccaagcagggtgctcaagagccaccccaaacatacccaccgcaatgccaggagagcgccaccaccggtgcctcggcctgcttggcccggggcaggggagggggcggaagtgtaggccgtttccggctccggaaacccccggcctgagcccccgtctgcccgcgggactcagccatggcgtctcctcctctcagccgtccgtccatccctccgcgccgcagatgctcaggagcagctggcctgagccctggagaccgcggtgccgagaaaccgcggcccctgtcctcagcgctgagtatcgtgacaggcggtgttgatgggagcactctgcatgctcgagccaccagtggctgcaggttgaagggaaggtccttgcggggatagctcgcttccccattctgggccggacgggaacggtcctcccgggtcgctctgctctgcgcttcgggcaggctgcttgacttgtctgtatttcggtgcctctgtctcctctagtcaggccctcctctgaaaacctgtccccacagaggggcatgtgcccagctaaagaagcgggtgccagtctctaggaagcacactgcagggccgggggacagtacctgccccttggccggggtcatggtgaacagacctcttcgccccttgccttgcttttgaggaaatggttgagcttacacttgtcccctgtccatcgccttggcccccttcccagcaagtcctgaggcctagagaaacgttcgcctgtccgagaggctgccggggtcacgactgctctcaccacaaggacttctgtggcctgggcccggagagtaccttcgtgatttccctgaacacagttagccttagaagagggctggaaacagatccgtggatgtttgtggcttttcaagccaagggagggcctcccctgctcacactcagcacccgcacggacatgcacacgcaggccgaggccccatcgctgggcagcactttcaggaggaacagtacaaagcatgaccttgtctggaagaggctgagtccactcccagacacggagatgaagtgtgaagggctgtggggaagtgtgttggaagtgtcggggcagcggtcggaggctgcccgtgccggactccgtctgggcgattcctgtgggcaaaccctgaacagagtctgatccaaaggagagggtttttcccggggaacaacacgggccgcagctctccaaggctcctggagccctctgcaggatcaaggccaagtcacagagcacccccaaaagccgtgtgacgagagcggtgggggtttcccaccctcgcctcagtctttgcgaggctgctctgctaagggctgaagagaggaggcttcccggcctctcagctcgggggcgggagggcatctccgtgggaggatgcagcgcacgctccgtttgtgatgcctcggtcactctgccagtagccacatacaccctggcccgtgctgtgattcggtccccgggaaagaaaccactctgaggatcctggttgatcactacgtggtgggcttaggaggtgcatagagggagatccttgattaaaataaatcagaggagtcaacaaataaagcaaagagcttgaaattacaggaggacactcagtgacctttgcagagcccaactcctgggcagcccctcttcaggacaggcaggggccacctgtgggagttcacgccgaactatggctgtgcccagcctgcccagcttaccctccctccgctactgagaacaggttctgagaagggacagggaaagaaggacagccatccagggaagccgccagaccccaccacacagcgtctcaagccaaaaccagtgccccctactggtctattagtattaaatggtggtttcatcagagtaaagatggaagtgaaataggtacaaagcttaaacaggatcagatttcagcatgcagaggaaccgcagagctgatctgattgaaatgactcattgtacggtcaaatccagagaggggaagggactgtccgcagtcacataactggtaaatcgaggtgaagtccagccttgaactcgggccctctgactccttgtgcagtgttctttcatctcagcacagctggaaacagcggtgttcccgccttggacacagtgatgttacttaagatctggcccacattcttttctgcttctcccacacgcccttatacctccacaaatgaaatcacaggatttttctgagtcccaggtcagtcagtctgccagccccgtggtgaaccggttgtgctgttcaggagagacccaggccaggaggagagggaccagctgattggtgtttgtcaccacgaagctctcccctcgggtggcatctcttgcccccagcatactgcgtccccgcgagagggggcctggtaggctctgtgccctccaccctggccgcgggggagcggggccgtggaagttccacccccggatctgccgggctggcgtgcagcacatgcaaagacttcagtgaagcaataaacacaaaactccgggagacgaagtgcaaaattttgtgcacgtctcttgtttctctttgaaagaggatgcaggtcggacgactgccctgctctcctttctgacttccagactcagtgttctcagtcagctgtcccctgcccggctcccagctctgtgccagcctcgcgccctcctgctctaagcaccggtcgcctgtgacgtggccgctctgtcctgcccctccctaccccacgctgggccccagggacctctggccccgcagcctccccagcacacacattttccagtttgttccgttcagcggggaaatcttttccaaatgtctccatcccttcccacatacccacacacacacaagttggtctgatctttttttcccattggttaaatattttcactcaccgtggcagaccttgttttaacccctctcacatcatgttctttccttttttcgagttattttgcattaaccaaccttgtcagcgacagatgcgtatctgagggtgtcatgttgaccttcagcagggaaggcttcgggccgtagaagaccat

SEQ ID NO: 26898 - DNA, 749 bp, Bovine  19866880746252
gagcactgtttccagcgaggacatcactacaggaagagttaggcacctgcaatacatcaatttcctggaggaagaaagcaaggctctggaggtagaaggactttgaaaactcccacgtgtgggctgtgggggcctgctcaccaagagacactcaaactatttccaagggggttggaaaaatcttttataagcacattcttttctttaaaccttttttaattacagaagtttcaaacatatacaaaagtagacaatagtataatgaacctctgtgtacccatcacatgcaagttctttttaattctcttacatttaaaaatagatacgttaagtaaagcattggggaagaaatctgttgcaaaatcaaattataggatttcacagttctcaggcaatcacacactccccttctatctttcctcctgtcatagaaggtgtaggtctttgatttctttttcttctataatttattgcccttacttgtattcctagagttctcctacagtatgtaaaaggtgaacattttgattttcaaaaaaagagtaattatgcttatcaacatgactctgcagccatcaataataataataataaagactatataacagggaaagagttatcagctaaagttaaacacagtaaagtacaaaatgctgtgtgcacattgacgacagcggtgtaaacacatactgcctgtgcacataaacaaaaacgagagaaattgaaaaaattaaatcagtttttgcatg

SEQ ID NO: 26899 - DNA, 1473 bp, Bovine  19866880759634
tttcctgccatgactagtggctgtgggtaaggaccgctgggccctcccatttctgctgagtggactcagggagaccttgccttggggccggaacaccatgagccttagttatgggcgtttattccttttctgaccaacctagtgaccaaagcctgggggcccaagacagccaggggtctacccctcagccacacgagtggtcccattacaaccaagtccaggggaacctggacacatttcctgtaccagacacacagccttagcacgctcacatctgtgttgttcacggtcatcctgtgggtgttattttatgccttcaactttattatatacacattccttgagggagggagccctgtcttgactgcctctgtgtcttccatggcgcctacaacaaagtaaggtctcggtacgtgttgatgggtttattagggggtgagttttcactgatgtaactatcagatccccttttctaaggggctggggccacgggagcaggtggaggccctttattaaacatttattgagcaccttctcccactccttcgttttctttggggaggtgttgcttacaaagcacgttcaggagtcatcctgtgatatcccggggcagcagagctgacatgagtgccctgggaaagtgactgtctaagtgattgcactgggctctgcctacaggaggaatgtgctaagccagggagcttgtctctggggcagtgtgtgtgggaggctctccagaggtctgctgggggagggcaccctgaaccagccacctggtgcgtcctggctgagaggctgccacaccacgaaggccattcatggccacagtgttctctgcccagtttccatgttctctgagtaagcttccctctgaatctcagcttcccctcatgtggaagcaaagggtgaacactgctcatcagcaacccaaaggcctagttggtttgacagcagtttacaaaccaacaaactgacattctggctgtgtctgttcatctcctggagattttttgcaagtctggccctgagtctcctcggtctgtggctagcaaggtgtctgagcagccacgtgaggcccagaccctgaattgaaaaagcatcttaaaggggacctggccaccacgtgagactctgaggaggaaccagccagctccccccaggtgccacccagcccacggcttctccattcatagagcactgcgcttagagacagagccaagccaggggtcctacagcagaagtggggctccatgccaggggccgacctgctttagtaggaagccaaaggaccaggaagacactgcagatcaggctggaggcggattcggaatccagccagagaaccttgaaaggtcactgcactcttccccctgctgctgggtgaggcatgtggtcagccctgctggggagctgggtcagcacccctgggagctggcgtcctccaaggagggaaagcagggatgagcagggagt

SEQ ID NO: 26900 - DNA, 1363 bp, Bovine  19866880764822
ctctctgacaccccttgatgtttaaacatttttttatgaattcccacagaataggaaacaatttcctgcctcttgctattgggaaaagagaagtcttttatttcttaggattaattgcatttacaaaaagaaacaactttatgcttacctgttgatcttgacaccttatcttcaacacttaaggcttcatcattttcaaggtaaatgaactggctgttgacaaggaaaacaggattctacaagcctactctttatcctccttgtttatacacttactactttagcaaatttgctattaccaggagtgttccctttcagcagcctaattgggatttcctttcacaagaagcattaagcttagtgggataatcccacctcttccatgaggcggacagtgggtttagacgagtttgttaattatttttgtttcattcaggctcgctgagcacatactgtgtgtcaagtgttttcacgctcgtttttcaacaagcgttttcagtttaatccttacaataaccatgtgaggatagatattattagcccctgtttacagaagagacaaccaaggataagagaggttaagggatttggttgccccaaaacatgcagagagtaacagaaccagaattcttacatgaattttctaatgccaagacaagtgttcttcccaccacatcatgttatttatttataattaaccagtggaaccaaagtaaactggaaaatgctactcctacatactgaatataatctcttgtattgtaaacttacacatttttatcttatcgtgaacatcaaaatatagtatgtgcctacattttcccaagaaacctttaatagaataatctagtcctttaaataaaatttcaatccaagtattttcaagttctctttattttaggtactcaataattgactgtggctaatgaaaatttgtcatcgtcttcaaactggtggttgcatgtcacacagctctatacacaacttctcaccaaaacttctttggcagcataatatgacactcaatgtaagtcagaaatgggtgagacacatttgaactcccaaggatagaatcactggagtggaatgttcaacttttgaagctggatgacatttctgtttaaagccatggccctcactctgccaggcaatgtttaagtgctttatatatgttatatatataacaccctatgttacccaacaccctataaggttggtatccccacttctaaatgaggaaactggggcttaaggaggttagacaatttgcctccaatcccacggtcagtggatagcagagcgaggatttgtccgcaagcagactggctgcagagtctgagctcttaacctctcaacactgtct

SEQ ID NO: 26901 - DNA, 1399 bp, Bovine  19866880796832
cacccagacctcagataccaaaagacctgactaagcatttggcccagttttgttaacagtcactcatgaagtataggaatgccagaaaagctaaaaccgctactttgggaaatccttctgagttaggtctcaggagcaccctgaaaagaaaatgagaccatgacacacaaaaaagaaccaacaaagcagcatgggccatgacaaaggagtcaggattaaagcatgactctgacattcttcaagcagctcttctccagtcttaaaaaggcaaggggatacaaataggaactggagactaaagagcagtattgggatgaatttatcaaataggaaggaatgatggcagacttttccaagaaggcctctcagaagaagagaggccaacttcgctcaatgatttcaggtaggctgctgctaatgagccccatcggggtaggtacctttgggcttcagaattgacgtactctacgccacctggaaagggttcgaggatgccccagttcctgcaccctaccaagctctaagacccacctttgaactccatgttggcagcatcatccagaagttcctccttcatggtgttaagagtctcaacgatcatgtccttcatttcctcttgcttccggttggcaatattcatcaatgattcgtacagctcattctccttttttcgagtgtattccagacgtttgggcgtaatctgcaggtcccgctgcatgtcaaaagcctggttaatgaaagatgtcgaggcagcggcagtgcaccaggttcagggccttggctgcgtccaccaggcgagtctgcagcacctggtgagaaaacgtgttcaagtgtctcagcttctcactttgctccaccaacatgctctgagctttggtgtcctggccgggggccccacagttacagaggctgctgctcagatagcccaggtcagtcagctgtcgatgaagtggcgatctttcactctccattctttcagtggaggagtcaattatctccgagcccagcttcggcactttgaaaaagaatatgggaaaggagaaatactttcggatttcctgaagctcttgctcatccctctcagagagttcatctttgtggagcgcataggttatcacaggcaagaaatcattcaccaagtcactcagaacatccactgtgggccggaggccttggcacggtgctaccacaatgtccacttcctggaaggggaagggggtcatatcagcacttcagggtcagaaccagtccttgcctccccagagtcccacactgagaccaaaatccagacctatgatggggcaactgggcttcagtatatgccctaatcacttgtccccctccttcctcggttagcaacactcccctggtgccacctaagcaggcaggcactcatcga

SEQ ID NO: 26902 - DNA, 1362 bp, Bovine  19866880849771
acctcctattcatttcaatttgaatttctcagtttgtacactagatgtatattctcctcttcgattttgtcataccctccccaaccattgtaatgttctgtagttctgtataaggtgagacttagtcttgggtatttcctactgaagctttagtgctttgtaaacaaaattagaagtttattaaagaaaaaactttctaataattttttttcactttcagatatcctccagtctttggaaaaccgatgctcactttgcagcttcacttttcagcaccactgtcctcaacttcctaatgactaaatgaacctgggaaagacaaatctcagccattacagttgaccttcagtatccatgggtgattggttcaagaccccctgctgctgctgttgcaaagtcacatcagttgtgtcctacttctgtgtgaccccacagatggcagcccactaggctcccccgtctctgggactctccaggcaagaacactggagtgggttgccatttccctctccaatgcatgaaagtgaaaaatcaaagtgaagtagctcagtcgtgtccaactcttcgcaaccccatggactgcagcctaccaggctcctccatccatgggattttccaggcaagagtactggagtgggctgccattgtcttctcagatagcaaaatcagaggatgctcaagtcccttatataggatggtgtagtatttgcatataacctacacatatcatctcttatagcttacattatccatagattacttataatagccagtacaggtaaatgctgtgtaaatatctgtaaatacaatgcaaatatctgtaaatataatgtaaatgctacgtaaatagtggctgtacatggcaaattcaactttggcttcatagaactttctggaatgtttcaagtattttttacccccaggggttgaatcccgggtggatgcatgacctgtggaataaaagagctaactgtacttaacaagtgtgaaaagtgagtgttagtcactcaggtatgtccaactctttgcaactccatggactgtagcccaccgggctcttcatccatggaattctccaggcaagaatactggagtgggttgcctttccctctccaggggatcttcccgaccctgggatcacacccaggtctcctgcatcggaggcagagcctgtactgactgagccaccagggaaacctttccttaacaaatgcctgatttactaaatggtgtccctggaatactcacagtgccaagagcattatgtcaccttcccttcatccttcactgccacacagggaaggacttatggtaaatccaagccagagaacagggaaggctaggcagcatccaccactgaac

SEQ ID NO: 26903 - DNA, 1376 bp, Bovine  19866880851379
ctcccccgtccctgggattctccaggcaagaacactggagtgggttgccatttccttctccaacgcaggaaagtgaaaagtgaaagtgaagtcgctcagtcatgtccgactcttagcgaccccatggactgcaggcccaccaggctcctccaaccatgggattttccaggcaagagtactggagtggggtgtcattgccttctccggaaactaacatagtgtaaatcaattatagctcaactttttttttaaaaaaggcaacatgaagagttcttgtggtgatgggaattttctgtatcttgactgataacttccatattctggttaggatattattatactatacattttgcaagatgttacaagggaacattgagggaagttgggtaaaaggtgttatatcttacaaccgcgaagggaatccacaatttatctcaaaatacaaagtttaatctaaacaaaataaggaaactgaagttcagagtaagtagttaaattcttttagagtcagaatttaaatccaggtctgtcagattcccaggcctgagtgtttcaagacttggctctgttcaggagaactgcatagggggaccccagaagcctgcagttcctcacaccaggcggctcaccggcctcaggggcacctctgttactgcagactgctggtctgataaggccattgccggtcttgaaagaattatttgtcaagccctgtgggttggtgctggagggcccagatttggtacccaggttttcccttcctaaggtgtgtaaagaaggatgatgtggaagggaccactcacgtgtttgcccttccacttctgtctctggctggctgtgtgtccgccaaactgtgcatttgtcagtttctctgtggatatgaccatttccgggtggacggtgtggtggcgatgtgtaaattatgcatgtgtgcacaggttagcgtgtacattgttcggatgcccctgtgtcaggtctgggggtgtcacacccacataacacgttcctattaggttaaaccatctgataatacctcccccatagcagagcccactgttgagccagtctgtcacgaattgggtctgtgtattgtagataaactgggtaattggactctccgcctcctcacccaaaacaaacactcacaaaccgcccaccccgccctggagcgagtcccggcccgtcatccggatacttggctctagggccccgctttccccgaacagtaggcaagggggtgcgcgcctcccgccgggccctttccctcccccgcggccgtagcaccgaggcttatgtaaagcggccgcggggcgcacgcggcttcccgcacaggtgtggcagccgcggggaggctgtgcgcggggccgccccacccc

SEQ ID NO: 26904 - DNA, 2106 bp, Bovine  19866880874177
agactggctcagctaagatgggcacaatctcggaaacgactgacctcaccagcttcccattttgcaggtatgatagcacttgctgcttttgctgcagccaggagaaggcaagaagcagcgaacatttcaaagtcctctggtggcagcatggagacctaagtaatgtgacttttttatatggctttggtaactttggtcactgtgctctttattctcctgtatctaggctttctgtctctcccatcagcctggggactccctggggtaggtcttccctccccttcagtctggatttcatgaactgtgcctcccccatcacactgcgagctgtctgaaggcaggggctgtgtctcttccattagatcggaagctacctaagattaaagatcacatttcccaatagctttagagtgccctgaaccccgggactcccatctcctcttttaacccccccaacaccaaggacaggggactgtgttctcttctcccctgcaatctgacctctcagaaatccatgaactacacgacggaacctgggagatcagactcttgggagaggatcaggcactcagctcatcctcgatgcccgagcctcacctatctggactgagatgtggagcaactgatcgtgcttggtctctccgctccctccctgtctctctcttctacattccgccccatgagccctgctgcccgccctgggagcagacagaaaggaagggctctctcagcctagcagcacaaccctagtttaatcacagagtgatttgtcctcacaattaatagtttcatgtttcctctcacagtctaatgacaggaaaaagaaacgtgtgcttctgaggaagaggtctacttcagggttttcaggtgataagggttagctatacaatgtacagggtaagtttcatggtaggtaaggtaagttacaggtaggttacaggtaagtttcgtggtagctcagatggtaaagaatccacctacaatgcaggaggtccagattctatccctgggttgggaagatcccctgaagaagggcatggctacccactccagtattcttgcctggagaatcccctgggcagaggagcctagtaggctacagtccatgggctcgcaaagagttggacacaactgagtgactaaacttccagtgtctccttttattctgtatctcctaagaaacttagggggaaaaaaatctgtgctcagatggaatttctatctcccctcagctcatggatttcattattttattccaaatttaatcatcttgttttatttaagccatcacaagagtctttaaatcctaaattatacaaagaagcgttaaaaaattatattgtgtatatatttttgtcttattagtgacctgagaggacagaactatgcagtgattcataaaatgggctttggaattagagacctgaacacacaccagcttttattagttcaccagtgaattaccgtgcagctgtgggccactcgttcaacccgtctgagctttgctgcctcgcggatgcactggggacagcgtgtctgcaatgcattctcactgatctaaatctcttaccaggcctccccctcccggcccgcctagccctctgctctggaccacgctggacttcacagccccacgtgctcacaggctgttgccgccgcctggggctcgctccaccctagcctcacctgttgcgtttccggctggatcctcgtgacatctcagtgtaaaagtctctgcttgggagaggccttccttcgtctcttactttagaccaagataatcccaggctgctggccagtgcttcccaagcttcagtgtacaaccaatgactcacccagtgatcttactaaaatacagcatgcctgggtggggccctacatttgtaatttataacaagctgcatgcaggtggtctgaatgctgctgggaggagcgcccttgagagtgccaaagcactctcgcacaccttagtcatttgtttaatggtatctgtcttcctgctagaccgagctccgtatcccaggcccaggcacagtgccgagaccagaagcactccagaaatgctggccgattaaactgagcaatatctgtgatatctctggcctg

SEQ ID NO: 26905 - DNA, 1620 bp, Bovine  19866880881165
aaattgtttcctgacaatagaacccacattgagaactgatttggaaagaccagccctaaaaggatggcaagtttgcagaagttaacagtggttccctaacttgagcttaatgtacattggaataacccgggtgcttattgaagccacttctctggttccgcaccaggaggatttcattctgaagatctgggatggggccaaataatctgtattttttttgggccacactgtgcagtatgtgggatcagggatgaactcgtgtccctacagtggaagcaccgagtcttaaccactgaacctccagaaaggtcgaaagtgaaagtattagtgtctcaggcgtgtctgactcttcgtgaccccgtggactttagcctgccaagcttctccgtccgagggattttccaggcaagaatactggagtaggttgtcatttccttctccaggggatattcccaacccagggatccaatccaggtctcctgcattgcaggcagactctttaccatctgagccaccagacaagtccctaaataatctgtattttaagaagccttttaaaagcaagtggtttagggattgttttaccaaatccagttgggtgctggttatgagacgtgcatgtatgcgtgaccgtggtttgcctattggctatggcagcaagtcacctcccagattgtttgcttttgcagccagtagctggtttgaaattcaggaagtcatttcattggtgaaggagagtggatgctggggaaagggagtggattatggccccatcaatagaaccgagtatgtttttcctgctaacgcctggcacagtccccaggtgcctactgccaggttacagctattgggcaatcatgtacttcctgactttccttttctttctctttctataaagtgtgatggcccaataagcctccaggcttgagactgctggacccaggctttgttaggggctcagctgaaaaatagcttcttgtggcttgtggctcgtacctcttgttggggggcagactggattggggaggaatggggtggcccagaaactgacactgaaatttagaaaccccattaagctcttgacctgggtcactgcgtgtgtatgggtgtgtgtgtgtaagagagaaagggagagatcattgattctggaatgagataaaccagctttcagtttgcaaacctcagtggctgtaggcagagatttcagctcttattacatcagaacagagaattcagaggtgctccctggcttcatgtctcttgtctccagggagccaagatgagtaggaatgggacctgctccctgatccatagatcaccctgtacttctgctggcagtttgctcagggcctccgacctccttggagagcagctctacacactgctaaactctggtttctctaaattctggagggaaagcctctttccccactgcaccccactcctgcctctgcagtgtcctctctgaagaaagaccgacctggtgtcccaggagaggagtgtgggagcagcccacgacctcccccaaaatgaaccaaggtctttggggaggaggatcacaggaaagcctgctgggtgacttccgccccattcccaattcccagcctgtctgatcggatt

SEQ ID NO: 26906 - DNA, 3224 bp, Bovine  19866880890567
cacgactgagggactgaactgaatactattcttgcaactttccctaagtttgaacttatctcaaaataaattattcaaaaaatgtttaaagaggcagggatagatttacatctacgattgagaagaaggaatcctatgtactgatagagcacatataacattttttttttaagtttgatctgcctcattcaacacacaacactcacagagagcaatctttaattatatgtgtatatttaactgtatgaatacatttgtgtgtgatgggataagtcacttcagtcatgcccgctctttgtgaccctatggactgacgagcctgccaggctcctctgtccatgggattctccaggcaagaacactggagtgagttgccttgttcttctccaagggatcttgctgacccagggatccaacccatgactcctgagtctcctgcattggcaggcgggttctttaccaccagcgtcacctgtaggcaactgtaaatcacattctatggcacttgggagctcgatactgaagattccatttccattatattatttttcactaagtatattgctttgtattgcagataattaaatatcatgctttttatataatattaatgataagaatattatttatttgtacttatataactccttattctccatcacttctctattttacccactccaacttaatccttacagaattatatgaagttgagattattatcatccatatttgcggatgaaaaaatgaagacacagagagggcaagtgtcttgtccaagttagtggagaactgggatatgagcccaggcggtacagtccgtattttttatatacatgttctttgtttccggagctctatttaaatttctgcaagacagaaactatggcttcttttgcacctattttcttcctaatgaaggtctaacacaacaccctatatacagggtgagtaactgtatatgccctatatacagttaagaaccaagagtagtcgctaactcacacgctgagagccggtggaagctctgcagtcacgaccccctgggtggtcattactttgctctgacccaagtactgtctctcgagagactacagtaaagggtgtgcccaggagatggcacagacgacgaggccagagagccaggtcatcatcgccagtgcaggtgaagcttccctgcaggtcagcagcagggactgagcaactgccccaacccacacatgcctggcgttgagctaaacagaggactcagatacagtttttcaccctcaaaagttgacagcctggaacactcctgggcagagggtggaagtaggggttgattgaaaaggcagattcctagaaccagacccacagagcacatgaggagaaactgctggtggaatgtagtacaggagaggcggcaagatgagaagaaggcattccaggctgggagagcagaatgagcggggattctggccgaaaagagcacgctctgtcggggagagaataaggaacccagatgggaccaggagcacacaccttccagggccagctgccctctgggtgttgcacatggcagcccccccacccaaagacgtgtgcatgcacaaacacgtcaccctttggaaccactcccaggcccagggtgaccatatgccctgttttgccagaacagccctgtttttacttctgctatttcagcatcccttctggtttcattctcaagcatcctgttaggggtaataaattatatggtcaccctactcaaaccccactgtatgcaacctcagtgcttagattgtgttgccttcctacttccacccgaacactgtttttccctctttgggagaaggggacttagagcccgagttatacacacgggcccaactccttcctccatcagtggaagcccaaactgtgtctagagtctatccgatggaaaacactcagttcaaaatgtccacctggctttgctggtagtcttaaccaccgaatcaaatgggccgtacatgtggcttgataacacacacacacacatatagtactcaaaagtgtgcagaaattgacacaatccaaatctcaaagtggtttgtattcccctagaaatcttctgaaataagagggaaatgtgtgctcactggtgtttcagagaaatgtaaacactgcccttgcaggtacttagaggcctgttaggtacagaccagtgcttttaagtaattaaagtctatggtgttcgacaagtgtctcaataaacacactttctaccacattgtacatggaaatttaagtgcttatttacatttactttcagacttaaagttgaaaagatgtcttggggcccttccaagaatcaaaatggcttatataaatccttcagatcaaaacatcttatgccatcacaaactttctattaaattctattgctcatttaaaatattgacatgttttatttcgggtctccgtaaagcaaagcatgaagagcattggtcccacctgatgcattttaaatactcaggctgctattttttctgtaaatgtctttgcaggaactatacaaaaggctttttctgtggaaatgaggtttactgaatggaaaggattcctttaatgagccatttagaagaatttaaaaatccttttagaaaatgtgtaagatatcagaatttcttcatcaaatttgaattatgtttccgtgggaagctgaagctagagtgtactgcgggaatgtttacataggggctccttttcactcggtatttaaactgagcaagtagtctacacactagatcacattggtaaacttacccatttgtcaacagaactgtttggtagatttgatgaggtgagctttgtgctcctactatgcgcaagagcctgtggcagccactgaaggggacacaaggcacctgcagagggacgcgttgcactggcctttgagatgctccttaagtcatcacaggattttaacaggaaggaaaacggggagcaggtgggagaatgaaaagaattccatgcaaagagaacagctgaggcaaaggcctgtggaaagaaagtgagcgaggtgcagaaacaagtaattacagttgagtctgatgagggtgataaagttactggagacactggtgtctcctcacggtgtagaataagcctgcatcctgttctacagcctccaggcaaattagaaatatatttaatctctactggtaggtttagccgactcggtaaagtggaggaagaggcca

SEQ ID NO: 26907 - DNA, 1112 bp, Bovine  19866880898414
cctctggggtggcagtcgggggtcccttaggatggcctcgaatgagagggcctcacctcctgaccatgcagcctcaactggagggcggagtcagccacgttccttccgctacccgcaccctgccatagcacggagcgcagtgcacggagcgcggcatgcagcatggcactcagcacagagagtagagcctggagcctagagggacgaaacgggggtcaccatacacgcatcagtctgcctgggagcaacctctgcccatttaggtaaaaccaggacattggaaagtggatcacagataaggcattggcagggtggtcatcttgattttcagactcacaagatacacaatttagaaggaagagttggggagcacaaattcctctgctccttaaagcatcagatgataaaagacagcaggaagaggagccttctcagaaagacctcggctacttctctgtgtttattgaggaaattgtaagaggaaatggggcttgtaataaagcctgaggatctgggttataaaaaggaagaatttcctgccccgggagcatcagaaaattaaaataccagcatgaggtgaggtgagagaccatggtgtcacttcccctgggaggtactggaaataggaaagacacagggctgagagtcaaaagacctctgttccagctcacatcttgtcataaccaggctgtgcacctctggaccaagcacatctattctggtgtctgtaaaatgagagaggagggaagtagacagcggcctgaggtctggcccagctggagcgtccttccgcagcgggcacgcagggtgggaagccctagagaaataatcgtttaaccagagtgacaaagcaggaggttccagaatggacatcctcacgttcttctgggtggggcaaccgtacagaggtctggcctccctggctctcatgggtgctccccactccccagggttctgtcaccagaagggaccgtactagggaccttccccctggggctgttgtggccaccagcctcgtttccccagctcagccagggacccggggacctgggcgagctgccgctgcggctaaggactggcttctggtagaccttgggctgccacccagaagc

SEQ ID NO: 26908 - DNA, 1201 bp, Bovine  19866880912186
ctcagtaattttccaactgacctggaattcctcctgactgctgccctcttttctggggcaagagggacaccagctaagggacccaggactccacccaatcctctctgctggccacaaatgggtgtgccaaaggctttggaaagcgattgcagccctggagggtcacctgctgggaggctgggggaggggtaagtgtgcccagagaggcaacttattcagtgatccagaaaatagaggagattcttgtttttttctccctctcctctctcctgtgcccactctcctcatcaccatcaccagggctccactgttcctctctcccttcgagatttcccattcttctctgccttcaattggaagttcccttagagagcctctggccaactccttcttacccagcctcagaatatggaagggacttgttcccacatcatgcctggttgatgtcagggccagccttggagccctgtgccttggtgctggatccatggctacagtcaactaggtcctccccttcaaaagcatcttccccctgatttcacagtattcaaatcaacaatgcacataaatcggagtgctctccactccatggaggaagaaagacacaactgggccccccaccccaagggcagcctgggcccccagttctctcccacctgcacagttcagtcttgttaaaggcatcctggaaacaggcatcttctgggaccttgctcaacagctgataaagggaacattttactgtcaacatatcctatttcccccgcccctttcccgatacacagccttaagcagaaagaaaaaaatctgaaatcttttttaacttcagaaagagggactgagtgagccatcaggaagctctttctgcttccgagaacagcaaacagtaggaagagtaactcggggagaatacgacatctcttgcaagggctggtcctgggtgggtggggtgcggctcggcccgggggaccaggggctggccggcatagctcgcgcgggtaatggctgcagaccggccgcggggagcggaggcgccccgagaagccgggcaggtactacctaaatgtttggtggcaagggcgagggcgagggggcggcgtactgccctaggtaatgatagtctgggagccacgcgggggctgcccgtcgcggtcgcggctacaaagacagctcggggacctcccgctttcctcccctgggt

SEQ ID NO: 26909 - DNA, 1640 bp, Bovine  19866880978362
ttccattatgcccagcaacagcacaaaaacgttaaaatttcagtggctgggacttcccctggtggcacacgccatggagtgactaagcctgtgcaccacaattactgaagcccatgtgccctggagcctgtgctccataacaagagaagcccccacaccacagctagagagcagctccttctctccacagctacagaaagccctcgcgcagcaacagagacccagagcaaccaaaaataaaaagttttcagtggctgaatttacatctcagacttagaagcagtttgggaaaaaaaaaaagaaatgtcattcagaggccacatatcccagttttggtttggaaaatgtggtcagatgagccaagacggaagatgagtttttcaatcctggtctggcggtcatctttggagtccctctgtccatcctggacttacagacggcggccactggagacccaccacgaggctggtctctctgcacactcaacaatctccagtgagaggagctcagagctcaccgaagcgaggtactggtgtttaggctacatcctttctggggactaatctaaatctctccttcctctaaagaagtgctttggttttgtgggactctctctgcttttgccagaatcatagtgtctatgtcctcagtcacctctgctcctgtcttaaagcttgctctcagatactctcctgtttgatttcttgatgctcgatgcaaagagtggccctcacatcaggcaggacgcctgggccaccctgcagcctggggggtcccaggggtgtacagggcgagggccccaggctgccaggcaggcgtcgtgggcgggctggaggggctctcaccgtccacgtgatctccatgttgttcttcctggtcccctctcccttcacatcagaggggttggactcgggggctggaacccaaatggagacaaagtcaaacccagggtacgcatcacagggcacagtaaacagcctctcctccccagctgactggccccttccatgctcatctctgcatttctcaacacactcagtcccctacgcagctgagctcgctctgccactctgttgtacatacgatgtgtgttcctagctgagacttaaacccccaaaggagggatagtttcttctgagttttaatcgctgacaaaatagcatttattacaaggctttccacactttagatgatcaatagagccaactcaatgtggattatcccctttgtggattatccactaagtgtgtttaataccaacttggtttatcctggcattcgacattttgggggagcatctttcaccctcaatgagccagtgtgatttcagaaattgaagcatttcattacccaagtatgttaagaaaccttatgcaacatgagattatatgtttctaccgccaatcttcatagctcttccctttaaagcagatcatcaagaattattcataattattactaataagtagtaataaaaatgtcagttaacatttattgtgtgcttactacatgcacattacattaaggacctgaattgtattttcaaacaattgtattttcacaacagccctgtaacggagatggtataattattctgtttcataaatgaggaagccggaatagctgcctaaattcacggg

SEQ ID NO: 26910 - DNA, 739 bp, Bovine  19866881042940
aaatcctgtatgattctacttatattaggtacctaaagtactcaaattcatagaaacaaaaaacaaaatggtagttaccagagattaagagagaggaaatggggagtcattgttcagtgggtatagagtttcactttgcaagaggagaaagaaaagctctggaaattggttgtacagcaacatgaatacaccctacacttctgaactggacacttataaatgattaaaatggtaaagtttactcatcgttattcattattaatattattaatactcacttgtattcattatgaaatgctactctattatgcatgaaattctatgcagttttccaatactgaatttatactttttatccagactgggtaagggcagtacctccgatgcaaattttaaggaggtgccaaaaaacttaatagtcaagataaataatattttaatgcattatttttaaaaatcaaaattccatgaggaacaaaatatcaaaatttaaatacagaccagatcagtaaaagggccatgtcaagctatactgggccctggggcaaatggaaaaatcggtaatactgattcaaggttaaacctttttgttctccacccactgtcagaggatcttgccataatcttttcagtaagactgaattcatctgatctaacctccatcgcatttcctcctctttgagctgtcagaatttcacttttcctttactcctggtccctggagatgttctccctgttg

SEQ ID NO: 26911 - DNA, 1662 bp, Bovine  19866881043435
ctgctacatgctacagaatcccctcttatttggcaaaaatgcagattcctaccccaccctgatttattgaattagagtaggggagaatgcagggcctggaaatctgcacttggccagcagtccggtcaactcttatgcacgtgaatagctgagaagtcctgctgtcgaccatggactgtggagtgtcacagacctgggttcaaatcccaggcctaccatgaggtagctacgtggactggaactaattcctaacctctcatctgtaagacatggcgtactataccggcctatttattggtcttgctgtgaggattcaatcagaccctgagaaaattgattcaaagcaccaggcatacagcctgctctgaaagcacaccccatctagtggcaaagaggatgcagacataaatgcctcccctgggagggaagcgctgcacattactcaccccccagcaaacacagagcagctttaaaacaattctgaccctgcctttcctctggggtgagctcagtgacgttttcaaggtgactagggccgttcccaccctgaggtgtgagccattcctagctagggtcaggcattggcaaacctctggttggccagggtccctgggaccttcagccttgcagcaggctgccaggaaccgggagtctacaagtccttcctttcccgggctcccctagtctggctgatccaaagaaatgccaaaacttgtaaaaagcttcagccattcataactggtcagctccctcgggaaacactccccgctctgctgaaagcttgccaggcgacttggtgatgtcgtgctctcagcccacacaatgggcagagcaggaaaaacatcccgcctgtccataggctcacatcctcctggggccccaccctgcggctcccagagtttggggatggcggtgcagagggaggcaaagggcagctgtggaggaggggaaagggggtggaagcaggaccagatctccccagtttggctgcctccggaacaagctgggtgggttagattacaagttaaatctgctttttctggctcccctgccagtccccggagaccactgcttaacagccccgacactgaaatggactaaaacctgacctggtaaacaaagctgttcagagggcagtcagcaggtaggcacacccggtgggaggccttgccttgcacttacttgactgtgcaagctgttaaacctcccaggccctcagtttccacatccattgaatggggagtattcctgtatgtcctgtctactacacagcgtgttctcacagcaaaatgggctaccgtgcatgaaagcccctcagtaaccataaacacatcactggtgtcattgtcattgcagagggactggggagtgaggtggcatgcctggggagaaacacccgtgaggacatggccctcttcggcccagccagctggcaacctgaacccagagaagagatctaacagcttggaaacatggacacgtgagtgctgaccacaagctgtgagaatgttcagacaggcttgggggccggggtggggtaggataagtggagagggagcaggggagcgtttactggagaacttacccagagaccacagttccatactaagctctgtgtttttccttagcgtcgtgtatatttagggggcctttggaaaaggg

SEQ ID NO: 26912 - DNA, 1952 bp, Bovine  19866881074898
cctgcatcaccagtagctgtgcctagaagaagctgtcaccttagcagtttggaaaggcagaagcctggcctccggtttttatgacattcagatagaacaagcaatactcattttctgccaagggatagctcttgaggttagagagttgtccttttctctgtgcatggagttgggtttatttgaaaagggagttagtttatttgaatattgggacgtcaaactacttaaagccaaatttcaatctgcaacccattttccctttttcttgagataagcttgatacaaaatgagttttcttgactcccaaatccctaagttacacttttttctcaaagcctaattcaaaattcacagtggtgctttctgtgtcttaaccactattggagaaaaaaccctgtaaacctgcctgttgccatgtcgtggagcgactggactggtgacatctgtagggcgcgctctgtgtggctggtgggacgccaccattgtgcatacactttgtacatcggggtgaagggagggttttctagattatgggggagggcaaaattgggattttttttgttgttccttttttgatgggatgtaggggtatagtactcagtttatgccctaaataacttgtataaaaatccctgaagtattgtgtgggtgtgtgtgtgagtgtgtgtttgttatatgtctggcaattaaaactttgtcttctggaaattagcgaattctctttttttctccagaagtgtttgttacaagatttgtaaataagagctctacttagtttgtttaccaagaacatgttgcagcaaaccttttacacctaattcccacgaggttgaagtaacgacttttaagatttgccagggtaagcagcagccaggttctcagtcattgttggccttgattcatctttcagacttcattttcccagctctaaaattcccagtattccttaattgtagtccttttatgttctagaagcaggaagggggaaagagaagaccctgcttaaatgtatttaattgtccatgggccgaggcccgggcatccctcaagactgtaatgttgctgggtatatgtgatcagacaccagagggctgggcattcttgcagcaccttaacagtgctgatacctgcagcatggtactaaggaagttaaaagtttgaatgtaaccactttatttaaaagtttttttcttttaatttaaatgaaatgggggttgaagtgaacatgattttgttgaccatgtccgtgaattctagatgcaacatgcattggtagacttgtgcgatggtcttttgtgatacttaatttttacatatcccagtctctgtatgtatctgcataaacaaagataaaacaaactcctgctttcttttattgaagggtttccaggactgcgtgtctgttcctgagctctgttttaagtatgtgtatcctttgcttgtattttgtattaaaaaataagaaaaaagaacactttattgttgagcatgttggcattgtcccttttatttttttctctttttgggacatatgaagcaagttattctttttctgtatctttttttcttttgtaaactttttttgttttgtttaaaaatggctttataaaagggcttttgtaacccagatgcgtgctctgtgtacttcttgtgatactcaagcgaatacactgatttactatacaactgggcaccttggcctggcacctcccagtctaatttgactttagggggaaactgctagatgaatgaattctttagaaattagcggtgaccgtcactgttgttggtaacaggaaaggtatgttttgtctaaactaggactggagttaggaatcaagaaacagactcattaacctttgattaatcaagggagcacgaagctggatgcaaggggagtcctagttagtgctttcctcacgttcatgaccaggttatgaagtctcacgagg

SEQ ID NO: 26913 - DNA, 1540 bp, Bovine  19866881077539
tttaatctgttttgtgtagtaagaagttaggttaaaaaaagaggttaagtgagttttaggatccttttcaaactttttagagtttgagttccattgcattttttttttttcctttttgactgggtcatatcagttagtatggctacttaagagagtggcagtgttgtgggtatttttgtggtaaaatgcacttacagcgtactgtcttaaccattcttaagcgtgcagctcagtagtataaagtacatcgatattgtgcagtcatcaacatcatttatctccagagctcttttcatctcacacttaccttgtacttattaaatgacttgctgttccttactccctttcagcccctggaaaccatcattctcctttctgtttctatgaagttggaactcatccagtattttttgtgtgtgactggcttatttcacttagcataatgtccttaaagattcattcatgttgtagcacatgtcttcaaaatttctttccttttcatatccaagtaatattccattgtatgtatatgtcacattctgtttatctgttgatggatacttgggttgcttccactttctgtctcttgtggataatgttaaacactgtcttttaaacataggttaagacattgtctttaattgaaggggtaaaagcaagttgaatagagacacttaggttttcacccagtctttgcccagttttaaaaacagaacccgtatctaattactgtaaattatcagaatatttacttactttttttctctgttaaactttagattttggtcctaaaaaccgattctcaggatcttgttgcttccttcagagtaacaactggaacaagcaataccacagccattaagtcaatagagtttgcccggaaggggaggtgagtacccggaaggggaggtgagtgcccggaaggggaggtgaatgtggcctgtctctttagagacagtcttaaaagtgagcagaacgcagaatacattgagagtcatagtttttgtgtgtattatacttaaactttttaagagtttatttaaaaaatatttgtagaaacggttactgtctggttcttaagtttgtaaaatttactgcattgagccagcagacacatcttaccggagtttcacaggcagttgctttacagaaaagatgtctgagtggtctgtgcttagaaccaaaatgcctggcacatggtaagcactgggcagagatgagctatttattatattgtaatcagaattgataccgcagaattcacatagtaattgaatatgcagtttacttacgtgaaacttatttatcctcttactttcagatgttttcctagtaagtttggttacccaactagaagtagatatcaacagaaacaagaagaaaataggttgtcaataagagaaattgtcagtaagagaagtgatggtcactttagtttgtatagaaatcactgttcacacttagaagacattcatgttcaatttctcttgaattcagaaaaagtgaagtctgtaagaaagtggtaaaataagttgtattt

SEQ ID NO: 26914 - DNA, 2681 bp, Bovine  19866881192071
attcctgggttgggaagatcccctggagaagggaaaggctatccactccgtattcttgcttggagaattccatggactttatagtccatgggatcacaaagagtcggacacgactgagcgactttcacttgccttcacagcattcctttgaatctaaggcaaagggagcaagggctccacacgccccctggtggggctgctccagggccagcgacccagcgctgggactgggcctgtctggggagccctcactgaccttaacccccggctcctcagccctgattatcataccaaaccctcccagacaccatagctctctttcatcctgaaaaggcctctttcctcgtgcagaaagtacctcctccatagctaactttttccttcatcattctcttttcctccagttagatgtcccttctcgcatcttttcagtccctcttttttctctctcatccaactctttcctgaaactctgttgaagtttttctctccctttccctttcctgttcctttgaaagcgccctccctccttttcccattttcctttcttgtcttgtatttcaggatagaacagttcgacatctagcagctagtgcgctagtatgagctccgtactgtgctgggggcagtaaatttcaggaagtctgtacagtgtctatgccccactagtgcccgactctcctttctccatcgtctgctgctagaacctttctcaacacttcatgtgttacctcggctccctaaaccatatgaaggaaaatacaaacagaagctagaatgaaacctctccccctcccagcacctgccatgaggtggacagcggctcaggaccggggtaagagtgcaggctggtgtggactgtggctttcctctgcggtgtccctactctgcatggctaggtgctcaatgaatgtgaaagtgaactcattcacatttcatgctttttcctctacttcttcctacccttaaattctgtacttgaatagactttctacatgccttctagtgatgaggttccttctcaacttgttatcatctccgtaactacctggatttagagaatttatatttgtcatgactataacatcacatgagctcatcgttgcaaatttggaaatggtagaaaattgcaaagaaaaggaaatcttcccataattccaccacatatagataaccaccattattaacattttgttatacttcattccgtttctttcctatacatatgtgtatttttaataaggttttcacagatgtatcataattggaatatgttatgtagggtagggccatactgcaacaataaagattactcaaattttcctatgttttaacacattagaagtgatttgttgctcctgtaacagtcttcgctgattatttagctttgtgtggtggctttgctgcagagagtccttaaagtctggagctccttccattgtgtggttctgctttctccttaaggccttgttattgtcttcagttctcaaaaagagaaacagagcgtgaagcagacacacccaccgtggttccgagtagcgcacaccacttgtccactcatgttccactggtgggtcccttggtcacgtgtccccacctaacgtctggggaggctgggagatgtagtccagccacacacttggctacaatccacttctgttaaaagagggactacttaacagccggtgatgcttcccacagcttccgtaagctccctggggactgctcactgtgaaggcctgtgctctcacacctcactttccttacacaggcatgcaccctcctctgcgggtgctgccccagcgattagagctcccttacccgtcctaacaaccctaagctgccctggcgattgtcactcatctgtgctctcacatgtcacacggtggggttagatgactcggtcgtctcattgagactgtgggtttcttgagggcagcatcttaaacacaaattcagaagttaataattttgttgttgagttctgttgtaaaataggtacttaagatgaatttgctaagcaagacaggaaatagataggagaaaaagtgtggacacggccagaactgcagaggcatcagaaatgagcccacctgatggagcatgtgcgaagagagctgtgtggggatggtctcagggctgcgggtgggagcattgctagaacggaggccggggcagatcccttcatcagggctctcttaaagtgactcctcacgcgtcatttttaaggagacgtgttggtgtgatggctatttagacaacaacacaaaacatcagagaaaaccaggggagacagtcttgaaaaaccgagagaaagtggcgcacgggcctcccggtccctaccagtcacccgcacaggcctcacctccgctcgggctttgctccccaggcccggccctgaccagccagggtggtagcctctgtgcgcagctgctttcctagagtttagaagctggctgtgcttctgggttctgactctgcctgaggtttcacattggagtggtggcagcaggtcaaagtggaaatgggtgtagaagatgtaggtctgataaacgaagtcttttctttcgagctgcttggatgtgaatggaggggacagggtacagcagaagcaggaaagggatatgagttcagtaaagggcttttgcaggaggtgaggaagctggggtaatcttgttttt

SEQ ID NO: 26915 - DNA, 949 bp, Bovine  19866881215150
acacaacttagcaactaaaaacaacacaagtatcattcaaactttctgtgctttttcttctaatgtcttctctaaggcttacaactcgccattgagcctacaaaaaaactatttcaaattttttctgataagactataaactctttattatgttatgctatgtattaacctctcttgcacagcctctccagaggcattatttggaagggggtttgtctcttctgcttgactggcaatacttttattttacaaatatgtacagggcacgtgctacatgtcaggcaccaataagggttttccaaataccacttatttagtcttcataatgccctatgaaaacagtactattcttatccatcattttccaactgaggaaattgaagcccaggaacttcatgttattattgaacatttaataatgttcttattaaacagcaaatttatgagctagtagccatgaaattaaaagacacttactccttggaaggaaagttataaccaacctagatagcatattcaaaagcagagacattactttgccaacaaaggtccgtcttagtcaaggctatggtttttccaatggtcatgtatggatgtgagagttggactgtgaagaaagctgagcgccaaagaattgatgtttttgaactgtggtgttggagaagactcttgagagtcccttggactgcaaggagatccaaccagtccattgtaaaggagatcaaaaaaaaaagtttccttgattttttatttgaattgtgttgttgctgctttgattatggacggttttatttagtccttgcatagattcccccaccccagtataaaataagcttgttcagagacaccccggtttgtttttgtctctggaagcccgtacaggtaaagcaatataaactaataatgattctttgctggagaccaaatgaaactagctatcttcataaac

SEQ ID NO: 26916 - DNA, 895 bp, Bovine  19866881225422
atgcaggagacgctggagatacggggttcagttcctgggttggaaagatccccggagaagggcgaggcaacccactccagtatttcttgcctggagaatcccatggacagaggagcctggccggctacagtccatagggtcacaaagagtcagacgtgactgaagcaacttagcacaggacacagtgtgctaataaattgaaaaatcagtgaaatttaacatttcctttttatctgtatttgcttcctcagcgtttactaatgcagttttctttctatctgctgttacaggatatttttctctcaaacaacctggctttcctacagatgttcatagaaaaaaaggttatttaaggaatatttttaagacactgtaaggaatatccttactctgatttttttcttttttttaaagaaagcaccagtggcagagagtcgtttcactgttgcactgtgggggttaaagaatgaatttggagattttagtactcggccaaatatgtgaaacttgaacataagtagcaattggactattctctttcatgatggttgacttcacagttgtgaactttgtaaagaggtgttaaagataattccatttgctttattggtttgttcaggtattttaacaagaaggtttgtgttcacatgttttaaaaaacctatcagtgtttccaccatgcacttctgtttttaggggtttataactttaagtcttaacattcctagtaacgtgtgctttcctcgcgaagactagggggaagggtcttttaaaactttagccttagtattttatgtaatagtctctttaatatattaatctgcactaacggtttctgtgatatatgcacatcctttagagtaatcacatcctctaggttatttgtgtgcatttg

SEQ ID NO: 26917 - DNA, 1428 bp, Bovine  19866881238714
tttttctcttaagacagttgtttgccctttgtaatcataaggcagttgtggcagagtaaggaactggccctgccttctgcagaaagggctccatcctttgccctttatcacacagatttttagaagcctgggaagtgggtctcaagaaggaagagactcatgtgatagcagagggtgagaaggcccagggaagaggaatatatcctctgggatcagagacaagataaatgcttggatcaacacacacccccacagaggtatatttagtaaactttgcttctcatagagcttgaaagatcaaaattgctttttaaaaaataatagaaaggaaacagccactgtggtttcttttgacatcagtccaatttcttggctgtcacaatacttccaaataacatgtgtaagacctctctgggctgtctctttccccctaaaatccaaggcaaaaaacaacaacaaaagtctgctgtttcagctgcatgacaatgtgtggccagaggcttcctgagagctctaacagtcctctatactttatcggacctgatgttttcccagcaaggacaaaatggcgttatgcaaatataatatgggctaatggtgtcaacccaggccaacagcctgaactagtgggttcactatgtaatggtcctgggtagtctttgaaatccacctggccagcatttacaacaacaaaaaatacaggccgttgcagtcttccccatgggatccgatgctgtaaggtaacgcttccctatggccctgagcgctttctcatggactcgccagtcctctaattctcctgcacccacacttttttcttccaggtatagctcagaggagaaagtacgtcatctcctacgcaagattaacctttccatctattgttttgatcccattttacatttaagacagtctctagttattctctccataatcagttttattgaaattaacttacatatagtgaaatgcatccgttttagcaaatgggtgagttttgacaaaagaatatacctggttaagcactagtcccacaaatcaagatataaaacagtgttgcctccccaaaagctgcctcctgcagtcagttccccagcaaccactgctgaaagccggcagacctgcttctgtcaccgtagattagttctggctgtagtagaatttcataaacggtgtcatacggaattcagttttttcatgtttggcttcttttgctcaatataatatcttgagatgcaccctcttgtgtgtgtcagcggtttgctctttttattgctgagtagtattccctcatatagatatgctagtttatttatccatgtatctactgatggacatttggattttttcctggctgtataagctgtaaacatacttgtataatcttcatgtggacaggctttcatttctcttgggtaaatacctaga

SEQ ID NO: 26918 - DNA, 1722 bp, Bovine  19866881252699
taattttgttttttgtgtttatttgtttcagactgatctactctcgcccaccagccacagctcacctttccctagttctcttgaagctgagttcctattgaggataggatgagttcctatggaaccctggccaggaccctaccagacccatccctgtctacacaaagctgtgcttttctgctgagggtctgaggcaagctctgggcaggggtgggggagggggagggggctgggacctggggctgctgggccgcagctgtggctccaaattgctcggaggcccactgcctggtctgcaattcggcaggaaccacatcaaacaaatgggctctgatgcattaagtggggagggggaggctgaaataggcgcccccccagtgcagtgttgagcggcagaggctgccttgatgaggaggaccataacgaattcccagattccatcccttcaagggcagctgggcaagaggggatatagccttcactcttaataaagattggaggatgacgcactccctcccactgggtcagttaatccagctccacactagggatcagcatttctaatgggctgggaggcacagccttcagaagcgggggatgagggatgacagatattctggggtccctgggggctctggagggaggctggcctcgctttgtttggactcatttgaatcgaggtccgtgttcttcgagtaagacagtcgtttcatctctctacttctgtgctcttgagtgaaggctcctgctctaaaagtgggccagtggaccccccccccaaagtatccaagtccaaaatccaaaatatccaaaagggtgacacaaaagtttcaaattcacctggctacttctttccttcaaaggcacagctgtgtcattcattcatccatatgcattctgtccttactgtgtgccaggctggcctgcagatatagaggtggaaaaaatgatattaattcaggctgttcatcttttagtgaaagaagcagaaaataagtgttatatgccaagcccctgggagagacccgaaataggtgttctgggggcatagagagggaatcttaacgagactgcactgtgcgtgcgtgtgtgcacatgtgtgcgtgtgtgtgtgtgtgtgtgcgcgcgcacgtgtgcatgtgtactcgtgtggccatagcagaatcagggagaactttccgagacagtgtcccctgcacatcttgttaaagacatgtgacccagcacggaggccacagcctgactttcaggagctgagatgatctgtaggggaaaaggtggttagagagatttgggaaggacaaaagagcctggaattaggtgtttcaaggcctggttgtgagcatcagattatgcattatccggttggacaggtgtctgtaaagttgagaggagagtatttcaagcctgccaacttttgatgataatttatttattgaatccacagttattgagcccgttgtcctggacattgtcacattgcttttgcttacctggtcgtctctcttgatagtctgagtttcctgaggactggaaatctatcctactgattttatgtcattaactggtccagaaaaagttattaataggtgctttttgaggggaattaaattgccaaaatggagaagtctgagaaattgcatgtcaaaggcgctagaaatcgcttgaaaggctaaaatttagggtatatgtaagaatcgtaaaagaaaaaaagactgcaga

SEQ ID NO: 26919 - DNA, 3567 bp, Bovine  19866881330055
tagaaaggagccctgcatcatcgctgcaacagccttgaggcagccccgctacagctgccccaggggagcccgtatccatagcaaccagcatttgtgagttgccatccctggagggagggcaggcagcatcagtcttgctgtttattctgagtggaaacaggcttttctcctgctggtttgggaagtgctccattcctgacagaggtatcctcacacacttcggtctgtttcccctctctgtcagcaaggtgtagtggagatgatatactgattcaaaggtaggatgttctcccggtttctacttgaagctgatcgtgcataaaatcttgcttctgtgttacctgggagctcggagtaggggcaactagaaaaaaacaaatcacgcagctggtaggaacctgagatgtcccgcccccctgcctctgagccagatggcacctcacctgatctcatggcaaaatcaaaaacacatcttctttttaaatgaatgaaaaatgaaaatgaaaaaattaaaacactcataataaatgctttgcttaaaaggtattccagcctgggactctcatttcaatgtctcatattccttttaggccaggcaggcagaggttctacgtttatcttacaccataggttacaggttaaacatgagtaggggtgagaggcttcctaggatgaatgcaaaagacagtcacaggttttcttttaaaatatttaaataatttggtgcccctttctacagagataccaaccaatctgaccctagaaaatatattcaaactcagaaagcaggcttccatgcgaaagaaactgggcacaccaagccaccttcaccccagaaagagagtgacgtcgccaccagctcccgtgaacaggggccacagcccaccacaagagtcccagccacctgacagctggactacataagccggggcagaaactgccccttcctcacactaaaaaccacgtctctcattccccagctcttgtcccttgaaagatggcaaatcttttttttcttttaaaacacacacagaacaaacctagcccgctgtcttttctctatcgctttctgcagcctctagaacgcactcttaaattccagtcttgactcttcccctcctcccaaagaaatgccctggctttgaaatacaaggaatcccacaatcctctgtaaagttgagagaaaaaatgtaccgtttggctgccccagtcctttgagaaggcacacctggtggcgcttatgtgagcccattcctgcagccccagagatggcccctggtcccctccaccccccatcacctgtgctctcccctcccgacactcgttctgctcagacaggacagcaagaacacacacctctgccagcggcgggacgcgtgaccccagtttccccatctacaaaatagacacaaactgtacccatcttacagattgctttggggggtataatcagacaattatgtcaagcgtctagcacatacatatgtgaattgttattatcagctgttacattagttgctaataatagctgctatttttgtgggccacaaatttttccagagcagatatcaacattacatagttggattcccacgctcagtgtctggcgcatggtggatattaaaaaaaaaaaaaattaaaatgtctgttaaataaatctagttgaagaggccataagcttatttcctattggttcccactccatattagactgccttggctgttcccctaaggggatggttatcctcacataacctctcctcctactcagaaaaattccagtaaaatcaaacggaaggaggaaaacgctttaagagcgggaagtctctctgcatatcacctcgccaggactcaccaggcctctcaaaagatcggtcccctccccctgcctcctggatgctgttcagtaaccagctgaataatgaaccatcagaggggattccaactgatggcaattaacactcttccagctgggaagagagttaacttcacggtgcccagatctgccgactccccttccctcttccagaaaacgccagctgctaccactccacacgggaggaccccacagatcagaaagaagaacctggtcaatgaagcaagactggtgatggagacatgggcaccatgagactgttctctctactcttgtatattgtgaaaaataaacaaaaccctgattaataattccttcttttgcataactaggagaaggaaatggcaactcactctagtattcttgcctggagaatctcatggacagaggagcctggtgggctgctgtccatagggtcacacagagtcagacacgactgaagcgacttagcatgcatgcatgcactggagaagggaatggcaacccactccagcagtcttgcctggagaatcccagggagcggggagcctggtgggctgccgtctatggggtcgcacagagtcagacacaactgaagcgacttagcagcagcagcagcagcagggcaaagaagcccaaagggttactctttccaaatcacaggtggaacaccaggcctggatttatattgtaaaagaaaagatctggaaaatatctctggcatttgaaagatcagtatggcatttaggtggtatatagaaagagtgttggcctctgagcttgggcaagtaacccaagccctctgagcctctcctccgcttccttacccttaaaacttaggctttgtccccacgtcacagggctacccagtgaggcaaaggaagtgaagcttccagtactgtgaaagcacctccaaaggtacctagcacatagtagatgctggataaaatttagtttattttcttcccttaatgaaacaaagctgttctattgtattcttaagaagcttatggaatcaaactccagaagttagctggtggccaagagtaactaagacacattagtaactaagacacaaaagaatgcttctaaggaaaggaactcaactctactgcctgggaaacctgagctcccaatacccatccaagactgaagtgtgtgaatagcgtcacttgtcacaggcactaagccaggagggatagggcggcaggctaagaaggagaagggcattcctctcccaggcctcgggcagcagcaggtttaagcaagaggagatgctagaagggtttgctgagcatttaaataccatgaagaccagaccgatatttgtacacaaatgttcataacattagcattatccacaatagccaaaatgcagaaacaacccagatagccactgacagatggataaacaaaatgtactatttatacaatgaaataacattcagttttttaaaggaacggaattctgatacttgctacaacatggataaccctggaagacattatgctaaatgaaataaaccagatacaggaacactgattccctaacacgaggttactagagtagccagattcatagagacaggaagtaggatggtggttaccagaggaggggggcccacggggagttagtgtctaacgggtaccgagttccggtcaggcaggacggaaggttctggacacaaatggatggtgtctgcacacaaagt

SEQ ID NO: 26920 - DNA, 445 bp, Bovine  19866881351926
cagcagcaatggaggcctagtgaaatagaccctgactctcccatcacacttgatgccttgcatctcttgatttctgctttgaaactaatcaactcccttgctacctctggtgtccattctcattaccatattcagaagtcagatgatatcatgtatctttcttaatttttgatgagtgtggaaaatacatcccagtgtatgagaccccagggtaaagggattttatgttaccagagtagtaacagctttctagatgctggaggctgccttactatatttcacttataagcccaatatgcaacttgggcaaaagaacataggcagttttctgcatttgctagcagctttatttaaaggtgggatattgcttgcaaaagtaggccatttggagacgtgcaaggaatacaccactaatcacctgccagcatctttcttgcttatacca

SEQ ID NO: 26921 - DNA, 627 bp, Bovine  19866881555765
tgagatcaagctcatttcccaaattccttgttggccattgctttcagattcttgctgttttgcctttgaattaaacatctgattccgagatgcaggaggagtggggccagataatgtgagtttagggctaccggaagccctaaaccaaaagtcactgtattttttaaagattctaaagttgtattagctttctcttggcttggctttaagaatagccaagcttttaaatgaactctttggtgagagcatttctttctccaaagaaattaattctcacgttaatgttttatagtatcttttccccagtgggctggggaccaggtttgcaggtttctgggttgatgtcttgctgcataatgctgcaagtgacatcaattggccatggtgccctaaaataggtctgttcctcaaagctctggtagtctgagtggaagaagagggagaggttaacagaacaaaatcctgtggcacaacttgcttatgagcagttttgtggctagcacttaacagccataggaaataaatgttatatatagacctttgcctgggggtggaaagtagatagacagaaaatcattaggtaatttaagtgctaaattggatagagtttttagtatccaatcactt

SEQ ID NO: 26922 - DNA, 1152 bp, Bovine  19866881601612
ccctgctcctctctcctcttccgccgcctctcctcccctcctcccctcctttctctggctccctcctcccttccttcccctcctgcttccatctgcactctcttttctgtccctcagcccctccttgctcctcttcggcgtccatgccggatgccccccgcctcctttcagcccagccagcagtgcctcgtcccccgacagaggcagggatgcctgagcaggctctggccctgtggttacttggctcgcccttactgcaccctgggcccatgcctgtcctctccctcagccagattcggatctgactggagttgagggcgggcccaggcgtagatggtgtgtaaagtcccccaggtgttgggaatatgcagctggggctgagaacgttgatctgagcctccccccaggctctcttctgtaccagcttcggtctcggggcagggtgcacgtgggtaccagctgggtctgccgatcatctggtttcctggaggggcataatcctacagcaggcacgggctcctgggtgccctcctccctctggagacagttcaggggagcccagggcacttgggtgagtgcaggcatcgctctgggttggagacagagctggaagcttgagaagacctgccttcaggggtgggccgtgctgcgccctaattcaggaggggagcgcagaggacctgggggatccaagcacagtgaatacggaggggccccctagtgccgcccgtgtcctgccccctcctcaacctcctcaagctcctcgagtgctcagcatggcaggaagaccctgtccctcccacagcactgcagtgagcccccgtcccctaggaggggctgcagctgcccactcagacccactgtccccaccccagggagcagatggacaggcagtgcctgccacccccgcctccccacctcactgtctcccctccaccttcctccaacccctcccgcttcctttgcagaatgaagaaggaggaggattccctgaccatcttcggcgtggccgagcgggaccagggcagctacacgtgcgttgccagcactgagctggaccaagacctggccaaagcctacctgaccgtcctcggtaaccgccgctgcacgccctgccgcggccccaccccgcctccctgccctgaccgtcct

SEQ ID NO: 26923 - DNA, 704 bp, Bovine  19866881619988
taacatgaagatggtaacggtccctctctcgtggggctgttgtgagatgtaaacctgcacccaatcaattctttcttcccttctccgcaggtcctgttacaagccaaagcctgtctccttgcagagagtcagacaagactcagctaggggtttcccctggcaccccagcccccggggcccctcttctgcaggcccctctgctctgctaacctaaagggtctgcggctttcctggggggctctggtggccaagcagcgtgacagagggggcccaggggcagcccagcccactccttgccccattcagtccctcctcctccctgccagtgacaagccgctgccctgcaggtaggacaagcatccctgcgcccggaggactgaatgcagaagctggaaacagctctccctcacagactgtgtgggcagcttctgaaaaaccaaagttcaaacccgccccactttctcttgggaggcgcagcacccagacagggagagctcagccagcagagaaacccccttcctgccccagtgccgcaggctctcctttctgaccccacccgtacccgggcagacacagtctcccgaagcactgcaggaacgcttggcgggccctgacctcactctgcccctaaggtgcagaagtcatttccttctactgggcctcagtttcctcctctgcaaaatgggaataaagtgaatgcttgc

SEQ ID NO: 26924 - DNA, 1109 bp, Bovine  19866881660980
gttggagaattttgaccttactttactagcgtgtgagatgagtgcaattgtgtggtagtttgagcattctttggcattgcctttctttgggattggaatgataactgaccttttccagtcctgtggccactgctgagttttccggatttgctgacatattgagtgcagcactttcactgagccgtattttgagaagggttctagatcagaacttctgaaatcagctccagggaaatgacaggagccgtaaacactgacacgcaggaaagttgctcagctaggttcaagacctactttccaggtacttagagatctgtgtgaggattgttggatagtgctccctctttccactacagtttgaggatggggaatgttctcatgaccagaatgacatccattcacctttgctccagcatcctaaccctcacctccattaaaccacctccctgcagagcttgattcatgagaaatggggtaggcaggaggatgatatgaaatattttcttctggctaaaatatatagagcatgtttttttggggggaagcatattctttatgtcaagcattgtatttggcatatattaatagatacatactaagccagttggaatatgttttggaactcaggtttcagaatcttccagaaaccctccacgaagataacatagacaaaggaaagggtattattgataggttttcaattctccatctttcttcatgcagatcagcccagaaagataaaaatacaacatgttacaaggtcataggctgggcaagcaaagaaattaaccaaaaaggagttccaccagaatggcaggtaacatagtgaaaaaagcatcaaaaacatttagatatggaaaagcattaccaatcttccggtcttattgatgataaatgaattgcagcaaaacaatgttcagggcttcttctggaaagctttgagtcagttactctaaaaaacttctggaaactttgttcttctactcggcagtaaaacagatgacctccgtttgggcttatactaaatttcttttaattgattgtttttccttccatgctctgcaccctaacagccaggaatgccactgatgaaatatttagcattggaa

SEQ ID NO: 26925 - DNA, 868 bp, Bovine  19866881809370
ttcctcttatgagcctttttctgcctaaattaaatagctttgaaatccctgactacttaactgtctctaaagaataagaatatttaagtctttgattttaatcatctctaatctgagtgtctgtttacgaatcttccctgttatgtgactgagaatctttctgacatcacagctgtttcctagcaaccttgacccaagcggattatgagctccttccgtgtttcgtggggtggagggactagactgagaggcagggagatttaggtattctctcccccagaatatatcttttgttaccttgggaaggaagagtgcctaaaagtgagaaactgtatttaatattgcctatcttgctaagcattgattctagaagacctcgtggcccttgccttcgtgaattttcatttctctttaaaattccttacacatgaagagtgtttcacactttacaaagtgttctcatgtacagtttatcatacgatgctcaaagtgaccttcctgaaataggcaagcagttgttaatttacaaaggagaaaacaaatttaggaagaggaagtcacttgcatcttagtccagagtccttaatccttttaatagaaggtttaggagcatttaaaggtgatgatagcttaattcaaattaatcctctctttttagagttagtatttgatttcttatttggtcagatttaacggggattttggaacgtttgaattcagatcccacaatttgggaagggtgaggaacagtatagccctcagtgggcatttgaggttatttggaaattcacttcagcttctgaagccttttcatctgtcttcccaagaggcggatttaaattcattaaaaagatgtgaaaagagtgaa

SEQ ID NO: 26926 - DNA, 1331 bp, Bovine  19866881881491
tggacagcctttgccaacccagcccagctgaagtgagctacggtgaaaaatccccccaatctctgtctcctgccaccctccaaactcccactggtacagctgaacccaatgggaaaccccagagaaaaaggtgtggcccacagagctgggtggagaggtaagagtggatgtggaggggcgaggaagcactcggtgcaatccctgccatgcaccccacatgagcggcacagagcagcggtgcccgcagctgctcacaggctagaggggaacggcctccatcagcgggccaataaacagcaacagaaataccgactactttcgtgctcacaacaaacacttattaaaaattcaccatgagctagtcatagagtaagttcccacaacttttttaaaactggcatcacatggaccatgctctctgcccacaatgtaattgctataaatcattaacaaagaaggaatttatcctcatagtcagaaacttaaaaacatgcctctgtaaaacttggggcaaagaagaaatcacaatggcaattagaaaacagttaaaactgaatgatgacaaaaatgttacagattaaaatttatgggatacagcaatagtttgtatttaaagggagattctgaacataaatgcttacattagaaaagaagaaaagttgaaaattcataagctaagcatccaacttaagaagatgggggatggataatagaaaaaccctaaaaaggagaacaaaaaagacaattaagacgagcagaaattaatgaaacagaaaacagagatacaatggggaaacaaccaaaccaaaaggcggctctctgagaaaaagcaaacggctcagctgcagtacgtgtgcacgtcagaaggatgcactgcagtaaagacggatgtgctacagtgacagcagattagcttgggtgaaatcagaggcttgcgagtgaaaataaaaagctacagaaggttaaatacaggtaacaccatttttgtaaagctcaagaacacgtaaaaccaagttatgtattactcagggtgtatctgggaaaaaatttttttaaagcaagagaatgagaagcacaatcaggactggcatctgggaagagcccagaggggcctcaagaccatggggaatgttctggtccacaaatttaaaaggatgcttgtaaatatgactttttgcaggtatctaataataatttttaaaaactgtaagcaaatcctggtcagtagaatgtctcagactaactctgcatcgtttctctacgtgtcagtatgggaaccgtctcatcctctgctgccctcttcttttgcccttcagtctttcccagcatca

SEQ ID NO: 26927 - DNA, 1156 bp, Bovine  19866881916575
aaactgttcccaactttctggggcagtgctgtatccccagtgtctagcatatggtggaagttcagcacgaatttgccagacgactaagttaaatgtgtgcctgatttgcctcctttgtttctcctggatttcagtttatgaacatcctaagctgcatgtaagcagcagtcttccacttcttctcacagccctactgtgtttctgccctgcaggggctgatgccgcagaggacgaggaagtagatgtcaccagcgtggaccctatcgcggccttctgtagcaggtgagctggaggccaggcctcagggtgcgcctcctcttcagtctctgggtgtgctgctcagtccccactgttcctcagtcccgtctgcctttaggctcaaagagttaactcctgtgatgtgcaagaggtcccttccattctcccttgatagaaaatcttaaggaagtgaagtaattaattttatgccatttatttttactactcattttatcatattgtctgattttcttttatccatcttggcttttgtgaaattttaggtccgtacctgttgcttatggttagatgattctgccctagaggaagggttcatggtttaagcaactttctcctcttttttcctatcccttttctgatcctgttccaaatagtgatgaagaactggaagattcaaaggctctattatatttacccattgcccctgaggtagaagacccagaagaaaatccttatggccccccaccggatgcagtccaaacctccctgatggacgaaggggctagctcagagaagaagaggcagtcttcagcagacgggtcccagccacctaagaagaaacccaaaacaaccaatattgaactgcaaggagtaccaaatgatggtaagggccgcatttcctctctctcacctgatagacccactctccagcacaacctgtaatatcctttctggctgatattcccttaaaggaagttttccatgagtcttttttgtagtgttttacagctttgtaacaattttatctgctttcacttctcttttaaaatgggggagattctgccctcagtacttttcctacgataacacgctttaagtcttctgacgtcggatcagttgtttaagtaccaggcttcctcacctctcctcccacatt

SEQ ID NO: 26928 - DNA, 868 bp, Bovine  19866880280207
agaaagaagtgagactgaatcttgtctactgtgtctcttcttgaaaatgctgtttttcgcgaattctgcttaatgttatgtgacagcttggatggaaaggaagtttggggcagaatggatacatgtatatgcatggctgagtctctttgctgtccacctgaaactatcacaacattattaatcagctatactccaattcaaagtttttttgaaagtaatttttaacaatgctgttttgaaattttattttcttataacttaagtgcaataaaatgtgcttttttcatgttaaaataaataaataaaaatgctgttttacgggacttccttgaagagtgggtaagagtggtaagagtgggtaagactctgtactcccaagcatagcacatcaggtaactagatcccacatgccacaactacaacctctgttcagttaagttcagtcgctcagtcgtgtcagactctttgctaccccataaacagcagcatgccaggcctccctgtccatcaccaactcccggagttcactcaaactcacattcaacgagtccatgaatccatccagccatctcatcctctgttgtccccttctcctcctgcccccaatccctcccagtatcagggacttttccaatgagtcaactcttcacatgaggtgtccaaagtattggactttcagctttagcatcattccttccaaagaacacccaggactgatctcctttagaatggactggttggatctccttgctgtcaaagggactctcaagaatcttgtccaacaccacggttcaaaagcatcaattcttcggcactcagctttcttcgcagtccaactctcatatccatacagaccacggacaaacca

SEQ ID NO: 26929 - DNA, 1269 bp, Bovine  19866880361642
atgaactttctcattttcaggattggtttgtctgttttccaactcaaagtccattgcattcagagtctgccatttcactgagcttacaaaccaaatttcctggaggcactggtgtgggtggcaagtccacccagctacccggcagccacatggcaccctgtttggttgtttatttactgatatctggggaaagattatgaattggggattcctaaaggcctcataacataaactttattgtttttcaaattttgcaagaagtatggaagggtaaaatcagcaaccaaacccaacccacagccaaaggaccgtgaggtcttgaatataaaatactgggagtttgggggcacttgacatgggcttgtgtcatgggtgcaaatgtcctaatgagatttttccgctcctctggtaatgattttggatggggccccagaaccaaattctattaaatatacattatggcgaatcgggctgtagggagaatccagtggattgatttataaatctgagcaaagtgatgggcctgttagacaggaggcagagagagggggtgaagtcccaagagtgagctgtgagatgattctacattattagctcagacatttgctccagaaagtctctctctctttctctcccacggttctgtttccgacatataaacaagacctcgaaattttaaacagatgaaatacctctgggcagagtttgctttactgatattggatgcattctgttcatagtgagcagctgggtgttgatctgattagctgagagctagaaaagtgaagactcacccttcttccgcctcctgagtactgggaaccacttatgatttctacaaagtaagttaacctcggctgatgagagagctttccttttcgggttttgcctttgagcaacttcaaacttaacctgaggacaatttaaattatttattgctcaaaattaatttattgaatagcttaggcactatgagaataaaaaaaaaaggtgtaaaactattatgaaagtctactagggttctgttaaaaacatcacgtatgtccaagggtccataatggaaaacagagatatttggacaatcgaatgaaaagtcattccaaagggacatttaacaatatggggaaaaattagttgtcagattgaattttcttcttttctgtcaggtccatggggtctcacccagtagggctcagtagggtggggtaaggcaagatgtttctctgtgagggacttagttgattgaaggattttttttttttttttttt

SEQ ID NO: 26930 - DNA, 3864 bp, Bovine  19866880459081
ctggagtgagttgcccttccttctccggggatcttcccgacccaggggataaacccgcatctcctgcattgccaggcagattctttaccgctgagccatctgggaagcccgagtagaaaagcagctaaactcttcttagttagaagcgctggagaaactgagaaaggaagaccatttcaaataagccaaaatgtaatgctgtgtttggtgttaaataaatcccttacttagaacgtggaggcatataagttttactaatacaaaatcggaatttctcccttctaaatgaatgtggaacaacatttaaggaaacattttgggaagtgccaaagtattaacttgttctgacctcatcttcagcttgatcctggggcctcccccagacctcctcagccacccccaacaccgagggaggcaaggccgagggcagagccagaacagggtatgtggaagagtccaaccccagcaaggagctatgttaaccatgaccacagctcagcatcaggcaagaatctcagcattagacaaggtgggattgaaaacagtcaaggcctagtttcaattcaccccgagatgttcacatttcttttaaatgacattatcgtacatttaattaaaatctattgtcttctgtagacttgtaggtaactgaccagccattatactgctagcaactagttaattcttctactttatctcaatttagttttattttttataatgttttaaaatctcaatctttgaaaaaaatatgtacttttaaaatttatttgactgtcctgggtcttaatcttacgtcttagttgcagcatgtgggatctactttcctgaccagggatcgagccttggcctcctgcgctgggagcacagggtcttagacactgaaccaccagggaagtctcggttttgtttttaaatataggttaactcaacatcttttccgtttaaatggcaatacatgactattttcaagaatgtacaaaaaacagaattgtatatgtaagaccagaaaaatcgcctacaatctcaccaccagaggtgaagacagttaatcatgggtacgcttccttccagtcctttattccctgctaagcacggacgcggtttccttttctgaacacatttgtttctgtacagagctggggttgcgctgctctctggcctgactcagctccttaacctcgtgttgtcacatcttcttttctgccctgtaccagtgcgggtcctccaggaaacaggtttccctctgacctcccgaggattgatgaagggactcggaggcatgctgacctaaacggagtgccaggaagcggtcctccggataaggctgcaggaggggcagtcagggaccaggaggagagagggcgggagggggtggcaggagccccccgacacagtggaagctgcccaggaatcaaagccctgactccactctcctcctactgtgcccacactggacaaacccagagggagggcaagggcaggccgcctggagggtgcagagtgatccggagggcaaaagaagagaagccacaattcgtatcatcatatatgctgtaagtacactttcaaaataagaatgcctagtattcctctataggaaagtatcataaattatttatcacagtccctgtggattctttctgaattttttttttttactattacaactagaaccacagtaaccattcttatacatacatttctggctgcatctctgagtattttctcaggataaactcccaggggtggaattactgagtcaggggaatctatatgtttaaggctttttatatatattgccaaatagccctcccaaaggctattacaccgatttaaatgcccacatgcaatgcatatagagtcctcatcaggggagaacctgccagttaatctagcatgtgccatctaaacgcaccacttctgcctggagacctggctccagctgcctggttgaaggggacactagaggaagaaggagctagcctgagcctgccccggggatcatgtctgtgaaaggtcgcacctcccgggccgggaaaaccgaccggttgtcaagacaggagaaggcttcagagtcggttcactcaagggtcagcgggggtgtctgacagcgggaaaggaggtgatggatattgactgggagtttcgtttcatctgacctcatttccctctggccgaatgtgtagtaaacaaggtgggctgtcatacaaggtgcccgctggagttttctccttggggaatagtttcacaggccaagagaaggtcacggcaggggccgggtgcaaatgagaagccctgacggtttggacatgagggagagaggaggagcgcagggggacccagagctggagccatgaacccacctccgtacctgtgatcactgcccccatctgagtccctaactttaacggattggggcacggagatggggcaggtccctcactgaggaagcttcatggtggattctatttcccttcccccaaaggaatcaacaagcacctggggggccagagaccacccccttaatcacgcgccaaggaaagggggatcaagataaggctcccgccagataaacagcagggtaatggtatcgtaggcttccctggtggctccgtggtaaagaatctacctgccaatgcaggcgatgcagggtacacaggtttgatccctgaattggcaagatcccctggaggaggaaatggctacccactccagtatccttgcctgggaaatcccacagacagagcagcctggcaggctacagtccatggggtcgctaaagggtcagacacgacttagcggctaaacaacaataacagtggtctcgtaaacgaggctgcctgtaattgctccctggcagataaataacatgaatatttgatcagcaatttataaattcaatacaaagaaacaatagaccgagtccaagagggcatagacacataggtttatggtttattattgattgggaagaggagtcatattaataatagccaacttttagagcacactctgcccgtggtgctgagaaatgtacagacggtcagtaatttcatcctcctgacacccggagatgactagagtaacccatcctgtccccgcccggtggcccttgtcctgaagctgctcccaactgtctctgccgctctgacccctccctgggaggctcagaggaagggctgcagtgactagccagaccctgactgccagtcggatgcccgctcattctccattcaactagcaaatactcacaagcccagacgagttctggaaacagtgggaatagccatgaacaaaacagatagaatccctgctctcgggaagctatgcgggggagggagagagagatgatgctttgtcttttggcctcaggccctttgtacttggggttcccttgactgcaaggcttttctccgggcatctgactcagcagctcgcttgctgcactcaggtctccagtcagcgctgcctcctccaaccaggcttccttcccctccctgtctgaaacagagccctttcaactttctctcttttgctgtactttatttttctcctctcaccatcttgatatatatacacatgtgtttctgtgtaaacatttgcttgtttcttcgctgtctctcccactaaaaggttgacattctgagattctggcaggagggtgactcactcagtgttggcctcttgggtccagtggagcccatttcctgggtcccgattatctcttaagtgtaccacactgggtcaaggttcttggttgcaagcaacagaaactttgtctgttgggtggaagactgggaacacttcagtgggagacagaagggcctgggaaatacaggaaagcaaggaaccagaaccgga

SEQ ID NO: 26931 - DNA, 1095 bp, Bovine  19866880502099
tctggcctttaaaaacatttcacgtttaccactgagaaaaagatggccttgatttaaaaatgatacaagtacttcgaatgggcatgctttctgctctgggctgcaaacacaattaagaagcatctcctcagcaccaaatcacctcaataggatctctgccatcctggaggaacatcccagcctacttgcaaaaaagagaggaggatcgaatgtgttgaggattgaatgtgttgtattctgctgcaggggcttaggaggtttggttttcactggttctccttgtatttaacaccaggagtaaaaaaaatagggagtaaatatagcacacgtgcctcttatctcagcctgtgctcatggtgagtgtgaaaatgttatggcccacttatctggggagcagctccaatcacaccaacttcttataacttgacataagggatggagaaagatgcaccataccatcctcagacggagcactctaaatcagtgtctggtcacatttagaactcgggtactgaaaatggaatgcagctgtggcaaagagaagatgttgctctaatgatatacttgaagaaaatcagaaagggcaagtccccttctttaaaaagagaaaaagagagatttgatcaatgatgcatcaaaggaaggaaacaattaatgtcttggggaggagttccttttgctaaacttcctttgatagcttccttgagatggcatttccatttccgttggtgagatgggttgtcctttcttgcccaggatgggattatttcagccctgctgagtcagagaaacctcactgtacttctgctgaaggtatttgcagctggagggcttttggaattgacttgtgttatggtctgagctgtgtccccaccactccccccacaaaaataattcacatgttgaaggcctacccccatacctcagaatgtgactttctttgggaaaaggtcctttaaggaagtgattaagttaaaatgaggctgctagagtgggccataatccaatctgactggtgtccttacacgaagaggaactgtggactcagagagacacctgggtgtgcctacgcagagggaagacagtgtgagcaca

SEQ ID NO: 26932 - DNA, 867 bp, Bovine  19866880561471
ctcactgaagtccttctgaaagtaggacatatcattaagtgtttcatttccacagggcgcccctgttgggatccagggtttatagaaaatcagagcaacatgcagctgaggggacaatgaaggagagagaaaataatcagtagctcaaaagcagaaaagatagagcttaatctgctgacaacctttggatagattttatgtgtctctattttctccattgccttggaaaaactacttctctttaactctcctgaaatcccaagtttcctcacacaatatccattcttggcatttacttcttgccaaacactgagctaaaagctttccctgcattatctcacttaatcctcacactgaccctcactggtatgtatttgaattccagtgttacggatgagaaaacagctcagagtcagtatagaaggaaatgtgctaagaccacacaggcaagcattcaagctctggttgttctggctccaaaaattgtgcactcacaactgttctacagctagccagcaacaaggaacacaagagtaagttccaaaacttcctctagtcctttccagcatttggaagaactcaaaactgtttgcaccctttgcaggcagattctttaccatctgagccaccagggaagccttttgcatccttctgctccttcaaaattgagtcctttttggattcttttcaatagataagccttaaggtatatgaaagtctactatatatgtatcttttaaaatatttattttttattttggctatactgtgctttagttgtggtacatgggatcctttttttttttttttaagttgccacatgtgggatcgaacccaggccccctgattgggaacacagagtcttag

SEQ ID NO: 26933 - DNA, 3040 bp, Bovine  19866880592551
ttgcaggaaggcactaaatagcctcttaactggcacattgttgtcagtattattacggctttttcctcactcctgtctctggattatggtaatttttttagtcatgtattttaatcagagttgaagtctctgagctgctgacagctcaagagagctgtaactgctctaagattgacttcacactgtcacaaaatcataacacaaggagaaatctggagatcctcacaagcctcctcctgccaattaaaaccaaagcacctttctaaacagcgggcttcttgttcaggctgcacacacaagggagaaaggcacagggcaactccttcccccaactcctcctccctgcagagttcaacccagggaaacgctgatcctggcaagggcggtcctagaagcagacactgcaatttcactaatgtaactacaggaagccagaaatcattgctgtgacatgccgaggctcttacacagcatcaggctctgttgagttcctctggcctggcagggcctcctcccagatgttgttcacgatcactcatctgaacggccaccatggaccagagtgaatggggtagccatcttctttggaggtgatgagacggaggcagccagacccctggccttgccttcttgtcgtcacgtgtgtggaagtcccctactgaccaagtacaatgctgactgcaaagcacctagcattagggcatgtgtttggcagagatcactacatcttttttctgtcaccaatcttagacaaaccctaggtattgctctgctctgctttgagtcctctcttctccacgtgtaacctcgttctctttgctaggaccgtcattcttagaacccagtgaccatgatctaatttaggtttgtcctctacgccgagccaaaccttcatttgcccaaggtcctgttctcaagtaactaccatggacagttgacctgaagacatcaggcaggataaggtaagtgatgctgcaataataaacaatcccaaaatttcagtggccaaaacaagggtttctcaatcctgttgcccgtccatcacaggttgctaaaggactctgctccactgagttgagtgacccaggccaccatctcaaaagttgaaatcatcatgaaaggaaagaaggctctaaagtattttcctggtaattaaatacactggctcaacaattatcaatattacttctactctcaagtcattgaccagaattaaccatattgctccatccaaccagaaaggaagcaggaagtacaatctttttctgtgtatccgaagtatagagatatttggtgcattgcataaatgattaacacaccaattcatgagtgatcactaagaaagaaagtgaagattcacagagttcctctcccacttatactcactggtacgatgatgcttatgatggtcaaatcgccagtgctggacatgggcaatcagatcatgggcacaagggaaacctctcaattcagacttcatatttgtatgatttgccttcttgtcatcatatgtgtggcagtcctctcctgaccaatcaggcccagcgacaaggcatctagtcttagggtatgtgctagttctcaaagtggtttgccagagtaaatcaaaaattatataaacacccactgatgatgaaaaaggatgtggtgaaaaattgaggagatcagggtaggaagaattgaaagccaagcaggaatctgaaagggatggtggcatgatgaaaatgtatctgcacgtgtgctaagtcactttagtcatgtccaattctgtgcaaccctacagactgtagcctgccaggctcctctgtccatgagattctccaggcaagaaaactggagtgggttgctgtgccctcctccaggggatcttcccaacacagggatcgaactcatgtgtcttatgtctcctccactggcagacaggttctttaccactaacaccatcttggaaccccccaaaatgtactcagacaggataatttttgctgttggctgcttgttttctggaagcaagaaaacaaaaatgccagtatgaaaattataacttgagtctaacatgaagcagctggagaagcattgcgaggaaagtaatatctgatctcagtatctgaggctctggtggaggaatcatggacatggtaagatggtggtgtggggagatagactcttgctcttccgggatccaggagagcagctggacaccagcaggaactccagacaagggcagcaagaagtcgagtctcagtaaacagagggaagcaaaataatgctcttgtgccccagcaaatgctatctatgtgcccagggcaaagccagccaaggcaaaagcaaacccaagtacaatccatggtgtggtgttgagaacttattatcaggacaggagggggcagggctgcaatgacagagatgtctgtgcccccaggcagcagctcctggaaagcagacctgtggggtggcaccacatcccacctgggagccaattctgtgggctcttccttcagcacatgaccgaaaggagagtacatgttgccacctccacctgccatcttccgccaagccactctattccgatgcctggatttttgtagctgtagcttcctaactggtctcttatttaaacttttgcctcgtgggtgtctatcttctatgaaacatccagaataatcctcttgaataatcatttctctgctcagtgagaactccttgtcttcccaatccactcagaggaccccaaggctttcccttgccttagaaagccctgcaggatacagtcctctgaatcttatggtacctcaccccccaccatcccttcctcaaccattcagctttagttacaccagcatcgctgcttctctgccaagccttccatctcagggcctttgcacagactctcctctctacctggaaggcccttctctcagtgattggcatcaggcctggcaaacaggcctccttgagggtctctgctcaaataccatatcagtgatatctaatggttactaactcctccttgagggtctctgctcaaatactaccatat

SEQ ID NO: 26934 - DNA, 3959 bp, Bovine  19866880613280
aaaaagcaagagaattccagaaaaacatctacctttgcttcattgactacgctaaagcctttgactctgtggatcacaaaaaactatggaaaattcttaaagagatgggaataccagaccatcttacctgcctcctgagaaatctgtatgcaggtcaagaagcaacagttagaaccagacatggaacaacagactggttccaaattggaaaagcaatacgtcaaggctgtatactgtcaccctgcttatttaacttatatgcagagtacatcatgccaaatgccgggctggatgaagcacaagttggaatcaaaatttccaggagaaatatcaataacctcagatatgcagatgataccactcttaagggagaaaatgaagaggaactaaagagctccttgatgaaagtgaaagaagagaataaaaaagttggcttaaaactggacattcagaaaactaaaaccatgacatccggtcccatcacttcatggcaaatagatggggaaacaatggaaacagtgacagactttattttcttgggctccaaaatcactgcagatggtgactgcagccatgaaattagaagacacttgctccttggaagaaaagcaatgataaacctagacattgtattaaaaagcagagacatcactttgccaacaaaggtccagacagtcaaagctatggtttttccagtagtcatgtatagatgtgagagttggaccataaagaaggctgagtgatgctttccaactgtggtgctggagaagactcttgagagtcccttggacagccaggagatcaaaccagtctatccttaaggaaatcaagcctgaatattcattggaaggactgatgctgaagctccagtatcttcaccacctgatgcaaagagccaactcattggaaaagaccctaatgttgggaaagattgagggcaggaggaggaggggatgacagaggatgaaatggctggatggcatcaccagttcaatggacatgggtttgagcgaattctgggagctggtgaagaacagggaagccccgtgtgctgcagtccatggggttgcagagccggatgtgacttatagacctaacaacagcagcaaatgcgttttagctgtgccaggtcttatctgcagcgtgtgggatctagtgccctgaccagtaatccaacccgggccccttgcattgcaagctcagagtctaagtcactgggacaccagggaagtcctctaaagacagcctttttaaagaaaagaagatagaaaagcaaagaaaagaaaaactttctgtatgggaaataacagaactctcagcacccagaatcagcttgcgctgaggtggtcttacttacccaggttctacattctttttaaagcaaatccaaaacatatcatatttattgggaaatatttcaatatgtatctgtaaaggacaaggagtctcttttttaaaacataactacattaccaccatcacatctagaaactaataatataaggaccagttttctatacttcagtgtccagacctgtaaacaatacataaaagactggcaaggaatttcagtagatgaggataaaggattcaccaacaaaaaatgttatttcacagacttccctggtggtccagtggttacgactctgtactttcactgcagaggcgtgggttcaatccctggtccggtgactaagctcccacatacagctcaccatggcaagaaaataaaaggtaaataaaattaatatatagaattataaaaaacgaaaaaatattatttcagttagtttactagtcttggaataaagcctttaaggaaatctcatgactaaggttttaaatgtggaaaaggaatctgttaaaaattaatctgatttaggggtcacaatggcaatttgataaactgtcaatgaaagacagaattttcctccaaacaacatattagaattttctccttaaagcgcccatctaatacgttttcaaggatcttgtaagaagtgaagaacgcaccagcactggctgtcgcctgtagctcacacttccgcacagtggaagttcctgtaatcagtctagagcagccagctcaagtgtggtggacagcgatgcatattccctttcatttctcttagccccgggtagctgaaaaagctgtgttgaaaaagacttcctatgcgtggttgtattaccattctcccagatgggcacttattttagggggcgggaaaaaaaatctttactttcttgtacctttttaatatgtaaagttgaagagctactcatctttatttcctattcccaggaagcctgctttataaacttgggggtttcacgttcttttctgttaaaaagggtattactttgccttgaaataattttctgaaaaatcatttgggatttttatacagcaatgctatacttctcatttcttaatttccttctcgaacatgtacctgttttgatctttgattttttttaaacttaccatgaggcaaatgtactctccaaccaccacctttgatgcatctcaaattataccccttggaattgcttcagtattattcatttcaaaatggtttctcaacatttcttgaatttcatttatacaggtaaagtctttaagcaaaaggttatttgggggccagcgctcacagaatcccaagcttactcagcctcctgagatgagttcctttggaagcagcccaggaaagaattcaggtcgaaagctacaaagcacagaaaaatgggcagaaaattaaatatatatctgaacatatttgcacttaagaaaattcagagtagaatgcccgattctttccaaagacctattagactgatatgtttgtttatttcataatttaatctttccattgcagatgtaatctccaattaaattcccccttaaaaacaacgttcacttcagagagcaattagcatttaaagaaaagaagtttgctcgtgatttgggttctgcatagaactcaagcaactgcagtcgacctcactaaaaagatgatttccaggagccaagtagatgattggtgaagtaattatgttatttaaggccattctctagcgctgaaagatgaatcacatttgcataggtgaaaacaaagcctcatatgggaaaaaataaagcaaagttgttttgcagaaacaaaaaacaaagcttctgtggcttctctttctgaaacattttcctgttactgccagtctctgcaggctagaaaccaaatcttgggtgaagcactgaggtgacccagggaaggtccctgtgatccaggtccccacagagcagctgcagcatcactgcaatcctgtgtgcaggtttattcaatgataaaggaaccaagtttaagacaatgcatgatgcactcacctcccagtaacattattcataatatctaaaatactgaagcaacccaaatggccatcaccagatgactggagaaacacagtgtgggctatacccacaggggactaggacccagattttcaaagggaggggattttgacacatgttacgatacggatgaaccttgagaacattatgctatgtgaaatcagccagtcacaaaagggcaaatactgcatgattccacttaaaacgaggtacctggagtagtcatattcatagaggcagaaaatagactggtgttgccaggggctgtggaagagtggaaggtggggagttatcatctaatgggtacagagtttgtttcacagatgaaaaagctccagagatggatgatggtgacggttccacactgtgaatttacctaaggtcactgaattgggcggtacttaaaaatgctgacactggtaaattgttttcttagagacttttagttttttaattagtttgtttggagtatagttgttttacagtgttgtgttagtttctgctgttcagcacagtgaatcagctatacgtatacgtatgtcccctcttcagtaaa

SEQ ID NO: 26935 - DNA, 2197 bp, Bovine  19866880620136
tgtaatcacatgcatttacaggtagatagcttgaaggtaaggatgacatgaagttctctaatcttcttggattctgatcctaaagccgggaaaggggaggagatttggaattgtaaggaatttggactggggaaattaaaactaaaataaacagggctcattttactgcttttaagagggcaaaattattaattttgataattaaaatgaaaaatgaaaaactagttttacttcatcagaaattatttatggtaataatagaaatgaacattaaagcagttttgtatattacatgttgtgttttacactagatatcaagttttggtacacacaaagcggtgacattctaatttaactcatttttaaaatcaggaagtagctgccctcaactggatagtatggagcactgcaactcaagcaaacacttaaattacgtgtctacaatacacttctgtgaaaaagagacaatattagtgattgagcacagtgagtactaattcccaaactactgtttcatctttttcctgagcaatcaggttaacagtacttgtaaagcaatgttctaaatcagcatgtgtgtgtgctcagtcgtatccgactctgcaaccccgtggactgtaacctgccaagctcctctgtccatgggattctccaggcagtaatactgtagtgggttgccatttccttcttcactaaatcagcatggaaatgaccaaaatacaaaaccttcaaatacagaagaaaaccctagtcaatgaaggaaactgtagacaacatgtaggaaaatcccaatggctaatattttaaaatgcagctggttccatgtgttcaagaaaaagaatttttggtctaaattatgcttttagaaacattaaagataatcttaattatgaacccccatccaaactgggatttttcaaaacagacaacctctttttaaaatggtatcaaatattacagaagtatcataagtcagtcgaaatattgatgctggagtcaaactgccatagttcaaagctgggttccatcacttgttagtgctatgtccttaaattgatgcctctatgcttcaatttcatctatacagaacttacctcacaggacagttatcaagattgcatcagttaatgtaagcgagacacagaacaatgctttacattagtaagtgctcaacactgctagctgccattgctactaggataaaaaaaaaaccatagagctttgtggattacatttcaaccttaacaatcactaagaaagcaaagatgcaaaatccagctatggtaattttggactagaatgttttaaaacacaatcctcaacaatttttacaaagacttcttaaattttttcaaaattttatttaaaaattaagctggaacatcttagtagttgtgttgtaacattttaagattccagatatcactatccatccaaaaagaactcaatattggggaagctgtgatagaagattctctattcaagatattttgcctgcttatcactctctgattatctttcttctaaacatttgcattagccacagattattaaaatataaatgctatatgtaacaaaataccaatgatatggtatttctaaaatgtattacagttccatacattccaattctcttacaacaatgataagatttacagcagcttattctggattttgactgcttctttcattcattattatatagaaggcctgtgatttaactgctccagaccaaagtccacagcatatgagcagcataaagattttctatttttcataaactattcttgaatcagctaaaacaaatcacttgggaagatacaaattaacctgtaagtatttctaattttgtaccgtaagttttcaaagtctcatatcaaaaacagggaaactatcatttattatgtctgtgaatttaagcaacaagtgacttactcttttgtatgaacagaaacagaaaatttccagattccaaaaattatactaccactgagcactgaagaatttgatgcttttgaactgtggtgttggagaagactcttgagagtcccttggactgcaaaaagatccaaccaggccaccctaaaggagatcagtgctgggtgttcactggaaggactgatgctgaagctgaaactccaatactttggcccctcatgcgaagagttgactcattggaaaagaccctgatcctggg

SEQ ID NO: 26936 - DNA, 2995 bp, Bovine  19866880659645
aactggaaaaatggcagattgcacgtgacttttaaattcttgctaaatatcatttttctcagtctaacttcttaggataccaggtggctataaaaccaagatggctctccccagcggacacctgggaagctgctgggttgccataggacacagggccatctgccacagcagatgccagcctcctccgatgagccacgaaaatgggaaaggatgtggcctcaggttaggaggacaaggatacaggcaggatgaggaggtagaagcaactttccaggttaagagaagagctggaccaagcccccaaggtaggaggaagtgtggagtgtggaggagacgctgtttgccttgttcatgccactccttcaagtctccactcagaggacccccccacaggctaccccgttgaaaacagcctccttctgcacctgccaggctcacctctctctcaccctgcgtcatcgcactcatcgcctccagagatcccaccagacagctgaagaaaaaacttcggaagtggaagacactgcatacgcagggccctgaggtcagcggagctgccagaatgcagtgaatggggctgcgtgtccagaaaggcccgtggagaggaccctggggaccccgagccagctaccccagccaagtggtgcccagcggtgagcacccatttctctgcacatctgggggtccaccagggcagccctcccccatgggtgtccctctggggcccagccacacagcccctgggcccatcattgtccctgtgacaggggaggggcaggagggcaaatctgaccacctagagtcgggtctgctgccaccccacggccagggcacatctgcaaagaagtccgcatcacagggagggaggactcgacggcctcaggcaggctgtggcaaaaggaccttggggtgttctaccgccacccagcagggagggaaacacgagcagggacagtcatccattcctccacagcaagcgggatggggcagccagcaggtggcgggcggagaggcttgagtggaggtgtgaaggagttctctctctagctgagggccgaaatggaggcagaaagccccggccaaaatatatccaatgaggaccatgggctcactgaagcctgctgtgtgccgggcagctggaacaccagagaagccgaaacacttaagccctgcctcggggccccgcaacatggagccgtggtctccgctctgacagcctgcaggaacggctaggcaggctcggtttcagccctgtggttctcctcgcactcgtgtgcatggacagcaggaggggcggagagggagcaggagcctctggccccggggacggccgctggggacatcacaggagtgggaacagccactcggaccaggtgtggacagagagctccctggcagaactacacgcccacgtggtgttcagagcaggggctgggagggaggcgggcaatctgtgcctcgctgaagctgtaaaaataaggcagccggatgatgagtcaaaggaagctggctggcttcacacccttcaggaagaaaggaacggcaacccacctcttcccatcctacttaaaccctgcaggtgtcacgtctcagatctcccgacagcaacagcaaaatgagatgctccgagaaagcagcctttgggaaagcagtctgttttataaaaggaacacagcgtaaccaggaattcccgtctgtggagaagtgaacaagttgtcagagcgtgtcaagcagacgctgcaggcaacaggcagaggggttcctgagctgggcagggctgggcggagggcctgctatcctgcagggtgactggaggcatctctggatcccagataacagaatgaaagtaaccagctgtcagcggggtacctgacagcttgggctcagataccctcttcatagcgctggggaagtttacaaaaggacagtgattaaagacctaaaaggaaatttctcctattcaaaagttcataggaacataaatagcaaaaactaagcacatataaccagaaaagaagtataaagctactaaatgggtcagatcccggcgcataacttctttcgaatttagtttttcatctttaggctgtggcattcgaaccaagtcacattttaactttccttttagttctgaaactctatgattcattaaaaaacacttgcaagaaatcccccaaaatgtcaaaactaaagccaagaaactgaagacctgggtggaatgcactaaggaatagaaattgtactagctctgggtcatgccctctacctgggaaacgagcacccttaaaatggagaggtcggagcgtgcaataaaattgtggtccgtgcacagaatgttctagtcttaactgacgaaacagatatcaataaaccacccagacaggatggaacccacctaagaatttcaagcaaattcacgggcaggattgtggagctgttgaccacgatgtgaaactagttgttgtaacagctgctgtgttagattcagagcagtcaggtcgctaataccaggctccttccaagactcagaggggactctaggataccgctcactggtcgttgctcccttccccactcaccaagctggcggaatcaccaaatgaagcacggaatggagaaagctcaaatctgcacaacgtacggaggtaaaggcaggatggattctacaccaggagccagctctgattatcagagttctttgagggtctggggaaagaggaaagagtcactcttcaggctttggagttacctttggcaagtgtccacaccaaacgcctactgtaggcaagtaaagaacagttgatgggattccatggtcgtccagtggttaagaatcagccttccgcaatgcaggaagctgggttcaattcctagtcaggaaactaagataccacatgccacagggcagctaagtctgcataccacagctactgaagcccacgtgctccaaagcccatgcaccacaaccaaaccaagcacagcagcgaaagagccc

SEQ ID NO: 26937 - DNA, 2513 bp, Bovine  19866880774357
ataatacgtatatttttttctaggctctgtagctgcaaacttcctttagctctcctgttgatctcagagtctcctagcacccctcgactgcccccctccatcctgagagctttctgtttcaggcataatcattactgtagggactgaattttgtcgttttctttgcttttaatctttcttgataaacagtgttttatttattgggaagaatgaaaacttgagctgtcagtttagtttaacttcagctataaaattaatgttgatgtttatcagatgatgattttgttgactatgtattttgacagtgtaaaggggctgatggaatcagctgtcaacccgtttaagatattaaaatattttctatactcaaaataattctgcacttaaatttgaggtgaatattgataagtgaatatttataatgaataaattattcagtgaatattgttaaatctcagatgctgtgatagtatattactataaattgtataactgacgtcatagaactatgtttacctcactcaaaataactgatttttacttacaattacatcaaaaattcaacagtgtaggaaatataattatctcccccctccttactgtttaatttcttaaattgttaacactgtcaaataccttatatttatttttcataggataaattcccacaatgtattaagtcatcaatttggtgaacttctgcattatagctcagtttaatttttttaaggtatagaaaaaaacaacaaccctatattacttatggtactttaaagaagtatagtattatgtccttatttattactccctggtctgtagcatttttcagagtttttacgagagaaataaatggttcataaaatgtctttagtttaactgaaagattaatgaaacttttgtgcttaaacttgttcatgaaagtaagttaaattatggaccttgaaaagctgaaattaaagaagtttttgtcttctttcttgtactaaagttttatttgtgaattggagaaaattaagttgcttttaaattactctatcatcacatgaagtttttgcatgattgaaatacctgtaattactatgtcatttttgtcattgttgacttaaaggtgtagctataataatcatctgctaaattcttggagagcagctgtgtaagaccagttttaacagctggggtaacccagcacagactataagagttgaacttgatcttgaggcaagttatgttatagtcactgagaacttcatactagacatttctgaaatacttaattcaacccaagagttgggtttttgttttatcacaaatatttctttaaacgtttaatgaaaatagtgaggaaaagtatcatcttgatattaacaacctaaagttctaaggcaaaatatgggaacaaaatccaaagtcagttactcatttaaaaaagtcaaatgcactccaaatatcaccatttatgccagtttggtaaacatgaaattaagagatgcttgctccttggaaggaaaactgtgagaaacctagatagcgtgttaaaaagcagaatcatcattttgctgacaaaggtcggtatggttgaagctatggtttttccagtattcatgtatggacttgagagtttggaccttaaagaaggctgagcaccaaagaattgatgcttttgaactgtggtgctgaagaggaagacttttgagagtcccttggacatcaaggagattaagccagtcaatcctaaaggaaatcagctctgaatatttgttggaagggggctgatgctgaagctgaagctccaggactttggcttggatgccaagagccaactcatttgaaaagaccctatcctgggaaagattgaaggcaaaaggagaagagggtggcagaggataagatggttagatagcatgactgactcagtgtacatgaatttgagcaaactctgggagatagtgaaggacagaggagcctgatgtttcagtcgcaaagtgtcgaacatgacatagtgattgaacaagaacaacctacggttaggaaagactaaaaaacaatgacttagatacagagagtaatctgcctcactctgtatcccagaataaatgaatatgctttataataccatattttcatctccaaaggatattgattctgatttattcctctttcagttgagttcagtcgctcagttgtgtccaactctttgcgaccccatgaatcgcagcacgccaggcctccctttccatcaccgactcccagagtttacccaaactcatgtccatcgagtctgtgatgccatccagccatctcatcctctgtcgtccccttctcctcccgccttcaatccctcccaggatcagggtcttttccaatgagtcaactcttcgcatgaggtggccaaagtattggagtttcagcttcagcatcagtccttccagtgaacacccagcactgatctcctttagggtggcctggttggatctttttgcagtccaagggactctcaagagtcgtctccaaca

SEQ ID NO: 26938 - DNA, 1448 bp, Bovine  19866880800792
gaggagggctcctaggacagagaagaagcctaagtgggaattttggggcttcagggaaatgcactttgtgagtggtcagatgggggccttgtccaagggggaaagcccttgtgcctctctgtgatttctcccctcagcagcatcattgtgttatgttagcggagatcagagagcctctcctgacctgatttgaagctttacgcacatacatgcacatatatatatacacacacacacacatacctgtgtgtgtatgtgtttatttattatcttattttttaaagattttttttgatgtggaccattttaaagtcttcattgaatttggtgcaatattgcttctgtttcatgttttggctttttggccccagagcatgtagcatgtagagtctcagctccttgaccaggaatggaaccgacgcccccacattggatggtaaggtcttaaccactggaccaccagggaagtccctatttgtttgtttataacacttctgagaggctggaaacagctttgcatctctgagaaaaaagatggccatctgaaatcaagtctctcctctgtaaaagacacctgttagctgtgcctctgagccccaaggggggggcggtttcccttggaaggagcagtgattatggttgggcattgattcgttccatccctgggagatgagttcccaaggagagagctgaagagaaattactcagagcaaatcctaggggaggaagtcagtctcctctgtgggaataactgagatccattaggcaggcatatctacatagcatttgcagaagaccacagcttatcatgacaacactgaaatccaactgacattatgcaccaagtactgggggaaactgatagcaaaattgcttatcacgcagaacgataccctagcaccatgttgctaaaattctgtctggtgtggtttatttggccagagtagacagagcctctgaggagtggaaaaagcaggagtttaatcacaccaagtgccagatcccctctctagacccaccccctcagagcatattcattcctggccccacaactttctccccttcctagggtcctgcccaagttaataagtcttggagaaagcaaagaactggcaagttcccccaagcagactgtgtagtgtcttgctcagctagagggtagtcttctcaaggaggatgacagtggggaagagatatgcagtattcatgaaagatttggggcaacaggggtaggaaaaatgtgcgagatgttttctgtttgggagcacaatgaatgtcaatgtttctcaacccaagaggccggactatccaacagagcaaacccaagagggcagtgaataaagttacctgggaagacgaagtaagtttaagagcagttaggtgtcacagaggggggatctttgcagtgatagaaaataatggggtcaatttttattattaataatgaa

SEQ ID NO: 26939 - DNA, 1711 bp, Bovine  19866880803420
acctgtaacgaaaaagtccctcccattttaatgcacagtaaatccatttctatgcagatttgaacccacattggatcctccgccacaactcaggaaacgattattatctttcctactccttgacaagagatcaaggaaagaagatgatgcccatttctggagagcttcttcttctgaaacactaaactcttctgaagttcattacttacagagtactctttagatggtgggcattgtgatgggccagaggtctagagatgaatgggtcatagcttctgacctccaggactggccagcaagtttagtggatggggactcaagctgaagacattgaaaatgactgaactggcaccagttgctgcaaattggtcaagagaaaaaactcagtggaaagtggacactcagcctgggtcttccaactgggagaactggggagagggttcattgtatttctaagtttgagaacaatgtctggaacaggtcaggtgttccaaaaattatttattgaatcaagggatgaatctcagtggctgatttcccctttttttggctgggccatttgctgcaaggaatcccccttcttccccaagataggacagtgccattgggtaggtatatcttgggaatttgtaccatctgtttggggcccatagagagggtgtaccagatggaccccaggtctattttggtctttactttgcatgtttcttgtttttctgcgtcccatgcagatggataccgtcaggttatttatagcaggaatgtgctaacaataatagagcagttgctgtaattccaaggccgattgaattagtttggctttgcattctttggcgcacctatagcaaacacagggttaaatagctgtgggaccaggatggttcccatagagcatcaggggccacccatcctgacccccttcaccaagacagttctctctgaaacatgggacacagcgatggtgtttgcatgcattccacaggttttagaaacagtccattcatagatacaaaacttctaaaaaaaatacagcactggaaaatgtaatttaacaggatattaatacccatggccaagaatgcaaagatggttcttatgtaaaagaatattcatgattctagaatttataacagtgcacagcaaaggaaaccataaacaaaaacgaaaagacaacctacagaatgggagaaaatatttgcaaatgatgcactgacaaagaattaatttccaaaatatacaaactgctcatacagctcaatatcaacaaaacaaacaacttaatacaaactgggcagaagacctaaacagatatttctccaaagaagacttacagagggccaataggcacaggaaaaaatgctcaacatcactaattattagaaaaactcaaatcaaagccacaatgaggtatcacttcacaccagtcagaatggccatcattaaaaattctacaaataataaatgccgaagagggtgtggagaaaagggaaccctcctacactgttggtaagaatgtaaattggtgcagtcactgcggaaaacgatatgaaacttccttaaaaaactaaaaataggggccttccctggtggtctagtggttaagatttcaccttccagtacagagggtgcttgctgcatccctggtcggggagctaagatctcatatgacttgctgccaaaaactaaagcataaaacagaaacaatagtgta

SEQ ID NO: 26940 - DNA, 1074 bp, Bovine  19866880830097
accagatgcaactttcactgctaggactcacattgcagtgagatacatatgtccgcatcagttacatcgagcaagtctcttaaatacccagaatttggaggcagatttccaaacacagggtcccaaatgctcaggtcaggcttctctgcttgaagaaatattcctatactctaactcagtggttctccaacttcagtgtacctttagaataactgtgagtgggagaagggtgttaaaaaataaagatgccagaaattctgactcagtaggttcagggtataacctgaaggatccacagacagcgcgtggagatgcctgacctcgatcagtctttgtttttcaagccttcactggataactaaaatttgctcaaatttcaggaactgctgaattttcaacacgttttccatgtgacaagagcattatcctcctgcccagactcagaacatcaaaccccgggaggtatctctcctccaccacggtgtcctggtgaatccacagcaactggccgccagctccggtgggccccctgggagaagcagcgggagcagaggtaaggaacagaactctgtttgcatgcagatcgtttccatagaaaattaaacaagcaataacggcctacagaaagcattgtgtataaccaccacaacaaaaaaaattgtactttaagggatagctcatctaaatttgaaagtaatattagctctcaaaggtcccgcactcagataagatagaggtcaacttaaggagctgaggaactagaaaggttaagaattcatggtaaagatcaaatcttgcactgagaaattcctgtgttgaactgtgccaaaaccagatgcttttattggtaattattatgatgataattcatttaactaggaataaaatagggcatgattgtttacttctgcccatttccccagacaggcaggggaaatgagaagaaaaatctcagaggttttactcttggttaaatgatataatttcctcaattaaccaggaataaacatagcaacaaaataatttgcctttacattatacaatagttgtaaatagacttcttacacctccttg

SEQ ID NO: 26941 - DNA, 860 bp, Bovine  19866880892426
ctaaagaaggctgagccctgaagaattgatcctttcaactgtggtgttggcgaagactcttgacagtcccttggactgcaaggagatcaaaccagtccatcctaaagaaatcagtcctgaatattcattggaaggactgatgttgaagttgaagctccagtactttggtcacctgatgtgaagagttaactcattagaaaagaccctgatgctgggaaagattaaagtcaagaggagaagctgatgacagaggacaagattgttggatggcatcaccgactcgatggacacgagtttgcgcaagcttggggagatggtgaaggactaggaagcctggcgtgctgcagtccatggggtcgcaaagagtcagaaacaactgagcgactgaacgacagcaacaaccataagagagagcttatgcagattttctgcaggattgcaaagaaaattgatttaaaaaatctttatttctgccacagtgctgttcctttcataggaagatcagacttagaactcaaatgttgcgcactgtcctgctccattccctcttgggctttaaatttcttccatttcttgtcagtttcagatctctttacatcccaggatagaatgaaagtataggcatttgcagcaatgtctttggagaaaataaattccagatatagccaataaatccagcacagtcattccctgaaacaaagagaatgactggcagagcagagaaaaatcctgcagaaaacaaaccatcgaaaatacggcagagaagctggcctgccatgctcctgagagcccacgggagggggctgctcacccctttgccctggggtcctcgtgttgcaggaaggagaccccttccaggg

SEQ ID NO: 26942 - DNA, 1856 bp, Bovine  19866880899365
cctggcctatggccagctttggggatgggatggggcaggaactctttgtctaggcttcatttgactgcaggggcctctccttggggtccttgctgagcggccagagcagtggtacaagaagaatgctcagatttccacatttggaagcctttcaagagatgcatgccctggtctcaccctcaaacaaaggggacagaaccaaatacaaagaaatgctttttcccagtcccccggcaccaactaaatatcgtccatccatccattaaatagctgtgaagcccctgctgtgtggtgcgctgggtgctggaatgacataaaatgaattgcaccctcatctcaagcaaggaaaacatagctacttttccacagggaagactcagtggggagggagcaagagccaggccctggagggggaggaacacagcccctgcaccttgacaagcctgaccctgtcatctctctctccatcgctcttatgtcactctgggcctgggtgccaaaggtccatggtgccaggtaccaaggggataccctcaaaccctccaccttgctgggaaacttgcaaatcacctaccagtatgttcgccagacttcgggaattactcaaaagttttctgcaccaaaatctttctggagctgacaaataaggaatgatgattccctttagatcaaatatatgtttttaaagggaaacagttttctattgtgaatggaaagtaggtctcacctcagaatggagcccatttgtcagtggtcctggaggcctgggagatgatgatctagatgtctccagggtcagggaagaatggtctgaggacccatctcccccactggctgcccccttactaaacagcttccaagttttaggtgggtgaggttggagtcagaaagagaatggcctcgaacttgacacctgagtgtcctccagctgatagaagatcacttcagtgcagatggagccatcccaaaagaaaaacaattgcaattacttagcaggtcctgtgccccgtgttgaatccatcctgctctattcctcacacacaaagcgagaggcccttagtcatttgaagagatggcccacagtaccagtgttgactgagggctctgtcggaaccactttctcaattcagttaacaagcaggggttgccaagggcccctggccagtggcatgcagccccggatggcacctgagggaggtgttgctgtgattctagccacgtccttcatgctccacctgtggatgcagcacagccagctagctttcagcgaggagcccccctcccacccccaaagctggactgcaaaggcctttcttcccaggccctgagcacaggaccagaggaagctgcctctgctgatgcgagcggagcctctgaacaaaggggcctgtgtgagccgccgcaacagcatctgtgggtgcagagccgagtctggctggagtgcttgcagtgcggcagtgggcgtgctgtggaatacagattgcccccgagccttgggggctttgcttgtcaagtggcggggcctggcttgggcagcccaatatccggctgtcaacagcccgcaggcctgtttgcagcatggccagggtcctgtttggtgatttgacaagagtcccaggctctcctggcacatcagaattcagggtttggtgctgccagcgtgggctggctgcttctggaggctggggtgttctccgccatggatcagctgctggcggagctcaggagaggcagctggaaggtccctgaaatgcctccgcttcctgccctccatcctcaggccctccctccattactcacaggaagacatgacaagatgttccaagatactgtctggagaagggctaaacacacgc

SEQ ID NO: 26943 - DNA, 859 bp, Bovine  19866880906949
gtaagcatgttgcctgttgagctgaaatgaatgcggatctgcagagcagcacgtgatgttcttttattgccccagccctgtcccctgcaaggcattcatgacacttggctggcaggacccagggccggccacctgccacaaatagaggtgactccagaatgtcagctggacagagacagggtatttatggcacaaacgctttgcagaagaaagggagagggggaaataccattaaaaaaagaagagggagagtcctaaaaacccattttctctgcaggaccagactacctacccccaccccatcctgccccatcgccatcaggggctccagggtccaggtcatccggaaccacaccaagggagagctcactccgctctcagggtttgccaagagagagaaaatgatcagtctatgggaagtcccagttttctgtcccaaaggcgttgttttggtcaattcagataaaggctgagattcagagctctctcattgatctcacacttgagggcacttgactgaggatgtttagaaatctctcttgaaatgaccccgccccacggtaaaccatagtttttgtgtctaagtacaagggcctctttgggaaggtggtgaaatgctaccctctctccctgcacacagcctcctctttaggcctgctgactctccccatcctcacccatctgctaggctggcccactgacaagttggcttgacccttgacctcaggcacacatccaaggccacacgggcttagatggcaggtctgagtaatgccggaggtaccatctgtccggcaggaagaccatcttctgagtcagtcctcaagcactgattccatattttcatcacagctggtaa

SEQ ID NO: 26944 - DNA, 1043 bp, Bovine  19866880907157
gataccctgcatgccccaaagcattatatattctaaagttgttgaaaataggagcttttggtcattcatgtatcttaggagtaaactttctgaaaaagtcctgaacaccatatgccttacaattctatatttcttaaaatcatttaatgtctacccattgcatagaatgaagtctaaattctagagaatagaaacatgacctttcaagagcatacgtgcattgcatttccctacatgcatgttacattctagccttactgcattaattaaaaatttctgaatttactgtgctatttcatgtatctttttgtatataagttattcactaagcctaaagtatactttcctttatttagcttcaagagtccccacactggtaggctttttatctcatttaagctcaatgaattatatccctcatgctattttatttagtagttaatactgttataagctatgttatagtagtttttttaagatgcctgtctcattcctttaagtgctcgagggcaaggattatatattaatcttagtatcatctgtgccttgcttactatagttgattgattaatgctgattgggtaaatgaacatttttgttcttcatttggagaatatttataggggttgttgcttagttgcttatgagaagatgacacagatgtctacacaacttggctctatgggaaaacagaagacagtaattaattaaataaaagaaaagaaaagtagtttcatctaggaaccgctttctgaagttggaactaatacgttattaaattacctcaaatggaaggtcaaatttctcatatgattaagttttagttgttaaagcaaatggcatgtaagggaattttcaagttcatacagcaaaaacaggaaaaaattgcaaagttagatctctgaggtttctgatgtttcatagactaacaaaaggttgctttattaactgcattaatgaacgaattgcttcactggcttaggcatactggtagctttgtcggcccagagtgctttaaagttcttatttcaattcatggatta

SEQ ID NO: 26945 - DNA, 804 bp, Bovine  19866880931215
gatctggaacctccgcctcctcctacctgtattggctgccatggatacaggtttcttaaaggggtcgaggatggaacagatgctttacattagcttttatgtcctccataaaattaacaacaagcaaaccccgaggaatggagctataattctgtcttgcaagtctgatccaacacagagcgtaagagcttggctcttgaggctaaaagctgtttccagacatcctcaatggaatgttacctctgtaattcacttattgttattagctttatgtatatttacagatagcgccccccaaaatcacacagcaaaaccaaagtaaagaagaaaagaaaagctagtggttttcacgtttaaattacaatcattatgtaagatacaatatcttgccaccctacagcacttctagactaaatataaaatatgcttcacagcaaggtaaacataatacaatagctttttaaaagaatgaatattacctagctctgtcttcagggatgttattctcaatagcaatatcaattcagaaagaaaagtcaagagaataacgacatcttcttagccaataggactcgcggatgtgaacaagatcagcgaaaggactagatgagatccttgaaaggcctctaaagttattgttcaactgcacaaccaaacacaatccaataaaccttcatcatttatgtcgcagtttctaatgaaactaacgtcgtgaaaaagacaccagtgtacacatgggttggagaggtctgggatcaaatatgcctcttgttgttgttagttttaaaccatttaaggcaatca

SEQ ID NO: 26946 - DNA, 851 bp, Bovine  19866880936058
tctcctgcactgcaggcagatcctttaccaactgagctatcagggaagcccaatacagagggaagatatgatttatgcaaataaatacttctagagtatgaaggtttcccctagacggtgtcataggaaggcaccctacagacctatagcaatttaaataagtgttcaagtcagtcccaagtgaaacagtatttgaaaagcattcactgttggaaggaaggggagaagtaggagaagaaggagagggggaaaaaaaaaaggaggggcagggggaggcggagaagaaggagaaggaggggaactgggaaggggagaggaggaagaggaaggagaagcagtagcaattgccaagagacagttgttcaatccaataaagtaatgatctgtgtgaactctaattattgtatttgcaaaacagtacgtgtataatttgtgggcatccctgttccaacataataaaagagtcatttcatgaaaaccttttgtgttttctttagaagatttggacaaaaacaatgcatctttaactctgaaagcagaataatggattcttgaaagatttatctggaatccaatgcacatgtcattctgtattgattatcttggctattcattatcatactcagcctatcatttatatgcagatgacgctatcatttatggtagtaggttatgctggaagaaagcttaatattatcttcaagctgatttaaatgagctttaagatcatctggcacaatctaaattactcttaaatattaatgaaacaaagatctcattattcggctcaaaacaaaaagttggagaccgaaaaactggtctagcagcagacctggacagagcagacaaat

SEQ ID NO: 26947 - DNA, 760 bp, Bovine  19866880955661
aaaatactgactttagaaccaaaaattaattctgcaattttgaagggatgcagaaagtcagtaaaatctctttaaacataaatccctaatattctagtaagagaggcaactaaaggaaaaaaaaaaaaaaaaacccaccctagatacaaggcatagaaaaattaaaggcaaaaaggttcactgaaagctaactaagggtagagtatttccaggtcagcatttaacagagccacgtttctaaagtacgaatatatttttagaggaaaaattctcagattaaaatactcattttattttaaatgtaaagcttttttcagctcacgttgtctttccattatttgcttacattcatgatataaaacagaataccagatatccagccacccaccaaaattagaggatactgcagccatctctgatgatacagattttccttctcaggcaggcatacacacacacacacacaatcatacaacacaggaagaaaacagcttacttactttgtaaaaaatcatttttagtgtgccgtagaaacccatattttctggatttttccccttcagtgattctgtgcccccgtgtgtccggctgcttggcagtctctgacaatataaacctttttcaggtaggtatgtcacagattctaatgtggacatgctcaggcacgtcagaaaaggaagattaggaagcagaaccggcaacaaaactccacagtagaggcaaatgcagctcagtatcaaaccgcttctcgggacacaca

SEQ ID NO: 26948 - DNA, 2552 bp, Bovine  19866881029483
taagaagaagaattaatgccatttgcagcatcctgtacggacctagagactatcatagcaagtgaagtgagtcagagaaagacaaatacatgatattatttatatgtggaatcttaaaagaaaatgatacaaatgaacttatttccaaatggaaatagactcacagacatagaaaacaaacttatgatgccagaagggaaagggaatggggaggaatatattaggagtgtgggattaacagatatacactaatatatatgtaatagataaataacaaggaccaactgtacagcacagagaaatatactcaatatgttatataatgaaaaagaatctggaaaaaagtatatataactgaatcactttgccatatacctgaaacataaatcaactatatttcaataaaaaattaaaattaaaaaaaaaatgtataatagcaaatgggtgaatgggcctccctggtggctcagtggtaaaggattagcctgcaatgcaggagccacaggagacctgtgttcactctcttagtcaggaagctaccctggaggagggcatggcaacccactccagtactctagcctggagaatcccatggacagaggatgttggtgagcttcagtcatatggttgcaaagagtcggacacaactgaagcaacttagcacacacataatagtgaatacttgaaaacgatctatatgttcgacagtagcaggcttgtctagaaaattatcctgcagtggtgtgatgtaatactctatagctatcaaatagtatacttcaggataatagttaatactattagaaagtggttgtgatatattaagtgaaaacctgcagatcaaacacatatatatacacatatatgatctacccttgcaaatgtgcatgcctaggaaaaaagattgaaagcgtacagtgagtaatttctcagtgcgaagatcatgagtgacttattttctctttctgctttttgttttttaaagatttctacaatgaacatttattacttttgtatctaaaaatatatatactgttttgaagaatagtccttttggttgtttccaggtgggacttggtatctgaagtttatattaaatgctagctcagggcatctactgtgagagatgaccaaagggaaaagaggaagtgtacagccatggtctttaaagcagacatttaaaagattgcttttaatttaatctcaaaaggaaggaaggtggtgtcttctctgtagatatttattaatgctggtttgtacgttacccaggcatctcgaacttgccctgaaagtgaaagtgaagtcgctcagtcatgtacgactctttgtgaccccatggactgtaacctaccaggctcctccatccatgggattctccagacaagaatactggagtgggttgccatttccttcttgaacttgccctaaagcccgtctataaagaactggcatgtgtaggcagcgcatgcgcttttcacatccataaattgcgtgttgcccaagactggtcatctatcaggtttgccgatgaacgaagaccaaccttcggaatctcagctttaagtaaatagcagaaaagcttttgggagaggaagtttttgaggaggaggactgtggacccagcttttgcttacatcctcccgcttgccagtcccctgtcttggaacctggcccccgctcatgggcatttcctcatgcacaacctccttgtaagctcatcttggttaaagacatgagctttctgaagcctgagggaggaacagtctgactcatagtcactgttttaacttgaacaaactgtaatagctgcacagcgggctctgatgattagcagcggaatttatctttcttggtttgcatttacagtgacagtgttatgcgcctagatagggcatctacaaagtcagctgtgtcatgctcactatttctaactatacgaagagcagccatatctaatgtaatccatgatagcactgtaattaaaaagtcctgcataacgaggacgtctaataaacaaagcagagcaagtattatgtttcagaacaaataaatgctggaatttaggcagccttaaaacccagtaactactatatagtctcaaaacttgtcccagcaactgagaaatgaggatcagcctttgatagcagagaaaacaagattagggacaaccttttcaacatgggatttagacaactgttgaagagaaatagagaacacaatttacttgacaaaaactgctcatctgagacagcttggaaagatgaaaataaatgcattagagattgaatctatcctgattattctactttagaatctgataatggctatcagtgggcttccctggtggctcagaggttaaatcatctgcctgcaatgcaggagacatgggttcaatccatgggtcagggaagatccaatggctatcagttcagttcagttgctcagtcgtgtctgactcttttcgaccccatgaatcacagcatgccaggcctccctgtccatcaccaactcccaaagtttacccaaactcatgtccattggagtcggggatg

SEQ ID NO: 26949 - DNA, 931 bp, Bovine  19866881041473
acatcctaaattcattcacatcatttcacgctggttttagaagaggcacatatcttgaatgacagcaaaaatacattttaagttttaaatgacttctatgaaagtgcttgaaaataatttaagaaaacatttaagatgcaacttaatttaaaagccaaaagaaaaagattgtcagtagctcccctttgcctcctgatttaaatttggaggcagttcactggaggatttaagtgtctcctttcagctttttttctcgtcactgcctgctctgtaacccattcccagactggctggcctgcctgctagtcacagaccacgtgcctgcactcctggtgcccttgtccatctatttctctctgagggaggtgcctctgctcatatgtgccccaccccactccccctcacctgcctctggcaggcagaaatgctgcttatcctctaaggcttctgaaaaccttcatcttcatcttcatcttcgctaggcttagcctagtggttggtactgccccagctgaccaactccaggctgaagcaagcgaggtactcacctgaaatatacattttcaaaaggataccaaaaaactcaggactcaagtattttcaaatgagtacccagtcaagtttcactctttgcatttggttatctcttcattctttttttaatctgtaacattccaaccacatcttagaacatgtagcttataagaatgtaccatatctaatacaccttgaaaagcttcactttataatatttatatatgtaatattttatgtaaacacttggaaaataaaaatgcaaagcatggatgatgatatttgattatgtcagaattttaaataaagacaggatcagcatgactgatttttcctgaaccttgggctccagcacggctccaggcgcaccggctggttccccctctgctcatcactg

SEQ ID NO: 26950 - DNA, 1423 bp, Bovine  19866881059579
catataagctttgatttccagctgggtgttgataagacaaaactgttccctaatgcttaagtaattgagtggaaaatagttgacaaaaaatgaaaaggttgattttgattatacatagaatctcttctcttaggaacaaaatgtgtttgaataggcatgagtcatttctacagggttgtaagatgattgatttatttatgtagttgttttttttaattgatttttttgggtgctgaaatccaagattgatatgttttaaaataatacctttgttaatatatggaaaaaccaatacaatattgtaaagtaattagccttcaattaaaataaataaatttatattaaaaataaataaataaaataaaataatacctttactggctttgtacatgtatattataaaaattcaagaaacacaccgaaaaacagctctttactcaaattctcttactcaacaataactagtattaatatatcatgaacctcaattcaaatatctctatttacaaattataattggatgaatgaatagatgaatggacaaaatatcctcataataatggaatcatgttatatttccttttaaaataaaaatacatttttccgtggattgaatagaaggcaaaagaaactgaagcaaaaataaaagaaatagtgaaattcatagatctttcctcattcgtaagagattgctctgaggataagaaaaaagaccatgagtattattaaaaggctgtcttataattacttgtttcaattttagacatttttgaaaaactttgccataaaagattaagtgaccagtatactttgactctcttccacttttcttcactccacctctcgattttttgggagctttaattttgtttgcttagtcaagatatatacatatacattctgttctgcagtcattctttccttggttgctgttttttgtttaattttggctctgcttttaaactaattaaatcctcaccagtggtttatctcgtggtggaatagatttcttcatcatcatgatatataacattgattacagcaaacgtgtgtatatacagctttgctacgagccaggcactattcccagcactgtgtgcatattaattttttttcaaactttaaactttctattttgtgctgagtgaagtctctcagtcgtgtccgactctttgtgaccccatggactgtagcctaccagattcctccatccatgggattttccaggcaagaatactggagtgggttgccatttccttctccaggagatcttcccgacccagggattgaacccgggtctcccacattgtaggcagacgctgtaccatctgagccaccagggaagcccattttgtgttggggaatatccagttaacagtgtggtaggagttttagggaacagtgaaggcctcagccatacata

SEQ ID NO: 26951 - DNA, 1275 bp, Bovine  19866881083719
tgggaaattgtaatctggacaccgttggctccctgactgtctatactctcttgagtcacctcccatagctgagtgaccagctctcaggaacttcttggaaatatactgttgttctctttttcacagtgacaatgaatcctgaaactgaatggtgctaatgctttccaagagaagcagccccggaggaagcccgctgggcctgccaacagaggatgaagaggatccgaatttaattaacttcaaatcaatgtaaacacaagaaccttttgctgttgcttccaacgcccactcttccgtcgcccaatgcatcacctttacttggaagaatgcttgattgagaagtgctgggcaaaggcctggatgccatccatcgctgagggtgggggagccacgaggtgcagtcagcgctcatcacggggtgttccctccgctcagccgacctctagggactggactaccactctggctatgctgagtccctgttacctttctgcttcattccttgagtacaaaactggacactcttatctctggtttccttctgggtcactttatgacctaaatagctggataatttcttctgattagtcaagtcttctgataggtcagtcacgttcagcaggaactttgctcaaggtgagttatgtcatggaaaagacagcaaacaaagcaagtgtttcaatgtgtacgccatcccaggggggtggtaagcttgttcctgcctgccgtgagacgcagcgtgagatacacagtcaaagggatgctgtttggtgacgtgtggactgtaagttggccaggtgacagagaaatgggaattttccatgaaagagcgactgttttccttctcagctaaaatcagctgcttgtttccacttccccatggctcttccttgtcctcgccacacctccctggcgtgtggtgtgtgggtagatgggagcagctgggcctcttccgtcaccttctgtgtcctggagatctttaaggtcatctggaacaaacagaacggcattaggctctctctgtgtgggtggcggggacctctcctcgcactcaggacctctcctgcgcccgggacaggtctggtgtgctcagcgccactccccaggaggccaacacccgtccatcagagatgacattctacgtgatactgttgacatcctcctgctagaagtgacggcgcaaaatcagaggggcctatttatcactcccactcacgtaaaatcaatctccatttaatccttaattttccacttctgacctttaaagcaatcgag

SEQ ID NO: 26952 - DNA, 1166 bp, Bovine  19866881114494
atgaagatatttagcattagcatcattgcccaaggcctccccttttgtcgaagacgggtaagtctcacacatttgaaaaacaggaatatttgtttaaatgaactacttctgcctcttttggtgaaaacatgcttcaaatttcaattgatatttataactaaaactatcggagcattatgtcgcccctgaaaacttctgtaagtgacagttttagtaacatgatagagagtcttgagggcaaggttacctaatttacctttttgtctctctcatttatttttatggtgttagaattctttaaacttacttaaaattagtaaatttaaaaaccatgttttgaaatatgttggcaaatgctgaaaacccaaatttattgtgtttattttgtgggaaaagtaaagagctggcgggactgtcctttaacatgggaattacagtatctagctcttataaagagtttatctggcacttgaagctagattatttttaaatcactattttttaaattaaacttaacataatagagacattactttttgctgttatgtaaaataaaactagtgtgctgttgtgtggcagttacgatatagtttatatatagacaatcctgaagtaacaaacattttgtagaatttgtactaatctgtaatcaggttatgattttctgtatgttcttcaggataacattctcatcccctccaagttttgaccctgtaattaatggttttgttgtattttttgagttacttcatattgccattttgaattattaactagagtaatatattttagatctagttatgtttaggatcctgaatacattaaaccaaaaaatacctgtcagagatgcacatatccatactattagtgttttagtcctttttaactctctcctcttttcttttaactgaaagacaaatattctattaaacaaataggttaacttatagtacctgaaaaatatttttcctctttatttgctgggacttaaatagtctttgtaaaaatacgttttctaattactttagtttttgaactgtttctacttctactccaaataagtggtagccatgttgaaaagcattttaaggtaggttttaaatgtaatacaaattaaacattgaatataaaatataaatctctctgtcccctcattttcttcttta

SEQ ID NO: 26953 - DNA, 718 bp, Bovine  19866881122827
ccaaaaggcaaagcaatgagaaaataaccctttgatatcctttctctttcgtcgttcctttgacttttttttattatgcagctaacaattatgatcaagtagataatatgtattaaatgtgctctaaaaatataatctcattatttttatgggttttaagttttcctaacagaccttctgcttgtgacattcaaaagcaccattatcatcattcctattgtccctcagggcttccagggtggtgctagtggtaaagaacctgcctgccagtgcaggagacataagagatgcaggttcgatccctgggtcagaaagatgccctggagaaggccatggcaccccactccagtgttcttgcctggagaatcccatggacagagaagcttggggggtctatggtccataaggttgcaaagagttggatgcaactgaagtgacttagcaggcactgttccataatcaaaaatcatcccgtcctcctaactcctagtcatctctattctactttctgtctctatgaatttgcctagaagcacctcacataaatacagcccctgcttttcaatctactctcaaaattgtgcactgcacctcccccgccacactctcatacagaggccagaagccatccattctaaactgtggtctttcaataagacattaccctctgtacaccactttatgaagtccttataaaacctagcaagctacatgtgag

SEQ ID NO: 26954 - DNA, 1276 bp, Bovine  19866881134715
tctgcctcttgtataaaaggcattgattatctgctagctgcccattaatttgaagggaggcagccaggcggagggcagccacgtcgtgtgtggctgagggtgcagcccccttggaaggcatactgctaaacaatggaagtctatctcctgcaagaaattgttcctgctggctgtgcgaacgtcaggctgcagcctgcccctggagaggcagtgcattactatgtatttgtacaatcagcagagccaatgcatgaatgctcacggtggtggattttacaagctactcacgatgggcctctgcgtctatggttaaagaaaaccatacctcaaagtaaatttagcctattgtgagtccttcttattttaggctttgccattttgaaagggtatcgtttcccccaggagaaaatgctctttgtgtgaaatgacttcgtagacatgaaattacaatatattaccctccatttggtacagcccagcctaccttttatactttgttgaaccacttctcatccttgcaccactgatactctggggacagcagctttgggaggcccacaccatggacagttggcaggccccaaggcttcagaggtcctcccaggagagaggccctcccacggggcagaggccctgctgagcccgcccagggcttggcctccacactcaagactgccgctggtggcccggccatgtcagtatctggtgatggagaggcctctccacctgtctgctgctggcttgggaccaagtcaccgcacacagccagcagcaggtggtaagagtttttaaccccaaccgacagtgctgccttcaaactgaaacttagtgaagtcccccaacttttcatctgccttccctcaagtatcatttgctgtcaactttacccttcaaatcatcctttggaactgcgccattttaaccagccaaattaattttgccattagtgaaatcaataaaacattgtaaaacattcctcttggaactttaaatttggctttaaactttttccagttttattgagaaataaattgtcatgcattaccatagtgaagtttaaggcttacagcatgatggtttgatttacatatattgcaaaacgattaccatcataggtttggctaacatccatcttctcatatagatacaattgaaagaaatgagcagaaagggaaacatttctccttgtgataacttgggatttattctcttaacagtttttctatgtatcacatagcagtgttatagtcaccatgttgtacattgcaaaatttta

SEQ ID NO: 26955 - DNA, 1281 bp, Bovine  19866881152778
tattttaaacataactgtaataagatgctttatttttcaaactgaagaaggcaaatcatttaaaaaaataatttctgcaccaatgagggagagaatatatgtagagaaactcaacatatacatgtatgtactaaaaaaaaaaaaccctctccccaagaaaataactggcagagaataggcatattcacactttcaatctgattgaacttagataaaatctagtttatgatcatttcaaaacactgctgtgttctcctaaccaataaccttgagattttggacctttaaactttaaaatatttttctgatcagagggtatgaatttttatgatttattcaaaatcaataaaaaaaaaaccttttggcacgtatgctatggaaagtgatccacactgccattttacagcacaactcaaacactaatcatataattgcgtattaacatggaccatcttgccgaatctgcttcaggaatgatcttctgcaatacccgctcctctctaggcttatacttgggaattctgcaaaggaccaggaagaaacaaacagggccaaaacatctcgggtaattcaacaggaatgtaatgtgcagaccacgtaacggcatggacacggcaaacaggcctccgaaaactgtttttgcccgtaaggaaagaatccccatttccttccctcccccatccaagagagaggtctcacaaaacagaagtaaatactctgagagattctctggcctccagatgaaggctggtgagcatttcatttcttgatggcaaaaagccttcaatcaattcgttcatttggatggacaagcataggcatatgcagttatcactagaagaaggaaagttgtaattgtgtgtgaaaacagacacaccaaccactaacccagagggcactgctgtgggaggtaagtgaacacaacccctgagcttagagagtctatttttgattgctttcctaatttgctttgatttactagaactaatttgcaatagtgactggcagtcagcccttggaaagggtgtttctaaatttaaaattcaattttacttcatttccagagatgcttattaagccctttctaagtgccaggtaatatgctaggtcctgggaataaagatgggaacaaaaagcatggtggccctgcctgcagtctagcagaatgtcagaatgaagtttatctactcatttctctcatagaacattgactttaaaacactttctgggattccatctcatgccctccacttggccagtcatctggggcttcctcacagg

SEQ ID NO: 26956 - DNA, 1122 bp, Bovine  19866881153207
tctggctgttactattatttatcccagtattttgtttggaagtctagccttctgacctatccctgctgctgctgctgctgctgctaagtcgcttcagtcgtgtccaactctgtgcaaccccatagatggcagcccaccaggctcccctgtccctgggattctccaggcaagaacattggagtgggtgacctgtccctaataagatgctaatactgcagtcacttcagtcatatctgactctttgtgaccccgtggactgtagcccgtcaggctcctctgtccgtgggattctctacgcaagagtactggagtgggttgccaggggatcatcccaacccggggatcacacgcttgtgtctcacgtctcctgcattggcaggtgggctctttaccactagtgccacctgcgaagtccccagtaagatcggggacagaaatccaaaaccaccagagacactgtgaaggactcattcacgttgatagtatctccttttctgggagtataaatcctcaacttcttctgtatggatcactttgtatttgcagagagcccacaaagcatcattgtttgtgaaagcgttgctgcttgaaaatgaatctgtgtcctttccttgaaaataaatctggtccttccttcacagcaggcactatcaagacctttccctagggctcaatccagacagatggaatcattggccatgaagtaatagtaacacacaattacctctctgtatttttaagttcatagaggaatgattctttgattgcaacactttcttttgtgttaactgaacatttgccacctgacctggtcatataacaattttttcagaactctgattatgtgcataaaaaatgcagccctgtacccctttctggctttctctgatactgtttcgataacttcgggagtataatacatttacatgagtgagtgaaaggtgttcagttgtgtccgactctttgcaaagccatggaatgtagcctcccaggctctgcagtccatggaattctccacccaagaatactggagtgggtagccattcccttcctccagtggatcttcctggatccagggatgggaactctggtttcccacatcgtggtaggatagaatttaaa

SEQ ID NO: 26957 - DNA, 1307 bp, Bovine  19866881154211
tatttattttttggtatcaaattagaacacatgtcacgacaccactgtcagtcacttgcattcacgtgcgctttcttgagctggagaaaaagagtggaaattagaaatgtttttctagggtgctagaaatgttttcagaaactatagttcattccacgtgggctgcagcttgagaagtgtgttagcttgggtgacagctgcgttaaactctgcagtcttccccagacttggggggaactgaacaacttcatcttgaagaggctgtacttgcagaactgggtccaccgtgtgctcttgcctctgcccaccaccagctttgtggtcacggtatcaaccctttctgtcagcagcctttcatataaagttacagaacacatatcacaagggcctgatttaactcgaggacaaggaaatgtttacgttctaggcctgctccgagtcataggagactggtcacattgtgtaaccttttttgactatttctaggggcatcccatacatagctgttgcaaggtacactgttacagtttgcccagactctagcacctgttaggcaatttgaaataaaaacaagtcggtggggaacatgataaggtatctgagaacacatttctttccattggaataccgttgcggactattccatttcagtaaactctgcaagcattcttccttgtcattatttgccaagagaagaggggaaaaatgtatctttttataggaaacaaacctgcattcctcaggtccaggggccacagacacagtcttctcttgcttattctcctgcagcctttctcctctcccttgtttaggctagtatctccacccttttaatttgtcccagttgccctttcccaaagagctctcatttcctcttgttccccagatctgcacttcctggccccttgcctcttatgagaggacatcacccgagaagaccaggtaagggaaatgaatgaatgtcacgaggttctcagggcggacccatctgacttcacgaaaagaagggacctggcatctgcatccacttgggtaaccctgagtcctgccctggagctcactctcccaccttgaaattgtctccttgactaggagacggctcaggactgcttagagaaacagcgtggaggtcagcgatatctaaccccactagagtcttcctggttccttaggtgatgcccagactgctttttggtctttttgtttctgttctgaaaatatgagtgcttcccctaaactctttatcagctaatgtcattttttacatgttaggaggcgggagatgtgggggcagacaaaacccgaga

SEQ ID NO: 26958 - DNA, 1112 bp, Bovine  19866881175349
acaggtccgggggagtcaatgagccaaaaaaaagacgtggtccctgtctgcatggaaatggagagagtggaacagaaagacaaccaccaatcatacatataaacgtcaactgcagctgtggtaagtgtacgatgttactgtctcaggttagattagggagcttagatcatgtcctaaagaagcaaaacttcagttgaggtgtgaaggatagttggaagccaacaagtaaaacgaaagtaaagaacgagtggtctagacagggagaaaagcacgtgccaaagccgtgcaatgcaagagcaagacgagtgcaaaggactggtgaaggccagcacgcgtgaaatgaagagttacggctggagggctaggtgctgttacagagttttgtttttaccccaaaagcaatgagaagccataaaaagattgggagggaggagggaagagctgacaatcagatgtgttttcaaaataaatcactgtgcctttaggatggatactggattagagatgatctgaagaagtgggtaaacaagaaagaaggctcctgtagaaatttcaagcgagattatggtaacaaagtaaagtggttgtagtggaaatgggaaacactagacaggtttaagagatatttagaaaataagactaataaaaacttgttgacagactggacctatcagggagaggagtgaataaggttcactcctactttcctggattttccaactggtaagataatggagttattcactaaaataaaaaacaaagaaagaagaaaaaacatattggggcaggggttgggagtgagggagagaccagtttagtttcagaccttgtatatgagatatctttaatactagtccagagaggtgctaacttaaagtaagatatacagatctagagctcagaggagatagaaaacactcacatccttagaaaagctgacatctttatcctagaaaagcagctaaccataatccccaaacatccaaggaaaatattagactctgaccatctggatttagttaaaacaaaaagctgagaaaaaacacggcagtaatatctcaccagcagtaaacaaaaactacacaacatgcgaaacagatattttaaaaaat

SEQ ID NO: 26959 - DNA, 880 bp, Bovine  19866881188844
ggtttggggaaattttttatgctgactcaaagactgttttaaaccgagtcctgcttagatggagactctctctcactctatgcttccttccctcaccctttcccttgatccctccccccacccccttgctttctcactccctaattgcctacagcttggggaattcttcctgcccattttcctcgggaaaaaatagaagattactattttccttttaattggcattgtgtttggagaagtataacaagaagggaatagctgcctgccatatatgcttgtgacagggagcttatctaatcactaacctttgcactgctattggctattattcagctttagaaaaatcaggtaccatttattcgcttggcttatgggggaactgtagcagcctgttttttatttattgactaggaagaaaagcaggcagtgggttaaaggatattgttatttatcattatatatatttcagtgttattctctgaaagtaaactctttattaaagggtactgattctcctcctcctcctcctaagtcacttcagtcgtgtccgactctgtgcgaccccatagacggcagcccaccaggctcccccgtccctgggattatccaggcaagaacacttaatgcaatatttaaataagcccatgaaaagtagaatgggtagaacataaagtagaaattgttttaactacaaaggaaaaaacttataattccattgtctacagttaacatcaacattatggtcaatatcttatgcaaatttttttcttcatttatttaacaaattgttattgggaacctacagttagctgggcaccaagcactgtaggaacagccgtgagcctctgccttcaaggaactttcagtataggttggattt

SEQ ID NO: 26960 - DNA, 1494 bp, Bovine  19866881237033
cagacagtgatgttcctgctctccccaaaccaagatattcaggcatcctagggcaaggtcccacacttgggttttttctgacagcttctcctgagtaaagatcaatgaaccccattctatcttcaaaaggacagaatttttcctcctggggaacataaaagggacggtggaagctgacacgtccctttgtttattttccatgcacctctatcagagtccctgaagaacagagcttcccggtcaccccaggttggtccctaaagccaggctagggaacagtccagaagccagcaagccagtgctcaccctttggggtaagacacactggatgtaatgaaggagggcctcctgatgtacaaacggccaactcctccccgcctgcagtgatcgaacacgccagtttctggctttagaggaaaatcatatcacaaacacccacaagagatctcagcttggggttcctcttggcctctggcatccatctcctgggtcccagacaggaggccttctccagcaccaaacaaggggcctctgtactatttttaaaagctctccaggaaatacccttgtgcctacacttcctcaccacccactcaccttcaccagcttctgatctgccttccgccccacctctctctccacccgctggagcctcaggaaggacccgggaccacctcctcagcagccccagcccagtcctcatccttgaccagttcagtatttgtcaggaaatctcctggcttctgggacaggaaactcaggatttcctatcctttttttttttttttttaaatttggccgcaaggggtgttagttgcggcgtgagagatcttttttagctgtggcatgtgagctctagctcactgaccagggatggaacccaggctcctgcattgggagtgcaatcttagccactgggccacaagggaagtctctttcctatcttggtcatatggccatttccccagagacctgagcttctgagcttggctgccaactccctgcctccctccctaacccccatcgctgagcctcacttggcgcctccccgctgatggtcctcacatcacagccctcttgtcaatgcccgccctgatggcatgctctaaggacgtctcttcccaggcacctttcctgggtgtctgaatatcccaggctgcaccagtcatttgctgctctagcgctgatcctcccttcatacagccctctctgaatggcaccaccagccttcagtaaccactctccaatctcagcatcatctctagttcacccattgggctcacctcctgaatccagccagttgccagagtctctctgtgcaatgtctctttccagtcccgtcaagtgcttattttgtactcttttccaaacctcctcaatgagccatctctaccctctcctctgccacccccctcacaatctccatagtatgcttctacaagggtacttttttaaaagtccaacaaaaagacacaatcctctcactcctccgtt

SEQ ID NO: 26961 - DNA, 1127 bp, Bovine  19866881276689
aaatgaactctagagaccaacatacagtagcttattgttcactctctggagaatagaaataccttccctcacaaggtacaatggtgcaaacagggagtaacacttgggcttcaatgagcaaggcgttcagggtcaggaggaggccagtactgctgacctgaatctggtcagtaagaataaactccatcgacaggtataagcaaagaggggacgtgtctttcagcttttcagatgagtcgtgtgttcagatgattttcaaagttgtttacagagagaaacaagttacagatccaattctctatccactgacccacctccatgatttctgcaagggttatatatattaagtcatgctttctctttcactaaagccaatccttattttgcctattctcatagatcttagggagtaagaaaggagagttggtctaaatgagatacctacatggtttttaattacaaaattcttcatcgcatcaagacttttattggagttgcaatcacagagacactcagggcaaaccaacatccccccccccccccaacaccctggctcttgggtctcagttttctcatctatgaagcgaatagtgcatggatcagtgtttacccaattggtcaccgggtgtagaacagatgattttaggtgataggtgaataattgctccaagttatgtatttatttactaactttcaaaacacatgatgtttatgaatattactggttaaagtagatactgaagtcagtgaatagaaagaaaaatactaagtaaatgataaaaatagtcataaaatggtgacatgttatttttgaatgagtaacatctggaaaatactagactggatgatccccaaggtatgttttagctcggactctaaaatgtctataattgttaagtccttgttccaaaccttgctcacattaatggtactaaagaagccaaaattaaataaaacatgaaagttaaacagcggaagtgcagagggcttaagtaattctcagacttgagactcactccaaaattaaaactggatacatttcctttgattttgacatggaattttaacaatattgtctaagcaactccatgcaacactttcataaaagcctttttaagagcccctat

SEQ ID NO: 26962 - DNA, 896 bp, Bovine  19866881286377
cgtcttccccgtcagtaagagtcgtttatttgtgtgatggtgttgctatttgctgtgaaatataaatagccttaaaaacgtcattcagtgttcctcctgcctgattgatgatttctcccttccagggtggatcttgcctgaggtttatttaaaggagctgatctttatttatttatttatttttgcctatctttttaaaaaggaaaatctctgaatgtttcaatgacataagactagatcacaaagcaccatatattttatcattccatacaagtaaaacgtccaggataggaaaatctatagagacagaatgttgataagcagtagccaggggcgggaggaagaagggggtgggagtgatagttaatgggcacagggtttctttttggagagataaaactgttctaaaattagatggtggggatgatagaacaaccctgtaaatatactaaaaacactgaattgtacactttaaataggtgaattgtatagtatgtgaattatatctcaaaggaatttttattgaagtatagttgatttcaatcaactattcggggcttccctggtggctcagagggtaaagtgtctgcctgcgggagacccggattcagtccttgggttagggaagatcccctggagaaggaaatgacaacccattccagtactcttgcctggagaatcccatggacagaggagcctggtgggctacagtccatggggtcgcaaagagtcggacacgactgagcgacttcactgtcactttccatagctgattcacaacactgtgttagtttcaagcatatagcgaagtgactcagttttatatatacatgtatatgtatacacacacacacacacacttatatactatttcaaattcgttccccttataaggt

SEQ ID NO: 26963 - DNA, 1371 bp, Bovine  19866881317579
tgacattttaaaattctgaactgataatgtagagatatctatggattattgaaaagctgcttaagctgtttaaattgctcccaagtgaataatctgagatcatccacacataaaaatgtaattaaatataggaataacccaaagatttcaattttcattttcaagactagtaaggagaacaagtttaagagaatttcatccaacattatcatatatattttttttctctcaaaatagatttccccaacattacatgtagtgttagttgcccagtcatgtccgactctttgtgatcccatggactgtagcccgccaggctcctctgtccgtggagctctctcggcaagaatactggagtggactgccatttccttctccaggcaatctttctgacccaggggattagacccaggtctcctgcactgtaactcgattctttactgtctgagctacagagaagccacaacattacatggtcaataaaaaacataagtaaataaacaaatggctaataagctatgtgcatttgaggtcaatacttgtatattaatgtctgagaaatactgttgaattgtttcccccagatctaaaaaaatttcaataaaattcataaacgtatacataaacacttacacacatagacattaccaaaaccacaagaaaaacttttattaatctaatcttaggtttacttttaaaaaacctactataattattttaccttttacccattgtaggaataaagtgctatatatgcaaatagagagatgtgttgcattgctaagttcttgtaaaagaaactaagaatgtcattggttttaccacaaatggtagtcctttctagtattactcctatagaaaaacataccacattttttaaaaatcctacattatagtatcattatttacatctgccacaattatatctaccattatttaactgatttatatgtgagacacattcatttatgcaagtttccattaaaaggtcagggatagggtcaagaactctaattctgacttaggaacaatccaggaagaaatcactgtggcgagcctgatattaaagactacagttttccagcaaaaacatgaaaaacaaaatagtatggcatcatatttaatttttcagagcctcaggataatattctatgctggatactacccagcagtatttgaaaacttatagatcataatatttttcaattaagttaccaacataatgctatcaagtaaggcagagtgtgtgcatatgtattaatatgtatgtgtatggaggcatccttatatacatatggagaaaccataacacaaataaatgatcaccaaccctcttggaaatggggaagtactgatgctgctgctgctaag

SEQ ID NO: 26964 - DNA, 666 bp, Bovine  19866881365662
aatcctacgtaactttacaattggcccttgatgtctgcagtcccacatccaagagttcagccaacctgggactgtgtagaaacatagtagacattgagcaaaagaaatttgtaagtgtagtggaccctcccagttcaaacccatgttgtgcaagggtcagctgtatttcctattattaatacttacacagcttgtttaccaattactgcccactagtgatcagcaaattagtacatggtcctagggctcacagttcagtccttggagtatttgtttcttcatgggattatgtctgtgtcatgaaatattgacgtaaaataaagatgtctgttaacttagaaaaggttattaatttggaggagagggaattggctgcagttgtctgtatgttttgtgatgtgtagcccatttaaataaacccttagattgagaaaataggtaggaactttattatcagtctgggaatttgtagatgtttgttgacttctggtttagcagggaagctgaagaagagtactatagatagtttgctttggttatcaaaatgccaccacttctaattctaattatctgttggcacagttcctacctagcattaggttcctgtaaatgaaattttttattttacatacagtttaatggaactgctttaagtatcgctctttt

SEQ ID NO: 26965 - DNA, 745 bp, Bovine  19866881411407
atctggatgcctgcaggcttctctgtgagctggagctagacctgcgtgcagatgatggaaaagtttaaaaacccattacaaaagtgctccagatgcaccgaatgcgaagctcctgtaatcagtattcaaacagagcaaaaagcctcctgtggcttcatctcccctgctccacggccattacccctgccccggccgccatggcaacgtgaaaacatctgggagggcgcccccgaacagagcattaaaccgggagggagaccaattacccgtccccggcaatcaggccctgcccgctccactccacctggcttcgtctctttattaacagccacctactccctgtgcgcccccgaggctctcacacagccccccacctgcacttgattccattttgcctcctacagccctgccatttcctgccctcctccgtcaggacacctcctcctcccacaggacgcccctttggcccccgggtccccctcccggctgccctccctgcgcagccgacgggagcagcgcagggcggggccggggccggagcgcagcaggagaccatcttgcttatctggcttccgtgctcaacgcgagtgtctttctggagagtgagccgagccaggggtcctggagccacagcctgtttaaagcgatgctttactgccagctgtttcccctgcagctctttcccagagaggcagcccattaagacacctaataaatattaaataataacaactgcagatctaat

SEQ ID NO: 26966 - DNA, 902 bp, Bovine  19866881465422
gaagaacgggtcatcagccttggccctcaggtggctgaaggagaaaatgtatttggtgtgtgccacatctttgcagccttcaacgacacttttgtgcacgtcactgatctctctggcaaggaaaccatctgccgtgtaactggggggatgaaggtgaaggctgaccgagatgagtcctctccatacgctgccatattggccgcccaggatgtagaccagagaggcaaggagctaggcatgactgccctccacatcaaactccaggccagaggaggaaataggaccaagactcctggaccaggggcccagtcagcgctcagagccctcgactgctcagggatgaagattgggcggattgaggatgtcaccccaatcctctccgacagcactcgcaggaaagggggtcgccgtggtcgccgtctgtgaacaggactcctcaaagtattgctttctgtcaataaattgctttgatgtaaaaaataaataaataaatagttctcactaaactgtgagagaaaaagggaaaactaaagttaatattatttactggaaatggagtttgaaggtgaagctaaaaggtggagattcaataatggtaaacagtttatgcataaataaacctaggcttaaacaagacagactttttttcttcctcttttctaacagaaaattccatagtgggtagtctagggctagtgcaggggaattctcattgcggttatcttttaggctcattctatctttccactttgccatctttgtcatttgatttcatcctcaaagttgtctcatggtgattacaggcaccagtcattgcatcagcattccaggaagtgggaagactataaaaggctaaatggcaaactgagtcagcattcttttaaggagttttcatggaaatt

SEQ ID NO: 26967 - DNA, 1497 bp, Bovine  19866881485957
tttcaacatttatttaatggataagtaaactgtggcacatccatgcattggaatatttctcagcaacacaaagaagtaagctacgggtgtgtgcagcttgtgtatatctgaagtgagtcatgccaagtgagagaagccagactccaaaggctacaaactgtgtaattccaacactgtgacattctggaaaggcaaaaccaggagacccaccacactggtggttgtcagggtctggggcagagccatcagggtggactacaaaggagcctgagggaacttttgggggtgatggaaaagttctgtatcttgattgtggtgatagtaaatgtaaatctgaaaaaaatctaaatggttaaccacacttgttccccaagtgatctggaatctactgctgatgaaggctgcgtgctgttttctgtcggaagatgtttgggacccacagggctcagggtcagataaccgttctgcctgagcagacactggacattcttctcggggatgggtgggcgggctctgggcccagcccggctcctctcaccaaccagctggttgcccctgaccagcgtcctgtgagaggtgaatttcccccaacagggtcctgcggtcccccgatctagagaattcgcagcagcctcctgaagtgctcgtgacttctggcctgccagtgtgggtgccacacccccaccagtctccaaactgaaatgaagttcaaggtagctcctcgtagctcctggaggcaaaccctcagggacgtgaaagggtcccagagacgccagtggggtgttttgatcagtgtaaacagctttgcagcctgtactttcagggaccaggccaggagttaagaccctgctgttaacagtcactttatcctctccgcccactctgcggagcctggcaggaaggcaggaggagcagcgggcaacagatgcacacagcggctgggcggaggccccgcagataggaagaggcagagtgaaggccagtctgcccacagtgctgaatggcccagttttcttggggtcaagcataaccttgcttgctccgtgaagcccctcttcctttgcctttatcaaccttttctcatgcacggattccatttgatcactatgtaaccagccagaactgaaagcgtgatctgcgatttgaaggcctgtgctttgagaaattgtgtgtttgcactgctgaagttctaggagggtagtaatgaggcacaggaggagagagaataggatggagcagacagaatcagggcttctgtcaccataaggagtaatctttccaactgcccttaagtcctgactctgctaaagcagtgtgccccttcccagccacaacatcttgataagacagagggggaaggggtcctttaaaagcagaccctgcaggaataaggtgtgtgttccaagctcctctggtcctccgctttccccatcagatgacagaggaatgtcttcctgagttttctacagcagaaacctgttggcaaggcagagatca

SEQ ID NO: 26968 - DNA, 749 bp, Bovine  19866881732221
taaagacaaggttctggaagcctttgaatcactgagatttgatccaaaagagaaaaagactgagaacggctttttacacagacctggaagaggcactaatgaggtggtaccgaatcgctcagtgtctgaatgtgccagttaatggcccaatgttgcggctaaaagctaatgattttgcccagaaactgggacataatgattttaagtgcagcaatgggtggctggatcgttttaaatccaggtatggtctagtattcagagctcaacctgtagaagccacaggtgtatcagcagacccttcagctgtctggcaccaaaacatacttccttattatttaaatgattatcatcctaaaaatgtttttaatgtaaaagagactgggctgctttatcgaatgttgcctacaaatacctttgcatttaaaggagaaacctgttcaattggcaagttatgcaaagacagaataaccctggtggtcgggacaaacatggatggctcagagaagcttcctctgcttctcattgggaaaaacagaaatccacgttgcttcaaaggcataaaatcgttgcctgtgtattatgaagctaacaaaatggcatggatgactgcagaagtatttgaacagtggatgcagaagctggatgagagatttcaagctcagcaaagaagagtggtgatttttgttgaatcttctcctgcacacccagaggtaaaaaacctgaagtccatgaattagcgttctttccat

SEQ ID NO: 26969 - DNA, 1458 bp, Bovine  19866881740741
ctattatgctaatggagtgtttgtctcattgccagacttgaatgacattatacaaggtctggctttgagctcttggaaattggaattagagcaggagggaaggatcttggcctacaacatttgaaaccttgattttaaattaattatacataattagcataatttaattacacttaggacagaagttctcaaagtatgttctaaggaacctaagattctgtgaagatctttagggaattttgcaaatgttttattgaaaatttttaaataccatatgtttttaattgtaaacaaataatatattatataccaacttttaacaatcagcacataagcttgtgcctgccaacctaactttgagtgtctgagcccagatattggaataaaacttttcctactatcactattaactataaaatgtctggaattcacaaagcaaataggtttttcataatctgttaccatttgcagctcctcatctgtgggaatcagtcttccctcacaattatacaatcaaaaaaatgctaaaataaattggatgtttaggctgatgtaacttcaatttatggccctaagtccctgttttaaattacgtgtcacaaagattttccattatctccttgattggcttctaatgaataaaatttttgagtgaaagcctataaaataaatgtttaataataatttgcccattttaatctgtttcctatgttcgtatagcagaatacttgctgttgcaaattagagaaaaacccaactcaaaacggcttaaagtgataggatttgtcaccttgcatataaagaaattctgggggtggtggatttgatggctcagcaacattgtggaggacctaggttcttcccatcttctattctgccttcctcagggtgttgacttggggttaattcccttcaaaatggcaagacggttgtcagtttcaattgtcccatgctcacatggttgtcagtttcaagcatcccgtgcacacgcatccccaaatagtcaatgggcagaaagggcaaagagtctcctcttaggaccaagcactctttcccagaagcccctgagcaggtctccccctggtatctaattgcctagagcctgtctaaaccaggtttagaaggagaaagcccaccatcattggcttttcctgaatcacagaccttaaaacaaacctgggctcagccagcatgatcacaggaaagaaaggctgttggaaccctactaacagtgtatgctaggacttgggttcattgtatgaattatttgataaaatatttttgccattaaaaaaaaaatcagttggagaaccaggattactgagaacttttcttggattggccttgtggctgtttttgccgaaggtcagctttgctgatcctgccccagttttgctgggagagaagggagagctcccacctgcattaacctcggggcttgcggcctactttttcgca

SEQ ID NO: 26970 - DNA, 934 bp, Bovine  19866881826005
cttagatgccaggcggtctaataaatccagcctgggttaagattaacattgtgctgaagccagtgcctcttggtctaatctatagtcaaaggggtacccaaacatcttttcatgtggcccactgctgacttttttcctttaattcgcagaagtacgaccaaaggaaaactttaaagctgatgacgttgaactttataagctgaaaatcacctctctctgctgcatggagtaaacagagatttgcatgaactggcaaagcatcacccagcagagacccaggggtccttaaggaagactcattccagccccttcaagagcatcccttcaagagcctcttgaaatgtccaggatggaatttgaaaaaattaagacaggtagctattgacttaatggagggtaaaatactttgaaataaattttcttagtatttaaaaccctacagaagcttcctgctatggaccgaattgtgtcttccacccccaaattcatacactgtaatctgaacccccaacataatggtgttaggaagtggggcctctgggagggaactggggttagatgaggtcatgaggatgagcccccatgtgggattagtgccctaataagaagaaacagcagagcatcttcccatcgtgcaaggacatagcaagaaagcagcctcaatgtcaccctctcacagaggcccccccacaccccatctaaaatctccacggtcacccatagtgtctgtctccttttctgctttattctctccctagcatgtatattttgttctcacttaatctggttcattatatacactccccgtcatgccacgatgagatgagtcacttcagtcatgtccgactctgtgtgaccccttggactgtagccttccaggctcctctgtccaggaattctccaggcaagaataccagaggttgaacccacatct

SEQ ID NO: 26971 - DNA, 778 bp, Bovine  19866881931522
tctgtggacactgggttgcttccacctcttggctgttataaagatcgatggtgtgaacgtgggtagacaaataactgttcaagtccctacttccagttcttttgggtgttgtgtccagggtggaattgctgggtcatgtggtaattttatgtttattttgaggaatcgctatactgtttttcatagcagctatatcattttacattcccacaagcactgcccaagggttccaatttatgcacatcctcaccaacattttatagaattattctaagagagaaattaaacagttaatatacaacatgccatacagaatgcaaaatttacatgattgttttgtcataacagtgttcgtgttctgcattttggtggttttgagcataggagaaaattagatacatgataaaatgtgtaatttgtattattggtaaaggcagttatactctttaaatgttccacatttcaggtattgatgaaccattgcacatcaagagaagaaaagtaataaaaccgggtttcatccatagtccttggaaaagtgcatacatcagacagcacagaattgatacgaactggaggcggggagaactcaagtctcctaaggtaactgaacgcagtgcagtctaacagaaaccgttaatcagtgctgtggtacacagtgcgctctttccctggcaagccgtgtgatttgacagcccatcttctgtacaaggaaaacaatatatttttaaaataacagaaaatgtaactgacagtgttcctctttactaatttttct

SEQ ID NO: 26972 - DNA, 1719 bp, Bovine  19866880520767
atattattatatttccaatctcagaaagggttggattttctaaggttatgcacctaataaacagcagaatttggacttaggtaatataccaagtaactttttaaggacctaacttctttggatttaaaaattccaaattcttgccgtttcagatactgctagaaaagaggaaaggaaacatttgttgagctaatatttatatttgagcctctacattaaagtattcttcaatttcttttatatttccctttagcacaaactatatcatttcctattagtaaatacttcttttcattaatctcatctccatgttataaaccacccccctttttttttcttaaatcatctttcggtaaggttgcatttttactccttagcaatcagtgctgatttttttttttggccaaattagacttctttccttttccttccaaagaaaaaaacctatgtttggctctcataaacatttagactcaggatgctttacataatcactatctcttttaattttcaaaataatatataaggttaatattattaggttttccattttactggtaacaaagagacttaaacagattacctgacttacttgaggcctcacacctagtaaatatccatactttaaacccaggtatttccctgctgcatcctgctgcctccctggcaggaatgactgaaattcttttcacctgttatgatcccagaagcactttttcttacgtgtctgagcagctgtaaatgcacttcttggttcccatcccataaacctaattccatctcagggtcattctgcacagcttgacttacacataaaaattaacttttaagaggtttactttagcttgatagccatctattcactgatctagaaagcaggtatcctgagtgcaatttcctttctataaatgaatacattgctccactcttctgtgagctcattcttatagagtatcacatttgcattattgttccagactagatgagggcataccgacctatagttctcaaaccctcttggtcttcgaatttccataaacaactaagcctgggcattcagaggacccagatattgaattttttttttctcatttggaggaaaagtaaaagaaaagagaaatagaaagtacttggcaaaaataagcacaaattgatcttggagtggaaaaaaagatttgcagaaaaagatgaaaagggctgaattcccacagcacagacgaaagatgattgaagggaaaagtctttactaacagagatgatattaaaaaggaattctgctgagaaagtttagttgtagcagaatgtttaatacaaattgtgtgtatatatatatgtgtgtatatttgaacttggaatgctgtgtaacccctgaattgttcttattaatattactagctaactcttagttttcctgtgtgctgaacagttagctcatttagttctcgaaacaatcttgtgagtaaggtacacttttttctgtgctttataaagatttggagaggttaataacttgctcaagttcacaggactggtaagttgtagaaatactgacaaatgcttaatagcacttaccatgctctgtaattacttatatgcttactatctgtctcttccagtagaacataagtcccaagaaagtgaaagtgttagttgctcagtcgtgtccaactctgcaaccccatgcactgtagcccaccaggttcccctgtccatggaatt

SEQ ID NO: 26973 - DNA, 3497 bp, Bovine  19866880561805
tcctcctcctcgccttcctatgtttttatagagcttaaattttgataggtgatatataacctcccccccgccccccgcccccggcaaaaaaaagtgcttcccaggtggtgctaggggtaaaaaatccacctgccaatgcagatccaacaggcagacgtttgatccctgggtcaggaagatcccctggagtacaaaatggtaactgctccactattcttctctggaaaattccatggacagaggagcctggcgggctacagtccatagagtcacaaagagttggacaagactaaaagactggagcacagagcacataccaaaaaagcaggtaaaaccaggtacctgttttgtagctactttctcttccactcagcaatatggaatatatatcattttctatcaattaatcatctatattatcggacgtgagtctcagtgaactccaggagttggtgatggacagggaggcctggcgtgctgcaattcatggggtcgcaaagagtcagacacgactgagcgactgatctgatctgattccacaattatacatgtctcatatttctcttaaccaagcaatggctgagagttcttcaaactgttttaaaatgctgatagcatttttttaaactgttaataagtagggcaatggctgtcaatcttccttacaattctattttaagcatctaaaagaataatttattattaaagataattaatatttaagcatctttgtgcacaaaacagtaatcacttgataaatgtttaagtgaatgaccaggttgatgaacaaacttagattcgtgacattcagttatctccttaggctatattatactttccttacttgacatttttcttcactcacatctctgatccttgttctatatcccttctgcttagaacattcttctctaaagtttactccatgcagctctgtcgattcctgttaatcctgtgcggcagtttcaatgtcactctcatctttctgagtccttactctgagcttacgtgattttaaacactttgagaacacagacggatatctgcatcttgtttactatcacccctaaaaagctttacaaaattcagttgtttcttaactctaatataaagttttacattttctcttggattttgggaaagcttttgtcaatttccttaaggccttgaccagttatgggatatgacttctgcttacaacaatttgaataggtatgtgattgaaagcagagtgaatctttcatttttggcatttagaatgcaagtcatttcccctatattttgaagaaagcaaagattataatttctactttgcaaagagaaagtattatttcaccacacttctacatgttcttattacaaacatgctaaatactacctttcaactatgaatgttccaagctacttattttttgtttagtagaaattttttatctgcaaatccaggaggactacatgaatgtgtgtttaaaacaacagtttccaccaattaaaagggatgatatcttggacctaagatgtccctttaacttcttgacaaaacacaataccagaagatacttcttagttgattgtttttccaagaggcaaacaaaatcaccagataatgttgatcaaaaaacagcatcctctctgtctgccccggtcctctacctgccttacaaaggagtagcacacaattagtagcaagaagaatctgggactgaaaagcctttccttagaaatgctgttagcatactggactggctgagcccagatagaggctctattgtaactgccccgaaatgggagaagactccagggaccacaacttaagcacatttgggggaagttgaagttacaggctttctcttgcactcgtcaatttaaaaaaaaaaagaaaaagaaaagaagacttcttttttctctactaagaaaacttcctatgaaggtaagtgagtaaaatctcccagactgaagattactgggcacctgtcaaaatgaagaatctaaacaaaaagtctgtcataggtgacaccaacaggtcaatttctcaggatttttaaataaactgacagccctcagccaattacgtgaattaccagccgaagtggcatgtctgttcggcaagcaggaaaaggcgctttacatgctgaggcccaccaggtgccaggcactgactggggctccagatattctctcctaacggtactgcacctcggaaccatctctgatgctcaccagggtggatgggtgaagctcatgcattcattgttcaggtgaggcctgaactggggcctgaatttcaaagaagtgttcaccgtttcctcagaccacgctgcctagtagttgcttcatccacagaatgaagccagtgttttattttattctattttccaggaaataaaaccagtattttaaataacgataaatggaatataacctttaaaagtgtgaatcagtatgttatacacctgaaacttacatattcttatacatcaattataccacaataaaaaataataaaaaagagactttggtaaaactaggaagatagcttcacaggcaggtcaattaccagtttgttagaacatccacttttgttttacatatgttatcaatgtatgttgagattctgtgttgccaaacagaaatctcacaaagagacccctgctctgagatgtttctttttcactcaatatgttcttcttggaatcctaaccaatttcacgagtgatgacttcaaacttgcttctctctgttgagcttcagacctgcatttactacatttgctggagtctgtctgatgtccagaacacacttcaaattcaacaactcaaaaaaactgtacttagcatcttccttttagagccagctcactgtcctgggttttccatctctaccttactgttcaagcctgaactaagattctggtctcccaacccagtacatcaaatccactcccacatcctctccagactgttttcttaagagcttctccatttgcccccatactctgttcccacaaacaagccctggtgatttctcctctagattattgatacccctgacttcacgatgcaattcatctccatagcaaagataaacattcgttcatgattaccctaggcattcatatgatatggcacttccttagcagagttaacaaagcctctcgtaatctggctcctctctgcccgcttacctcccaactgcttggcatgcagtgtcagtgtcagtgtcagtgtcagtgtgtgtgtgtgtgtgtgtgtgtgtgtgttcgctgctcagttgtgtgagactgtttgcacccccatggactgtagcccaccacgcacctctgtccatggaattcttcaggcaagaagactggagcaggttgccatttccttctccaggggatcttcccaacccagggattgaaccccgggctcctgaattccaggcaggattctttaccacctgagccaacactttagatctactcaaactgttcctaaatgccggctctctcacac

SEQ ID NO: 26974 - DNA, 801 bp, Bovine  19866880567783
actttgtggactctcagtgtagtagcattcagagaaagtaattttcagctaacatttttggggaagactccaggagaagcagtgggattttatttgagtcttaaagagtaggatttggaaagttcaggagaggacatgacagttatgggagtagcatgaacacaggagtgtctgcatgtgagtgtgtgttttgtagttgttcagttgctaagtcttgtccacctctttgtgaccccatggactgtagcctgccaggctcctctgtccatgggaatctccaggcaagaatactggagtgggttgccatgtccttctccaggggatcttcccagatcagggatcaaacctgcatctcccgcatgagcaggtggattctttaccactggcatgtacatgcgcatgtgtgtatttaatcaaactcagtgctcaagagaagactggttcaattgaggagcagcgaggaagaggccacagggttcgggagatggggccatgcgccgtccttcacacaggccggactccacagaccagtgaggcacttgagttaaaaagtgcctttggagtcactgacctcttctgataggtgttatttattattctctcacatatgtgctcttggcccccagaaaatgctttaatctaaagctccaaaatcatctgtcattgtccagaatagaattaagcgcaacaaatatgaccatcgctctgagacactcatgggatttgggatgtcgaaaagacacaaaagcctcagcataataggcagagaagtggcaggttcctagcacaggactaattttt

SEQ ID NO: 26975 - DNA, 3000 bp, Bovine  19866880583819
ctcctggggcatatatcccaggcaaaactctaattcaaaaagatacatgcatctccatgttcatagcagcactatttacaatagccaagacatagaaacaacctgaatgtccatcaatgaatggataacgaggataaggtaaatatagacaacgggagtctactcagccatagaaagaatggaataataccatttggagcaacatggatgcaagtagagactatcacactaagtaaatcagatgaagacaaaggtcatacaaatcactcatgtgtagaatctaaacgtgacacaaataaacctatctacaaaacagaaacagactcatagacatagagaacagacttgtagttgccaagggtgtggggggttgggttagaggaaggatggagtgagatcagcagatgtacttttacatgtagaatggataaacaaggtcccactatatagcacagaaaactatattcagcatcctctgataaatcataatggaaatgaatatttaaaaaagaatgtgcatacatatatatacatatatatatatatatatataattgaatcactgctgctgtacagcagaaattaacacaacattgcaaatcagctgttgttgttcagttgctaagtcatgtctgactccttgcaaccccatggactgcagcacaccaggcgtccttgttgtgggaatcaactgtacttcaaattaaaaaaatcttctgtagcattttaaaagataattttgtttatttaattttgactgtgctgggtctttgttgctgcatgggcttgtctctagcttcagagagcaggggctactctatgttgcaatgctcaggcttctcattgtggtggcttctcttcctgcatagtgcaggctctgtgtcacatgagcgtcggtatttgtggcacatgggctcagtcgttgcagctcctgggctctagagcacaggctcaatagttgtggcacatgcactaagttgctttgcgcatgtgggatcatcccagaccaggaatggaacccatgtcttctgtattggcaggtggattctttaccactgagccaccagggaagctcttctttaagaatttctatcctaagttacactctgaaacaactgccaaaataatcttattctctccctatccctctacctccccttctgcattttgaccatttttggtggggacaaatccacttatcttttaaaaccatgacttctgaaagctctccctccatgggaaatagcagcctttggtgatggctatggtaaccatggtcaccatctttacctgaacccaggtccattttggtaatctgtagatccaataccttcccatgtatggtataccttccactaaaatgtcagacccatcagaggcagcaagtttaagcgaggattggtaactaggcaatggtcagctatgaggtccagaagaaaacaattaagaaacatcaaagagtaaaactaagaagaggattgattatctatcaggaaatgtatccagagaaattcaatgagaagtgatgagtgcagtgaagaaatgcaaagctttaaaacaaaaaatcagagctgtgatgaaccgaaagctaagttgaatggaaaaagaccaaagtatataataatataagaatatgctaagatctatgtcctaaagtaacattcactgctgaaagaaataatcttcctgtcttggcttgtactcaacaacagccaggaccaaattccattcacctctgtgtagagcctggcacatgagtgcaggcatgaacaaatgagttgattgctggtagatgatctgaactcagttgtactgctttttttaaatatatagttgacccttgaacaatgtaggcttgaactgcacaggtccacttatatgtagatttttttcaacagtaactgccatagtactataggatgcggttggttgaatctgttggtgtagaaccacaggtaaggagggctaataaaagctatatgaggattttccactgtgcagagtgggcatccctaaccactctctcctccatgttgttcaaggttcaactatactaacttcttgcgtgttgacacaactcaagtgatttgttttaaaggatacagtatcactcaaaatcattttactatctagcttactccccatcaaccctttctgtgtctttgaaacgatcagaaaaaccatgtgtatttgtgtctatgtgtgtttcacaggagaaccataatactccctatcaacttcccagaaaatcacatccattttcaataatacaacttcaaacttctcagcacttatgaatgtttcacaagcctaagaaaataagatattagcaatagtataaataaaacgctggctatttagatatagtcaaatacatatatcattttcacaaatggattcaaattgctaacatgtgtttgcatgtggtctttcaggtacacaataaaatgttagggtaaatactgggttaattttaataaatactctttgtttagactgtagattgtattatagaatcaacaagaatttgttgagctgattaaaataacagagtagatatgaatgcaccaaaatagtcatgcaaaagtgttcatatctcattcaacacagaaagtaaaatataaattctttatactgaatattatatcaactatgacttgaggataggtgattgattcagtgtcttgtacatcatattagctgattgttctattccacataagattcaaggtattaattttagtttttaacgtccctatgttttaggaactacatccttgagcaaataactagatatgctaaaatgatcttgctacagtttcccatatatagagtctgggttatctttgatttagtgtagttaaatgaaaatctctgaacttttcagtacagaatagtacactatttcaaaatcataataaactcaccctgtttggaaatggctatggccccaggttctattattagccatatactatagaggttcaaataaaatttttc

SEQ ID NO: 26976 - DNA, 729 bp, Bovine  19866880596763
ttcctgtgctatacattaggttgccattagttatgcattttatgcatggtatcaatcgtggatatatgtcaatcccaatttcccagttcatcccacccctccttggtatccatacatttattctctatgtctgtgtctctatttctgctatgcaaataagatcatctttaccatttttctagattctacatatttacgatatttgtttttacaatgtttttttaaaaaggcacatgtcacagaagttaaaaaggctgcttctagaacacattttgcccaggctcacccagagaatcatggacacaagggagaggtgtcctttgccacacccatagctcagtttagacagctgaaccctaatcataactgcagaggattataccaaagccctgatggcagattcaaggaaatgaataacaatataataatttatccagtgcctgctctcggccagatattttgtcaggtgccttatgtatgttaccactaatcctcactagatccctacaaggtgagctttttcctcacagtccaacagatgaggaaactacagctcagagagtttcagtaacttgccctcaaagtcatgccactaccatcctgtttttgcagtgcactttactccaaagcccacacactttccattttattaaattccctttatgaaatacagattctaaaacagaagagtcctcttgagaaaatatgacactcattcattaaaacaaa

SEQ ID NO: 26977 - DNA, 1069 bp, Bovine  19866880680278
caaacactgatctctgcaaagtactcaaattaggaaggcagaaaggatgaagaaaagagatcggttcatttccaaagtactcatttgaaattttttggtgctgcaaccaaggagatgggtatgaaaaagaaattggatcaaaatatccaagtctatatttctgtataacccaagtctctgaggttagccattgtttacatctgcaataggagaacagagttaaacacgtaacactggtcttttggcttgatgacagaaaagaacatgatgccaagggcaatttatattcctgacatatatatgctactcagtgccttaggtcaaagatttgaccctaatgccttgatttctcaatctgaaaatatggatagagagcaagaagggggctcctagtagatgagagacaccacatttgtactatacttatgctctaattgcaaactacccacagttatgtacattctgttttatgtgctttataagagtcagatgtggaattccctgttggtagtggttgttttaactctctagaaacttgaagggaagttagaactaaaaagaaataaaagaaataagacttaagaattaaatgctttgaatattttcctccctaattttctttgtagagaaatggaagacagactagcatcagcggggtgctttcaagtgaatcataatcaaatgtgcgtgcaaaaccattggtgaagtctagatgtgcaattaaatgcctaattatgctcagagagcccctgcattctttactccctcactgcaccctcaggaaaccacacagcagccttctgtcttgagtacgggctctttaaagtgtttaaatggcatgcaagtgcaactgcgtgcccaattaggggtgcaactgctgggccaaagcatgaaacacagtctattccctgccactctgggttagctctccagacctttagggccatgttcctcagctcctttggcatcccagggctcagtgagaagtactggatggtgctttatcctttgtcagttttagagatggtaccagggagaaaaagtcaaactctgatgcttccaccaaagg

SEQ ID NO: 26978 - DNA, 1512 bp, Bovine  19866880720077
atggtttcagttatcatttctaacctgattgtgagacgagtattatttccgtgctgagtcttgtgactaagcctgcaaaggaattttctggtttgattgagtaaaaagcatctcatttcagtttcttatccaccaagatccaataacttattctaaagaaaagaaaatagttttaatttatgagaacataagtgaaaaagctcaaacgaataacactagtcagaaactatccaaaatcatagtctttggtgtttcatgttgattttaaaatttagaatacaatttataatacagggcaataaaaatgaagattgttcccaataaacaaagtgcaaatggtaaaaacaaaacagcttgaatttctcaaataagtagaattagtattctcttctatctagttcccttagagaagaaggaaaaattgaggttaaggtttgaaatattttgaactaattacccacactggcaaataaaaggtgcttataatctgggagtaaagatatgatggcagttattttaagagtttaaatatttttaactatttttaataggcagttattttcatcctatctgagcatctatttttcttcttcttgacctacaatacatgttcctttcagaaatatacagaaaactattaaatatttcaaaatagttagaatcatccagttctttattacaaagtaaaacagaatttaatttgtcctcagcagactgtcagtgattaaaaagattgcaaacagccagttccagcaaacatgggaaaattatacaaatacaaatatacaaataggtgggaaaaatatacaaattttgtggaaagtaatttggctgtcaatatctattgaaatttgaaatgtgtataccttgtaaggctgttcattgaaaaaacatgataacaatagcaaatataggaggaaattaaattagggaaaaaataaaattaataagggaatggttcagtggtaacaacatacagtcatcaaagagctaaaaagtcctgcatgaaatgacctagaaaatgtccatactatagttttagtaattaaaactgattctagataaaagcatttaataatattccagtttagggtatcaaatacatatgcacataaagtagaaacctaagaaagatgaatgatatatatcaaatagctagccagtttttaaccctgggcagagaaagtgtaaggtgggaagtctctagcttcttattttataaaatccaaacataaatggaaggatagcaggtgaattctatttatttttcaacatatttggaaatattttcaaatttaaaaaatattcagaagtcagaaatctatatttcaataaatatatttaaaagtattctcatcatctacaaaataaaacatccatgaaataattgacctcttaatttagggagaactacatttgttaaaatgaggttacgttgacttggactcttttcctttgccatttgttataaattggtttccagtcactctaaatataataaacatgactatt

SEQ ID NO: 26979 - DNA, 1367 bp, Bovine  19866881086502
cagggagcacaggttcgatccctcataggggaactaagatcctacattctatgtggccaataaataaattctaaacataaaaatcttgtattaaattttaaaaatgtagaacaatgttaaaagacatgaaaggatcaccagcaccacaaatgagagaacactaacaattgcaaaggaatatatacaatatcccatttccattaaaaaaatacatagatccttacacttgcataggatcaaagtcagagtcactgcttctcaatggttagagtagaagcgtttgtcttagtcagtcccagacctcatccccacacccaaattttacagagaacggcatgaatttttttaaaaagttatttttcaatagtaattacttttataaccaagactgagagagctagagaggccccactagcaaaaggcccactcacgtagatcataagtacaggacagccaaagcagctgaacccaaaagctaacctcaaaagcttagaaatgagttaaaatgtgtgccaagccatgatatgcactaagttgaaaggaaactggctgcgttacttgtgaggcaacatgattactgcaggcccagcgcttctctcgctcttctcttagatccccaaggcatccccttgaatcactccctgggacttgggtccagaaacagcgagtgaagagtgccgtgaatgtatcatgttcttaacctaacagaaatactgtttgtctttatttgtgatgatcattttgataagttttgtgtgtccaaggcatattataaatttctttgtcaaacagctacaattgtaataaaataagcacacaaatatggaataaattacatcttaaaatgttccttttggagaaaaaaacttttacaaggcacatttagcatgacagaaaaaagggaaagaagggagaagggatgggggaggaataaagaccttaaagaaaagaaaggtaaaaaggaaataaaattttaaaaaataagataactagagatgaaattagcataccataacatcccatacacttggagaaaatgagccacaaattcatatctaagcttcatagtagccaatgccacagatgaaacaattttctaattcatagtatgtttaagataaaagcagaaacaagaggggatttctcccatgatcccttaataagaaacacttttgttgttgctgtttagtggctaagtagtgtctgactcttttgcaacactatggactataacccttcaggctcctctgtccatgagattttccaggcaagaatactggagtgggttgccattttctttcccacagttatcttccccacccagagatcgaacccaggcttcctgcattggcaggcagattctttac

SEQ ID NO: 26980 - DNA, 3115 bp, Bovine  19866881109015
gctgccctgtccttcgctacttcccagaattttctcaaactcacgtccattgagtcggtgatgtcatccaatcatctcatcttctgtcgcccccttctcttgccctcaatctttcccagtatcaggggcttttccaatgaattggctcttcgcttcaggtggccaaagtactggaacttcagctttagcattagttcttgcactgaatattcagggttaatttcctctaggactgactggttggatctccttgcagtccaagggactctcaagagtcttctccagcaccacagttcaaaagtatcgattcttcagtgctcagccttctttatggtccaactctcacatctgtacatgcttaccagaaaaaccatagctttgattatccagacctttgtcggcaaagtgatgtctctgtttttttaataataccatgtcatccttcggatctcagtccaagagtcgattcctcaggaactgttaaattttgcgattgtgtatttgactgtctctctcccttgacagaattataagtccctgagtgcaagagctggaaatattttctctctccatcttgccttcaacagtgtctgggacgtaatagacatttaataagcattgaatgaatgagtgaatgaagctaggactcaactgtggtctatcccttccaaagcatgttttcttacttttgggggaagggggagtccttggggaggggacagttctgccacgtggcgtgtgggaccctagtttcctaaccaggcatgaaactcaagccccttgtattggaagtgtggagtcttaatcactggaccaccagagaattcccaaagcatgttttcttaaatggacatttactgctaaaaagagaaaacccagtcatataaagagttaggggaagggcactcaagatgaaggggttaatccatgcagaaggactgcatgtttaaggaagaaaaagacagccagtgagcaaggcggtatgccacagggaccacagcttctattgctaactagctgtgtgacctcagcctctcagagtctcatctaaaaatgaggcaaacacctactgtatagcattactataaaacttgtataaagtaatccatgtaagtactaagcctggcacatagtgaaaagtaactaaaactaatgtcttacaggatctgagacctttgaaatatacagacctttatctaagagaaattttctgtctcttcttcctcctctcctgtgccctccttgctcctctccaccttttctccaccctcttcctctctctctctctcctctgtgtgtgtgtgtgtctctctctgtctctctgtcaaatcacttcccaagctactggagtatatttgcaaacacactggctgtgaccttgacatggccccattcccactccaccacatcccctgtcacacacatggggacacacacacacagatatactctgtggcaatgtaatccccataaattccagattcctgtgctgtttagctgatcactgctttaaaataaatctaaaagacagaaagaaacacactaaatcctcattttaaatttgctgaggtatttttaacttttatcttcaaatatctaggacttcaaagtttctctgtacatgcagttaagaaaaaaggcaagctaacatagaaagcatcaataagaaaaacagagtttatttggcaatggtgcagaaatatgctgcctgaggctactactcatgaaaaatacattaaaaagagagctcagaaaagccttcaactattgggtaaaaggatataaaaggcctgggtttttttcacatttgtaaatattcggggagatttttttaaacttaactatgacagagatatcctagtctatatatgttcgggggcattccagcagcacactcttcgattctaagaatggattgtcaatattccatatcagttttcttcatttaaatagctagtggcagcagaaaacttcagtttaaagctcacagattttcctatttgctgctctaagagccccataaacatatgtatctttggaaaactatcatgtgttttcaacttcctgaagaattcttgtaaaatataactgaaccacattaccctttgtcctgagcttttattccactaatggacaaattgggaggaggctgagaacaaatgtgctattaattacccagatggctttttaatagaaccttggattattcttcagccactaaacactgtccagaaatttcttaataatgctggtgtgcaaggcattccttccaggagaataaagatctcattgactggcaggctcagttatgtcaggttactttaggagacggtagacaaagggtaggtattgtatagaccagagagaatgacagaccatatctgagctgcccggtctccccagcaatgacagattttctaatttactgcagattctcacaaaactgggtggtcagctttgcagagaaccaacagtgggtctattgattctgggtgggagcaacataattctgaattaacctgaattgattcaatacaacagagagcctcggtattggattaaaattaggattaatacattaaatgttaggtcagaatgttaagtcccagtgctgaaagacctacatgaagtaagtcaaagccattacagaaagatattttagccagcagataatttgtacttttagaccttagaaatacatcactcaaaatccactggcacaaatgaagatttctatgatacagcatgttctgttacggttttgtggggcttttttttttctgctttggttataaacaatcattttgaatgtgtgccctttaagttcatcatatatatatatatatatatatatatatatgatgacaagagagagagagagagaagctttcatctgacacagtaatggttgttagacagcctggctcattttatgttcccgctttcgtaaaattatctcgccagaggcaaaatctgctgcttcgggctttccaagtagacagcaattaactttcactgtgctcttttgcagacgtacgcttctgttaaatcatgaaggatgcaaactaccattttgaatatgttttcccaactacgaaagaatatatttatattt

SEQ ID NO: 26981 - DNA, 3822 bp, Bovine  19866881130736
cggccctctctcgttctatggcctccgtctcttgccacagccagagggttgaaatctagcaactcggaagagtaagactgacctccggctattctcttgtctctggattaggccagtcttttaccaggaaaggattactcatagattttgagattcgaatgcaaatctaccactattctcccggacacaagctagaaaattacatttttgaaaaacataactgtattgatgtgatgttgtgaaaacatataaaacttggggtatgtgaaagtttacaaagagtcttaatgtagaatataataaataagagcctctgcagtgattattagtagaaaaagaaaacaaacatattacatcgtataataattgtacccaaagcatatatgcaccttagccaggaaaagaacagaaagaatttgagggtaaagggggcaatacgtatataaatgtgtacatatatgtaaatgtgtgtatgtaaatgagtgtataggtaaatgcatgaggatagttatgtacataaatagaaaccaagaattaacattttaaggtgttagcaaaaagtatgtctttttgcttctttagttcagaatgagtgtagaatatttgctaagagagtttagtgcatttctgagacttactgagtcaaatctgtgtgattaaaaagaaatgaaattctgcttgaatgcttaaatactctttaaaaacaaaaacacaactttgtgacttggacactcaagtggagcacatatctctgaaaggcacaggaacatccacctccaagcaagaaaataacaggctgagtttgcaacttgagaaatttcatataggaatacatttttatttttaaaaattgctgaatcagtgcaggaaaatgagaatctgtcctatttctactcccttgagagactagactgtgtttcttggtatcatggtctcaggggtgtgtttccccttgagtccaaacaatagaccagaggactttccggtcctgcctagccctgttcatcccccacctttgagtgcattgttccaaacagtagccaggactccctgtgctcttaaagtattgccactgtaaaagtcatcactgactggtatttaagaagattgtgagtgtattttctaagagttgatgtcaaatcagaatcacttaatcagtgtctgtaggttccttagtatagtctaactttctattatgttgacttaggaaattgctatttctgcagatcagaaaggtctatgatgtcatgtggtctacccagagctgaaactatatcagtgttatcaaacacatattttgtgtttttctttcatgattgtgcattatttttcttttccagccattgggagcagcagcttcagcccaagaccaactcatcagttctccccaccacagatttatccttccaagtaagatgtattttctcttaatcaataaataacttttccgagtagtcttttaccttatttcaagtcaggtctggtgcccacatgttacatcttaagttaaactaaagtgtgtttcatagagacttaagtgtacttatgtaaacttatttggagcatcacctaggagggacactgaaatatttcagcactttgtctatgatagttgaaggttatacatgaagaaacaatctttaactagaatttatgatttggttgttaatcagttaccttgcatgtttccatctaatgcatgggctttctattttctgtcatttctgacaaatagcagaccatacccacatattcttcctaccccttcctcacaaactatggctgcatatgggcaaacacagtttactacaggaatgcaacaagctacagcctacgccacgtacccacagccgggacagccctatggaatctcctcctatggtgagtaatccggttgctttagcagtggtgttgccgagtgggcacacctgtgcgtgtgaaagtgtcacaggagtggtatatagagatggggctcttggtcacttgagaaagggctgtcaccttttgtgtctgaattcttaatatgattgtttctgatgaacattgtaagaaggggtggctgcttatcttgaggtcagaagtggcagatggatagcatggttcatatgctttcttgctctttggtttttttcccccatttatatctcagttcttaatttgccatttgaacacttggtttgggaatccaaagtattctggtgcatatttctgataaaacttctgtgaatgaagtcttttgggggtgaagattcatttcctatttatcaggtgctgagctatgattagagaagtacaagccacattcaacaaaccctggctctaaacttgatgggagcagtcgtttcatatgtcagtgttatcaaccactaggaaaagtgatctatatcatggcttgggctgcacttgaaagagcccaatcaggaaacattgaaagctcacatccttatttgttccctctcacctggagattatttttatcttggtgtaatttaactcaattgttaacagggtcaatacctataaattaaaaataaagccagccaaacttcagagtttaattcttaaaaatcttaggattccaaaaataccttcttttccatggaatggtagctataatcttaaacaaattgcaacttgttggaatataaaaatatgaattattggcattttattacaaaataaataaaacctggtgatccagaaaaaaaatacatgaaattttggaagcaatgactgaaagaaaaaactagtggattattttgtgatcaatattctaattttccttctgctattgttgtttcataatcttctcagtatgttgaaacaaataatgttcttcttcaggtatttcattgatcgttagaaggtaaattatctttgttttttttgtcctgtctttaccccaggcaaatttcccatatatacattttacagaaatgaaaatctaaaattatgtattacttcagcttttatagttttattttaaaaagatcacaactgaatgtgatccagtgaagtgtttttcaactagacttaaaaaacaggcatcaaatggacttcctagaattatctttcatttccatgactttgctgagtttcttaaaatgatgttaaatacagatcaaattatctgtaatttacttttaaactgttcttgtgctgaaagaggaaaaaggttccatgatttgaattgtgtgacttcaaattctgtaatgtgaattaaggcagtcccccaatttatattctcaaaatttatttacaagctgatgatttgaaatataaatgtatattctagggcaaacaatattcaagtactatagatgtatcaatgctgccaggagaaggtacctttcctggtactgctttggctgctactcacataactctcttggtttttttgttttgctcctccccattcagtcatggttgggccctttgccaatttctgggtaaggactcctctagttttaaaccatcaacagatgtctctgttgtttgaaatagttggtccagtagggtgagatgagcagacgttctaaggttatactcccaactagtaaagtgagaatggggattttcatatggtaggtggggattggggaagtggtgagagtaaggctttgtgtgaaggacttgatcccagagccttctgtgcttataaatctgggaataaataattctcagtcctgagcactttcgtgatccaccctccttcttctctttttgtgccttgaaggcaaggagatgccctagagcttctggcctgccattctgtttttcttgggccagtgcacggaaaaatatggcagctttcttttcatt

SEQ ID NO: 26982 - DNA, 1314 bp, Bovine  19866881162378
caaagtagaacagccttctaggtaaactgaaaaaaattaaccatttattttgacttctcattccagtgttccaaatataggaaaactctcaggattttctgaactggtgttcagagaatacatgagatcagctttaagaagttggaattgatttccatatttaattatcacatatgtatatgaaaatatctagcagagtgttttaagtgtttaccaaaaaagtggatatgatgacccccagtcagattctaagtgtgtaattgaattctggaaatcaggaaggcctaagagaaattccagtactctttccaggccactgggatgccctataaggaattccttgtcagtttagtaagtatggccccaattccatcatgtcctgataggctgtgccagaggtcatgtgtactaagtcacttcagtcatgtccaactctttgttaccccatggactgtagcccaccaggttcctctgtccatgggatatcccagacaagaatactggagtgggttgctatttcctatgccagaggatcttcccaacccagggatccaatctgcatctcttgcattgacaggtggattctttaccactaggaccgcctgaggccatataattgttctaatgccagggagattgtggttgatgatagtttaattacaatagtaaagataacaaggaatggcccatcgtacctggttagagtttgttttaaagaagtatttttttttgaagtatagttgctttccaagattatattactttcaggtgtacaacacagtaattttgtatttttataggttatactccttgtaaagtataaaatttattataaaatattggctatatcccttgtgttatatattacatccttaaatgtatttattttatacttagtagtttatatcttttaatccccttcaccaaccttgcctctccctccactcctttacgtgattttaatttaataggatgtttcaaataactgaagtggtggtgtggtaggtttctggctttttcacaagtaattcaagtggcatttacattgattttcttctccgtgtgttctgtccctgtactgacagcatacaaaaattagctttctaattttgtttattgtatgtttaaataaatttatgtgaaatgatctaaaataaaaggcaaagtatttacattcaatgggcaatttctcttttatatagtctttggtttttcttatggatattattataattgcaaacaaacaaacaaacaaaccgtattcggctttgcgtatacaactggggggaagtactagtaggagcttccccgctg

SEQ ID NO: 26983 - DNA, 1766 bp, Bovine  19866881299967
tctgttaaatattaatattttgcttcaaagacttggtgactttgtaacatattatttttaaaaatgaatttttagacatatttttagacaaaatctttctagataagagtacagagaatagagtgatgaattgccgcatacctatcactgaaatttaatacatatttgattcgaaaaagaatttaaaagttaatcatagacttttaacattctgttcctaaatatttatttccatgttcatctctgaaagaattcttctctaataacactagtgtcatcatgcctataaaaatgaataacttttcccagtaaacataagtataaagtttttttaactttatgtaacagtgaaaatattttgcatgttatgttttttagtttgtacccggaatcttctcaaaatttatatcactgtcaacagaaagtagttttttttttttttttaacatttggaaaaaaccttgataccacattatggaatgaacacattccttgtgttccatcttagagattttattgagaaacttattgaataaatctgcatcttttttttctcacattctttagcataatgttttattgttcaaaatacatgtgtttttggtaccatgaataatcatttattcctttatgattttttttttatttgtgggacttgatggcttacgatgagaacagctgaatcatctctcaagtcatactcccggtgtacatgagaaccgatgatacattgaactgtttccattctatgggatttaactcacctaatgtattgggtggtcaagtataagaattacaacattagactttcaaagctctctctaaggaccttgttaggaaccatgtgttttcacagtgtctgtgaatgctttataaggacagttctttaaatgtgactgatacaaaaggtcatcttggacactgggtaagacgtctagaattccaataaaaagcatgtgttgagttccagcttacatcttagtctctgtgtgaccttaggccagacagttgacttctttgagtctcagtttcctaactcgttagatggaacaaaccacagagttatgaggattaaatggtacaaagttttttggaaaaacatactactctattcacccaagttgatagggattgtgctacagactgaactatgtcctgccaagttcatgtgttgaatcccttagcccccaacatgactgtatttcaagataaggtttttagggggtaattaaggttaaatattccttaattaaatatgaccaacctagatagcatcttgaagagtagagacattactttgccagcaaaggtccatctagtcaaggccatggtttttccagtggtcatgtatggatatgagagttgaactgtgaagaaagctgagcaccgaagaattgctgcttttgaactgtggtgttggagaagactcttttttttttttaattttatttttaaaattttattttatttttaaactttacataattgtattagttttgccaaatattaaaatgaatccgccacaggtatacatgtgttccccatctagaacccaccttcctcctacctccccataccatccctctgggtcgtcccagtgcactagccccaagcatccagtatcgtgcatcgaacctggactggcatctcctcttgagagtcccttggactgcaaggagatccaaccagttcattctaaaggagatcagccctgggggttctttggaaggaatgatgctaaagctgaaactccagtactttggcca

SEQ ID NO: 26984 - DNA, 2119 bp, Bovine  19866881305203
tcctcatagcatttagtctttgcttccagttctacctcaaggctgactccattatcttcaggtattaaaagacactcatattctgataacagataatgattaaaattgtttaaattgacctgctgcaacttacaaccaacactttaatatgaaaattgtgtccaaactaaaagctgaagtgatagtaagaaaattgtatattttctccagttacacataaaaccattacggtaactaaaatagaaaataagttactgcttcaaaaccttatttttcacgaattaagaacttgccgatgtacaagctggatttagaaaaggcagaagagctagagatcaaattgccaacatttgttagattatagaaaaagaaagataatttcagaaaaacatctacttctgcttcattgactatgctaaagcctctgactgtgtggatcacaacaaactatggaaaattcttaaagagataagaatacaagacgacctgatctgcctcttgtgaaacctgtatgcaggtcaagaagcaagttagaatcagacatggaacaactgactggttcaaaatggagaaaggggtacctcaaggctgtatactgtcatcctgcttatttaacttacattcagagtacatcatgagaaatgctgggctgtatgactcacaagctggaatcaagattgctgggagaaatatcaccaacttcagatatgcagatgataccaccctaatggcagaaagtgaagaggaactaagaggctcctgatgaaggttaaagagaagagtgaaaaggctggcttaaaactcaacaatcaaaaaactaagatcatggaatctagttctatcccttcatggcaaatagaaaggggaataatggaaacagtggaaaattttattttggggggttcttaaatcactgcagacagtgattgcaccatgaaatcaaaagatgcttaaacctacgcagcatattaaaaagcagagacatcattttgccatcaaaggtccgtacagtcaaagcgacggttcttccagtaattatgtgtatggatgtgagaactggaccataaagaaggctgagcaccgaagaattaaggctttcgaactgcagtgttggagaaaactcttgagagtcccgtggactgcaaggagatcaaaccagtcaatcctaaaggaaatcaaccctgaatattcactggaaggactgatcctaaagctcaaactccaatactttgaccacctgatgggaacagctgactcactggaaaagatcttgatgctggggaatactgaggggcaggaggagaaggggattaacagaggatgagatggttggatggcatcactgactcaatgcacatgaatttgagcaaactttgggagatagtgaaggacagggaagcctggcatgcggcagtccatggggttgcaaagagtgggacatgacttagtggttgaacaaccaccaaccaaaatattgtgaagtacaaaaaatgcccactctcagaaacattgttataaaatccacagtaggtcatgagtgggaaagggtaggccaaaagaatcactatcttccatgattgatccttagagtctatttgattttttgaaaaacattaactagttcacgatgataaacattaaattcaagatgatgtcatttatattcatatgtcaacactttagttaaagttacagttaagcatcctagctaaatgtttataattatacatccaaaaagccacatatataccctgaaaatggagtacatgtacaactaaataaaatctcatgtatttttacatgagatcatatctcatcgtatttcatgtaagtttcaagtttataacttcatatgaaagcttttaagtaaataagtaaaaataatgtcacaatcatgctgcttgactaaaggccttgctaaaacttgccaaaagtgtgcaaccattgtcatgaatatatgattgtagaaaaatgcatttaaaccatcagaaatacagcctgcaggactaatcaaggcaaatcattacctgctgcgggatctgtaactgcttggctggtaatgccggatggtggctcctgaagctggtaagtggcatttgtggacggcgttgttgggctg

SEQ ID NO: 26985 - DNA, 1957 bp, Bovine  19866881569764
ccccctccccctccatagaacttccaaagtcacagaaaatctctagggttgacccatcttaccttatttttccaacaaaattatgcagctatctaggcagtcgggagttatttccaaaagccgcatggaaatcactcccttaaaaacctgtcactcaaatactggtcaccctgtaatgccatctgtacaatttggatttttgattagaaagagggtagtgtgagcagagccacagggagaatcttttgttttttcttttaatttttcaaagcactgttgatcacttgccttccagacagctgatgtgagtgtgtgccgtgtgtggtagtcgcttcagtcgtgtccgactctgtgtgaccccctggactgtgaccccatggagcccaccaggctcctctgtccatggaactctccaggcaagaatgctggagtgggttgccatttcctcctctgggggatcttcccgacccagggattgaacccacatctcttatgtctcctgcattagcaggcaggttcttcaccactagcgccacctgggaaacccatttgagtgcgttgtctctaaaagcactagaaatactcctgtactccatatattatagttttcatatttaggaataaaaggaaaacgttctggtaacttgcagatgtctaaggtgtcaagctagttatcttattgtttggtggagaggtcagagcagtggatgtaactgcttgatgacagaaggggacagagaacccagccaccgtgtccctggccaactccagcaagtctcagtaggctcactgatgcacagacccaatgaaaattgctccttctctggggatgctttttctttccatttttacttcataaaggaaggtattgaaacaattagtcggcagtatggtgttcgttttctcatggtaaatttggaaaatggagcaaatatcgcttcagtcagcagaatctgggcttatataactcaacttctcccaagacatgtttgtaacatttttatattgttccctttcataacgtgcagactgcctccaagtcttcaagtctgtttatgcaaagcctgcaggtttacttggagtttatgtttctagtgtcaggttcaggggtgtaaacgcctcagcatcctgactgtgatgtcactgtgtttggcacacagaataagacccattgtaactgtcttaattcttttcattaattttcctaaatgaacgtgaatggcatggtgtgtttttacataattatggcacaagtgagaggcttgagggaaaagtccaaccactacggtatcaaagcagaataaatatttgcagaaaaattctgccataacttaatattttgcatatgagcccctgtacaaaatctgagttattcccggagctcagtccaaaagaacatgtctgtggcccagccctggaaggccagagatgatgatggatcggaaaaaggtcagcttgagttgcagtgccaagaataatgacagaaagaaccaaaaaggcagaataacagtgcacccagagttctgagggagaccatgcctttgctgcgtggccgtgagataggaccccctgtggctttcttcctgctcccagccctggacctggtattcagctgcttcatgggttggcagttttccccagccatgcatgtcagcattttataatccagccccacaagtgctgagatgtctgtaagctgagggcccagagtcactgaagcttgccgattttattgattttactgctctgtgagaagcacaagccatggaacataaagggaagccagacaaggctgaactttgggtgttgggtttgtggtgtttatctgaaggatgcttgctcacaggagccgtttcaggtacaacagagcctgcaggccagtgcctgtggactcagcatcatgcttccctggtcgttgccacctgccctcattcaactcgactgtgactgtgaccga

SEQ ID NO: 26986 - DNA, 1635 bp, Bovine  19866880562039
acaaggagtcccacactgtactgttctctccacttctgcgtaatgtgcagatccatctggatatggcataccagggtcatctaaggtgaagcccaggccattctcatcaaggtccccacaagagcctaatatgccaggcagccaaggggctcctccgggggctattaaaaatgatcctatctgctccaaactttgaaattctagggatcctattttttatttagccaattcagtctgaacaatcaacaagttcatgagtgctcatgttcactgtggcattccctaaatgcttctgtcccatgagagccaggctggttgtcaaattcagattcgtctttcttacaccttcctttctcaatctgtccctgactgaactgcgcccagaggccagatcttctctcacatccccccagagggcactgtgtcttcataaagccagtcaccactattttaggtacttcataaacgaccagagagtggcagttttccttcatgattttctcttctctatttaagtattaaaatatcaaaaggagaaaaagaagttaacctcatagtacttggtaaagagacatgtgccccagcacagtacatgccaagtactcagaatctatagttatatcagttaaaggtcaaaaacactaagaaaagtaatatttttcttactgttaagataaaaaacatagctgtctcaagtgacattcaaaaaaaaggaggacatgcacattaaccaaatcaaaactgttttttctacagttagatgtgacaatcttaagccaaatcatccatgaaagttttctaatgtacttaaggttgtatacgtatatttgcttcttcaaagatattttgcaaagccactttgaggtagaagggaagaggtttcaatggaccgctttttcctgctccactgtaaccgtaattgatcactgctcacagaagacatagcttccgtattttggtccaccacattttccaccatcacgtaagtatgcttgttaggttctcactttattatctgcctatttattgcttccagaatgcccagtaaagctgaaatttttcatttaaagtgatagaaaaattttcctaaaatacttgcttaatcatcttagatttgacttttggcaagacagttaagcacatagaaatgaaaacactacatttcacaaatacacacacaaaaaaatacaaactttcactgtttttcttatagagctcagtcgtaaatgtgcagcttacatataaactaaaaacacttttaaacatgattgtcacaaaaatattttaaacagagatgaaatgtatgaaggcacacacagattgtcgatagtgacatcagttacatcacatttctttagaaacagaacctttcctgtttctgtaaacaactttttttttctcacacatttaaagtgagggttagtgctgacataagattattgctatactcacagtttgagtgtttccactgtgtatgaggtacattttctccatccatacatccctactactcttacctacttgagagttaagagtcaacccaagtctgtaagctatatccattcaataagatttttgtcaatactggaatgataccagataacattataaaacatcagagatcaaaaatatctt

SEQ ID NO: 26987 - DNA, 924 bp, Bovine  19866880096726
catcccttcatgggaaatagatggggaaccagtgtcagactttatttttttgggctccaaaatcactgcagatggtgactgcagccatgaaatcaaaagacgcttagtccttggaaggaaagttatgaccaacctagatagcatattcaaaagcagaaacattactttgccaacaaaggtccgtctagtcaaggctatggtttttcctgtggtcatgtatggatgtgagagttggactgtgaagaaggctgagcgccgaagaattgatgcttttgaactgtggtgttggagaagactcttgagagtccgttggactacaaggagatccaaccagtccattctgaaggagatcagccctgggatttctttggaaggaatgatgttaaagctgaaactccagtactttggccacctcatgcgaagagttgactcattggaaaagactctgatgctgggagggattgggggcaggaggagaagggaatgacagaggatgagatagctggatggcatcactgactcgatggacgtgagtctgggttaactccgggagttggtaatggacagggaggcctggtgtgctgccattcatggggtctctaagagtcggacatgactgagtgactgaactgaactgaactgaagataatacattaactagaatttacaattaaaagggtgtttgttttgtgaagaaaaattctctggaatattcatgttattttaatgtgcctctgaaaattcaactttaaaattgctagaattgtggattttcaaagaaaaatgcactgaaaaatgcaagcaatgccagcctttaggttttattctctttaggaaagaataagcttaatcaggcctctgatgaacaaaaaattgtccccagacaacagcagaatcctgtcaaatccaaaaatcttttataaa

SEQ ID NO: 26988 - DNA, 993 bp, Bovine  19866880410141
tccatattagattttcatccaccaagtgttaacaaggtatggaggttaacatgcatttacacgcacatttgcattgtgctcattaggcatggtttattaactattatcatgataagtgtactatctaagcttacagaggtgtttcagtgttatgtaggcaactgcaaacagttttaacaggctctattttggaaccatctctctgctacattttcccacttatgcaaagacattatataacaggcatcatcttagatgtatattatgcaaccaggtcactactcaagaactgaaaataccacagagatgaaaatgaatttcagagtaaaaaatgcattaggatgtgccaacactttcaattccccaagtgcctgtgcttaatcacaatcagctctgtagtagaagaccgaaggacaattgcagaagtgttgtttatctacttggagaggattcattacctccaacattatttgacatgaaaacagatgtacctctgtcactgctttgaccctctctaataagatgaaaaactaggctgatacagttattgatcagagtgaaacccattccaccggaaatagatgtacatgtacagcaatataaatgaggatttaacatctgttcccagtagattgcctattaatctggaatctaaaatgacacaactagctgtttggcagtactacctcttattgtaggtatacagataaaatcacttcttgtattgctcaggaggcaatgttttataaatatgggtaactgtatatgaaacttgtaaatcaaatatcccaaacttggtcggcattctaagtgtgttgaatattgaaagtgtttatcattttgcaattaacttgtcttctttctaaaggtaacaagaagcatttgtgaatattagtgggtaccaataagtattttatacttattcagatgatctttcactattgttaatatttatataatataatcttactaaaagggttacattaataaaat

SEQ ID NO: 26989 - DNA, 864 bp, Bovine  19866880499571
aaacaattttccacaatcactcttgtagtatggatatctcagaggcagaatttattgccaagaggcagttttaattagaatcaagtagagtacaattggagctttaataataagacaaagattttcctcattaaatacattaaaagaaaatgataaaatgcatgactaattagaaaatattattcaaattttcaattcaatacaaagaaacatatactgtcattgcagtactataaatattacttataattactaaataatatttattgtgaatttttaaagtgctatagtattaaataatggcagtaaatatctgtatcacataaatattttctataaacttgaaacctaacagaaatgtagacattcccacagactactcatctttttatttttgactttactaataaataatattagagaaaaggactataattttaattttcactaaaagatacactatattagagtcacattatgaaatcctctgattccattgtcttcctttctcatatgcttatatatttcaagagttgtcataattcaggttattccattcccttctataatacatctgaatgatatattataacatctgaatgacagttatcttctatctttaaaactacagactagagctcatgaactagttttctctctttattttaaagttcatatttatagctcaatcacactatggaatttatttaaactgaagaatcctacaaatgtctttcacaatgatgcaagttatggtaggcacaaattaataaggggaaataatggtaactgcgaaactatttttttctgacctgtgaactggaaaaaaatatctacttgatatataaacacatggttaacatt

SEQ ID NO: 26990 - DNA, 887 bp, Bovine  19866880562063
aacacccaggactgatctccttcagaatggactggctggatctccttgcagtccaagggactctcaagagccttctccaacaccacagttcaaaagcatcaattcttcggcgctcagctttcttcacagtctaactctcacatccatacatgactacaataacatagtaatcataaataatgttaaactgtatgctttgaccttagaaatccaatatgcagtgaagaaatctgtccattgagcaaatatttatagcacatctactaatgctcagtgctggggaacaaaatagattttttttttgtatcatgtcgtttatattttatttacacttttacttaattatctacatatagtagaatgtactttttagaaaaatcttgccattgttaagtccaaatttacttttaactttggtataaactttccttgacaactctaactcccacgagtataacaaggcaatagatatgtttggcagagcaactatttatgtcctgtcttctgtgttgccagggtgatggtagcaatatcgaaaacattggaggtggttgttattggcaaggatcctaactttcattttcaaatggaagaactgtaaaaagcaaaatgtaggctgggatgtgggctgtagactggtcatggctatacctaaactagatgaatggattattaatggttaaccaagtatggatgctattctcggaaaactaatactgataggcaatatttccttaatatttaaaaattaatgaaatttggtcattacatcaaatacttttattaaaagctaataccatatcattgcacaatattacattttttttgtccacttttctgtctttttcgtggaaaacaattcaaaagctttactgaacttttggttt

SEQ ID NO: 26991 - DNA, 911 bp, Bovine  19866880633416
atctttgagcttgtttgtgtatgtagaataaaagaggttttgaggcaccagaaaactccattataggtggcagaaaggagtcttcaccaaatatagtactgtattttagcaaaaaaaatctagaacacaaagataccatgactatagttacaggaataaattggggcagtaatagatgtttttaataagagaattgcatgttgcttttgaattttccccaagctctttcaaagatttatataaaaccagccaaaagcttgatgtttgtcaacaactctatattgtaagaaatttagtggtggtatacagagctcatctattataagctacctggaggaatgtgttcttttgtattatgtttaatacaaatagtgaaattaactgaatgattcaaatgcctggattcacaggactagtcattttttaaattaccatcactctcttattaggtcataaaaagtatattgaattacatcaactagagtcgtgcaagagatgtgtacccagtctgaatctgtaagcagatatgagctaattggcctaactggccttagatccagtgttatttaaaaggtatggagactttctaaaataaacttaccaaagaaggtaggataatgttatattttgaacatatatatttaaatctcagggagtaaagcaattatttaggtttatctggacattgattattgctacttgaaatctagactagtatttaatctgcaaatgtcaaggtccacctggtgtggattaatatatcagatcagatcagatcagtcactcagtcgtgtccgactctttgcgaccccatgaatcacagcacgccaggcctccctgtccatcaccaactccgggagttcactcagactcatgtccatcgagtcggtgacgccatccagccatctcat

SEQ ID NO: 26992 - DNA, 1357 bp, Bovine  19866880634328
tttgccagtgaaagcgccctgaccttctctaacgttgagagagacacgtgacccaaatgaatcagattccctgtccttggaactgaaatcttggcagagtgccaccaactctggaactctgaggcaaaataccccaatttgtagcaccgtaaaaagatagttcattagtttctattacctagcctccaggagctgttctacttcctgggctctaggacactggcttttcagttttctcataatatgcttccaaattcattttttgcctaagttttcccaaagagtttttgtggcttgcaactcatgacattgactggtagcaggcagtttctcataatatagttaggggatttcagcgtgacatgctattgttgatgggttatgctttggacccattaatgtcttgtaggtaaggtaacgatataattcatgatcttaatctgggacacttctgaaagtcacagagggcatcatttaaaattagctataaccacagtaaagaccaagacataggtcctactcttacttttagtatatcttgtgtaaaaaaaaaaaaactttagataataagctctggtttgtatttacacacctttgttttaagaagtaataaagaatgggctcgtcattgaacaatcatgtctttctacaaaattttgagtgtgccactcctaagatcccagagtggtggtttgctatcttgagaatttatctgaccttatagttcaagtcttctgcattaaaacattattgctaaggttgttactgtatgaagtaatagaggcacaacaaacaaaaccaccaacaaagacgaaaaggtctggctgatgctctccaaaacatattggctgtatgagacagcccacactcagcccatattcttttgaatatgttccattctatataggtcagtagtactctttgttttttaaggaacagaaaagttgaaaaagtccttttaatagtaaaattcttttaaccatgcctaccatatatatacatacaaatatatataatatatacatatacatatgtgtatacatatacataaatactgatcataattttcacctactgaattacccagtttacacagatattgtgaataaattatgtgataatgtagggatgttcatacatggaaaaaattccacaaaaaaccatgaagagaataaaagtacagttttgtagtgtaaggattaattgtaaatatgacatcgtaattcactttttagctattttccacctttagggttttttttttaacctaggaaagactttttaaatgaaggaaatacagttgatttacaatgttgcattgatttctgctgtacagcaaagtgggttcagttttata

SEQ ID NO: 26993 - DNA, 1320 bp, Bovine  19866880659277
aatggtacagctatttgtgtctatttttgttttttaaaatgtcagtttctgaatgaaaatattgttaagatatgacccccacccaaggagtggtttttaaaccctcaaccctgattaagattgattttctgttgacattatggaagtacttcctctagggattcttcaacacaacaactggaacttttagaattggacataaggatcaaatcagattctttcataagactttgtataaagttactataaaaagaagccacaactcactttattgctgcttagagttgaaattaagaaagaaattggtactggatgatcataacacacaaagtaaagtgacccataatgcatactaatgttttatagacagcattttatctgaaaataaataactgactcaggtccttactgttttagataatcaagtaagaattataacagcttacaagttgcaaaacagtcattattattaagcaacatttttgtttctttaaagaaattgaaaactgaagaaatgaatcttagttgtctaataatattctaggacaatagtgatttttgtctctaaataattgaagttatgctactggaaagaatgatccaatatgaagagcaatttgaaattacctctcagaaaacagtacaacatacaatcacaatattgtttatgtgactctccacctgtgtactttaaaggataggcattcattaaatggtaacagttagaagctacatgtataaccttaatttcttacactttaataggtataatgtaagaaaaagcacccccatacatcaataagaaggaaattctgcaacattatcggtctagcaatctctctcccatgtgatcatttatgtgtgttatgagaggatggttctcaacctttagtttgcaaaagaattcaccaacaggttatttaaaaggtggattctccttctcctatcccagatttctgctaaaattatattggtatagttactaaaatttatatgagtaaggactacttcaggagatttggctcaggtggcccatggattccacttaggaacagaagtggtataaagaactatgttagtcagcaattgagaaaactggggggaaagatatcaaacagttttaatttgtgaatgcttcttgacacaattgcataaaaaatgtaattattattaaaaataacattttttaatcttaagtcagatagagttatatacatgtgatttttgaaacttctacatgtgccttgttatcttctgcttgggtagatagaattacattgatccaaaacaaaagataggagattataggctaagtctttt

SEQ ID NO: 26994 - DNA, 1223 bp, Bovine  19866880685139
ccagtaattggttaaaaagatgttactcatatttcttggaaaagggagatgttcactagtttgtaggtgacatagagacctttttgggactgtttaaataaaattacgaagtgagcttgttttgtttcattgtggtcttgtctgatattgatgttctataagaatgtctaatattcaacaggacagcatggtctagctgtaagcaccaggccagtttctgacaacagcaagtcccagctgtcaatgtcagaccagttttaggccacctaggactgcttttcccttcctttttttttttttttttaaatcaaggctcccagcatagtaagaagtgagttacttttcattccaatggtaaatttgcagaatatagtccttaaaagtggtaactaaacgtagggtaaatatcaaggaaagtgaatattactcatacaaattcattcatttgataaatatattgagtattgagtagttggaaagaactctcagtagcccaaaggggaatgagtatgtagttgcatatgagacagtgattgtctcttaaaaaaacgtacattttggtcttatatataataaatatttcttctaacttagaccatttattataaataaggaaaaactgtctgtgtatttgttaactaaattcttgtttagagctgaattctaaataattatatgtagtaactttaagaatattgtcagagaatccttatggaattatttagcctgctatgtttgtgactatgtttgtgaaactcaaatatttacctcccacagagtttatcaaggctgctatacactgagttgtcagtagaaataaatacatgactgaatttaaccaaagaaatcagtgttaaataatatatgacaaatagctgttcaccacaagaatcaccctgcatgtcgtctctagcagtgctctgcactcacactgatatgatagatgtatgatataaaaccagagctgtgtcatgtagtcttgggtattcttatataaaataaagatttcttcgtaatttttttttctattaagtcacagcaaaatgtgatggtaggaaccactgttctttttggtattgtcatcagccttttatagtcaataaatgcaatcctctaaaaggaaacacaagggaaagcagcccagtttaaagatgttgttaccaaaagtaattgacatgcagaaagagaggtctttaagtcctgtatctaccctgtgggggtat

SEQ ID NO: 26995 - DNA, 786 bp, Bovine  19866880708680
attactactgtaattgcttccaacctgtcccctactgcttcctagctccaaggctgctttttcatggccagataactttatgggcatggtgtcctttttccaaagttacctcctggtctggcattgatgattcatggggtcagtgcaacactggttaaacagtaataagaaatgaagagtaataaatttgatattcaactctggcgctattccaccagggttgaagaaaactaaatggaaaagaaatacttttttttttttaaaggaaactcaaaagtgaaaaaacattgattatttattgacaaatcaaatcttttttttttgacagttcagcaagcctgtcttgtaatcaaactataacaggttgccaggccacatgaagcctatgtcaataatgcatgttattgacagcagcctggcttgcaaatatccttttaaaacagctttcttccatatcattttcttattagaagattttccaatatctactcagcctattaccatatcataagatcaaagtatatgatgctggaagtgttgatacatttagatagaaactggtttgaaaggttggacagattcttactgaaatataattttcttttagattttgtgagctagagaaccaagcttaatggtcatcagaagtagctctctacttgtttctgatggctagcaagaaggattagcgagagactttggtcaggaatagaccatagggaaagaagcagttacttttaaaatcatacttctaatccataaataggatgttttaacttttataat

SEQ ID NO: 26996 - DNA, 748 bp, Bovine  19866880759069
tctctgtgatcccttgtatagtaatgcctcctctccatgaaggatggctttcctagaccttattatgctttcctaaatcacctgagtttaaaattcagtggtaatgatttctagtcctcgattactcactgggaatttaacatagaaagcatattctaaaaacagtctattattgaaataaaaaataattcagggtctttacctgaaacagattcatcactggaggttattaactgaccactagaaattaattaaatttctttaatatatcttgaccatttcctagccataagcacgtatcaaagaattggcaattgctaaatgtaagcccagaacattttagactttctgaaattaatatctgtaatggcagtttttaatattttctggaaatgtcttcattgcctagaagtccctgaaatacttgcattgggagttagtgctctgatttatttatgagagaggcatttgaatcaaaataaggactttaaaacatagtaaagggtagtgaatgaatataaaccaaaaatattctcttagcatagatgtggaaaattaacaaaaaagacatataaatactacagatacatagttttactttgttctaaatgcctttaaaacattaatgcattttctgattcattttcatgaaacagtaggggatgtaaatatagaataatgatttccactttaaagttatagaaacagagacccggaacaatgaaaccattcatcgaacgtcaactaa

SEQ ID NO: 26997 - DNA, 1687 bp, Bovine  19866880796284
ggagaaaagtttatataaaacaaggaatgactaattacaggtgggaaggtagttaatctttctagctccctttaaatgctgccatatgggactaccaactttaccttctgtttggtttgaatttgtacaagggaacaaaataagccttaagaaaaatctattgtgtgaaaatatttaaggtacttaaaggccaaatataatatttttgtgctgtagtctaccttagtctgccataatatcagtatcctttatgacatggataattaaatttcattgcattttgaatttaaacagatcagtttggataatctgagacttcagaattagatgagtgggaaaaacatcaagggggtcagcagaagtgaagattacactgtgtaatttgccagtcctgttcaatttagtgctagaaattgagtaatttttcatggacatagaaaacatgcagaggacgtaacttgtttccatctagttatatgcttgtgcagtgaatgtgttatccgattctaaaaccatctttgaattagctttttttttttttttcacgttggtactctgtggtttctgagattttgtatgatcgtatgaactgcaagtgatgctcaatattgacaagtacagtacaaacagcagatggtaagatactgatggagacatttgttaatgggccagtagtcttccttagaagtacagattttggggagagtttttggcttttttaacccactgcttttctatactgagtacctgggaaggaagaaagaatccaaagattcttttgtgtttcttcatgggtagaaaaggtgagtatcaggattccatcaaccttaggtgaaaccactgttagtaaacggagttgctacgttaggaaaaagaatgtatgtaaacaccagctctcacacactagttggtaaacttggacagatttcctaacccttctgaatttaagattcttttaatgtatgttgaagatcacaatatctattttattatgttttccatttactaggatgaagtaatacatgtatagaaaatgtacatagtgatgctcctggatattattatgtaactgggaactaaacaatgtcatgggagatcatagattctactggcttaaagtatgggcttcagaaaatcagaaagatctggatttgaaccccagacttacagcttcctttctgtgggagcataaacaaattactttcttagtttaagcattagtttctttataaaatggagtattgttgttatatggatagtgctgctgctgctaagtcgcttcagtcgtgtccgactctgtgcgaccccatggatggcagcccactaggctcctctgtccccgggattctctaggcaagaacagtggagtgggtcccatttccttctccaatgcatgaaagtgaaaagtgaaagtgaagtccctcagtcatgcccgactcttagcgaccccatggactgcagcctaccaggctcctccgtccctgggattttccaggcaagagtactggagtggggtgccattgccttctcccatggatagtgctgctgctgctgctgctgctgctgctaagtcacttcagtcgtgtccgactctgtgcgaccccagagacgtcaggcagcccgccaggctcccctgtccctgggattctccaggcaagaacacggaggggttgccatttccttctcc

SEQ ID NO: 26998 - DNA, 3233 bp, Bovine  19866880818320
ttaagaatggataatagaagaaagttgatgttttttacttattaagtatagaatatgcccagtacagtcacttaaacaatcattctgcattttaaccaggtgcttaaaaactagagataacaatactgttgtctatctgttttcaagtgtactttttacatttttgtatgtctgaataaagtctattaaggttacaaaagaatattcattttgtgttatctttgaaataaacagcatcaaatacttaaccaatgtcttcatattctcacttactttttcatatcctgactaccaatacaccataaattcagggcaaatcattttgatgggactacatttttcttacagttacttaataaagtcacacattatgttatgactatatttgagaagaatgaaggagaaaaaaacataagaactctacaagtgttactggaatcagaaaaacagattataggttgtttttgcttttaaatctgtcatcaaattccataataacttacaaagatttttgtatgtactctctgcaaatggattcattcatatgtaatttgtaatagctttcttctcaaatatgtatttaaatatacatgaaaataattcaaaatatgctctgtcataattaacaagatatggcactattttataagtccaaatataattgctctaaaatgacaagcaactttttcccccttatatactgcaaaatatttgagtgaacagagcttcattggcacacacaggaatgattcttttaactctactgtatttcaattactaatataattcctattctaatttatctgattttccattttactattagtattaatggcaacccactccagtacccttgcctggaaaatctcatgaacagaggagcctggtaggctacagtccatggggtcacagagtcggacacgactgagtgacttcacttgcacttattagtattaaaatgtagatctaaaccaggtgttgttctttaaacaaaagtataacacaaaatcctgaataaaatccattcaaatgagttaaattattttagaacaaaaatttaaagtacatttaatttaaagttcaattttcttacatgtaaaatgggaccgggttggtgaaaaactatgtgttacttttcaaattaaaatttgaataaacctctactaacatatgattttggcctttcatacagttcatgagtataaatgaacatgaacttgggctccaggagatggtgagagacagggaggcctggcatgctgtaatccatgggggtcacaaagactcagacatgactgggtgactgaacaataacgcataatttaaagaaactaatatggggcatattccatcaaattattgcaatatcatttttgatcacttgagaatttcattagctcttgaaatttattcccttaaataagcctgtgatgtttcatagaggcaaatggaaatttgcaagggcagagcaacaggtcaacagtaaaaatattcttacttttatataatatatatgagctatctatatgtatacatattataccaaaagaggtatgcatacaaaaaaccccagaagtgtattccatttcattttaaattaaacatatcctataactgatgattcataatacatagtaatttgtggcccagtttaaaatatcaatcaacattagtagacgacaattttgaggaaatttgacagggatttacagatagaattataaagtggccaataatctaggagagatattacacaaagtaaaatttttgtttttttcaaatactactgacttgatttttggagaaatagtcaactgtctcagtttcttatcacacgagtctttgtggttaaaagaggtaatacatacatagtcttttccaaaactacttgcaataacatgccagacatattggtgtgtgtagaaaaaaaagagcaaaaacttagggttgaaatattggccttatattattaagtctattattaaatgtcaagtattgaacagaactctgcctagtcaggtaatagtttatcaggtagtagcaaatgaagtacaattttaaataatgctgacgtaagctagaatatgctagaatttcatagggaaaaaatcctaatacaaagaaggttgcagacgtgtttcacatccagtatatagaaatctattagtttcaaccaataatcagaactgttttatacatttatatgtttttaatgtttaaaaatgaaatttaaaaagaggatatgaacctgcctatttctccccatggcttttcttcccactcagacagttattcttcttagatatgaaaggtgggtgttaaaaggggaacgcgggtatacctgtggcggattcatttcgatatttggcaaaactaatacaatattgtaaagtttacaaataaaataaaattaaaaagaaataaaaggagaaaaataaaatgagagtaaactcattcacatgttatgtgctaatggtagatgacatgtaacagtttttaaaaaacttggagatagtacattatcaattacttaaaaattaagtttagtagataatatatctacgcaaaatgaatggttacacacacacacatgcacagtcacacacacacactatttatacagttttctttttactaaagactttacacaatatttaggttatcctggtctcttatcttactattcctttgtttctgagaagtttgatggtttctcttaattattaacaattctgacagaagactaaagaaatagcacaaatgtctgttaatattttaaagacagtatacaaggcaatatacgaaatatatttcattccaatatatttttctatttttatttcaatcattttttctgttttattccaatcttttctgctttaatacagttgacctcatacattactcatttactttatctgtatctatcaattaactatgtaggagttatatactcacttgctgcatatagtttttcctactactttcatttaacctcataatataagtgcatacaaggctatttattaatatctttgcttacatcattaaatatagcaatatagtattttactatgaaaatcaacatcatttaaccattttcaattattacatactgaaaatatttccaggtttcgccaaggaagctcttaaattgtgtttttagggtcatcacaaatccatgtgtaatactgagtgggagagttagggttttcttattggagcatgtactt

SEQ ID NO: 26999 - DNA, 1262 bp, Bovine  19866880845744
aattcagtgctgagtccaagagaaggactaaatacgttcagaaaagtcttaatcctgagtggaatcaaccagtgatttataaaagtatctccatggaacaggtatgcagctattattttctatatgacagatttaggctaatataaaaacagtgatgataaaattattgaaagaatgtgatttatatcaatttttctatataaacaaccaccaaccaaccaaaaataggtaaagtacatataagaaatgtagccataaaaggaactgagtgcagttcaaagaacggtgaaagaaaatgtgcacattttggcaaaacagctaaaaaaataaatacagtaaataagattggtaaaacattttccattgattatttcaaaatgaaatatttaagtagaatgggccctattatattttgagggaaaatatttccagctaggcacatcatgacatttataaacagtatagagatacaaaagaactggacacactgaaatgaattatcccatcaggcaacattttggagatcgtcttttctctaaattgagacttaataaggatctggcattgtggaactgaattgtacaaaagaaagcatgaagaaaactaatgtaaagggttatcaccagaaacagaatgactctaggcaaaactacatcaatatatttgtgaaaatcttcataactatgcatgatttacagaaaataactgatggtttataaggatgaattaagagagaagagaatacaaataaaatagaaagaagacatccatggaaacaatttacgaatgagttgtctttcaaagtgagatttctaatttatcctctggaagatttctaatttgactgtgaaattgaagctggatatcaattataatctgggttcttgagttgaaaataagtcaaattcacctgcaaaaataagataatgctactaatgtgttttggcaatttactgagacaaatccaaatgctttatctaaataacctagacatttttatgacctatgaatttcatgtgttaaagagtatatatagattctgctttgtacttttaataatgggagggggtagaataacaggaaataaagtaaaaatcacccttttgtttgcaaaacagtgaggtaccttatgatcaaacactcggttggactgcaaaatgattgacagtttacataatatttaatgtaagtatacagttttagataaaattaaaactatttttacataaatagagtacaaggaataaaaataaaaggctctg

SEQ ID NO: 27000 - DNA, 868 bp, Bovine  19866880942156
catggtattcattgttgttattatgaaaagcatcactttgtaaaggctgggctttggactgtctgggcttcccaggtagctcagtggtaaataatccacctgccagtgcaggagtaaaagagacatgggtttgatccctgggctgggaagatcccctagaggaggaaatataaaaccactccattattcttgcctggaaaatctcatggaaaggggagcctggcgggcctcagtccatgggggtcccaaaaatttggacatgttttagtgactaagcatgcatgtggctgactgtctatttttagagttttcctaattcagacccctatctatgcagttaggtacaagaatttccttttaatgttggttatttaagagaatttactgaaagtaactaaagggctctatgagatgaaaatcatttaatcatatgtgtgtgtgtgtgtgtgtgtgtgtatgctgatgtgtgtatatattcatatggtggtgatggtttagttgccaagttgtgtccatatacatacatacatatatcccaaaccagaagtacttatacatgtggttttaacttctgtaagcttctcacaaggatctaatagaaacacaaagctgtccaagctattcccactcagatttctatcttctttcatctttcaactctgcaccacctcctggcattttcaaagtcccacgaggctcatatcctgctctgtctgcattgttgtagttgctgcttgatgccatggtgtttactaacaattgcacagagaactgtttacagtttagactttgtgtatagaatttttgtctatttttatctctagctatgggaaaatctgtgcactcctagaatttaagagagtgttaa

SEQ ID NO: 27001 - DNA, 1820 bp, Bovine  19866881241332
tgcaagcttcttgtcttgaagttttattggtcccccgcgtaaaccaaagctactcagcctcttttctccactgaattttcctactgagctatccttattctattactctttatatctctaattaatatctaattgaagctatcgtatcctgaccctcgccgacgccgtctctccttcgagtaccctggatcagccggggctggtcctcggcagtcattaccttaaaaacattctttcagtcttccctggtagctcagtggtaaagaatccatctgccaatgcagcagacaccagtttgagccctgatctgaggagatcgaacatgccacagagcagctaagcctgagctccacagctactgaccctgtgctctagagcccagaagccacaactattgatcccttatgcttcaactgctgaagcccacacaccctagagcccacgctccacaacaagagagaagccaccacaatgagaagtccaggcaccgcaactagagagtagccctcgctctctgcaactagagagaagcatgcacagcaacaaagacccagggcagcaaaaaatacattaataagtaaataaaagtattttttttaattcttcaattaaggattttaaaaagcactgaattttcatatttttagcattttaaaatgacttattatttgtatcttttagcaatgtagagacttctttattctatccatgtacatattttagaagggagaaaagctaacttgattactgtgccctttttctgtttcaaggacaaactacatctgatgtatttcaaaagatatatagaactttccatttttattctaattaccctttttacgatgtttaatgttgtcacatacagtgaggccataaaacactatacactgaggatgcagatgttaatgactgcttcaaaagactatagtttagggaatgtgcagcattgcagacagaaatgtttttttttcctatctctggagggattttcaatgcagcagtactcagaggaactgcatctatgattctgctgagtttacctcaaagacattttctgttttatctttctttattttccaggtagccttcaagctacaaatttacatgagaaaaccacagtgtactgacttttaattaaaacttcacccccaaaaatgcattgggattgaatttaaatatttaattaaaacacagctttaaaaagaaaagaagaaggagggatttgagactaagttatcatttgagtaagagacatcctaatttaaccatgacaagtaccctgatgggtccctgtctaagggactcacctgacctatggaccattaaatttgtcttgctaatgagtagccccttctgtgtattttgtgggcactaaaactcaggtctcccaacactgaaatcatcatcttatcattctcctgtactttttattgtgatgaatgatactcatatccctctagttaccaaagcttgaagccctaatttctcccactccctccctctgcttaataatcagtgtcttttatgaagataacttggcacacagctctgcttacatagggacaatgttaattggcttcatcagtttctttttctacattttgtgcaagtggggtcaaattgattctagaatacagttttagaaatcaatgaactttttctctagaggtggcaagatcatgtgaaagtcacagttgtattgaattcagaatggtgtagcttccaatgaggtgtggctgtagtacttcttgtctcttccctgaaaatcgggtaggtagctttttctaggtcccaatgagatttagctgcaaaatactatt

SEQ ID NO: 27002 - DNA, 782 bp, Bovine  19866881265674
tgcaaagagttggacatgactgaagcaacttagcatgcagacacatagcctttgagcttctccacaactttacattaaagatgaatctgaaaagaaatgtgataaaactttctgactttcttcaggcatgggaaagacagtgttatagagcagatctacatccatatagacaggagtctgaaattagtgagagtagcagagaatatagcttgcattcctgtgtatatatttatttacacatgtaaactagagatcttgtgttcaaccagtctgtgaaatcacaaatgaattaaatgtttttctggaaacagagctccagaaattctgattgcaagtagcatgatattttaccaggttcccctccctaaggatttgtggaagttgctgaaaaaattgaacgtattccaaaatgcatcgtgaatggcatttaccagttcaaccagcttcctgcctcctgtcatttgctccacaccactgcaagaatatctcaaatcttctgtaatccagggatctgctttactcaagtgatagttgtaatctaatacatcactttcccacgatttcccattactgcttacaatcctgttatgcactttctaatcttctactttctgacttatacttcattgatgggaattttctcaccactcccaggaatctataagcatgccctcaactacgaccatgaaattctttcctgtgacagcagagtacatgtcctttcattcaaagactggttgctctgtatacgttcaagatctcatttctttccccataaataa

SEQ ID NO: 27003 - DNA, 1032 bp, Bovine  19866881312908
ccaggggattttcccaacccaagaatcaaacccaggtctcctaccttgcagacagtttctttaccatctgagccaccagggaagcctaaatataaatttgaaataaatactttattcactttgaattatctttatgtgttaccattaatttttccttgttgtgtagaatcagaactacgtaaaacaaaatatgttacagagtacttctaaaccccacgtttcttttaaatattcaacaatcctgttattgttttgcagaaaatttacaaatttatgaaagcatttatatctgctgacagcctttttcacccttcatgccttcaaataattgactttgacagctttgcaaatgcctgcctttcaaaaacaaacccaacagtgtctatctgatggagataatcataaaaaaaatccagatacacaatggaaatacaatgttgggagcaatatatcaactaaataattttatgctcatgaattaagattgcaatagatttttcagaggctcccttagttcccccaaataaaagacttatcattttttttttcactataaaggctatagtgagtctcctcaactgaaatcaataagtaattgtgacagaatgtcacagaccattaaggatctcattctaaaattcttctctaggccctttcttctccacattccctgactacccaatgggcaggaaggtgtcctatttattccaaatttttgtggccctctttagtgtttgaatgtattcggggattattagtgttaatggggggaaatagtgttcaaaaaaaaggtcaatatttgtattagcaaacaaacactctttactgtatttatgaaatctatggtgatcatgcaataaatgctgaaatcttcaggagatttttaggcttgggagtattgcatttacaactatgataggtatagttggctttttcagcaaatgaaaataggatactgtgtttaaaaaaccaaatgtggaagtgcagtggaaacaattaaaaaggtcagatttgtcaattgcactttcatta

SEQ ID NO: 27004 - DNA, 1252 bp, Bovine  19866881358746
tggtcatttacattttcaaaattccaacatagagatagcttacaagatttcagtgatactatttgtcatgaatatttttatcataaagcaatagttttatcgtaaatcattttttttgtttttatcctaaattagatgcttatttagaaagtgttttgctgtcacttcataatttaatattgcctgttattgtttaaaacttaatcatgttaaaattattcactgccatattcttaaatatattggaacctaccaaaaagtccctggatattctgacagactattagaataaacacagacttgaggcagtatttatttatcacagtgctctgctgaaaccagcttgaccaactcactgcgagaagctttgcacatctcttcccagcttcactttgaatgccatcatgttgatagcttgaattggccatggtgagagtatttaaacatgaaaatagacaaatgctgtaaatcaaacctttttgttcatttagttgcgttattgactttcagaaagctagtttaccaggatattgccaaatatataactgaaagtatattatttaaaatattctaattatattcatacaacagcaaaaattgggagggctagctaaatgaaaaagaagactatatgaatcaaaacataaccattaggaacaaacactggatctgtatgaattttaaatgactgtaatcctatcatgcctaatactattctcttggtattacagtctaggtaagatacaaagattgaggcccatttgtaagtatgggcatgatatgtttactttcagatagcatacttcagaaagaaatgaatatgctgtttttcttttagaataaaatttgcaacttagtaactgtgcctaatatagtttgacaaagatacttggataatttaaagataaaatttcataaccttctttgtcttaacaacatgaaaatcaccaaatgctacaaatcaggatgattttaagtacagtttcaatgaagtactctgtgatgaagtgactctgtctgtatttggtagcttatgtggctatttttaaattcatgcacctaaattaaaaatagatgtaatgcaaactcattcaagaaagaaaactgaaatgaacctaaaattacatttgtgattttataaactcagacactgccatttaagtcctcatctttttttggaactgagaattttgcaggttgtttcatttgtttaagtgggaactcattaaaagctatgtgcatatgacttggg

SEQ ID NO: 27005 - DNA, 914 bp, Bovine  19866881447410
tctgaaggcaaataatataatcaagttttcactaaacttgagaaaaaaaaattgtcatgcaattaatattgttccttttgagatgacatttgcctgtcaatggctttcaaaagagtattgcatagttcagaaaactttatttaaaaaaaaaaaagaaagagagagatggaaattcatttcattttgcatgcatttgaggaacatcaaaattcagaacagcacaaattacaccctgctccatctactgtaaagtgtagtagttgagtacaaagtgtcaagtttgtatagttatctatttaattgttttaaatgctacagagagaatttgcctttttactggttggaataataaagccaaactgaaagctaagaaatgttgtaacaggtcctacagaggctgactgtcttccttcctaccctcacatagtaagtcctcagttaaaaaagaatgtgtgaacttcctatagtaatagagtattgaaacagacatctttttcctacatccatcctgaattatcccactagtaattatagagacgagagcaaaaaaggaagatattggtgtgtcccactttatcccctctcccaacccccacttcccccttggtaaccagaagtttggtttctacaaaagaacctactgaatagcacaggaactctgctcaatactctgtatgatctatatgggaagggaatcgttaaagaagtggatacatgtatatgtatagctgattcactttgctgtacagcaaaaactaaaacaaaattataaattaactatattccaataaaaattaatctttaaaaatctctttaagttattgtagatacacagaaaataaatgcaaacagcagagggctggtacagtatgagactgagaggaagaggaggcaggagagtagaagcccatgcc

SEQ ID NO: 27006 - DNA, 1284 bp, Bovine  19866880508091
taaaattttctacatgaataattaatatgttttcaagatggtgataatgttttatgctttttaaatagtaatacaacagtattttaaaacacacttgtacaaatctaaattgcaaattaaaaaatcagaatttcctgtaaatttaataaaagttggggcttcccaggtggcactagtggtaaagaatcagcctggcaatgcaggagatgcaagagatgatggttcaattactgggtggggaagattccctggagtaggatatggcaccccactccagtatttttgcctggaaaattccatgggtagaggagcttggcgggctaaagtccatggaactacaaaacttggactggactgagagcatgacatgacaatttttctggaataattgtttcagaaagtcttacataagatattaaaatagtttttactagaataagcatcatactctttgtcacttatgtggttatcatttacagtttcaggaaactacttacactgttgaaattgtcttgctcctttacaagcttccagtgggtattaaataaacctacatatgcaaatgtcttagagcaatgactgacccataaagaccattcagtacaattaaccattattaaaataactctagttacttgtaatttaaaatgtactgaggcctgactataacaaagccaattttgccttcattttttttccaccatcctgcctatacttctttcccaacattctcaaactggcattatactcagagattattttgaactctgtgatattcatagtttcacttctaaaactgtcagttattttttttcctcctctgagttaacagttaatgaagattcccagcagagtgttaaggtagcaattacagaggaatttttgagctgcagcactgagctgaaaagcaaattctatcttaatcaaagccccatcaaacgagtgaaagcaaaagaaaattcagtagctacactggccagttatctgaaataaaaataatgctgctcttatagcccttacaatacctattttcaggtagccatgtttagggaaaaaaaatatccattcttatgttcacacatcagttctgtccttgaaatacaattttaataaaaagagataaatgagattattctttttgctttcttttttctaatcactaaattaaatatggtcattgtataaagtttggaaatcatgggaagggtgccacgaaacagtaaaaaggggttgtaaatgacatgctacttaatgatatactaacttcagctaaaataaagtcat

SEQ ID NO: 27007 - DNA, 1034 bp, Bovine  19866880560584
aatttatcttgcacgcttttctctagtgagtatgtttcataatgcgaggtctgctataatggaaaagaagaaagagaaattagtagtttaaatattaaaaaaaattaatattttaaatgataaaatactaatatctaaacgttatatctttatagtcaattgcaaatgcagttagataaaagcatttaattgtccccagtaataaactagtaagacagaatatattaatagtatgtaataaaaatcagactagttgttattatgcacccatattataccatatataactttgcaacagtaaatactaatttgatctatatgagttactaaattatatcttaaaatatgatataaatctcaagtgtttatatttttctagtacaatacatttttgtagtagatttaacacagtactaaatttgaagtggttaaaaaaaatgtaagatattacacaattatagtattgcaagaatagtggagtgggtagccattcccttctcctggggatcttcccagcccagggatcaaaggcaggtcttgcacattgcaagcagattctttacagtctgagccaccagggaagcccaatacatgcagagttaccacactgtcacttacagttttagcaatctctccagccactgaaaatatacaagaactagatggaatactgatttctctaaactgttttcctgaggcactaatcatcagaaacaacagacaagccaccaaggaccattatgcaaaaatagaatcaatgttgattgcttttattgtggtttgcacatgcttatttcattatttcttcatttcctttgatttgctgccaattttctatcgtattttacaaaaacactaataaaattattaatgaaacatatttgttttgagttaactggaaaatctagtggaaaaaagcagagtaagaggaaattgatcacattttatactcaatatagtgactttcttatctacttaggaagggaagggacacacttcaattggtattttgaagagcacaggaatacaatgca

SEQ ID NO: 27008 - DNA, 1061 bp, Bovine  19866880562067
tgagctttttttttataaaagagaggatttcatctatgatcaagtcatgtgatcagcaaaatattatcccatgaattataatccttaaatgacatgacaggaaccatctagtgaattattgtgttaacaagattaagatgacattccctttaatatataataaaccccatagaagagatgcaaaaacaaacaaacaattttcttctaactcttcttaatttttaaaatatgttatcatgattttccagaaatttattcaagcacatacataaatatattgctttctgtcctgtaaaatcaattactcgcagcttttaagaaacactcttttcctgaagtgagcagtttactccattagcttgctgtgggcattagatatcatagcaattacagaaagatgattcaatgaatattaattggtaagaaaaatcaatgaggcttggcattgcctcttcatgtaaagactatggtgtcccttacagcattattatgaccattatttgataatccttgctgtgaattctgattgatttctaaaatctagaacatagcatcatttacttggattctgtactgcttggcataaaaggaatgagtctactgttgtgttccctagagcctccttcagattttatattataagagcagactgtgtcatctatacagtaagaaaaagaagagatttcattacagatctattgggtgccagttcttagctttattttggaaatgttttccgggaagcataatcactatgaatgttctgaataaagaattgcaggaggtcaatcacacacacttggaggaggggatgggaagataaggtctggaaagtaaagctaaaggatcaaagaaaagttactcatcaatgttttggaagtaagagaccccagaagcactacaaaggagagccagtgggggctgtgcctctgcaccccttggtgggcctgggtcccttgttggtcataagggccctgggggaaaggggctggacaactgataggaggaagttatgacaagctggaatccaccaagacctctgcatctggctctcatctcat

SEQ ID NO: 27009 - DNA, 1389 bp, Bovine  19866880723904
tttgtgtgtatacttttgtgtgtaagtgtataataaaatattcaatacttaagactggaaagtaatgaatagatttttaagtcaattccttgtttttttttgtctcaagttgaagcaattgaatgagaagataaattaacttttaattgttggcaggatatccccacattggcatttgtttttcatttataaaattccttaatacaataaattattgaaaataaaattttctatttctatatttgagtgtctacatacgaatatagtataatattgcattcaattaagaaaccacaaagttttataaaatattctaactaatatagagaaaatcaatggggttgtattgtccaatgtaatctctggtagcaagtgaatcagtagatacaggaaatacatttctcacatgaatatctgacattaaagaaccaatgtttgaaaatgagggaggaatggatctgagtaattcatgcaaaaataggacaattatcttatgtattagtgatgcagcttgcaattttagcaacctttatttctctcacagttgaagagaactggaaagatgccatttctacatttgaaagcctttattttcctttatgttgcctggcagcctatggtagatcagtaaggtctgtgcctgtccggatgcacagaaagtaattggcatgtccatttcgtttgtttctctctggccttcaactgctacactcatccattttctggctgtccttttaatatttgacaccaataccagaaagtggtcatttgctctttggtaaataggataatggcataaaaatcttgaaaaaaagacatcaaaataggcatatcaatatcaaaacagctctaatccccagacaatattcattctctcctagatgaacagctgctagattaacagaactatttttaaaagtcagttttcacaatgtaaaacatcagtaaacattgaccaaggtaattctctcaaaattcactattaattctatataaacatatgtcatggttgtggacacattcatttggaaaaaggggaaggcaaatggcagtaagttgaaaagatcaagttggctttttctacaaagcatggattcaagtgtactccataaaaattggattggtgtcaggatcagaacaggaggctaactgactgggtccacgtgtatgctggaactggtccttactggctcatgaaagcaaattttagggaatttcacaagtcagttgttgaatatatccatccttaaaaagtgaatttttgcaaattagaataaaataaatatatttaaatcaaaagtactaagcatgtgagctttttgtctcaacattcaataagtttaattttatagtttaaaattattatccattagttcagttcatttcaat

SEQ ID NO: 27010 - DNA, 2226 bp, Bovine  19866880821512
attcatgttgatatatggcaaaacccaaatccaatattgtaaatttaaaaaattaaaaaaaaataagaaatgtatttacacagtggaaatgatcaggtgttgagacactaagaatctaccatcatttcttcccaccagcttaggagcatatgtatggtgagaagtttgctccaaccaggctcctatgagacatcactggtggtccagtggttaagaccacccgtggttcatacttccaagtgcagggggcttgggtttgatccctggactgggaactaagattccacatgccacccaagtggtcaaaacaaacaaacaaaaacaggctcccgtgggaaaagctttgggtgcatgctcaagttgacaaaagaactgcctccaccatcaaacccaggtggggaatgctgagaggtatgggaacactgaaaaaggctccaatgacacagatgctgttcagcaccactggaccagctgtcatcctcagcagggacctagtggtcagcccatttcttggggctcctgctacttctaggagagtgaacatgaacagcctggtagaacagcagagttgggaggctgctagaaaaggtggttaggtcacgttggagctccaggagctcaggtgagccagcttggatggccatctggctggagattgcaagtgacccacatagaggccttttcttgaagcagctcttgggtgtctgtgacactggcacctctcatccctcctccttaggatgtgagaaatgagttcactcttggtgggcaatttctaggcaagggagacagtaagaaaggcccttatgcatgttcctaccaggttctagccctggtaccacatacccagagaagaaagacccctatggggctgagtagaaagggcccacagaggcctccaactttttccaaggacaaatgacccaaatactcaggtgaaaatgaaggatcattgaaaggaaaggatttaaggctagagtttgatttaatcttctgcccttcctcactctaaaattcacttgcagccaccccaagcaggcgcaaggtcacccagaaaaatgtcgactgattcagcagcccaagcaccacctgaaactagggacactccctgtgtggtcagtgattgtaggtacagggagtggtgcattgtgtaacctgcattgtatagcctgcattgtatgaccaccatggaacttcacatcaaactctgttagaatcacagtgtgtgtttttttttggagttctttagagaatttaaaataacgtacatcaggaacacgaagcttctttcagtaagccattccagaggatgtcgggactgtcacagctgataaaattgctagaaaatggactgcaatttgtagtcttttatctaactgttttgacaatctagagacatatttattgtcaatcatttatccttccttcaaattctcctcagttgcaaataggataatttttattcagtgagcttccaggagcagctaattcccatattaaaaattaatattggtgactgtgtctgaatgaagcagctaacttttcccaaaattcttgattttaacaggtcgtatgttcatagctttctacataatccctaaaaatagctgaagcagctcagcaaaagtagaattctttagcactcaatttgatccaattatcttttgatatgagcctatgagagaagtttcagagaaggcaatggcaccctactccagtctcttgcctggaaagtctcatggacggggaaagcctggtaggctgcagtccatggggtcgcgaagagtcggacaatgactgagcgatttcactttcacttttcacttttatgcattggagaaggaaatggcaacccacctccaagtgttcttccctggagaatcccagggacgggggagcctggtggcctgccatctatggggtcacacagagtcggacatgactgaagcgacttagcagcagcagcaactcttctttagcattaatattaatatgttaatattaatattaatattaaatatacccttcttcccaggtggctctaaggtaaagaatccccatgcaggagatgcaggttcaatccctgggttcggaagatccctggagaaggaaatagctacccactccagtattcttgcctggagaatcccatgggcagaggagtctagtggctacagtccagggagtttgcaaagagtgaacagactgagcatgcacatgtgtgct

SEQ ID NO: 27011 - DNA, 3384 bp, Bovine  19866880862670
tttctttgactcaacatttgtcttctttaaccttaaagttattaaaaagcatattgtctaacttcaaatatttggggatttgacgtctatctttctgtttgatttgtactgtaatccctctggctctgaaagcgtactttatgtttttctgttctcttaaatttgttaagacatattttatgtcctcccagagtgtggtcagtcttgatgaatgctctatgtgagcttgtgaaggatgtgtaccttgctgttgttggctgaagtagcccataaatatcaattggttcaaattaactgacagtgtttttcaggtaaaatatattctgattttctgcttgatggtcagtcagttgctgaaggaacagtgtttgaagtcttcagctacagtaatgaatttgtctatttctccctttcatcttatcagtttttgcctctctttttttggacacactcttgttaggtatacacatttaagagaaattaaaattgacttctttatcattatataatgcccatttatccatgataactttccttcttctgaagtatgctttatttggaatcaatacagtactttagttttcttttgattattgttagcacaatgtccattgctccatcctttttaaccaattggagattttaattttaaagttgacttccatcagacaacataaattgagtcttgcttttatacccattctgacaatctttgaatttaaattggtgctctgaccatccacgttgagagttattcttaatacagttggattaatatctaacatgtttgtaactttgttctattcattgaatttattgtttttcccctttttctgccttatctgctactaaatgaacatccaatatgattcccttttacttcacatcttagcacataaattagttttttttaatgttgcatttgccttagattttccaatatacattttctttaactgccctgtctgatagtctttatatatatataaagcagcaacaaccacaaagaattatatataatttttttttatgtatttacttctggctgtgatggttctttgtggttgttgctgcttgggcttttctctggtttcggtgatcgggggctactcatggggcttctctttatggtggctcctcctgtttctgagcacaggctccaggtcatgggggcttcagtagttacagcacatgggctcagtagttgtggctcctgggctttagagcataggctcaactgttgtgatgcttgggcttagtttgccccatggcatgtatggccttcctggataaaggattaccatgtttcccatcttggcaggtggacttttttttttactactgaaccatcaaggaagcctcccaatatgcatggaatgatactcgaccactttcacttgtagcaacagaatatttccaatccctgtttcttctccctgtgacattgctgtcattcactatctatccataggctatactcacacagaacattgttgctattattacttgaaatacagttatcttttatattaaataagaataagaaaaataaaatatttttaatctttttttctctgacatgttcttttcctttaagtagattcaagtttgtggtgtatctcatctttcttctgctaagccccccaatatacatttttaattaatctaattgtcattaaaatactagaccacttcacttgtagcaacagaatatttccaatccctgtttcttctccctgtgacattgctgtcattcattatttatccataggctatactcacatggaacattgttactattattacttgaaacacagttatcttttatattaaataagaataagaaaaataaaatattttttaatcttttaaaaaaattttttttctctgacatgttcttttcctttaagtagattcaagtttgtggtgtatatcatcttccttctggttaagaaatcttttaacttttttttgcatacaggtatgctaataatggggtttccctcagttggtaaagaatccgcctgcaatgtaggagaccccggttcgatccctgggtcagaaagatccactggagaagggataggctacccactccagtattcttgggcttcccttgaggctcagctggtaaagaatccacttgcaatgtgggagacctgggtttgattcctggattgggaagataccctggagaagggaaaggctggccactccggtattctggcctggagaattccatggtttgtatagtccatggggttgcaaagagtcggacatgactgagcgactcacactatgctaatgatgaattccttcagtttttgtttgtcttaggaagtttttatatttctctttcactttagagagtaatctttctggatacagaattcttggctggttctttttatttttctttcaacactgaagatcctaccttctttcttgcataatttctgacaaaaagtccattgtatctttgttcctttataagtaaggtttattttccattctctagattcttttaagatttttttttctgtctttctctctttatgttggaggatgctagctgctgctaagttgcttcagtcgtgtccgactctgtgtgaccccatagacggaagcccaccaggcttcagcatccctgggattctccaggcaagaacactggagtgggttgccatttccttctccaatgcatgaaagtgaaaagtaaaagtgaagtcactcagtcttttccgacccctagtgacccccatggactgcagcctccgtccatgggattttctaggcaagagtactggggtgggttgccattgccttctccatttggaggatgagggtttcttaatattatgtgtgtggaagtagtgttttggtacttatttttgttctgactttcatggatgtgtggtttggtgtctatcataaagtttgggagcttctcagccattattacttcaaatattccttcttattatggtatgccagttatgtgtatcttatatcttttgacattattccacaggttttggatgttctgggtttaggtttttttcccttctttttgaatttcattttgggaagtttatattgatctgtcttcaagctcactgatgctttcctcagatttatctagtttattgatgaacttatcataggcattcttaatgtctattatagggttgggtatttctagcatttcctttgaattcttcctcagagtttgtagctctttgcttactttacccaagtgttcttgcacattatctaactttttaaattagagctcataatgttttgccaagagttttaaaacatttcctgtgataattttaacatctgtgttacatttgagtctagttctgaagcttactttat

SEQ ID NO: 27012 - DNA, 1025 bp, Bovine  19866881299213
cgactgaagcgacttagcagcagcagcagtttccccttcatatctcagtgctgaattttagtaagtatttagatattctatactaattattaataactctctcttctgtcaaattgtgtttaagtacaggaatatttctaccagaattttgcacagtccttagaatgcaattcactaaaacttctagaataactttggatatctcttcatctcctggctccgaaagaatatccatggaagttatataaactgtataaagtactccttttcaaaagacattttaattttttgggggtctccttaagttccatcattacaaataaaaatatacaataggccatggcgaataaggaatacaagtgtcagaccattcctttagaagtttatatctcaagctttggctatcttgtgatagatacttttagtttatttatactatcctagcactggagttttcattaggctgaaatgtgggcagaacttgtttgccgcttcctagaaagatgtgaggaggaagaatcctattgattttatttctagctcttggcttcgagctaaaagagcaaaaaaggcctcccaagagccttagctactgtgagggagtggttttataaataattgagttacctaccctggaagaaaattctttctttccttatattttggtgatttttcactgaaattttcttttgacattctgtttattctaaataaggattctgaaaaagtgagttaactataccagttaatccacaacaagcagaaatattaatttatacctcatgttatatcgggacaaatgtctaatgaatacattcttattttttaacctggttatatgatggaatattatgcaatttctagtggaaaatagaatatgctatccctttggcatgggaactatttaaaggtaaaagcatttaaaatgaagcaaacacagtaattttcctacatgctaacacacaaattgcaaactttcaaagatggaaacattataaacctattacagcacagtgctacatagc

SEQ ID NO: 27013 - DNA, 1531 bp, Bovine  19866881311802
ataaaaaatatttgtgactgcttttgtgtcctaaattgatttttgtcttaactattatgtggaaaaatttcataaaaacatcagttacatccctaagcagagtaaacaaaataagattattgttaaactataccttaagctacatctgttcaacattatggcctctcaaagcaagtatttatatgatttcaaaattatatttcaaaataggcattaaaataaaaactcataaagagcataaagcagaggggaagggatttgaagggtgggcgaacagggtcaacagtatagtgatggatggcgactagacttgtgggggtgatcactctgtaatatatatacagatgctgaattataatgctgtactcctgaaattcataatataaaagcaaatagaaaataatgtgattacaaaacatctttcttttgctagtaaacttcaaaatgataattaacactatttgaatgtagcttgttatatattctgtttataactgtagtcaaataacttaaatttcacttaaatacttaaattttgcttacaaaacccagtgatataaattataacttggtctgagtatatttacacttctagctttaaaaataaaattactgctctgccaacacatttaataaaacacttttgtgagaattgcaatttgaaatcacatttgaaaaagttacaattactagtggaagcaaattttcaaaggaatttatgcatcttgagaacaaatattttaactttttttttttttttaagcagaacaaatatttgggccttttcaagtgaaaataattatttgctggtttttcctttaagatgattctgtcagtttgccagatgtctgttctgtattccaaatatgtaataatgatccttaaatctgcataacttacaacagttttgctccactccatgtaactcatctcagtctgtaagtagctttagttttgtacaaatatttgcaattcctgtttggaataactgttcatgttcaccatctcacactctactaagagacttgggcatcatgttactcgataaacacacgaaccaaatggcatggacaattttctttcttaaaccccttgtaaagactgagacccatcaaaccacaaacccatactttggccaaatgttttccattaaacccaactggtagtatagcacaaacagcatttctacactatgttctttgtcatctatcctgccttctttattctcccatgcatattagtccaactaatcaagatcttctatagaaaaaaaaagagtaaaatttatatattgtgagcacccattaagatctccccatttggatataggatttatttttttaaggcatattttcattccaatcccaaagaaggacaatgccaaagaatgttcaaactaccagacaattgcattcatgtctcatgctagcaagttaatgctcaaaatcctttaagctacacttcagcagtatatgaacctagaaagtccagatgtacaagctgtatttagaaaaggcagaggaaccagaga

SEQ ID NO: 27014 - DNA, 3997 bp, Bovine  19866881463690
ttggagaaggaaacggcaacccactccagtgttcttgccttgagaatcccagggatgggggagcctggtgggctgtcgtctatggggtcgcacagagttggacacgactgaagcgacttagcagcagcagcatagatgggccactgagactgtatggttgtctgtctgtccttgaatcctttagacacacattatcccatctagacaatgaacacggttccatgtaggtcactactgtgttttatttcttttccagtctcataaacccacaagatctctctggactccttgtcagttcaaggagatcattctactgcttccttgccccacactgggcttccagcctgtgtggcatcatctagtctctacttgtgtcgtgctgttccaggtgctggggaaccgtttcacttttgcaggtcctactgaggcttgaggaattctatgaggctatctcaccctcttgaccctgattaacaccaccactcccccactccgccacctcacccaggcatttctgctctgggattttattgcttcccaagattctattcctggtgactcagagggtagagaatccacctgcaatgcagaagatcccaggtttggggcagggaatagcaagccactccagtattcttgcctggaaaatcccatgggcagaggagcctggtgggctacagtccatggagttgcaaagaatcagacacaactgagtgactttcacttttcaaggttctactcaagaaagggggcaaatagaggatggcagtttgtgctttcaaataccatactcctttctgcttagctcacttccatgctaggatcagaagatgaggtgggcaagtgacctttctcagggactcacaccgtctactcacctttcacttttcttctatcagtcctccactccagtccagggaacacttattgcatctgtggagcccagaatctttctcttacacagtttgttttcagtttgctttcatagtttgttccttccaagttttagtcatacatgatagtctttgacttgttcctggaaactgaatttataaattgaaagcaaggaaaatgtttgcatttcccatttgctatgtcatcattttctagagataaaaacatcctaaacagggagggacagacagggataagtggaattttaaacaaaaaaatcattaccacacaaaacatattggtcaatatttttgaaattttatagtagcccagaagacatgatgtgtttgaacttgcctgctgctctgaaagtggactagtatgggaggaaaagtgatgtcagtgaactgggacttagtgtgaaatgcaaggataaattgtgttttcttgcataggctacactcctgaaatggacttcccaggtggctcagtggtaaagaatccacttgccaatataggcgatgcaggttggatccctgggtctggaagatcccctggagaaggaaatggcaactcacttcagtgtttttggctgggaaatctcatggacagaggagactagtggggtacagtctatggggtcaaaaaagagttgaacacaacttaatgactgaacaacatacacattcctgaaatacttattggtattcactttctttctcttaattctgacatttctttttagtcattggactagaactgcttagaatattaaaatgaggcattactaattcttgagctttttggccagatgtcaatttcaaaggaaagagtaaatttttaaatacagatatatttaatgaaaatgattcttttgctcaaaagtaatttttagaattcattcatttatttatttattgctactctgagtcttaattgctgcacatgagcgttctctggttgtggcaagcagggcctactctctagtggccgtgtccaggcttcttattgtggtggcttctcttgttgcggagcacaggatttagggtgtgcaagctaagtagttgtggcatgtgggcttagttgctctgaggcaagtgggatcttcctgaaccgggaccaaatctgtgtcttctgcattggcagggagattctttaccaccgagctaatgggaagtcctgctcaaaagtatttatcaatcattaacaatatgcttcagttcagttcagttgctcagtcgtgttggactctttgcgaccctatgaatcgcagcatgctaggcctccctgtccatcaccaactcccggagttcactcaaactcatgtccagtgagtcagtgatgccatccagccatctcatcctctgtcgtccccttctcctcctgcccccaatccctcccagcagcagagtcttttccaatgagtcaactttttgcatgaggtggccaaagtaatggcgtttcagctttagcatcattccttccaaagaaatcccagggctgatctccttcagaatggactggttggatctccttgcagtccaagggactctcaagagtcttctccaacacgatggttcaaaagcatcaattcttaggaagtgtaaaacttctttggatgtttgaaactgcctaggaattgccttgataaagtatgttgcctgttgttgatttttaatttgttgtggacttaagaaggaatttgtgattcataaattttaaagaacaaacttagttaattctcatagacctgtgatttcactgtgactttgttgaaacaggttggacctctagctcctataaattggatctaaatgttctttcttattgctgagctcagaatcacatgcatttttagaatctagataataagtactcagttctgcctcctgcaaataataattcacaatagatactcactggtgttgatttatttatgatggtgactgctgcacaaatctcatgtacactaaatgttgaacaagcattatcattattttgacaaatatcctcaggtctttggcactagttttgacaaatggtcacgaggaagctgattcagatgaatgacaggcagttgtagtgcagttctaccagttgattcttcatcatggaatgatttaaaaaaagcgaaggaaagtgctcatctgacttgacagcagagggtccgtctgcactgtggatggtgggtgattgttattgggctggaaatactcggtaaagactatcttcaccagagcaaatcaaagaattatctttgtcaactccctacatcgtaaaaccttggactatatgattgtgtttaaaagtgtatttatataaaaataaaaataaactttatatggacttgtcatataaaatggattagccaagtcattagggttcatctagataaggtgtacatgtgtgggcctgaattcattatatagaaaagggttagtaaattatgagtgatgttttaaatagtgaaaccaaataaaaagaaaataaaatatacagaaacatcctcatgtaagtaaaccttatgtattatttaggttttcaaagaacatatatttgtaaaatttttctccattttatttttttaactgctaaaatgtcgataccatgaaagaaagaagaatgaactgagtcacaaaatctgcattggagtcctgcctcgatagctttacccaattcatttaacacaatgttattattcttccaaagtggtttattaaatattttatcttaattagcttacctccactgaaatgtttatttcacagataaaagctggcttaaaactcaacattcaaaaaactaatatcatagcatctgctcccatcaccttatggcaaatgaaggggaaacagtgaaaacagtgacaaattttattttcttgggctgcaaaatcactatggacagctactgcaggcatgaaattaaaagatgtttgccccttggaagaaaaagctatgacaaacctagacagtgtattaaaaaacagacacattactttgctgacaaaggtccatatagtcaaaactatgatttttccagtagtcatgtatgcgtgtgagagctggataatataaaaggctgagcactaaagaattgatgc

SEQ ID NO: 27015 - DNA, 2097 bp, Bovine  19866881521523
ctggatggcatcactgactcgatggacctgagtctcagtgaactccaggagttggtgatggacagggaggcctagagtgctgcaattcatggggtcacaaagagtcggacatgactgagcgactgatctgatataatggcttggtcttctcaggtggtgctagtggtaaagaacccatttgccaatgcaggagacataagagaagtgggttccatctctgagttgggaagatcccctggaggaaggcatggcaacccactccagtattcttgtccagagaatcccatggacattggagcatggcatcatgtccagagagctggacacaactgaagtaacttagcatgcatgtatgcatgcatacaatggcttggaaacatttaacagcttcagctggtttctttaatcaattactagcctatatggaaaaaaaggggagttgctgttttctaggtttatactgttcatattctagtccattttgctcatttaaggcattaattgcctccctgatacatcagattgactcaatatggcaaagctaatttatgttaacagacaataaaacaggatttcccagatgtcacagtggtaaagagtctgcctgccaatgcaggtgacccaagagatgtgagttagatccctgggtgggaaagataccctggagtaggaaatggcaacccactccagtattcttggctggaaaattccatggacaaagaaacttggtagactaaagtccatgaggtcacaaagagtaggacatgaccgagtgtacacatacacaataaaaacatagaaacacacagcattctagccactgcttttttcactgtacaatattaatattaaaactcactattttaagatcataatgccctgattttgagtaatattttgaaggagaaaggaaaaattgacgatatttctttattaaagttaaagataaaaataagctaaaacattatcagatcatatatgctatgaaaaatttaaagtaaccaaatattatactggaagatcataaagcatctgaaacatacgtataaatgagttccaactctgcccgtctttttaatgacaaaaagcgaagttgcctggagagtatttgggtaaatttatttgcagaaactactgtgaatttacattttgatatgcattctaaagtgaatctgttcaaggtggtgtttagtttacatcttgaaaatttttttaaatgtaccaatttaagttgatgtattattcattcaaaagattgcattgactcagaaatgtgaccagctgaaagaaagtaaatctagctttaatcatatattgaggcaaggacaaaagtgaacatatcttaattgtcttggcccacaaaaaagctgaggctcattttgattattttctggagataattacaacacccaaaatggactctatttgaaactttataagccaatcatactggtattgcatatatatatatatatatatatatatatatatatatatacatatatatacacacacacatacacacacacactacctaggaaaaagaaatcagcaattttctgctaaataatgattaacagaaaaccaaaaatgtaatgtgcttctgggaaaaacaaccttactaacaaatgacatacagagccaaagtgtctattaaagcaagcatctatagaataaatctcttttaattttcagcagttatttataatattatcttgatagatgaacagccaatttgctgtttattcactgaagccaatctgactcttttgcaatcccttggactgtagtcctccaggctcttctgtccatggaattctccaatcaagaatacttgagtgaatggcaatttccctttccaggggatcttcccaacccaggtccaacccaaacctcccgcattggcaggatgattctttaccactgagccacctaggaagcccagcaaaccaattaggaaaaaataataatcattataaaatagaaagggttaaaagaatgtctataaatgataaagacttcataactcctggagggaagtacccttcagaagaaataaacataatcatacagaataaattttaccaaaccttccag

SEQ ID NO: 27016 - DNA, 872 bp, Bovine  19866881613733
aactgaaaattcctaattaatatatcttttgctaactctcaaagggtcagcattttaaatagactttccaatttgccatcagcaacattgatgatactaaaaattaaaattcctatgattcttactgaatctattgggctttatattttattttaaaatttaaaatataatgacagattaatcaaaagctcttttaaatcctaaagcaagtaatgttaacactagcaaagtaattgaaataattactttgtgattttaatacataaagaaggctaaaagctttttgcatttttccaggtcatttaatatctttttcaatagcatgcactacatctgtactgttattgtttggttgttgagttgtgtccagctctttgcaaccttgtggactgtagctcaccaggctcctccatacatggtatttcccagacaagaatactggaatagattgccatttcattcttcaggggaacctccctacccagggatcaaacccaaatctcctgtggattctttaccactgagcaaccagggaagtccatctgcactgtagagaagtggtggttatggaaaaatatataaagcaataagcataagtatatttattcctgagctcactgtttagagatatccattaataacataaaaagtagacacacacatgtcatagtaaaggaaggaagcctttgaggaaagtgataacttttgcttggggggacagcaacaactacaaccataactcaaggatgttcaggaaagagttgaagttacagagccactttgttttaaaatttgaaagtttctagagaggaatttggaaatattagacaaaagcagctaggtggaaaagtagcagattgagattaaaagca

SEQ ID NO: 27017 - DNA, 1433 bp, Bovine  19866881858622
tgctgtctaggttggtcataacttttcttccaataagcaagcatcttttaatttcatggctgcaatcaccatctgcagtgattttggagcaccccccaaaataaagtctatctctgtttccactgtttccccatttatttcccctgaagtgatggaaccagatgccatgatcttagattcatgaatatgaatattgatggataaaaaatttctggcttcaatagctgagtaggtgatgttgcaaattcttgtgattagaaataagtgataaaaagatactcagtttctttaacaacttgtagtctttttatattctctaaaacttgaattaaataaagctctaatctatcaaaaatatttttaaggaaaagattttatactctatcaaaaatttaagaaaaatatttctatgccatgtaatttaaagtatgttatatttttaactttgttagtaagagtcagatatgtcatcatttagatattgactctgtgtgtatacatatgggtctgtatatacaatcaaaagatattatgactcaccctttataactgtcttaaaagtcatctgttttattttgctttgtgttacattttttcattatcaatacattaaatttcttgtgccaggttaagaatctaatgagtgaacaaacaagtatcttgagggaactaaagcactctagtgtaacgggaaaaattgtggaacagtaagggcctgactagtttggaaaatgtacaatattgttggtttcaagcattcaggaaaatgatatagacaacccccctgctgtccttctgcacattggatctaatttgaattcataatgccacctgctcccagtgcttttctatgaattgtaatgacttagaacatttagtagagtttgataaactaaggaaaaacagagggttatatggttaaaattttttggtaatttttattattgaaaataaaaaaataatagtctatagccatgcaatctgaaaaatgcatatatattcacatcaggacctaataatcaaattttatgaatgggaaaatatacatttcagttcttcaatatcaagaatggagaaagacaataaattaatttcttgactctcattattgaaaaatttaaacgtagcactataaaattgttgcttctgaaattaaatgacaaaatatatgtacattacaattgagttatgaaagttagaattaggacaattgggttttcatattttggttttgctttggcattaatgtgttttaactataaaggaatttcaagcaaacagtgctgattagattatcagctgattagtgcatgtaaagtggtgtcttatgattttgttgtcacttagcaatgatacaaaatatctctccatatgtttccaaggaacaatgtgatgacaactctttaataacttaggactgactgcgtcatcca

SEQ ID NO: 27018 - DNA, 759 bp, Bovine  19866882035956
aaactgtataatttgctgcctatcttaatttaagaaatgtgtaattttaatttgagaataattaacaattttttttccctgcagataaaggtaggatccctccttctgaattccaaccataatcagctattgatattccagtgattaccctactgatcacctttacactggctgtccttccatactttatcatactttaaccaatattatcatcaaagattatgcaaaaacaaaggcacacacccctgacctaaaggtgttggaatttaaaggaagacaggttaggaaatataatgaaggaaccaacgttttcaaaggtatgaactgagtgtttgtatgtgttatactctctaatctaaggggcaagaatttactcacaattaaatctcctatgaactattatttaaaaattcatctaaacatacttatatttgcaaaagacagaagagatttgctaatattccctttgccattgattttattttgagagaaatgatgatttaagagctttgatagtatgtataataggcatatatttgtatttgtttagaaataaaaacttggcaactttatgaaattatgttcatgtgagaaagaatactcatagagcagatataactcaaccatatgccgcattccttggaaacttattcagtcagtgtgccaagaaaaatattgaataaaattgatgttttcatgggtttatgaaccagtaaaatggagtgaactacttctactgaacacagcaagaattcttca

SEQ ID NO: 27019 - DNA, 1292 bp, Bovine  19866880497902
aactgattcaaatgtattctttttaatggctgagtaatactccattgtgtatatgtaccaccgctttcttatccattcatctgctgatgggcatctaggttgcttccatgtcctggctattataaacagtgctgcgatgactacactttcatttgaaaatatggaaatagtatatgttaatctgctctgaggcttatttaagtttaatagacaattaatgcagtataaagaattatctggaaaatttgttcttgttcagtcattcagtcgtgtctgactctttgtgaccccatggactgtagcatgccaggcttccctggcatgtaaaaaccatgtagtttctacatagtaaactgttccctagttccctagtttattatgtataaactaaacattactatgtataaatagtgagagccccctgtataacacagggcactctattcaacactttgcatgcatgcatgctgtcacttgagtctgcctctttgtgaccctatgactgtagcccaccaggattctctgtccatggggattctccaggcaagaatactggagtgggttgccgtgccctcctctgggatcctcctgacccagggatcgaacctgggtctcctgcattgcaggtggattccctgccatgatcccactcaagaccctattgacctaaatgggaaggaaatccaaaaaagaggggatatatgtatatgtatagctgattcactttgctgcacagcagaaagtaacccaaccttgtaaagcagttattttttgtggtggttgtttagtcactaagatatgtctgactcttttgtgaccacatggactatagcctgccaggctcctctgtctatgggatttcccaggcaaaaatatgggagtgggttgccattagactcataaagatacacaatttattggtcaacattgatcaagaaacagtattcaagtactaaatttaacaatagcccttatagacatcccagatatgagattttaataggatgagaaacagaataagtgataaaaagctgagcccctgtaattagccagtcactattgtgctttgattttgtcatttttcttataataattgaccagctcttttactgcgttcaatgcccagaacaaccttgtagtcatggtatgttgacatgcacaggtggaagagatacaggctttgcttgagtaagcaagattttctaagtgacatatacgagtaaaacatattggctttagtgtgccagggttttgcaagaacaagcaattaaacattcttagattctgtgcac

SEQ ID NO: 27020 - DNA, 3403 bp, Bovine  19866880562439
atcttgcctctcaaacagacaggtgctggtggcaatttttcctttctaaaaaaaaaactatgtagaaaacaacttatagaaaatagaaataaagaagataaaaatgaaaacaaatgcacatgccattttggaaatagtagttagatataaaatattgatatattacaattttactgactcagagataaatttaagaaaaaaattaatgagacatactttttacaggtgaaccacacatatttatctaacttaggtgcatattatctctactccatagcttgattttcttagggaaggagtagggcatatttaatacttttattaaaagatcatttttaaccagctgcttcacaaatagtcatgaaaaaagccaaataatgacaatgtctgtaaaagaagacagagcacattttattttatattaatcatatgagtaaaaataaaatgaaaatataaattgagaaattaaatatacataactggaagtaatcgtatagtataaatatgggaaagaggaaggattttattacattaatgtattttttgaaaaatgtatgtaaatatgaaatgaaaaacactgtccaaaagtacactctacagtgtacaaagaatgctattcacaatgatttcattaatgagttctgtttctttgtacttacaattgctgggttatcattgtttatttttatatccaaacagtgaaatggaatatggagcattacaaaacttggagatgtgaactgtgccccaagcaaccacaagtgattctgaatgttatgaactaactttcaatgggattcatgtggcaaagctctgttgtgtctaggactctattgttgggagttctccaaattaacatccacatagactacagtttttactaaagtaaaagtaacatgaatgcactaattagaagttcagttatatatttcatcagtattaactgcagcaattttctctaataacaaacgatatttttataagaagaatgtttaatcaatgatgttaataatactgaaagtcacttaatcatgtctgactctgtgaccccatggactgtagctaggctcctctgtccatgaaattctataggcagaatactagaatgagtagccattcccttttccaggggatcttcccaacccagggattaaacccaggtctccttctttgcaggaagattctttaccatctgaaccaccataagattagcaacacaaaatgagtgttttttgttttttttttaagtccaatgttgaattgattttatcactgcttatggatttcccatagattttttttcccccccacagcttggacaaaccgctttacctgacccactgttggtccaccactggaaaggatgcatagtaagtacttcacattgagtgtaacaatatttaagtttcaaaacacttaaatgacattgaaattaaattaattagaagtatctaagctgtgtttggcagacattcatttcaacctgccgtaagaaggaatttattaagatactatgggaaagaaaacttttaagaatcaggagagttccaggtaatttagtctctagaacatgaattatttttgctatgtttctttatatcccatttttacatggtatgggaaaacctgtaggatcatactgttactgaaaaagcatataagctgattgtggtgaaggaaagtacagcatttattttaagggtcaagcaggaaatatgggcagctcaccccgctccagtactcttgcctggaaaatcccattgacagaggagcctggtgggctacagtccatggggtcgcaaagagtcagacaacgactgagtgacttcactttcactttcatgcattggagaaggaaatggcaacgcactccagtgttcttgcctggagaatcccagggacggcggagcctggtgggctgccgtctatggggtcacacagactcggacagactgacgcgatttagcagcagcagcagcagcagtgctccaaagaccaaactccccaatgtgtttcagagaagagtttttaaatgcagggtaaaaggaggggagtctctgggtgtgtgatcagcttatgcacaattctctgattggttgatggtgacatcactggatggagtcacaggttaacattattatgtgccaggcagtctggaaactatgtgtttaggattatcatgcagttaacttctcctatctggttccagttttatttgtaaaacaactgaaaacaatgagacactgctatctatgttctttagtgaggaactagagattccgtgactgctatatggcagatttcctgttgaaattgttactagtcctcctatcccagctgccatgtattttgtttctaacatgtgttaacattctttcagtcattaactcttgagccagcaatttgtttttaagctcaggggaggcctgggaacctagtgtttctacaaacaaaaagcagatggaggacaagaggaggagtctgtcctgggaaggccacataggattctgcttgtttacgttatttagaattgacattctctattgttgctttgctgccattctctattgttgctttgctgccattctctattgtgactgctatctttgaggttacattcctaacttctgaccaagaaatgaatgggaacaattcctaattatctccaattagaaaaacctaggaaaacaatatgatcagtctggctttctttgagtatccatttcataactatgagtagattcaaaaaaggaattgaagatctttgcttgaatatttatttttaaattataacgcattattatttatatgcatatgtgttttccattaaccttgaaactctttagaacagttgcagacaacagttagtgtaggttcacaacagtcaagtagaactctaaggctaataggaatagaatattctgtgataactaatagtgagaagttagggagaagaggaaactggtgagttgctgtattaaacatctgtagctgtattgaacaaatgaaaaatatggagaaggatatttaaagacatgaaatgaccttttgcagtgctcagagacagatatgttgggtgttgtgaatatgggctataaagtgtacaaaatggtgtaagagatgtttcctgtcttagaggcatttggggagataaggaaaatgttcaattatctagcaatataaagtttatctgactgattttaaatgaatgtgtccatcaaaaggtgtattatgttatattatgatgattattatattttgcataaacatttaaaggaagaaaattgatggtatacaagtgtgtccagtcacatagaggcaaagggcttagagtaggaaatctcaatcgacaataactggatctgaatacagaatgagataaggcccattttcatgtacaaaa

SEQ ID NO: 27021 - DNA, 749 bp, Bovine  19866880637948
cattgacagtgtttagagaagaatgtataagagagtgaaagatctcaaatgggtatcaaatagtgtcagctgtgtgtcaactctgtgtcaaataacatgtcaactgtataataatgtctagtcaagcagattttcattgccagttgatgaaagcatcttgcttgaaaaatgaagctttactgcctgaatatataatgcccataaggaagtaaaaagtcctagagcaaacattgtttttagtatttgaaacaggataatttatttcacaaacataaaaaatgttttttcaactgcatttgtgaacagagaaggactgactcatcatttggattggtcagaaactagatttcagccaacttaaaaatgtagcaagagatggtttggcattctattgacctcttcacatatgacacacagtaacaaagaaatgtcagtgaaggacttcacaaatcaaggaatgttacctgtggtgttagctataacattaagagcattagatagaacattaagaacattgctttgaataatttgagaactctgtaatcagtgtagaagacttttaatgtgtgtttctacacaaaggaatcaaactgttaagtaaattaaaaaacaaatcttactattaaatgttataacaactttattcaaacaacactagttaaatatatgatttaaatattaaaaataatgtaaaaaatttcagatatatgcaaagtgtttaatcatgtgttctgaagcttcaaggaaaa

SEQ ID NO: 27022 - DNA, 2522 bp, Bovine  19866880697688
ttccctttactaacctggtacaatgggccataaccttgagtttgtgaataagattaaaaataaaaggatgcaaaggatattgccattccaggaaagctgacttcacattccttatttttaaaaaagtgcttgcacattttcagagcattagcaaggtgactgaggtattaaattttttgttcgttactgcatgtcaagtctatgctaatggcaacacaagggcagaccataatcaaccatttaaacccagagtaaaggcataataatgcaaaaattacaatctgatcatgtacttgtttttctttgatataatctttgtttcttaagcctcgttagggccttagaaaaggtcaggattaggaggaaattgggtgaatcagtttataacatgggtagagaggctagatatatgcccttaagatagtgcaaatacaaaatgattcctatcaccatgaagtaatcttctccatgattaataatatttttggctgtaaaatcaaatttgtttgttgttattatagcttttcaagttttcttttgattattattattgaaaatgttttccctttattttagcatatttatttgcttacattttaaaattagttttcttttaggcatcatacagtttgatttaattcagttaacaacacctgactcttaattaaattgtctagaatatttgcatttactgtgataattgtttctaatatttagcattaaatctatcattattattttcattttacatcatcttccttttctgcttttttcagtattattaatatcatactagaatgttaactatatattttgttttgtgtttctgtaattatttatagttaataccatatatcttcaagggatattgtgccatttcatgtgtattttaggaacgttacaatattatcgtttcattatatctctcctggtttttgggcaaattttgttattcattttacttctacatgtattataaactaaataatacactgttaatgttttggttttcagttcagttcagtcgttcagtcatgtctgactctatgaccgcatggaccgagcaggccaggcctccctgtccatcaccaactcccagagcttaatcaaactcatgtccatcgagttggtgatgccatccaacaatctcatcctctggtgtccccttctcctcctgcccccaatccctcccagcatcagtgttttccaatgagccaactcttcgcatgaggtagccaaagtactggagtttcagctttagcatcagtccctccaatgaacacccatgactgatctcctttaggatggactggttggatctccttgcagtccaagggactctcaagagtcttctccaacaccacagttcaaaggcatcagttcttggtgctcagctttctttatagtccaagtctcacatccatacgtgactattggaaaaaccatagccttgactagacagaaatttgttaccaaagtaatatctctgctttttaatatggctatttagattggaaataaatttcattccaaggagtaagtgtgttttaatttcatggctgcagtcaccatctgcaatgatttgggagcccccaacaataaaggcagccactatttccagtttccccatcaatttgccatgaagtgatgggaccagatgccatgatcatagttttctgaatgttgagttttaagccaacattttcactctcctctttcactttcatcaagaggctcttcagttcttcttcacttcctgccataaggctggtgtcatctgcatatctgcaattgttgatatttctcccggcaatcttgatcccagcttgtgcttcttacagcccagtatttctcatgatgtactctgcatataagttaaatattcaggttaacaatatgcagccttgatgtactctttttcctatttagaaccagttgtttgttccatgtccggttttaactgtttcttcctgacctgcatacaggtttctcaagagacaggtcaggtgtctggtattcccatctctttcagaattttccacagtttattgtgatccacacagtcaaaggcttttgcatagtcaataaagcagaaatagatgtttttctggagctcttttgctttttctatgatccagtggatgttggcaatttgatctctggttcctctgcattttctgaaactagcttgtactggggtccagcccaggttggatccagggatagcttcaggatgacggcattggcaattgaaagtatagataaaaggggagagacagaggcttgatctgactagtttacttgggaaaccaataaagttcgtaacaccgagcttgttctgaccacagaggccgcaggcgccttctcgagttggtcttagaagcccaggcaggtaagtggtctcagagggcccccacactccaatcagtcatcttgaaggaagaacagagaagaaaagaagagaaaaggaagcaagaacaacatggggagaccgagcctgatgagcaaggcccgtagcttta

SEQ ID NO: 27023 - DNA, 823 bp, Bovine  19866880850458
caaaatgaccaagcataagagctctatacgtctgacagactgatgaaaggattcctatttgacattatcttttagaaaataaataaatgaagtgattacaactcttttttttttttttttttttgtaattgacctgtaagttactggcagaaaaatcaataaattccaaatgaaaaaaaataatgcaataaccacactcagctttgacctaaaaacatgtataacaatcaatatgataaagactctgtaaatgtgattttaaaaaagaaaatgtagtgcattcatgtgaaaaagtcattttgccagctaaacattctctgctaatactgaacattcatttcgcttaggttttaaatattcctatgtcctgaaaatgcatacattatattctcagtgttcaaaataataatgtgctagaatgaaagcccatctctgcaggtgattattatacatacattatctatcctgtgtgtttgtaggaaaaatatatttttcagcattagatgttataaaataacatgaatttagtagactgtttctagaaaactggaaaaaatatattgcattattaaatagtacctttaattaatgtaggcatgctataatcttgtgttctgaactatgactagcagaactataacgagcagaagacctactcacaaacttgcttgctaagttgttgaagtcatgtctgattctttgagacgctatggcctgtatcccaccagactcctctgtccatctgattctccaggcaagaatattggagtagattgccatttccttctccaggggaatcttcctcacccagggattgaaccag

SEQ ID NO: 27024 - DNA, 1385 bp, Bovine  19866881331504
tattttaatacagcttaccctttattgtccttaataattcttttggatatacttatcagctttctcagatttaatttgtttcaagtgaattaataatagtcaaaagtcaaataacaagtaatattatttctaaatgcttaaatatgcaaatttggctagtagaagccctctacattgacttattattctttcactcattccttagcatttttgacagcaggatactctcaactcttcctcattttattcatcccaaggcatggatctgggtagcatcaaaggagccttggcttcctttgctggagaatattagcagaggactgaagataggatgacgacttggtggtgggtaaatgttttgcccctggtgctgctgctgaggcaattctgagggaaagaacttgaaaaagatttcctttctggttatgagttgacattgatcttacaaatttaacttatcatattgctaccctactttttaatagtatgtggtttcattgatcaccaaagtttcctctacattgacatttggcatgtcagatgtcaggctgagttagcaacaaagacagcctagggcacaggacgtaatatgggagccagagaccacaactagaccacggggatataaatgtgatttaaactttctccctacaaacctctgtcaaatactagcccctgcttcctgcccctggcagccaccatcactttcaccttgctttcttttttctcaatagcagataaaagcattttatatgtgttatttgtttccttcactggaatctaagctctatgaagagatgatattcaattttgttcaccattaggttcccgttgcaaagagagttcttggcatattatagttccttactaagtaattgttaaacaaaattttccttataaaatccataggctgaatgacctcaccaaaagaaaatatttaaagtgaaaagaactgaaggtgaagaatgtaattaagtcatgttgtatttcaggacaagggaagaacagtccaaaacggtggctgaaaagtctcagggaaaaaaagatgggggggggtgggtggggagaaggaaacccagatacgacagacaccagacaaaaaaggaatcctaaattggattttatggccattagcaccaaatgtacatagtggtcaagaaaaggaaaaaagttcgcattatgtttggcaccacacagcagtattttaaagctggcaagaacagttatggtgcgatagtgagaatgttgccaaggattggatttacaggagtgaatggaaagtcagaccttaaatggaacccacatttggcattttctcagaaagtttggtataaaggacaggatgggattgtggggactctcaaaaatgtttacacttttcttta

SEQ ID NO: 27025 - DNA, 903 bp, Bovine  19866881586095
ctgctcgtgggagttaaacatgtagtcttggaaggaaaagacaaagtactttcattggttatataaaattcaaacagggattttattattgatattttcaaggccccactggatatcactatgctatagcaataataaagaaatatgaagacctgtggccaaaatacatggaatagctaatactttctttagaaaatctaaagaatgctttatcttctgactctaattgcaacatagccttatacaatcttgttaactagaacagtcatggctctgtcctgcaaaaactttttttcggtgattcaaatcatcacaccctcacaataaagctaaatattatttctgacaaataagttactcaacagaaaacaattcattatttttgaagcattctgatttttgttgtcttcacatgttttcatgggaaagtgaaatagattttatcaatccccactgtgcttaattgctcaatcgtgtccagctctttgggaacctctggactgtagccagacagtctcctctgtccatcagatttttcaggcaagaaaactggagtggatttccatttcttcctccaagagatcttcccgacccagggatcaaacacatgtctcccaaggtttgaacccatgtctcccatgtctcctgcattgcaggcagatttttactcactgagccatcagggaagccccactaattatatgctgtttcaaatggaaatcttactggcatctcttgatggaaacaaaagtgacttgacccaagaaaatagactagcatgtaatactgcatcgctagatgtctcttttcaaaggtgtagtttcccattgcatgttattcacaaagtagtgtagagaaaacaaaaggaactcagaattttttttattgatttcatatatgcag

SEQ ID NO: 27026 - DNA, 2173 bp, Bovine  19866880158516
accaaactcccctcccatccaggctgccatataatattgagcagagttccttgtgctatgcattaggaccttggtggttatccattttagatatagcaatatgtatatgtccctcccaaactccctgtctcttcccccattcttcccccaactccagcaaccgtaaagtctgcctcaccgactctttatattaatgtaacacactaggctttggagaactctgataacattggttccagggccccaaccataggcctaagaaccatatttaaacaaagtcaattcccaattcataaaaaatgatctcagaggccatactaaagctaccaatgacttgagccaccagtctgtcagagagcaagcccagaagttgagatgaaggaaaagacaatgactgaatttctctgactttgtaaaaatagtcaaatcatggagacatttggaaacattcataacttttttcttatttggaatgcttcaggctattgtgtagaaatggcagagatataatcctcctttgtcttctcaattagtgtttctacttattagataatcatatataagcttaaaaaattacaaccttgtttgtaaagtgaataaatgtgtttctaagatacacaggaagcagacatatgaagaaagaaagtgaatttttaaactatcttgttttcattttagacccagccatggtttacttgcttcggtcctccatagtactgatttatttttttatatttcatccttggagtttgtgattatgtgaggtaaataagacagtgattcactatttattagatcagattaatatggaagttggtgtccataagatccaggtccttaagttttgacctacattttgctcggtatttacttaattttttcacgaaagcaaaattccccttccctccaattcctccaccatgtggatggagtaatcacaagaaattttggggtccacgtgctttcagttcagttcagttcagttcagtcgctcagtcgtgtccaactctttgcgaccccatgaatcacagcacaccaggcctccctgtccatcaccaactcccggagttcacccaaactcatgtccattgagtcggtgatgccatccagccatctcatcctccgtcatccccttctcctcctgcccccaatccctcccagcatcagggtcttttccagtgagtcaactcttcacatgaggtggccaaagtattggagtttcagcctcagcatcagtccttccaatgaacaccttagcagggtataattattgttcaaatgaattggatttttaaaatggcttcagaaaaagaaaagtagaaaacgtgtctctcaacatcacaatccctatctaggatgcattttcacatctctaacatgaagagtttagactagatgaggactattcatctttccttccagttctaaaggtctatgcttccattgttcccaacagaccttgtgaacctgccagaacaaaacccagcaagctccaactgcagcctctgagagaaacaaagaggctcctcttcatttcttgggctcagaaactatttctcctcagaatctcatttcagtggctgcaaaattgagacctgccactttcattccaaccaggatcacatgaattaaagtcagagagaatccaggcattcttactcaggatacacacgtgaaaatatagttaaaaactaaagcttgaaaatatactgatagaaaaaaaaagttaccatgacaaaatgatttttaagaagggtagaggtacatttcttataaagagagcactgttggaaggtaacctttagaaaatggtataaaattaaaaattaaaaataaattaatgaagaactcatcaaatatccattggtcactaagtacattcatagaaaaagactaaacctccaaagacagcattcaaagaaggcttttgcagtttcaaaagatgtttatctctgccctgattcaactaataaaatacttcctgaagcttttttaaggaagaaagtctactagtggattagactctaatgtcccaagagaatctttggcatagaaataatttacaatgcccatattactagaagagcaagtgataaatgggagagaaaacagtttgaaaatatttagaaataaatattttgtgtctccgaaaatagcacacacaaaaggagaa

SEQ ID NO: 27027 - DNA, 1574 bp, Bovine  19866880414586
ccctaatgcccccaggcctctacgggaggacgatgccttttattgggacagttattcgagtgcttcgtagggacacagtcacacctgttttcacattgtctatgggcagcgtctacctgcaaaggtggccttgataggtgtggcagagaccacgcagcccgtgactctaaaacacctactcgctgctgctttataaaaatctgcctcacgtgccttttgatggccaagtcgaagatctctcttggtaaatgtcacactgcacttgaaaatacgtgttgttgttcggtcactgagtcgtctctgactctttgtgcccccatggactgcagcacagcaggcatccctgtccctcaccatctcctggaatttgctcaaactcatgcccattgagccactgaggccattcaaccacctcatcctctgtcgcccccttctcctcctgccctcagtttcccccagcaaatatgtgggttgtttccaaatatcttttgacgttggtttctaacgtaatccaagtggtaagagaacagactctgtgacgtcagcacctgcagaccacgagactttggcaccttgttttatgtgccaggatgtattccagtgtctcctggttcacagtctatggaacttgaatcgaattggtaccctgttgctgtgtgaaaattatgtaaatcttaattatgttgaattggttcacagtgctgttcggatctactctttctacttctttgtatatttattctactaatttttgatattgaaactccaaataaaaaatcttaatttatccacttagaaaataattgtaatatatagtggaactatatgtaaccttgttctgtattttctgagtctcctgtaaatgtgttatcatattttcataatttaaaaaatttttaaaaagggaaaaaaagaaagtcactcctgcttgatcctcaccagggatgggagaggctcagctgccgataaaggtctatcaatcttcagagggttacaggcaccacatttattcaagagcaaatatggatcgttaggcaaagctgaccataagttagaacaatagtctcttaattgtgctattgatattcatcactgtaataaaattgtctaattgaaaaagtccatattgacaaaccaaaaagaagtgcattgatttaatagtagttttgaattattaactctacaaatttttattccatggagctgtcacattttttatcaggcaggtcatctcttaaagggggccaaaggtttatcctggaaaattcctgagactggaagataaggaagttttgtggatcccaagaaaagctgttctgttttttgtatgcactggagtgtgtgtgtgtgtgtgtgtgtgtgtgtgtccacagactgatttccttagatgatctgagccaaagagatgggaatgtcaagtttgctcggtcagtcctgtggactgagatcacttatgggcaagaaaggatggggagtcagtgtattaatacaagctcacatacctggtggccctgacctctgtaaggacagcccagtttagggatgggcaagggcattgtggtgattatccatag

SEQ ID NO: 27028 - DNA, 1802 bp, Bovine  19866880535049
gaacacaaaaataactacactaaaactcaaatacctatttcaatccaaggagtctataaacttctgtggatgtttacatgaagacgaccttctttgtcccatgctttttcaatgctgttaaaaaaacaaaatgtactcattaggttgtgcattatttattgatgctcagacggctcctccttgaatttcatagaagacttcggttggcccacttcctaaataaaaaggtcagagctagagacatacattttaatgcctcatactgagaactgttctaaccctgggtttctgcgagcttacctctcaacaacaacaacaaaatctattaattttagctttctggtacttcagagagcccaattttgaaaaagaatcacaggtgctccattattttctatccacagcctcagagatcccaacttagtggtcagtttgagatcttttctaattagcagtgtggagaagccgagagttccactggacattggaaccaccagacctgtctatggtctttcagctttagagtcaaggacaaaaattcagaaactttgtatgcttagatagaattctcattacaagataactaaatgggggcatccttgtcctcagacactcctcaacacaaaggtagtagaggggaaaaatggaagatcagatagggtagttccatctctcagcaacaatattaccacccatcttactgggttaagatgtgtaaataaaatcatgcttgtaaagcgcttaatagagtcgcagagacacttgattaactagaagtaatagtataatatattattattatcattaccactactactatattccatatcataatagctgaaaagaaaatttaaaaaattctttttcttacaaagaaaagcttagctatgataaggaagcatcttaaggtcagatgaaaaattttcctcatgtgtgtggtacagattcaattagaattgttcagattctgtttttattaaggtactaatacactggagaatgctgaaatcctgttcaggtagttgcataacgtaacttccattgagaagacagtcattggaagacaaatgtagtcaggctagttgatattgagccattctggatacaaagttaggtagaagcagacctccttaaatagtaacataagggacttccctggcagtccagtggttaagacttcctatttctactgcagggagtatggggaacctgcaagctacttgacaaaaaaattaaaataaattactttcacctcacttaggagaaatacagagctagtccagtgttggaatggataccacagagttactacgggcccattatccttccaggactccggtcctccaagcttatactgcaagccttattttcattgtacaagattgctgctggagccttcacaactcattctaaataatgagattttgaaaaggaaagagaaaggcactttcccctgtttagggaaatgagttttctactttcataatttttcccctaggttttactagccacacattcatccttaacggcaaggaagactgggaaacatagtctttactctgaaataaaagatcattttactatggaaaaaggggatattaatgagttaaagaagttaaaattcccagtcacactaaattcattcttctctgaatattttctctctctttcccttttcattcctggttttccttcttttatttctgaatgatcattctacttttctgtctatattctgtatttcaactttatccatttcaaaggcttgaattgtcgagtttgaggctagggaaggtgttaaa

SEQ ID NO: 27029 - DNA, 1641 bp, Bovine  19866880553292
ctaacagtgaatagcagcttagtgtgcgcgcgcgcgcgcgtgtgtgtgtgtttagtactaacagtgcttgaaggcctacatctctttgctactgttgggaatctcttatattcttctttctaaatgagaaaaaaatatatatataataaattgttggtatttctttatctgagacaatgatgaatagataagcaaccttctatgtattaatattatatattctttagtgttattatgtccaattagaaatactcatttaaacttagagtagcatcatgagatctctgaaagcaacttcttaattattttatgtgttaatactaataagattcttgaaataacttctttaaataagtaaccatctagattgcacatttattcctgagtatattcaagggtgcattgatctgggtaaggtctcaataatttaatttggttcctttctgtgttaacattccatagtagtagctgtattttagaaactcagactaaaagatctgtttttaatatcttaatttttagaggcatacatatttatgattataagattatctgttataatactttgtatagtatagtttaaattaaatatgtaggaactttgaactactagaaaagatagttcctcccagaggtatccttacaaaaagtggaaaaatagcatgagtctcaacttggcaaaacatgaaaaacagtatctctgagtcacaagatgagtcaaaagggtgaggtttgtttgcttttccttgttcatctgttttaaagggagtgtgattccaagtagctgaaaaaaatcttcgatgaaagatggtgccaaaagttggaattctttatatttagaagtacatatctgaaacattcagtggtgttgccaggatggatttgatctgtgcctaactgttaggagattggtaataactgtaaatgaaaagtaacctttaaaaatatttaacttttattaatttttttcttaaaatttaattaaaaatttaaaagtgctgggttttatttgttcatacttgcgaagaatgatctttagacgaatattcaagaagctggcagcattggagggagactttgaatattgaactgtattcaaaccttgttcagattttgaaccatgaactgttagaaataaactaaattaaaatttgaaaagagaaatgaaaatcagagtgcctagtgtacatagcagagattgatttagtccacctgatatgaaccacctgactttcatgatcagcttagcattgtcaatcctgtaatatcttggtactcagcatacagttggttgtatgttatggcgggtgcagacaagcaaagaggtaacgagaaaaatttcatgatatattttctttgttataagaagttagtccatagtatgttcatctctaaattaaattgaaaattaaactattggataactgctgaattttttctggtagttatactatcatttggtaaatcgtgctgctcctttttgtttgtttttagttgatgcagatgaaattaaaaggctaggaaagagatttaagaagctcgatttggacaattctggttctttgagtgtggaagagttcatgtctctacctgagttacaacagaatcccttagtacagcgagtaatagatatattcgaca

SEQ ID NO: 27030 - DNA, 1029 bp, Bovine  19866880562712
gtttataccctactttgtaccccttatttcgtttaagtgtgtgtgtgtgtgtgtgtgtgtttcccttgaggctaggaggtaaggttgaatcaagggaggtgaggagaggatgaagatgaagtaaacaggaaatcttaacagctaatctgccacgttaagtgatctctcctggcatctcctgttctacttatgattggactcaagcccagtctctctggctacttctcggcatagctcgcctcctactcctaaattcaagtgctcagctatatcaagctgctgagttgtaactttgcccctcgaccatctggaagggctatttttatacaagttgtagccacgtctctctacttccaagcatcggatggctacccagaagcttgaggaactaggccacccttccaatcaccatgatgacggagacactttggaacaggtggaagagtagaaacgccttgaatttctcttttgtgacaccttgcttattgagaagtcacttatccagccatctaaaccatccagaatcccagttgaggacagaaaacatgcccaaaagtgaagatctccatcacaggtgtcacaaagtccaatcactaaaggcttaggtcttctctcaagacctcatgactcatattttaaagacagttctagcttaaagggtgacctggtctctggctcttagaaaattgggagcagaataactaaaggaaagacggcaatttgtaggtttatatactgaaaataattttttcacagagagaggacaaagagaaaaaatattgaaagaaggtaagtcaaaaagcataatagatagggacatagttctgaattaaacaatagtttctgtggatatcaataaaaattgatatacataatcatgactgatttatttaggacggtgatccattatcttcagaaatgttacatcgtgacccagtgttttttaagagttcagtctggagccaagatgccttgattcataacctgactcagcctcttattaactgtggatcttaggcaagtcactta

SEQ ID NO: 27031 - DNA, 2518 bp, Bovine  19866880586605
ttttaaaggcacagttgggataaggattacaaggggaatgacttaatcctgattggttgatagtgaggtaataggatgatatttggggaatcttattccaaccaacctggggtctatgtgcttgtggtcagcttggggtcaccaccctcctcctggatggggtatcttagttcttgcagaacatctcaaagatatgtgtcagactgttccatatatcccttgaggatgaactaagatgctgaaatattattttcttgactgcttttactttatttctgcgttctctcacttctgcatattcagcccccctccatggcccatgtaagccaaccaaaacccaagcctgcaaatgtctcaaggtaatgaaatcaaaatctaaggaccatccatcacaagctgtagccaatcaaaaggctcctttctttgcttctgcaccttctctatataaggtgaaatggaatatttcctgctgtatcagtaaacataggatgtcacagtcatccgccattgcagccttccaatgtgagccagtgagccctgagaaaactcggggctgaaaagaatacctgccatctagtagccaccagactgcggccactccctgcaaacccctaaggtaagtcctgaggaaactcaggaggtgaaaacacaggattctggccccagatagctgatgtgcatatcaacggaatgatttcagtaatcccagactcctgcatcttcccatatatagaaaagtgctaaattccttaacctgacatatctgatttcttaagttaatattttgacattcctgactacctgccctttgttgcaaaactcctttatatcctagctcctcgccttgcctaccctgagcagtttctcagtgctatctgaggtgctgtctccagggctgcagtcttcattttgccccaaataaaacaactcacaactctacaactctaacgttgtgcaattttttttttttttttaatcaacaaaggctttccctggctcctgctgttggagtgctcgtacccatttccagtttggtgctgcccaagccaaattgacttttgctcaaataaactaaaatttttcatatgactcagtttatctcttaactgcaaagacctgactgtgctgcacagagtaagttcacaatcaatcaaaaacaagtaacacagtatttcttctataccaggcattgttatcttcttggggaaaacaaaggtgaagagtatttttgtctttgtatcactttgagtgacctgggaagacaatagccatataagcaaggataatgctagctgtggtcagtggaagaagcaactctcagtgcacagagccctcttccctccttctgaatttgagaacaaggtggagggtgaccctctctggaataaaagccaagagggacagggcctgctatctgcagaagaaatccacttagctctgtctcatttggctgttacgtttgcctttgaaccataaccccttccagctactctttaccacacacacacacacacacacacacacacacacatccttttttctgcctccttctacttctttccacttgttttctcatttcttctccttcctgagcctctctccatcctttcctttccactgagcttttctatagaaataggcctctaatgtgacaccctggtgtcccgcagaaagtgtgcattgaggggtgagcagggggtgggaggcatcaagattgggttctttaaataacacttaatgaacgataaacacaatccagcccagccaaactggtacttagctcctaagtacctagtcaatggcccatctgtcatattgttaagacctttagaagctgtttaacaaaatgttaaatgagatgacattcagcaggcagcaaaatgcttgactgcctaatgcaaccccaaagagccagcctgatggcagtgtctgatataatgctctgtatacccctcccaagaactcaggagcagaaggtctccctgcctgtcacttcctatcttgctaaagtgagcctggggtgggaaggacatgattaccattgccaaggaggccccagccagctgatgagatgcttttctgaagaagcatgactgagagggggcacctggaaataaagccagtagagagaaaaaaaacaataattcatccgcagtttcattctctccccttcttcgtcgccagtggaccctacctctctctgttggccttgggggagaaggcaggggtgataatgagacacgactttttctaagagctgaaatatgaagccaattactaaggggaagatttccagcaaattggctcctgatagctcacatttatctgctttagatttgcatagtcgggaggaaagactaggctttggtccaggtaacaaagacggcatctcttccgcaggaggtgaatgactgattcaacttaaaaccttcaacccttgtatccagagttcaaccattaaaggcaataacaaacaaatcacaaatctcacaaagaatgtttaaagggaaaaggagga

SEQ ID NO: 27032 - DNA, 1406 bp, Bovine  19866880665510
ttggagaagactcttgagagtcccttggactgcaaggagatccaactagtcctcctaaaggaaatcagtcttgaatactcattggaaggactgatgctaaagctgaaactccaatactgtggccacctgatgtgaagaactgattcatttgaaaagaccctgacgctgggaaagattgagggcaggaggagaaggggatgatagaggatgagatggttagatggcatcaccaactcaatggacaggagtttgagtaagctccgggagttggtgatggacagggaagcctggcgtgctgcagtccatggggtcacaaagagctggacacgactgagagactgaactgaagtgcataactgtaggatccaaagaatgaagcagggagtccaagttgccagcagtggaagttcagatatagagtcaaattctggatatattctgaaagtagatccatcaagattttgctgagtgtaggataaagtgggaggtcaagaataatgtcaagttgtttagcctgatcaggagaggaagatttgcgggggaacaaaaaaggcaaatagaattcagtcccaaacatgtaaagttcgagatgtctatcattcaagtggagatgttgaatagacaattgcatatgtaaatctggaatttagagaagaggtcaaggcttgagttaaaattttagaattattgttaaaacaacaacaaaaaacagattacatgaagcaaatgaatgtaaatagtaaaataaagaccaaggactctgctttagggtactcagcattaagagctcatgaaaaaactaaacacccagcaatggacactgggagtaaggtagaaaaagccacaagatattctaatttcctagaagaaaaatgaagtgtctgaaggaggtaggagtgacttgtttcaaacaagcagaaagttcaagaagaatgagggttgagaattgatgacaggatttagaggagtgatcacagacgctcttgaccacagcagttgcaatggagaggtgataaggagagcctgacttgaaagactttcaaaggaggaaaagcattggtgacacaggtatagacaacacacggggaattttgctgtgacagggagaagagaaacggagtagtgaagctgcagggaaaagtggaattggtgggaagatttgtttttaggatggaagaaatatttatatggtgatgggaatggttcaatatataggaaaaaaaggatgaaatgggagcaaaagggaagaataaccagtgtgaaatccacgagaatgtataagaggtgcctgaaaatggggggttggctttaaataggaacacagacaattcatctgcaatatctggaaagacaacagagaatatgggaatagctgggggataggtagacacaggtgagagtctggg

SEQ ID NO: 27033 - DNA, 3814 bp, Bovine  19866880751847
tagttctagtgttagaatggtcgaaagctatatttagttggttgtactgctgagatctctgcagggctttctcctttttttatatcagtattggtctaaaattgattcagatttggtttggtagtgtaggagctgaacaacccaggcaaatagccaagaagtttctcatacttggaaaagtgaaaggcagactactcagatttgtaaagaaaatctggggcatattatttgcagattctaggagtgaagagaattcttgaaaagggattatgatgattaattttttttaaagatatgactgcttttttggtttcaaatgttctttgagtgatattctcattttttaagtgaaacttgatgttaattcatattgaattggcagttttaaaatccatggctcatttgataaaaaagctattctgtctgtagcagctctatggttgagtagcagaaacccaaggttttctagggagtgacagtataatacattgttacttggagagaaggaaatagagttggaaaaagaacagtgtacccatgatgatgagctttctgcttgccagcagtgaaggaaaaaattgatgccagcaaccttaaactattgttattacagggaacaggatgcttctcctgcagttgcaaactagtgcttcagaaggctacactgatttgattggatagtatgtgctaaaaacagaaagatgtaaaatatcataaatgatcacaaaagcagctatggaaaatcctacagagttgagaggtgatgttaatatagcaatttatatcttttgaaattggtaagtaagaatcttctttctgtgaacaaaaaaattctatctgtaaaggtagaaatgtaggaaatataggcttttccttccttagcaatggaagagtttgtttcattaaactctccatgagggtcctcaaggaagctgaacagaagtaggcctctgatgtaggtgaagaatgaaggacactaataaatggaatattcctgaccctacacatctacttgaactaaaaggagatcaaaccagttaaccctaaaggaaatcaaaaaataaaatcaaccctgaatatccattggaaggactgatgctgaagctgaagctccaacactttggccacctgatgcaaagagccaactcattagaaaagaccctgatgctgggaaagactgaaggcaaaaggagaaaagggcggcagaggatgagatatttaagagagcatcaccaactcaatggacatgaatttgagcaaactctgggagacagtaaaggacagggaagcctgatgtgctgcagtccatggggtcacaaagagtcggacatgacttagtgactgaacaacaagagtatcattcattcacagtaactgcagagactctccctgtcagttaaactgaccccaccttcgaactccaaacacaacttattattttctgcctcaatgtccttgaccaacctattactcaatttgtctgggatgtcctatacccacctacccaaagctaagaaacaaagataattgaaatcctaccaccttaaagaccaactttatttaaaattcccttactaagttaccctgataaatccaaacaaaaagtactccatctcttttctccaagattgtagagcatctcaccacaagcattagtggtgagatgctagttttcatgtatctctgtagttctgttcacttggaagtcatataataaatgaataaatgcgtgcataagtaaatgaatcattacataaatgagcttaagatctgggtaatgttaaactttaaggatttgggaaataataaaaacacatatgttagaattttatgtcagatatcactaagaaatatagtgagacttataaaattttaaatacctcagagagtttaatttataggttctataataagaagagatatcctgactatacctgccacatgacaactcttgaaagtacattaaatatataaggctaaactgttatattaaaatatcctatttttttaaaaagtattttcaatgaaataaaaatttttcttaaaaacagttaaatgttctaaaaatatgttcttcattcagaagctgcttcaatgataattcaaagagatttttcgaagaaaattcagatacttttcaacatgccatatgatgtatattgacagttttcaggtaaaaggttcctagttctacaaagataaatctgtcaaatgctctttcatgggaaaatgctaaaatttgtcaataaaatagagttttaatcaaatgttattatattattgttcaaaataatatttttgaacttttgaaagttaacttaacaaccataaatgccatagcttcagatacagcctcagtaaggaaagtataacatataacctccataccatattaactgagataaagtaatcatatttgtgtctggagtattaaaacactaaagtgtgttttaataagaaaacagtaaatagaattcccttgtggtgaaattaattattttaatcacttggttttatcacttggttacaagttggctgtgtttatacatatacaaacgcatgtgggcataacctggatatacagttaattccctcactctgtgggcagaaatactgatgcatccagaaatttaggatgctgaattggccactgagttatataaatgatataaagaagccagagtttattaaagggaaaaaatattagagttcagaagcaaaggaaacagaaggcagaacaggttgatgtaagcaggactgatggtcattcgatagttgtttctttggtgtttgtcccctacttctcttcccctaaaacaatagtttctattgaggatctctgtggttttgaagaaagagactctactttggttccaagggtagaacaaactaattagtggtcacagtgattcattcaagaataacaatgtgatttaaaccagtttttttttaaaaagttagtttcatgacttttcctaatagcaagaatcaaagccgttttctctctctccttaggtgtaaacatggatgcttatcatcccagctgaataaggatgcatatagttccttgctggggagagcagccagtcttaggataaaaatcactcctctaaggacagtatgatggaaggaaagtgggttattggtgacattattgacattattaatgagctgaagcaacaaatcttgtctaatctagccctatttctggacttttcagtaaaagaagtcaatatgctctctttatcattcaggccagtttgagattttgttttaagatacctgcaaacaaaagaattgtttaacagatacaaagaaaaatatatatacactgttagacaatgattgcagaaaaaatctatataaaaatttatcatttttaaatttaagaaaatcattaaaatcaataattcaacaaattcacagaagcagagattttaaaatactattaaaataagtggcaactgtctctaggtttaacaagagaatccatcttaaggtttcattttgagtttcctgaagtaaaatcacttacctggaaatgtactatgtctatattctatcttgtgctggggattcttcctaaaaagaaagaaagaaacgaaagaaagcaaatataaggtcaggtttgacaatcactaaaaatgaataagactatttaaattaaactagagcactcactaaactacaaattagcaataagcctcttattgaaaaacatttgctttgttactgccgttaactacagtcaccatgctgtacaaagcatctgctttttaatcacatttactgaggccattccatgccaggtata

SEQ ID NO: 27034 - DNA, 2899 bp, Bovine  19866880755469
cctcgtgaagccctcctcagtcctggcctccgcctcctcttgaacccagagtggcctttccaaagcacgggaaatgtcactcctctcttcagttcagtcagttcagttcagtcactcagttgtgtccgactctttgtgaccccatggactgcagcacgccaggcctccctgtccatcaccaactcctggaatttactcaaactcatgtccattgagtcagtgatgccatccaaccatctcatcctctgccatccccttctcctcctgccttcaatctttcccagaatcagggtcttttcaaatgagtcagttctttgcatcaggtggccaaaggtggtgtctcttcaggcccccactatggctgctataggaggacctctccagtgtttatccccaacccgagaaacacaagggtctgtatgcacaacaagggcttgaatggcagcgatgctcagctcaaggatttaccttcatctggatttggctctgcaggcagaccctccactgagactcactgggcaggacttccggatcctccactagcttcctggtctctgtcacaaatctatcttggtctccaaccaagtttgtctgaactttccccaaggaccctctcaaacctctgtgaccctgctcttcaccttaacacccttcttctgcttctgcctgatgaagctccatgcccccctcaccccaggggaaaggcttcccttcctttaataaccctgtttagaaggaacaatctgtctcttgagcctttaattcctctgccttgacctgtaatccatggttgacggcagtctccttactagattctaaaacccttgaagacaggcttcctagcatataagactttgcatcttaggcccttgcctaagacagagggcccataaccaatgaactgagtttctgaacctctggcccttaggggtgggagtaggactaataattggtaagttggcagggtctgtgctggaaccttcagctgggccagaaagtctcgaaagtgccccacaacaatggcttcttccaggtacacagcagcctgctgccaggagggattaaagaaaggtctgttgacaatgcccaggagtgccaggtctcctggcaccctctttagctgtcccatccctaaatagcttgacagtgttatcagagaagaaaggtgctttctgagaaaggcaggcccctaggtgctcgtggcattttgtaatgaggacagcactctgggatccctgtgaccagggggccaccttgggatctgggggacaggaattcacggaattcactcattttagagtgagtcctcgtgcttggaaagtgggtatggcaacccactccagtgttcttgcctggataatcccatggacagaggagcctggtgggctacaatccatagggtcaaaaagagtcagacacaactgaagcaacttagcatgcataccctgttccaagggtatgaccttgggcaagtcattaaacttccccgaatctttagttcattttggagaaattgagagcaagaataagagatatctgtggttccttggagatgtctgtgtttcctcggagttgtctcactctataatacatgagtaaatacaacagttgctcttctcaatgtgttcagatctttggttaaaattaggaacattcttattctctctctttcccccttctcctccctctcagcatgttagtgaccctcatagagagaagcattttatggcatacaatctaaatatcaatacataacccaacaactagctgcctggtcactagcatcgctcctactttcctctaaacataagacaaaattaaacttctcttgttccattttgacaataataacccctggctgacctgcaccatgagctctgtgttacaatcaaggctattttacctgcacactgaccagaattctccattatggggtcatagggcagagtgcagtggagagtcagacagctccacaatgcccacgtgacccggcccccaactggcatggccccactctgcaaaccttagttaatttcagagctgcctcctcccaggtttgacgggagctggggagaacaattacagaaatgattagcatgcaaatgggaccggcaggctatgggcaagaactctctcagtaaggactgcagaggccaactgctctctgagcaaatcatcctactctaaactgaagaaaagtcactggcttttttgtcaatgggaaatgagtttatctcactattttaaatgcattattcctaaatattttaatcaagcaataagaactggagactcaaaatataacaagatgaaagtttgaatactactttgtctaaaagacacagtggaacttctgtttaatttattcatttcgtctcaatcattttcttccttgcacttatgggtgtccttgcatgcctcagccatgaggccatggacaggtgctagttcgtaccaacatttttcccagttcagggcacattttaaaaaataaggacactgtaatcaattctttataaggctaaatttattcaagttaaaggagagtgctattatgtttgtcctacttttgatattaagaagttctttctttagtgaaatgactgtgattctaaattaaagttcattttttcagtttgctttttttttgtaaatatccttaccagaaaaattaactattaactgccaaatttgtgtgatgcctgttttgctcggtaataaaatcccagtgcctgagatcctctggtttaggtatcagcagagacattatccagctcttaccagggccaggaaggccatggtgcatataaaaggactcagcatggaggtgctttgatcctccgcttctctgtgctcccttagtggaaaaaatggttcacctaatcccaagtaagggctt

SEQ ID NO: 27035 - DNA, 2317 bp, Bovine  19866880825695
acctgagagctcacttatatcagtacttgattataatttgtcttgaattattctttgattctttcttgttctttcatgtaagaaaatctaatcaaatgaaatatatcaaagtactatcaataaaagcagcaagctctagctgggaagtgtcacttgatcagctcttattttggtgtcgcatccttgctctttctcttcataagcttgaccttgtggagcactacctgaaaaccatttcatggactttagttctaaatggcagaattgttctctctttctcagacagcattaaattatgtaaagagttaaaaactaaaaatgtataaaaactaaaattaataagtgtgtaagtgagtagtgatggttcataaatctcaacaaatctctaaaaggcagaaaacattttgagacttggctagtaaaacagagtgaataaagtttagcatactaacgtgtacttggattttagtaaaaggaaaacatccattgccccccaaaattatagggaggctctgtccttgaaggtagcattcatgtcagtaggactgaaaatggaagacaaattggagctccatgcaactgttgatatcactcctgctatcttccctgtgcaactcagaatagccccttttctcaagatgaacattctctaaagaaactgaatacagtctttggaagaggattgatgttaggattactgccctaggtcaaagttctcttcattatggaattgaggagtctccagatgtaatggcaggttccccactggttcaagtaaagcaaaacctgctggttgataagccaaagcttattcacagatctggtcagctgttctactgtttccttcttaaacatgaaaagatacttgatgattatcaaagtcttgagcaaagccagtaacttgaaagggaatggctaagagaaacaacaagaaatagaaataactcaagagacagaggagaacttaaaaaattagcttcttcacagggatttgagaaactttggtattcataaaacaaaagagaatgttataaaaaggaaaaaagagataaaataagaaagagcttgtgaaacataagtgatgattgccaacaaaataaactatatatatataaagatatatatatatatagatgtaaagattgggagggggaatgaaggaaatctctaagaacttaagagtataaaaatgaaaaagagaaagaaagaaagggaggagagaaagaaataattagaaagagaatgaaaacttaggaggattaatacaggaatagtatcctctgaataatacactggctttaataggggcttctgaatttacagaggaaaccagagaagagaaaattattaagtaaataagaaaagaaaattacccagaacaggagaaagatacaagtcttcagattaaaatgaccttctaagcattgagtataataaattaaaaaagatcctcaccaagacaaataatcatacaattctgttttattggaaataaagacagggtcttaaaagtttcctgagacaaaagcaggcaatttagaaaggaacaagggtcagtgtcttagtttgttcatgctaagtcacttgagctgtgtctgactctttgcgaccctgtggactgtagcccaccaggttcctctgtccatgggattttccaggcaagaacactggagcacgttgatgtgccctcctccagggaatcttctcaacccagggattgaactcatgtctcttatgtctacctgcgttggcagggtggttctttaccactagtgccactggggaagcccattgttgatgctactataacaaaatgcaagaaactagggtggcttataaaaacaaacatttatttctcacagttatagaggctggaagcccaagatcaaggggctggtatggtcacatttggtgagactctcttccagggtcatagttggcccctactcattgtatttccaaagtggtggtagggggctaaatgcactaattctattcattagggctccaaccctcatgactgaagcaactcccaaagtctccacctccaaagaatatcacattgggcattctaatttcaatatatgaatttgagggagacacaaacatttcagttcagttcagttcagttcagtcgctcagtcgtgtccgactctttgcgaccccatgaatcgcagcacgccaggcctccctgtccatcatcaactcacggagttcactcaaatttacatccattgagtcagtgatgccatccagccatctcatcctctgtcgtccccttctcctcctgcccccaatccctcccagcatcagagtc

SEQ ID NO: 27036 - DNA, 1062 bp, Bovine  19866880959972
tcaatgggattcagaacaattccttttaagccacagaatgggacaatttcacaaggacatagttcaggctgttgagacaaggaaaggagtttggagcaggttactttggttctcttcagcctccccacattccttactttggcccctgagaaaaagtgcaacattcagaatcttcagtggaatggaaataaactgagttggtgcctgtttgtctctatagcaatctaaccttacctaaatgagtgggtgtgtggtttggattcctttgttttcttcccctggttcctttatctctattccaacccagtgctcactctgggcaggtgcctaatgggccagcttaggttacacgatggttttaaatttggcctggtttgtgtgtaatgtctttcaaaggcttaggatgaagcttggattctggacgccatggatgtttgcagggacacactgactcatgaaggaaaagctgagtttcagcagaaaagggagacctcagcctagcaacatcaccccagaggaattcccaagagtgtggctcaaggcttcaaccagccagatggagatcaccatgggggtcatggatgagaatgccaccaatacgtcaaccaactatttccctctgcttgaccccctcggagcccaagctgcttctttccccttcaacttcagctacggtgactatgatatgcccttggatgaagatgaggatgtgaccaattcccggaccttctttgccgccaagattgtcattggcatggcgctggtgggtattatgctggtctgtggtatcggcaacttcatcttcatcgctgccctggcccgctacaagaagctacgcaacctcaccaatctgctcatcgccaacctggccatctctgatttcctagtggccattgtctgctgccccttcgagatggactactacgtggtgcgccagctctcctgggagcacggccacgtgctgtgcgcctctgtcaactacctgcgcacggtctctctctacgtctccaccaatgccctgctggccatcgccatcgacaggtgagtgggggtggggaccac

SEQ ID NO: 27037 - DNA, 2625 bp, Bovine  19866881516974
ctatttcactccatgttaataaacaattttgtgtttttttttcctctaacaatacatgcaaaatctcctttgaagttatggaagggactgtgtgtgtgtgtccttgccatttttatttttcttaaagttccgataggctggcctgggctgggattggatagagaacttcagagagaaagagtagaaaccactgtctcttgaagtttgcctgctggcctcctagcaattgccttcttgttggaggtgcagtcaagctgtgtggggacttggagcactgtgaagggacgcagatttgttgttatactgtgtaatgacgttgtttgtaattaacacaaacattccatttaagacgtcatgaaggaaagagggagagttttcagaatgagccttctctttctttctttaaattcttttctattatgggttattgcaagatagagttccttgtgctatacagtatgtccttattagtgatctattttacatacagcagtgtgtgtatgttatcctactttatccctcctcctttcctctttggtaaccaaaagtttgttttctatgtttatgtttctattttgtaaataagttcatttgtttcatattttagattccatatacaagtaatatcatgtggatatttgtctttgtctgacttttttttttcgaaaaagcatatttatttacaaagaaatatgagtatactaaggagcaaaggaaataaaaaggtgggtgtatatatttacacagcaaatggaggcaaaacttatcaagaagtttctttaaatacttctacaatataacatttaatggtgaaatcagcttctaaaaataattctttatcacttcaagaagctttattaggaggttcaatttatgattcacagtattactatcttagtgaaaaaattgtagttttatattctttggaaatctccaagttgctggaggccaagtaaaccagattagtaccagtttttaaaagattcaaaggttcttaaattcagaagtcataattgctttaagaaattgtttcttacaacccaaatgtactatcatcagctgagcagcataatacagacttagtatgataaggtccatccatgcccttcttctgaagtctttatagaactgaagagtccagggaggacacagactgcagaggaagggcatattgagggttttcactgggaggggggagcggggcagagtgagcagtggtttagcccagggcacaagcagacttgtaaagctgagttctgcttctgagtgggctagagtaggtcatggtacaccaactcacttactgacaaagagcagaaaaaactggataaataacaaaagttatacttttaatggcatcagagagttgaggaagctacaaggatcaatggactaaaattgcagaaaggggagaactgtctggaggtgagtggataactggctgccccatgtgttcctgggtcattttctgatcctgggctgagctccatgccagggagggagcaacgaaactcagtggccctgtgggctgccctgctcaaagcaggggttttaggagtctcgaactcacggctaccgaaagcttttctgaatctgaggcagtgggagtgataaataagtcaggtgacatgttctaaaagacagaatgaaatatcctatggtctggaggtcctgaagaaactaaaatggccaagtggaaatgaacggaaaacaaaaaagccacagatgaaagctatagggagaggaatatgctgacactccataggtccttttaacccagggtcacttattaattctggaagctactagagcctgcgagtcaagacttgtccctaagtctgctgctggagagcaatgagaaattggaggggggtgggtgatacaactgaagaccagaggaacctcacaaggacggctgggcgctctctgaggaaatgtactaaactttgaatttgtacactatgagatggtacaaagctaagcggcaaagctgtgaagggcagagttgaatctcctttggtctctgggcttgatagatgggctccaggttggggatttacagcaagcttcccgtttgcacttggaaatagaaataacaacacaaacagtaaatagccaatctttgtctcctaaggacactttaggataacagtcgtggcaaaaacagagaggggctaaaccttatttgagtaaaagatcaagaggtcatatatttcccatccttggggaaagggagacagtgcacatgtacataaaggctccttgaggtcaaaagtgggggacaccaccccagaatatgtgatgccaaggccaccccataagcctctggactggagtccatcttggaaaactttgcacacgtgtatccagaaggatcctagggtaggtcaggtgtggaaaaagacaccagataattggccacaggtaaataaaggcctggcagaactgccctacatgaattatttagccacctctttaccatgcttctcattagggaggatgcccacacccttcctctctgggtgtgcatctctgcctggcttcgggtcaacgagaagtttctctgtgtgcttgctcacttgttgttgtcttgtgtttctaataataaactttgtagctggtttt

SEQ ID NO: 27038 - DNA, 2860 bp, Bovine  19866881539194
tttactttgtcaattaatgggaatacaccaggtaatagtcatgagctcttgggggatattctcgaggctgtttccaaatatcctttatggcagcatatggtcgtatcctccacttcatcaccaggtcaatctgcagttgctctatggtatgttcttcatgcaccaatgcaatttccaagctccatcacatttgttttttccccccatggtgcttgaaagttgcttaagccgctgattattgccttgccatgagcgctgatcactcttctggatagtaggcattcagatgtcatctttaatttgcgatattaatattgaactccatcaccgttcagtggttttagtgaagtatttacatatagactagcaaagcgtttgagcagtgcattgaaaactgtcctttcctaattggaaccgtaaagtttaccacagcatctgcatgacatggatatgatttctggttataaagcagccttggaggtttgccttcaaaaacaaatgagatgtgtttttctcagctctgtatttcctcacccattcagaccattaatgattggtggtgacagtgctcagggaactgttttttataacctcacacacttttaagaaggattaactgtctcaatgagtattttttttaaaactggaatcacatttaaaattaatgaactaattagttaagaaatgtattactttattatggaaagagaaaccctgcactataatgatggtgtgaaatgcatgaaaagtccttttattttaggacattagagcaaggaggattgttcaggaacatttggactgctattattaattatctgatttgaagatcacctcaccctgtgagaaacatggatatcaatcagtatctgagagaagtgaaagaatgaaagagaaaaaagggaacatcttcccttcttgtattgttagatgacctcgtgccctggtatgtttaaattgcttacttcctataactctataaacttctggtgtttcatttgccggattagattgaagtgtcaagtatatttgatgaatggcattggtaatatatgttcatgttcgtctttgctctttttctgcttttatttatatagagtcagtataatttatttctcctgaaaaagctttcagcaaaaaagattttttaaagtacaaatactttttaacagggttctggggtttgtgatgatcaaatcactcatctttccttcttctttctagcttttttttttccttccttacatttcttttgaaactagtgactaaaaaaggcttccctggtggctcagatggtaaagaatctgcctgcaatatagaagacctcagtttgatccctgggttaggaagagcccctggaagaagggatggctacccactccagtgttcttgcctgggaaatcccatggacagaggagcctagtgggctacagtccatggggtcacagagagtcggacacgactgagcatgcatgcactaccacaatctcagttgcaattacccaactctgctgtctcagttaagtgcagtcacagacaatacctaaacaagtgtgtacaggtgtgttccaggaaagcatattgatggacactaaaatctgaatcattttcttcttgtatgttattaagtataatgacattttaattttttcccaatcatttgaaaatgtaaaaccattcttacttcacgggccatgtgtagtccccgcccatatcacagtagcacatgggagaagtgatgctacataatgtctaagatgcagttttaaggaccatacgtttctgtcttggatgcatgctctctctcaggtctctgccatgttgtgtggtgaggcccacaaggcaaggagccaaagccactacccaatgttcacagatgaaccgaggcctcctgaaaacacacatgagggtaagtttggaggcagatcttcctcttccagtcgagcctttagatgactgcagccttggctaacagcttgcacacaacctcatgggagattctgcaataaagtcaccccactaactctcctagaattctaacatcacagaaactgtaaaactgtgtattgggcttccctggtggctcagtggtaaagaatccacctgccaaagcaggagacacgggtttgatctctggtctgggaagaccccatctgtcacagagcaactaagccagtgcactacaactactaagcctgtgttccagagcccggaagccctgaccactagagcccatgcactctagagcctgtggtctgcaacaagaggagccactgtaatgagaagcccctgtgccacaacataagtagcccccgcttgccgcaactagagaaaagcccgcacagcaatgaagatcccgcacagccgaaaaaacaaacaaacaaaaagtgtgtattctttgtagctgctaagcttgggggtaattttttatgattcataaattagtacagtacgtatattcgaccaaggtctgttgggctcctaacactaacccttcacatatcgctgctctcaagaacactctgctctgactcaaacccaacagcttgtgcgggtgcccagtctacgaaccttgctgtactaagacactcgctgaaaccaagccttaactccagtctttggaatgtctgtgtgttacatgtggaagtagtaaaagaagaggaggggaatgttcctacacattattttccataaaacactggtcagattttctgaatcttgtggtttaaagtatccttccctctcaagaaaaaacaagaaatttagtcactgcttcttaacctgctatataaatctccagctctcctcaatcaccctttttcagtatctttccacacaatacattttgtctttgagaatt

SEQ ID NO: 27039 - DNA, 1287 bp, Bovine  19866881873358
cctagtgggtccccgcccctgtagcccatctctagacgcctgtgggctatgcagtgtgatgttaaagtgagctggtaccaggcccttttctggtaatatcaggaagcccgagactgtaattgactcccaggtacttgtaggtttttggctcccgggttgtacatcttcagtgaagaatgtggttccttcctgtttcctctagtcagccttgacttaactttataaaatcattatgtaataatggtaaaatgttaaattatggctttccaaatgtacctcagtgcctttgatgattttgggaccttactaaccgagaagaaaattttctagttacaagtatttggtatacagattgaaaagataaaatgattttttttttaagtgctttcacatgagccagtaatgttaaagttgttttacttggtttgaaagaaactcttggatataatcattggagcatcactcataaatattctctattttcaggtgtgtagcttggagtttgacagaaaagacataagtatgaataagttagtagctacatctctggaaggaaagtttcatgtttttgacatgagaacacagcatccaaccaaaggttttgcttctgtttcagaaaaggtaaagatgagggaaataaatacctttctatgaagaggagtgttcgtattaatagcttgctttagactaataaatagaatgagtcaccaagttccttccaggttttttgcatgaagggagctatttttaatatattcttgtaggatcttgataagttattctgtgtaaagaatactttcctaaagtttgtcagtttcgtatttcttgattatattaataattaaggcctttgttggtaatgactcttattttgtagtttaagagcaatcacaagaaaactagctggtttaagaaattagtcaacaataaatgggaaggaaatccaagaaagagagtatgtatgtatatgtgtggctgattcactttgtacagcagaaactaacacaacattgtaaagcaactatcagattttttttttttaattaagaagaaaaagaatttggttaacaaaacatagtcttgtgtttcctaataaatatacttgtgttaatacccaattatatatttttaggtatatgcgagtatcccaacccagggatcaaacccagtctcttgcattgcagacagattgtttaccatctgagccaccatggaagccctatatataccttaacataatactaattatatacttttcaaaaatgtacccatatatatgcatgtgtg

SEQ ID NO: 27040 - DNA, 818 bp, Bovine  19866880408395
tgtttcctgatgactgatgtgatatattcttggctttctgagcaagaaaagtcatcagggtttcatttgttatgtttatgccaatagaaataaatctcagccgtggtggaggagatgttcacactacactcgctgtctggggaagcctgctggttgaatccctggcgggcgggcagaactgattcagggtaagatacactttggccttattgatcacaaagcttcttcattacttctgtggggctgcaaatcaatagacaggcccatagaaacataatagattttttttttttttttagaaaatcaattaaacagattattttttttttgcagagttgagtttgcatggccattgtctttggcacactgtctaacatgtttaatggggtttccttctaaggactgcctgatcatgaccaagtggcaaagccttgtttaaaaggtcaaatttgaaagaaaaagaggatggtctggaagaagcagaaggcaccctgttcagccctgcaaccttggatctgccgccttgctagaaagcccatgggtcacgtgagcagaatctgtcagcatgcctcctctccggctaaaaacaaggaaccgaaacttcttggaaagcccagattgatgtctgaatttccccattccgaaagcagaaggaagctcggtgggcataacagtgaaatacaatcgggctggggctaccaaggctagccagcgagctgtatactcatccttctctcccaaggacacagctggagactcagggacgctgagctcaggaggcagctgtggcctcagtcaactggtcacactcaattgaa

SEQ ID NO: 27041 - DNA, 1223 bp, Bovine  19866880469849
ctggtagcatttggatggatggaagggatattctacaaggagacagatgggcaagtcatgtttggggaccatttcggcaagcacctgaccatagcagctggagcccagtgtttttattgagtaagtgaaccctgagacctagctgtaagtggaggttgtatgttgactttgaagtttagaaggggctgtatgggtagcatctccattctttggctggttaggagcttttggtggttgttgatgggcatgccattgaaccaaatggtagatttgaaaattgcatcaagcaggtggttggaggggagattggaagcatgaaaaaccatggctgttgtggttgtctgtggaaggtgatgcgagcttagacaagcgtaatggtagggtcaaactgaaaaggtgttagaaagagtcagcaggacaaaacaataccaaatgattggtgtggggctgttggaaagaattctaagaggtcagacacagagggctcactgctcttcctgggatgtttgagagaggccttaaattaagtaaataaagaagctaatggtaaaactgtttgatttaatacataacagtgagtccttttaaaatgctgattggagaaagcacataatatagcagttttaggagagtttatcgtttgaggttctggtatagagatttgactcacaagcataaatcccagtatgtaatgagccatgtaataatagggttctgctgttaattatggtgagtactctcaacgaaatcgaattttcttagtaccacccccgaaaaaatatcctaactcagactttatataacagtcccagatacactgtaaactttgtagatatgggatattgaccgaaaaaagagagaaaacaaatcttcagtatttccagaaaatcttactcatcctcagtgcaccgtgttgtctgtgggagcctatagggatgggcagttaccttttcaggtctctgggcgccgccaaattctaaagattaatatgtgatatttcttatggacatttgaaccttaggtatagttcctggtttgcctttcacagataaggtgactatcattagatattagccattggaaaaatgagtgttataattaataggatcattttggccaatccacaacgtctggttagcatatattagatgtatttttctgttctcctctagggggactctggaagtcagatcgaattttagaaggatattgaaaattctttt

SEQ ID NO: 27042 - DNA, 4536 bp, Bovine  19866880562820
cctgccttcactatgcacacatgtgcaccttggagatgtaactgtcctagaaaagatgccaaagaaatggaagatgccaaagagctggaagaatcacactctctgactttggacagtattattgatacaaagccacagtcatcagaacagtatggtactggcataaaaacagacacgcagatgaacggaacagatcataaagcccagatataaatccacacacttatggtcaattaatctacaacaaagaaggcaagaatatacaacagggtaaagacagtctgttcaataagtggtgctgggaacactggacagctacatatagaataatgaaattagaacattttcttatgccatatacaaaaacaactgaaaatagattaaagacctaaaagaccaggaaccataaaactcctagaggaaaacatgggcagaacactcttggatataaatcatagcaatattttttggatttggctcctaaaggaaataaagcaaaggcaaacaaatgagacctaattaaactttaaaactgtttcacagtaaaggaaatgatcaataaaatgaaaagataatgcactgtgtgggagaaaatatttgcaaatgatatgacatacaaggacagggagacctagcgtgccgcagtccatggggttgcaaagaatcaggcatgactgagcgaccgaacaacaagtgatgtataagggattaatatccaacatatataaacagctcataccgttcaacaatctgattacaaaatgggcagaagaactgaacagaaatgtttccaaagaggagatgcagatggccaacaggcagaggaatagatgctcaacatcactaattatcggggaaatgcaagtcaaaatcacaaggctatagcacctcacacgtgtcagaatggctatccgcaaaaggaataccacaaacgctggcgagggtgtgcagaaaagggaatccttacacactgttcatgggaacgtaaattggtgtagccagtgtagaaaacggtatggaggtttcttgaaaaattaaaaatagaactatcctatgacccagcaactctacttctggtatatatctgaaaaagccaaaaacactaacttgaaaagatgcatataccctaatgtccacagcagcattatttgcaattgttgagttgtggaagcaacctaagtatccatcaacagatgaatgaataaagaagatgtggtactcatacacacacacaagaatattactcaaccataaaaaaaaaaaaagagaaattttgccattggcagcaacacaggtgggcttggagggcatcacgctaagtgaaataagtcacataaagaaagacacacactgtacgagatcactaacatgcggaacctaaaaaatacagcaaactagtgaatacaacaaaaaagaagcagagtcacagatacagggaacaaaccagcagttaccagtgggtagagggaagcgtgcaggggcagtaaaggggtgggggattaacaggtacaaactgttatgtataaaataagccagaagaatatacggcacaatataggtaatatagccaatattttctaataactataaatggagtataatctttaaaaagtgtgaatcatatattatacacttacaacacataatactgtccatcacctatacttcagtgataaaacatggttataaacaatgaacagtagaaaaagatcctggggtcccagtggaccaagaccgtaacaatgatacattcaacgaacatttactgagcacgtattacatagtaacaaaaagaagacactgtataggcttgaggtcagtctgaatgaaaactatggtgccacacaggaagaagaagtttatttattcaaatgttcatcagccaaaacttccaggcagattcatggtaatcccttacaagtaaggaacccaatctggcacaggattctcgtgttgcgcatcacaaacctcttttaggagctgttaaaagataaggaatctctccctaaaataagcacacatgaagacaggcaataaattgtgaataaatttggacaatctgtggggttcatcaaagaaccccgtagctttcttcatgaaactaacttggtctaacgagaacttggaatttaatcattttatttctgaattgaacttctcaacatacaaagatattgtgggttccatggtcagaaaagggtgaggaagagtttttaaaaaaatgatcagggaatcctatggtggtccagtggttaggactcaagagcttccactgcagggaccctgggtttgatccctggttggggaactagatccccaaagctacgaggcacagccaaaaaatgagaaaaaaaaaaaagatgaaaaataacaataaaaaaaatcagggtagggggacttccctggtggtacagtggataagaattcacctgccaatgcaggggacacaagttcgatccctggtccgggaagatcccacatgctgcagagcaactaagcctgcacgcctgcagctactgagcctgtgctccgcaacaagagaaactgctgcaacgagaagcccttgcacccaccgcaactggagaacagcccccgcttgccacaactaaagaaagcctgagttcagcagccaaaactgcgaccccacgggctgcagcccgccaggctcctctgtccatggggattctccaggcaagaacaccggagtgggtagcctatcccttctccaggggatcttccccaacccaggggtcgaactggggtcttctgcattgcaggcggattctttaccagctgagctaccagggaagcccaaaagaaataaataaattaaaaaaaaaaattttttttttgatgatcaaaggcaggaaaagaggaaaagggcagaggctatgaagctggtctccatccctgagcccaaggagaaagctgtgagggatgggcagggacataagggctgtcattccctgcggggctttgaaacagaatcttttcccatttaccagattccgtttttcctcgtgtccccgtgaacctaccccagccactacaaactccccataaatgtcacaggggaacttcctgttcccttctaaagatggaaacactgaatacaaatgactgaattttgcaaatttgtgcaggcggggaatcaaggcatgcatttttaaagcgtacacggctcatctaattcaataagtagttccaaatcgaattacacttcacactttgtacagggcagaaagtgtctccccaaagcctgatgaggaaccaggaggccagaaatctgagagcctgccctctggcctgaaagccggcttagagatccagcacaaaggcgaaggcctctctgaagaaagacgggagtttacaaacgccaggagttgcatctctctccccattggatctttcccaagaggagactcaaaacaaggtcgcagctttagggtttctgtgcagggacagattgggtggaaagacttcccacgaccccgcgccctttgcaagacctgggaggggacagggtaggaacagcccctgctcccacccgactctattcattcaggggcccagggcgccccaaagtccggcggggggtgattccccgcttctactgcccgcccttgtctcttgccaaaccctttaaagcaaacgtcttcccttttgtccaggaaagaatctcaagaacctcttcgcttctgccaacacggtttcaattggcgtcggtcggtggagccagatttggacggcatccaaccgctcagcccgcaccccccacccccttctggaagaggccccctctgttctttcatttccagcctgcctcccgccccgctcctccagcagagttcctcacccgggttcagcagcctattgagacatcaatctttggtcagagcaggctccaacctgcaccacgtcctaggcgctttcctaaaacgcggtctgcagaactgagtgcctccgaatccgcatggcggaggaggccagggatgaggcctccgacttcctgtgtcaagggatttatctttcattctgtgttccgccgcccacactcgcctcgaagactcagggaatgtgcccccgagccgcctcccaccccagggaaccttccagcaggatagaccctgccccaaggcaaacccggaatccagcccgcccaccacgtccaagcggtcagccacagagagattccgttagttcttggcaagtgctcgcaaagttaaagagagaaagagaagaccttcccccacagatgggtggaaagtggccatttgtcacgggggtgggagtcccccggcccccctctcctatcagcaggactgtcagcagacgcacaccagagctccgtgctggggaggctgggggcgcccactccagcaactgatgagatcatgtaaaataacaaaaactagacagggtcctctggggtgcaagagagcggccccctgccaggagctaagtaggaaaagagctcccccgccccagagataccaagcaattctccagtcagatcatctgctcaggcttccgagg

SEQ ID NO: 27043 - DNA, 1168 bp, Bovine  19866880705218
aaaccgtttattaaaaattaacagctaagttaaggccccattagcaaagaggcttcccaatcgagaaaagctgacacgctttatcttgcttggaaatgttgttatttgttgttgtcattacctccaacttttaaaagggaacagtaatttattgtttgttgcctgcatgcagctggcagaacccaccactaaggaataaaaagatcttcagctaagctcacacttagggcagtttaatgaggtcttattcttcaaaattaaccttcaaacccattacattccaggaaactaaaaatttacactagttttccatttttaatgggcttacaataaaaggaaatatttacagctcgaaataaaatagatggcactttaagttcatttttcaagtcatcccaaatagacataaaaggcaaagaaagacacataaaccatgtaaagagaaacttaaaagacataacaataataaaaaaccaaaatgcccatctccatgtaacagacagtaagcaaggggacggtctggagccacactcaggcagggctctcagctctgcatgtggacaagtagtaggaagcagccatcgcttccaagccatgacacccagggactgagccactgggtccccaatatgcccagcatccctccatgagatgggttctctgagccaacaggaaatgccttcattgttctggagtgggaccaccaggaggccgagtggaaacagctggaaaaccagggaaggcagtggaatgggggacgattgaagagaaagaaacatctactcaagatgagtctagggacctacccagtggtctagtggttaagaatccaccttgcaatgcaggagataggggttcagtccccagtcagggaactaagattccacatgttgcagagtaactcagcccatgagccacgactactgagcctgcacactccagagcctctgtgccatgacaaaagatcccacgtgatgcaactgagacccgtgcagccaaataaaatacatactataagtaagacgtctgaaaacctgagccccaaaacgcaggcacagttaatgctaatagagacactcaagaaaaatcaaccatggagatgtgaaatcacagcatgatttccataagaaatgcaaataatagaagaatctgaaaatgatatgtagga

SEQ ID NO: 27044 - DNA, 2260 bp, Bovine  19866880763550
taagagggacacagacgctcctcaagctagggactcagtcaaggtgtttcagagactctcataatatgaccttagagagtctgtctgaggaagagagccggtgggcactggaaggcaggagcagcaggatggtctttgctggggcactgctgctgcgccaggcctgtcctttgctctgcttgtctcacacacacacacacacacacacacacatactactgcacacacacacactaatgcacgcacacaccctacttccaaggaagcatctttcaagaaaggatgtttggtcttcatcctctcctcctgctcaccttgggtagagaatacatcatcatgatggaaagcagcaagacagaaggaacctatgtccctaatgatgagaccagaggccacctgaatccacattcaggtggtcttgggggagtcggcagttgacagtgatcagggaagtgtcattcccaccctggactttcctggacttgattcatgtgcaagggacacagacttctatcttgtcaaggcacttttactttgggcttttggtcaatggcagccaaacctgatcccgatatacttttcctccgctcacctttatgcctcacccagcgtctgacacataataagaactcccgtgcacgtgtgttaaaatgactggatctctctgcttaactgcagcatggtgttcagtgctgtttcttatagattttggatatctgcccaatggaactgattttaaaacaatcaaacacacccataccttatgcatctagagtgttgctcccttcccgagtctattcaccttgggaatctgttcatgtatcttgctgatactgcttaaagatactgttcatgtatcttttttcttttttaaaccaccttctgtcactgtacatgcacaaggtttcactggagacttatccctggttttgctgttgggattgtgtgacccaaaactggacactgagccctctggatcaaaagactggttcagggatgggcatgtgatctaggtcaggcttgtgggatctagcccaaccagggattgaacctgtgtcccttgctttagcaggtggattcttaaccactgggccaccagggaagtccacgtgaggatttctacaatttggatttttcaagaaagtaattttatatgtgaaaaaaattttcatttaagtataaatatacatacaaagcacacaaattataagtgtatgacttagtaaattcctcagtctcttttgatctatagtgtggcctttatcctgtttttttttccattgtactttgataaacaatgtatttgtcatgcagcatttcccatgatgaatgcttggctgataatttcccccttggtgtcatttaacatgttgctctgttctctatttcctgtaaatttgtggttgcatgtagagccttatcagatgaggtcaattctggggtgagaccatttcataagtgctgttgtttactgggttgtctctttctcccagcatcttttaaggtggatgtgatttttacaaacaggcaagagccagttcctagatgaacctagtaagcagggtaggtgatcatgttggaaaatgatggtttgagttgaaaaacaaggtgtgatcaagcaatgaatgattttcttgtgtgactggtaaactggccttgaagggaactctaaaacagttccaaaaatgtgctctgccctggcagcgtcaaatgtacagccacccagggtgactaatgggaacggaacaacagtgacattgatggagaaactgtatgttggctataaaaccagccttgttgtgtgggtggacgtgcgtgctgtccctctctagtcattagctcttcttaagaacccccaaaggtctcagtgtgtatcacacttgtgcttcgaagttggagctctcgctgaaacgccagatccgcttggcttagttccattgcacagcctggacgtgttgacaagatgctgctgggtcccacccagcccctccccagtcctggcgtgtgtctcatctgcattactcggcgagaatgtggtcagggcactgcagatgtcaacaaaaaacgaggaagctcggagaggctcctgcgccgatcagaccaagggcagggggcctagcccagggccgtgggcgccggcaaagccggaaggccccagctgttctgatgcctcgcagacttcccagtttcaagtcagcggaactcccgcgggtctcggctcaccgccggtttttttttttttgtttgtttcggccacctc

SEQ ID NO: 27045 - DNA, 1831 bp, Bovine  19866880769219
taggcaccttataagtcactgctgccttccaggagtctggtgcctagcagaatgctgggcacacagtcgatcctctgtgatggagccgagggctcagcctggccaccctctcttccttctgtgccccctccttggtaccctgacccttcccctcatcaaagcagcatcatatgtgagttccgtgtcctggggggccggggtggcagagaagagaggcgtcaggagaaatgtgccctcagtggtgggggtgaaggggctcattagggatgtgactaggtctcagattgcccacctggttcaaggtcaggaggcactcgtgtggcccacccacccaatttaaccctttcatacttgtccaacaccccgggcttctcctcgggggcatcagagcccgtgcccccgtctgacactggggtggagtgaatcgcagtctgatgcaccttcataggacacaggatacagaggccaggctgtgccccaccaggctctgtcttcccccagacaaagcccagcctctaggctgtaccagccggcagatggcaagacaccccgagtcagtgtccaggggcatttgtcacattggagaatgatgaagaggaggcaggtgtctgacctgggatgacaaaaacgcagagcagtgaagcctcccccccaccccccgccaagtgggggaggggacagagacctagtgtcatttttcagcatgattttcctccatttaatgttcccatagattacagagcctgatcatccaatggcccatagagatgctttatggtgttagggtgtaaggttttaggagacgaaagaattaactgcgaactttctgtcctacaaagacccccgttgtctgtagaataccaagttgattttgttttgcttttttaaagatgtgtactcaaggtgagaaagataaataggatttacgaacctccttctgcatgtaaaaaagatggaaaggaacttcttctctagaaacttccttttggcttggaagaaagcagggatgcatcttctcacacccctcaggcagaggtttgtggcttccctggtcactcagacagtaaagaatctgcctgcagtgcaggagacctgggttcagttcctgggtcaggaagatcccctggagaagcaaacggctacccactccagttttctttttttttaactttacactttttattttgcactggggtggcgatgattaaccaggttgtggtagtttctggtgagcagcgcagggactcggccacacatacacatgtatccattctcctccaaatcccctctcatccaggctcccactccagggttcttgcctagagaattccacggacagaggagcctggtgggcgacactccatggcgtcacaaagagtggggcatgactgagcaactgtttcactttcacttttcactggaacaaccgagaaattgatgctacatattgtatttacaacctttggctcttctgctgcagttccctgtcctggctcagtgatcagtctgaggaaagagacagaaagtgctctctcttcgacagatcctgttctgggccacaagtgcccccagagtccagtttgtagttcttgacgctatgagtaaaaatcattgacaaaccactcttctttgggaacgagggtaaaaaagagaaaccaatatcacacctacggaggggccggggagcacatgaaaagatggtcaacaccattgatcagcagggaaatgcacgtcaaaaccacctcacacccgttaggatggccagagtcaagacagatgataacaagtgttgatcacaatgtgagaaactgaagcccttgcctgttgctgt

SEQ ID NO: 27046 - DNA, 857 bp, Bovine  19866880813887
tgaaggaatgtggtctgtagaggcccaccctcaaaaaacctggcctcccaaggtgctgtccagctgcagaggtgctgaattgagagcaggccccccggaatgtcttggagagcagactctgacgtcactgacatcagttagttgctctccacccttgccccaaccactctctttttccttgccagtctttttacctgatctcagcccctcctcctcctctgtggaatatctgttgctcacccctgccacagtcctgatcagttacccaggaaaaaaaatgcgttcgtccagaaagtcaaatctccaaatcacccagataatcgatagtcgactactgtgttacagagcaggggatcgatttcctgccagccattgctaggcaacaggaagctttcacagcatcctcatgcaatgaagggaactgtgaatggtggaacagcactatggggttagttctcaagggtcagtggcatgtgaagccaaaaaatcaaatcacggggtgaagagggacctgctgcttttaagactttagtgatgcttcatctgccactgtgacttgcagcaaaccctagttgaaaaatccttttcactgtagaaagtttcaaatgattacacagagggatactataatgaatctccatggagtcatcacctagcttcaataattaacaacccttggtaaattcagttttcccctgggacttccctggcagtccagtggttagaactccattctataccactgcagggggcatgggttcaatccttggttggagaactaagatcctgcatgctgcctggcagggccaaaaaaaaagagagagagaagagaaaaagatcagcttcagtctatggtg

SEQ ID NO: 27047 - DNA, 2707 bp, Bovine  19866880830145
tgactgggggagaggggaggaggggcctggtggcagggcgcggggtggggtggggtggtggggagatagacctggaaggatagacccaggccaggtgggagaagcacccagtgaccttgaccttcatcctggaggtcctggttctcaagactggctgcacagaagcaggcgcccagagcaactagaaccaagtgagagagaagccagacccaccaggggcctggtcactgatggtcctgcaaggctatcccaaggatggggccgtatgtctgaggttgcaaccagagtctgtctggtcccaacacctgtgcccttgggtggcagagggggaggccggaaggggatagagactggatgaagggggagacttcaccaggtggccggatggtcctgagagacaccaaagtttgctctcaaacctttgcagcgatgagaatcaggagaaaggccatggttctggggacacttgccgaatcagaaaatagatcatgcctgggcagtcagggtggaagatccacgtgattgctgtgaggctctggaaagccacgcacctgcctgctgcactgttaagagatgaagacccacctacaaagagccagcagggtccccacgaagcatcctagaggtcttggtgaccacctagccatcactggaggccaggagaagagagacagactcaagagcaaagactggggccggggatgaaggggagttttgttaaagctggggtttgggaagaagaccccagctcgggggagtggggagcccccagacccttatgaaggctgtcagggatataagcaggtctgggggtgttggggactggaatctcctgtccgttgtaatgttcgccataaagtagagactgcggtcctgtccctccaagaaacagaacttgacctctcagggttggggccccctcttcttaggggaataagacagtgaatgctgagcaggaacaaagggtgaggaggagactcacctcccaggctgtgggaatcccggctggagacaggagcatctctgtttaaacccttactggaatgtctcactctgcccatttccatttcatattttagctaaaaaataatgacaaagcctgcagagcagcctccctctcctcggtaattaccaaattaacacattctaacagacgagcccccagcagcaggctgtgattaatgcgcgaggacaattagcagcagagcctgccccttgcgctcacctccttaaacagcgagaccgcgtgcggggtctctggggtaagccttccgccacccgcccgccctcccgctccctttaatgggctctggggccgggcttcacgtgccaggctgtgtccgtcccacccttggggggtgggggctgaccccacgggtcagggaggcggcttccccacccaggcaggaagccgggaaagcgagccccaaattaatttattcagccaattcattaggcaggcgtgggttgtgtgctgagtacgtgcccagctcagggctcaggcggaggcaagataagtgtaggaaggggctgccgccctccaggagcttgctgttgggaagacgattaaggaaaaacgattaagtggtcagtgtggggcagagcccgaggtcctgaggaagcctagggaagagcatgccctggttttcatggatagtgatggggacacagatggtgggagatgtatccccactgccgtcagcatcagtgatgggaaaccgagctgaaagctagaggatgacccgtcttgaaacagggggagcgtatgttcattctgacataagagcaggaaagggcttcccaggtggcgctagtgataaagaatccgtctgtgatgcaggagcctcaagagatgcagcttccatccctggcttgggaagataccctggaagaggaaacggcaacccactccagtattcttgcctggaaagtcccatggaaagaggagcctggtgggctacagtccatagagtcgcaaagagtcgtaatgactaaagcaacttagcaggcatgcaagggcagtaaaagaaggagtctggcctgcatccagcactgtctccttagtgatggagcataactgataatggggagagtgagaaaggcatgccttggtgggagccagctccaacggagggacatatctgggatacttagcccaggttagagagcaggaaggaagttgatgctgaatctgggcaagaaagtgcctatgctggtctcagggccgggaagaaggaagggaggagctcaagggaaaactccaaggcagaatcacgaggctggacacctttttgaagtgaggctcagagaaaggccggtgttggggtgtgagctgaatcgccaggagaagattcaccagggagaaagactgggcaggggtttggggtcagagctgctccatggggggcactgatcacgggaaaggtaacacgctccagaagctgaggatgaggaaagacaggggtgggcccccggggaggtccagagattcaggacctgcccactctcagaccgagacatcctcaggaggaagctcccctcttgactctcgtggaaacacaccttgacggaggaggagtccaaattccaggcactcaggtgctcagtctcctaagtgactgagttttaatggcagactgaaataacaggacaccagctccatccttacttaacacagttacattcaggaagctttcctgacctccag

SEQ ID NO: 27048 - DNA, 688 bp, Bovine  19866880891862
cttccttctccagacagaaaagccaggctgtgggcaggctcaggggaccctacctgcacgctctccccttctttgcagatcagaggcgactccacccatgctgtagtcccggcccagctgccagactctgtctatcagctgtacgttgttccctcctggggaagtgatgctgtgcgcccccagggagtccttcttgggtggctgtggtgaccgcttggagtgatagatgttaaagacaatgtcccctttgcacacgtcaaaatcccacgtgatcaccgatgaggcgtccacgatctgaatgagaatctggaaggagaggttggctgcatcagcctgccacagtgaacatgagcctgtgagccagcgtcgcggcagcacgtccccaccgccccccagctctcctctcagctgggggaggggggtcccagccgcaggcctcctcggccagactcggcattcgatcaagttccgggctccgttagctccccctgcagcctgtgtgtcctgaacatgcaatttagatgccattctaggctaccgggtcctggctgtaaaaaaggccttgatacaaaacagaaataacgctcaacagcacaaaagtggttccgagggttgctctgggctgaggggcacagggaaggtcccagagtaaacagcccgggagggacaagaggaggggaggcgagca

SEQ ID NO: 27049 - DNA, 1002 bp, Bovine  19866880934343
aagctgcagtggcaatatcagtcttcagggagatggggtgccgtgaggggcacgggtcccaggaaggcggtgggaggctgtgcactcttggggtctgtgactccttccggtaaagaggacccctcccccatccacacccctccttcccatggctgcccttcagtccttggctgggagcacgggggtttcctggtggctttctcttgtctgtagtgcagccttgccttcgagggtgaattccatccctgtctcttaagcatgcagacaagatttatgctgaatcaaggaggggccaccgcagaggcttgggggtctccaagcaataactcctaattcggagattcatccacgagagcagagacaagggcacctcccgttaggacttgtcagcgagcagaggatccagtctgcaggctccttcctcgtccacttggcgtactcctaattatgacttgggctgctacaaacagaaatggactaaacccgttaaatctattttttccccttggtgggagggagcagggattttgcaaagatagagattttaaattaagctttaaaaccgtgcctgagcaagatttaatactgacaattagcctggacaaacagctaatcgcactggtggggtaatttatataagctccacgcaaccatgaggcaggcagcacgttacactgcaaattaaggcaataaaagaggctgccgcccggtggggcggggccaccttgggcttcctgcgcccgccttgctggatggagctgcgctgagtctctggtcttggaaagggaaatctcgctgcttccctctgggggacatgacacagtaaacagaatccagcatttctggagggtttaagggctcctctgcctttggggagctgcgtgtgctaagctattgctcatttactctgtgcgtcagtgtcctcatctgtaaaatggggagacacttgcccagcacggttccttggggagaggcagggtagaagcatctctctcggttccc

SEQ ID NO: 27050 - DNA, 927 bp, Bovine  19866880934466
cctgcaggctgccctgctcagggctctggaaactttcaaaacaaagctgactgcattcactcctggtcggtcatagtttagaagtgggcttgtgcagtaagtgatgaatgaatgaatgagtctctctggcggactgcaggggaggagctggcatgtctgactctagcaatctgggtgcgtgtcagacggtggaggctgcaggcaggtgtccgggtccagcctgggcccgtcctgggctgcaggttcttctccagcgtgtgttgttgtccgcggggaaggcttctgctgggcttgccctggtcgcccagacagcagaccccagggcaccatgaccttggcagcagtaggacagccacctgcctccccgtcttagagacctctcgagtttggtcggcttagcacctcagcaaatctgctcgagttgggacttgcctgccttgagcctccccagggatcaagcgctgggccgaggggcatgtgcagggaggcaggaggctgacttcacccggagctctgttctggctccctcctggggggcagggagggaggagaacagctcgccccccactctgcccagtccagcctggcttacctcgtgttgcagacccaggacagggaaaccccagttcccaacaaggtagacgcgggttgtaccggagccggcgtgtgcctgacccgtgccagcacctgttcatcctgcagacagtcctggcagccggcaccctggagcccagcccaggttttggagttcgatggacttcactttgttctgggctcaattcctcatagctgtgtagcctcagacaagtgacgcaaccccactgagacttggttatctcatctgcaaaatggggtaataagggtcgggtgggaaaatgtgcatcaagggtttgacccagtggctggtccgcatccagacggtggaag

SEQ ID NO: 27051 - DNA, 956 bp, Bovine  19866881092674
tctcctgcattgcaggcagacgctttacctttgagctaccagggaagcccaatatttagctacctgatgcaaagagccgactcactggaaaggaccctgatcctgggaaagacggggggcaggaggaaaagggggcaacagtggatgagatggttggatggcatcactgactcaacagacatgagattgagcaagctccgggagatagtgaaggacagtgaagcctggcatgccgcggtccatggggtcacaaacatggggtcacagagagtcagacagaacttagtggctgaaaaatgaatgacgaatcagggagtttttttctctccccttgaagagctggttgttaaacatgaaccagtacacagtgcagggagcaccctggggaggtgcttttccagttagcatcatggccgctttgagaggctgccctgggctcttgttcctcttcttcggcatctgcacagggtctgccttcctcaggctgccacacccttcaaggtcagggctgatctgtgcacacagtctgcactgctttaacttggcttgagatgactcagctctgagccaacaccagaacttatttaaacaataaatacttgcaagctgaataaaacaagctccccacgcagagctatataacgtgacttctttatgcagtgagtggggcagagcctgctcagcatcacccgttacaaagagtggccccgaggagtgttcacttgttcctcttcttgtgcccaccttcctggaagtcggaggctccaggggttcctggaagcatgagtgtttggggccgggtgtcccatgcttagaacacttccaatgggagtcaattactcctgagttaggcccagcggtacagagcaatgctgcggactcttcattgacacagttgcagagaagattcaggatatacatttgaacaaggattaaccattcccagaacaagtagc

SEQ ID NO: 27052 - DNA, 752 bp, Bovine  19866881112070
atgaggaagcgagaagggaacgaaccttgcaggcaagtcccacgtgaatgagtgaggctgcaggacaggcctcaaatccagggctgcctcttctgcttctgagccaatgtttccaattattgctgtcctaaccctcactgcctcccctgcatggacgccatattttgaaaagtgttgccaacaaaattgaataaattaaggaagtggaaatgtgttccccaattcttattaatcaaagacatatgtacctgccaattacagccctcgctccctgtccagcccccaggcagaagccaagacttgagagttttgactttgcgggggaagtttgcctctggtcattcgacatccaaggagtctgtgcacctactaagtgccaggcactgtcagaggtgcttgggatacgtcaggaaacaaagccaagatccctcatttatgttacagtggatggaggggagacagcatggagaaatatgataaatatgcatatgtcggtggtgttagaaaatgataaagggtctagaggcatgttgagcgaagtaagggggggctcctgggagtggggagggagcacgtttaaaataagggttcaggacagatctgcaaagacccctggacctggaggcggggcagagatgggagagagctctgattggccagcagctagccggagatgtggcttgctaaggcagtgtggacagagcatgggttagtagaaagacccgggtctgaattccagctttgccactcat

SEQ ID NO: 27053 - DNA, 2112 bp, Bovine  19866881153739
ttcccccttagtaactgtatgtttattttctacatgtgtgactcaatttctcttttgtaaataggttcatttgtactattttaaaaacagacttttgaattgtaagttggaattaaaaaaaaattaacttgctttaatttgtttacattagaaaatatgaagcatgtgactgtgtttttccaataccttacaatatataatccctatcaatagatccaccaaaccctaggcagtttcaaaatctgcatatgagaaaacagactttactcacatgagtaatcattttgctaaaagaaagactgctagatttaaaaaaaaatcttgttcatcttgatccctgattttagcctggtttcaggagcaccaaagcagaaatttgctgtagttactataactttatcaaccattgatgaatattcttaatgctatgggatctgagccaatcagaagaatgttatacctgacagtgagatagataggatctttatgtaaagtgtgattaaggatatcattttgcagaattaattgtatgaaccctgggcaaccccatgttcccttagctgaaattattaattacaattatagagaattctcagtctaaaggggcttccctgatggctcagcaggtaaagaatatgcctgcaatcctggagccacaagagacttaaatttgatccttgagttggaaagatcccctggaggagggaaatggcaacccactctagtattcttgcctagagaatcctatggccagaggagcctggcaggctacagtccatggggtggcaaagagtcggacgtgattaagtgactgagcgcgtatgcacacactacgcaactaaagaaaccctgcttgcttgcagcaaggaagacccaacgaacaaacaagcttttttaaaaaaacaaagccactttgaggagcaccatgcagtcaggcccatgacaccccccagattccagggcagtgatgacacaacctgctagtcagatatccacgtgagaatttgttttctccgcccacagacgctacaagtgcaacagctgcctggagggacttgagcgtctttggtgttcagaggagccacggcttctaagatccccgccagcccgctgctcaaagatgccacgactaatcatcgccatgcccttagtattcactggcccctcgtgggggctgcatgaggacctgctggtccatgcgccgtatgtaaaacacttggaaggaacaaataatccccacgcaaacagcaaaaggagaggcaattttcatcagccgagacaccataaatcttcatatgttttatgaatctcacttacatttcttgtccgacttgtgcataaaacttctccagatttatacagccaactgcataagtcattcccttccccaacgggctctatatcttgatgaccttttagaaaccaatgactgcttttctgttgttatccataattggaaaagcactggagataagaaaatttatggcaatgaatgatctacctgagcaaagctataaagaatgctggatatctaaaagaggggcggaggggacagcccactctccctgtttatcaagtgttatctccaccagccagggtcctctgcaggcacagcacccacagcggaccctggaaactcggtggggctcttggaaggctggtcaagtcactgctgcttgacacagtggtccagttctgctttctgtaagaggaggtcaaaagacacagtccccctgccccccgccatccaatttcactcccatttccatgttgatatagaccgtgattcaatggcagtacaagacaggcaaaaacgggcagcagacctaatcagaccgttctccagagaagacctgcagactgtctacaggcacatgaaatgaaaagatgctcaatatcgctaattattagactattcaaaactacaatagggtatcatgtcccaacagtcagaacggccatcatcaaaaagcctgtaagtaacaaacgctggagaagatgtggagaacaggaaactcttgtgcgttgttggtgagaatgccacctggtgcagccactagggagaacggtatggagggtccttaagaaactaaaaacggaactaccagcaat

SEQ ID NO: 27054 - DNA, 1179 bp, Bovine  19866881229307
agatgctgcctgacctcagggctgacgtgcccttggaaagcccactggatgctgccctggggaccagtatggagccctacaacccaacgctcctgacccccccaccagcttagccgagcaggagtgaacgactccccagaaccccatcaatgactagcccaggctcctctgtccagagacccgtgtcagaagaatcagcacacttcctttagccactgggcacagccgggcctttgtgtgttggggtcaatcctggctcctaattggcagtgtagacaatgggcctctgtgtctgttcccagaagacagcggcattctggggaaatgacacgcgtttcaatgtacaaaaaaaaaaaaaagaaaaaggagcagagctttatgtcccagcaaaaaaattctttggagactcctgtacttatcactaaaagaccttattatatgtcatccaaatggctgcaacagcaagctcttcggggatttcgggtgtggggccaaatgtgcagtgatgggcagccggcaagactgtattagacacagtggaagagtcttacctgccacagtacctgccatggagaacctctaccccaggtccaactcaagccaaagacggcagccatcagagaggggaggaagacagacagaagagaccaagagggagagggagcttctttcccacaaatggtccagaggacttgggaggcatgacgtgtgggctcccgccccacggggtccttgcaagaggagatatgaaggcacctgtggctaggccgttggcataggtagcagcagcttccccagctgtttgcagcagaaacttagaggcgggagtctccgggtgccgcctgggactcagcagccgttgtccctttgtgtccaactctggcagctggtgaggttgggagaggggaggatggcagatccagtagccatgccttgtgcgtcactgcatcagtcagtgttctgagaggcagagaatccgtgggagaagctgggggtgggggggcggggaagggaaaagagatttattttaaggatccgagtcttagttgtggcatgcaggatccttttttttttttttttactgaagcacgcaggatctcattccctgacccctgaccagggattgaacctggggtgcctgcattgggagcacagagtctcagccatggaagggaagtt

SEQ ID NO: 27055 - DNA, 788 bp, Bovine  19866881358068
tggtgtggaacagaggggactgcgagagtcatcggcctggtgacaaatcttggcaggttctttgtgaacagtgtgtgtcaagagtcacacacgtgccaacagtgagagacccagctttcaagcctgcaggatccttacgaggctacagggcatccccggtcccccaacacacacacacacacacacacaatacacacaagctcgttggttcttcccacggggctatctaaggagcaggcccttgctggctttgtggccgaatgaaaaaatgttataaaggcaagcatcccgaccgtgtgcaatgtcaggctccggcctgagcagctgacacgtgttgccccactcgacccttctggtgactgtcatcatctctgttttgctgatgaggaagatggagctgagagaagaaggctgtccaaggccatccaggtggtaaagggcaaagactctatttcagttgctctaacccagaaccttagtccggaacccaccttcttgcccacaacagggtgctgcctggtaggaggacagatggatgagggcttgcaccgtgagtgggtgggcctcctctccttccagggccttgctcatggccacttgggctcgcataagaaggtactggtaaacagactctagctccaagcagagacagacttccatgaaaggcagtttgttggtccaaaataattgcctcctatcaggttgtgttaaaactggggagtaataagggctccgctacctcaagatttatggtacccgacacgctcgcctctccgccacaacacatt

SEQ ID NO: 27056 - DNA, 1363 bp, Bovine  19866881461538
tgcgaagggaacccatcagcaaaaatgaaagccaggtaagagctttgccatgcacggtttccgaaagtgttgtaggtttcccaaatccaccagtgttgtgctctgattcctgggcagaccgtgagaagggatgggatgtactgagggttccgccccagcgggggaaccaacagcatgaccttggtaatggagagacctgtgtgctttgggactagttactgaacttctctgagcatcggtttactcatctgtgtgtttaccccaaagtgttgtgagcatcggaaattgccctgggcatttggctggaaggaatgaaaagcttgaaaggggtacctctaccaacaagaaccatgatataaaggttttcttttttttataacctgctttgaaggagcccaaaatcctgccatgcgtattgctgacatccgtgaccttccattgccacacagttcacagcctgccgggccatgttcaacaccaaagaccaaacatgccaggccctctcagggtgtgtccaggggtatgggaaggatgccccttgcttttctactgatttatttgcccagagtctgcactgggctcagaatgcccccccaccctttctctcatgctattccatcctccataaattaacattttctctccttttgtctgccccaaaactgaacaaacttcaaaaccagtatatatttcatctgcgcagtgaagtcttctttgctgcccaccatccagggaggtggatggcatttctaggcctccatgtcctccccacttgctgaaagtgtgcattataactgtgagagcaagaatgcaatttctgtgaagacaggggccgtggccaagccatcattctcaccccaacacccagcaccatcctgacacatgagccaagcttggtaaatatttgtgacatccacatatacatgcatggatggacggaggattggatgggtggatgggtggatgaaggatggatagaagatggatagatgggtatgcgactgcaccctccagagagagttagttcctagctttagcagcccagtgtcagcaaatgggagtaggtcatcccagctcaaggaggcccaagaacatttgggagcatctccctccccatgcactgttctccactcccctggagaccttggaaactaacttgacaacaacccagagggagcttgtgtcttcaggctgcagcttttacgatccttctcccatcatcagagcctgcaaataaaatagtagctatgccttgcaacctcagaggatcaaaggcacctagacaaaagaaaaatcaaattaccttgaaaggcaacaggccctggaagaaacaggctttcagaactaaagcaggaagacagga

SEQ ID NO: 27057 - DNA, 1501 bp, Bovine  19866881529095
cgctcttggattcccccttgctctgcacagggagctgggggccttcaggaatacagcgccagctcccggctccagtcaggatgggatggatggctgagcgcgagggctgttagtggtggaatttggccccgtctgggccgtctctctcccttgtctagatttccttccacgctgacctggaagaactcccaaagcaacaggccagcccaggctgtttgcaccagtaaaccctgcagcagtccccagggcagagagtagctggatcgtatttatttaggaacggccgaaacttgaggcaccataaaaagtggagagaagattccggagaggaatgcggccggccccaggcccagaattcatcgtcttgctctgggaggctgcaggcggccagactggggccggccctggagggtctcggccggctgcccgctctgctggcaggtacagtagccatgactgcaggacggtcagtgggagggggtcggagggatggagcttctttatttttaactaaggaaagcgcacttcagtggttgagtcggaggatgagcaggaaatgaagggaaaagtctgtttttaaagtgagcggttggtatcccccactttgttggtgtttagtcgcttagtcgtgtccaacccttttgcgaccccatggattgcagcccaccaggattctctgtccctgggatctcccaggcaagaatactagagtgggttgccatttccttctctagggcacttcccgacccagggatcgaacccgcgtctcctgcactggcaggccgtttctttgccactgaggcagcagggaagccctgcgtctcccataggtaggaggcaattatggaggattctcgaagaaggtacctgcttgaggggtgggagaggtgagaggtggcaggaaatctgagcccagagcctcagagagtgtcctttcagctagaatcctctcctcccacctcctcacaggcccctccccagaatgggccccaggaacaagaatgtgcccgtcttgtggacccccttcctgaggcccctgctgcccgtgtcagagttacctggagcgcctgcccccttttcacggctgggtcagcccaggcctcctggactgtgttgggagttcagggctcattgggatcgcctcttactcctgtgtcccctccagctgggtgcgggggcttcgtggaaggggacttagtgctgtcttcacagataaaacaggcctcactcttcctctttacctgccctgggcccctctctaatgatggtgacatcaaaaagaaggtggcagggagtatgcaggtcacaggggcaggtctgtggaggtcaagggtagagatactgcctttagaactgtctggaaggggctgctgggcaaccccatccgggcaggcacaggtggctgggaacagggactcgttgactggcataggggaggtccccaaagttgtggcctggggttggggagggcgccctccctccccgggacagcaggcatcaa

SEQ ID NO: 27058 - DNA, 1709 bp, Bovine  19866881568455
agcctatagagggtgttggggaatttccgttactattgctgtacaagaaactaccccaaaactcggcgacataaaacaataactgcaggacttccctgcagttgtggagttgtggagaatctgcctgccaatacaagagacaccagttcgatccctggttcaggaggattccacatgccttggggcaactgaaccctcgagccacaactcctgaagcccgagccctagaggctgtgctctgcaacaagagaagccctctcaccgcaacttgagggtaacgctgcttgctgcaactaaagaaagcctgtgcacagcaacgaagacccagtgcagccagaaaaaaaattaaattaaaaactgcattatgctctcaaacgctttgggtcaggattcagacaggaaccagcaggaatggcttttctctgttccacaacgcctgggaatcaatcggctgggaaggtttgctgggggctgagatccgcttgggggtgagtgcacacatacccccttgggtggatgcccggctgtcggctgggacttcccctctgtggcctccatgtgttgcccgcactctctcacaccatggcagcctcgaggaggtcggcctgtttccctggctgctcaggactgccaggacgagtgatccagtgaccaataaggaagacggaggccttttctgacccagcctcagaagccatgcagtgttgattctgcgtgttagttcaagtgagtcacaagcctgctccaaaatttaccattgttggaggggaagagttttttgattccacacgagactccaaggaatctggactggcttccttctccctccccgcctccacaaacctcaaagtagagaaggaagattgttcccatcactcagaagccagtcgactctcgctgattccttggacctgagtacttaccagctgaaaagatctttccttccttccttctttcattccttcaagacatgtttcctgagcccatgttaaataccaggtcctgttgtcagcagggagattcaacagggactagcaggtggatccctgctctcattgtgttaaaatcccagcaagaaaaagcaggcacagagactaacaaataaataaacaagaccatttcgaacagcaagaagggcatgagaaaaattaagtcagataaaatgaggggccaggtagagtccttgaagttgggtggtcagggcagattcaactctaagtaccagtgtcagtccaggaggacccctagaccctgaggaggaatttgtttttgtttttttttttttctaaaagggatgataagtcactgaggattttaagtcaggagcgaaacccctttgctgggtgctggagctgggggggggtggggtgggtacactcagccccagatccactgagagggtccacgcgtgtgtacacgtgggtgtttgcagagtgaacggtgtaattactgcagctctgtgccctggcttccattaataatgcagtgaatttcagcagcagattaaattctataaaggagtaaatggcccaggaaagtgaagcgaggcccatgctggaggacggtcagtacattatagagctttattagatagaagcccacagcagcgggcagctgagctcttaggaaggtacgcatatgagaaacgcagcgacagcgtcagtcagcttctcagagtcactcggaagagctgggcttgtgccgaagcg

SEQ ID NO: 27059 - DNA, 3845 bp, Bovine  19866880347826
tctcggagcttgtgcagggctggatccctgggcggcaggaagccaaggtgcctccaagctggtgcgggccacggttgtcctgaggctggggtccgtctgctggtgggcaggctgtgtcccaccgcggaaggctggggtccctctgctggcgggagaggctgggtctgcagctacagccgctcactgggaggctgggcttggcctggggactccaggctaacaagctggagcggggattacagaatggtgcttgtggcaggacaggcccccagagggtctgatgccactgtctctgccccagggtgtgttccagctgacatctcctccagaagactgcaggatcggcggtaggtctgcacctttctcagcgttgctttgcccgagacctcaaagcacacacctcctgtaagagcggtgtgtctgtttcccacagcactctgggacgcctgaacgtgagctccactggcctgcaagcccaaaccttctgagggctcatcttcctcgtgcagacccctgctctgcaactgtgatttttctctgaaatgtgccctgcggctttgtctctcccacccatctcatcgtggttccttcttatatctttagttgtagaaactcttttctggtgaatgtgttaagtcactactcagtcatgtctgactctttgcaaccccacagactgtagcccgccaggctcctctgtccatgggattctccaggcaagagtactggagtaggttgccatgccctcccccaggggacttgtgtctcctgcatggcaggcagattctttaccatctgagccaccagggtaggttctggtcttggtcctcaattgctgttctgtaaatagccattatttcggcatgcccgcaaacccctactctgccatgtgggcaactctcatctcacagtgctaagtattttatgctttatgggccatacgacctttgttgtagtcactcacctctgcaccaaagcagccatggaccacacacacaaatgaggacggctgttgtctaatgaaagtttatccacaaaaacgggccgcagcaggcggggggtggggggggtagatttgccactggtaatcatttgcttatatctgatctaaataattctgcatgaatcaatttccaagtctgttaaatgagtaaaataatggtagaaaatttttaaagaaatccaatttcatggtgaggctggcagcacctctcaagccagagttgttttttctgaagagctatgtaacacctgttagctataacaatgcaagggccaaccaaaccatagctttggattcctgaggacacgttgttctctcagactcagcatcacaaaccagtcccagctcaaaagcatcaaaccaacccatctaaagtttcttccaagtcttctgaggaaaaggacacctgtaacatctgaatttagaagttgtgtgtccttggctgatcaactgcctaactctgagctttaccagcctcatccacaaaacagggacaataatacccacaaataagaccactttcccaatgtctcagctggtaaagaatccacctgcagtgcatgagatacaagacacgtgtgttccatccctgggtcaaaaagatcccctggaggaggaaatggcaaacacactcctgtattcttgcccgaaaaaccccttgaacagaggagcctggtgggctacagttcatggggtcacaaagcacaactgagagactaagctcacaacatcacctccaggatgaggggaggagatagacaggtgtacaggatgtaacacagtgcatagaaatggctggacaaatgctagccatcattgatactactcagaaacatgagaaccgagtcagtcaagactcatgagcagactaaaacacagaagactctagtggtggttttaatagcagcaacaactatgaacattagcagtaccttgggactaactgctttgtattacttattcattgaaacaaaacagaaaagaaaaaacctaactctgcacaatattatcatctcagttttatagatgtgaaaatggaggctcaccaacgctggaacctgcccagggactcaggtcgttcggacaggtccctaacagcagttgtaaacggaatcttgcttaactttaacccccctcagtctctgtgtgctcacctgttgccatggcgatgaataccacccagcggccagactgtacactggatgggctggacacgccccctggctgcaggtttcctccaagtccacgtttggtttcttaatattgcggcaccgtcgctcggggagagttatcagcttgccttggaaggccttctcgctgcatttcatctccctcttcctcactcccagaccacagctcacggaacactatggggcaagaaaggaggcgtcagggtgcgggctccaccatccacgtgtaatcagagcgatggggctagggcaggtcagccacagcccaccaggctcctgaaggcagggcctcaagtcccgcaggctacagaagccagaggactggagttactttcccaagggcacagcatggctcagcaccacaaaataaaggcaggcgctgccatgacacggcacacaaggtgagcgagacagagcccgagagaaagacgagaccagcagaggatgaggtcagggtcactgtgtcgtggccggatgtccagggcaggaggcagggcgcagggactgggcctacaggcagttcaggggaagaaccacaggtaacaagcaactgtccttcatctttacctgcctctctcttcagctgggatatacactgaggctgtgttatggcaggagaaaaacaaaaagaggatggaggctgatgaaataagtctgagaaaacctgttttttttttaatgtgactgactgctattttatttaaatatttccttacttccactatacaaattttctttttcaaaaactttaaattttgtattggggtacagctgataagcaacgttgtgatagtttcaggtgaatagcaaagggactcagccatataaacacatgtatccatatgtatacatgtatcccaaactcccctcccacccaggctgccacgaaacaccgagcagagttccctgtgctatacagtaggttcttgttggtcatcggttctcaatacagcagtgtgtacaggtcagtccccaaccccctaactatcacttctccctaggcacccataagctccttctctaagtctgtgagtctgtttcgtaagttcatttgtctttagattccacatagaagggatgtcacaggatattcttctctgacttactcaggactacagtctctaggttcatccatgtggctgcaaatgcattagagaaaacccgtttttaagtattttaaacagtataatgggatactgtacagggccttgatgaactgcataaagcagtaagaaatgacatcagcataaccatcatcaatcatgaaggctggggatcagatcaagacggcagagaggcaggacgtggtgctccccttctcccccgagacgtcaaaactagagttatgtagagaacgagtctcacggagcatctagcaaacgctggcaaaagacctcagacctccgaaagggtaagaaaatctgcacaaaaccaggtgggacaaaagggggggaaaaaaagaggaattgggccaggacctgctcctggggagggcgctgtgaaaggggaaagctttctgtaccccggttcgccccccaccggcagggaggtcaaccaggacccaggggagctctgaagggggcccagcaagcagggtgtagagggcagagcgtagagagacttccgggtgctgccggcctcagacgctcccc

SEQ ID NO: 27060 - DNA, 1471 bp, Bovine  19866880349638
aaacgaagatctggcatctggtcccatcacttctgggaaatagatggggaaacagtgtaaacagtgacagactattttttggggctccaaaatcactgcagatggtgattgcagccatgaaattaaaagatgcttacttcttggaaggaaagtcatgaccaacctagacagcatattaaaaagcagagatattactttgccaacaaaagttcgtctagtcaagggtatggtttttcctgtggtcatgtattggatgtgagagttggactataaagaaaggtgaacactgaagaattgatgtctttgaactgtggtgttgggagaagactcttgagagtcccttggactgcaaggagatccaaccagtccatcctaaaggagaccagtccttgggtgttcattggaaggactgatgctgaggctgaaactccaaaactttggccacctcatgtgaagagttgactgattgggaaaaaccctgatgctaagagggattggggcaggaggagaaggggacgacagaggatgagatggctggatggcatcaccgactcgatgcacatgagttttggtgaactctgggagttgatgatggacagggaggcctggcatactgcgattcatggggtcacaaagagtcggacacgactgagcgactgaactgaactgaaggtataccgtgtgaaaatttgtatatgtgaaatcaccatgcactgaagttgaggaacatatccatcaccttacatagtttactattttgtgtgtggtagaacacataaggtctactgtcttagtaaatttcaagtacaccattattattaatgataatcaacatgctgtacatctctagaattgatcttatatctggaagtttgtatccttcaaccaacatctctttatttttcccactccttagcccctgcaaacacctacatactctgtttttctgtgtgtttgacttatagagagcagaggttatagctgagtcggcaacaaacatagccatggttgacaggagaacatccttttggacatttagttaagagtaagagccattcgttgtatatcatcgcacttcatagttctttagtagaatgcctgtcaggtggtaactgccctttagctgtaggttgaatacccaaatgaatgaagaatatgcttgatctctgataactgtaatttgcactgaaaaatgactcgatctactgatagaaaatcaggaagcagagtgtgaacttcctgaaattctgtgctcagagaaaattttcagttattactgaagagaatccaaaatcccttattaactaattttctaccttttacataggctttcatgcctatggaagtatcaaagctttagtatcgctttagcagtgcttgagcctcaagcagacacgaatggctcttccacttaaccaggaaaatgaagaaggacatgttccagacttctgtccgagaaatgctcctttgg

SEQ ID NO: 27061 - DNA, 1481 bp, Bovine  19866880369384
atattccctggagtaggaaatagcaaacccactccagtattcttgcctggagaatcccatggacggaggagcctggggggctacagtccacggggtcgcaaagagttggacatgactgagcgccttcacttactcacacatcagtatattacttagatattaaatgccaatataaaactctcatagtcctatagttaagactcttgctgttaacattttggtgaatttccttactagagctaatttaatgtattataaaattaatctatattcttggtaagaaacaaaaatgatacaacatgtagaaatcagttgtttcctcaaaccccaggacttaccctccagaattaactactgttgatggtttttagcttaattttccaaatgttttagcatgcttatatttaaagttcagaaagcattccccccacccaccttctagttccccagaaaaaggaagagttgggttctatttaatgcaaagaggctgtgctgagggtcctaatagagaccatgttcagctcagttgaagacctatttctgcagtttgcttatgttcttggtgccattccttctcaatatataggggctccctcatggttcagacagtgaagaatctgcctgtaatgcaggagactaaggttcaatctctgagtggggaatactcagccattcctggagaagggattggctacccactccagtattcttgcctggagaatctcatggacagaggaacacagcatgcgtggcattatgctggtacttagagggctgtgaagaaggtgctgagcaaagtgcatgtgttctgtacaaaaaaagggtgaaagtaacactgtggttgcttcccaggagtgggcattccaagtgatagagtggcagccagtagctgcttttttggaccagaaactggacagcatcactcttagcatattccattggtcaggcaggcgcagaaccagatccgtatctggggaacttagatccacttcttaacaggaagcatgctaatggaatttgaaggtgtgtgtgtgtgagagagagagtcagtcatgtatctctctcagccttccagtggtaagatcgctcacctttctatggggagcttcaccccaccattcattgcgtagaatgctggagggacttcattcagttttagtcattgaccacagggtgggtatatgatctcagtctgaccagcagtcataccatatgcatgtggctgaaatgactgattggacctggagtgagcacgtgcctcgttaggccaattgtattccttcaccaagactataacaacacaaacaaaaacagtgttctccccacttcttctgatgttgctataacagtagtaaaggcctgtgacctttacttcactccttgccacagaaaaagaatttgtctgcagtaggtttggatcccatatgccatacaagtacttgggtgtagcttcccctgggtgtcagtttcctgccttagta

SEQ ID NO: 27062 - DNA, 979 bp, Bovine  19866880514975
ctgcagtcaccatctgcagtgattttggagcccagaaaaatgaagtctgacactgtttccactgtttccccatctatttcccatgaagtgatgggactggatgccatgatcttcgttttctgaatgttgagctttaagctaactttttcactctcctctttcactttcatcaagaggcttcttagttcctcttcactttctgccataagggtggtgtcatctgcatatctgaggtcatcgatattttccccagcaatcttgattacagcttgtgcttcttccagcccagcgtttctcatgatgtactctacatagaagttaaataagcaggatgacaatatacagccttgatgtactccttttcctatttggaaccagtctgttgttccatagtacagtactgtactaaggctgaatatgagtatttcaaaaagtgcatgatgattcccttgacaatgtctaaaaacacgtttgtgtgatgaagagagatttttttcccagcaccacaaaggaaactttcagacaccagctcattaaatttacactgcaaagcttcaaaaaattaatatagccacaataatgtcaatacctattccatccctcagtggctttccatggtccttccaaataaaataaaacaaacatggataagcagagtctatttgttattgatctctctgctccacacttacttagaaatacttttcagaggctctagaagtcagtcaaatgttgctcgagttatgttttaaaatatactagaggtccattttctgttatttctttttgtgtgtgtgtgtgtgtgtgtgtaataaagttttactgaagtataaaggagatagagaaagcttctgacataggcatcataagggggcagaaagagtacctgcctgctagtcttcagctggatgttatatagtcactagcagtctgttaatgaaagaaaggaatgttatttcttttgtcaattttctcagtt

SEQ ID NO: 27063 - DNA, 1136 bp, Bovine  19866880563173
aaaaagccctttaagttatagtgtccaagtttgtccttttgcatatgggaaaagttgaggccagatttttcatggcaggaactagagaagagggttaacctcgataaaaagagaattagatcacttgagtagatttttattccttcattcttttcatatccaaaaatctctaatttcatccccataagttatacttaaagaagagaaacatagagtgaattaaactgagtgagtcaaaagggacaggtaaaacagatatgaactccaaagcattaagagaagactcaagggtttggtactcaccttaggtagagaaaagctcttaaaaaaaaagagaggaaaaaaagcttggagttgtcctcatttgcctctcctttgagccccagtgttctctgttctcaatgcaaaatcctaacttccagagtggggtggtttttctctggagaaagaaaaataaatgcaatggcagaggcttgctaactaagtactgaagatccatattcaacagtaaaactgactttttgaagtagggcatcaagggaattggaaagaggacagagagagaacactaacttttcaaattcaatcctaaatttaagctgtattttcccccctcatttatgtccctgtctcattcctctgcgattttcactatccaagagtggtttcaatagttctcattgtcaaaagagttttgccaatatcgatgtgagttttcagatgttcctgaatgagaagggaagtaggtgtttgtggagctagcgaactccagtactcttgcctggcaaattccatggatggaggagcctggtgggttgcagtccatggggtcgctaggagtcggacacgactgagtgacttcactttcacttttcactttcctgcactggagaaggaaatggcaacccacttcagtgttcttgcctggagaatcccagggacgggggagcctggtgggctgccgtctatggggttgcacagagttggacatgactgaagcgacttggcagcagcagcagcagcagcagcagcagcagcagcagcaaactctagtgccctgtgatatcaaatgtacaaatggtgtgcaggcaggggtgtttgctgctggcttcctagcaacagtgacatacctctga

SEQ ID NO: 27064 - DNA, 1783 bp, Bovine  19866880623874
caccacccttatggcagaaagtgaagaggagctgaagagcctcttgacgaaagtgaaagagaagagtgaaaaagttggcttaaagctcaacatttataaaactaagatcatggcatctggtgccatcacttcatggcaaatagatggggaaacaatggaaatagtgacagattttattttcttgggctccaaaatcactgcagatggtgactgcagccatgaaattaaaagatgcttgctccttggaagaaaagctatgaccaacctagacagtatgttaaaaagcagagacattactttaccaacaaaggtctatctagtcaaagctatggtttttccagtagtcatgtatggatgtgagagttggactataaagaaagctgagagctgaagaattgatgcttttgaactatggtgttggagaagactcttgagaatcccttggactgcaaggagatccaaccagtcaaaggaaatcagtcctgtttcctaaaggaaattagtcctgaatatcattggaaggactgatgttgaagctgaaactccaatactttggccacctgatgcgaagagctgactcatttgaaaagaccctgacgctgggaaagattgagggcaggaggagaaggggatgatagaggatgagctggttgtatggcatcaccaactcgatggacatgagtttgagcaagctccaggaactggtgatggacaggcagcctggcaagctgcagtctaatgggatcagacacgactgagcgactgaactgattgactgaccccaatatggccccttgtgtcaggcaaagaagcaatgctcttcttttctacttcaccaaaaaccgtctccaagattcagtttggtacagaggctagatctcagttataggaaggggcccaaagtgatgtatgtttattggatctttacctgaatgacaacagagtactaaacacacatgtaagcattttttaatggtcggtgaaatttgtaatccagaagtatttcagatgctaagtagatcatgttgtcacataatgctcgatatttccaatgaagaaatagctgccagataggaagaaaatactctcttaagtgtgtatacacatgcatacataataacatacacacacacactatagtgtgtaacccccaaattttgaaaatgtactgattacttacagttaagatgtagtaatttcacacttttacactttctttataaaaccctacattttaaagaaatgtgtctagataaaggatgcacgtgtcataggaagccaaagataggagacttctcactgaaaaaggaaatttcagagatcattttcatctgtttagtgtctgtaaggtattttaaaacattttaaaattcatgggaataatcaacattcagaagaattacatctttggcaatgcgaactatgttgggaggatttagagcctttgcaaactgccacttgagcacattacttatgaactctttgctctttaaaattgagaacaaagcaattaaatacaaatttcacacattcagaaagagcaagaacatgcctgccgtctattgtaaattccagagtgtattctatcacttaaatttatagttcctttgtggggcgattttccttttattcaaaagactgttcaaaaatgaatcttcttattttgttcattgaaaaggagcaatgcataccaattttgttcttaagaaaataagtttaaataggtgcctttgtaaaaataactgtgagcctaatatttaaagaatgtgatatacattgggca

SEQ ID NO: 27065 - DNA, 2007 bp, Bovine  19866880804872
ttggaatgacgttaccaaggagttggccaccatgatttctctcgatctttaggactcagtaaagtatggctagtcctgaaggatgcgtggcttatagtgcttttgctctatccaacacacctcgtaactcagcactaaaaaggccctgctccagaatttaacagacagaccagcacagaagcacacacgcaagcaccaagcttttaggtgtccggggaacaagatcacgtactcatttccctatccaaactgctgctttgagaagttttccaaatgcacagcctgacaaagattattaaagtggttctttttaagatgcctttttaattgcaaaatgataatatcccatcatctctgcctcgttgagattagggaaatatttagaatgtgtttgcgtgtcctaagagaatgactggtacataattgcaaattattaccacttctgcaggtcatgctgacaagattatctcccagcaggctgacaatcagaaatctgcttctaatctggcggtttttcacagctggtaacctttttctttattcttggatagaatggaaatgagtgttgtatgccttctcctctcgctttcatggaccatttatcatatcaaaggcccattcgtctgcacaccagcctaaccaaattaggtaaacagagttcgagaaggaactgacagctgttagcgagacgagtaatcacaaaacacaaagctcatggcagcagctgccacataaacacagttttcaaaattatggcagctcggaggcagtttcaggagagaatcttcagaggactgttagtgcactcaaaatgcttcatttgcaatggaggcttgaattccccattccttaatagggtagaaaaagccctgtaagatctggtctggctcatctctctgagcgtaccaactctctgccctccccctccacgcctgcagcaccctggtcttcctttgggtcctccaacgctccgagctccttccaccccaggacctgggtgcgtgcatccctcctttgacagaagcgtagcacgagcacacagacgaagcagacacctgcaagttcattcgttcaggcagcacttgctgagcagctaagtctaaaaggccttgagccaaaggatatcaagatacagagcggaatgagacactgattcctaagttcagccctcagcacacagacactgcgcttctgtataagaaatcatgaaacgggacttgcctcgtggtccagtggttaagactccacgatcccaacacaaggggtctgggttggatccgtgatcagggaaataggatcctgcatggcacgaacatcttgccaccttgccctcgacttctggtacaatctcctccctgtcccatttgtaaaattcgtgttctccaactgtccttagttttagtatcaagcaaatcatcttagaccactctgtaataggcagagtatacatcaccaataaaggacatctaacggaatgtatacactcatatatatgcacacgtatgtgtatgttatggagaagggtatggcaaccccctccagtattcttgcctggagaatcccacagacagaggagcctggcgggctacagtgcatgtggctgcaaaagagctggacatgactgagtgaccaagcacatgtatgtattaagtagcaatcaaatggacacaaaaatagacctaaaaagtctaaaaactgtgttcaataaggagcaaaatgccatagagtggatatggacatcagaatgaaatggtttatattcacatcctagcccatctctacctgccctgagatgctccgttgcttatctgctctctgtctccgtacactcataccaaaaagaaaaagaaaagcgtctgtacatcagaaggtggttacagaattaatcaagcccatcaatgtaaagcactgaatgcactttcctacaatgcctcacacacaggccttcaaacataagtggttgctggtgacgcccatgtgttgctactggcctcatccttcagttgg

SEQ ID NO: 27066 - DNA, 1103 bp, Bovine  19866880818818
tctgcagtgattttggagcccaagaaaataaagtctctcactgtttccattgtttccccatctatttgccatgaagtgatgggacaagatgtcatgatcttggtttcctgaatgttgagttttaagccaactttttcactctcctctttcactttcatgaagaggctctttagttcttcttcactttctgccctaagggtggtgtcatcggcatatctgacattattgatatttctcccagcactcttgattccaaaatgttgtataaatagctttaaaatgttcagtgaggtttctggaattccaggatctgacctgcgtcttgatctctgatttgtatcttatactgtccagattctcatgcaaggcaaaaacccaggaatagcttggaagtatgcacttcccaaggtcacgaatggaactctgccagcctcaaaaagacacagctacgcctggagcacagtgcagacagattgctccgtctcctgtgggggaggtaggtttcccaattctgtcttccatgtcttttcttaaaacaggttctcccactccagacctctttcaattgtctggttgaaatacgcaacaaaagaactatctttatgagaactgtcactatttagagggaaaaaatcaaatattatttgtactctttggggattttcctatgtattaatagaaaggaaccagctcaagcaaatctcaagtcaactacaaccaggacttgaaagtgatgcatctgaaacttccaggggggaaaaatataaacacgtgtccctttattataaatatgaggattgatgggttgatatgtctgccgagagttttctttctttctgtcctggcttttctgttgttaactttccagggggagttagagaaggtaagcgatagacagtgaaaacacacgccagacgggcttaaggctgcgagctaacacgtgaaggaggggtagtctatcccccgaggggtgatgtcagcagaatctctgcaggcaagtggattcaatctgagaaataaccctcgtaaggaaggaagagtcacagccatcccctcagtgagtagaatggaggcattttatttagacctaagaatatcacata

SEQ ID NO: 27067 - DNA, 1024 bp, Bovine  19866880900345
ggctggctgggagggaagatgctacacctccccacagacttctaccaaaagggtcttaccagatttaatccctccataacctgtcaacaataattccttccttggaaggctgtagtgaggatcttttgggaaaaaaaaaagaaaaaaactatgccaaatgtctgggtcgtggtcagcactcagccaccagtcttttcttcagcttttctccactgtatttcttgtaaggaatgtctagtcaacagtcttgcccactggggttttagtcctccttcaaattgatttccacacaaaatgtaggacgttggtaactcgctctgcagcctgtcctttcaaccttccatttgcatgaaaattactacatcaaataatgtcatcctgcagaaaaaccacaactgtgaaatcaagcaaaccctgcaaaagtggccaaatcagaggatctgccaaacgccaccactaccaattagaagccggggtgatttgggacaacatctttaaaaaagaacaagaagtctttcttccaaagagtaccacgaaagttctcctttcatacagagaacagagggtatcaaggttgaacgtattcttccccacttttcagtacagctgagtgctgagggctgatctggcgagtactaactttcagtgggtgcttcacggttttctttagggctctacatttcctgacttctccaatctaatgtaaagtaccccttctctcttatctttatcaagtacaatatttggaactatcaagctcaccgctgcaaggagactttggttgataaggacagttagatcttgcagctccaaccctgtcctaagatttatattttgtataggagtcccagtgccaccacccccagtggccttgggtagtgttgaaccagaagaaatgactcccattttagcttaaatgtgggcaaaagaccctttctttttacgctataacttaactaagactttgtcaacatggtcacatccaacttgctaaaagggaaaccaaccccaaagtcaagactgc

SEQ ID NO: 27068 - DNA, 2285 bp, Bovine  19866880917398
acatgactgtgcgacttttcacttttttgtcctttataagtgctaccatatacttctctttctgacttacttcacttagtatgataatttctaggtccatccatataaactgcaaatggcattatttcactcttttttatggctgaatagtattccactgtgtatatacatcacatcttctttgtcaattcatctgtcgatggacatttagatcgcttccatgtcttggctattgtaaggagtgctgctgtgaacatggaaggtgcaagtatctttttgaattaaagtttttccctgatatatggccagaggtgggattgctggatcatatagcaaatctatttttaatgttttaagggcctccacactcttcttcatagtggctgccccagtttacattcccactagaattgcaggcaggttcccttttcaaaggagaatgcattttgatcgctcagccccgtgtgccccaggcatctttccttgtcagatctaaacacatattttgtgtccatgatccattttcattagccctgctggtggccacagcaaatttgctaagttccttgttaacctagggttgataacggctttgcctgtcccccatctccctagacagttgccatccatgttttcatccagagaaaggaatggtgggcgttttggtcccctggcatgctcctaagggagtcacctttggtcaaaagggaccttttccatcactgtctcaaagcattccttggaggagaactcctgtttaatctgcggagggtggtttgcactgcagggtgatgagctgtatggagtaggtagaatgtttgtggagggaggctttgtgggaggagtcatggtccgaaatgtgcagatgggcccggtgttgtccattggcaggagctccacagtgtgaggtcgaggtgacacagagcaaccttttcagatggactctccatccttcaaaatgaaatctgtcttcagagctaggctagtagagaatcagatggtctggtcatttgtctgggattaaagtcagaccccaggaaggtgggaagtttctggccatgggggtgacgagagctgcggatggagaaagcaattagaaaggagcgacacagtcacaccctcatggggcacaaaagggggacctctgggaatggatttctgggcaaccgtgacttttcatgaagagcagtcagatggtagttgtgctttgaaacacacaactgttgaccaagccagttgtgaaaggactcggagctgagcagatggattctaacaacttattcatccacttgtcacggctgtgctgactgttgtccagctggcctccgacagcatgagtctcctccaaagtgacaggcaagggctgcattttctctgcctcagtagatgtttccctcctcccaggtctaaaagggcaggtcttctgaagcccctgtagactctctccctctcgccctctctcggtctttctctgtccccctcctcccctccctgtgaaagtgtaagcttctctcatgaagagttcaaccataaatgcccaccctgaacagagggtgcaaaatttaaatatggagaaaagtagcattcaccaaaatcaagtattaatttcttgaaaatccttccattaaagcaaaaaccagaaaatgcttatctgctgacttgatatcaactactgtttaaaaagcacacatcaaagttcccttgtaatttcagggtttggaaatgaaaggggaaaagaagttgctgggggaaatgtgttagagtttactgagccccatatatctggaaaacagtttgagatccttggccaaacttagagttctggctgggtgttcatacccctgctattgacagctaatttcttgagcaaatttattcactgtttttgaaaaaaaaaaacaaaatctggctgcctggagccacctcagatgtgcagcctgttcagaaattcccgagtccaactttcttaagcatttctgttttcttcttagctctcaaagaacattctagcaacatgactgattatttgtctgtgacctttcactaatggggcactcacatggaggagccctgctactttctgaagataaggcaaaatgctttatctctaatacagccttatattttaaaaaaaatttttttagtgtaagaaggaaaaaaaaaagtgtaacgtcttgattttgacagaatttaactgcttgtctcaggagagaatgtctatgtgcgctgaaaacttagaatcttgagcttgaatctaatatcatttgtaaaaacccagtcattat

SEQ ID NO: 27069 - DNA, 2056 bp, Bovine  19866881044649
ccccggcagtgttcacagagaccagatggctggtacatggtccagaccgcttgctctcacattcttggcctcgtgcgcaacccaagggctccctccacacctcctccctctttatttcacgtcatttactgctttttccccttagtttcagatatgagccacaagttaaagactttgcaaaagactagaatctctgacatttgggggatctggtgtttattaaattgggagatttaaactgactgtgatttgttcttaatttagagctgctgctgctaaattgcttcagtcatgtccaactctgtgtgaccccatagatggcagcccaccatgctcccccgtccctgggattctccaggcaagaacactggagtgggttgccattttcttctccaaggcatgaaagtgaaaagtgaaagtgaagtcactcagtcgtgtccaactcttcacgactccatggactgcagcctaccaggctcctccgtccatgggattttccaggcaagagtactggagtggggtgccatcgtaatttagagcagtgacagacaaatgcctgaagtgtgtgtgtgtgtttgtagagcatccaggatccaggcacacttgggggagtaaacagcttaaaaatccagggagccatgcggctgattcatgtcaatgtatggcaaaaccactataatattataaagtaattagccttcaattaaaataaataaattaaaaaaaaaaatccagggagccataagttggaggagaagaaacctcaacacacatttgaactctatgggtggctggccacagcacaggggcccccatggtcctgatgcggccacagctgtgggctcacgtctggagactcctgctggactaaaatgcctttcaagagtgagtgagtggattgtttcaatctgctgatctctggaaagaccctgagtctgcctcaggggagacagacggctgggccacaccccctccccctgggccctgggcctctcccgaccatgctggtaataatcacctggccttctcaaggtgcttcagatcacttacacccactgtgtgccaggcactgctaaatactttataaaaatctcttaatcttcacaacctctgagctgggtaatatcctagagtaaaacgaatttcacagatggaaggaatcacagctcagaaatgttaattgcctgagaccctggcaggtggtgtaaggtgggcttttaacattaggcttatctgactcccaaatctgtattctcctcctaccccagtcatcacgtttactcggtctttaccctcaggctaaacgctgtgggtaagctatgaatatagacgtaaagtctgcccaccaggatatctgtctgtctcaaaacagtacactatttacttatcttttgagtcagctagtattcaaggaagaacatccaaggattcaaacgtgcatgggatcaaggagctgcctgtctgcgtgtggagctttacatagactgggaggaggggcccacggagtcaacgaagcaacaaggaaatacagtaaacagctgcagatgctaataagtgctgctgctgctgctgctaagtcgcttcagtcatgtccgactctgtgcgaccccatagatggcagcccaccagacttccccgcccctgggattctccaggcaagaacactggaatgcgttgccattgccttctccaatgcatgaaagtgaaaggtgaaagtgaagtcgctcagtcgtgtccgactcttagcgaccccatggactgcagcctaccaggctcctctgtccatggattttccaggcaagagtactggagtggggtgccaataagtgttaggaaggacctaatcaggctgccacagtggagaccagccgctgacaccgtcccacaaggaaacacatcactttataaggtaacaagcttcacacctccggaagtatttaatcagaggctgggggacccacaaatgatccttccactgagggaagccacagaaggttgggggaaagagagagacgtcaactcgattcctggtgatgctcttttcaaccaggggcaa

SEQ ID NO: 27070 - DNA, 1192 bp, Bovine  19866881123490
actcattgatcaccgagttgacggtgtggggcatcatggtcagtccccttctcataaagctccttcctcatgaccctgctgtctgcaccccttcccccacggggcaggggccgagatgagcaaagatgtgcctcaggatagaatcagtgtcggggagagagattagccaaggagtggggacagagtgaagacacggctcacgaaagaggccaagaagcagtggaggactaattgagaccagatgacggggaaccccaggctctggaggacgagtcagacgtgctcccgagatgccgcatcacttctccccaggttgccattcgctgtttgaagtgtgggcctccagttaatttgcggcaaatacttctgtgacaggttggagcgcgctctttctctcccctaaactcctaggaatgtggatgagttgaattagaattgtagtctcggttcaatgtgtcagcccacacctttgaagccgcctcgtagatggacttccaaggccccagttggggtctttgtggtgctgcgtcctgtcaaatccgactcactcacacctaatcccagagatgatacctgctcatgttcttcgggctttgaagcaaacaagaagctggggacaactggctgatttttcacatcacgaggcttcccagaaaatcacaggatcatacagaatcattgaactcacaacacaaaaacgattcctcctctgacttagtcaacgtgtaatgtactgtaaaatccatcctttatcagaaggggtccatctgtaaagtgggttgaatttcagctgttaaaatggtatttaaaacaaacatttctgtaaatgaagggggaaatggattgaggatattaaaaatcacaaatccttaaatcaagaggagcctggtaggctgcagtccatggggtcgctaagagtcagacacgacagagcgacttcactttcacttttcactttcatgcattggagaaggaaatggcaacccactccaatattcttgcctggagaatcccagggatgggctgccatcatggggtcgtacagagtcagacacgactgaagtgacttagcagcagcagcagcagcatgttcaagaagggacattttcaggttggaacccgatagcgaaatgtatatgttagagcatgttattggatcccagtgacaatatcttttcagtgttccttcagt

SEQ ID NO: 27071 - DNA, 598 bp, Bovine  19866881214345
tctgaagagaaccgagttaattacaatgcgcattatgtttaacttctcaaaaggtttcttataatataaacaaaatatgatcatagataaacattcttccttgtctctcaggcacatctaattatggcattgcaaaaatgaaaggtaaaaaaacagcacagggttatttaatatgcaacttgaatcagggcttgcattgtttggaaataaaattgaaagcaacaaagaaattgaatatagattatattagagaatgaaggcttttctgtagcatttgcttctgactaatatccatatatgtaaaagcaaaactagtggacaagtaagcatatttttaagcaaactctagttcagtattctagcattgtatttaatttggctttaagggttgtttttcttttgttttccctcctgggataagattagctgggaacttggcacagtttttgtggtttgaagtcttatccttgtggtggtggtgtttttttttttttttttttttacatattactgcagtgggctttccattttattttatttttttttttttccatcaggaggaaattaaaaacaagcaaacaaaacaatctgggaaata

SEQ ID NO: 27072 - DNA, 874 bp, Bovine  19866881215050
cgcgcgttatcgttttaacattaatcatgatgattcctcgttaatagtagctgtgtggaaaatccagttccctgaaaatctcccataatgaaaaagaatatttctggtaggttaaggtcataatgtagaattatgtgtctgatattatatcaataattcaaatacttttaaagaaaagataaaagtgataaatagacctaaaaagcagtatacaagttaaactcatttcaagagatcccctcatctcaagatgacagggtacaccagttgacatttataaaatactggccaacatgattttttaaaatatgtgaaccagtcactcatgtaacaagagtttattaattaaattcactgttttcggcattggtaaacacgggactgcaaacaatgtccaggacagtgattgccctcaaggagatagcaattaatcatggagacagtgtttttacccagaaaaaaggttgagaacagtttagggcactaattaattatagtcaacttttcatagtaaccagggaagtcagtcaagtcaagtgatgggatttggctagaagtgaaaatgtattttttttccaacatcatttcttgaaaagactgtcttttccccattgaatatttttttttcctgatctgaaagtgttctcttttttaatttttatttttaattagagaataattactttacagtgttgtgatggtttctgccaaacgtcaacatgaattggccataggtacataagtgtcccttcctcttaaatctcctgctccatcccacccctctagattgtcacaaagcattgactttgggttccccacatcatatagcaaattcccactggctctctgttttacatgtggtaatgtatatgtt

SEQ ID NO: 27073 - DNA, 894 bp, Bovine  19866881264232
tggctaacctatgagaaagttgctaatactttcatatttcagaaaaataactttcagtactttgtgtaagttacatcttacgtctctgaacagaactgtggtcccagttctgttcagagatgaccaacaaacccttggactcaagcctgagttaatcaaagggaaggactatccttggtctacgagaaaagattcattcccatctcttcatttgttaaatattgaatttattgtctggacagcctatgataaaaccttggctaatcgcctcggagttgattaatttttcgtgtactttgggtgttattcacttggcacttaatatacagagatatgcttttgccaagaacatatgtggaagattcaggcaacacctgattcctttctcagctatggtttggcagatcctgatgtgtgaaattgttgtatttcaaggaatacacactagttttctagaggtgtcttcaattcagttcagttcagttcagttgctcagttgggagataaaaaatgcaacaccgaaatctgttttcccctgtcccctcttcatgggtcctagaagttcattttggactttgctgctgaattatattctgccagtccctctctctagcaatgaactatctgtgcaagtttcaggtcagcgtgcagaggtaataagtcatttttcctactgcttttcttggattcccccagcaggctaagcgacaggaatttcccctgaatgcataatttacagtcttctcactgatgatggatttacagtttcgtggtgaaaatgaagccctcatcccagctaccaactgcttggcaattacacttttggaaaaagacatgtatttaaaattacattaagcttatttttcaacctagcttgagtttcacaaattacaa

SEQ ID NO: 27074 - DNA, 664 bp, Bovine  19866881299367
taaggtaattcttaactagtacagataagactttttcatagtcatacaaaaattgaatttaaacattataattgctagtctttcagtgttttaagagctgcattatgatccaggtagctgatgtagccaactttgcttaactctaccactagggcatgaaacagcacaaacagggatatattctgatactagtttaaaaatgcaaaatgtaaaagtgtatcagtgattacaaaacatgctggtctgaaatgaagcttcatggatctgtcttctcacagcaaagaaaagatcaaacatatttttgaaaagtggaaactttccttgatagggaagaagataatgatcacatagagaaaagcaggtatcttccttcagggcttgtgaaaacaatgctgagatctgaaaattcattagtgtacttttctacaacctttgaattttcgtagaaactaggaaagatgccactagactagaaatatccatgtgttctaaaggggagactatctattgaagtcatgtcccaaaagtgaagaagtggctcaatctttttaaagggaagtaatctctaaagaaccaggtgcctccctttagaccgatgagtatttacaaatatatgttgattctatagcagcctgtttttgtaccaaaataactctacatacat

SEQ ID NO: 27075 - DNA, 3283 bp, Bovine  19866881314474
acccagggatcaaacccggcatctcttgtgtctatagcttgccaggcagacttttaccaccgtgccacctgggcagcacctctgtgaatgttaccagagcacaattcagtgtctgtctgggttggatctaagtggcacccacaatactgctttcttgagggacaatgacacactatatcatagccattaaatatgaatgttccgtaacagtgttttttaaaccattttgactaaaagccatattaaaaaattagcatacacaacccatgcattttataacctgcctcagtgtatgcacacatacatatccacactgcaaaattttatgaaccatagttcctagatatcagtagtctggtattgtctctttatgctagttttatgctactctgtaatatttcctttctcactagtgtttgttataataattaaattgattcatgacccactaattgatcacaactcggaagtctgaaaaaggtattttctctaggaaaccagaattttttttctcaaattggtgagccaggcaatgtttttctaaactagcatacataactgacatataacattatgttagtttcaggtatacaacataatgatgtgatatatgtatatattgcaaaatgctcagcaccatacatctggttaatgtccatcgccacatgcagctacgttttctctcttgtgatgacatcttttaagatttactctgggatttccctggtggtccggtggctaagacactgcgctcccaatgcatggggcctgggtttgatccctggtcagggaactagatcccacgtacagcaactaagatacaaacactgcaagtaaagatcctgcagctgtaaccaaatgatcctacatgctgcaactaagacctggcacagccaaataaatgatttgtttttaaaaaaagatttactctgttagcaacattcaaagacatgatatatattattaactacagtcaaccatgctgtacaatcctatcccaggcttttttttttttttttccatttcactgattctgcaaatgtggtgagcacgagaattttgaaactgtcgatgtcaaggattccagtctcagaggttctaattcagtagatctaaagtggggaatatggaattttagccaaccaatcaataaaaaaggaatccttttggtttgctttcattgtgaggaagcttcaagataggagacgaatagacctgtcttgttcaatacaatagctgttaccggcacttgtaaagtagccggtctgaactgaacatgcagtaactgtaaaatgcaaacttgattttgaagacctgtgtgtaaaataaaaataaagtatctcattaatcattttggtattggttatattttgcaataacatttttgatatactggattaaataaaatagactaccaacacaaatctcacccatttcttttgctttctttttaacatgagtactagaaaatttgaaatgacacatgttgacttgcattatattctaccaaacagcactgtgccagagcagagatggaattccacgcatcaaaaaaagaaagaaatagaagatttcatgggggagaaaaacccacttctgctgtcatcaactcaaaataaaaaatccactgcagactaaaattagattcatcaaaataaatatcttcaaagacacaaatgaacggcatatgaatgtggaaccatataatccatcaataagcagtcctggtttacaacatcgtcccacatgtcatcgtcccaacaaatcactgagaagtggtttcacagtgtgaagtcatcctctaagccagctgtggaggctctgtctccctcccactgctcactgacaggcatttaatgcgctcacttgtactggctgcttgaaagccatgtgcagtcacggttggcagacacggaaaggtgtgtagcaacaagacagctgaagataaagtagtgaatcaacaagctagatgatgcacccaacacgcactgtaaagaacacatactggcagctctagagacaatcagactctgtgcatcgggcattgcacacaatgaacgctgaccacgaagggtgtagggcaagctgcccagtgccctggcctgtcagctactgcacgctgaatgcctggttgccttacacttgttttctccaggagtctatgagctcttcatagaaagtgtccagaatttgttcatccctatcgtagttaagactttcagttcaaagtgagaagttaaattagattaactgaaaaaaagaaaaaaaagggggtggggagttatggctcatggaaaggccaagatactttcatttcaggcataactggacgtcaaaggctgtgatgaccttattctaggtgtcaagacggctgccactccagagttagagggcatcctcttcgctttccccaggtgtcccagaattaattttattggctctgatgctgttagatgcccctgagccaatcattgcagtcaaggacagctgatgttctgattggaaaacagagtcacctccatccagttccaaggtgcaggtaaggaaggttcatccccagggaaaacttcagcgttcttaccaaaagactggggaaagggatgctgggcagataaaaaagtacaggtggccagtgctgttatctgtatctctaatctgatatataaaggataaaaagatatataagttatgagtgttatcaatgaatgcacacatgcataatatctaattcatgatgtatgtcaaacatggaaatgatgtatgtatttctaaatcaccaggatattaagtacacacattcatgtaatgagtggtcatcaagtgtctactattagccagagactattctagccactggagacacagctgtgcagcagcagagatgaagctacaggcttatggaacccagatttaagaggggaaggcagaaatgcacagtaataaacaagtcagtcaggtagtgataaagaggaggaatgaaaataaagcaaggtcaggggatgtcgcgtgatggagtgtcagggaggagctttctgcaataatggcctctgcacagagaaccgatgtgccaggaagtggtaaaagcaactgggtgactgtctgggtgaagaacatacaaagtgcaggcacaggagagggggcctctgggaatgctgaaagggcctggacatcagaagggctggggaacagacgatgggaggagagactggacctcagcccaaggttgccagactacacagggccttgcagaccatggtaagacacttgattacaccccatgggt

SEQ ID NO: 27076 - DNA, 1545 bp, Bovine  19866881316743
ctccagtgtttttgcctggagaatcccagggacggggaagcctggcgggctgctgtctatggggtcacacagagtcggacacgactgaagtgacttagccatgcatagcatagcatacatataaccttgttctgtattttccaagtctcctgtaaatgtgttaccatattttcataatttaaaaaattaaaaaaaaaaagagagatcaagggttaaggattgagagggtgagaaagaagtcaatggaggaagatcaagagggccaccactttctgcttggcctcctgggtctttcacaagctactgacattacacccaggtcttgaagactgagtaaggacgatgcatatggaaatgagaaggacggccagagctgaagagaacggtccctcaacaagttccatgtaatgggagaaaagctcttttcagatgacttagacatgtagctagattctgaagtcatcataaaccttgtaattcagttactctggacaatacacttaaaaactgtgatactcagaatactctgctgagaaaggaagagttgacaagatgccccctcaggccccagctagaactcactctgtgggctgcctggtcctaggtcctgtctcaatcagaaagaactggcagctcatcaagacagctacaaggaatctcatcaaactcaactgagaagaactatgaaactggatgtggggggctgttacaaaacaagggaaaacagcagcacttgaacaaagagaaaatacatgacttctaaaaactacagagatagaaacttttgaagatgaacacaatcccctgtgaagttctctgacaattagtcgtgttaagttgccaaggcacattgtaagtgtgagtccacagctgccccatctcagtgccagggagtgttatttttactcttacagtttcggcaagactcctaattattgaaactgccaatgtcaccttaattacagttttatttaatggtcacattgggcactgctacatggtggaacttttttaaaccaaaatacagcagaggagtggagacagagaattcagctcccaacagattattattcaggtcattgcaggggagtaagcttaagagaagatggcaaaagcttcaatgcaaaggtaatattgaaatttaaatctggcgtgggttgtttcaaaggttagaaagaaatggcacattttcaaaatgtaagtttatattgaacgcttttctagccaggcattactggaaatcataatcgttgatacattatttctcagaacagagaactctattagagatacaaccaaactgtgtgggaaacttcttacatgagctgatgatttgcacatttcctgaaagcccacagtatgacagcactaggcaaactccaggagcctgtaatttcacagtggcagcgagtgacaaagacgtacattaactgcacataaacagctgggtgctgaacagtctgaaaaagtgcaagtgactcagagtaatagctaggtgtcatcagatcaaaagcaaggtttcctgttgcaatgcaaatcgtccaa

SEQ ID NO: 27077 - DNA, 693 bp, Bovine  19866881343238
aaaaattaccataagacgtgctttataaaatcaaaacttattttgttgagaaatcttgcttctgcatgtaggacagattaaagctggagaagccagagtagcaacaaaggcagaaacagggccatcgctgttagctgggaatcagctagatgtacgactgggacacaggagggaaacagtagtcacagaagaactggatgaagggatcaatgagtaaagctgatgataccgtacaggaccctcgggggcttctgggaacaaggcctctgtccctcatttctgattataggaaacggccttcattcagctccaggaccttctctaagttccaataggcagattcaagcagttgttaattagggaaggaaggaacagacggacgaaagagaaacaaacagtcaagggcagccttggggcaaggtcctatttccccatcagtggatacacacaacaataatttttagctattttacagatgctgaaatcccctccaggtgggagaagttctggtatgctggccacaagcatgtagaccccagaccacttaaacttcaaggctggcaacactgactccattttgaccaccaacccatgagaagaatgtccacaagttgatcacgccctcttttactataaaacttgtcactatcttccccaagtggggacacttggttttgagggcattaatctgct

SEQ ID NO: 27078 - DNA, 2398 bp, Bovine  19866881358856
ccgactctttgtgacctcgtgaactgcggcacgccaggcatccctgtccttcaccatctcctggagtttgctcaaactcatgtccattgagttggtgatgccatctaaccatctcatcctctgtcgtccccttttcctcctgctttcagtctttcctaccatcagggtctttcctggtgagttagctctttgcatcaggtggccaaagtactggagcttcagcttcagcatcagtccttctaatgaatattcaggatttacttcccttaggattgactgggttgatttccttgcagtccaagggactctcaagagtcttctccaacaccacagttcaaaagcatcaattcttcagcactcagctttctttatagtccaactctcacatccatacatgactactggaaaaaccatagatttgactaggcagacctttgttggcaaagtaatgtctctgctttttaatatgctggtctgggtttgtcatagcttttcttccaaggagcaagcatcttttaatttcatggctgcagtcaccatctgcagtgatttggggacccaagaaaataaaatttgtcactgtttccattgtttccccatctacttgccatgaagtggtatataccatgaagttatacccccagtaaaaattattttaaaaagaatttgacattgggaggaataaacagaaactttctagtatctaaatcacagctactttgtaatctgctaaatttactacatcacatttcaacttctagcaactctcgcagggacttagagtccagctgtgttgatgagcttgtaagtttttcaggcatttcctggttccgtgtccacaggtctttgtgtgctttccatcctgaaatgctgcgtggccatgaggacaagtatttctcttttttattattactgttgttaaagattcagctcaaatattacctccgttttccccccaaggaaacttaaacttcgctttccctgagctctgttttcaccctttatgccaccttcacagacttgtgatactaatattttaactgtctgtgtatgtctcttgcctcagtagatagagtatctgcaatgcctggcatatacctgacgtattaacagatactcagtaactgcttattggatttacaatgataatcaaaggccacatatttcttgtggctgttccacatagcatgtgggatcttcgttccctgaacagggatcgaacctgtgtcctctttattgggagcacgaagtcttaacccctgggccaccaaggacatctgatcaaagcccacatactgttagcactcccgttttcagaacatggacaattttgcctctatctctttctcatcattcctcaaggaagcaggagtagcttctcttgaggagccaaagatgactctggggcttggggcttgtgcagctgataggatgggggtgtcataagtgagctgtggaacatggaacagatttggggggacagctggggaattgtgttttggttgtattaaatttgagatgcttgataaagttggattggcagagacctttaacctttgtgcatctcatacttcccttaaaggggcatccaatcattagaaacagtaggagaaggtgggcacccagggaccagatggaacaatggacagcgctgagactccttaaaaatcacatccaggcaacacaaggcctttggggtctccatgcttattttctttttcccttaaattatgacttaagactaaggaattatagataaggaaaagttagaagaataggctgaaaaaataaaaagaggtaagaacaagaaagaaaaaagtgcaaactctgatttctgtttcttttgaaagaaagcttgctctgaaggctctggggtcgtcagaacacgtcgttggctataattacacttgacttctgtgctccaccacaaaagaaataacatgtttgcacagccagtcgtatttcactctggaatccctgtgtttctgtgttttgcttgattttcctggtctcctccagctgccccttttccttggccctgtggcttggcgttggccacggattggggcctccgttgctttggtccactctggggccattttggtggctgccacattggctctgtgtgtgtgttatggcttgacctgggctgtaagagagaaagcagtttaattctgaaagcctttctcgctgcagctttgtttccatggtgacctcccatccctctgtttcgttttgatagagacgggttttttccaccttaactggtccctcttggattcagggtgacccagatgggaatgcacggagatggtaaacttcattcgtctagttggaaggctgcctcacgctttctactaatgtcagtgacagggtccatttccatgggaaacgtttc

SEQ ID NO: 27079 - DNA, 1749 bp, Bovine  19866881388117
ctttggcgttgtcggggcctgtccttccaagtgacccggcagggtctccaagtgtgaatcggacaggtctgaagggacgtgtgagaacgctgtggtctggaacggctgcagcggtgctgcccagggacagcataatctatgcgagtaggttttcaatctgcggagaatatgctttatacttcttctctatcttccaaagttcagagaaaggaagcaagtgttgctcaagaaacagtaattgattattcttgtgggtattcatctcattttttaattggacatttattgaaccgtatctttttcaaggacatgttagagtgtgtcacagataaaaccccaaaatatagcacatgcgtgggaattgtgaacctggtcagtagttctgatgttttgttacttgctggttagaggaactttttcaaatgggaattatatgtgtctgttgtctcagaagatataaaaagacaatggaaatacacattgtttgtttcaacacgatgaaactagaaaagaattctcaacaagaaaacattgcccaaaggcaagaagctgaaagaacaatagtgactaatacactaataaaataaatctaaacctaaatggtttctcttatgtttaaacaaaaggacaataataattctgctctgaaagaatatccctggggagttacacatgaaaatatttttttcctaggcagtatttggcctttcctattctgtcatcttatttttgaaacagtttaatatctggtaacatctgctctgtctgcatggtctgtacttcatactcagaacttgtggcagcatataagaacactttgccactgttgtgaaggattctattatttattgactgcatttataactttctatttttcacaacatcagggtcttccctgatgccgagaaaggagaagagggcggcagaggatgagatggttagagagcatcaccaattcaatggacatgaacttgagcaaactccaggaggtagtggaggaaagggaagactggaatgctgcagtccatagggttgcagagtcagacatgacttagcaattgaacagcaacaaaattcttcccaaagaaacaaaatccattaaaataaacataagaaattggggcaaggaaaagaaaggaaactgaggaatgaatccatatgataactctgtggattaatatatttatcatggctgatcttccagtttgactgagtttcctagcagcaaaagcaaaacaaacccaagcaaaaattttaaatatgcaaggttcccagtaacagaaagttagaatgaatacaattttataaggggtttctaccatcacttcatatttttctcttattctcatattttgtcactccatatttttataaaggattctactatcacttcatattttttctcttactccataataaatgctttttaatcgcaatgaaatccaacagcagagaactattactaaggttctaaggtggtagttctcaaactcgagcaagcattggaaattcctagaaggtctatgaaaacagattttggggccccattctcagagtttctgagccaagggggcctgagaatctgtgttactaacaagttacacaaattttactaaccctgaagtcaaaggtacaactctgaagtttccagtgtgctcagttcatgcggtcagaaaatgtcctagagtctgatgtacgacttcaattcacagattagagtttagagctcctaagggaatcaatacataa

SEQ ID NO: 27080 - DNA, 1901 bp, Bovine  19866881400117
agctgtgagcagcgtgtgactacgtagttgggcagggcggctgggtggtacccaggagcagaggaagtgggtgatcactagcagtcgtgaaagacagtgtctagcacttgaattggtttcggggatttggtattactgaaatatcctttttaaggaacatctatttggcgtgaatttgtaatactagtggtattaaggatagtgatgatatttgtagtggccatgacacatacttgatatgaaatataaaagctaatctttaaagcagctttatgattagatatgatcctcatttcatggataaggaaactgaaactcagagtcatttatcaaaatggccaattgaggttttaaattgagctctaaatgatttgatcatttcatttttctctgtggagtgctgacttcactataatgactgtaccagttgttatagtattaaatggatctgtagtacatacagtcctgagctttccaaatgcatttttccttcccagcaacccttgaatctgtcactgtccattaactaaagggatggtgcctaatctaacaggtactttgaggtctctgctcagacactggccaatatccatgccagcaccttatctattacaaagcatttaatagaattttaaatatgacttctgactattctgtttccacagcaactaaattaatattgggtcaaagagtcctattgaccacttattttgtactatattaaagttggtgttgatgaaacaggaacgtgggcagcattctacaggatacatatttgtaaactttagttaaaaaataatatacaacctgtatatagaaaaaaaggagaagggggcagcagaggatgagatggttggatagcatcaccaactcaatgggcatgacattgagcaaattctgggagatagtgaaggacagggaagcctggcctgctgtaacctatggagttgccaagagtcagacatgacttagcgactgaacaagaacagcagcaatacaaagtgtgataatgaattcagaagcaaaggaaaatgtctgtgtctgcagtttctaagcaataaaataaaatgagcattttatgtttttaaagattcttcccacaatactgatttttcttgacccactcttccagctagaattgtagcttcttttctttgactctttggagagcacttttgagttactcaatccatttgtctgtccatccattgcaccttctactgagagtctctcttgaccacagattagatccaaagtctcagaacaggtgcagtggcatcatctgtcaggagatgagtaaagtgcttgttgcgtggtctccctcctccccttgttgagatgtctgtctgtctccccgctgagctctgctgacggcccttccaaatgctcttctgttccctgtagacgcccctaagcctcccacagaggacacctatctcaggtttgatgaatatgggagctcgggacggcccagaaggtcagctggcaagtcacagaagggcctcaacgtggaaacccttgtggtagcagacaagaagatggtggagaagcatggcaaggccaatgtcaccacgtacattctcacggtcatgaacatggtacggagacagtcaggaccccagccctctgcctccctgagacagctcagagtcatggagttcccgtgcgtgagttaaacagcagatgcagccacgtgattgtattgaaagaaattaagttggaaggaaattgccttcctacataaatatatttggtcaaatcaatgcatacttgctcatattcccttgcagttttggaaattaaaaaatttttttttttttttttttgcttttctctgatttcaatttgtttcaacaggtttccagcctctttaaagatgggaccattggaagtgatataaa

SEQ ID NO: 27081 - DNA, 679 bp, Bovine  19866881455524
cttcttggcatcacatttaacaagccagaggcctggaatctaagctcacaccaatagagagacaaaatcttagatcatcttctctaaccgttgccaactcctactataaaaaactaaatcagcatttcttagagtagctagttttgaaagacataggatgaattgttctctagggcctgtttaagaatttggaaaaaatataaggcaatttaaaaagcaataagccattttactcagcagtctggccatctaaaaatgcattcagctccagctctcaattttgtctcctgcatctttgatcttcatctctaagaaataacattgtgatgcttctctccaaatgaatatgttactggaagtgtccatagtgggaaagaataaattggaaaatgcatataagcttctttgtagacttcctggtggctggttagtttaacttgcacacttgaaaaaccatttacctgtatccaaaaccttagtgcaagaaaatatgcagtaagtttctgctcttagtaaggcgtaaaattacaaaatgtactaatacttataatccaagaataactgttagcattaaaaatttaatttgatatttaatttggtgttaatttcattttatgactacaaacactgtttctcagtcataatactctccatttccaattaaacattgatttataat

SEQ ID NO: 27082 - DNA, 1222 bp, Bovine  19866881474784
taggaggaaagaggagaggaaactgagttcaggaatagtgatgggggttgctgtgaagtgagtgaagccccaggtggtttttggaatggggattatgttatccagttttttgtttttaaaacatcttttgagatggcttatctggggaaaaactgcaagtgatgagtccggttgatagctatggtagtaattgaggccaggtgtgttggtggcttgaaataggctatttcccatgaaggtagtggtaaattatactcagtggtaggttttatttaggcgacatcacagacaggacctgcagacagaccgaatatgagaagtgatgagagatgactgatttccagagactgcccaagtatgtgatagttaaatgatatgactaggttatgaatgattaaatattggccatctagatagaaagtgttgtgatcctgtgatgattctgagcttgtgatgagctctgggcaagtgaaggcaggaccaccatgctccgtctcccccaggtcgctcaggaaactgaagtatagcagagagtcaggaggccagcgctcttgaacacgtagttgaagagcttcagcaccttacaacagatgtgcaaatgtcagatactgtttttgacttactggaagatttttctatcccctttctatgatttcttttcccaaagttgtaggcagatgtgagtttggcagttgctatagaaatggaaatatcataagacatgctgaactactcaatgactagatttatctttgaaatgtatttttttctacattctttcctcctaattaattacagctttgaacatttgggtaacagataaattgacaggaggttttgcccccctctgactgaaatgatcataatatagtgagtagttctgcaaattgggtgaccccagactgtgataaatagttctttgtgaaacagatagaagtatttcaagataccttgacagcatttgaggccatgtcagtggcatgatgccagtgaagagagctaataacaaaggtttttgttggacagaaaatataagaaagtaactttaaaaagtgagagatccatgttcaaggtaatataaaatactgtcaatttgcctggtggtatttacagttaagtctttgtgaccagaaaattcaggtatgggtgagacatacttttatggtgtcttttttatttacgtatttttagtttgtacaaagtcaaagtgttcaatcttttt

SEQ ID NO: 27083 - DNA, 802 bp, Bovine  19866881638649
ctgttcttgttacttaaatatttgataggaaaacacttggaaataaatggcttccacaggggaaaaggttgcaccatttgcccaagaaggaagggggtcatgaatggttaactttgctgctccatctttttaaaacatatcaaatcataaggtactgatttcacatatgtaggaaatcttttataaaagtctgactctttaataggaatgctatactcagttttattgtttctgttttaattcaatatgaatgctatggttgacttctttaaaaaaatctcaccctcagatctaaaactatatgtagcaaatgagttaaatctgcagtacttaatatgtactgtcaaaaaattcattttggagaactgtaaactcttctgctctgaactttcgctgaatcccctgctccctgacactaaagatcctaacctgttctctttatattccttcttggagtcaacaatcccaagaacagaacatgaagtgtgaagacagaccaaacaacaaaggaaaagaaccccatgacacgtggtccaagtgtgataagtagcatcttaaataggtgtccaacaggaagcagtaacctggtgatttcactttcgtaaacacaaatgcacacacagacacacaaacacacagattatataacctggaaactgtcaggaagtacacatagcagattggtaatagtcattttttctgggggttggaactagaagcagggaagaaatcgattttgttcctttgcatttttcaataatttctacatttaaacaataacaaagaaaacaaaaggaagata

SEQ ID NO: 27084 - DNA, 719 bp, Bovine  19866881764635
ggggcccccttcgccttcgattccttccgcattattgaactaacaagtatggatacccaggcagctgtagctcctggtgaagcttatgtaatcagagctggctttcccagtgagggcctcaaactattaaaggtttgtaacagattaactgaatctgatgagcagaggtgaaagtgtttgcttcatatgtcctttttgtttgaatacacatttaggagtgttagcgtttctaatagcagggggcttcctataaacatcccatttatattcaagctccaaatatagctctggccaaatttattgaccagtatttggaatgaatatgtcatcgaactctggttcggctgctcacagttgaaaagccaataattccagaggcatgtgtcagtgggaaggaaagttgctttcatcagaaaagccggccatctggggagaagatggactcctgtcctgagtgagaccaactgcccagctcagccatgaaagtttttaaagggaaaaatccaaggagtaggtggagaatctcaggcaatgatcaggagaggaagtgggattctgcattctcgtgcatggtgtgcagactggctgagtctctcctcaggcgttaatctcgccctagtgatctgcctgcaggattgctaaggggtctgaagcaagtcattttttaattacgtgattctttggttttactgctttttgtcttgggaaaggagccacag

SEQ ID NO: 27085 - DNA, 828 bp, Bovine  19866881997020
ttgaattaactttcatccccatacttctgtccataataccctaagatatttgacattgattatcaacatcaattttggtttgatgccacctgttatgcaccatgggacttaagcatgccttttctcttctctctttcccttttttcctaagctcatgtgaattcccataccttctgacatgtaggaacactatgatacaacaaaatatttccaaaaagaaaaaatcagtctttgagtttccccattcttctgttcatgggaagcaatctcccttgcttgtaacgactcaccagtggtcagaaaactaaacctggggccccttcaatcaccatcggctctctttatggcagaagcatgagatatggcagaaaagcttcagcccttctgccaagagatcactttcatttttggacagttatgatttcttaggaaatgcttccctgtataggtatgaacttgcatctctgtgatttttaatcattgttctttggtcttttatgtccacctgagttaaaactattctcttccagctgactgctcttctactgtgtgaagacatccgtctccctcccagtccccagctcctctcttttccaaagagttctcataaggcttacctgtgagacctcacacctggtcatcctcatgtgatgagcatcactctgagagggcagcctgcacgacccctcttggcatgtctaatggacatattacactagtgaaagtgggaagtgaagccactcagtcgtgtcccactctttgcgaccccatggactgtagcctatcaggttcctccgtccatggaattttccaggcaagagtgctgga

SEQ ID NO: 27086 - DNA, 3225 bp, Bovine  19866880097095
catccggtcccatgacttctgggaaatagatggggaaacagtggaaacagtatcagactttatttttctgggctccaaaatcactacagatggtgactgcagccatgaaattaaaagacgcttactccttggaaggaaagttatgaccaacctagataacatattcaaaagcagagacatcactttgccaacaaagattcgtctagtcaaggctgtggtttttcctgtggtcatgtatggatgtgagagttggactgtgaagaaggctgagtgctgaagaattgatgcttttgagctgtggtgatgcttgagagtcccttggactgcaaggagatccagccagtccattctgaaggagatcagccctggaatttctttggagggaatgatgctaaagctgaatctccggtactttggccacctcatgcgaagagttgactcgctggaaaagactctgatgctcggagggttggggagcaggaggagaaggggacgacagaggatgagatggctggattggcatcgctgactcgatggacgtgagtctgagtgaactccagaagttggtgatggacagggagcctggagtgctgtgattcatggggtcgcaaagagttggacgcgactgagcgactgatctgatctgaatatgtaatgtatcagtggaaaaacaaaatgtcgaagttaactgaataagaaatgcagaggaagaaatcctcatatagtttgatgtgacttgaaatttactgacaaacttttaaaacgtcaaaaccacaggcaccagtgacagccaactttaaccaacctccagatgactgaaagtgacttattagagaggaacgccagatcctctagattctcacatgcaaatattgtgaagaaagtttaggtagaattctggtttaggtattaaaaagagaaagcttagattgatagatgaatggtattttttagttagttttaaaataaattagtacatgtactgtagtgcttacatttttaacttgaaacgtcttgatgtgaaagtgaaagtcactcagttgtgttagactcttttcgaccccgtggagtgtatagtccattgaattctgcaggccggaatactggagagggtagcctttcccttctccaggggatcttcccaacccagggatcgaacccaggtctcccgcattgcgggtggattctttaccagctgagccataagggaagcccaagactactggcgtgggtagcctatcccttctccaggggatcttcccaacccaggagtcgaaccggggtctcctgcattgcaggtagattctttaccaactgaactatgagggaagcctgaaatgtcttagagtgtgtcttataatcagtggtttcttagactcaagaaatttagttatagtgctccccctctttcatgctcttgtctctgccatccagttgatctctggaaactcactacctgtcattttacaatccagttcccctaaacagtttcctgccctataaatgtaacatgctctctcaactctttatacctgtggcacatcctctgcttggcgttgttgtttgttcagtcactcagttgtgtctgactctttgcgaccccgtggatgctacacagcaggtttccctgtccatcactatctcccagaggttgctcagattcgtgcccattgagtcgatggtaccattcaaccgtctcatctcctgtcacccccttctcctcctgccttcaatctttcccagcatcagggtcctttccaatgagttggtactgtgcatcaggtaacgacagcattggagcttcagcttcagcatcagtccttccgatgactattcagggttgatttccttcaggattgacctgctctgttctttagccattgaatgcaattttcctggcataattctcagtagtttaagactcagctctggcgtcacttctctaaaaaattttccctgactgtgtaccgcctccatattgtaccctgtgcttatctctggcactgcacttagagtgcaaatcttatatttttactcatatcaattcaacaacacacaaacaaaagcaaacatatttttcatgcagcatggcccctaaatggaagccaaattcttcatctggtgcttcactgaagaatctctgatctgtttccgtactgggggtgtgtgattgcactgtgtgatgggtttactgagttattgcagtttgttgtatagagttgctgggctcaatttgcaaaaagcagaactcattctacatattttaagcaggataaactataattcacggaatccagctcatacatattcatcagagtgctggagaccattgctaaatttttcagaaaaaattccagaatactgctacctggcctgtcaggagtgctgctgcctctctcagagcaggcatgtggaattaggagtgacccgtacctgctgctgttcgggggtcagggagccagcactaacccaatcgcacctacctctggacccccacagagcatgatatgggcactgggacatggctgcggaaaacccagataccccaggactgtgcctctgagtaggaggaagactggatggtgttcacttgcggattcaatctcatgcaaagaattgaaggacttatccagtttgcactggaaacctggtggcaaggggttctggaccaagtagttttatctgttctactggtgcaggtcggggggtgctctagaaagctgaactgaatgcttatatctaattccctacatccgccataacccggtgtgctgtgtatctcgagcaaggtagagacctttcttgggtaactttgtttatacattaaaaccaacatctcacatgattgtaaatccacgatctgttctaagacaatggcctctttgtcttagaagtagacttccagctctgaacagtgaccgcgctctactcatctttggaacacagtggccagtactgtgacttgtcaaatgaatgaggaatgtatgcatcaattaactggtgaataaaaaaaaaaaaaaaaaacaaaccctgtgtccctttgtcctttttttgatttagccagtagttcctctgacttttctttactgtctgagccacaagggaagcccctttgactttttctaatccaatggttctcaatcaggggcaattttgcctttcccgggggacatttaaagatgtctagagacatttttgagtataactattttttagggaggagtg

SEQ ID NO: 27087 - DNA, 1166 bp, Bovine  19866880220650
actctgccttcagatgggtatatcttttcttttctcctttgcctttcacttctcttcttttctcagctatttgtaaatccctctcagacaaccattttgcctttttgcatttcttcttcttggggatggtcttgatcaatgcctcctgtaaaatgtcaacaaacctctgtccatagttcttcaggcactctgtctatcagatctaatcccttgaatctatttgtcacttccgctgtatagtcataaaggatttgatttaggtcatacctgaatggtacagtcatggaaaactaatcaaactgatcacatgcaccacagccttgtctgactcaatgaaactatgagccatgtgtgtagggccacccaagatggacaggtcatggtggagagttctatttaacctttctttagtggatcagaaaaattaggaaacataaaatttatttttaagtataatattattacatttttaaataatatgctcagtatatttaaagcaataggtctatttgttatctagagaatgtcaaaaaaaaactctggaagtggaggaaaacatactgtacatattatacttttttcggattaccatcattttaaaatttagaaatatttagtataaaaagatgtctggaagttgaagaaaaaatattgagcatattgtctgaaactgtaactaaaatactgtttaaatataagtacaccctgtttcctgaatttcagacccctggtgggcgcagcacctaacactatgcctagtgcctgatatacaatatgtctaatgtattctaaactgaacagagcaaccagctgaaatatccattggtccagcgacttccagttctagctcattatagctcctgcttctgtctctccttttagtgagctcttatcagcttcagtcactttgtcagtcacactcctccatttgttctccctttcagctagcatcagtgctttgggctgaattgtaattatttacatgctttggacatctgttatggagaggagttcccaaactcttccccattgatgacagtacatgttattaaggggtagagacaattgatgggagcagtagagcaaataaagccctccacatcagctagtggaccattcattcatttattcaacaaatattcttccaacatgtgcgatctgctagg

SEQ ID NO: 27088 - DNA, 1593 bp, Bovine  19866880345871
tttttaaaggttctcatagaaccctcccaagtccttgcattctacaggtctctccctccctttatccccaataatcaacattcttcactcttagcagttcacacattctaaattctggaacaaaattacctaaaagctaccagaccccttagaagcaaaacacccacaagcagaaattggagcaagaataatccttctcttacagtcaggaattttaacttgaggtacctcttatggtgcccataaatgcctgtggaggcaagggagaggatgcaggtctgtgaattacctaaaactatatgcaaaattgtatgtatatgctgtttcctaagaaagcatgccaagctttcataggattagtaaacaaatactggagtcaaaaaaaagttaagatctttgttttattaggttttaagcagttatgtggggcttacctggtggctcagtcagtaaagaatctccctgcaatacaggagacctgggttcgatctctgggttgggaagatctcctggaggagggcttggcaacccactccagtattcttgcctggagaatccccatggacagaagagcctggcaggctgcagttcatggggttgcaaagagtcagacacaactgagcaactaagcacagaacaacacaagcagctatgtcactttctcaatcataaaagttagcctgggtgtccatttttatttcagctctactttttaacaataaagaatgtgattttcagaaatatcttattttttctttttaagtgccattgaaaattttaaatgtgaagtccagtggaggtcatgataaagatttctacctattttaatatgtaaattgcccaagggcttaaactagcttgctatcactttgtgctacattgtggaggagcaacttgggcacataaatagaatgagtggtaattaattctcacaagttatagtgagaatcatagccattagtgtcaaaagctaaagctgaaaattattgaaatatgtgtctaatagaactgccttatcactctctgtttctgtcatttgatacttacattacattcagaccaccaaaaacagacctcaattttcaagaaagaaatggctagaaaaaccaaaaaaatcccataaattctcagtcttatagttgaaactgttagttgttcagccgtgtccagctatttgtgacacaatggactgtagcctccaagttcctctgtccatggcattctccaagcgagaacactggagtgggtagacatgcctttctccagggatcttcctgacccagggatcaaacctgggtctcctgcattgcaggcagattacttaccatctgagctaccagggaaacattgccaaatacctttcccactctagctggcatgcagaaacagctgcagaagcaatacacatttcttggttggggtggggggagccttcaataaatatctaaaacaatggctaagtactttcccctttagatcacagttgcaaatacctagatagagaaggaagagaaaacaaccttcagttctataatcgccttctggcattttctattctgtgtgcaatcagagtgtgtaaggagaaataataca

SEQ ID NO: 27089 - DNA, 1874 bp, Bovine  19866880363703
cccaactttctgctttcctgtggcatttatgttcttcaccataaaatcacccaaattcctagtcttcaacaggtctagcataacacatttgccctttttagtttctaaatgaacatgggtgttttttttaatccatttattacatggtcagggcataattatcacattgacaagaatctgatgtacaaaacaaagccgatgggagcctcttcctcatttattctccacacagctaaacatgtatttattgatcacatgctgagctatgcactgtggcagttaggtgcccagccttacctctcatttcatcaccatctctgctgcctccattccgctggcaggcaggtgtcgtcctgtctccccacacctgccctgtgcttcctcagctctcccaggcctgcacactgtaccccacacacccattctcacttcctatgcaagtccctctgaactctcatttctaaggagctattgttatttgctcagctcctgtctctctccttcctgagcaccatttttgaccgctcacatttaatgtctgtgccatattttttgaaacgtgactgtaaaacaaccatcgttttcccatataatacatgtataatgactccatatgaattcctcccagcgaccctggagggtaaaaaacatgccagatgccttttttcaggatctgtcagagcaaacgtccctgtgctagacaggagtacctgaggaagtgaacacagaaacaatacccttctgctttcacattatgctttttctttgcattgttttgctaagaggcataagagacacaaggcttgaaaggaaaacatgcagagaaggaaaaataagaacccagagggttgctcgggaggagagggaagagagaagagaaacagaaaactgacaaggagatgtaataaaatgaaatccaagtcacttccaaacagctgtcaacactgaagacatttttttcgtagctttatcccattctctggtcaatgactatcattatgctctcaaaacaatatcatagcaccttcccctcactagtactcttttcctttcatacctggtctgctaattaacctcaattctgaactgatccaatcatttttctttcccagtctatccccaggttgctggctattcccagggtctgacactactacaaaaagtttccagtctcaggttgatcctcagtgctcattcataatctttacttgtcttagtcttatccaatcccacagggcccacagattaataaattattggttccttcccaaactacattgataatgaggagaatagttatttatatatatatatacacgcataaaacatttacatatatataaaatgcttgtatatattttgcttcctatgtgccagaacatcatgtgaaatgccaggctggatgaaccacaagtaggaatcaagattgctgggagaaacatcaacaacctcagatacgcagatgatagcactctaatggcataaagtaaagaggaactaaaagaccttcttgataacagtgaaagcttaaaactcaacattcagaaaactaagatcatggcatccagtcccaccactttatggcaaacagaaggggaaaaagtggaaacagtgacagacttttattttcttgggctccaaaataactgtggatggtgactacagccatgaaatttaaagatgcctgctccttggaaggaaagctatgacaaacctagatagtgtattgaaaagcagagatagcattttgctgaaaaaggcccacacaatcaaagctacggtttctccagtggtcatgtttggatgtgagagttggaccataaagaaagctgagtgctgaagaattgatgcttttgaactacagtgttgggaga

SEQ ID NO: 27090 - DNA, 1108 bp, Bovine  19866880410117
tcacttcagtcgtgtccgactctgtgtgaccccatagacggcagcccaccaggctcccccgtccctgggattctcaaggcaagaacactggagtgggttaccatttccttctccaatgcatgacagtgaaaagtgaaagtgaagtcattcagttgtgtccgaccctcagcgaccccacggactgcagccttccaggctcctccttccatgggattttccaggcaagagtcctggagtggggtgccattgcctgctcagttgtgtccaactctttgtgaccccatggactgcagcacaccaggccttcctgtccatcaccaactcccagagcttgttcaaattcatgtccattgagttggtacagtcaaatagaacctctagggaatagctgcacccttgactgcatattacaagcacctggaaagagagcatctcggtagtcagatggtatcagacaccacattccaagcacgtagttaactagtgatttgatgttcaaagttaagaccaacacttagcaatgtgttacaagtaaaaatacacacaagggtatagtccagaccattaaatcagacacactggtggcgggagcaggtcatcagtaattttttaaactcccctagtgattccaatgtatacccaagttgaagacccactgatgtaggcagtagagcttgagtatccgtgttttcagtaggtgacccaagttattcttcctagccaacccatgaaaaacatttgatcctcagcactgaggcatctatcttctattccttggtcagcttcctccaatcccctaagaaaaacaaatgtcaactcttttctctcctctctctctctttttttttttatgtcaagaatctcattctcatttagctaaacttacctcacaatttgcaagataaaaaggtgttacccatagaacatacaacacagggatggacttacacttttgacctgatgattaaggcccttcagtagttctgtgatgaagctgtgagccaaagaaatagttttgaaaaataagacagatatggattagactgaagaggaaccatttttttcagttacaaagccaatggccttgtaaattattgggaaaaaaaat

SEQ ID NO: 27091 - DNA, 1485 bp, Bovine  19866880430156
aacctaaggagaatacttaataagaccttttcactttcatattcccacatttcttctcccccgcccccaacaccccaccccttatcacttcccagctgtctccagattttagctataaggtcagagttaagcctttaggaatgtgtctctctataggcagaaacctgattccatctgaaaaaaactcttggtagaccttgggaaaactgcagttgctatcccatgtacagagagagcttttgcagtcattggactttaaatgcctgtttgttggcctgccaaaaggttacagctccctggagaactgagccagttccctctaaacccctcccactgactcatatgtttgtctggctgcagctgctaaaaaagatgagaatttaaaagctgctacacaagtgcaaaagcaataaccagaacagtggcaatatcctcaggtcttgaaaagaaaatatttactgagaaaggcaaaaggtgagggaagggacattagcaagaaaacagtggaatatagaacagataaagatgagaagaacaggaaggaaatcacgggttctcagggctggaatttattctgctctgtgaccttgctaaaggcagtctcatggatttattttctttcccctgtggttaaattttctttgacccagatttacatggaagttgatatttgataacttgtccactatcacaacattataatcattttcttcagcaatgctcagagaactttaaaagttgtttgttatttctatcctagcaatattgcagtgagataggacagaaggtcatttcctacataaagtaaagattccttaactctcaagtcattgtaacaaatccatgtttcattcagtagagtccagggaaatattggtaaaccagcactactgtcttctaggactctgactccattctgcagtctcggctctccctacccccttccatattcacctcctttcattctcaagttttcccatctctctgatcaaacaggaaagtgatctaacaagcattgatctaaagagtggagaaacgaaagtgctgccattctcagcaattcttccaccttcaaaaagagacaaaaggaaaggatgatgttcatcactgagtaattgctaataatggaactttttagtcctaagtgtgagagttaattggagataggaagactttgctgaaagcccttaaatcacactgttgagacatattaaagatatagtccttttaaaaaaatctaaacctttttcccgatgcctattatgtcacaaatcctgcacaacacatttgatccaatagtagtaacactgcaaataaaccccatgcccataggttagaaatgtcatctttactgtgcttggtacagaaatctcttccttaccagaatgtgtctcctccatagtctttcttcatctgttatcaaaagtggggtttttctttctcaaggcagaatcagcctaagagagtacttgagaatttcactaa

SEQ ID NO: 27092 - DNA, 1416 bp, Bovine  19866880481861
tcactcattacaaaatataatcccaaacatcttattcaccaggagagtgataaaatcaaggaaaccctggaaaaccaaactgttcaggaatactggcaacagaataagagaatgccaaataaatctgaattgatattaaatatttttaaaatttagtatagtgcataatttggtacacaactaaatagtctatgtctttataaagtggtggggggaggaagagggagggcaactgagggtgttaatattttttattcgttgtttatttagacaactataagaggagagaaaattctttacaagaaacttttatcaaattcactgagacaaaaatgtttttaggcctagattatacagctaatggtcctggtttttccactggagtttacaaggatagaaactgtatgtctaactgccagcatctctgtggatttatgtaaatctttggttataatacacttttcatttatccttctctatttttacgtctgagataattctaatagtggtcagatacttgggatgttaaaacctatttggatatatgaaccacagcaactattacagcacctctctaaccagaagtccacttgagttggtttacactgccctctacagccttgagtcattctttctgaaaaataactgtatttttgaaatacagaaggacaacagaacaaggggccaagagatattcttttttttttttttttaattagggtatagttgctttacaatgttctgcagagatattcttaagcactcagttttcatctctgaatcacattaataatgttgacttgataactgaatttttaaacactgtcaaccatctttttacccatttttactcattaagctcccaatgaggaattttctttatttcaacaaataattactgcgggcttattatcatgtatgatattgtgctaagtgttagaataaccaaaatatttatggtgtgatcctttattcttcaaaatttccaaagagcagcctaagttttaacagatgattattaaagatacatatgtatttgaaatgacatttcttaaaagatcaatctaaagatgctatattacaaagaagagtgaaataacctatactcaattacaatttaatataatgttatcttgggagtaaaagaatggtgggtttgaatctggagtcctctattaggactatgtgatcatggataagttacttaactctccagatctcaattttctcatttataaaacagagatgtttgtaattcctaccaccagtttttggcaagattaagtgacatatccttgaaaccatactgccttatcataatgagtgttcaatcaatgatacctattaagttctttttattacccacatgtattttccaaaccaaaagtggggatagataagctgaaaaactgctag

SEQ ID NO: 27093 - DNA, 1448 bp, Bovine  19866880538115
tccacatagcacatccataagaatactggaagtttttgttacatcaaagctgctagacctgcaggagaacttcttgacccacctggtgtagcacactgggacggtctacatttgatacaactatgacaagattctgttcccctcaacgtggccaggcaaggacctgctgccaccagcagagagcagcttcttccgttcactccagagtgctgctcaaatagccactgttccatgtgtgcacagaagtttgggaaattatgaatttggggaactgcagaagttacctggtacttgtatcattgcatgtctcaaagactaattcccaaagaaaaggaaagaaaatattgactgcaactagagcatcttatgtaaaagaatgaagattcctggggctatttgaacccttccttcatcttttaccttaaagtcactttgaaatgctaagtgaaagaagtcagacacaaaagatcatataatatatgattccatttgtgtgaaatgtccagaaaagacaaatctatacaaacagaaagtagattagtggttgcctagggccgggggtaggaacagaccaactgcaaatgggcatcaggaatctttgggggatgatgaaatgttctaaaattggactgtgctgatggctgagggctgaacaactctgcaaataattgaatggtacacttaaaatgactgaagttcacaatatttaaaccatatatcaataaagctcttaagaaacactctgaagtaatattaaacaatttataattttatccatattacttagatttctcaacagaaatatatatgttataaaaaagaggttgcaacattgatatcctttttttcattaaaaaaagaagttgtattttaaaggagaaaaaaagtatttaatcttgaatatgcacagaaaatgactcagaggaaatacaaggaatgtgggttttagtggatgagattaaagtttcttcgcagggaaatttttacttctaacttcatgtatttttgtatcattgtatatttttataggaaaatattccctttgtttaaaaaaatacaaattacccttaatgtctatgtctttctttgagtctaaaacacatttgtcaccaaggttctcagaacatgagttatctataattaaatgcatcagttccagaataaaatggtaaagtatttgctggttctggaaaaaatgtgattaaagatttaatgcatattttttcagcaaaactgccctgtaataatgtttacagagtgtgctatgtgttgtattgatgatatgcagacaattttaggtcagagtttggcaagtttttctaaaagagtcaaataatgaatatgctagtcattttgggccagtctgtcttggtctcaactgctctgctgttacaggtaaaagcagccatagacaattcataaatgaatagacttgactatgtctgttg

SEQ ID NO: 27094 - DNA, 2690 bp, Bovine  19866880564169
aatattacttctgccatcccacagtaataaattaataactctgggaatttcagcctaagtgggagaagccagtcttagcggttttatgttttaaggcagaactcaaattatgcgtgaaatagtttaatttctgctgattttgaaggttggattatgaaacaccttccaatgtggtggaaatgatccttgaatatattctcaaatctttgatgttttagtttctacattatattctacccccaaattcatcagctgtagcttcacaactttcagcttttttgccttttagctgaaggtgtgaattcacaggggaataactttattgaaacataacagtgaaatgtatcttgactaataaatgtttaaaaggcagaaaaatataaaaattctaatcagagatgcttgaccaaaggctagcacacaacatagaagtttttttgaattattttaaaaagtattcagcttaaaacagtttttcctttttatacagatatctgttaactgtatgacagagaaggtaaaatgaaatgtgtgcatctatgtgggaaggcttaagggtatattaagtctgtaatccagaaaaactattttcaagattgcaatggatgggaacagagaagggacaaactttaaatacaggcaggattacttgtctttttgtatttcatttagctgcactttaattttcttcttcctcttttttttttctcacctttttttttcttaagctaaactggcagtgaaatgctgtctgaataagtcacaactcacaaaaaactgaacagtgcattgtaaaataggacacaaaacaaaagacttcatctaagagctgagatcatcgggctgggaaacacagacccagtgcagcaattcaacagtgtttctcagagcctgagacagtttcacaatttttgatatgctattgccccctgctgttcacagtgaagtactgacaacagaaataggttttcctaacactccagggttttagtgcaatatcatgctatcagagaaagttagacaaagcatttcaaacatttcaaatagaataatttaaggagttgttttctaaaaagctattaaagaaatcccaaagcaccttccctacttcccaatatatcgaaaagaaatgtatgattcagttaattgaatgaatcatgcagtttcctctttaagtttctgaagagagcagagcacaaggcaattgagatagcttggaaaaaagctgatgaagtgagcagagaaaatggagtgcaaaatgtgccaaaggagagggtcatgaataatttacatacaacaggggtgaagcagttcagtcctgaacagatcattcacatttttccaaggatgttggataaaactgttttgtctccacagaagagcatggatgggctatttgtgagccttcaggtcttctgccccttgttcttgggtttggtcatggaaacttaaaaccattagggtatgaatttgggtccctgaagcagagcagaaggacagaatccttggagccgatttcctgatttactctgtcatttctaaaggggtcaggtctatctcctggatggaagtcggtccatgtgcagatgtgtgtgtttgagcatgggagatcatgttatttgtttcagaactgtagcaactgtgggctgctagaataatctgtattccagctcttccatgggattaggtaataaggtgctgccaggatcccctcacattcagtaaaagcactttaaaaagtaagggccttgtttcagcatttgatttttgctcagactctttctccatgaggaacatgactagagaagaatcttttaatatttagaaaatcacatgcatatttatatacaaaattacatcctgttaggataaacctagaaatccagcctgaactactcctcaaagatttagctttggctctagatattgctaagaatgctgtttctaacttctgaagtccctacctcaaatcacaaatggtggattttgagaaaacatttaaatcatttatttcaggtaacaataagctgtttccttaatacttgaggtagttgcattcacagtgttgattttagtgcttatagtattttgtttctctctcttatgtgacattttagtgtttatttactctcttaaatttatattcttcattatgtgctgtgcttagtcgctcagttgtgtccaactctgtgaccccatgggctgtagccctgccaggctcctctgtccacagggattcttcaggcaagaatactggagtgggttgctatgccctcctccaggggatcttccaacctggggattgaacccaggtcttctgcattgcaggtgaattctttactgcctgagccatgaggaaagcctcttcttcattagggcagatgttaaagatagggtgaaaaatatgatagactctgcatttaagctttttatagtaatttagcaaaatgtagaacaacaatatgataatcatataagaaggagcccaagaggtagaaaaataatctccccatcctttttcattttatcattttatttcatttcttctctttactattttattttatttgtattcattttattttttaaaattacaaatcaggaaagctgactatcctttttatgtatctttacacgatccctagtactctagtactttatacaagtgctttatataagtttgcacacat

SEQ ID NO: 27095 - DNA, 1934 bp, Bovine  19866880569736
atgtgtgatcctgtatattgactgtccattaattaattatgattattagtttaagtgacaagtagaagtttccagaaatgtcctagtcaaaaatgcagacatatatttttacatttgtacaatgtatacataaagatgttaaaagaacaataatatggtgtgagactactaacaggcagctgcagaagctagaggctatgaatgcccacaatgcaccataaggcatgctgctgaatttaagaaaggaatccaggttatatccttaggacggtttaaaaccctcggaaaacaggaaaccctcattaaacttttttttttcaacaatataaatcagccctgggaaacaatttaaaaaactgaaaaatttccaaacaggtacttcgcctcaccagatgcactaacagaaaataatcagacagcaagtaatgagtaagggaaaaagtgacatttcaactaaggctgtaatatgcacacaaaaaaacaccagcacaattacctgcactcttttgtaatttcaaaaccatttggtaagtaggtagaaacaagtatcacttacgactagaaaccaattatataaggattttgaaagtagctgaaccttccacgcatggcactggaagtgagacatttcataagagcaactataaacaagacaagttgttgggtggaagagccagttactgtcgccattggagtagcttgggggttggggggggggggcggggcggcacaccttatgagatttagatttcattacttaccacaatggcaaatattgtgaagctaattaagtaactagtaaaggaattcctatatgaaaataagacttccttcctcttaaaagtggccacctgttgggtttatcaattagcagtatttgagaaagtaaacaattatgggacaggctgtatgttacccaaaaacagtaatccaaaaataaactcaagagtttaattataggaggcttatgcaactctctatgaggtttcagattaattgttttatcttagaagcatgactatgaaaggatctaaagctacttaatgggaatcttttactattaattactgttatgagaatgaaaatctccagtagcatttaaaatcatgtagattactggaattgattttaaatttgcaagataagatgctctacatagctaaaattctgtctttaacaatacagttaattcctgaagccttatgtgaccattaattacacaataactatgctaatcatttattctggattcaaatttccctgaagactaagaaatttttatgttccatgttagcttgttaagcaactcaataaaaccacagcaattgaaagaattatttttctacatactgagatgtctaataaaatatctcacttgaaactctgtatttgtcacctgctggtccatcttctcatagaacttaaccaaatgtttgggtggctggggtttttcatgaatcaatattatttgcaagctgtaactctaaagaaatatagttagaattattcctttcaagttaaccacaatgatattgctttgctttccccttacttgctaaatccattatacaatacattttaaatgtacaatgaactcacactaatttaaggttactttagaaacagatcagtatacaatttttgaataaattaagtcacattttggaacatacactccagtcctctggaaagtattcctgtatggaaatacttctcaccaactgctgctcacagtgtttacacgcacgcacacatcacagtacatcctgttccactgccattcgttcctctactggctttgaatactcatgccgtacttactacctacagaaagaagtcaaagcatatcttttgataacctgtgtatattacaaaatttttttaaaaattagtgctggaagggatgcaaatttttgttccaactttctctttct

SEQ ID NO: 27096 - DNA, 1511 bp, Bovine  19866880623066
ctcctcctcacaatctctctccagactccctggataccttaatcgcctcatgttacttgctctgccaataggaccatacttacctggcttgctgccaattcaggttgtctggctccagctaagtcttcatggttaatcttgttattcttttctggttttgtttcttagtatgtaagtttcacaatttctttagtagggggaaagaaaaaaaccctgcctttatttttccaaataaagccttacttgtgccaataaatgaaaccaatcaaagtttctctggttggagtagaaatggggtttgggcccacaggcccataggctcagctcagcgtttctctcccatcccttttaaagtggtccctgagggagctccactgtactcttagggcatctcttagcgaaacaatttaaagctacttcctaacacctacacttaacaatgattattcctgggaactctcaaatgtcaaaagaggctcaggccacttccatatttaaaaaatacagacatgctaaacaggattgcacaaactacgatatagtttaaagatttaaacttaacaggttaacacttttaactcagatacaatattgatggcattttcagtcccagccccaattttccactggctctgacttttcttaacctggcctgtttctcaattctgcagttccacttctactctctcattcaacggtcagttaatgaatgtccactcagtgttaagttcatgcaaggtactgggatcacaaagatgaaaaagacaatctttgcccctcaggcaaatggcaaactaatggggaagagagcccagaagatagtccccagggaaccatgccttctggtattcatgcctttgatagtcctgagccctgtggcttgtaacacaaggcaagtaaatagcacgggaagtgacaaagttagggagtaacatttaagatgacctgcagtttttgatttcttccttttggaatgttcttctttgggagctctgactgcaggatgggctaccttggtggaaagaccttgtggaacaattcatggaaagaaagaagcccaggtgtcccagcatcccagcttgagcccagtcttccagccatctcatccaaggcaccagacagatgagtgaatcatcttggaagttccagcttcgttgagcccaacagttggctgttgtgtgctatgctcagtcttatccaactctttgtgacccctgggtcctgtagcccaccaggcctcctgtccatgggatttttcaggcaagaatcctgcagtgggttgccatttcctccttgaggggatattcctgacccagggatcgaacccacgtctcctgtgtctcctgcattgtaggcatattctctacctgctaagccactggggaagccccgatgcatttgactgtagcccccagctgatatcacatggagctgaagactcacacagctgatccttggcaatccatagaactcatagagatgacaaattagttgtcatttaaaccactatg

SEQ ID NO: 27097 - DNA, 1459 bp, Bovine  19866880628668
tatcatgttcattaatatcccaccaatctcaccagaaaagtctttgagtattggcaagaggccaagctcgtggtggcagataaaattttccaaaattttaattttagcttgcaaaacttgaaatttattaagcttgttagttgtttttcttgaagtgacaggcgtctctacatccatttttttttttttttgcaaaaatgcttgccaaatacccaagtatgaataccatagttggctgccagtttttctttcaaaactatgttccatgaaaaaaacagcttatttgtaactcaaataagtacttttcctggagacagttatatttctgtaagcagcagaagtgctttatgggtacttcacattacatcatgcttaatattaaaaagacatacagaaggttaagatttaataaaatgtaaaattttatgcttcatcaaggatgttctagagctaagctggctttttcttgtatgccttctttttcttcttctctgattgaatggaggtgaaaaatacaatcactattggtagtttagtacttttgccttggcgtgtgctaaggtatcagttttacccaccattggttttgcaatgccatttggaaaattaaaatgacatgataactatgtatgtcaagatatagtcccagcttattaaagaagatattccttcttggatcagtgccggttccaaccctctactaaatcattctttctcctgtttatgtttaaatgcagggccagcttcagcctaggttttggtataaactctgaatttaagcaaaagtagttttagaattttggcttgtcagtgatacctgggatttttactttactgtcctgtctttgaatcccagtttagtaacctttccaaaacttctagaaactttaccaaactcttgctgagaagaaatgttctccaagaggcagactatcaccgaaagtaatttggagtcagaaaaggtagccttcaaagctgtcccatttactttggccaagaccatcttatccatcaagcactacaaatacttagtactatgacatttcaagggccaataagaataagtattcaagaggtagggaaaaaaaaaaaaacaaacctgtgctcagaatatcaaaagatgcaagattgaaaccataaatgtttaattaaatatctccagagtgtactattatatcatcttcattaattgttaagttagtattaaaatttcattacatttggaggcaatttgtacattaggtattcttgctttacagaaattcccaattaaattgcagggactgcttggagcaattactccctccaggttaataacagctaagacttattggatacataccagacattgttctaaatattagcttaattaactgaaatcagagaagtcaaataactttcctttctgctaaaaaatgggcagaggaaatttcaaatccttacagggccactgtttctc

SEQ ID NO: 27098 - DNA, 1438 bp, Bovine  19866880655416
tcctgacctgtgggttcagtctatctgagttgtgcagttgcatgtatattagttatttttatgcctattatataaaagtgttaacctggcagagttctatcatattacttatacaagttttaagttgaaagcgtccaaatgaatgggatttattgtatataaaattacttaattttgaaatcaaaattagtctgaatatcctaattttgtgggttttacccatcagtttctctttttaccatcagtctaatgcagcatttattcacattagctctctctgttcactccaaagaggcagtataaagatcttgtaacttttcctgcagccagaaaatctaattcaccataacagtcacagctgtgtgtgttccctaggctgctgtagacataaccctttaaaacttagtttagttaaagaaaatagcacaaaacaatagggagaaattcagtgttgtagggcctggacccagtcatttctttcttataaagtgactttgttttgggtattttagctttatttgaatcataagcatgtcttactgctgctgctgctgctgagtctcttcagtcgtgtctgactctgtgcgaccccatagatggcagcccaccaggctcccccgtccctgggagtctccaggcaagaacactggaatgggttgccatttccttctccaatgcatgaaagtgaaaagtgaaagtgaagtcgctcagttgtgtccgactcttcgcaaccccatggactgcaagtctaccaggctcctccatccatgggattttccaggcaagagtactggagtggggtgccatcgccttctccggaagcatatcttaggaggtcttgattttactaggcgctgtctcttaggaaatagtgttaggcatttttctgccagtggcatttgcagccaagaagggacaaattaaagatcagtcagtactcacttcacttccttggaccatccacaaatctgcatgattttacatgtggagataaaagtcaaacacttttgaatagatcattctggtggatgtgggctgaagacttgtggatgtagctgtggttcagaagcaattactctgtgaaaatgaatgcagatacaatgcagatgtatataagggaaaaacattctgcatgaaactgcaatcataagttctggcattcttttttaatgtaaaataaattttagattaaataaattcgcactctgtaagatttcaaaattcttgttaagaaacgatggaacacatagtttgtcagggtgtatttagcagttgctttgaatgactgtctcttttgaaaaatattgcaagtaggagtagggtacacaggcagaagagatatgccaacagggagggaactgcaatccacatattacattgttacattcaagactgcctacaaaatctgaagcttgaggcaaacagaaaatgaagaacc

SEQ ID NO: 27099 - DNA, 1312 bp, Bovine  19866880682234
tgacttaggctttgccaacactagggttcctccagttcaggcagcatcttcagtgaaggccttcagcagcaaggagcagccagcagctgtccccaggacccagtcaggctgtttcctagcaggatcccttcagtgagacacttccttgggaacaacttcctgcatcccagagacttctgtcacagcaacttctctgccatttctggctcagacctggagtacaggcgcaaaggagaccttccttgggtatattgtggggttgggtagtgattggtccttacattggctatattcttcagagttctctttacttctttcaagccaatccctccttaatcataagccctgcttctttatataacactttccctgtttacttcactggtttttatctcctggttcaatcctggttgatgaatataccttcatccagtaatttcctctctcctcctcaagattcagttcaggcatcatcattatactcgttcaggtatattgcaatgaatcatacaaaatttctattttttgtaggtcaaaaatagttgaatattggcagtttcagtggttcaaactaatattttctctgtagttctcatcacatacctctgtcagcacttaccccactaattgaaaataacagttttttaaaatatgtcacctactataagacacactcttgggaataatttttagtcttttattcctaatgcctaaatgcctaatccaattcacagtaattactatatgttcagaaaaaatactgttgaactaactgaatactcgcaaatcatttagcctctcaaatcttcaatttcttcctcttctaactggtatcattaacacctgctccatttaactcaaaagttcttaagacagactaaatgagtatttctttctacttccttaacacaactaaaagcagatcatgctactaaatgagtgatttcatgtgggaaaaaaatggaagaattactcttttagtatgattttatttttcaaatattataattaattgtagaattaaagaacacaaaaagcataaaaaaatattcaaaatattactaaccagagatagaactgttaatattttcatgtagttatttctagtacttttccatgaatattttaaaaacaaaaattatgaaaaaactatatgtatatagctttttaccctgttttttccattcaatgtaatgtaagaatatttctagatcattaaacacccttttaaaaacatgtttttattggctattattccatcacatgaataaaccagtaaacatttatcaagttatttggacacattatgttt

SEQ ID NO: 27100 - DNA, 1692 bp, Bovine  19866880721948
atgcctaaaaatttcttaaacctacaatagttttaattaaaacacgaagaactcaatccagatataatttacaatggtatatactcatatagaatataatgagaacggaaatttgttgtataagaatccgtaccagctatctgttcattcatactacccttcatccaaaacaaaagttttaatgattgaaggtttgacccacttgtggatctgcttcagtaaacgcactcactctgtgcaaagcagactaactattttgactttgttgtaagtaataacatccataacagtaagcctttgttctgctgggtaatttgtttcctgatgggtgttaaaaaatatagagatatcagaatgttaaacatatatagctagtaaaacattaaaaggttaacaacattatcttgtgtgcctgtggtgtatatgtggcatgctttgggaaacagtgccttaccctatgggggcttctcaagtggctatagtggtaaagaacccgcctgccagtgcaggagacgcaggagattcgggttcagtccctgggttggtaagattcccctggaggagagcatggcaaccctttccagtattcttgcctggagaattccatggacagagaagcctggcgggctacagttaatagggtcgcagagtcagacacgactgaagtgacttaactcacatacatgcatgccttattctacaacatcaggatcttgagtcacataaaggaacctactatctttaagtcatctgaccatccacactgtgctattcaaagatataaactcttatgaaacatatgtcagtatttttgattctttcttctgaaaatctaactttttaatgaacagttgagattgtagtagatggaagaggcaaagaaaaattaggctaataaaaacatcttccactctcttctctacatccttctaattgtgaagcagtcagggtgttaaaaaaggtaactacagaaatttgaattccaatccaggagtttaacttagaactcttaggagtttaaaccatgctacatacggtttcttccgtgaatattaaaaataatttcatctgtctgaaggattcttgtttaaatgaggtttaaatgagatccaaatgtagcatgcttgacacagggcttagtgcattagtatatgttcaaaatattagaaatacttttaatcagttgtgctttctctgtgtgggctaagaataagttttatactgttgatgctactgtagaaactaaattgtttgtaaattttttttgagctcctctctatcaagggttaacaagcctttctttgaaaattccaaaagtaccaacccatctaacaaatcagacaaataatggaaaaattttaccatttctaaaataaggtacctttgtcagagagtcagcggggcttaataacatactctaaatgttggatgtttttagttttcagatgaaaggcactgtggaaataaggtgtcattactgttaattttactgtgccttgacaaacaaactttctaaaatcatggagtcaagacatgtagcacagcctcctatcacattatcttttagaatatgtataaaatcaagatgtatgtatcacaatataaaaaactgtgatccccagttatgcaaatacagaattgtcatccctaattggggaacccagaattaaataattttaagaaagttatttg

SEQ ID NO: 27101 - DNA, 2668 bp, Bovine  19866880779866
tttgagatttgttcgatgatttgtgaccgtctatggttagttttggtaagtgtcctgggtataccttccctggtggctcagatggtaaagcgtctgcctgcaatgtgggagacctgagctcaatctctgggttgggaagataccctggaggaggaaatggcaacccactccagtattcttgcctggagaatcccaaagacagagtagcctggcaggctccagtccatggggtcgcaaagagtcagatgagactgagcaactaacactttcataccttaaaagagcatgcattctgaaatgtgtggatgtaacgtttcatgtctaacatgtgtgcactgtgctaacaatcagcaaacagtaggactcaagccattctaagtaactcagaagtttattcctattgatggtgattccagaccagataagaggatgattatgctatcacatggatgtaggcagaaagaaaattatttctggtaaaatggaacttcaaagaggaaccccaaatcaaaatgtgcagttatcccccatcccctgccccgattccaacctatattaataccaaccctttatgtgatggaaattattccaacatttttcattcctgtgttcctaccagtgttcccttcattggttgtaatttctatatcgctagtgctatgtaacaatagaagacaatatcttaggaaaaactaatgacatttataaagctcaaggaaatataagaaatggttgattttatttctccaatttatgattacttctcagattacatgaatttagaggatatctaatcctgctatccaatagagtaacttaagttttttcaagttctaatgtcactttctatttcttatgagcattactcaaggttaaaactgttattaacatacagcttctaggaaatacatttagccttcctatttagccctctgccaagctctgttctggacaatgaaattgcaatgatagaaaggagagagaatatagatttagacaaggctaatggcacattctctaggcttcagaaatgcctcctgtgcactgcctcccatgtcttccacctccaattccagctgtggctttggtgaacagctctgggcaggtttcaccctgctctgtgctgacagtgcctcatctcaggcgtgtatcaagaatctagcttcttgtcctgaagcttctctgctgcagcacgtgtgatgctgtagcccagtgaggctctcccatgggggggtgttgctgccccatgggagcagccctcagcacacaggtgagatcagctgacagataaatgcttcttcttttcatccctcaggcagacaattctgagacacagtttaattaggatactgggagggttctgcactaagtagccaagaacactagtgggtactaacactaccttttttgcctggacattctttccttttccacctgttttctcccctgtctcatccttgttccctgggaccacatttccaaatagaatatgtctctacctttgtctcgggctctgctttcaagagtagtctagatgaagacagtatgcagataggttgttggtagactaaataacacaggaatataatttcccttgactctacacatgctacaaagaaacacttatttagttgggagcacagattatgataatttcgatgattttccatctttttcctttttgaaagttcatcattgatcctgatgcctgaagaaaaaaaaagttggtacaaattagcttataattgaataggcaaatttctttgtgatgacagctctaagtattttttctttgtgaggcagccctcagctatttgattggatttttcaatctaataaggagaagccctcagtctacttaatgaggtaaagctttttgttgctttggaaacaaccatatcacatttcttattctctttggtaaaaagctggagctgttagcactgtaatccttttttctaagacactcaaacatactttaaaaatgtaaaaattactggagtactgtcagaactttcttattcatgaaacactgaaagaatatcttgaaagatttaggggttattaggaatacactaaggttgcccacatgccatctctgagaagaatgttattgttaaaattttttactcatttaaggtactgaagacactacagagaacaaaattggtaaattcctctccctcctcactgaaacttatattttatgagtggggaaggtgagacagtaaggaaattaaataattaaaatatatagcacttcaaataaaggctacagataaaaataaactggggatgcgggaatgaacatgcaagttttctgttttgttttgtttaatttctaggtcgtactgagaaaatgatgtttgaacaaagacctgaggaggagaaaagcgtcagtcatatggatgtttgggaggggaccattcaggaagcaagaaaaggcatccccaaagccctcagatggaaagatgccagagtggtttgagagaggtgaagattagaagatgaggtaggaaagacagcagtggcagatcacatgagagaggggctctcgatggatgtagggccatacgatgcactgggggatattctgaaaacctgggaggacattttggtattactatgattgggtggtactctgggctttagtgggtaagcaaaattt

SEQ ID NO: 27102 - DNA, 961 bp, Bovine  19866880804918
cagaagtctaaagctgagtctggggattcagtgttctaagtcagtcactcagccaggtccatctatacaatctgtggtcacagtgctgaattcagtatcacacagtggctacagaacacttgctggcaaacccatctctctcaaataacactgaaaactgagctaaggaaaagcaagaaatcaggccctctgttcttcaaggaagattggaaacagaagagagttaagaatgaactggagccatggagatactatgagggtttccaactcatcctttccctttcttgtgatacttaaggctaattgtcctcataaaacccacaagttggcatagagtattcagaaactccttttgttatctgtgatactctgatgtagacatagacctatcttttattctgtctacttaaaaacagtttcatttaccaagttaataaggaaaaatataatcataaaactgaaggatcactaacaattttagtgttttctagtaattttgaacattagcctctgggggatctctttaacatgcttacacacatattcatatcataaccccctggacacttttgcagccctgaatctgaacattactcagttctcggccttccctgggaaaatctccagagaacctcagttctcatctgcatagatgggagttgccaatcacttctctccccactgcagagacattgagaatcatctcaaatctggtttctttatatgttagaaaggagctcaattcagaaagtcactcaggatggttataaccttataggatttaacaattgtaaggaacttcattctacatacaatttttatgtaatttatgaaaggcagtggtgctcattttccctttccttctctaaaataaacaaaaaatgtttggagttaggctttttttgtattttcattttgcagtaaattttcttgttgttgttgttttttttttttctagtat

SEQ ID NO: 27103 - DNA, 1020 bp, Bovine  19866880827269
attccttcattcatgatctttaaacaagtattaattaattgcctaatatcaaccaaggcttcttccagccacatgacttgtgggatcttagttccgcaatcagagattgaacccaaggcccccagcagtgagagtcctaagtcctaaccactggaccactagggaactccaggatctgctttttctttcagaacctttattttacagttgcagcaggattttgtttgagttgagccatgttgttttcacggtgagcagttatagttagaatggacttcacttgttgctaagaaaatgggttctgatgccaggaggggcatcagtcggggtctagtggtcacagctgtggttagttaactgcagaacccttccttttggatcttccttgtggttggtgttcagctgacaccagatttgatcagttcctcaggctgtgctcacttggacttgatgctccacctgattgttcacagtttcattgcaatgtgagatgcctgctttcctcctaagcccgcaatcttagtttctgagaacaaatctccaaaattatcattgacttctagttatgtatgatagcaacttttgaaacctgatgcagacttctgaattatttgttttccttaggcagattaccatttcacaataatatgcatcatctagaaagtacatcataattagatgtaaagtatatgttgacgtatatactgaagcttccagatgactcatgtagtatgttttgttgacgcttacagattagtccctgctgcttgtcagggctgtagaagcctgggaccgacacgtagcacttcactcctttggtaataagggaattcattaatcaagaaaccattctctctgaacagagatatttttaatatgttaaaacattctgccaattctctaatgctgtcttttcagtattctattgcagaaaatggcaagccacctagcttcaactctgcttgtcctttatttgctctggctgaccactgtgttcttcttattcctttgagagggaaa

SEQ ID NO: 27104 - DNA, 1591 bp, Bovine  19866880863767
tcctcatctgtctttttccttttggcaggggtttccccctgtcgcctctctttccatgttaatcattctgtccccacatgtattaataatggacctcagggacacagactggcctttaagctcttacaatagaatgtttctagagggaaattttggagtgtctttcttcaacttcttaattttatagctctagattttgaattaaaatttcattcaacttacaaaatatctttaaaaaatgggagattttattctaaaatatttagaacctcgatggtcaatgtatcaattttactgaattagttgattttttacattactctttcctcttttgacaattatctgtccagtagtcttcaagagcaatgaaatcttgctcccaaaatgaacttcctagaaaaattcagtacttcttttagtttatagaaatatatcccttttcatagttaagtacttctggaagtgtaaatatatcacaattagataattaatgtaattaaatgcttataattaaaacataagtacttagtcataattaaagtcatatatgtctatgatcagaacagggagtcaataaacctcttaaagcctgaactaaatgtaactcagcttaagcatccaactcttactgagcagctactattcccctctgcttgccattgagaatacattagtgagcatattatatccagtccttaccctcatggagctttcattagttagttagggtctctctctactagataatcacacaagtaggatttaattactatggtgaaaatcttataactaaaaatcacaagatggtatgaaagtaaatagggaatctgacagtatttagaagttaatcaggagagtttcttaagaaaatagtgattgaattcatacctgaaagatgaaagagttggctatgcacaatctggaggaaacaacattcctagcagatgcatctataatatcttgaggcaaaaaaagagtttgttcagaaaacacagagaaggattttggatgtaatatgtagaactgggaagccatgaaatggttttagtagaggaatgatttaatcagatttacattttaaatgggcttcccttgtggctcagctggtaaagaatccacctgcaatgcgggagacctgggttcgatccctgggttgggaagatcccctggggaagggaaaggctacccactccagtattctggcctggagaattccatgtactgtgtagtccatggggtcgcaaagaattggacatgactgtacgactttcgcttttcacattttaaatgattgctgtcattgttatgtgaaaaatggagttgggacaaggaaaagtatgttagaggaaactggagagagggtgatctgggtagccaggtgagagatgatggtgacttcaatcggaaagcagatcaatgtgggggcaaagtcaactgaatttgtgattgttttttggggggcagaagtggagtggagtgtggttaggggagaatcactgaaggagaggaagtgttaagaatggttcacagacttctggctagagagtctgggaggatgctgatatcatttaccatgataggtaacgctaga

SEQ ID NO: 27105 - DNA, 1532 bp, Bovine  19866880884691
aaaaaagcttgtactccttattactggcctctgactcacctgaatgttagtgcctgtagatcagtggtctctaggctttttggcaccagggaccagtttcttggaacaccgtttttccacggactggggtgggggatgacttcaggatgattcaagcacattatatgtattgtgcacttcattgctgttattattataacagctccacctcagatccagtactcttgcctggaaaatcccatggacggaggagcctggtaggctacagtccatggggtcccaaagaatcggacatgactgagcgacttccctttcactcttcactttcttgcattggagaaggaaatggcaacccactccagtgttcttgcctggagaatcccagggacgggggagcctggtgggctgccatctatggggtcgcacagagtcggacactactgatgtgacttagcagcagcagcagtggcttcttgatgtcccatttccccttgttctactgcttaccccagcccctaccatcccttctcagtctcctgtaccatcttcatacccctgcctgccagagccttgtggctttaagttagaaataagcctgaagcgacttagcaacagcagcagccacctcagatcatcaagtgttagatgctagaggttggggatccctactctagatgatgccagattgactgtttttcgacaagaacatcccaagattagccacgaactagggtaatctggccatggtgctcccacttctctgatctcgctcctgtccgttgtcacctagttaggacagtctcagttccagttcttgttcttcagacacaatgatgaaagaaatttgagattatgtgtcaaacaggtagccttctgtctctttaccgatgaagcggacttgtctcaataaagacttgctgaaaagctgtctgcatggctgtgttataaacgagttagttgctaagggataaagacatgattagccacacaagaacacagatgcacttccacacacagctcacactcatttccacccgttcaaattcacagacccttcaaaacagaagtctgagcttaaaaagaacatgaccagtgaaactcttcctcctaaatttcaggacttcttaatataccctacaacctcaaaagaaagaacaatttgttcaacaaggaacaaagtttttagaagttcaggttttgtttctataaagaaaaatctcttgcatttcaagtatctgcagtgaaagaatttgagtattaacttttgcagtaagaagtcaactttttcataggcataaatccttaattgtttcattagtgaagaactaagtaatttatatttgaagttcaggcataccgtgtattgatttgcttaatgcagaaggtggcaagctatggcatgcagactcaatctagctttcacctatttttggaaatatttgttggaacatagccacactcattcatttagatattgtagacagctgctttcactcagagactgtgttcagaggtaaaggaatttcacagaa

SEQ ID NO: 27106 - DNA, 1875 bp, Bovine  19866880897420
atcaaaagagcagtagctttggaaagaaactgtgttgggttctgctttaggtacttatcatccatctggctgtgggcagactacctcttcctatgcatgtccttctgtaaagtggagttttaataactacttttaggctattataagacttaccaataaatcaaaaaatcaggatcatattatagtattccagttcctctcactgtgcccagagtcctataatagcctattcaactgggaccacggacctcagcccagacccccctttaggaccaaaggaatcatttcccctgctgatgacactgtcagccctctctgggaatttcctgagccaaagccacaccctcttcttggaggagcagcttgtatccaaagactggtggatacaagaggacagagtcagtcccattgacccaagccagggaaattctgaaaggtcatcccacccacagagcagggttggccaagggaggctgtgtggtaactgcaccacaggcccccactttccccttagtccagccctgcttccctacattttttcctataagaaatgtgataaagataaaatctgatcttaggagccaccctcttaaacatcctacatggctgatctctgggtcagaactggcctcttggagaaccataatcccttgttcaagaccacccacaagctattattgacatcctacaatcattttaatgcaaaatctggtaaaataaacatgaaacactatcttggccactagttttggacatatgctaagtgtcaaagcccgtgtaagtgttcagtcctggtccttcatttctcatggtcctcctcagcctgaccaccagccagtgcagaatggccactgctgctgctgctaagtcacttcagtcgtgtccaactctgtgtgaccccatagacgtcagcccaccaggctcccccgtccctgggattctccaggcaagaatactggagtgggttgccatttccttctccaatgcatgaaagtgaaaagtgagagtgaagtcgctcagttgtgtctgactctcagcgaccccagggactgcagctcctgggaccccaggctcctccatccatgggattttccaggcaagagtactggagtgtgttgccattgccttctccaagaatggccactagtgacacaatagctctaggatacttgccacactggagagctggctaacacagatatggtctttagcttttctctgatccagaacaaaaacttgcaactaccacaataaggcttttatatcattgtctccactctatgtgaataaacagtgtctagctataggagattgtcagtttctctatacagactaagcacctgttcatattattgccctgctatatacaaattaaccatttgggaaaatgagtagaacaaatatgctccacaaactgcaatgcaagcagtgcccagtttgaagataagttgtattctgtaaattgattcccattggctatttggaactcagtgtcataaatgatggccagcttcacagtattctccacaaaccctggtaaactcacaacataattaaaatgccactgtctttaataatgagctgttctttatgggggaaatattcttcacagggtatgagataaagccatgtggcaccaggaacatgcacctctctcactcatagctgtactcttctgtatgccacatatttgctgtaatcacccattttcaagatggccacaatgttgggcagtgaacctggccgttctctctcctctagaatttaaacacaagtataatgaagacttggagacctctggcttctagcagatgataagaaaaatacagaggctcccagaatgtttcttgatccctgggccacaaggatctatag

SEQ ID NO: 27107 - DNA, 3965 bp, Bovine  19866880901209
ctgggatgacccgagggatggtatggggagggaggaggaaggagggttcagaacggggaacacgtgtacacccgtggcagatgcatgttgatatatggcaaaaccaacacaatattataaagtaaaaaataataataataattttaaaaaattaaaaaaatataaaatgaaaaaaaaagaccctccttaaggccttcatcttgctgtacccataaatccaaagttattttatcataaactgcccaatcttaacaacttgcctgtcttgcagaactcagaattggctctaaaaccctgtaagtatgcttccataatttccccattttgagaagcaatcactattttttcaagttggtgttctccctcatgctatgagtcaaataaagttagtcatggttgatcaatgggcttctttggtggtctactgaggagtagagagttgagactactaaacttttcatcaaacttcctttttcttgccctgagtgcaaaatgggcctttagtcctcagaatatcttatctaactggttttcagtaaattatacataattatccctcaagcttgctcagaaatttatagaagactttcatcccaatcttgggtgatcctcacccatacggctcatcccccagctaagaacactaccgtggaatgcagataaaccttgggatggcagaagaatgagaagatagtcgttgtcctagtcctctgccaaacctaccaaattctactttgctgaattacattgatatgcaaacatatagggagtattctctgattatataacaaagagaaagccactacccactttcatgcttgaaatatgcagtaagcagtgctctctaggagtctatgttcctaggctatgttactgtatgtccctctaccaatttcatagtccttgttcaaagaaagtgtccttggacttcaatttttaagttttgacatcttgtcttctccattaactctccatgacattatatggaagagcgtgaagcatttggcttcctcacttaactatttacaaattctcctgaagcccaaattgcccacactttttcaatcgagtcaaaatttatctcaaagtttgtaataagggagatttgcacatgataatgcccttcttccttccttgtaggactgcttcacagccttagggcctcagtctgtggagctgctgagctaatagagctaattaacaatataacattattatcaactgcaacaaagcacttttgtgctcttaaaaagactaaccatgaactgacctcattttaatttgtttatttcatctagaagggaccattcagtgcccagctcctttcttctatggttgagaaagggaaagaagtggtgggagggctcgtctccttctgagggttcctgttaagctcaggtggttatgcaagtcaaggtctattactatcggtgatctgttaccaccaagcaccttcacatacttaacttttaaggagaggaaattggcttccttttattgagagaagcacctcagaataattttctaagcccttctatcaaggcagaagttttcactgagaggttactgagaagcaacttggggcacactattaaatttaacctttatccttataatatttacaattttaattacattggagggattattcaatgcatctttctccactagaatatatttttcctaatgtcataaaccacgtttgtatatagaatatgcctccctggcacataatcagtgatcttttgccacatagcaggctcttgttaggacacaaagagtccttagtaaagacttaaaataagagactgcacaagtaggaaggaaaccagtcacctgtaaggaatgcttcctaaattatgcttatttccactaatatacagtgtaatgagaaaaataactagaatggggccaattttcataatattattaatacatatcttatgctatgttttattctactcttttggtgttaaaaggccatgccctaccttttatgaaatgttggtatgaataatgttgattttctgtgtttgtaattttaaaattgacactacttggaaaattaaaattggcaactctatctcagtcatccaatttaattttattttaataaattttcttcttcataaattctgaaagtttgggaactactcttctaaggcatttcaaagtataattttcaaaaaattaaaattgtgatatacaaatatatagtatatatatgtcaaagttttttttaaactcattaatgagagaattagaaggatggcaaacctgtttcaaaggaggatatgagaatttgaaagatggctacaaaaggagagaaagctgaaataagtttactaatttagatgcagagcaatgaaatgtaacctttaggggttatcttttctataggacaaaaaaacatttgagtctctactagaaaaaaatgtaatttgtaccttattaatcttctgtagttaacatgtaactcattagagactgagccttaatcaataataaattgtaagtcaatattactttcctttggaatggcagatgactcagacaagcttgctagacagcttctagcaagagtttggaaggtcacacgctagtcttgatttccaagtttgggataattttattaagaagaacctgcctctaatatttggatggaggttatatgtatatatgtgcacataagtaaatgtggatcaaatttataggtatgaaactgaaaggaaataaacccaaaaattaacagttgtcctgacttggaaatagcattatgagtgtatcggtttgtgaggactgccttaataaagtgtttacaaactggcttaaacaacagaaatgttactatctcacagttctggaggctacacgggtgttgtgttccctctaatggcgctggggaagggtcagttgcaggtctcttctctcctgatctgcttgtggcagtaaaaggccagccttcacgcgatgttctcactgtatacaagtctgtgtccacatgtcctcttttgtaaggataccagtcatgttggattggacctggccccatataacctcatcttaatgaactgattacatctaaaatgaccctatttccaagtatggtcacattctgaggtactgggggttagaattcaaacacatgggggacacaactcaatacaaaacaatgcattaagtttttctgagatgctacttcctaaatttttagaaaaaataatatgccagcacccattttcaaaaacattcaactatagttctagttgtcagtattagtttcctaagtccgctatcataaattaccacaaattgggtggcttaaaacaacagaaatttattttattatagattgaagggctagaaattcaaatcaagctgttggcagggccacactccctctgaaggcctgaggaggaaccttttcttgcctgttcctagcttctgtgcacgtgagcgcacacatcacttcagttttgtctgacattttgcaactccatggactgtagcccactaggttcctctgtccaagggattctccaggcaagaatattggagtgggttgccgtgccctcctccagggatcttcctgaccctgggattgaactcttgtttcctgcgtctcctgccttggcaggtaggttctttatctagcttctttacctatgacttttcctgtggtcatgtatggatgtgagaattggactgtgaagaaagctgagcaccaaagaattgatgcttttgaactgtggtgttggagaagactcttgagagtcctttggactgcaaggagatccagccagtgcattctgaaggagatcagccctgggtgttctttggaaggaatgatgctaaagttgaagctccagtactttggccacctcatgcgaagagctgactcattggaaaagactctgatgctgggagggattgggggcaggaggagaaggggacgacagaggatg

SEQ ID NO: 27108 - DNA, 859 bp, Bovine  19866880982087
tcactcagtattcattgctggggaatgtgaagccagtaggcagatcacatcacctcggtcttggaattggagaggtggcagcaggattaccagggtttttttaaaaagcattatcaacatggatccaaacaggttatgcttctcagataggagaaaggcagctcaatatacttctgaatgccaaccctaaaaatctatccaaagatattcaatttcacttttctttcttgtatgtctctacagactattttctcctgtcaacagaagaggccacctcaggctgtcctctaacagctgacactggcgctccgtcctttgggttagacctatgagctgcaccactctgccccgctctgcctggggtgccagccacagcatccttttgtctggtttccaggtcaataatctctcctggcatctgcctatttcaccccttccatcctcctccccctccatcaagaaatttaattccaagttggcaggcagaaggtcagaaatctttgaaagccgcaatttccctcacccacgctcggggctcgcctcttgcacattctgccaaatgccaacttactgctctccctcctctgtcacatcctgtatctctgccatgcccaggctgtcacctgaatcttgctctcacatctgcttccctccccttcctcagcagcagggccatcttttaatagtaacatcctgccacgtctgtcccaaaggcccagggcatcgtgtcatccatcctgggaccagcagcctcttcagagctatcgactctgggacttgcctctgtcagaggtgttgagaggcctggagctggcccacagcacctggggaaggagaactgacagtcccccgaaaccca

SEQ ID NO: 27109 - DNA, 1116 bp, Bovine  19866880986421
gaaatctaacatagaaaattctagttcattaaaaaagtggggtttatgtagaatctaaaaaaaatgatacaaatgaacttatttacaaaacagaaataagtccacagacatggtaaaaaaaattagggttaccagagaatgtatatttcaataaaaacttaaaaataaacaaaaataatggggttttaagaggtcatgaattctaaaaactaaaatatacagtattaattgaagtcataccatgttcttattaaatttcccatttaaaaaattaaaaattatcatttcccttttaaaataaataagaggataggactgtttccatttaacagatgttaaaatctaacttaactccaatatgccattttcatagctttttcctaactgttcttgataacaaggatcacaatgtgtttggaagtttgctttgctcagtttaaaaacttggttaaaaattcagttgaatgtcctggtttgtcataggagttcaccaacaagcataacaaccaatgcttcttaaaggcattaagtagaacatttacaataatgttaattcatatagcatatatgtttttaggacttggaagaaatataatgtcagtgagaaagaattctaatcaaatttggagatactcctgtagaactattctttgaatttttcaggcttactcatacatattgttctcaaattatttgtggcttagtagagacatggatggagaaggcaatggcaccccactccagtactcttgcctggaaaatcccatggacggaggagcctggtaggctgcagtccatgggatcgctaggagtcggacacaactgagcaacttccctttcacttttcactttcatgcgttggagaaggaaatggcaacccactccagtgttcttgcctggagaatcccagggataggggagcctggtgggctgcggtctatggggttgcacagagtgggacacgactgaagcgacttagcagcagcagcagcaacagggaattcactggtttaggaatgcaaaaacaaataaacagtagaagtgggtcatatactcactatatctttattctaattccaagagaaaacgtaagttttcctattccatcactctatt

SEQ ID NO: 27110 - DNA, 1205 bp, Bovine  19866881049438
ttaccatttccagttctcttcacttgctcctgtgtatccaagttaccatctggtgtctcttctttatgccaatacagctttgctcccactcaccttctttgatcagctattggcaaatacattgcatttcttcgtgttataggtccaacaatacaataatgtacatatattattttataattgccctggatcagttaagtaaagataggaaaagaactatgcatttatactgtcttttaaaattgcatgattacctttaccagccctctgttttttcatgtggattcaaatcaactgtcttgggttacaggcattttctgtggtctgctttttcttcccaagtgggtcacacttcctgtttctttgatattttgtcctatctctttttgaagagattgggctgcctttctgggtgcatgggatcttccaccagcattcagaagttgttttgtggaaattgctccacactcaaatgatcttttgatgaatttgtggaggagaaagtggtctccccatcctatttctatgccatcttgaggccacctcccacactttcctatttccttgtgtgtctcataatctttccttgaaacgacattttaagtaatatattctagaatactggatatggatcccctcccatctctggagcttgtgtttttgttatcattgtttgtttaacaacttggatagatgatttgagtaaagtctactatcgtgcactgtgaaacctccgatgttgctcctcagagggagcagctttgggcatacatacagtcaccctgggatgacagtggtttcagtagagctctctttaactatttctctggccctcctgttagagggtattactcctttgacatcacaccaagttcttaggctccactaattgctaactgattgctctactatctttgaccatattcttggggcataagttgttctacagtctgatgtaattgaattggagctgattttcaggaatatttttggacagattttgaggtttgctctggccccaggagggctcttcttaattgtgtcttctgctggttctctctggtaaactagatggcttctggtttaggtcttttatagatataccaacctcatcttaattgcttaccaccaaaaatctccattgtatttgaggcttgaaatccccaacactttgtttcaaatgaaatcaattcctttgggaaaca

SEQ ID NO: 27111 - DNA, 1061 bp, Bovine  19866881135104
ttacacagacagcattatggagagagggcaggcaggaaggagcactctcactcacacatatagtgatttgtcacggcagcaacagttattggccgaacacataatcaacacggggctacagggctactcatatgcctgcactgttttttcctttcaccttctttttttcaaagatgaaagctattttgctgacatatctaaaaacattgttttgattttgataataaagctctttataataagaaattggaggtacacttcactaataagttgtaaatacattttctaataagaaaattcagtactgctctaaaaacttccgggttactttaactgctacttcgcaatcatgaaagacattgtgacttacagattgtatctgtttatctgatatgacacagtcctgtgaagtgggtacaagtaagcccatttcacagctgaggaagaggagcctcgcagagatttacataatctccccaaagtcacggaggggcaaaagaggggcacagcctaaaggcttgggctttaatctctaagcataagttctttcttccacatgactgcatcactgattttagttttaaatcaatacatttattttgagaggagaagtaatgccactttataagcctttttgagcatttgtttagtatcttagcatttacttagctagagaattcctaaatttccatttatatttcaaaacagttctttgtatggatttagacatactctatacactgggggaagggagggactcagagtaagaaagcatatgtatctgtgaatactcagtatacttttcttcactttgcattttgtaaatattgatgttgcagctcccagagtgctctcataagtagttatgactgacagtccatgagtgctgtgtctctcaaaacaaatatgctttactgacagagagcacgtgtaccgccatctaattattctgagagccagggtggaacaaacaacataattcctcagctcagtttggcattctccactgaacacgataggcaggttacagtttaacacatactatgctgctgctgctgctg

SEQ ID NO: 27112 - DNA, 868 bp, Bovine  19866881176175
ttggtgatggacagggaggtctggcgtgctacgattcatggggtcgcaaagagtaggatacgactgagcaactgaactgaactgtaactgtatagcctctaaatattgctggtgagaaacatagcagtctatttacaaaagcaaattcttttataagtatagagcagcatcatgccaaatggaaatacctatggtccaagatacttaaactgtcatcaacctataaaaagcaaaccaaaatagattatttgcattaaagctattatccttaaatgttaaatcattaacatttggtggtaataagagtaaaaatcagaaaaaaaaataactttttcatatgtggtttgaatagttaagtcagaaacagaaaatattgggatattttcatgtctctgtaaatttgttctcatacttaatggccttcatatgcttttcaaagctctttttcaaaatctgagccacataatagtctactaaataaacacctaaggagatatttagagcactatttgtttcttattttggcagattaggaaaatacaatataaaaatatcatctcaagaaaagattaaatttttacaaaagtgtcaattactcaccactggtctttggtttccccatttgtcatcagtgctaaccctattctaccctttctgctgcttctaccgctctccagatatgcatggtctaacctgaccagatttcttctatcacaaagagaaattatctatttcataaattgatatctttccctacataaaagtatttttaaagatgagtctgtggcatgattgcaaaactaaaacaaggcagtggtttactacatgaagaattccaaacacaaatacttagaaagaggaaaagttt

SEQ ID NO: 27113 - DNA, 1489 bp, Bovine  19866881303707
cagcatacacattttgatatatgttgcagataccacccccaggaaggtgtaccttgtttttctattatatccccttttttgatgtttgatatatttcctattagagactgccttgttttgttgaattgttagtccagcattagacattttgatgataaaaataagagtgttttctataagcaactgtaaatattttttcttttataatggtttgtaattagctttgttttagatttctgttaagaatgtattatctgctcaatatttagcattcaatttttaaaaagatatgctctgtatatcccagcttaattgaggattgatgtaacttgtcatgatcagctaggtcaggaactttttcatttcaaatgctgacttggtgaggtggtgtcaggaagtacttaatgaccgaaagaaactagagaaagagattagcaattatattcacattgtaagatctatgtagctctttatttattcaactgacctctaactcaagtcagaaaattatttaagtcctctgtgatagcctacagatgataaatcttcctgttggtgtttctttacctgagttagcattctagagttgtctgttttcagttttgtgactgtggcattagaagctttgtgtaatttaattgtcaaaacttgaccatttctttaatttgttattgggcagttcatcaagcagtcttataaagtattatcatggaaggagttatagctctgtaggaattcttctgaagctggactccattcaggagtagaaatgttgtacatttaaccaaataatggaaaacatccttgcatggggagttccttatataacagagctaaaagaaatggagacagagcagttactacttacctagcaactccactggaccaagctctgtgataggtacttatgtggcatgatctttaattctcataactgccttaaaacatggctataatactgaaacagtctccatttaacatgtgagagactaaggcattgatttcttaagtaacttacctatagtcacctagctagtaagcagaagagcctaaaattcaagccagtgcgtcactcaatggtaatatacactactcgccctccaacccctaatccttacctcaccccccacaaacacacactttttgtatcttttggtctccaattttatatttatttttttactacagtagaatttcttctccccttatcagagatgttttggtttattacattatgtaccccaaacgtaaaccatttttttggatctcaaattgaagagttttgctccttggaatcatactaagaactttgatatttaaaagtactctcatcatcatttttcttacagaagaggcaatagcgtgttctgttagtaaactcttttaaatctttatttccagatcagtgaatagaaaatccagacaaagtagtgctgtgctaggcagtaataaaggccctccaaagatgtccctgttctaatcttagata

SEQ ID NO: 27114 - DNA, 675 bp, Bovine  19866881344592
gaagaaacactgctggtggcctcaaaaaatattgctcagatcaggacaaaccaaagccatgcgatagtctgctgcttcattaagttccctctctgggttaggaattttaaaaaatattatagcatctggctgatgtttctgctcaaagggacctttgagtgatgcacaaaattgtggaatcaagtaactgtttttttttgtttttaagatttcttcttcaaatttaagatactagcttgagatcttccactaaggagctgtgtgacattgggaaagtcacttcacttccctgtactgacaggtcaggctatgtgatctcagaggacttttccaactctagattctgttttccaatttttcttaagtccttgaactatgagtttgtgagtggtggagaagcaagggagggaacaagaaagtctttttcagatgccttcgtgttttcaggatatgggtcatccaaataaataagtgactgaagaataaatgacttgacttgttgttgatatgggataaggaactgggcatgcttggctctatcccttttctcctcttttacttttgatgctggaagcatcatttccggttggcttttcaatgtctgaaatttgttttacaaggtagtttcccacatagggaggcctgtagttctccacttttgcatttgacttgatg

SEQ ID NO: 27115 - DNA, 1056 bp, Bovine  19866881368275
tgaaaagtgaaagtgaagtcgctcagtcatgtccgactcttagtgaccccatggactgcagccaaccaggctcctccatccatgggattttccaggcaagagtactggagtggggtgccagttatacactggtcattttggagactgttggttcactgaattatgcagatcttccacatgttgactcatttcatcacacaatatcaaaaatatcaagttccttaattttatcactgtttttcatcaggaaacattttgcatgtcaggatactactggtagtagtagtcgcttagtagtgcccaactctttgcaactccatgaactgtatcccactaggctcctctgaccatgtaattctccaggtaagaatactggagttggtagccatttccttctccaggggatcttcccaatccagggattgaacccaggtctcttgcattgaaggcagattctttaccttctgagctaccagggaagccctgttaggatactggttttccaaaattctaatttttgtttgaaagttctgattttatcattagcaagaaatactattggttgtttgctttgaaggacagttgctctttatttctgagaaaatacctgccagatactcaagtctgagtaaccatagtttgtctgtcacttgtcctttcaaataaaaatgctactctgtgaaaaaagtggctaattcaacttgaaactcaactgcaccaatgcttttcctcaagacaaccattgtacttctgtaggtagcagaagcattttatgtatccttcccattttgtctcacaggttaaaaagacatgccctgaagggtaaggatttgataaaattaataattttcaccgccttctcaaagacatttgtaagtgaaaatgacttttctttcttttccttctctctctttttttttttaactgcaggtgtgtggtgataaagaatatattgactattactacagcttgatgccactcttttgctttctgttgaggcaaccagagttatatcccctgtcagtgaaaacatcaaccccagaaaaaggtaaatag

SEQ ID NO: 27116 - DNA, 1114 bp, Bovine  19866881372701
cctgtacattgtctaaaatgtaacagtaactcaacaaagatttgtaaaacaaatgaacaaacaaataaaaggactgtgaattttaaaaaggatcagagagaatagggatgagatgggtgctagagaatgttgggtgtcccaggcatatggtgaccagaatgtatgttatagtcatcatggttattcctgcgtagtgtttaaattttctaaagcacctttatatttgaactagcttgtcatactcactaaaatccatgtgaggtaggtgagacaaatagagggaatttcttttaaagatgaaaaaaatgaagcagggaaaggttaaatgatgctttcaatattatatagctagtagtagcactggggtagtactaaggttctagatacctagttctgcaagctttctgccctaggtaggagagaggggaaaggggagtcaccaaggagtcacttaaggaccataccataaaaatagatctctaagtagacaatgattttacactaatggttttgatagtaaagtcagtaagcactagcattagcatcagccagcccttctagccaccatctcatcagaagcttcagcaacatccccaacagggaaggtattctatgatacatccaactctttggaactcctttcttcccaagacaatggatttcatcttctgttggttttgagcactacagaattcttctggatctttaacgtaccttttctcctctaagtgttatccactgttcctttttcagttcccttgttactacatagaacaatctaacccctttttcatgtaccatttgaattatgtgaaacagcactcatgaccgcttcctgccttgagtcgtgccttttccaggcagtctcagttctttaaatcattcttcctgttcctgattcctggtcttctctcaaaccctgcctattgtctttgtcagtttactccttcaagtgggctatccagagcaggtaggggctgaggcagtgtgcagtacagcatgaccatggctcccttctctttgaaacaaaatttctattactgcagcctaacagagaactctcttctttggcagtcacatctctctgctgactggtactgggcttcttctcaaa

SEQ ID NO: 27117 - DNA, 1734 bp, Bovine  19866881403088
tcatttccttctccaatgcatgaaagtgaaaagtgaaagtgaagtcactcagtcctatccgactcttcgcgacatgcagcaaatccaagtttttctttttggaatgtcctgaaaaaattttttgaatattttccatccacagtttgttgactccatggatgtggaaactgtggatacagaagactgactgtattccatttctttgtattccgagtcaaaatatcaaggggacaaggagtgggagtggagcttctctgtgagaggcagtaaacatttgctagattccagtggtaataatcaaagacatcagttctaacatgtgtttttaacagttgtgagaaggcagcaaagttagtgttagcccatattagcaaatgtgtatagactcaagtctgtcttcagcccatcttcgaaatctgaactaactggacctgtgagtattatgcatgtgaacaggtgttggaaggggaaaaaatttactagtttggaggggtagcaaatagaaaataaatgcttagagatatctgagatgtttaaaaaaataaaacttagatcaggttccatttgatgatattttagttaaatatcaaagctttttcatagtttgaaatttctcaggacaaatctctttaaaatgtcatggatgacaggtttgtaaaactgcgtgaacccatcatcctcttgaaatgctaaacactgatggttctaaagaaagtaaatacaattttcttgaatttaatagaaaattttggtgtttttttttttgttttgttttaagctcaatacattatcacatacattcttaaagggaaaggaaatatagaattatgccaacttatctcaaaagaggattaactggtatatgaagaaagatgtaaaaaatggataaatgaagaattagatgtttaaatgtgatcagaaatattgtgaaaaagaactgagtgttgaaccaagagtgaatagctgtagatattgagtttctcagactgtgaatccctatcataaaacatgaatgtttgtgtgatcacttatttcacagctttgaaaccaatacattctttaacctaacatcatagaaaaagaatttcctaattttatcataatcaggccactctaattcccaaatttctctggggtttttcttctttctaattgtgctggatggtacctttaatattggactgaaacacactgaaaattctcaaatcttttttctcttactgttgtcttcaagaatagtcttagagatgtttttaaactatgtaaatcgaagaccttgaataatatctgtctcacaccttctctttgatcctgtttcctatgccctcagatgtgtctgtccatttcagaaagaaaatggggtttcaactttgttttccagttttccaatatgactttcaaagacattaagataatcctttccatttcactaaaagttatttttgtcctgttttttcctccattctcacttattattataaatattctgaatcattaaagtgtttgtgtgtaatcttactttgggatttagccttacttgtgaaaatggtgaaaatcctaaactttttaggaaataaggaatgaagattccagccttgaagggcattgaggttttcagcatcataacagtttctaacttcttaatatacagtagttaattaaatcatcagctagacatatcctgtttattgctcttttagattaaaataaattaaagcagaaaagaaacacaat

SEQ ID NO: 27118 - DNA, 1025 bp, Bovine  19866881469315
ttaaagaacattttattctagaatggaaaaaaaaaaaaaaaaacctaaatgccccacactggtatggggctaacataaacacagaatgataggcagttaaatttaaaaccagaataatgagataatcttacagcatatcaatgttgctatatgatttcttatgtacagtgttttggtttccatgaccggaatttcagaggccatatgatgatgaatcacggtcctgtttacagtgctaacatttttgttctcccttgtagctatgacaggagtctgaagagattttcagctcattctaattttcttccatgaagctgctacttactgtccagggctgatgctctttgcagaaagtatcctgggtagctcagggtttcaggatcttaaaagtgtctcctaaccagagtgcaaggacctaaaggcccttaattaagtttctaatcacaaacaagatggtcttgtattaagggccctttgaaagtagcagcaattgtgtcattgtgtctccgtcccgtcaccgtatcaaataggattcttattttagcactgaaagcaattctttccttgtagagagtgaagagaaactctcaacagtcagtttgacgaacagaacacagtagagcaaaacacatttccttttctctcccacaaggctgtggagctgactttattttatttgacaattacagagcgaatgctattttacaaatcttgggctgtttaatcttcgtagcaaccttgtgacataggtactattgtcatctccagtttacagaggagaaaaggacacactgagtgtgtaaggccagccgatagcgagcccagatgcaagtgcagggccctcagctccatcactcaggaacatccagctactttcttctcttggtggaggtctccactgtctacgtgccaaacaaacagcactagaggcaggacattttagacatacttaaaatactccataaatttttattttaattctttctgcctgtacaaaatttatgcttaataaaagagaaaacagc

SEQ ID NO: 27119 - DNA, 1649 bp, Bovine  19866881585517
gttgaggggttctgccccctaaacccctgaaatccccaaagtgtttcagcaaagcagttttaaaggccaggtgagggaagggggcctcttaggaattgtgagcatttcgtgcacagttctctgattattttgatgttgagctaacaggacagttaacatcaatccttagaccccattaagtcctgggggcaatgcgttcagaatcatcaaatactgtagttaatttcttccatttgatgctggtctttagcctctgaaaaactcaggaaatatgcatgagttactattatctgggtccttcagagaggagctaaagcagaagatatgggggagggagtctgtctggggaaggccccataggatcatgccagttacattttctggaacagtttgtctgcctccttttaggcaccaagaaggccagtcctggctcatttctaagcaataactccggttaagtttttttttcccttcttcccttcaccatttttattccctggtgcttgttcctgcttctggactcacagcaaggaggcctgcagcttgagaactatttgccacttaacgttcctcttccattttctgttcacagaagtattttcttaatttctgtgaaggtattgggatttagttatagttgatttaaatatgtatatcctgggacatagataaaccatttttatgacaatctttaatgcttaatttgatgatactaataaaattattttgaaagtgatgaaaattaattgactgtacttgctgggtttagtaaaagtttaaattgcatgctactttaaaaaatattttcaaatgttctttttcaatgtaattacccctagaggtatctcattatacatccttggataactttatttcgggtgttatctaaatactgcaatatgatgtagtgaaagcaaaaatgattttattgccaggcagaagtaggttctcatctcaatttcaatagccgagggattgaggaagtttctaaattgtgttttctttctgaaaagaaaacatcacttcaaatatgaaagaggaattagatcaacatgctatttaaattttattcagcattagttcataaaaagacagaaactactgtacttggcatgcagatcttcactgatttacccctcttgtggtcatggcaggagtcactagttaaactttgtagtttccatctgagccaagatcgactgcaaaattttcagcaaagagcatctactagctgataagagatgacactgcagaaaactgatatatgattttagctctatccgatccctttcacctttatcactttttccctaatatactgcttttatttattgctgatatgcatctagcaaataaatgtattcataaggccagggaaatgttaatatctcatatgatttaatttcagatgtgtcacttttctgaaacagactaggctacagaataagtcattttacagaatgcattctatttgagtgacaataattatcaactggtagaaaagatatggataagaaatggctcaacagaataatagtttagcataaaagcacttgagagagcatattctacaaatggtgaataggtgttgtcagaaaaaagtttttcatgagaaaataattttatgataaaagtctgcatttaatgat

SEQ ID NO: 27120 - DNA, 6570 bp, Bovine  19866880515703
cttttataaataaggctgccataaacattcatattcaggtgtttgtatttcagctctaaaatagaatgctataatatatatctcataagctttcggatccaccgttatgatgatggaagggatgggaattgtcctaattttatagctgagaaaaactggagggaccaaaagatatgtggcttacttaaggctcttccagtacaagactgatgagggttcctttgcctcagtttcaaatgtctaaggtagcaatcaaggtcacaggctttggagcccagacagccctgggaccagacaccaactatgttatgtactagctgggtgagtatgggaaagttttcctactttttaaaatcttactttcattctctgtataatggaaacaatagtattattactattatctgatgttgttatgaggatggaatgaggtaatgtatgtaaactctaactatgatgtctagcatatagcgagtgctcaataaatggtaaccatcatatcctcatcatgaagatgagatttctgcatctagtccaatgttgattctctaatttgagaggatggaagaatctgaagtgtccccagcacttatcagcatgttaaaactgttttgtctagtagtcaaatctcttttcaaaaatatttgtgtaaaattgaccctcctgggagttgagttaggtttatcctatagcacttagtattgacattgctgcatatatcctgaggatacctttgttgttgttcagtcactaagtcatgtctgattctttgtgaccctttcatggactgtagtccaccaggctcctctgtcatgggatttcccatgacaagaatgggaagaattctggagtgggttgccattccttctccaggggatcttcccaatccagagattgaacctgtctcctgcattgcaggtggattctttaccactgagccacctgggaagcctttgtttcttctttgtagaaatgtctagttaggtctgctccccatttttcagttgggttgtttttttgtcgttgagttgtataagctatttgtatattttggaaattaagtccttgtaggtcacattgtttgcaaatgttttctcccagtccatagattgtcttttcaccctatttatgactttctttgctgtgcagaagcttataagtttgattaggttccatttgtttatttttgcttttatttttattaccttgggaaattgaactaagaaaactttggtactatttatgtcagagaaaactctgtgtatgatgtgaaagtgcattataacttcattgatttgtggctctccaactttcccaacatcacttactggagagactgtctttgccctgttatatattcttgcctgaagttgttgatgtttctcccaccagtcttgattccagcttgtaactcatccagcccagcatttctcaagatgtgctcagcccataggttaaataaacagtgtgacagcagacagccctgctgtactcctttctcaatactgaaccaaacagttgttccatacagggttctaactgttgcttcttgacccacataccagtctctcaggagacaccttacttataagtaagatggtctgcttgtcaataacttcagagatgtggatgataccactataatggcagaaagtgaataggaactagagaacctcttgctgagggtgaaggaggagagtgaaaaagccggcttaaaactaaatattaaaaaagctaagatcatggcatctggtcccattacttcatgggaaacagaaggggaaaggtggaattagtgatatatttcctcttcttggactctaaaatcactacagatgatgactgtagccatgaaatcagaagacagttgattcttgacaggaaagctgtaacaaacctagacagtatgttgaaaagcagaaatatcactctgctgacaaagctctgtatagtcaaggctatggtcttcctgctgctgctactgctaagtcacttcagtcatgtccaactctgtgcgaccccatagatggcagcccaccaggctcccctgtccctgggattctccaggcaagaatactggagtgagttgccatttccttctccaatgcatgaaagtgaaaagtgaaattgaagttgctcagttgtgtccgactcttagggaccgcatggactgtggcccaccagggccctctgtccatggggattttccaggcaagagtactggagtgggatgccattgccttctccctgggaggcatatatatagtttggccttaatcctcatgtctgacccctgagttagatcattacacacggcaaacccgaaaagcagaacacttagaaatgctctacgtggacataacaatcctaggtcagcattgtctgtgggtgtttatgctagaagctgggcaccagcttactttcatgttcttaatacatacaaccgaatgagcacatgtcctactgtcaataagcaatttgtcaccttctctgggtctggctttcgcctagcctagaatgtgctctttcttggtgaatgttccatatgaacttggaggaaggtgttagcactgttgaatactttttccattagatgtagctgataggtgctgtttagttcaactgtctttactgattgccctgccctgccaggcctgtcgatcagatagaagggtgttaatattcaactctaaagaactgcaaagagaaatggataagtccatgtctttcacattttgacattatatatgttcacacagactgttagagtcgaccccttaattttgttgtgctcttcttaatccttgataacttcctcagtctttcaaagagagacttgctccagctcgtagtgtcaacatggtatatcttcatcccattacttatcatcttcatatgaaaaatgagtttcttgcagacaacatcattgagtgacttgcctaaaaacatgtttgaaaactacgtggactgtggctcactcccttcagtggcacataataggctgtagctaacccatccattcaccaaattaaagttcccacttcaggggtccccaaacaatgctgaataaatgctgtcacaagtctgtctttgtaaaccggtgctttcattactgtggatggactcccaagagtgggattgctagaatgtgttgcacataaataagtcttactgttgccaagttgccttccaaaaaggacaatatacactctgctgcaaatagtactgtcttcattggagccaaaggcagaataactgggcaattgtccaggaagttggaatccttttgataaggtatctggaacattcaaaccaatactgtcatcttgtagcaagctcttcaaatttcagttaattgctccaacacaatccctcctgccctatcgatgcatcctgagccaatggctaaatgctgcttaggcacgtttggatgagcctttttatgtgaggagaaaaacttgaatttggttaaatatttagactcttattacctgagttagttcaggtgatgattaaagattgagttcagccaacggttaatgcttgttctctctagcccatcctataccctctaaatagatgggcatctagaaactgcagtctgctagggaagctgtttgaatgggctataaccaaggtgttaaaccaaactgtttgtggctttggaatgtggggcaggattttgcacaacagctttatctctcgctctgctcgccactaataggtcattaacttatctgggctatgaatgcatccccatcgcatatgtctatcaaaccataaacccacagccaccctggcagactgcataaggcagtgctgtagagacctctgtcttggagccaagtgctttatataactccatggtggtggccccaaccaacttgcctttcaacagctctgcgtggcacctttgcctgtctcatggtgacaagccaggaccttcttcaggcattttctcagcaggttaatcaaatggcatcagtgggaatgtttacagcttgccgccacttagggagctttatcagggtccttttaatatcagcccgcaacccaaggctgataacagaacaggagagggggcggagcaggggatggacagcttcgggagagctggtgaagaccaaaaaacaagatgtcagtttaatctgaaagacctcccatagagtccctgctgtagggtggcagtttggtctggaaattcttttcagggggtcgcgtatctctagttccagactcttggcctctagatctgtaggtctgttcaacactagagcaccaaccacgtaccaggttgtttctatggtgataagatgctgtcctctctctacttactcataaacgttgagctaagatctaagcctgagtactactattcctgcctctgaacaatttcctttcttggccattcttgaccctacttgaccgtgggtatgttttgaatgctgtttatgttttatgatctaacaagatatgaagggttggaaagcagtttgaaccacaccatcacaaggaatttgactatatctgagttttttacccatatttggggagaatagaataaaagcattaaagcaagaaacctaaaggccaagataaaacttgaggggctccagtgaaagaaaccaagagggaggcccctcttctgaagttcacacttgctgctttcactgaaaaatagaccctttgtacctttcaaagagctaacgtctaccaatctgttatggatattctcctgccaacctagtatggatgtttgctatctgaggcattttgtgctaaaagaggcaacatgcaattatctgactacagatgaaccacaattttaatcccaggcacatctcctggctttaatcccatgctgacttcagtgacaccatgggtgtccgctgctgtaaagttagccttggtaccttaagcaagctgaatattgttacctttggccctctagaactgcatgatgcattgaaattcagcggatgttctgaagtctgttagagcatctatcgaagagtctagtcagtgtcaggtctaggctagacacacagagtgaaacatacagagcatcttaatcaccaagttggcaagtctcgccctgtccacctaagtatttttcaatgatccactgaacttctgtgacccccaggtgcttaccctatgagctgatctgcctcaatccctccaggtatgcaatggaatccttgttttccaagtgaagttcacaaggacaacccacaagtaagacagtgaaattcaaacacgggtgtatgaagtctgtttctctgtaccagccacctccagctcccacaattggcaaccatgtggtcaaaatgagtaaagagctgacaattagatcaagggcacagactaggcaatgggcactaaaatatgacctgggagggggttctgggagcagggagagggctgaggtccctcagtttaagtttttagattctgacttctgcatcaccctctcccttgtgcctggagttcgagcatctggctgaaaccccacctagagaatagacataatcttcagtgggtaccagtttctgctgggaacggagggctgagtgtatggctgagtcagtgtctgtagagcagttatctgaccacctcacccttagcttcccaacggcgaggtctgaagaccccattgagtggatcaatccattttctttgtcttgtctttgcagacagtagtcttgactttcccctcttccagctggatgtgccacctcctcttccagggatttctcattctatattgagagtctcatccttatgagcctagtaacaactcttaaattcctttgggattcagggaaagaaaagagaaaagggttactcatttagcaatcaatctgaaacacttacctggcagttccaacggctaacttgcctgtttattcacttcctttgaggtgtctgtctcccaagacggcaattcccaggaggaaatctgcctgtgagttcagtcgactggtcttgttcctggaccagcttgtttccaggaaataagctgagatggagttacaggcacaaaagttttattggagaataacacagataaaggggaaaggggagaagcagggttggacccaaggaaccactggcccatgacccctacctggtcaagtctttggtcgcccagtggggtgctctggatccaagactgcccagtagagctttgcattaagctaactcttgcaccatttccaggcatctccacaggcttcccctgtaagtctggagaagagctgccacgtttaacagtccttcattccttcaaaatccgaaaacgtcctctttgaagatgctgtctcaatgatactagggttgctggacttggcgaaaattcagaattcctaatggatcttaagtttcagataagtgctttccagtctaagtgtcccaaatatttcctaggatgctgtttttaatcgggaaacttggcagtacagagaaagtaaaactctaatgttctaggagttataagagaacctgcatttgaactagggcaatgtgcttgactcctgttgaagttaaagggttaagtctctcccacct

SEQ ID NO: 27121 - DNA, 2117 bp, Bovine  19866880525562
aaaatacctatgttaggctgttcatctcaacgttgttagtgtaggcaaataggcaaacttaccgtccttcacttggtgagtggacagaggaaacgaggtgaaggaaggcatggacgattgtgaaacccagaaaagcaaaccagaggtatacatagcagcatgatggccacaagaatattttttgtggaaaggtaagacacaatgtggagagccgtatcacttacataaattgaaaacaataccaaagtctctcaacagttgactaggctaaacagcagtccccaaccctcctggcaccagggactggtttcctggaagattatttttccacagatggcaggaataccgggagaagtttggggatgaatcagcacgttacacttattgtgcactttatttccattattattacatcagcttcacctcagatcagcaggcattagatcctggaggttggggatgcctggatgaataccccggggtacattcatgtagtggagtactactcagccaggaaaaggaatgaagtgctgattcaggccacaacacagatgaatctcaaaatcattatactaagtgaaagaagccagacacgaaagaccacatgcagtaggatggccccatttatatgaaagctgagcacaggcagacttagtctgtaggggcagaaagaaagccggggcacccgtggcagaggcgattcccaagaggtacaagggaaatctttttctggagtgatgggagtgttgtacatctggattatggaggttacacaaataggtacatttgctaaaatttatcaaagtagatactcaaaaacaggtacctgagtttactgaatgtaaattagtcccaacaaagtttatttaaaatgatattttattgtaaacagtaaaataaagcaataatactttagaattttgatgactatagctttgtgtacatatatccatgtatctgtctctctaggtgtctgtgtatgtatgcatgctatgtgtgtgtttatggatgtgtgtataggacatacacaagagtaggtgtctgtagcagggaggaaaaagaaattacgaatgcggaattgtggtaggttggctcattgttcccagtcctcattccctgtgtacactgtgtaaagtacgtcacatgtgtcatctccctttttcttcctaagaacctcatgagataggtgctattgctccattttatagatgggaatctgagaccagagaggttaagtaatttgcccttggtcacacagctagcaggcaatggaaatctatgaatatgatcccaaagtctaggttcaagatgaagggacttaacttcaaaatgtcttttaggatttttcccctccatttgggtgtttctgtcccgcaaagacggtggcagaagtcagggagaccgttccgtgatggaaaacttaatgtggttgaacctgagaacatcaccttggggaagggctttgtcccttaagaaattataaatatttcattttcccctcttccctccttccttgtcagtcccgagatggagttatcgacgggaaccaggatgatggacagattggcagggttctgtattgatgagttaatagattgttggctatttttttcattctctgaaaaaaaaagaagtcttgacagctgtcttcactgtcgtgggggtgggagaggcagctgcagaaggtgatggaaagcaagacctgggtcagggtggtgcccatcagacaaccacagcagctcgaccttcaacacttaccccgaatcccaccagcttccattctcttccctgatgccccttgtccaaggccccatcatctcttggctgattatcacgagttcttctcagtgcctcagtgcgttctgcagccagcaggcagagctgtcgcaaagcataaaccagggacttgcctgctgatacagtccataagaatttgcctgccaatgcaggggacacaggtttgatccctggtcggggaagagcccacgtactgcggagcaactaagcccctgtgccattactactgagcctgtgctctagagccctcaagctgcaactgctgagcccatgtgctgcaactattgaagcccgcgcacactggagcctgtgctctgtag

SEQ ID NO: 27122 - DNA, 1508 bp, Bovine  19866880565528
aatggagtcacgatgatactaaccccccccttcaggtccgtcaagcactcactccgcaccagggaccaagtggttcacttacaataactcacttgatccttacaacaccatgaaagtgaggcaccactgattctgattctcctcatcttacacatggggaaactgaggtgcaacaaggttacagatgaggggctaaggtcaccacgaggagccgggagcccagggggcagggagaggaaggatgagggcagggaagcccgggtcggaggcgggtatggacctggagctgttggctttgtccttggactctttcttcttcttgtaggacgatgattccagggcgttggcatcctcactggcctccttcttgatggtggatggtaacacgtggagcatcctaccctggagtggggacgagaggaaggaggtgaggacaggcagggggctagtgcttctacatcctgcctgggggacgctggcctctccacgcgggggctggaccagcgctgagagttctgtcttaagacgggagcctcgggcagaacacccacgaggttagcacaggggtctgatgccgccttaaagagcacgctgcacagtttgtaagtaacgcctgtaggctctccaccctaccctgtccctgtgagcatgtgcgccccatgcgggcaagaatcaggtccggcctggcgcctgcaggggatcaacagatcatgaacgagtgaatgaatgataggaaagggaggcgcgtgcaccgagcatgctacttggaaagagaagcttcctacattctatactgtggccgtttcaatgcccggttcaaaaccctttccttccttactcctcctccaagtggtatttctcaagctggagagcatgttcatttaatccacaaacactttttaaaggcctactatgtgccaggcgctcctctaggcactaaatcagggaccagaactgagcagaccctgccctcggggtgggggtggggggaccctcccagcagctcagatcaggaggtggcttcacgggcatcaggtgcgtgtccctagaagctggcttgcacgtccgtgcctgcacacgcgcatgtgcatacactcacggcctcctcccaccgcctgggcccaccagtcatctgccagcccataggccatcacctggaaaacctgcccgtccacctcggcataggccttcacagcgtgctccgggaacatgaaggtgacgaaggcaaagcccttgggcttcttggtcaggctgtcgatggggtaatgcagctccgacacgggacctgcgggcaggaagggcgtcagtgtcccatgggccagggccaggtgtgagctccgggcaggaaaatgctgggcactagtcaggggaggggttttaaccagtgagagcgtggagctgaggtggctgctgaactaaacaggaggactatttaaacagcagagttcagactggagagcacttcatattcgcacacacagtgagtgggcttccaagaccaaagtgag

SEQ ID NO: 27123 - DNA, 1928 bp, Bovine  19866880627663
tataccctttggtggtggtggtttagttgctaagttgtgtccaactcttgacaccccgtggactgtagcccaccgcgttcctccgtccaggggatttcccaggccagaatattggagtgcgttgccatctccttctccaggggatcctccccgacccaaggatcaaacctgcgtctcctgcatggcaggcagattctttaccacctgagccatcagcgaagaccagtgttccattaggacttggctgaaagagtacttttggaccctggctcagtttctttctgattttctcccttccccagaggagatgttgcattgtttcctggcaaccagcagcaatcagcgtctttcatcagttctttcactatggattctggggctttattagcaaatgaaaatggcccgagtccagctgacatcagtggggctcggctaggagttggggctggagcatttccggtaggctccagcctcagacaaaccagtttgaagagaagccagttggctaccagtgagctatttttgacataaaaagaagctgaatttagccgataactgattgaagaaatttcaagcacaactggtggggggttataacatcttggcagcggtggtagagagacaaagggaagacaatgaatttgatcaggcaagatgttttgcaaacaactaattaaataccatcaagcaaccaattgtttgcaaaacaatggttggatagagttctatctctgtattttcctctccctctcatctttttactacctaaaatagtttatgtagaaaaacaaagtctttgcatttttcacgaacttgaagttggcacagtaattagaaaaattccctagcacaccattagaatgtgttcccttatctcctacagaaaaccaatttcaaaagttaagttatactttttcctgaaatactttggataggtaggcaacagaaaaaaaaaaaaaaaccattgctagatgtccagccaaatctaaaggtacagaaaacaatatcttgaaaatcttttattttcaataattcataaagaaatcaccttcacccacccacctttgtttcttcatagcaaccttatgtggcaagggtaaaaactataattattttttccttgagatctggagaactagacacccagaaaggtcgagtaatctgcctagggtcacacagcagtcaccaaggggctcagagtgtcccaattctatatttcaaggttctgcttcattttgccccctctgggttgtctgctgtggtttgatataaaaatttaacaggttcctattgctgattaagaattgtccgatttgggcctaaaagtcatttaactttggaaagtgtatccttgattagacttcttattattatcatggctactagttatagagtgtttaccacgtataggtcttttaatccccacctcaacttgtacaagctagctcttatgtccccgttttattatacaaaggaagaaagtgaagcttggtaaagcaaaggctgcccgagatcacgtacacaaacatgaccttgaaaatatttagtgggatttcctggtggtccagtggttaagactctccactgccaatgcagagggctcaggttcgatccctggtcagggaattaagatcctacatgccatgtggtgtggccaaaaagaaatgttttttatgtacactgaactcagcagtgtacatactttaagtcccccaaattgttttgggtatctaatcgatagaaactcttgtgcacagaataataactagtatataagaagcagcaggtaagatgttcactgtatcattgtttatagtggtgaaaaaaggaaacaatctacatatccatcaacagagaaagtgccctgggctagtaacttaaccctgtatgtcttagtttttcttggcggataatagaataacagtagc

SEQ ID NO: 27124 - DNA, 1262 bp, Bovine  19866880641495
gatgaatcctgggcctggtggctagacggtaaagcgtctgcctgcagtgcgggagacccgagtttgatccctgggtcgggaagatcccctggagaaggaaatggcaacccactccagtattcttgcctggaaaatcccatggactgaggagcttggttggctactgtccatggggtcgcaaagagtcggacacgaccgagtgacttcactatcactatcactatgggcacttgggtttctaaagaacagacatgaaccacgacaagtcaagatgagccctttctcccaagcaagatctctaccccctgacctgcagttagggaggcatcttattctagcatcactgtcaagctttgaaggaccaaactggggcctgaatttcaaacagcgtggggttctgacggtgacacaagccatctgcaacatcccacctctacacaacactgcagccaccagaaacaatgagctggccttgtgcacatctccccacaccaggctgtgtcctggcaggatcttatttaagtccccagaacttcaattcaggcagctggtgacacaagtttctcagtttttgcttttcttttagcaatgctagtcttgcttgagtatgtactttggggtcagtcattaccgaaacaagtaagaaagcatctgggaaggtccaagctcaaggtttccagcaactcagccacctcccccgatgggagctgaaatgcatccaaaaggcaagagtagaggaggaaaggacaccgacaccgcccccccacagaaaaggtggccccaggcagggtggcaccaggttccccacccaagggcaccgagcccgtcagtgaggggacctttcttttcactgatctttccaccactgcaggcggatgacttcttgttgcatttgaggataagtgttgataccaggtggtcagctatggtttgacaatttccatttagtgtgtgggagtatggctttcatgccaagcctgtgaatacagtacaaacagctgcgatccttaggctgcagctctgttcctgcctcagccccctggacagaagttggtgcccactgtagggtggaataaaggtgtccagaaggcttaaggttttagcagaagccccctgcggattcatgcaaacaagcaggtgaccccaggcctgctggttcctgggtcctgggcttaccttgtggttctggtaggaagtcaccgcaataaacgccgtctcaggaaagacatgagtacagaacgcggtgttttttgagccaaatc

SEQ ID NO: 27125 - DNA, 1822 bp, Bovine  19866880667698
tttttgcaatgatggaaatgttccacactgcccaatgtggtagccattagtcatgtgtggcgatggagcactcggaatatggctagtgaggcttaagagctgaatttttcacggtattaaatttaaattaattgaaatgtaaatagccacacgaggctattggctgtcttattagcttatgcagctttatttaggacagtgtgcttcctaaaaacagaaagtgttagttgctcagttgtgtccagctctttgcgaccccaagaactgtagcccatcaggctcctccgtccgtgggattttccaggcaagaatactggaatgggttgccatttcctcctccagggtaagtagctcacagaactttaaataatcttgaatcacatggtgagaaatcattgccttttttctcttggtcttcctccagtcttgggattccagcaagggagacagtctccattggtgccaatgggtctttagcaattttctaaaaactgttcacctctgtttttaatgaagggagagcagaaagagcctggagccttcaataggtaaaaatattggcttaaattaatagcataattttgggtttttgttgttacttgtacttatttgtatggttaccatcaatttatggcaagagaaactgattttccatgtataatcgtggcatggtttcattttaaattaaatttttaaaagtagagacttccctggtggtccagtggttaggccttcaccttccaatgtggagggtgcaggtttgattcctggtcggggagctaagatcctacgtgccttgtgaccaaaacaaccaacacataaaacagaagcaatattgcaacaaattcaataaagattttaaaaatggtccatattaaaaaaagaagcttcaatagcattatgactagagttaataattctgtattgcatactgtaaagttgctatgagcatacgacttaaatgttctcaccataacacttcatgcctatcagatgttcatcatcaactttctgcttgcatgcccctagtgacagggaggtcactccctaccaaggcaacacctctcatctttggacaactctgaattggattcacagcattctctctgacagtcttgtcacttgtccgttgactgtcttccaagtgacaaatagagaaggcgggtcttcaaacccaggttatctggctccagagtctgtattcgggatgccacgccaaactcacggtttcttctggcctcctctatggccttttcatgaagtgttctcactcgctacaaccaagtgatcttgtaaaaacgcaagccctcccatctggtttacgtcggttctctgcatgagaccctccagcggctacccatttcagtcttcttgccaggacagtcccgtggacagaggagactggcagactacagcccatggggttgcaaagagtcagacacgactgcgtgcacgcggacgtacatacttctgacttccgggttaataaatctctcccagttcccaccagatctccaccctgacttcctgtagcctctctttgaacctctgccccttcataccggtctccttactactcatacacagcagctccttccctccttggggtcttagcatttgctgggttttggagaacctagctcattccctgctcttcacaagcctggttccttctcaacctttcggtacacctcctcagggaggccctccctgattcctcaatcactgcagacttccctctgcgatctttacttcttgttagcctcggtcacccggaccctgttgatgtcccttatctcaaactcacactctgttttcttta

SEQ ID NO: 27126 - DNA, 1001 bp, Bovine  19866880693291
aacccctgggatctaaggaggtgaagctgatgtaataataatagaaacaaaatgcacagtgaatgtgatgagcctgaatcatgctgaaaccattcccccctgatccccaaccccattctgtggaaaaattgtcttccatgaaactggcccctggtgccaaaaatgttggggaccactgtcctattcctttccaccccgcgaggacacaggtgaagtctgtgacccccaaaagggccctcaccttactgtggtggcaccccgatcttggacttccaatctccagaacaatgaggaataaaatctgtcattaataaggcacccggtctatgctatttagttgcagcagcccaggggactaagtcgaaccaaagacacattccacgtgtaattgttttaaatggtggtatgtctaatgggtgtgaaatttctcatcctataaggtttaatttgaatgtattatcattttaggtgccttggaccactggcccctggagggtgtggggtcagggacagtccatttgccactgccagaccaaggaggccgagttccctggctccagaggcatcttgggacagtccttaatgtcccaaaggtcagcaatgactggacagaatgaggagctcattggacaattgaattccaattgccttcagagggaggagggcaaacttgttttgacgttccctggggcagatcaaaggggttattagtgaccattgttaggctatgctcctaaccgaatcttttccaattagggaaaaaatgaaatctctgctcatttggtgaaccaaagcagaatgagagtccctaatgatccctttgaaaggccacagtgaagcaattaaattggtatagcctttctgaaatttgggatttaccctgttacaacaagagctgtaaaactgttgtcttggatgaagaaatttgacagccatgaattgatcctaaggaaatgatcaaggacgtacacagttaacacatgaaaagatgttcacagtag

SEQ ID NO: 27127 - DNA, 1003 bp, Bovine  19866880874944
agaaggtgggtctgtctcggtggcccgcggagggtgggcagcagagacggcccttgccacccatctctccttgccatgtctctgtggcttcgtctttctgtccagtgccactctccccaggaccaacccccctggcccccgggagccctctagagactgggggaacatggcctcagagaacgtggttactctccaaagagttagcaaggttgagccctccctgacctactttgcctgttctctcttcttcccgcttctctggcgcccacagctgaaagacgataatgagttccaggagttcctgtcggttcaccagaagcggacacaggtggccacttgggcgaacgatgccctggacgctgagccctcgaaagggaagagcaagccagccaacgattacctgaactttgactccgactcagggcaggagagcgaggaggaggaagatggggagaactcggaaggtgagggtatgccccccgctatagtgtgcgccctgcacttgcccacacctgagcacgagtgacctgggagatggcagatcagatgctgccccgtagagggttgattatcccaaccatgggtacgtcggacttgatcgatcctggtcccttatccagtcagtggattactcgctcaagaattgattgagcgcctgctgtatgccaggcagtggatgtagcagtgagcaaaagacgagagtctgctcctatggagctgtcgtcctggtggggaaagaaacagtaaaggaatcagactgattcctttattcagtattcagtaaatgatgtgaacgtgagtgccacagagagaaagcaggaagtggggggtgggagaggccccggagaagggtggtccttgaacagaggcggtgagggatgagcctctgtccttagaaggggctcacggtgtagccataaggggctcagcgtggtgagtgcggtgatcgaggggtggaatcaacttcggttgaaaggcaagggagtgaatttgaggtgagttt

SEQ ID NO: 27128 - DNA, 1129 bp, Bovine  19866880903524
caactgaaatttagcctttccccagccttccaaggttgcctttgagaaggatgggcagatacctccatcagcagctgtcactcaccgtgtctgtatgtgtgtgtgtgtgtgtgtgtgttagttactcattcatgtccgactctttgcgatcccatggactgtagcccactaggctcctctgtccatgggattccccaggcaagaatactagagcaggttgccattcccttctccagaggatttctgcgacccagggattgtacccggctctcctgcattgcaggcagatactttactgtctgggccaccaaggtcattcaccataggagaagaaaaagcctgagtagcaggaaacccaggatgccctcaatggttcctctgaaccgcaggctagaaatttcttccctctccctatcagtgctctgaaaggctatgcttctttgtcctctagcttcctcttggattttgccaagaaaagattgatagaagagggtaggaggaaagagagagatgggggtatctcttctcctgctctaccaccacccctccctgtgccagcccagtatgggtttggcagccactgtctttctctacccaaacctgcagcttcttccaggcagtgctctcctaaactgttgttctctccaggtaccagaaacctctacgtcacctgcctcattgggtctgaatccagcaatagtttccccacatttgtcagcctctgggttctctgccacccctctgagttcccttaacccaacctctgcctttgcaaacaactcttccttcaactccctttgacccctcaagtgtgcatctatttcctgtctatttcctgccgggatgtcaagcccctctctgaacctcagtttctccatccgtgaaatgggatagcttctgcccagctcaccttgcagaggttgcctcaggggcaaagcagatcctggatgggaaaatcccctggggaaaaacaaaaagttcaaagtgccacccaggagccaggcattagtgttattaataaaagccagataggtctcctccatccacttggggcattccccctcccctctcacgccccctgacccttccacggctcagcctggtcagcttcctcccctgggtgatgttc

SEQ ID NO: 27129 - DNA, 1238 bp, Bovine  19866881001875
acagcctcattaatatgctaatctggttgcaggcctggaacggagttttgggttggtggtgctccggggtggtgggtgtttggttgcttagcaacccttttctccaggtaacccttctctggcttgcccttgatatcccccaaaggattgcaatgtggaagaggaggtaagcggggggaaagcattctgttgtcacagaacagtgagcaaaataaaaggcaaacacacacacacacattcgcacacaccacattatgccgggtgtctttacaaacaggctcggggagggggcagggaaggctgggtgggtgtaacagacagacaccaaaatgcaaatgcagtgtgtggtctgtggaaataaacacaggggtaacacccttctacgcacacacacacacacacatttgtgtgtgcacataaacacaattgacaaatgtgttttgtttaacaaataaacgcacataatgagattctcagtttatgtaataatacgtgttccgtgtcataccctcccatcatacatacacatgcatgcacacacacatgcagccatagcctatgggcagagtcttttccaagaacacaatagatataaacgcactaaacacagtgtgatactcagaatgtgcaaatgataaataataatcgattgtcaaatgcaacacacacacacaatccacagagcttgaacagataggccctggtaaaaatcacagggaggtgtgtacatatgtagatgcacagaaatgtacatgcatcatgtatgatgtctctgcaaaccaacagtgagtgaatacatatgggcatatacaccgtgtgtgaccaggtatcccaggaggcgctaggtacacacacaaacgtgcacacacagaggtgtgacagagtctcagcccttttctctttcccttgtcactgctaagctgaacaaagtctgctttttacttattttttaaaattttctatctagagaaatctctcattcgaaacgatacaggcaccccgccatgttcacagcagcactacccacaacagctaagtcacgaagcaacccaaacgtccacacgcccattgacgggtgaatggatacaggagacgtggcacgcgcgcacacacacacacacatacacaggaatattactcagccacaaaaaaaaacggaacaaggccatttgcagcaacgtggatggacccagagaccatcatcctgtggaagcaaatcagaaagagaaagacaaata

SEQ ID NO: 27130 - DNA, 890 bp, Bovine  19866881027372
tcaaacccattttacaggtgggtaaactgaggctcttagaggcacatctcctgctcaaggccatatactttgtaagatgctttctatcccagagagcctgtttcctaaaccaaataactttaatttaactgatctccacttcagcatcctcctcttggtcaacttttttttctttttctaactcctctacttcctgtcctgtcccgggattctcaccccacgctctaccactcaaaagtggatgagtgcaaataaaatacttgaaagagaacaaataggtccagaccaaggcaggtcaactaggttccagtgtaaatccaaagatcattggccagaccacatggtagcagatggcactgagaggcggacttgaatgcggggacagaagtaggtcaggcacatccctcagcccttcttcacaggaaacctgtccctggactcggggcttcaaaaggatttggtcccacctcctgtcttgctccagctcctacagccattcccatacatcctagctggtcttcactcctggagccagctctaagccctgaaaggtaatggggtgtgagaatatggttttggaaaattgctcggttaagatccggatgcagagctagggttcctgtggggagtcctttcacataggagctggggcagttaccaaacttcctcttatctggggactgggcttctgcctgtgatgtcttccaacttcaaatgcattcctctgctaccagggcaacgccccaggaagataccaggaatcctatttattggccgctgggactaactcacggccaaatcagcaaatagcacttgagcacggaggatacccaaggtgcccactgcacatccaaaatgctaaggtgtcagttctgtatatgtgtgcgtat

SEQ ID NO: 27131 - DNA, 644 bp, Bovine  19866881109296
tggctgtctccgccttgagaagctctgtctggttcgctcaccatcacctcttcccaccaccagtctcgttttggtggaatttgcaaggcgaagtccataggtgcggagaggcccggtgggactccccctacgagatgctcagtatcaccccaactgcggtgggcctgaggccgtgtgcccacatcacccctccctgccccccaccacctccgcaggcagcgagcaaaaagtgagaagtgggaaaggagacgtcaactggcgcgaccccccagttaaagctgcggctgtttaccagtgaggagaacgctgcctgccaacccgcccgccatcccatctccctactgccggctccccccaagtgtttatttaagccaacacattgctctgctaattggataacattccatgtgaaaatagaccttttaaaacaacagcagcagcggcaaataaaaacagctgcaactgcaaaagtacaaaggctcggtgggctcggagaagggagaaattaaaggcgcatgcatggggaggaaaagaaaaagaaaaaaaaagaatgttctggttgctgaacctcaagtctgctcttcttcctcagtgaccgaccggcagtccaggtaaagacggagaaggtggcggcttctacatgg

SEQ ID NO: 27132 - DNA, 732 bp, Bovine  19866881166201
ctcgctgggaagggtgtgttcaggtggagagtttggaaaggacccccccccccccaagagagaccccttttaggccaagccttcttccagcgtctgtcaagggtagtaaggtacctcccagctcgaagttggtttgtggtcctcgacaaattaaatattactgtttattaccaggcataccccaataaaataaagaggcgaccaggcgatacggactatctcaccagccgctgcacctataggacgtggagacgtcacgagtcacgcaaccggcccgcgcgctgtcacgctcgattggggggcagtggcgggatgttgatttctcgaatccccgacttcccctacaactccctccaggggtctgcgcaaccacaagtcccagacgcctgggccaggggaaaaataaagaaataaacaaatccaactctctctggggacatgggggtggcggacagcatccccaaatagaaccaagatcgattttcttagggagggaggaggggagctttgggcgaagggaggtgagaatcccacctcagcccaaaggttagaaagaaatcgggttggggggaaggggggcaggaatcgaggtctcctgaaggaggttaagagaattttttttttcctaattttctcaggaggagctctcagcattggcgtttgaggcgcctctataactggttaagtttgggacgcgataacttagtgccctcttgcagacggcatagaagc

SEQ ID NO: 27133 - DNA, 723 bp, Bovine  19866881323432
ttggtctcatcagtgggcataacttctaagcagccccgtggtggatgcgcataagcctttgcgcgcagctggaaatgcactgggttcaggggcgaaacgtaccccatagacgtccctggcagcgccgagaggagaggtaggcctacccgactccgagcgatcgagcgtccgaccttccggaaagggtaagttccccgccgaggggctcccagggagcccgaactttggaatctgggctctccccccggcttcggagttcgagactgggtttccgcgcgcggccagcccccagggctttccgaagcatggcctggctccaggccccgtccatctggggctggagcggcgcaaaatgtgcaggaaggcagtcgaccgagcagcctcagaagctaaggtcaggcccgtgggggaaagcgaccagtggtttccagcgccggacgcgggcgccccggccaattttggccgcaggctctgctgcttccagcaaatagaacccgcgtgccttttctccgtcaggcctcaagaactttaccgagcatcgctttcatttcccaaattattaataattattttttacccaatgcaaggccctttgggtgcagcctttgcgcctgtggatgctcaagagcgcaacccgaaatccttcgcccaaaacctggaaacgggttcccatttgacctctgggccgaggtgagccggaaaccgaggcctgggccccaaagg

SEQ ID NO: 27134 - DNA, 845 bp, Bovine  19866881330176
ttcattagcgcaagactgcatcggatgaatcttcttcaattcctcaacttaaacaagagaccggctccagacctctgaagaaatagctttgctgggcatccatcactttgtcagattcctgagaatatgaagcaccagcgcatactttgtggtagcccacatttgagagcagaccatgtaggcacagagctaaacaggtcttcaatttcaattagaaaccccgtccagataacccagagtggggaggaagaggcggtgcagtattgggtgggcatgtggtgccggtgagggggtgggggtgccgggttgatggaaacaccgggtctctgaaatctccgccgctctgccctttgcccttccatccgtgcctccctcatctcctctgactccctcccactgccaccagagacagccccctcccaccacacagtggaggggaggccggggtgggggagcggaagggtgggtaggggagagccctggtgtagaaagagcgctgcactggaggaaccaacgcagggaaaatcacagaagggcaggctctgctgtctactttcattacaaggctttttcaaatattaccaaaacacaccgatccctttcataagagacatgggttccattcctgggctacgaagatcccctggaggagggcatggcagcccactccagcattcttgcctggagaatcccagggacaggggagcctgatgggctacagtccataggatcgcaaagagtcagacacgactgaaagcgacttagcacgaacccatgcacgcacgcgccagtccctttggcctgtccagtcaagaggatctttaatccaattctccactttctgc

SEQ ID NO: 27135 - DNA, 756 bp, Bovine  19866881398256
gagatattgttgctttattgtttaaataagagaatgacaaatgtcatacaaattacacaattagtatggaatgagttttagcccccaaacaacccttgaagctgccaagaaaaaaaaaaaaaaatcaacagtctactgaagaacaatttcatttagcagataatttagaatcttgtaattattttcttagttttcttcaaaccaaagcatgcagacagtattgcaaagagctcactgctgttggttactaggagagtgtttgtgtaattagcaatgtggctctttggaagagcaatatggctcttcttgtttggaaagaggggagtgaattctctgtggtgtcttgtttgttgatgcgggtttttaaaagtgtcatgactaatatgtctctggacttgagccagatcacataatgtttggcaggcatttcgtgcaggcagggaggaggaagtttggtgaagggctggaattctgtctgtaactctttgctggtgagatccgagtctttgtgtcccaactggatcccacatctgaacaatgtgtgggatcactggctgggtagaggctgaggttctggggtcatgggaagttccacggccttggtgagtccagagctgatcattccttcagcaatggtatgaggtgcaactcaatgcagtgtatgtgctcagtcgctcagtcgtgtccaactcttatcgacgccatgggctgtagcccttggggcttctctgtccatgggatttcccaggcaagaat

SEQ ID NO: 27136 - DNA, 1316 bp, Bovine  19866881648260
cttagctattgccgtggcgtttcccaaatctatccggtatctgccttcttttcctggggggaaaaaaaaaacatttgcagaaaaagaaggggagagagagaaagaggcagagagatacataaaggaacctaagaaaagcttttacattgctctaatttctgaaacataaaagctattctttttgagtaaatccatttttttcccctgtggcattaaggatagagaaattcctaggaaaataatttgtcaagtcccgactgatcaaagatatgtatgaaaagacctcacttttttttttttttttgcttcccgaggaaaaaaccagcccccatctccgttcagaatgaattggcaattcatttactgactgtcagatgaagtagcacgatccccatcacatctttaactgggacaggaccagaaggaagcaattctgtgcccaccgaatgtacaagctgggggtatgttagtgattaagggctccaggcctgggggaggcagggagatatgactcagattcgaaaatgcaccataaatctccctcttttattcaaaatgtgtgttttatagtcgtttcctggccaattgctgccttgaataaatatataacatatctggactgagcttttaggcccagagctggggtttgtcttgagggccaagtattcttgatatttccaagaacttagcaaagggcaaataacgaaagctctcctttcttcctgactcaccagccacatcctacatggaaaaatcaaaataagcgatcaaggctaagtgggcagagagaggtaaagcaacagctactcagttgagctaattgcttgtgtccttcaaacaggcttccactttaacctctcctctgataccctcaaccagatacaccccaatgaagttgccagctccaagccatggacagcattttgttcagtcaatgtagactaactccgacatgtggcccaaaactttggtttggtggattaagagtttataaagagttttaggtttccatttgttttttaaacatcaggccatctccccagctttgcctgccccccaccccacctcaccaactttcattgcattatatcgaggctgtcacttccagaggtgggaaagagagaaggctcatttcacccagtctctttttccctctccttatcaacttcagttaagcttggagtttaggctccagagtgcttcacagctctgattattgaggatttattacatgctaagcactctggtggctcaaatggtaaagaacctgcctgcaatgtgggatacccgtattcgatccctgggtgggaagatcc

SEQ ID NO: 27137 - DNA, 1028 bp, Bovine  19866881666465
cgatctaatagtcggctctgtatatgttaccaagtacttagggctctcttttggaaagccattatgcccatgtgatttccctcaaagcctttcttgaggattttgttttgacaggagggcattaaggggttgaaactgatagcataagcacaccacttacacactttgatcaaatcgacccataattctcctagagaaagtcttgtatatattaggaaggaaattaattttatgaccgctgtggctttgctggttaatggcccagcaagtcagcctgccccagaaggcgggctgtgggaggtgaactcaccactttcctcccaggctcaccatccacgggggaggatgctccacaaggaagaacaatccagagggtatcagccagcgggaacctgggatgctgcaggacacggatgcaggggaagctgcaaccccttccttctgaccgcacctctgcctcggggctatcccagctggaatgcccacagtgcgctcacagagtgatgcacatttggctcaagtccagagcccaggtcacaagctcttggcaatgggagaaattcaaagaccgtaattcggaagaccaaggcagtgacgtggtatcacacgtttctatgaattaagaaacaaactagagagaagaaaagaatttatgtaatgggaagatctctttttgtctcactctcttcatctgcctgccatgccacttaatgaggcagcctggatgggaaggaattttgggggagagtggatacatgtatatgtacggttgattccctgcactgttcacctgaaactatcacaacactgttaatcaggcatacccccattcaaataaacagctttttaaaaaataattaagggatctgagttaaaaaaaaaaaatacttgctccaacgtgggtataaggtgccagatgcaaacaaggtctcttgggttcttctgggctcctggatgctgagtgtgactccaggggtgcagatgatagcgttttgtattaatacaacatgtacccaggcagccacttc

SEQ ID NO: 27138 - DNA, 905 bp, Bovine  19866881782998
cccagcggcgtcgagccgggccccgaggccgccaggaagctcgaatcggccggggactgcgcctgcgacggcgggccgtgcgcaaagaagtcatagttgcctccgggcgcgtagtagtctccttggtagtctgcggaggggacagggcggcagaggggagagtgagagatggggaggtcgctgaagaaggactcaaggggcctgagggaggagatccgggggaggggacccagggagaccaagggcagagtaggtgcagatgcggctggggctggcgggacaggacgttcatggggaccatgcgacacagactcgaggttagagaaagacccgtggagaggcaggccagaggagcggagggccagactcggagttcgtgctggggagacagacaaccagtgagacgcaaaggctacagtctcaggagctgggagagactcagggacgatgaaggacacacacctttcaacatcagaggttccctgacacagagacggagaggagacagaggtcacgggggaagctcaagagacagaggattccagacagtgccttagagctggcgagagatacacagagagcgcgaggcactggacaactgccaaataaagagacagggagagatcggtaggaccgcacgcaagtagacagcccagactcagagtccgaggggaggcaagaaaagagactcagtcactgaacccaaggctgagatagacacccggggttattcgagtaaaacagagatagttcaggagccggaaagggaaagctgaggcggctgtgtgtttagagacgcagaaaaaatctggggagagacccaggaacaagatggaaggtgggggagagacaaaaggcgtccagagacgcgcgagatgagtcagacagagggccagggacacggg

SEQ ID NO: 27139 - DNA, 1205 bp, Bovine  19866881791028
ccttgaatctttaggtgacttccttgtgcagaggacaggcccactgggccccattcaagaggaattgggggtgtccttgtcaccccagaactggagtgcagcgcctgcctcctctctggagaaaaagatatataacgctgaatgctgtgaaatttgccgctgtgagaatagctaatttttcacacccagacgaactggctgggtttgttaaagcccaagataatcaaataatcattataactcatcttcgcccctcctgtctttcgctctttgtaccattaatgtcccagtggggtgcagctctggtgagttcagacctagcctatttagataaccttccggttggtcttctgagagcgaaatatccctcctggagtatcttacaacaaatgaaccaatcctctctaatcttcttatcgttgtagcctctgctccaggcctggttatctcgtgggcttgcaagagagagaaagccagagatttatacatatatatttacgtttgatagaaattgctataaatatatgtgtatgcatgaaataagaaaaaaggaggcaccaaaaaagaggctaagctcttttctctctccccagtgaggcagcctggctgcaagcagtctggcccctctgcctggcccgggaggcatggagaagattctaaagacttctgtgttctctgctccctccacctgtcttggctgtggcagggaggcgcggtatgggggtgggagaaaggagggtggctggcctggccagtggggtaggggaccagcatccaagtggccggctccctggggatccatctccctccagcaaggaggttcctgtatctttctctcccctgttttctcatcttcatgaccctctgtatctatatttttttgtgttttttttttttcttctcagctctctgtagctcccttccctccaccttctctctctttctctctctcccctttgagtctctcctgtctctctctctcctctctgctgattctttccctgtgtctctaccagcctgccctagctcattcctctctgtgtccttccccaccctcgctggcagcccttgcctgcattctcttctctccagaccctcccggagctctctatttccccctcacctcccccgcgttcagcgcccccagcatcctggtcccccccagcctccctccctccgccagctgccccaagcatctcctcaca

SEQ ID NO: 27140 - DNA, 2485 bp, Bovine  19866880271029
cagttcaaaagcatcaattcttcggtgctcagccttcttcacagtccaactctcacatccatacatgaccactggaaaaaccatagccttgactggatggacctttgttggcaaagtaatgtctctgcttttgaatatgctgtctaggttggtcataactttccctccaaggagtaagcgtcttttaatttcacggctgcagtcaccatctgcagtgattttggagcccaaaaaataaagtctgacactgtttccactgtttccccatctacttcccatgaagtgatgggaccagatgccatgatcttcgttttctgaatgttgagctttaagccaactttttcactctcctatttcactttcatcaagaggcttttgagttcctcttcactttctgccgtaagggtggtgtcatctgtatatctgaggttattgatatttctccctgcaatcttgattccagctgtgccccttccagcccagcatttctcatgatgtactctgcatataagttaaataagcagggtgacaatatactggggtatggtaaaaaattaatataattgaatgttgccatactaaggtcattagacctagatttttgatcattttttcaatctgattataattaatagctgcctgaaggacagggtgtattttggttacaacgaacaagagaaaacattgccggaatcacagtgacactctactgcgggagaatgaaaaagaaggaaaaaagaaaagcctgcttctatggtaaaacccaagggaagagaaattagataaaagacatgaagatatatgtgtgtgacatgctccatagcaaggttttaattgtccttttcacttgataggaaaaaatgcagacacttaatagaaattaaaaactcatttttcttgacttttccctgtgccaggcctggtggatgaaatcattctgccaaggaccttggtctgaagccattatttgtatagctacttcttgttcagaaatcagaaagtcatttaagctgggggtagacagctgtgtgaagtgttataaagtaagtgatgtctgaaaattagtaaggcagaaaagtctgcagctggcagcatcatctgaaattcaacaatgtttggaaaatgcttggcagctgaaagaatgggtgaagagaaagaaaaaaaaaagaaacaaaatttgacattcagaataagaacatgaaatatgtttctatgagacaaggttatattattatatattacatgatacatatatcctacatattgtctaaaatgtatatttcagagtagattgtactacttatactttgggctactactgtatatttttaaatatatgttttgacatttaattctcttaggacaaaatgatgtaaaactaaccatgaaaaaaatgtcttccaagctagatttctttattgaagtaaagattatacatatgaaagagaaaaaccttttctgtgcacaagcatttccaagtgacaatatgattctgtaataacaccagtgggacaagcctgggttgacagcctatgcctgaggatcttgtgcacttgtgtggttttttggagtctgtctagataaaatacattttctagattagatagaatgaacaggtaggctcctgggtgccctctcttttgggagaaaaaaaattgctttcggtttcaagtttgcaatcttgctacttgaaatcatgaaatagttacagttaatcaaaatacatcaaatactaatatcaataagaatgaatacatttcaggtcagtggggtggttggaaggcatcaccagccaactcaatggacatgaatctgagcaaactccaagagatagtgaaagacagggaaccctggcatactgcattgcatggagtcccaaagagtcaaacattacttagtgaaggaacaacaaatttttatatttgtgggcagaattctttcttagaactgctcacattctgttttggttcatcactttttactggatgtaggaagggaccttggccactggactagattttatcttccacagttggagcgacaatgtactccattccacatatttttctttctgtgtgatgtaaacctgttctcatttaatgagtgcattccaatccctgagtcgggaagatcccctagagaagaaaatggtaacccactccaatattcttgcctggaaaatcccatggatggaggagcctggcgggctacagtccacagggtcacaaagagtcagacatgactgagcaacttcactttctttcactttccatccctttgggtggaatctgagggccgccccaaacaagaacttacagtgaaagtgatgcaaatgaggtgcaaagtgaggtcataaaagtgccatcaacttttgctgtgttctctcaggatgctcatttttggaacccagtcatcacgctgtgaggaagccaagtagaaacttggagagacagcatctgtgttctggttgacggcctgttatgga

SEQ ID NO: 27141 - DNA, 3759 bp, Bovine  19866880422779
tgaagtagtcatctcaaacagaaagaattaaacatgaggatgatatatcttagaaaagtcctaaattataacataagtgaacaataaaattagatcaatttctgatcatgaaaatcaatcagaatccctttcatgaattatggatgcctgctgagacagtcaaaccgtttcatccttgaagggctcaagaaaaaatagtagaatttgctttcttatttcaaaatgaagaggttttttctttatttattgctctaatcatctttaactcagtcttctttctcccactattcaaatcacaagtatctcttttaagctccaagatgtttaataagtaaagaaaaatgaggaggaataaaattgaatagtatcgatcacttaacaaagttctgaggctttttctcactccaaaaagaacattaagtactttgtttttgaagattttaaatatagatggttttataaaatgatgttctggggtttttaagcattttgataactgcatccttattttttaaatctgtctagtgactgataaatggaccatggatacctttgctttctgtctccagtggatgttcagatacactcaacaactggatggtatattctacacagtgaagattatcccttaaaaaggtcattgtctgaagtcatttgcataagacaattattcagtctgaaatgagttagaagtgatttctgttgcatatgccacatgtggataagaacctgtaaactgcaaaagatacacagaaagccaacacaaattgagacctgtgataatttcacattagccattgtcctctaaataaagatattccctcaggacacagactggcttacgttggagtctaacaagcttagcaagctgactttttaaattctctaaatgctattgaacacatccatggagtagttcactgctatttttcagagttaaagcaatctctgaaggtcggtgactggcagtaagaaagtaatttaaataggagacaatccagaacagtatatgagaccatctgatctgtagccatttttgctgaaaacattacgaattagcttttatgtttttggtgaacaaaaccaacattgagtcttttaaaaactcctcgtaaattaacagcataacagatattcaagacccattccctgtgtttccatcaaatattgtttcttctataagaagtggcttccttggtggctcagacggtaaagcgtctgtctgtaatgtgggagacccgggtttgatccctgggtcgggaagttcccctggagaagggaatggcaacccactctagtattcttgcctggagaatcccacggacagaagagcctggcaggctgcagtagtccatggggtctcaaagagttggacacaactgagtgacttcactttcttttctttctttctataagaatagagggcttccgggtggctcagtggtaaagaatccacctgcaacacaggagactcaggttccatttctgggttgggaagatcccctggaggaggaaatggcaacccactccaggattcttgcctgggaaatcccgtggacagaggagcctggcgggctacagtccatggggtcgcaaagagtcgggcacaactgaagcaactgagcagagcagcagaacaagaatagaatcttccttcctggtcccagccatgatggccagagcacagaaactgggagccgtgcttctctgagagtctgccttgggctctgcggagtacagacacacactaagataatttatactttagcacacaggggtggctccttgctgggaacgtgtctatgactcacaccattccagctccctggaaacatttcttcacggctcctgccctgtgtccctgaaacagaattgaatttagtggtttgtgaggtgtgcctcttccctcttccaagatgggcgaagcttggaggtacaggaaggaattagcagagcaactaagcaaaggatgaacaaatgggtgacgtgtggatttctccctctgacatggcacatggactcagtggattcttgtgcgtgtaatgaagtgccagacgaagagcaacatttcgaagtccacataggagatagggaagagcagaattcaagtcctgtctttggagtcccaccaaggggaaccccagggctagtgcaggaacctggaccagccatggtttccctgccatgatggatgggagtgctcttaggaatacaggccaattcccaaaaggacgctgtctcagaaaaaaaaaaaaaaagatggtagttgctggtgtctcaaaacaagaatgacctattgatcatccattgatctggacacctcatcagaggaaagacactggaagttcaacagagtaaaaggagaaaaagatgtgaccacacgtgtatgtccctcgagtcgatgaaccaagtcataggagttcaaagtgttcatgaaatgcacaaatacataataaatgtcacaagagttaatgtgtcgccaccatccacagacttcccagagaagggccctggctagttttcttagtttaataaaatcctgcctccaaattatgcagcccccacagtctaattaaacctgacttcttgccaagactttttaaatgtttttcagggcattgctcttttagcctttttaaaatgtcgtgaacacagtgaaagtgaaagtcgctcggttgtgtccagctctttgcgatcccatggactatacagtccctggaattctctaggccagaatatgggagtgggtagccgttcccttctccagtggatcttcccaacccagggatcaaacctaggtctccccaccatttaaggcagattcttcaccagcatatgaatcagtgatgttggtataactggatttatgttagagaatgcattgtaattaacaattacatagcatattaatataccaacattgctgattcagagttcacagataaaattattctcttcttcaatgaattacctgtatcttgagtcctttctgaaaacctatcacccctcaattacacccattacatcctagaaaaccttctgccaggttctttgtgacccattaaacatggagtcagaagaacttccatatctattaaaaatatattagacttttaccaaaactgaaacataattttcttcaaattcagaaacagaattttggagaaaatcaattactggaattttcatgttcttctgtgattaaaaaaaaaaaaaaaaaagccaatataagccaatcatttgtgaaactgttaaacaggcaaagtgtcttcgagacttagcattttcaggcactcagtattttcatgtctagttttcccccatcactaagagaaggactggtcaacttattcatggcatggtgttgtgaattgacatttatgtaacctcagaattgaaatatgtcacagagaccagccagcccaaacttctgcctaatacagtaatctcctcttcattatccttgagaagcaaacatctctgttactcacacggatcaatccctttcccatcacactgccaagcaagctgtttcagaaagttctgacctcctaggggtcaaggtcacctttttcagctttcatccattacccatttttgatgccacagacaagagtatgtccaggcttatgtgtgacagctctccaggtatttgaagaaagttattttattctcaagcggccctttcactgggctttatttaactccagtaatttcaacttttcctcttatgccatggaatttccaattgactaacaa

SEQ ID NO: 27142 - DNA, 2082 bp, Bovine  19866880453315
ctagatagcatattcaaaagcagagacattactttgccaacaaaggtccgtccagtcaaggctatggtttttccagtggtcatgtatggatgtgagagttggactgtgaagaaaggtgagctccaaagaattgatgcttttgaactgtggtgttggagaagactcttgagagtcccttggactgtaaggagatccaaccagtccattctaaaggagatcagtcctgggtgttctttggaaggattgatgctaaagctgaaaccccagtactttggccacctgatgcgaagagttgactcactggaaaagactctgatgctgggagggattgggggcaggaggagaaggggacgacagagggtgagatggctggatggcatcactgactcaatggacatgagtttgagtgaactccgggagttggtgatggacagggaggcctagcttgctgcagttcatggggtagcagagtcggacacgactgagtgactgaaatgaactgaactgaactgaaaccctttctatctaatatgctttaggggcagaaaaggaagtgtcatttcagagtccattgtctgttttctagcttttgctgctctgacataatttgactctgaaattgtaaaattaatttcatgtaaacaacataagatgattccaggttagatcagagacaaagacatactatgagatgagctggatcagtaatttctaactttctccagggagttttgccaaatcttagcatcgcaagaacgtctcaggtttctttaatgttctttaattttaccagctttactatatgctgtacaaataagtgggctgtaaagtgcacttaaagccaaaaggaataatggcaaataccactgataaatggttctacttggaagtctctttatcaagtatgttagcagaactaaacaaaagccagaaaaaagaatttatgggaccttcgcaaaggaacttgaaaaaaccttttattttatttttttctaaaaaaaatttttttttctttttctaaaggagtaggctgaatctcaatgtgcatttaaaattcagcccattgcattctcaatactatcttaagtatggggcaattatagttctatcctaagtgttctgacttttcacaatgggaatattaagcaaaattgtagctaggtcttgaaattggatttcacttcatcctgctctctagaccaaaaccaagatgagctgaactcgccaatcagcatacgctttgaatatgagaatatgttatcaaagtaagagaagaaaaggaaacagtttgtcttttcaagggctagagactgtgcaaatggctttcaaccgcccctttatgagagctatacgtggggagggaggagttgggggagaagttggaagtgggtattattccaattgaagaacgagggtttccaactctattatgtccacctgcgtgtggaagggagcgagctgcctaacagccaactttgtttcacaaaagtgcaagaaaaactgttcagggcttggtgaatatgattgttatctgctcgtattcttcactgaaattgcgagcaactttagtgtagaagacacccaaatctatacacatctggattttttttcttaccattttgactttatgaataaatgcaaaaaatgccttccagtctacagtgcgtttctcaaaccagatgaagaagcaggtagttctgccctaatcccaccttgataagtgtcttccatgacaatatttatagcagttattgcattcacttatttcttgaagattatccatcagcagtgctctagtcctgagatgaacaaactgtaccatacgctaaccatcacgccttgcattttgtactataaacggagagagtgaacgtcgggtcttcatctttgctatttgctttctgattggccacagtaatcagctttttttttttttttaatgcatgaagaggaaaatttgtatatgtatatctaaaggaagattatttatcatatctggtcattttctttcacttcagcattcatctcactattttaattcagcaaataaatctaaagcatggattaggtcacagacagtct

SEQ ID NO: 27143 - DNA, 1344 bp, Bovine  19866880464122
cctttttaatgcaatgattctcttaaaaatcacaccagtaataattctgtgcagaaataaggcagccaaatgtgtggaaataaattccatttgtgtataaaatatctaagataggaaaaattatacttgtaaaatttaaagccagctaaggattcattgaaaaaaattttcatataccatcccttcaaatctggttttaaagaggctgtaacataattctaggaataaaaactttctggaaccggggtctatggaaaagagattacagcccccataacattatagaaatgcaaagagcttgcacgatcatctcagagaagtttcttttctttccttgctgtagacaaggaaacaattaaacaggggttctgaaaacattgctttctatgagcatacatttcttccattggtgctgaattttgtattgattaattacatttttttcctctttggaaagaaaacttttaagggggaaaatcactgttgtgctcacatgaaaacttcctattgactttgagaggtaagcattgactttttgatgggagggtgcaacttattgaagacgaaatttgaacccctggtgagatcctgattctagggtatagtttagttatctaaaaagaatgtgtctaatgtcagtctaaagaatcatatgcctttagatttttatatggggaaagttcagtaagacattttgacatagaaaatttcaactttgaaaaggaactttaaaaaaaatgctgtttgttcattcttttgaaatatatctgagtacaagaagagtaactaaacagcaaggaatgctgggcacagggttttcaccactttgaactgtcagatagtttctcaaaatgtatcaggcactgggaagtctagggaggttttagaaagtaatcaagcaatggctgacgatgcataagcctgaatcatcttatgtgctattgcgtgttttttgtaggcgggaaagtcattgctgactgtgatgggggctgggtgatatagactcttaatgctctcaacattttccaactcgcatgtcaggccaaaattgtaataacaaagctcagggcagctgcctgcgctgggtttggttctaactcaggtgagaacattcatcatgtctctacccttcatgaatgcacatgcatacaggttttcaaatataaagtcaaaagacatttcaagatttgaatagaacccttcagacttaaaagtaatctgaaagcacaagagttttgaaactttcccaaggattaaacaaatggcaagatcttgtctgtttaaatggtgtatgtcttcaggcctgtcagatctcagagtcatattttcaatagaaaaatagca

SEQ ID NO: 27144 - DNA, 4851 bp, Bovine  19866880475869
ctacagttgtagcaataattgtatcaatcacatatcaaagaaagtgtctcaccttttagacgagaggggaaaatcccatgaagaggatggcacgtatcttggcataatttttcacaggtgaaatcagtactgttcacaaaagagttcatgaagcccactgcctttacatgaggtgtaagatccagcaggctggtaactgcatgcagtctcaggcctagagctgtttggggccgtgttttaaatccccatcccctgtcgcattctctgtcccctgcccccactcaccactctgcccctactcacctcatcctcctcctgctcccccgctaccaactacaaagagaagacttcttctgatcggcctagaagtttggtcaaccctgccagatacaattgcattcatctcagaagttgctttcgtgccaagggcttgtcagaatgtgtaaggccgaatggaggtgcctctgcacttatacatgtctccatgacatgtttatttatttatttattttcctgcttgctaataacgccttccccttgggaggatttccgtctgataactgctttaatcattacccacactatggagaaggaaagggcaaaccactccagtcttctcacctgggaaatcccatggacagaggagcctggtgggccacagtccatggggtcacaagagtcagacacaacccacaacaaaattaccaccaccacccatgctatagtaagacaaacacaatatgtgtgcaatagagacactcaggctgtagtcacaaatacttgtggtccctaccacacgcaagccaaattgctggggggttccctgaccactgttgaatgcctgaagtcagctcacagatgtgatcagaacttcacagatgctgaactcctatagttgagatcacctacttttcctttccttccccttttaccaaaagctgactcttcagctttttgtaagtttttttttttttttttaatgtggatcatttttaaagacgttattgaatctgttacaataacacttcttctttttgtcctgatttttggccatgagacatgttggatattagctctccctgaccaaggatcaaacccacaccctctgctctggaagaagtcttaactcctggactgccagggaagtcccatgattcttgagctttttagcattttcttcccctcccagctatctcatcctagtctctcccgagtctcaacagtcacagagtgattctgtcttgcggctgcctttcccgttgggagccactcttcattcttgtgaggggctgaagtgcgctcctcccagactggtgggttgaagtgctaacctcacacctgtgaccgtgacctgatttgcaagcaggtcatctcagatgagatccatttaagctgaggccatcagagcacgctctaatgtgacttggctgcaacttctatcagaagacagacacggggggagtcgaccaagcgaacacagaggcgaagaccagaggtttgctgctgtcagccaaggagcgcgtggcattagcagcagctgaaagaagccgggaaggatgctctcctaaaggttccagagggaacaagtctctggctgacacttcaggactctgagaaaatacagtagttatttaagtcacactatttgttctgggggcctaggacataatacacttcccagcattattgatgctgtttaggcttcagcataaaatggtgctaaacacttgcttatcatacaaacgataaggctaatgattgatgataagactaatgattgatgatgtcaaggctctgactccattcacctcctcttcatcctttgtaatgaaatgagaccaaattgactcttgtcattctcttgcttccctgggggctcagccataaagaatccacctgccaatgcaggagcctcaggagccaagggatgttgggttccatccctggttggggataatccccctggagaagagactggtaacccactccagtattcccgcctggagaatccactggcgggctacagtccatagcgtcacaaagagtcagacacgacttgagcgactcagcagacaggcaggccactttcttgctcaaaatacttgatgattatcacctaaatttagaacagagtccaaatcttgagcttgagtctcttaggacccacccttgctcttcaaatgcacctcttactacactgcttcagaccctttcctgaacactggaatcttcccacccttgcactccaaagccatctgctctccaggacttgaccccacaatgtcccccatcagaactgccctttttctctcatctccactggtcagatccagttcacatgccatcgcttgagtgatggcttttataatctacctatccaaacaagccttttcatctctctgcttcataagactgcatgtatacatactggtatcataatatgctctatgttatagtaaattgtatacatttgccatctcaattagattccaaactccttaaggcttttcatttttgcacatgctgtcttatcttgcacagaaactggcatatcacatagtatttgtcagactgaattggaaaaaaaaaaaattgtgggttgtctcagtaagattcgatgcctacatgttagtgaaatggcatctatcctctttatgaaaagatgcccactgacattttcccactcaggtcaagtctttctggtgattaaccaagcaatagatagtgcatgagagaaagcaatactcacgcaactgtttatctttagtaacatgatcattgtggaggcatccactccccaaacacctaagatatgcatagctcttccttttcagcaaagtatcagaaatgtttatctaaaaatagagaacggaatatctcatatcctaagctctagagaaaccttggaatcctttcctgaacatcatgaacacacaatggacacaatctgatacttgtttttgtgactgatggcaacaattcaataaggctggatatcgattgactagtagaatgctattttatagaattcttttatttctttgagcatttcaagctttctgtattattgcgtgtagctgatgaactggatttggtagacttcctcctggaagttgtactcttgcttctggggtttaggagtttatgctggctcagctcatgggcactatatttcaaatgctcaaagtaaaagattttcatacaagcagtactcttgtctttctggaaaggatgaacatttaaaataactgtgtgcaaaatccacacattgactaggtaagattgaggaataagcattgacaaatatgctttcgaaaaataaactcttgaattagcacttttattatgaaacccagtgcccaatatgaaccaaataacatcatctgcaaaactaaaaatcaatttccaaaaaaaaaaggcaatctaacataggtcatgcaaattctagaaccatgaaatggtatgtgaaaaaggaacatttgccctgatttgctgtaataaaaccatggactataaattatgaccaattcagaatggctcttaagtcagtttttaattactgagtgatttgacctaaaatttctatagctcttccttttcaacatctgcatgtatcagtttagaatttcatctatgcttaccaatttagaactgtactccatttctgcctaacacttatttccaaggaaattaaaattgggggaatatcctacctaactctttccaccagcacttcccagtagaacacataatattaggagtttagcctttactgttgacactcttggaaagtgaagagtgaaacgtgttaatcactcagttgtgcccaactctgtgaccccatggactgtagcctgccaggctcctctgtccattggatttcccaggaaagagtactggggaagtactgggagtgggttgccatgccctcctccaggggatattccccacccaaggatggaacccaagcctcctgcatcgaaggcagattccttactgtctgaaccatcaggccactattattattttgctaaagctctgtaaacatcctacacttaaatcctttgttttacaatctcttattacccagagacaaaaagcaattcaagaatatcaacatcaggcatcccccttccccacctggatcccagcccaggttagggactcagaaaagaatcaaatcccaatacctccaatggagtcacacctgtcttcttcaagatttcttagagttgcaatgtggacatggtttttgtcaattataacaaaacttttgcttcagttgtacaatctttgcaaaaaaaagtcttatgtattccagttgacttacttaaggatcaaacaacatcatagctttagagcatcaagcttaaccatttaatttcgtcccttgtgtgacgatttccaactttagttttcatcatcatagaatgctgacgttcataggaaggtagtaaaagagggaaacattggttagatttgaaatatgtccaacaagcaggatcaatggtaatgcctcaaagccgtatctgcctctggagctagtttctagagatactgaacatttggttccagctttcttaaataatggaattggcgtcacagaatcctgggagcatgtctgttcaacctctacccatatccatcaagtttttctgtcccaaggagtgtttgagcaacaaagcagaaactagacatccatcgtctcttgagaagcttaggtctaatagaaggatcagagtagaaatagatgcagagatgattacagtcataatgatgcttaaaaggaaattactattcaaaaatggctttagtataaacatttctttgaggatcgtattaatctggaaa

SEQ ID NO: 27145 - DNA, 1291 bp, Bovine  19866880477425
accacagctcaagatgaagtcagggacctgattaggcaaggagtctgaaatggatccaaaaagccctgggaagcattagcacaatgggtcccttcaaaaatccaggagatactgtgtagcacagggaactatatttagtatcctgtgataaaccataatggagaagaatatgaaaaagcatatttagatgttggagtcagcagaaattaacacaacattgtaaatcaactatacttcaattaaaaacacacacacacacacacacaaagtctgagaggacagtggcaggcattggtggggtaaggcttgacagtcacttctctgctgtgtttttacaggtagagcagtatttcaaagcattatctggtgctagaatgcagtaactaaccagcatgggagactaaatcagaacccgctggtacccgcaaacgaacatcaactctgcatggtcatgtgactctgaaacactttcaaactgacgtatatatacactacgatatgtaacatagatagctagtgggaaccttctataaagcacaggaagctaagctcagtgctcagtgatgaattgggtgggatggagggaagtccaaaaggagaggatgcatgtatgcatattgctgattcacttctttgtatagcagaaatgaacacagcattgtaaagcaattatactccaataaaaataatccataaatacataaataaaagatcattgtaggttgctggctgtccgagggttagacttctggtagcatccatgaccctgcagtgtgagatctgcttttagtggcagctcttatgtttcttcacgtaagcaaatgacaaatgatgcttgtccttctgaataagcaggtctgggttaggattatcagaaagtcagtacttacacccaagagaatgttgccaccaaacccagaaaattccacctgatttgctaaagtgaaaagctcctccctgattgtctggaaacctcaccatctccccactctggctcttttatgagttatcataactcagcggtagctgtaatgtaactgaccagcactgatgatgaaatcaataaccactaaacaaaaataaatggtgttttgggtgtaagaaacacttagccatttttatcttagggaaagtacatctgactgaagtgtgctccaactcctcatatttcacattttttaaaaaataaactccaattctgctaaaatttctgtagtgtctaatcaatatatataacagtggcctgtctctctgggctcaaatagaatcagtgcgtcatttagggaggaaa

SEQ ID NO: 27146 - DNA, 1526 bp, Bovine  19866880482917
ggatttcccagacaagaatactggagtggttaggctttcccatctccagtggatcaaactagggtcttctacattgcaggtagattctttaccatctgagccaccagggaagccccttaagtgaccataggtcttcctttttccctaaaaattcaatcttgaaaaaacagaaaattcacatggacaaaccccattatgcagttttaatcaatctcataaagatataaaatgacccaaccaaaagacataatttcagtgacaaccaaattaatattttaaactaaactaaagaaattagaacatttcaagacatatataattcctattttataagactaagaccaataaagtccctacctcaaaataggagtgaattacacatattaacaaaaatacatcttcctcctgcaaacagcacaggcttaacccttagatgcagccatttaaactcatcacagtaaaataaaatatattttgcacaagaaagttgcattttccataataaaacacagtggatgtttttgaatgctacttccatgagttcaagctttcaagacattgggtataaaaacaaaaagctacacaggaataatgtggctcatagtgttttgggtcaattttgcaaaagtgatgtggcaactacagacaaaccttatggggaaaacacgaatataaaattttgaatgcctagagtgtaagaggtcctaacgtgtgatgacaacttcctggtcttttctcagaccaagtgaaattgtattcagataattttccatctgtacttttcctttctgtagatcccttttcctttcctcacatttaaaaaaaggcttcaaacagctctgcagtattttggcaatgcaaggacttttaatctgaggtcatggtcagttttccctgtcacgaccactttgcccagaacatgcacagatactcagctcattttcctgctttgcaggttttcctcctgttttgaaagagtcagtagaaggaggctgggcacgtgaattcgctccacacagatatagtcagagaagttttctactgcaatccagtctgctgtgaaggttgagcattagactgtatttctgaggtgtctgtcctataagtggaaggggtcatgggatcagcctgggcttcaaggcaggagaaccaatccccagatgcccttctcactggagggttttgaggctgttctaagtccccttgtcctcccagtggtggtgcttctttcataggagaggtgtacggatgacgcaagacacaatgtttgcagttgcatcagacacaatagagcgccagacacacgcaggctattgtgagatgcgtctacgggtcagtggccgtccttctgtaaagtggacagcgggagaagcaccactggaccagtctcttgctgttcagtagctgagtcatgtctgactctttgtgaccccacggactgcagcacaccaggcttccctgtccttcactaactcccagagtttgctcaaactcatgtccatgagtccgcgatgccatccaaccat

SEQ ID NO: 27147 - DNA, 1152 bp, Bovine  19866880513025
ataatggacttgtatttagagtatataaactcgttacagctcaatagtttaaaagacaactcaatttaaaaataggcaaaggatctttttccaaagaagatataaaaatggccaatgaaatggcacatgaaaagctgttcaatgtcatttgtcataaaagaaatgcaaagtaaaacccagataagatgccacttcaaacccattagagtggctatgatcaaaaagataaatataagagtatgtaaggatgtggaaaaaatagaatgcttcagcattgctggtggaaatatgaaatggtacagtttctttggaaagcagtctggcagtttcacagtaaggtaaatatagatttagcatatgacccagcaatcccactcctaggtataaacccaaggaaaatgaaaacatatgtccacacaaaaccttctacatgaatgttcatagcagcattattcataatattcagaaaatagaaacaattcaaatgtctatcaactgatgaatggataaaaacttgccccaagtcacacaagggcttccccggtggctcaggtggtaaagaatctgcctgagatgcaggagacccaggtttgatctctgggttgggaagatctcctggagatggaatggaaacccacttcaatattcttgcctgcagaattccatggacagaggaagcctgtgggctacagatcatggggttgtgaagagtcagatgcaactgagtcactaacactttcacttcgtaattgacagagaccgtactgatagagactgatgttttgaaatgcaagtcttatggaactaaaataaatttgttaaatgcaaatttgaattcaagatggcagaccgactgtgtacacatgacctgactttagttggtggtggtatttataactattagatcttttttagtaatattgttagccttctgtgtggagtggtagggggaattagacatccccttccttacagtctcagacagaattctgctgtacatgcagtcatgtatcatcaagcaggggcaaaatcaattgcactaaacttaatgttgtcactctctctattttttttttttcccatcctctacttgcacagagtgtaacatgtttactcaagccagaagacaaaagagctaagggcaaaattcag

SEQ ID NO: 27148 - DNA, 1655 bp, Bovine  19866880565930
gaatgcttaaagtaggtcttactctgagggacaactgagtcccagacagttacatatccatccttaggtcacgtgaccagtaaacgcagcaccgaaactgagtagtaggatgtttgagagcaaaactgcttgaagtgaagtgggaaagtcactcagtcgtgtctgacttttgtgaccctatggactgtagccagctaggctcctctgtccacgggattctccaggtaagaatattggaatgggttgtcattctcttctccagggggtcttcccgatccagggattgaacccgggtctcctgcattgtaagtggattcattgctgtctgagccaccagggaagcccgtgactcttaggcaatttataagactgagtccagtagattgttaacatgtcaaagaaggactttcaaagtatctgtggagaagtgccaagtattgctctcattgtttaaaatttccagcccatggaggactaatatttgtataaaatacaatatcatgtcactgctgtgtcctattgctataaaagttcctagatattttcattgtggttctgttataaactgtccacaaactggttttaaactcctttcaatagcatgaacttaaaattctaatttgggatttcttagctctcactttctagaagtttctgatatctttgaattcaagttgcagacagtttcctccaggaattgattattttcattctttgcaataactgatacaaaatgtctaatataattcaagagcaccaggaggttttattatcagtgctccaaaaatagccccaccaaataaattctctccgttgtattagctgtatgtattgtgtatcataaaacaagatagtttatgaaaaatagccgttttgacttagatatgtttttcatcattctccaaaatgttatgggggtggttttagggcttgtggtattatttacaacaagagtaagcgttctttatattgtgctgtggttctatttctttcttaatccttagaattatcttttccttcacataatttggtgaaagtctgaagtttgataaaattgcctttcatgtagcatggaaaggaagactaggcagctccttagagatatccgctagtgttactagtaagtctaaattcaagagtccaagccatgccctccgggtttctattttgagttggataagtattaaaaaaaaaaaattgtgtgttctctttaaccaagtatgttggctaggagaaggttatcatttatctctctgaaccagagatgagaaatttacaagaccacagggggcaggtagtaatttaaatgagtgagggcttctggtttagaacaaaagaccctagaggtggagtcttcgctgaatggaagacaccccatagaaagacattcacattcagtattgtaaagccctctctgaggcaaacacaggtgtcctggcatctttggtagtattttcatcttctgcatacatcagcagcgtggattctcaaagctttacaataaatagaaacaaatcctaaaccattcagtttcattgaatataaaactgtttttaattttctgatttacaagctacttctcagggtttcccacatgcaaataaaacccccctagttttttgagtatcatactgatgacagggggagaaaatgca

SEQ ID NO: 27149 - DNA, 1464 bp, Bovine  19866880587348
taaaaagccccagcatgggcttatctttagtcattagatttaggatcaagtcctgtatctaactatctaactatccaactctgtgggcttgaataagtcacttacctgcctgagccctagggccttaatccatgataccaccagatagtccagaattttccactcttatgatgcagtgttatactctctgtatgattgagtacttaagggttcttcatatcatttatttcaaaagctcacctaaggaggggaaaagacaaactcttaaacacagcatctcacacatcatttacctaaacagtaaatatgtagaatatgagatgaacctagattagaaaaacaaaattagagcaagtttactgctgatatgttgtgggagcaattttaaatttcatagcttgctttcatttcctttctaaataaagggattttgagatagaaatttaggttattgttgttgttcggtcactcagtcatgtcccactctttgtgaccccatggaccacagcatgccaggcctctctgtccttcaccatctcctggagcttgctcaagctcatgcccatcgagtcagtgatgccatccaaccatctcatcctctgtcgtccccttctcctcctgccttctatctttcccagcatcagggtcttttccaatgagttggctcttcgtatcagtattggagcttcagcttcagcatcagtccttccaatgaacattcaggtttaattcctttaggattgactgctttgatctccttgcagtccaagggactctcaagagtcttctccaacacatagttggagacaaaatttgattcctaaaagctcacagtctaaatgggttacaggcacacctcacgtatggatactcggggcagaaaagctttctcttcaaagtttcaatcttaagccttttatggagttcgcgttgtcggcggccacacgtcatgtagacgggggcttcctttctgaaatatgcctggactgcgcagcctgacatgcttgtaaaccaaatacaggaacggcgctgcagaaataatgacttcatgcccggcatccgcgtcctatttccactgtttaaccccacacacattgttctcatttccactcttcacgagacatttgttcttttcactgttctgtgctttaagtggatgaggttcatctggtttgctgatgttatgaaatatggaattcgcatattaatggtcctaaagtcatatgggaatactttgcaccgtgtctttgccacgacgtggcactacctggtaccgtgcagagtgagttaacatgatattaaattactgcttttggtgtcacttgcgtttcttattttcagaggacctttgtcctcctgtgggtgaaatgcaaccactcatggtcatccttggcgagcttatgcagagtttgaccttttacataaaactatgggatcagcgtatttaggcttcagaggagggat

SEQ ID NO: 27150 - DNA, 733 bp, Bovine  19866880595376
tggcacatgggcttggttgccctgctgcctgtgggatatttcccaacaagtatcgaacctgtgtctcctgcattggaaggtggattcttaaccattacactgccagggaagttcaaagagaaatatttattgcatatttttagtgggcgagtatctacacttggacatcatatgcacattcttcaagtattccaatatcatggcacaataaaaattcttattcatatcctaaagatagtgaaactcaggctcaaagaggataaaaattaaacacaaaaagtccactagtaggtagaacacccatgcaccctcttgaaatgtgctgtccaaaagcagcaacacacaaaggtccatggcctcgggctttttctcacaagaaacatagattcaccatctttctctactctttgcaccctcctgaattaaaattacaaagtgcattcacatttataagtcttacagctttttgatgctgtaatgataaaccagcacaacttatttttgagagaaagaaaatctgcatcctatagcccagaagagtcggttccaggcagggcgatggatggtctgacagtttcactggaggttagaagggacagctgtgttccacgtaaatttgctgacctttctgaactttccatcaacaagattttctcatcctcccattattgctgtccgacaattaatcaacagctgttgaaacattataagcatgcttgtaatttggggtaaa

SEQ ID NO: 27151 - DNA, 1415 bp, Bovine  19866880620790
gctcccccttccctgggattctccggcgagaacactggagtgggttgccatttccttctccaatgcatgaaagtgaaagtgaaagtgaagtcactcagtcgtgtccgactcttagcgaccccatggactacagcctaccagactcctccgtccatggggattttccaggcaagagtactggagtggggtgccattgccttctccgacaagtggactagcacatacatattttgcaactaaactttaaaatgtccttaatttctcaaaataaaaaaaaatcaagactttgcctctaatttttcacattgcttcactctgtgatattctgaaaatacaacaataaagagatctgtggtttagggggaacaaggaggtaagtaggcagagcagagagcatatttagggctgtgtgaaaatacggactgcgttatcatagtgttggaaatacgtcatatacattcatccaaacccacaggatggacaataccaagggtgaattgtaaggtaaattatgggctttctataattatgttaatgcttctatgttaatgaaggatcaactttggtaaaaaaacatccactctggtgagtgatgtagataatgggggagtcagggaataaataaatgggaaatatttgtacctttctctcaattgtgttgaaaacctaagactgatctaaatgataatatttgaaccacaaaaagaataaatgccatcgaaagcagtataaaagtaaagggcgaattatcaacaaacacagacatagctccttttctggaaacaataaagcaaaaacacaacactgtaagtcacccatactacaatataatttcttttttaaaataaaagggagggtggacaagacgaaaaaacaaaacagtttgagagtaatttgaccttttgaaagatacaacatgaagtcacaagggaattgaaaatgaagggaacaatacacaatatttaacaattagcaatggaagtgtgcagtaaaaatggcatcactttatcatctttcattgtaaggaaacactaattccaaacatcaaagagccacataaacgattaataatgcacttaaatgaactgatgtggcattgtaaacaaaggtatcagtggcagctaattcttggagtgtggctgatttctctcacagggccccgctcaaatcagttaaagaaagtcttcattctcttgcagagatcgtgtgtgtaaccacatggtctcttttacataaacaaggtgcatgcgtgctattgttcacacactgtgtgggagcaactgaaaatttaaaaaaaaaaaaagagcgagctggaaagaaatagttccataaaatgaattctttaacatgacattatcttctcaaaaatgcactggcctaacattgggaaggagatcattgtgaaaaaataatgg

SEQ ID NO: 27152 - DNA, 1155 bp, Bovine  19866880716311
tttaacaagcctccggcggagcacatgatattctagggcggaagccgcagttttttctgtaaagggccacttagtaaatattttaggctttgcagcctgtttggtctctgaggtaaccactgaactcattttgtgagcacagccataaacaatgcataaacaaatgcattcagccgtgttccaataaaactttatttatggatgttgacatccgaatttcatgtaattttcatgtgtcataaaatatttttctttggatttttccaaccatttaaaatataaaaatcattttcgttcacaagccctatgaaagcacgctgatattaataagttgcaaatgatttttgtccaattaaggtatagaatgatttctcccgtgtagggaaggcccatcaagggtaaaagctttatgccctataggatgttaactggttttgtgtttgatttttgtttgtttttggcacagcttgtgaaaccttagtgaaagcggtggaaaagtaccagatggaatcatgtgcctctgtttgctgttcagtttatgctgccgagtgcctttcacaggctctttctgttcctataccctagggccgttgcttggttccaagctggtttttgagtctgagagcaaggatttcctgggctaagggaggaaaaggtgaaacacagcttcagaaaggcaggttggcatcctaacaagccaggaccttggggagagagatggacacagaagataaggaaccagaggccctgtttaattacacagtacccttggagaaggaaatggcaacccactaccggtgttcttgcctggagtctgtggggtcacacagagtcggatacaactgaagtgacttagcagaagcagcagtggtgcttaaagcccctgagtatttcaagcgcagaggagagatcatagcagctctcagaaggcattggcccttaaccttttgggggaggtcagggggtctgttgccaaccagggaaatctaaggctcctctcctcataaatttatacacacacacacacacacacacacacaccaagttttgcctgtaacttcaggggtcttttgaaatcccagacagaaagagattgactcactaaatttaaacaaaaaatccagggcctttggtgtataaactcgtcgtctttgg

SEQ ID NO: 27153 - DNA, 2448 bp, Bovine  19866880719770
cttcagtgaatgttttttaacatttgcttttttacttgagtcttgatgttttccttttgaatatccctaagagtgcttctctggagttgtctaaatactgaatgttcataaatattttttttcttaggttttttttttctttaaagcatcaaatgtaaaaatagtcttagttatccttactacttaaaataattttcatcagttcaatttaaaggcattctccttttcatcgtacacttaatttaaaatcattctgaggtcatccattaaatgtcaaaacaacaacaacaacaacaacaacttttttggtgcctttttgtcctctatttgctttaaaccctccttaaactaaacaaaacccaaggcgaaatctccacctggaaaacttgagacgtttgattcgtttcaccagtttcatgcaatttaatttgggttcctttttcgagacagtctagaatataaactttctcttaaagagatcactttggaaaatccacctacacaagttgaaatcaacggtttccttacagaaaggaccctggggcaagaattagtgggaattactccatgggtacgtctgctactagttttttatgcttgatggtttgtcagttggcagaaatcaatggttctcttcacaccacagagcagctgaggaatagggcagactacaagttatcagcaccctgagtgtggattaaacatttcgtggctgcctctgcaacatgtgccctgaaagcaccacttggttcagaatcacaaaggactgagtttagcaaagctttaatttaaaagagacacaggtgacagctctgttatttttgcacgttcagatgcatccgcagctggttttatttatctcagccgtatatgcccgtatttgttgtaattactagtctcggatgtacttaaagataaatatctcaaatgcctatccggctaaattaaattaaggaaatcacacttttcacccgcacccactttggccctgctctgctgtggataatagcaacgatttaaaagtttgtgcctcatttcatctcccccatcagaagtgcttccaaagaagtcctgggtttcctatctcttccaactcaatatgctccataacggcattgttccctctagattcaacacagcaagaaggatttgtttcagagcttcttacctgctcataaaatgcttttaaatgcattttgacggctgggaatgtgaaagagtgttgtgtgcccaagaagtgtggcttgacccgttttaattcttctcccagtttgtccttcagtttgggattgcagacttggcttcggtgttcgtttgtttaccgttcacttgtggctcgttcaccgtgagcagtgtgtgaaacaacagggcgaggggttcacgtaacgtcagagtcagcatggggaaaatcagtgagagtctggaagtttgggaaaggggagagagacataataaaatgagaaggcagattaagaagatgaagttgcagagttttttaaaaggagtttgcttggcaagccgcacagaagtttgcccatgaaaatgtcaagaagatatggtatttgcctcccaaatgcttatacacggtccttcaggaaaaacagtgaatctgtttgcagtagtggcactcggttgacttgttttcagatgggaagacagagttttatttacttactttaaaatttgaaacaagacctgatgtgcacctctgttgaggagttgactggcttatgagtaagaatagtggcctttgcaaccccggcgtcaacactaacttctgctcctcttgagatctgagtatgttcattaatgacctggctgtctggaaggagcagctgcagagcaattcctccaacaatatttgggagaattagaccgcctgttaagaatgaacgagagaaaatgtcagtcaacatacttatacaatgaagaaatattgaataggtaagcaggtgatgcagggtggaaatttacatgtttttgcccgataaaaccacgggcaagagaagtatgttagtttcaacagaagagagtcgtatagtaccagatttcttctttacaggttgtgctgtttatttaaaaagtatttctattactttgatttatcactttaaatcaaagggatcctctccaaatgtctctctgaagtggatatctaataatgaacattgaagaattctgagtggatggaagccaagtccttttcgagaaagaccgtcagattgattttgtctggcttaacgtcgtggttactgtttgactgccttgcattttttctaaagcaaatttttttttgacccccctccaccaacccattcatttaaagggactctcttcagaaagacttgtgattttcctcagcacaatagactttgcctgacattcactctccttaaataaagatattaaaccctagtcctgcttcaggtactaactcagcaaatcagc

SEQ ID NO: 27154 - DNA, 779 bp, Bovine  19866880892704
cttccttagtttttgaaacgctaaacctcacaccatccccgcctgcctcagtctccctgcccaccctcctgaccaatcactaggacacacagcacggacctcaccccctgccatttcccatttctctggttctggcctccactcccccacctgattcaaagattcttcttctgttctccccatctcatccattctcttcaaggaggccggacaaagcgttcgcaaagacagcttgtgctacgtccctgctgttattagaacctttagcagctcctgtcatgggcccaattaagtaggaattgctcacccttgcatttcagggcctcctccatacggcgccacctccctttccagcctcatttcacacgtctcctctacaagtaccaacacggttgctcactgctcatccaaatggtctgtgcatatggcctgatgtcttttactcatgctgttacttcagttggcaagtcctcctccacaattttccctttgaaaagtctcctcttctttcaaggccagcctgaaattccacactgcttacaaaaaaatcattttcctgttgacccaacagaacgtgctcacttcccctctgagtccctttaacaattcatatgcatctctcatgttacttacacatgttcacctgaggcccgtggtcttgacatcttccctggtagattgcaaccttcttggtggcacagattgggtcatatttttcatacaccctagagcacccagcactgctgaatgcattttagatgttcttaactcactattta

SEQ ID NO: 27155 - DNA, 1374 bp, Bovine  19866880892995
agaagatttcagagaacaaaatccagtaataatttttattctgtgagtcagtcttttgtctgatccttcttgtttcccaagtgctatacccactttacaaagatatgaagataaactgtgaatggtctttagaaatattaacactacgcctattctttgtatgtgtggggcgggggaaagatgtcaagatcacaagagcaccatacttcattcctaaagctacaagttcttaggactaagatgccagtctgtctggtagaatccacacaaaataaggacctgaaataaatttcaactccattttccctcggaccactattgatttctatcttaaaacttactttcttgtggtactttggccaactccactggctaccctacaccttcaaaattcaactagcataattttcatctttacttcatccagatcttcaaggtcactcattggctccttccactcatcacagcttctgtattttccctttaataccatttcaatgtttctcccattcaaccctgagtacttcttaccatacatttcctgctgcttttagttcagtctgttatggaataaataacttttcctgtagttaatttcaacagccccaattctgggttttcgtagaagttgaagcccacataaatttttgaagcaccatattttcaatccttataactgactataaagttcagctcctaaaatagcttttgctttatgcaatatgtggtgattcaaatgtagccattcatcgaagcatattcttaccagatttatctcctcgtttaaaatgcttccttcattttttcatgactctgctcacaatgcaagtctctgaatttcaaagccctccagctaccagttctggaaaaggaaatggcaatccataccagcattcttgcctgggaaatcccatgggcagaggagcctggtgggctacagtccatggagtcacaaagagtcggacatgacagagcaactaacacttttcacttttctttctctcaattacttactctctcgatgcctcattaacaagaagtctaatagtgtcttttttccccaatgtatttattcaatttatttttattgaagcatagttaattcatagcgttatgttagtttccagcgcacagcaaagtgattcagttatacgtatatagacatatattgactagataaatatatacacatagatattctttttcagattcttttctgttataggtgattacaagacactgagtattcttccttgtgctacacagtaggacctttgttggttatccattttatatttagtggtgtgtggggttagtcactcagttgtgtccaactctttgtgatccctttggagtgtaaccagccaagctcct

SEQ ID NO: 27156 - DNA, 1171 bp, Bovine  19866880923978
ccacagttaaggtaccgagagctttgatctgtgtcattatgtttacgtaattaaataattcttttacaacatctcaggtggctgaggaccagggcatcttggagaaaacacactcatatacagttttccatcagccaactcaattcatagataactgaattccggggagtctttgcataattttagtgtggaatgctaggcaatccatagaacctttctgaaacttagtttaataaaagttgatgctctttacttgcctaatattacacaacttcttatctgattattagtttgaatcatgttctttattaacactacattgagtagaagagtgattctaatggcttttctggaattcttgggatgtgccgacctggaatgcagtccctgtaagccatatttcacatctatttaggttgtgtggagagagggagggcttccctgatagctcagtgggtagaaaatccactcgcaattctcccaggaggagacacaggacttgcaagttcaatccctggtccaggaagatgccctggagaaggaatggcataccactccaaaattcttgcctggagaattccatgggcagaggagcctgacaggctacagtccaaaggttcacaaagagttggacacgactgagtgactaagagagagaggcagggcttatgagaaactcatttattgaccaagtgcccttcactgatgagtgcagaaagaagctacctttaaaagaacacactacttttctttgctcctttaatgcttctgttcattctgatatgtttttaaataaaatattaaaaaattttcaaaggaatgaaagcatgtagattaggtgaaggaataaagactgttaatttgtaacaggaatggagcacagatttcagcagtaaagtgatgactgcacagggattcaagaagccagctcccacataaataccctttggtcttcatgttttccatctggtaagtaatgactaataaccatatgattctaataaaaagactttctgggtgagggtaggaaattctcaagtactcccttcagctggttcctgggagtggatagagtgactcagatctaaggggtggcttagcagaccactttccatttgcccatcttccttttcatttgacatagatggaattgatgcttttgaatatacgt

SEQ ID NO: 27157 - DNA, 889 bp, Bovine  19866880952440
tgggaaaatagagtgaaactattcttgctaacattctacagctgttcaagggggagaaaaagatacttcagtcattagtatttaaaggaaattcatctatgcaagactttccagttaggttatgggctactttttagatgctgaagaacacaggaacacatctttcaaaacagtgtggaaattctcataatcctttcatttaaaaaacctggccattggacagggaacaggtaggaattagggaagcaaaggaatgttctttgatgtcagaatagtttaatccagaagaacagatatatcaaagttaactgagtgatttaattcatggaaacacactttcctgtgttcctttgaaaaaatggcacctgcttaatttttctctatggagaaaggcatgtttttgagacaatcatagatgctatttgcaaagctgtcaatgcattttagggtttcttcttaaacattgtgctttagcccttaaaactaagtctcgattgtaaaatttaaagtactacttgtagaggttaaataagaatcttaatgaatttccacaaaatatgtctgtaaactgaatgctacattactttctgctatatattttaaatagccagaaaagagattcagggataatcagctttttaagttctttctcctcttttacttttacctcctccttgtctttctcctcctcctcttaatgagaaaatcagagtgtggatggatggtttcattttaaaatagtgaggtcaaggagggctcgtaacaatggtattggaaataataagacaaaaatactattaaaaggcaaaacatgtatgtgtatatttatttcatgtatatataagaaagttaataaatatgtatatagttcttgcttgatgtacagaat

SEQ ID NO: 27158 - DNA, 838 bp, Bovine  19866880954779
ttggctctttgtgacgggtagccaagaattggagctttagcatcagtccttccaaaaaatattcagggttgattccctttatcattgatgggtttggtctgcttgctgtccaagggactctcgagtcttctccagcaccatagtttgaaaacgtcacttcctcaattttcagcacgtagtccaaccctcacatctttatataactactggaaaaaccatacctttgactatatggacctttgtcagcaagatgatgtctccgctttttaaatatgctgtctaggtttgtcatagcttttcttccaaggagcaagcatcttttaatttcatctctgcattcacggtccacagtgattttggagcccccccaaaataaagccattatgcagcttttaacaccctggagccttttcccaagccttggatcaaatgaaaacaataaagtttttgtaaaaaaaaaaaaagtgtgggcaaagcaataaagctgttctacctcacccaaaactacctctaagatttgattcggtacctgtgcacagaagctgaggtcttggcatcaacctcaggtaatcaggaccacaattcatactaggacctgatcttttgatccagagcctacacttcccagactgtttgagcaagcagtgcacagataaatactataatactttctttagtttgtattgttattgaaaaattgcttcaattctcaaaattctgtattgaacaacaatgagaattagcaaaggaggagtgaaatatgattagacgtttatgcataatatgctgctcagtcacttcagtcctgtccaactctttgcaaccccatggactgata

SEQ ID NO: 27159 - DNA, 2386 bp, Bovine  19866881004111
aataagagacactctgtggtatagaaggaaaaacccttggactagatgtgctgtgatggtatctctttaggagtcaagctcctagagccttaaacagggtgaatgaagaaaccggccccccaaccacttaacagtcgtgtctgactctgtgaccccatggactgcagcacgccaggcttctctgcctccactatctcctgcagtttgctcaaactcatgaccattgattcagtgatgccatccaacttctcatcctctgatgccctcttctcctactgccttcaatctttcccagcatcagggtcttttccaataaattggctcttcgcatcaggtagccaaagtactggagcttcagcttcaggatcagtccttctgatgaatattcagggttgatttcctttaggagtgactggattgatcttcttgctgtccaagggactctcaagagtcttctccagcaccagaattcaaaagcatcagttctctggcactcagccttctttatggtccaattctcccagccatacgtgactactggaaaaactacggctttgactatatggatttttgtgggcaaagtgatgtctctggtttttaacatgttgtctaggattgtcatatttcactgttatacagggatgacatattcctttcaagtttcagctttatgtgtatgcattccagattaagtggtttacttcatgaggagaataaacctcatgtcaagcttgggaggcaatcaaatttcaaaggcacacattcctctagagtggaggaatacattttttgaaagcttactgagatgctatcagcaataaaaagcactattcagcatagaaatagctaaaacatgattatgagagttttaaatatttactaagaacatcacaggaactttgtcatgggtcaaaagtgacccagcagggcaagtgtggaaatgggaatagaattacctgcaaacgaaacagacatggaggataaataaaaaatttctgccaaagcagacaagacaatagttcccctgtcctgtttccagccaaggaaattacctggactaataggatttgatatacctcagtgagacgccccggcctgtaatttctccatttcctaccctcccccccaccaaactacacagtgcatttagccacttaataggttgaaacagagtcatttttatgtagtttttgttattttccaaagcattctttcttataataaagctagaaggcattcaaggtaataaatggatattttaaactatatttccaaatctatcatccaataaactctttgaacattgatttaactacgcaatatcaaattagcacctttcttaacatgtactgaacctggaaaattaggaaagatacaatcagaaatcaactcattcaactcatcccctccccccactgcttatggaaacccctggacctgaacaaaatagacagtagatgccccaggtatcagccacttgccccaaggtaacgaagagtgctctagacacttccaggcccaagaatcgcctggttgtgttcattacaatcctctaacctctacaagaatggaaacatcagtacttgcttaaattctcttcatgactttggccaatccggggaacaagcagcaagggtctttcttctccgtgtttaagtataagcttcctgcctttcctcccaggagcgtggtgggaagtgctctggagagaagaaaggccagtgcactgatgctctgattgacttgccaggtgtgaccttccggtggattcctccagaagtgaagggcagtttactgctgaattctctctgaagccctgccccatggctggtggttccccatgagtagccctaccagctaggctggatgcctacactctggctgctctcctgagattcctcccccaaaccctgacaatctggtaatactgtccttccggcctcagtctgcagaagtcctctcattcatgaaaaccttttggacaacagtttaactgtgattcataagaaaagagcaaatttgctggaatgcagtggtttctaagctgtagccttcttgcttcatgccatcggtatacaagcctcccttcttgaatgctttctagaggaaatcccacacttctgtgtccccttaggtcccaggacacacctcaagctcttggcaactggaaggggaaatgggtagagactcagggtatattggcaatccctccaaggacaggctgcaagtctttttaatttttttcttaattgaagtataattggcttacaatgttgtgtcagtttcatgtgtacagtaaaatgagccatatatatatatatatatatgaagtgatttagcatatatatatatataatgcggagaaggcaatggcaacccactccgg

SEQ ID NO: 27160 - DNA, 1076 bp, Bovine  19866881013552
gagagcctgtgtacaggcaggagtactctttagatctgttgttgtggagtccctcctaaagcctggatttacttccttcggagtatttaaaaggcacccgataaatgaacaccgatgttctggaagcttttaatgacagtagatttgaaacagtccatagatgcttgctttataggcttttaattaaattaagccagtaaaaataccagatgtgtgcattcattttatcatatctggtatggcttcttccttctttttattctggattccagtgtgtatatttcagctcagtttcaaaccatttttggccagctgttatgtacccagcacctccatggctgctgttaagtctgaagcattactggggaaagaacatggtactgcgtatctagaatctaggaagtcagtggaagaactttaacagagttgtaatgaacaaaataagcataacatcacaggatggataacaaatcattgtattacagaaagccataggattcttttggacagctgagcgtggctcctgttgaaagaccctctctgcaaccatttctctcattttagataaagatgcttcagcagaaactctgatcagagtattcccacatccaaacaaacatttataattaaaagctttccaccggccaagcaggaagtttctctctgggctgggttcctgcttttcattctgtccattctgttgttaaaaccagcaacaacttttaagaaaaagtcccctccatcttgcctcctgctgcgcgattcacagcttctgtctttgtccccttccatccatctacgaaaaacaaaccgcacccatacttctcaaacgcttgtctctgaggatgaaccgctttcccacccgaggttcatctaatccaaaaggaatgttccttttgttgcatcgaagctgaaatgttgaatgttttcaatcaagcctacatcctttcaggctctccgtattatgtctagcagaggtagatggttcaatccagccttaattaacaattctaatctcaaaaatagcaatgtcaactagaaaagaggaggaggagatagcaccgcggcctgcccac

SEQ ID NO: 27161 - DNA, 1886 bp, Bovine  19866881065789
ttggcgatttcctaaggcagtcttatgagtgctctgatgtatagtaacctgataagtctttatttagaacccatatttcactccttaacctttgaggcgggcttcagggaagctgtaagcagccaacgctttcccactcgagcaatgatgaggcgctcaccactatttgacacaaatcagtcaggtaccgttttggcagagacttaagtctcaagctttagtaaagcctctcaacagtgacgtcagactctggaggactaacccttatccctaagaaggttcagactcttgcgaatgtaggtgtatatgtaagtttattcctcacatacacacaaaatcagcatctaaaacaattatattggtttaaatcaatatattttttcttttatttttttaaaaaattgaaatgcagttgatttacaatgttgtgttaaattaatatatgtcttaagaagaaattcttataccaggacacaaaagaaatgaaatctccaaaagtcaacttttacaaaaaaaaagcaaaactctttattatgacttttccctcatacctaaactaattgcatcttaagtgtctataaatgattgatgttcagaagtgctatggtcaacattttttggcgtggtttggcagaataagatccatgccagaaatgtatagagacacagacaccttattacttgaaaatcaaggtataaagttaaaagtcgtcaggtaaacaacgaaaatagttttctgatccaaaattcagtctgaatctggtgccctgatggagcctacagaaggaagcctatcagagcttttccaggatgttcttagattacattctgagacaactcactgtaaacacattttgagaggtgctcattttcattcatttgagttttgtaatgggcagcattctgcttagaagaaatagcctttgaacttagccttgaaggataagtggtcaccttccaggctgtatgtgatgggggaataccaggttgcttagcagaggctgtagagacacatgactcctcacatatggacgaaatcaacagcaccatatacaaatttgaattccagggggactaaaaacccaagtgtgaatggcaaaactagatttaaagcctgttactactattattgggtggtaaagaatctgcttgctaatgcaggagattttggtttgatccctgggtctaggctgggaagatcctcttgagtgagaaatggcaaccccctccagtattcttgcccggggaaccccatggacagaagagcctggtgggctacagtccctggggctgcaaagagtcagacacgactgtgcacagagcacttccaatgttctacatagaatgcttttccagaaagaagctacctccttcattaccatacttcactcagatctctgatcaaatgtccccactttgtgacattcccagggttccctgactcccaagtgttgcatcacatctcatccctgacacccatactccctcgtacctgccttctttcctctccgtatcttgtattatcatttgccctcccatatatttcagtgtcggagaaggcagtggcaccccactccagtactcttgcctggaaaatcctgtggatggaggagcctggtaggctgcagtccatgggatctcgaggagtcgaacacgactgagcaacttcactttcacttttcactttcatgtgttggagaaggaaatggcaacccactccagtgttcttgcctggagaattccagggacgggggagcctggtgggctgccatctatggggtcgcacagagtcggacacgactgaagcgacttaacagtagcaatatttcagtgtttacttgtctagggtcttctctccactaaaacatcagctccctcaaggcagt

SEQ ID NO: 27162 - DNA, 1070 bp, Bovine  19866881101824
gagtcttaggagctcgctccttttgaaagggaaaaaaataaaactgagagcaaaagagaatgtgaggcaggaaaaagaaaaaaaaaaaaaaaaaagcacttcccctttccagatacgctgaaacagaactgtcaaatgcaggaaaatcttgtaaagttttcctccgctgtaggccattgaatagaactgcaataaactctgacccataaaaagtcatgtaaacattataacccggttttactagccctttaagtacggggaggcattgatctaaaacagcttgggtctcctaagttcccaaaaccttcgcgagcatccaacctccaacatgggtgttcgaaggcctccggcactgaaagccaaaaataggatggagctagaaaattgcagctatttagctatttgccccaggcagatgtttgatatttccaagagcaaaacatccgaaaggaaagctcccgaggaaaagctactttgtagcacctccgccatggaactatttaatgcgcaatgtccacagtcaaaataaatccctacgtggacctccgctgccatgtttcactgtccctaaaaatcatgccaagaaagtatttcacgcagtaaaagtagtcatctcactgccttaggacagatcagctccgactatctccctgcggctaaaaagctttaccgcatgaaatataaatgtggaaacattcaagggagatttttacaggtgtcaacacgaatgctcattccattacccatctgtggaatgctagttaagcctgccttgaaaatatctttttcttctttttcctagaatccaaaagaaagcagggtgaacgaggggagaagcaggcaggacacccggttagctcactgtcagattgctctagcttcctaatttttttttttaattttcaaaagcactttatcattctgttttttttaatgtaaatatttttttaaaatttttatgaagtcatgttggtttctgccatacaacaacacaaatcagccatcatcttgtttataattgtgcttgcaaggaagttagcatccgtgagtcagtctctgttgccaagtag

SEQ ID NO: 27163 - DNA, 958 bp, Bovine  19866881102148
ctccttggcatgtgggatcctcctagaccagggattgaacctgtgcccctgcattgcaagatggattcttaaccactggaccaccaggggagcctgcctgttcttttagatgtctatcattctaccaactgacctcacagaaagcattttaaataacagaagagaatctagattatgaatggggatagccatatcacctcacagcttcctctcctaaacaagaattttaaagtttcctaacatgttctgtgtgcatgcgtgctaaatcacttgtccatgcatgtccaactctttgcgaccccatggactgttgtcttccaggctcctccatccataggattctccaagcaagaatactggagtgggttgccgtgcccttctctaaagggtattcccagcccagggattgaacccacatctctggcatcttctgcattgacaggcagactctttaccactagcaccacctgggaaacccaacatgctttacagaaaaccacaaagcactgcttgtaggatgacaacacatagaatgaagttcaggtcatttcctacacatgtagccacagtctataaaatctgctcatgacaatacccccccaaaagatacggcatacggattctataaatacagaaacacggatcgagtccactgtggggtactgaatttctaagtttaatgttaatcctcagttgctcagaaacattgtttgtctttaattataatattctcattcaattaaaaaaaattaggtgctgtaattcagacttctaattaagtgaattagcttttgacattttcttggaaaaagatgttcccaatgtggctttttccctttacttgcaattaaacattccttagcactatttaaatactttggtaagaaatacgcaatttatagcaacatgccaacttttttcagacagtgacgaggcagctgttaacctcagacatcat

SEQ ID NO: 27164 - DNA, 1242 bp, Bovine  19866881141941
ctgaaggagtccgaggctcgagattgccaaggatcaggcaagcaatcctgaaggctttggactttatcccgaggactattaggaatctatgaatcacctttaaaaggggagtaatctgatcagctcttcagtcaagccaaatccccccagtagctccatggagagtgaagtgcagaggggtaagatcagaggccaggacacgaagcagcatcctctgatccgcgaatccgggaccgagtgggcggctggacccagggaggggctgagcgggtggagggaagatagaaaggcaggagaggcggtgtcagcgaacctgacaggacccgatgactgactcgacgtggaaaggagggagaatgaaaaatgactcccgaaatcccacctggtgcatttggacaccttttgccaagagagaaaataaaaaaggactaaggcgaggtggtgagttcatcccagatgactgcgtctgagctaagtgaagatgtccattctccagcaggaatctgtgctcacggaggtgtgcgctggagcaaggcagtccaggatctccgtgcatagttgactgggcttcccaggtggtgctactggtaaggaacccacctgccaatgcaggtagatgtaaaagacgctgggttcaatccctgggtcgggaagatgcccgggaggagggcatggcgacccgctccagtattcttgcctggagcatcccatggacagaggagcctggtaggctgcagtccatagggtcgcacggagtcaaacatgactgaagtgacttagcacataacacacaagtatagttgacgaagaagccatttgaggcacttcgtttagaaaggctgggaacaaagagaacagacctaagccggaaaatcggagttgtgtttgttctgtgctgaaattaatagctatattgagctctgtgtgctttacgtattgtatttcatttaaaagacatttttgggagcctttatgttcttttgtttgtttgttttatgtattttaacttgtttaatcttcacaatctgtataggagacagattcatccttatctttctcatggttgaagaaacggaggcccagatgggtccagttctctgcccaaggtaccagagacactgaagggcacagtgaggaagctgacccacacggtccggactcagtcttcgttctggccatccggcagtactgacccttactgtgctggataccacatttaagggaccagcagaggaaatccaa

SEQ ID NO: 27165 - DNA, 1150 bp, Bovine  19866881155212
ttttaacagaagctaacaacccccttagccgttcttcatgtcatttatacagtttggagggttgttaatgccatcttcacacatttgagaactggtcaaattgttgtctccagtcctgtatatctaaataaaaaagcattccggtgtacatgtgtgcatgctaagtcactgtagtcgtgtccaactctgtgtgactccaaggactgtagcccgcctggctcctgtgtccatgaaattgtccaggcaagaacactggagtggcttaccattcccttctccaggggatcttctcgactcagggatggaaccctggtctcccgcattgcaggtgcttctttaccatatgagcctccagggaagccctcttcaatagttattggataccatttccatgctacattccatcctggtcagtatcgccggacacactccattttgcttattcatgtagcactaatttactgaggcattgtccaagcaagcattagtgtctaagctgagaaggatacaaagacagacaaggagatttacttataaagtagccttctttatttctatgtcattattccattatatttgcactgggagtctcagatcatttgtttccatctggacatctgcaggtgtgacagccaacattgaattatgtgggtctgagaatttttccaaaaacgtgctgttggtcaaaagttccaagaaaaactaatattctatgtaaattcccaatgcaaggtttaagcaaggcctatacacttaaacaaagaatacgttgcttggtttatgcgtgtggcctatatagaaagcaaatacacagaggctatcttatatttgtcttacatatgataaggtaaaaaaaatctgccatgtgttcatggctgattttgatttgaccacctgtactgtgagactgtgtccaacagttggcaaaaagagtcagtctgaacataagaaaacattcaagtgtggctagattttgcacggaaagggacttattccaaggatcacataatatgatatgtgtacccactcttggggatggaaactagttatatattctagcttttactatttttttaagccaaagcagagatgtgatgagtcccactcataaaaattcaggaggatacatatatattttttaacagatgtg

SEQ ID NO: 27166 - DNA, 1755 bp, Bovine  19866881213742
tatcttaataaagtagtttaaatagaaagaaaagaaaaaaaatataaaatgcttcttactttaaaataaaacatacctctgtgtgtacacacatgtgcatattttcagttctattcctgctccctactagtttcttggtagcatttgtacataacagtttttgtattttagagaggtacagatctagattcaaagatcatcacaattaagcatgtttgtagcagaaaaggcacatgactgatactttcttgtgtttcctaaatttccttgagagtaaccagtagtcatgtatggatgggagagttggacccataaagaaagctgagcaccgaagaattgatgcttttgaactgtggtgttggagaagactcttgagagtcccttgaactgcaagaagatccaaccagtccatcctaaaggaaatcagtcctgaatgttcattggaaggaatgatgttgaagctgaaactccaatactttggccacctgatgcaaagaactgactgataaaaagaccctcatgctgggcaagattgaaggtgggaggagaaggggacaacagaggatgagatggttgaatggtatcaccaactcaatggacataagtttgagtaaattccaggagttggtgatggacagggcatcctggcatgctgcagtccatggggttgcaaagaattggacatgattgagcaactgaactgaactgaacagaattgaactgaactgaaccatagtgttgagatgcatttttccatatgttttctatatattatattttctatatattatatttctatatattatcaatttttttgtgtgtgtgtgaggtggttgatggagtccctattctgtttggggttatatctacttgggtatagatattaaatatagaagagattaatgaatcccaaggtttctctaataaaactctgtgtgctattttcttgaactcatttaatgatatttttgtgaaaagggaatttttcaagaaagggaaaattctgcaattctgttatttacctagattatattgtatctaacccaataatacttttcacatgtactatttaggggcttccctggtggctcagctggtaaagaatctgcctgcaatgtgggagacctggctttgatccctgggttggtgagatcccctagagaagggaacggctacccagtattctggatattctggcctggagaagtccatggactgtatagtccatggggttgcaaagagttgagtcagacacgattgagcaactttcactttcactttactttcatatactctttgaggtccttaggttaacacttaactatttttctcatttgaacaacaatgacagcagcaaattctgagtcttttttgtgttgctctattttttctagtgtgtagtttggcgttggttttgagtaagcatccactctcttttttgctgttgatactaacaccaatttattaaagggtaagacaccatatgttcatttcagaataccaattccattttgttcatctgaattcccggtatttgcaaagcagtttatttacttctaatttgcagtaatgtgtatgctttctattcttttcattttgacttattttcagataattttgttatcttacacttctgatgctttttattttgtgaaaaagatatatttttattctcactgaaaggaaaaagtagaaaagatgggtagcaggaatttttgtatttaaacaaagctgaagaagcatggcactgatttt

SEQ ID NO: 27167 - DNA, 1001 bp, Bovine  19866881262402
ctttctctttcatttttaagagttttaatcttgaatttaaagttgtgcttagcatatgtatcctttaaggtcttattttctatgatgaaagtaatccagttgatctattattagtagtatgtctactttttgtcttaaaaatctgtaattattagcaagggaggccttttaattttacatgggaaataataaatgtttcagaagtttaacatcttaaatcgtatattatcaaggaaaaagataaaggtaagtaaaaaagcctttccaagcttttaccaaaacaattgtaggaaatttctcatcatgcttctattattcttctgtcttgaaaagtaccctcagagacataatggccacaaccatttcattttctaacttattaagcagtctgagggtgaattgagagtttcagttccaggttgtggtgataattactaagtgcaaaagcccctgttgcctttcattaagcagttataatatttaattgagactacagggtgtcaatagtcagcatcataccatggataattatccatacacataaaagaacactgagggtactttcaacaataagacagattatcaaaaaattacatttttaatttaagttttgacttgagtcatttcagtgattaaatacatatctctgcatttttctgcaaatgaggacataaagctaaataaatgaaccataaagtggggaagggaaaaaaaatgttttcactgtaacataaatggatgaatgtagtatgcattaacaaatcacacagtgtctcttctaaaagctgtctcaggaaggagagccgctgacccaggtggtcaaagattcctgccagtttggctgggaaagggtcctctccttggtgagcctggcactgccaggatcgtgggccaaaatgtctgggtggcctttgctgcagcctttggcccccacaacttggcttctggcagagtacttatctctttgaccgctgactgggaaacgactgaaaagggaagaa

SEQ ID NO: 27168 - DNA, 861 bp, Bovine  19866881267590
cgggggatcttgcccgtcctctagcagttcttccctggagtttagagacggacccaccaaacacgtgagtgactaacccggaatctgaggctgtccccagggtgcacttaggggtgcatctcagtgatgcccttggcataccagtggcatggagaggggggtacagaccagctgaaagggggtggggggagggcagggaagggaaagagattgtggaaaagagcctcttgaagcacagaaaagagaaaaccctcttttgtggggccttgccagcgcctggggaacagcacaagctgaaagggcaagctttgccccgggaagcctggggctgctcgtctgtctgtgaagcacacacacctggggtggggattcctcccctgttgccctgcccgaccgcccgtcactttgagttacaggcctgtccgctccccgccctgctcctgctggtttcaaatggcctagatttttacttctccatttcaggagcaagagaggaaaaacttggcttcttagggtttctaagcagatgatctaattttaaagtccgtttccctcgcggcagagcaaatctacatgaagggtacttggagaatatcttatttttgtattcagtgcctttcagaggttccttgttgttttatttaaagctgtgtttggtgcattagcaatgcataacaataaccgcttagcaaacactgcaaaacggaaactcaagtaggtggcccccagggtaaaaaaaaaaaaaaagaaaaaggaagaaagaacacaaagacaattctcttggactcaaagaagtattttcctagctattatttcacagaagttttctaatacataaccaggaaaaaaaaaaaggaagga

SEQ ID NO: 27169 - DNA, 1491 bp, Bovine  19866881332082
actctcggagttcacccagactcacgtccatcaagtcagtgatgccatccagccatctcatcctctgtcatccccttctcctcctgcccccaatccctcccagcatcagagtcttttccaatgagtcaactgttctcatgaggtggccaaagtattagagtttcagctttagcatcattccttccgaagaacacccagggctgatctccttcagaatggactggttggatctccttgcagtccaagggagtctcaagagtcttctccaacaccacagttcaaaagcatcaattcttcggcgctcagctttcttcacagtccaactttcacatccatacatgaccactggaaaaaccatagccttgaagaaggggaaaaaaacaggcatttgtaaatagaacaaagtttcttctgaagaaccatgtatcttctggctgacccagagtgtcaggagccaaaaccagtacagcaagaagcttctcaaagaacagtggcaacaatgaaactctgcacacgggcaaagtcgcttcagtggtgtctgactctttgtgaccctgtggactgtagcccaccaggctcccctgtccataggcttctccaggcaagaatactggagtgggttgccatttcctcctccaggggatcttctggacctggggatcaaaccagcatctcttaggtctcctgccttcacaggcaggcttcttatcactagcaccatctggaaagcccagcagtgaaattaaccaggactaattttcacatgtgagaaaggagtaagaacccagagtaacaagatgcgtttgaaaaaagagggcatttctttcagaaacccaggagcaaaacacatatattacagccttaggctattttaaattgctgaaaaatcttagtgttggcacaaagtggtcataataatatgggcatatttgttagggtagaataaatctgatccttaaactacgcctggactttagccgggatttctttaaagacttctctctctccatcttttcattagaagtagctcactgctgtcctgagtaccctcttaattgggagagttggattgtgaagctctactagccacattctcttacatgaagccaatatggggtatcatgacatcataaaacacaacttaagttcccagattcataaaggaactccctctgggagccctcaggtggtgacaggttgacaaggcagtgtctgcgcttgcggtcccctaatggagtgacgtagtacagttcacgtcgtgtctctgagccccccggatgcggaggggagacacacagcctgcccttccagctggcggccatctgcctaagtgacaagtgccagatggggagaagaggctgaaatggggatcaaacattaagtaaaagaggatgtcttggaaagcagccttgacatcgatgattcgtatgacattctaatgtctggaagtttccatctgaaatatttgcgtaggaataaaaaagcagatag

SEQ ID NO: 27170 - DNA, 1129 bp, Bovine  19866881380257
ttccttgtgttcttctctgggtgcttgttatagtactttgtgtcaagaacacttagcagatctagtctcaacatattttaacgtgcacaggactgtattgttagttatacagagctccttaaaccccgaaacttgtgtcctgtgctttttggccaagaataactgataaccacttggttgatccacttaaacacaccacccaaactcagggtttgtcttggcttggccacatcgtgtggcatgtgggaaagagctccctgaccagggatcaaacccatgcccctggccttggaagcacctcgtcttaaccactggaccatcactggtttggttaaaccaaactcatttctaaaacagcctacatcccttctgttaaatatcatttaaattcctgtgagttgattattatatttttgatttgatccattttttaaaaaatgtgtcatgtggctgaaatatgcacagaattcagtaagatagcaaaaaataaaaagtaagacagtgtagatcttggcacatgaggataacagttgggatggactttggctcagagaggatcagagacttgggaacatggcgttgtcacatatgggaaaaaaaatcacctaatttctaaatttttgtttccgctgggatgctgaagcatcagaataaagcaaactgtactctgagggaagatagaggcagaaaggtaacggggtgcttgcaaatagcacactggaggccaagaagaaagggcctgaaaggaagcccagcgtcgtaacagttacgggtgtaatatttaccatatgtcccatatgttttcaaattgcaaaagtgcaactcgttcccacagcccatttgcaagtggacctgacaaccttagcccgcagaaatcaaagactgtaatctactataaattctgccacgctagatggaacgaatatctgtcaggcttttttacttaaacttctcttcctttaagagagcagcatctggctctaaactgcacatttaattgaaaaatcctttaataatagcattaattttcatcattttgcattccggccggctgtgacagggaacaaggccgccagaccgccgggaggaggggctgggcaggggcgggggcaggcgaggtgagggcgca

SEQ ID NO: 27171 - DNA, 936 bp, Bovine  19866881468610
ctgcgatttttaaagaaggtgtgaggttcacacggtaatagtattcatctcaacttcctggaatactttgatgggaaaaaaaaagggttaaaaatgcagctgccgagagagaaaacaccagctagcgaatcatgtgtgattgatggggttggggagagtcaatgataatagtatacacattggacttggcggggattttccttctaaagaagttaagtattttataaatattatctctttcatccttttaaacttcccgtgatgtggcatttattactctcagcttccagatggacagctaaccgcagagaaacgcacaaggctcccagaggcacgtgatgactgggtctctgtgtgctgggcgagacgggctctgacggatggagtcactcattcactggctcattcactcattcactcaacaggaaatgtggcagatctgcgctgtggcaggcaccacgctcaggacatggggaggaggcagggatgaatgaaggcaatcagctcacatggaggccaggaggctcacggaggcaaacaccggtaataggaagagaaggtgagctctccaatgaagagctggaaattgctgtgataaacagtgaagtattgggatggtgatgtgcttagttatagagatacagacatgccttaactggtgtgaaaagacgcacagcaaatattactaggtaacccacgctcagtcactcagttgtggccgacgcttagcaaccctatggactgtcgcccgtcaggctcttctgtccatggggtttcccaggcaagaatactagagtgctttgccaggggaccttcctggggaccttcctgacctagggatcgagttgacctctctggcttttcctgcattctttactaactgcgccacctgggagagaccaagtaaaacccaggtgaaaaaaagaataagaaggt

SEQ ID NO: 27172 - DNA, 944 bp, Bovine  19866881624977
ttctacaacctaatcaggcagatggcttttgacactttttatattcatttttggctatccccctaaagctctgagtatttttgctagctgtagcaggatcaaaaccacaaggtgaattccgggcctctttggttattgaatagttcaatagtacattaattttgtcaataatatatcaatcttagcaaagaaaaatattttttccgaatattttttagtgccctactgacaattatctttctaaagtcttgttatttgtcagcaggtctcaggtcaatttggaaataggtgagtttccaactcgtttctcttacgaagtggttttctcacggcacattccttggctttgatgtaagaggactttgaagccagaataaatatcttcctgataatggtgctgagctccattcccacccgaatagaaatttcagaatatttgagccaaaggtccccaacttttctgcaagcagtttggacacaagatcattaaatcgtaaaacaagcctcaacaaaaacgatgtattttgtttgcttccccgaccaggctgttcattggccttcactcagttccagcataaacatttgagtcacagggattctgtgggcgtgtcacatggctctttatcccgccgcctccgcggtcccatgccttctttgttctagccagaacacccaccatcagcgtgtgtctaacctcagaatgcatgcacagcagaggtctggggggtaagtcctttataagctccatgcctgtcatcctgaagtcatcagcctaaggaggaccgtgagcttactcacagtgtaattaagtggccatgtcagggggtcaggcagcatcatcttctctggccaaaaacacttagaatcctcgtgtggcgatttatgatagtgctgcctggccaactaccagaaaaccagctatcttaactcatccaggccacact

SEQ ID NO: 27173 - DNA, 839 bp, Bovine  19866881798458
acatttatatccatttctggtcacagagatagaatttttagaaaatgccatccaaaaacgtattcttaaagaatacctctatgaaggagctatttctacacaatcgattcagttactgaggttagtttttgacgtgtaacaacatgaaaacaattttgatggtgccttgaaaaatatcataaagaagtaataaattcataaatgcacaaatcttttctaatatcattttctattatcatttagtaggcatgcttatgttttctcctaagcaatttggtttcaaagatttcaaaaaaaaaaatattttaagccttcagaaaatacctccagtgctttcatttaagatcagcttggccactagggaaccgttactttatattggctgttgccaaatagaaatttgaatgaccttgctacccatttcacgagagtccacaacagtcagatccacatgactttccaaagttagtttattttggattatagcttgattccccacagatctggatatttaataaggaattactactaacttaaataagttcacaaaagacagcaagtaagcagcatgcgctccacgcacacggggaagtgtccgcgacggccgacgttccaataaatgtgcggttcattttaggctgattagcaacggttttcaaaaatggctccattaatcctcacaccgccaccccccgcctcaacccagaaccagcaaaatcttcagcttatttaagcttgaaacttgagaaaataatcttgcactctattggaaccccgaatgcagctgtatgtattcctctgagactttcacggagctggtagacacctcagtaaaagag

SEQ ID NO: 27174 - DNA, 925 bp, Bovine  19866882113620
aagccctagtattgttaggtatgtgaatcaactatacttcaaaaattaataagaaatgaaataaacatgagaaaaagaaagagaggagagaaaagaaaaaagcaattgcaaaatgttggtcttgttttcttgctgagaaaaccagataccagtgatctgatttacctgtttattcacaaatagctaattaattgcccatcatgggattttttttgtcattttgttttcctttcaaaatcatatccatgatgcgtatgcagatgctttttacatgtttaaaaaataaataatggggcttttatatattctattatgcagactttgaaaacccattttgttcttgatagcggtttggaaggtttgtatgggctgacagccaagcccagacctggctttctgggaaagcaaaggagtgatgaaaaaggccccttgcagttccctccgtctgccattcttcgactcagagatagacctttctcgatatgatgacttcctaacatctgaagtgtgagtggctttacaagacgtaaagagaaactatccagctgcaagttattactgtcaggtcaattaaatagattccaaggaccatcatcatgtttatacgtatcatggatcattggagatgaaaaacaatgtctttgtggtctcagctccctcctcccccactttcacagaaagagctgtagagacccgtgaataattgttggaatacgtttcaacagcagcctctccacacgggcaagcgattccacttaaattggttaatatcctattgttaatggtctgccttttctatagaaaggcattaaggaaaagggttggatcactacataaataacatgacatggtcttggctttgtcctgtgaagttcctgccaaagacgatggagtcttcgtgttgttcaataggttaaaaaaaaag

SEQ ID NO: 27175 - DNA, 1801 bp, Bovine  19866880081383
ctactgctgctacgtcacttcagtcgtgtccgactttgtgtgaccccatagacggcagcccaccaggctcccccgtccctgggattctccaggcaagaacactggagtgggttgccatttccttctccagtgcatgaaagtgaaaagtgaaagtgaagtcgctcagtcgtgtctgactctagcgacgccatggactgcagcccaccaggctcctccatccatgggattttccaggcaagagtactggagtggggtgccattgccttctccgccattagtcattagggaagtgcaaattaaaatcacagtgaaataccactacattttcattagaaaaactaaaattcaaaatactgtaccaatactgttggtgaagatgtggaggaactggaattttcatacactgctgtgggaacataatacaatcactttggaaaacagcttcgcggcttctttaaaaattaaacaggtaccctgtatatgatttagccattccattcctagatatttatccaagagaaaagaaagcatatatccatacagatacttttacatgattgttcatagcagctttatttgtaataatcaaatttggaaacgatgcaaataaatatccatcaataggtaaatggataaacaaattgtaatagacagtaaagaatcgcctgcaatgtgggagacctgggttcgatctctgggttgggcagatcccctggaggagggcattgaatggaagaagctagaaataaagaatgtgtactttacttttactagactagaaaatgcaaactaatctgtagaggcagacgacagatcagtggttgatggtgaagcagtagatgggtgtaacgagaaggagaagggtggaagggaggagatacaaaagggcacaaggaaacttttgagggtgatggataatagtcattatctaggttgtggtgatggtttcatgaagattacatttgtcaaacttatcaaatcgtacactttaaatatatgctgtatgtcaattgtatctcaaaaaggcctttaaaaatatggtttatatccatacattggaaaataatgtagcagttaataaaaataagaaagatccatgtgtattgatatcaagagttggctatgatatgtcattaaacaggaacaaattgcagaaaggtatctctagtatggcctcatttttattaagaaatttctatatgtctactatatgtatattcatatctttgtttttaaatactcagagaaatgtctgaaaaggtccccatcatactgataatggtgtttatctcagggatgggcatggggataagagataaggtagagataaaactttataagcattagtattatttgcattttgattttttaaaaagaatgcccccatatacctattcccatcttactgtctatcttatagtctttgttttttaataatctgttacagctcctcatcgttaacaattctgagttacaccaaatcttcatcttcaaatccccagttcacaggctaatagatataggttgttagtaaatgtttaatgagaggagtgaatttttttttccagcaactgtggactctattacattttatgcagaaatgagaaggcattggttcttttgtgtatcttttgtaaatcataccttcctaagtgagaaactgaactattaataaaaacaatcaatttaaatgtttattacagccaaaaagataagtggaaatccaggagtcagaattataaattagtgtcaatagtagaaaagatttaattgaagttaattcagttattggctgatatat

SEQ ID NO: 27176 - DNA, 2017 bp, Bovine  19866880102912
catataagttaaataagccttgacatactcccttttcctatttggaaccagtctgttgttccatgtccagttctaactgttgcttcctgacctgcatataggtttctcaagaggcaggtcaggtagacatggtattcccatctctttcagaattttccacagtttattgtgatccacacagtcaaaggctttggcatagtcaataagtctatgactatttgacttatttgacaagtctgccttgtctagggttttcacaaatatgagctcagtacatagccatttacgtctggcttctttcactcagcatgatgttttcaagtttcattcatgccattacgtatatgagtagttcattcctcttggttgatgaatagtattctacagtatgaatatattacaattttatccattcatcagttaatggaaatttttgttatttccaggatcgatttttttttcttttttacagttacattcagctgtatcaaattgtggatttcttttcatttatcctatttgcaactaaccagaattcttgaatctgtgaattggtgattttcactagttatggaaaactgtattttcatctgaaattgcctctactctactctctctccccttctcatctaaaatttcatgagatgtttgttagacctactcctcctatcctccacgtttctaaatctttcttattatttttttgtctctccatattgcatcctgaatagttccttcaggaactatttgtgtaccttctagtacacaaattttctctttttgacccgttcctaatatttctaggtccctggctggaaaagagtacatcatattcttattgatccattgattgcaacagtaatcattttatttgcaggctcaaatagacattccatgtgtacaggaagaaatttaagaggaaatatagcaatcagaggttttactgttaattttcataactgcaataatccagctaatcaagtttacaaccatgatcgctggtgaaaactgagtaaagatttacaaatctttatataattaaagacaatttctcacattttttgacagtgaggttacactacattttcaaaatttagattttgtattacagattttgcttaaacctctataaggtattttttaacaccgggtataaatattttagaaatgttcaccaaatgtgcagtgtaatacctaagttcaccactttttaaaattaggccaatgtggaatcaaatatcttaagatagaacacatacaacattgtgagaactgaccaaccaaggagactacattaaacagaacagctggaagcttgtctctggaatcttgaaggcaggcctcaaagagggaacgctaaagactaggaaacactacacgtcccagcatgctttgcgactaccgttgactactacccccagagtgcattgctcgccgaatgccgatttccctcacagctggggcttgtagttctctttggagccaatccggcgagggtggcgttttcttagccagccccaggctgttaggcttagtcttccagtctctgcaaaggggagacgcttcgggtccctgcgtggagtctttgtctcatctcttggctactgctttacccaggtaagtggtagaggggctactcctccccgcagctggggccttgccttgctttctgggagcgccttggctggggcgaagccgtttgtctctaagctctcgccgtagcagccgccgcccatccctctttgtgtgctgggggaagccgcggaactagtggtggcggctgttgctgttgcgggcgaaggagagggacgttaccgggaagttgctggcaggcggactcttccccatcccgccaccgaacaggtgggtggacggcccttccgtctccttctgtctgctgtgtctcggccctaagggcggcttggcctgctgacagtgccgcccagcccagcccggccctgggaaggagaggcggggtgagtcaggaaggccggggcctcgacgaacccactcactt

SEQ ID NO: 27177 - DNA, 1093 bp, Bovine  19866880414619
tgctgggcaaggttgaaggcaggaggagaaggggacgacagaggatgagatggttggatggcatcaccaactcgatggacatgagtttgagcaagctccaggagttggtgatggacagggaagcctgatgtgctgcagtccatggggtcgcaaagagtcagacacggctgagtgaactgaactgaattgaattttagctagcttgctgtacactagaaaacaggccctgctagccttataacaaaatccctgacctcctgggcaatcatgccctgtttccatattgcctcttctaatgtactataaaaccagcccttccccagaacaacttgggaagagtgctccactgcttgtgagacaccgtaccccccaatccatgtatgattttcgcttgaaaaaagacatcaatctcattactgaattgttttagtttttttcatttgacaattcctagaccagatgcctgcattcagaggactccttagtgggagcctcagaggagacactttggctctttccctcttcctaacccaccccctcactgtgccatgggcccataaaaaggcattagtctgtttttcaggggtcctgggcggtgagacagtttttcccatcgtgttacatccacttgatccttccctaatgccattccactaggagaatggaacactgggaaggaagctagggcctctttttcctcttgcttgcattgttatggtaagtaaaaggcttgattgctactttccgttggtctttttgtcctaatggatcacctcaataccttgactgcttcacagtgggaagtgggaatggtgttcgtaattcgttaatttgttattttttctttccttttcaggctttaagggttgcccattagaaatgtttctggaattcactgaatagtaatttgactttacatttgtgaaacacattgtagtttttactgttctttgtataaactttgtgacttaggaattgtctccatcttacaaatgagccttaggcaaagtatgtgactttccccaaaatcataattaatggattcactggaccatagtttaaatttgaggcttattcttttctcagttcagca

SEQ ID NO: 27178 - DNA, 1606 bp, Bovine  19866880454833
tgagtcaatagtagttactcacctaaatgaaagccatctaatgcccttatacccaggatcacagatgttagaattactagggatcttttaaagggcttccctgatggctcagagagtaaagaatccacctatcatgcaggagacttgggttcaaatccctgagctggcaagattcctctggagaagttactggctacccactccagtattctctcctagagaattccatggacagaggagtggtcgcagagtcaaacatgactgtacgactaacacttttacgtagatgccaggagtctagccctttatatggtcgatcagtatgcatatatcttatataaatcgatgattttggaggacacactctggcagttctcgatctttccaatgtcagaagcatgttatgaaagaagctaaatcaagaatcagtgggcaagttattacctgtgcaagttcatatctgcttcatttctagctcatcctggatgtccacatgctacgctgaatttactggtgacttcctcactggattacagtatagtggtgccacctgattctcacagttttcttttccttctagttgaagggggataaatcgtgcatttgtttttcaaggattggtggtagtttagtcactcagtcatgtccaactctgtatgaccccaaggactgtagattgccaggctcttctaaccatgggattctccaggcaagaatactggagtgggttgccatggccttccccaggggatcttcctgacccggggatctaacctgggtctcctgcactgcaggcagattctttactgactgaaccaccagggaagcccaaggattggctgagctgaatcacataaacatgtgctccatttcagctgttttgaaattgggcttaatgccctctgacatttctcttgggacttctaggtttcttttttctgcacacttcttgagacgcggcgctctgctaactttcaggttcctttcctacactcatgtcgttggcttcagttacagcgagcacagattacgacattaaaaaactctctccttggaactgatctgcatttgaaaaaggtggggcttgaagtcacctgaaagtattcttcattctcatccttgtgcatcttatctacctcagtggaaaacatttttttccctttatctttcaaggtgacccgaaagcatacaaaactgggtctccaagaagtataggtgtgtcctcttacgaactacccaaattcactctccttaaaagtaaaattatcaggaccatggaggcattaaaaggattgagctctaactaagtattctaagatttgatgtttctgatgagtggaaaagcaattttgtaacagaaagtatgtgattctatttaaaatatttacatatatttgcctgtaaaagacataggatgactgcacacacgggctgactggagagtgggattgtggtgtgtagacaaggtgaggaaggggatttacgctttttaaaaaaatcacttctgaactgtctgggtttttcactgtgtagttaagttacattcttaaatgttaattaggtgacatcacacacattcaccaagaatccttatcagtcttcactg

SEQ ID NO: 27179 - DNA, 1236 bp, Bovine  19866880467548
gaagggtttgcttctattatagtattttgtctttgtctcggtcaccttttcctcctttacatgtctaatagtgttttattatatgacagactttgtatataaaagaaggctccagctgataccttccttaggcagatagattgtagaacagatcatctcaatccaatcagtgattgaattgattcagagcttctaactgagagtttctttaatctctgtttcctcagccctgtagctctgttcttcatgtttgaatttagctctttagtgtccaaccccattattagagactaaatcgtgtctccccctgccctgcctgaccaccccccacaaattcttatgctgaagtcctaactctcagtcatcagcatgtgcccgtatttggagagagggtcttcaaagaggttaaaatgagttcatcagtgtgagccctaaggcaacgtgatgggtgttcttataagaagagattaggacacagactcacacacagaaagaaggttgtgtgaagacagggagaccaccatccataagccaaggaaacagacagtatagaaacctaaccctgctgacacttggatcttggacatctagcttccagaatggcgagaaaataaacttttctagactacccagtctgtggtagtctgttatggcagcacttagcaaacttgctgagcttccccaatggttcaacaggagacacaggagacaggggttctttcctgggttgggaagattccctggagaaagaaatggcaccccacttcagtattcttgcctgggaaatcccatggagagcagagccttgtgggctacagtcgaaagggttgcaaagagtcagacacgactgatgactaagcacagcaagctacacacccatgggcagaaacctgagggagagcctcgttgtgaatctgtgaaagcctctagtaggattttatcccctgtaggctttttcccctaagcaccacaagacaatggagatgaaaacctgcctttctgaccagcacccagcctcacatcaccctcaggaaatgtctcaggggcaaaattagccttgcacttgggcttttccagtttctaattggtcacaccagctctgtgtgactgtcaaaaattctgctggcttctttttcttctagtacagtctccctgcctaaatcaagcccaccagaggaaaaaaaaaagacaatcactagttcaccttggatgggttgttactgttgcagaatttta

SEQ ID NO: 27180 - DNA, 946 bp, Bovine  19866880473357
aacaagtagaaataagtgaaaatctgtttctgtttccactcaagataaatcacttagtaaaggtttactaccccggcaaagaaagagcttcaagtacattctgaacctggcccctgggtagtcttattatgcatggtaattgaaagatgtactttagtttcaaataactacaatcaaaatcaaatccctcagatgattatcttgaacatgtaagaataaatagaaacactttatgactacattcctgttgtagactgtaataagtatatacaattacttaatccacaagcacaaagagaacaattaaattcatgagttgtgtttttttgtcatcttttaaaaggataattatggtttgctttgtttttgactagcccatgactttctattccctgatccttgttccccactttgaaaagaaggatttgtgtaattcaaatgtattttcaaataatgaatgctaaaataaagtagtcactttattttaaaatttggtttaatctctggagtcaaatataagttcaaattccagtttctccatttactgcctttagatttgggcagctgcttttaacttcttaattaaaaactttaccaaatacctaataaacaattaaataataatatcacatcttaatgtcaaaaaaattaatattataattaaatcagaaatgagttcttacctttttgttgatctccagaatccctatgagtgaaaaaggtagcacatggaacactgcaagatacagcaaaacaggctgttgaatgcctgcctaaaaggaaagactaaaatcacagaccgctctcaagaatatattaacaccactattttcccagtggttaccagtgggtaaagagaacaggcaagggataatacaagaattagggcattaagaagcacaaactactatgtataaaacaagctacaaggatacactgtacaaca

SEQ ID NO: 27181 - DNA, 783 bp, Bovine  19866880566502
caaaagggaatgaaggttgcagatgaaattaaggttgctaatcagctgatcttaaaagaagattatgatgatgtgatttgagtgggcccaatgaattcacatgactccttaaatgtggatgagggaggcagaaagttaggtgaatgcactcacctaactgtaggccaccggaaacctcctgttaaagatagaataatagtgctagtcccctaaattagtttgtttgttgactcaggggtttcatttactctcattaactagtttggtttcagaggtctggaaatcaattacacttgtgtgtaaaacttataacatagagcagaactgagcattgattcctcctactaagtatgattagccctttacatgaaggcaagatgctttcaaagttgatttggttaaatcctaaaacaattgcacctcaagaccagtaccaaaagaatgttccaatgctcacttatgcattcctctcatgtgccgcagatatatcttgctgtatttttgcttttcttcacaataagcatttccagttgtcttgcctaagggttttcacgggtagatactcttttctctgaaaatctgaactgttgttagtgattagaattccaaagcaaacatgccaagaaatgactacaagcgcctgattatcccataagaatattcttccgttgttcattatttttcacatttgtacttagcagcaataaaagcttctttccttccctctgtggggaagttgtgacaatgttttcatttgaggctccaatcaccagggctaagtag

SEQ ID NO: 27182 - DNA, 1146 bp, Bovine  19866880610810
actttgaaaatgtactttctgattataaaagtaatacaaagaaggctgtataaacagaggctaagaacgtggggtgtcaaatcaggctccttaggttcgaatcctgatgttgctacttactagttagcaaccatcttggctgccacacagttcttaataataagcccttcataactacagttggctcttgaaccacacagatttgaactgcacaagtccacttatacatgaattttttttttttatagtaggtaccacagagctacacagtccgcagataatatttattcacagatgttctcctgcgaggaggatcagcacccttgaaaccaggttgtccaatggtcaactgtattcatagtggaagtattaagctactataaaaatatataaagaagagggaattccctggcagttcagtggtgaggactcagtgttttcacctgagtggcctggaatcaattcctggttggggaactaagatcccacaagctgtgtggcatggccaaaaaccaaaaaagtataaagaagaaagtaaaaagtcaatccagtccaccgtttagttagaattggcatttctaaagtgttttccccccctaaggagggctgctagtaatagaaccatgatttctaaaaattccttctacatccaagagaaagcttattaattactgaaatatttatttaggagaattaacttttgaggtccatttgtctttcacatttggattctatttattacacttgtttatccttctgctcagccttgtgatgattctgaatttggggcatcacatactctgtctctgtcatcagtaagattatgattttcctataagaccaagtagaaataggtcatggatgaaaagaacaccctcgccgcactccccgccaactggctggtgcatgcagctgaaaaccagcccctctaagaattgatgttacaaaaggcagctcctctctgttgtcttctgtcatttctccccgactttatgctctgtgaatagcagctgttcagggcattgccaggcgagcgcaggggtgctgcaatcagaaatgcgagtgagggacacagcaggagaaggctagggcggagggaggtggatctgctatacagcgagttaaggggagacacgacagagagca

SEQ ID NO: 27183 - DNA, 1020 bp, Bovine  19866880611381
aacccgctgcccagcctcccatccgcccccggcaaactcaactgcgcgggcggatgcagaggccccacaactctccaaggcccccctgccgggagttcccctggaggggaccggtttggcagtgattgccacattacaagatattacattccaccccggggcctgggccctatcggggcgggggagaagctgtgtttctcgaaaagaaaggagcaggcaggcaggtctcggaggagcagccactccgcctgcacgtgagaacgcaggcagaatctctcaatagacctttctttccccggccgcctcgactcctctccgtcctccgggtcgggccagaccgccaacactgcagcatcttagccgtgggcgggctgcgcagagctccctggagtctccggaggccttttttttggagggggggtggggggtggggaatcctccaggagtcctggtgccactgtctgcgtcccgggtcgggttccgccaagcgctgagagcttgagggcggaagcagggggattgaaggctgggcgcggagcccgagaaggtggagaaaggcttcctgtggcgggccagggctgcgggccaaagggttagaactcccgggaaggagaaaaggcgaaggagagggcgggattgaagtcggagcgcgccagggtgatcgcagcgggccgactggggcccgcactgaacaaacatggcgggctttgcctacccgcgctcctatcctccttttgtcgtccaggaggctcagataccctagatatgaaatcgtcgctcacggaacaatggcgatttctggccccggaacccgacggagtccgggctactccgagcggcgtccgggttcccgggtggcctctctcccgcagggagccgccgcaacccccgccccagccccgccccgtctcctggcagcactgcccttggcttcttaaagtcgcaggctgtctcagtgccccagaggagcgccgcccgaacgggaatgagtgttggggtggggtggggggtctatctctc

SEQ ID NO: 27184 - DNA, 1368 bp, Bovine  19866880644579
tagaaagtatgatatattaatttttagctaagaaatatccacagggagtaatcagagtcggcactgtacaggtgtttttccaattataaatgacatcagaacaccgaatattaacaaagtgattttcacctgcttattaaacatccagagatacatacacactgaatcatgttgttctagctgacatatgaaaggttatatgttattcaagaaagaaacatccaccttcaaggtgccatcatggaaattccttcctattctttttctttttttccttttaaattttatttaaatattaattattattaatagttaagtcctacacaataaaaatatgaaattgatcatggctgaccccaccactcagcttaagaagggaagtgaagtcgttcagtcgtgtccaactctttgagaccccatggactatagcccactaggctcctctgtccgtgggaattctccaggcaagaagactggagtggattgccatttccttttccaggggatcttcccaacccagggatcaaacctgggtctcccacattgcaggcagactctttaccctctgagccacctgggctacagcttaagaaacacaatgtaatcaacatgggggaacctctatgaaccaccactgcgtgctcttccttcccaccacttcacactctccactcccatgaacccctgaatttggtgtctgtccttcccatttgtctctttatgctttgtatacagagatatatagtgttttctatacatgtatatgtacatatatagtgtgttttcacgttttaaaaactgtgtttaaatggcttttttttctgtaacttgaatcttttttccttcaatgttatgatttgtgagattcagccattgcattaccttcctagggctactgtaacaagttggcataaattggtgtcttaaaacaatagaaattcattctctcacagttctgggagctagaagctgtaatcaagatatcctcagggctttccctccctcgggacacgaaggaagcatctgttcgttccctgcctcctccagcttctaacagcttcagacgctcctcggttcgtggctccaccactgcagtctgtctccaccttcacatggccttctgtcctatgtctgtgtcattggatttaggaccaatcctataatcccggatgatcttctcccaagatcattacctacatgtgcaaagcctccagatattatgtggtggaggcagggtttccaacccacacattttgactaactcctgatagttggattacatgtctctaaactcaggtgactgggacttcggttatttaaataaaaggcattttgtgggcatggttctaaagctcagcccgaataggt

SEQ ID NO: 27185 - DNA, 1967 bp, Bovine  19866880663652
atattcccagttcctagcatacttcctgccacataatagacctccaataaatacatgtgaaaataagtccaaagtgaaaacagagaaaaagtcagatcatttttgcatgaacagtgttgctatatttaggaggataagtgtccatttcatccctgaattatgtggtcttaaggccagggacttgtcttccatctttgtatccttccctgtgtgtgtgcgtgctcagtcgcttcagttgtgttcactctttgcaaccctgtggactgcattctgccaggctcctctgtccatgagatctccaggcaagaatactggagtgggtttccatgccctcctccaggggatcttcctgacccagggctcaaacccgggtctcctgcattgcaggcagattctttacctctgagccaccagggaaaccccaatccttccctaccccgtgcccaacacaatacctggtgcagaacagaatgttaatccgtgtttgttgaacaaagaatgaataaatatcattaaatatctagttgatgtggatgaggatttatataaataatatttccttaaatattttctggaacaaggcataaataacttaggtaaataaagtataaatagtattagaagaatatctgtggagaagaagagactacactgatgttaagtcctactctgggaacctatcccttaaaatgggtgtgtctacttctgtcttatttcccttgagaagaactggagccaaactttggaaatggctttgcacatgaaatgggagtataagagtgtgaacatggtggctgtgggatttttgttaatgtagtcatttctttccaaacacttgaaaaatatttttcttttatatttttcattcttttgccattgcctctgtgctttctcctcatttcacatttaaatgctagaaatcgtccagttaatgtggacatgcataataagtgggtccagatcttattctaaatggaagccagagccagtgtccaggcactaggaaagcataattaccccgagaacagagttgtgttttctgcaagggcttttatcagtgcctgtgaaggcccagatatatgtttcagcatcagacaagaaaaaagatttgtgaaacacatatctcctctttcctggggaaaaaaatcttttcttttgcaaaaagactttgtgtgtgagtacattccagtcctttaagggaaagaaagaaaattatatcagaaatctatgcatgctaaaataatattcactcaaaatggggaatgagggattctttccatatgttcttatcctatttcaatttaaattaattttgcaggagtcattaaccagctccacaaaatttgctgggtttgctcctaacacaagcttcggcacacctgcatccagtgcatgtctttttggttaatctataggaaccaaaattaatttcagtgaaacggccaaatggccctcaggatcctttactcatatgtctggctagcattccccaggggcacaaaacacagcctgacaagggtgatagaaatgtttcaaaggaactttcctaagctctctcagtaccatcttttttttttttttttttaatttgcaggtgcaaaaattccatttgtaattctttaattccaagggcaatgcgtgtcttggggtctcagaattcaggacatgtggccagctgggacatgatattatgcttgcaagtcatggcaggtgcagaaggggggtgagcagttgaagtttggcccactccctttttctctctttttgtgcttccttttgctcttccagacgagtgtacaattacacgagctgaattggttatctcccaaagctgtgctgttgtacatccaggaaaaggacttgattactcaaccagtgtttccaggagccttatttgggttctttgtgcagcagaagcaaaagtgctgagtgcaccctcttttgttttgcgatttgcctgctgggtg

SEQ ID NO: 27186 - DNA, 946 bp, Bovine  19866880745571
taggaacattctataaaatgcctgacagtcctcctcagaaacccttaaaaatgaggaaaatctgagaaactgtcagagccaagaagagcctaaggagacataagaactgaatataatgtggcatcctggatgggatcctggaacagaagaaggacatgagaaaaactgaggaaagcagaataaactgtggcctttgtttataataatatgtgaatattgatttattaattataacaaatgtaagatgctaacaataggggaaattgagtgttgggtatatgggaactctgtactattgaagtaggaccctatagtccttgcacccaccccatgtcagaccaccgatgaccaatttcaagatacaaagctaactgtgctatttctgcatgtagccccctccttctgtatataaagctcttgccccactggttgtcagtaaatggggagtcaacctttgcacagacgtcagccctcccccacttagttgccacatctgaaataaagcaagctttcctttccaccaaccagacctatttattggcttttgggtggcgagcagctggaccccaacaccttttggtaacactatcttcacaataattctatgaatccaaaacttttaaaataaaagctttattaaaaagaaaaaaaaaaaagattttcccttttcctagacttattccctagccttccacagacaaccagaggcagcggttgctttctgcattgcactcattctgcagtttattatctgcggtggggtgatggaggatataaagtatcacgccacacatctgtaaactaatttagagaaaaaatggaattaaatagagaaaaactggaattaaagcagtacatacacaaaaaaacaacttcccaaagcattttgttatttgtctgtgtgaatagaacataatctgtgagaaactccaagatggaatccgac

SEQ ID NO: 27187 - DNA, 2087 bp, Bovine  19866880772743
cttttactgagatcagatagcatcttttactgagaacaagataactttgttttaggaaatgctgggcaggagaaacaaaaatgacccactggtttctctggcctttgagtgaccagtttaagattccgagttgactaactcaaatcagcctgcctatgggaacccttgctcttaacacctaggctatcctagctctgttattccctttgttctactcattccaccagtgctaaacagagttgtgtaagaaaggaagaaaagaaccagtactgaagaattcccagtgcaacacagagggaagttcccaccaatctgcaccacaaaaccaataactcagatataagacagaacctgtgatactaaatttatgcacggtgtagggaaagagctctaccgaactctttaaatcccaatatagaacatttccaaagagaagtaaaatttgttgcaaaaccaagaggaaaaaaaagatgccgtaagagtcattttgcgtctatttcattatctccttaagacaatgctttccagtcacaatgagtgaacaggtcaagggggtggggggaatacaacaccaaagagtgtataaaacacgatctaaagaacttggttctaagctggggggatcacggtatcttttggtacatcttggaagctccttcaaaaatctgtctatgtgtgtttttttggaaagaaggttcatagctatcatcaagaggcccagattattgggggaaaaaaaccactaagaactactaacttgggcttcctaggtagcggtagtgataaagaacccacctgcaggagacctaagagacgcaggttcaatccctgggtgggaagatcccctgtagggagacatggcaacccactccagtattcttgcctggagaatcccagggacagaggagactggcaagctacagtccatagagacacaaagagttggacatgactgaggtgacttagcacgcgcacacacactgctaacttttagtaaaaataatattttctataatccagcagtattttctaaaacccaatttcccctccctcctgaaacagtgacctctccctcagtggcaactcagaggagctgggggcaccaggaactcagtgacaccaggtttggcagccacctcaccagcccttcctatcattcctgtgccccagcttagtctcctcggcaatggaagcccatagcaccctaagtaagccaaactggggacattcaaaagtgctaaacaggatatagcatggagaggaaacaccccagtccccaagagaacacagctcaaggtcgcctgcagaatggctcagggaacctggatgactggaatcagtcaaggaagcagaagaggtttccaaaggttagggaggaagagcatattacatgggctgggcttgcaggtgtaacaagcacagatcagaggcaggagcagattaaagcaacagagaggctaggaaggaacagatggtctggtccagggccagggaggaaatgaaaggcaagatgaagcccttatcattaagcatcactgagagatgaagcttgaacttttgtatggaagctgtcagagactgggcagatttcaatggggaaatagactacgtgactatgttctacagaggaaaagattgagaagcggggtctaaatgaatagaagacagaagaaagatatgactgcagagaagagaaataggccagcacatggggtgtcaggtattaattttgaaggcacatggtagatgaatggacaagtcaacaagaggcatacaggaccagatgcaggtgtggataaatggggtgccttaggccaaaggaaatggaggggtcctccctttcctttccctacgacagacttctgcgggtgacaagcctcccaccacatgcctgtaccctgactgcaaggaggtctgccctcagctctaggaactggctattaatgtagaattattgtaaatacttgtgatggtctcaacgtccatctctgcctatacctcattggagcaacctttttcccaactgagtagcaaagactaaagaaaaatataaataacagcacaagaaagtcagaaaataaccaata

SEQ ID NO: 27188 - DNA, 1815 bp, Bovine  19866880783184
tgggtgtgagtgcgtgcatagtgacaccttcaagggtggtcgtgcagagcaaacacagcatgagattcccattttgaagctgcagcgtgactgacgtcatagtgtgatcaaagtgctctgcaaatacttactgtaattattctgttcttgctaatacccttatttatactttgaaattataatcatccaaagaaagattaaaacaagatgtatgtgttgcctgagctccttgccttacagatggtcacactcagagttccctgaaattgctggggttaattgaagcttcagttttcactcaggtgtagttgatacttaaatgtttcttacctgtcagctttcactatttaaaacagtacaacaatagcgctttaatttgctttcattaatggtagcctctcaggtaatgttagtgcaggtttgtctggatgatgtttgttcctctgaatgaaacctttggaccagcttcccagctgagaagaaaagctaaatagttacagaggtaaaagcatgaatgtctcactaatttattcatttaaaggatgctcagaacccaggacacatccaggggaagttaacttttaaacaaagggcaagcatttagtgtatgattaacggcagtttctttccttgagatttcagtgagctgagacctcagggaatcattcttagggaggcagctcagagtcagccaagtgctccagggataatcattacagagtcacacaaacagcagtactttttgctctagttctttggtgctcttccagtagtattgagatgtgagaaagccgtattaggctcaagcctaatagcaagggaaataagcccttctttgcttctactcctcagctgtgtaaaagtagagggccagtgaaaagagctgggtgttacaatcttacgttatttaggtgatataagcgttctttgcctgtgtattgagatttgagtactgaaaagacaatgactttgctttcctacatcagaggactggtgtttgccagtggcattgcttgctatttgattaaggcccaagagaaaaagcaccccactccagtactcttgcctggaaaatcccatggatggaggagcctggtaggctgcagtccatggggttgcgaagagttggacacgactgagtgacttcactttcacttttcactttcatgcattggagaaggaaatggcaacccactgcagtgttcttgcctggagaatcccagggacggcggagcctggtgggctgccgtctatggggtcgcacagagtcagacatgactgaagcgacttagcagtagtagtagcaagagaaaaaacagaagtgagaaagatggagggaagatagtctgggcttccttatgtcaagtataagttagcaaccccaataaagactggggaataagtactgtgatgcttcttgcatgtgtagtacataaaactaggacgcatattgtatgtatatgcataataaagattaaaaataaataaaaggtaagtgtaggttctctcattcatctacttgggttcaagttgaagccttgttagtttttgatggggtaactttaagcattttgatggggtaactttaagcatgttgctttatttcattctgtgtgaggttttcctctgcaatacaaatataaaaatagaactcctttgatagggaaatagagattaagtaagataatactaaatgcttagaacagggcctcaagcatggtgaatgcttaacttttttatatttatatttaaataaaagataaatggggattgctggtttacttcctcaaatatttgttcaaattgcaaattatg

SEQ ID NO: 27189 - DNA, 1128 bp, Bovine  19866880805076
cttagaaccttctgtacaaatacaaccttctgtttttcctttcagtacagccttcaatatattacacaatatactcaacaatttattaaaaaatatgtgtggtattagatgatattgcccaattgtaggctaatgtaaatgtgctgagcatgtttaaggtaggacaggctaaattctgtttggtaggttagatatattaattggatttttgacttacaatattttcaacttatttgtacataaccccgttgtaagtcaaggaagatctgtactagcagtcatcaattctataccaccagtcaggggatgataaagaatgtactagtttttgttttaaaaaattcaattcactggagaatgtgttgggaagcatgcaaaaagctgcacactgaagacagatgactgacttgtagaaaagcacttgtacgattgtttgcattgtgaagtgaattaggtgcttttttcatggaatgctatttttacttgaaaaagcaaccgtagacaaactacagctattcagacttgagtatttggcatcttaaaagtaaatgaaatgagctttaaggacagtatttgctgtcaaagataaattttgtgctttcaaacaaaaatttgaatcttggataaactgtgtccaccgccatgagtttgatagctttcaatacttaaaaagatatttcctgatgggaataatagtgtattaataaatgtgatttctgattattagtgaaatgtgtcatatggatctacataaaacagggaaccaaactttccaaattatccatgtgtgatattataaaatgatacctaggtttaaaaaaagattcattcaaagtatatggtgctaaaagaaaaggggggaatgagagagtcatttcctaggcagggactcctagggagtctaggggtccccaaagagagaggggtctggaattctcaaggaggaaaaaaaggacaaactttttttctttctccacattccttaggattatataccaataatgtatcctgcctaaggacagtctttggattcaaccttctgttattttaaaaagttaattatgggagtatacctggtctttacaaggatgtatcttgcctgaggacagtgttatcttaaaatgtaaa

SEQ ID NO: 27190 - DNA, 879 bp, Bovine  19866880848375
ttcattagtataatttctgaaaaatggaattgctggctcaaagtgcttgtacaatgttaagatttaaaatgcatattacaaaaacttgaggtgcatttaaatatttttatttctctacttagagaaaattgtattggtctattattaaatcatcataccaaaattgtcccttcctttttctctacttaaggttacattatgatgacaataagtttagtactctgaaattgtactaggtcttatatttactcaaacttaaaattcattcatttatcagctgtttgttttctagaatttcttcaatacttaaaatttcaatgactgggtttgcaacccaatcttttggtctactaatataggcaaatctctctggtagttctattcagtttttgattaaattgatcatattgcaaacaaccataatctgtcactatttaagttaagtgaatttaaattagaatatgctaggcctttttgatgtgcaaatttacatgtaaattttcaatttacatgtgcaaagccatgtccacatagcagttaaatgctcagtcttttgatattagcacagcatgaaaagcaagtttttatattttggtagcacacatttactttaaaaatatgcatatatatgtatacatgcattctagagggatgctttattgcttgcagatatggaataaattatttaactaccaagccaaatatttataaatgtgttttgctgctgcttctactctgtataaaaaaccactagttagacactcccttttctgctatctcagccttaggaaacaaaagtataatttagcattatgcttgatgattaactctgttcaaaggcacagaaaatgctgatggttagacaagagacagagtatt

SEQ ID NO: 27191 - DNA, 1368 bp, Bovine  19866880898747
aaaaatgatttccttctctcatctttcttccttcttcctttttcataaaaggaatggaatggactacctgcttaaatgtcagtctcacagcaacaaagagcctgaccacatttcaaagcctctgaaagacgtctagaggacaagttgggggcagcagagaaacccttgccttctctaaccttttattcctcctagccaggattccaagtcacgtctgtccgatgctcttaacggcagattatgaaaaattaggtctttcaaatgagaacaagaaagaaaaaaatgtcatcatgtatattcatttgatttgggaataaacgggtgccctataatttagaagagacagggatgactcattacatctatgaaggttattaaggaaatgaataaatcggtcataccactacaactgtgcttgtcatcacagtaacattgccaatttccctttacagttggtaattgctattctataccttcttatatggaatataagacctattctggtgtaacaataaatattagaatagtcttcaaatccattattagttgaggctataaaaagctgtagctagagcaggtgcaagctacctcagaaccatggaaagagtcattcaaaattatagcactgaaaatactctgaactgtccaatgcaataaaagtatatataaaatttaatagtcatcaatgtaaaaagctataatacttgaaaattaagactattttgataatgttaaattgataccccaaactagaaaagtggtacaaagcctaactcacacttatatttcttcagtttaataagcatataaatgtttaacaaagagaataagagtgatatacattatagcagctttatttgaatctatttaggaagtaagatcttaagcttctctgtagttttccttattagctgattgattttcaatcaatttcagctaacactttgcttaactatgtctggttgctttgatccttaagcttggagttttctttctactgtggttttaactattctatagattttattacctctattgtcaaaaagtatgcctacattcaagcctgtttatcttatatttcttcttcaagcaagaaggtcaggaagaaggaaagggtaaaaagctaaaaagtacacttcctttcagctccagtctgtaattgaaaggctccatgacattcagaaatttaaaagcatagtctttggggatggaaatatataaaaggcactatccagagcggtctagagaatagactttggcctcaagccgccctgggtttcaagtctggtttcttcccttaatacctgcattactttggacaagctccctaatctctctaagcctcagctttctcatttgcaaaataag

SEQ ID NO: 27192 - DNA, 1775 bp, Bovine  19866880933473
ctcagacagtgaagaatctgcctgcaatgtgaaagactcaggttcgatccctgggtcgggaagatctcttggagaagagaatagttaatcactccagtattcttgcctagaaaatcccgtggacagaggagcctgatgggctacagtccatgggttgcaaacagtcagacatgactgagcaactaacactacttttccaggaataggtgaagtccaattcccctccacttatacatggcccagactcagtgactcatgtctaaagaatggaatgtggcagaaataatactaagtgacttcggagttttcctctgcctccctctcttggaatgcttgttcttggatatcttcaccatttagtgacaaagccaagctgttgcagggaaagttcacacgcaggtcacacgttgtcaagtgtaggtattccagcaacggttaacaatgagctcccagcagacagccagtgttagccactagacagatcagtgagtgagttttcgggtgatctagccactaattcttgaggtggcccagctgacactgagttcagcagagagaaactatcctctaagttcttccgaaattgtagattaatatcattgctgtttcaagtcatgaaagttttgggtggtttgtattgtagcaacagataactagaacaggttttggtatcatgacaaaaaaaaagtgaaaatatatggcaacgacttcgagactgggcaggaatttgggagggtcttcaagagaccattcgagggaacctcatggttcttgaagatgttattggttagggctgacaggaaagtgaggaaatgttacttgggggaaatgtatagtgactgaaagtttggcgacacttacggtaacatggaagatagaaaatacaccaaattacccgaatgacctaaggagattttcaggaagagaattgaagaattgaagaattgctgcctggttgttcttactacaataaaatgcaagaggagagagaaactaaagaaagaactgttaaatatctagcaaacaggaattgctaggttaacagtttcttcttcctcacctctccttttagcaaaagtggcttcctgtgaagatcaaatttggagcagggtcatgaaacacagcccggagataagccaggggtgtgactatggagctctttgttaagacttcaggcagtttttttttttttttttttgagatttgtgagttaagttttatttggggcaaaatgaggactgcagcctggaaggcagcacctcagatagctctgagagactgctccaaaaaggcggtcaggtaaagacctcaggtagttttaaggtgttgcttcctacatactttcaagtgtacgaaagacctgcagaccataaggatgttctcagacagcagtttgggatacactaaggtagagacaggtgaaatgagattcgtgggtatgacttttgctaaatggagttggttataaattgattggtaagaagcctacatttaaaaaaaaaattataatcagcttaggccaaaagagacattcaggccttcgaatcctcaaagggcaagaagcagtctacgaggagacttccctagtaaaaaatctgcctgccaaggcaggggacacaggtcggatccctggtctgggaagatcccacatgccaccagacagctaagcctgtgcaccacaacttctgggcccactttctagagccggttctccacatcaagagaagctccagcaatgagaagcctgtgcaccgcaacaaagagtagcctccgct

SEQ ID NO: 27193 - DNA, 627 bp, Bovine  19866881111225
tggcgctggcgccggcgccggaggggccgggcgggtggaggctggagccacccggcgctgagtgactcaccgcgccgagagctggcgaacctcgacccgggactcgcatgcgggcagagcgggaaccctcgcggcggccctgcgctgagtgcgcctgtcctcgcctcgccgcacctcaccgcaactcgcagcctgtcactcttgaccgacccagttcccccctgggcagcagctcgagcttccaggttgtgacaccagggaaaaagtgcacacatccaatgaaaacaataatttatttaaataatctcttcatattgtaaaatcaacattaagagcatgttgttttcataataaataaccccaaaatacctttcatttcaagaacaaagactttaggataagataaatccaaatcagtagcttaaactgagaaaatctttcaagggaaaaagaaaacggaggggtgctgaggtcactgctaaaccgcagttttcacaagtgggggtttacaaaaaaatgtctgaaaagatgagtatgtttatacaaataaatcagtgggaaaatctgcacagacacgtttatttacaaacgctatgtccaagtccaggctaatactcctgaataggt

SEQ ID NO: 27194 - DNA, 1280 bp, Bovine  19866881358262
tgaagttcagtttgtattatcaaactggtatttatagggtttttaaaatacaagacattcctctactgaaatcagtctttgagaatctttcactatagtgtcttatagattacaacaataacactctttgtgtgtccaactctttgtgaccccatggtctgtagcctaccaggctcctctgttcatgggattttccaggcaatagtactggagtggattgccatttccttctccaggggatcttcccaacccagggatcgaacctgggtctcccgcattgtagacagatgctttaccgtctgagccaccagggaagactctaaaatacaagacattcctctactgaaatgaatctttgactgagaatctttcactatagtgtcttatagattacaacaataacacaggaaaactatgtaaataatgaaccagaaagaaaaccttgattattattacatttttgataatatagttttttgtttatgttaagagtgataaaaacagtaagttctgagtcctataaagttattgcagccttatttctggtttgaaaaatactctgttaggaaactaaactccatgatattaccttgaagagtggaattgagcagatttttaaaaaatcttgttttaaactgaaaccctatttctgaggcatttggaagaagcctcagttgcagtggtggtcatatagttttggggctggggatgaaggttataggagggctagtccttgtctaacagacatgagacctgttcccttatgattctttagaagactgtgatgcactatgaggctaggagacgtggggagggtgaagggagacgggggctggaggggaagaagacaggagatgagagaggaggggagagagagagagagagagaagctacattggcataccatggaaaaggctgcgtctattttgctgctaccacattgatgagtagctagatgtgctagcaaaacatcaaggtatctgagtgtggttcactgtgggaagtttcagtagcaaaactttcttctgtttgagctccatggaatgatgattctgcctcggaaacaaattagaatgttcagttttactctgtgtaataatcaggaacttcataggtattataagatctaatttaaaggttgctaagaaatttacaaaataggattttagttaaaagtttttataatagtgctatagtcaggtaagtaaattgaaaaaggaaactaattgcttttatatctacattttatgttaatactttgcctggggtaagtaaagctt

SEQ ID NO: 27195 - DNA, 996 bp, Bovine  19866881368782
cgtgctttgtctggtattcctgacaggtattcattgcttaataacatattgttcctttggaaactgaaacgtgaaactaagatctgtaatgtatgttgaaagacactatagtttaattgaaacctgcctgcaaacttttgaaaccgattatggtaaagacacaattttgaagtattttgtttctaaatggacataataccaccatttaatgtttgttaaagcaatatgtaatctgaaaaagtggttgtacattaaatatttcttttaccatccactattgttttggctctttgcgaaattaaggtaataataagtatattttgttgagaataagtagatttttaaacagtgatgctgcatgttcatattatgtatttctagtaaaaatgatatgactaatataaattaaagattagatacagttattccactcaatccttctccactctgaattatcgtcactactcattgggcttctgattgtagtcattaggtatttatttttatattccttttattgggatctatcaccattttttttttctgtttatgtttcagtcgacctcttcaggatggagatattatcaacattgatgtcacggtgagtaaatcatataaaaaacagtctttgatcaacttcagaattgctggtagcaacaggaagaagagtggattgaaaacgtgaactgcgccgatggaagtgctgtttacttctagacccagacgcaagcagctggtttccttttttgtctttaacgctgtgtttattccaagtaaacccaggcctgacttgaatttagggctggaatcagatgcactgagatcaatgttggcctaagtgaaatgtcaacccaatcctgctatgtgtcatgtttttgagaaggtgtaattgttattgatccactgtgtggttaatgcagagccctacagcactgggcagctgctgaagctagatatatatgagatgagctaaggcgaagaaagccagcatttttc

SEQ ID NO: 27196 - DNA, 2779 bp, Bovine  19866881422274
gtcgaggacacgagtgaagcgaaaagattgagcgagagttgggccccagaagatgcaacggccaggctgctcctgcaaagatggagatgagcagttcccagaaaccaaaacccctctcccgaggtctgtgacgaattccccaaagacctgaaattgcaggaccctagaggtaatactttggaaacaaaaacacgaaagaacgcctctcggaccaatggcccggaaatccgtgtccctgggaccctcgacggcagagtgggaacagagggcagtctagcagcagcgtgtgtgaccccgagcgaagtaggtgaatgagaatgtgactgtcctggctgcgcacgaacagccctcgggcgcccaccctctgccggcagggggcatcctctcccccagggcacccctcggagttggctttctgtgtaatggaggacgcccagtggtcccgcagacacgatgcgccgagccaggcgacgccctggactcctgacccaggccagcggtggggcaggaactgaaagctaggcgcagcagacctgttcaaagagccgcttgctgtcttccggagatcggcagctgttcaaccgaggcttacagtaaataccctgcggtttacactatggcaacagagaaaggaggtgtacttaactcaaaggaagtcgtttccaccctggagcctcagtgttcctgtgtacaatgggaacgatgattacgtccttgtctgcaagggctgtcacaaggctcccaaggaaggagatggtgagactctgtgaccagatgaagtgccatggggacaccctggtgggcctagaatccaaagcaggaaggtctcagcgatgatgtggaacatacaagaccagagcagagacactgagccccctccttcccccatccgtctctagaaaactgaaagcagaaaacgggaaggagggtgccttgaggtggaggaggaattttggcggcaagaagacatgtctaattaccccaaaactcggtctgagccccgctaaactcctctccaatcattatggagagaggcatgcccctaactctgaactgctgaagagagtatcaattctcgacagtactgcctctctgactttagaccaaagggagaaaattatttggatattgtgatgcagcgatcagataatttaggtaaacccagatttgtgcctggattatcagaattaacatctcaggtctttacttgattctccaaatgcagttttaaattctgcgtcactctccctctctctctttgcttattgcctctggtcttttctcccacacgcacaagtcccttgttttccagttaaaggggaactggggtcatatttccttccaggaagatgccattttccagatctcagctgacctagacttcatgccattaatgcaggttctcacggttaataaaattcaacacacttgccaccatgaaaaagtctggtgggaccgaaggaacagagagagtcaagactatggaaattggatcttttatgtttcattttcaataggaaaacaagtttctgccttaggtcaaaacagctatcactgtgatgacagaaagattcgtcatgtggtgtgaagacaccaaaaagcaggcttcattacctatcaagaggttaagtttgtgactggagcccccaaagcagcaagctgcgccccagtggtgagccccacctcccaaggctttctaaacctgctcacccttctccatctaggggtcttttgtaaccaaaaggacggctgggaattaaatccaggcagatttgaaggccgattaccttcctcactattccgcggagagtgagctctgtggatgctggagttttaattacacacttgctttttctgaggaagaaaaccaaagatatttttcaaagtatcaacttgttttccattaggcagttgttgtaacaagttctttcagcgacctgttatgtctttaggacggggtgcttcagatggcacgcactagcacaattttgtggcttttaattactattttgttcttttggggggtttcagaggctggcgcctcggcgtcattagactgtctactgggtccaccgcaatcacgaacacctccaccaggtggcgccacaaggcaggaactgcggagtccagtaccggcgagtgtccctcaacaccgggccatggtttccaaccacgaggaaacagatacagaagaagtcgctaccagatttaaaagaaaaattgcagcgatagggtcaaataggatcctgagatgaaaataactttaaaacagtcttaagtacatgagataaaacttttctatttgcttctgtaagtttaccaagatttgtaatatcaagacaacactctcaccaaagtattatcccatttcttttttcataaaaatatggaatttagagttagaatgaacttgaaaggccatgtgatcagtctggtctagctttccaacctagagaggaaatcaccgggatcatgttttggtcgtcaattagccatcaaatacacgtaattactcaagagtctccctgtgtcagaaaagtataaagggaaatggtttcaaatatatcattagcaataatatctttgaatttatatagctcttctctcaaggaacaaagaaaatagtttaaatattaccgtattaattgttttaatatccctctgggttggttaggaagcaggtattatggttaatttaaatcagttggctatgtcaagtgtctaggggctgacaaccgtaaatgtcagacccttcgaggaaaagcggagctggaactgg

SEQ ID NO: 27197 - DNA, 1323 bp, Bovine  19866881474150
atgcttctagtaccaagatgctaaaacaaatcttccaaatcgctcagatcacttccttcattctgattctccagaggttttcagtttcatgacattcatgctgtgagacagtctgagtacacaggcatgtttcagagctcaggttcgccctgatagttgctgtaggaatcttttcaggaagcgtacttaaagggagttctctgcttgtacatttaaacttgaggtcctttgggttgagtctgctacattctggggtacacaaggaaataaattataaattttaatagtcctgtttggaacattctaccaaggaggtcaaaataatactttattcaaaaagttgagaaaagtgtgatgggcacaccatatttaagcagagtttataaaggtcttcaatttccagtgtacttcacttttaataacttattttgtggttcacttaaagcttatctaaagctattaagtgggtccaagggcagaatactttttactgatttgaaaggaccatttggttttatatgagctaacacttgggtcagcagttagatctgactgcctttcctggagaaggaaatggcaacccactccagtattcttgcctggacaatcccatggacaaaggagcctggcaggctccagtccatgggttctcaaagagtcagacacgattgagcatatacacacaacacttgggtcggcagttgaagttttaatttgtgcattttaaaagagaatctgctcattttctgggaaataataaattactgtactttattaagatttatatattcaacacatacttattgaatttctgctatgtgctaggctctgtgagctctttgctaaatgctgggatctgaccgtgacctagacagatgtgctcctatcttcataaatcacaagatttaaagaaagaagaactagagtcaaattgttttatatgtatgggcacattcctctccctctaagtgcccttgtccccacattcactttgacaaattctacatttgcattgtttgctacaagacaaatttgtgtatgtggatagttttgtaatggtatatggatggaaagctggtgtcaaaccagagattacatcttggagaatatgtatttcacatgtccctgagttgattatgctgcttaggaactgagaagatttctaataagtaaatacaactcaagttactgcgtttccctcttcattattgaaagaataattgtagacaggtcttcctccctccctcccttcttgcctgcctgccttccctccttccttttcaagtttatcacaacagcatgttccaccatcagccagcctgg

SEQ ID NO: 27198 - DNA, 956 bp, Bovine  19866881560204
tttttatttagttctttaatattttttaatacctttaatattcaaatcatcagaagtcctgtcaattctgcttttaatataaatatatcctgaatcggttaccttctttccctctccccctgccactctagctcatttaccatcgcttatctgggccagtgccacagccaccatgtccttgtttccattctcgtgcccctgcagtttattctctacactatagccacaatgatctcatcaaaacaaatcagatcatgttactttccttctccagagtgtcccatggcttcccttcaccacagaataaaatccaaaattccttactcctgacaaggcgtactagccttctgatagttttagaataatccaacgttgttattgccctggggaccctgtattggaacatccctctgcctgaactactctaactttagttctgtgtagattggctcatcctcattcaaggctcagttcaaaactccactcttcagaaaggcctttcttgaccattctgggtacagcagggctcccaaccactcactatcaagcacatccccctgttttatcttcttcacagtactttatcactacctgaaaatattttaaaaatctatttactgtctatctccctggacatgtgaggatcttgttccctgatcagttaaaccctatgccaaaatagttcccagcacattgtagatgaaaataattacatgttgaatgaatgacctcttgtggcccttggttcaaatttttttttgtctctgagtaaatgtttaggtttaataatcagagtgctttatatatttattcgttagccctctttaaacaaaatatatgaacaaaaagcattttattaacttctgaactcttatctcttcttcatcttgaaaggtatcgtggcaaggatgggttaagtattctcaaagcatcatatagacacagaatgaaaaaaa

SEQ ID NO: 27199 - DNA, 1672 bp, Bovine  19866881623181
ttacatacttgctattggacaaatataaatgtgacaaaattttttaaatggtgaaaataaaaaatttaaatatttattttaaaaaatgtgttatacatgtaatatagcattaataatgcttgaaagaaaaaccaagcagtccaacaaattgtaccactcttacaaagcaacctttgaagttatacatgccctttcaattgatatacatgttttatgatatacatgatatacaatttgatatacatgtttttatgttaactaattatgatatacatatttttgtatcatcctttttttgattttaagtggtacagatgttttagatgctatattattttcatactttgtgaaatttttaacagttttgtactaatccactgagtgaattatatgaatttcttaatatcaagctttaagggaatttatgttgaatttacacacactgtaccagtgtgccctttgagcaaataattcaagactgtttagcatgttgctgtatcaccctgtttgtaactggacatactctctctttttctataggaaaaatccttcatacagttcattgccaccagaaggtattttcacaaacacccttggccttctgattctggtgtttggggctctcattttttggatagtcaccagaccacaatggaaacgtcctaaagaaccaaattctgtccttcttcagccaaacggaggtgctccagagggagtggaaagttccatggcaatgaactttggcaacgtggacaaatcagattcagagttaaacagtgaagcagcagcaaggaaaagaaacatcacccttgatgaggctggacagagatccaccatgtaaaatggggtagcaatgtagccatataactccagtgtaaaaaactagctctccagtttagcttctcctacttacccgtgagatgattgaggtccacagagtcaatatttattctaatcaaaaaataggatgtcttgaaagtgtttatattgattgaggcttataaacttacccaagttgagagggagatgatcagtgtaaatattaataacagtagatataaattgtgcttatattacctttttctcgttgaggaccaacgcatttagcacagtgccttgcatagaacaaatgatcaaaatgtgtctacagttggtaaatctgataaactggcagtttccctggcctcttatcatgtagtcattttctgtgtattctgggaatccagttataaagttttggaatcagatcatgactatctgggacagagttaatgctccacaggtatcatgactagagcccagaaaaaaatgtaggaaaggaactggctcccttttccctgtacctgccctttgctccctccccggctggtttgtccttagattggccttggagagcaggatttattttagggcactttggagcagtgacaagactgtaggtagctgaaggtctcctctggtcagaccagaagtttttccaagttgacttaatcccaaggcttccttgggtttgatgtactttatgatccagattccaaacctaattatgatgagaatatacctgaatacataagcagtataaactgctctacaaaccttaaagaacactttctcccaagtttctggtgtttttaaacatggaacttactaagtgccagtactatcctaagca

SEQ ID NO: 27200 - DNA, 849 bp, Bovine  19866881648371
gctactggactggaactgggtttgggggtttctttttttgtgtgtgttttcaagttgtgctttcagcagtaccttccaatcaatgctgacaattccacagttcccagcaatgtataacagcttctgagaccccaaggaagctcaatcaaactcataattatggctgtgagacaaggtaaacacatccaatgtttaatttaattttgtgaactgcaagagtatctgtggtatcaggggaactggatgagtgacttttctgaccatgagagaaaagtttagtttaaacctctgtttcactcatggtaaatccaataatgataaaagaatataatgtggagaaatcagccttgtctatatcttgtccagctgactttttaaacagggatatcaatttttcctggaggataaaaatttcccttcactttcttaggttaccaactcagagttaattgctctatgccaacggcgataaaagaggtgtagtgatctgtttaactacagtcagatgaaacaacttctcaattattcatttattcaattcaatactgctgaggggaagaaagcctatgacacactaaccatacttaaatattcagaattcactctgaatcacactgaatatcacaactaaaaaaagtgaattaaaccacctatgtatctgacatattagtacaaattatgaaaatttattctaagttgcaatgtaacaaaagtcattttaaagctgtttttgtacagcaattacacaaacacctaagctgtcaaagttggaaatttccacatgtcattgataaagttaattgtctaataaaataaaactcttaagttatgaaatttaaagtctgagca

SEQ ID NO: 27201 - DNA, 947 bp, Bovine  19866881698375
tggaaaacagttgttggctttcaaaaatattactaattgtacttaaaccattccttttcaattagagggaatccttgaatttgtgcattcctgcatccaaagactcggagaaggaaatagcaacccactccagtgttcttgcctggagaatcccagggacgggggagcctggtgggctgccgtctatggggtcgcacagagtcagacacgactgaagcgacttagcagcagcagcagtagcatccaaagactactgcttaaaataaaaatctgaaaaaaattaagtaaaattccatgacttagaaaatcaggtgccatttgagatcctttaattagagatgtgaccatttggaaatcagttctgttgatagaattcatatagaaatagtaataaaactatttccatgtgcatttttattcctttagaagagtgtgtacttaaaaatagtgctcctctgccctcttggggaatgtattcttagtcatgaaatatagtttaaatgtatcaagaattttaatttatctagacaaaacttttgtggaggaaaactatctctcatgaaagggaattcaattaagagaacagtcacaggatgaaattccttgagagagatctctctcttaactctaaaccacacctgaaacatgaactgtaacacaataattttcaagttcataaactcctttatatgtctctctcctcctccccaaatattccatatgaagggcttcaaatcccaaatgtgctcagacttaaataagtgagctgctgtcttagagagtttttagttagaaaaaatcagaacagaagagctaatactcgggagagttctctttagcagatttcaacaaaaagaaggcagatttcatcctgtgtaatatccaaggcaagaagaccttcatgctcagaaataggtcacaacccatgatggctggtgttaaggagt

SEQ ID NO: 27202 - DNA, 1197 bp, Bovine  19866881772450
agtagctatgttgtgagatatggcagtgagaagtttgttttcttagaaaagtaatcttcacagtggttttatgtgagagagcctgtccttttcccctgtaagtggaggcagggttttctgaaggcgataaattgccccattctatcgtgccacaagtcagctgggaatgaaaagcagaacaacagaattgcagccttaatagatgccagcaacacaaaggtggtgagcttaataacagagccttagagagagggaggaagattgattgattgactgaaagcttagagcagagaacagaacgagagaaagaacactgtgtaatgcttttcaaagagaacttatctaagaaccccaggagggagagagaagagaaagaaagtatagaacaaatcgtaccttgcagtaccccaaacctgccctggctcattacagtggggcagggagcactgaaaggtgtcctccacaggctgacacagactttgacatggggagaaaatccattcaagcaggcaggaagtggtatccaatggctttgagaagttagaagattctctctctctcctgtggagtatagtgactttccttggcaaagcttttcccctcttgttgctctgtcatcttttggatgtttccctcatctttgtgaccaggatggttcgttctcccacccgtgtccctgctagtagaaaagagggaaagggtagacacaccccttactcttaaaggcttaacccagaagctgcacacaatattttggctcatgtcccattggcagaacctagtcatgtggctacaccacgtggccacacctaactgcgaaaggaagctggacattctggaaggtcacctgcccagataaaatcagatgttctctctgagaggtttcttcaccacctctagcctgaggtcttcttggccgcagactttcctccacatttaattttcaaaatgcccccaagaacctgtctgggagatctatcctcggaagacagaagatggagaggcaaacagtgggcaaagatggagtcctcttgaacaaaaatggggtgctaagcacatagattttgtttaaaaactcctaaaagggaggtgtctataacgccatcaggcaggcaaagccacctcatcttgttagggccctgcttctatcaatacccgaaaagtgctaaaaactgctgtaaactcaagagaagatag

SEQ ID NO: 27203 - DNA, 1844 bp, Bovine  19866880347403
cagcacagtaaattgtagcaaactgagaaggagccgagggctcactacttccgtctaaatgttctttccgtatgattataagcagagggaatgaatactgtaataatgcttatctttcctaatgttttccttctcctgcttttatgtggtagggtgcaaattagggggcattcgtgtgtgctaagtcacttcagtcatgtccagctttttgcaaccccctaaactgtagtcccggagaaggcaatggcaccccactccagtactctagcctggaaaatcccatggacggaggagcttggtaggcttcagtccatgggatcactaagagtcggacacaactgagcgacttccctttcacttttcactttcatacactggagaaggaaatggcaacccactccactgttcttgcctggagaatcccagggacgggggaatctggtgggcttccgtctatagggtcacacacagtcggacacgactgaagcgacttagcagcagcacactgtagtccaccaagctttgctgttcatgagattctccaggcaagaatcctagagtggattgccatgtcctcttccaggcaatcttcctgacccaggaactgaacctgtgtctcttttgtctccttcattggaaggtgggttctttaccactagtatcacctatgaagcccacagtttagggtatatagatttaaattaaaaaatgataattaatgataattatttggctgcttatttttattttttttaatttatttatttttaattaaaggataattgctttacagtattgttttggtttataccaaacatcaacatcgttacttatttttagtttcttactaataaatgtgcattcagtatgtatgtcactgctttgtgctgatctattcaccctcaaaatatatatgttgaagccctaaccctattaggtcagaagatcacaatatttgagacagagtctttaaggaggtaattaagctagtgagggcactaaggtgatccttaatcgattcaactcttgtgaaatgttaatttcatcggatggagactttattcttttccttgcaaaagtaaacctctgagagtcaagggaggacagtgacacccagaaatctcgccttaaaaaggctatcctaattttactcaaaatttcctagtctagacctgttactctacttaagtaccttgtgtgatcttttaggaagctctttacattatgttttactgaatctttgtgtctgtcactcttcaaaaattgttagctcatgtaaaataaagaccctatccctaagcacttagcacaacaaactgtagcatgtggcatgtgtaggtacttgataaatgctcatgaatacactgaaacttctttgtaatgctgtctgagtacctattctatgtaactgactgccttggtggtaaaagtcataacatgatcttttaagcacctcaataattaaatttgcttggatggtctccaaggaaagattaattcatccagtgttatagtgaaattccacaatggtaattctggttcttggttgtagagatcatccttagtacctaaagctaattaacatagcaatacaaatcttaatccatgcagtttacaaatagaaaacccaattggagtgatgtgatattaattagacaaaaataataagtttggattgacatcctggtgatcatatgaattatgaatatggggggaaatgcaaagtgggaagtgaaggggttcctatccacacaattactcaagacactctgagggttattttcatgatgctttatatgacatagaaagagtattattattattattttcacaaatactataca

SEQ ID NO: 27204 - DNA, 952 bp, Bovine  19866880387254
ttaatctctcattctgtccctcacttttcctctatctattcatgctgattaatctttttaaaacctctcatgtattatgcagtttttctccttagaaacatttccgcaattcctgtgacccagcagtggttctcatcctgcctgtatgtagaatcactcagggaactttaaataaagtgtcgctgactgagccccacctcacgccagataaattagagctaaggcaaaactatttttgaaatccccaggtaattcttgtgtgtagccaagagtttagaatccctgggttaaggttttcatttcttttctggcctcaggacactatagggaattttagcctcactcctctttcaatctgatctcttgttaatccttttccttatttaacccattgtggattatgtgattattttattttattattttttttttggatgcctcacaatgcctctgaaattggaaaaaagatcctatgtttgcataatactttatatctttacatataaattttatgtattatccacaagaaacctctgcagagagaggcagaaaatgtaatcctactttaacagatggggagtgcagaggttcagatagattcaaaggcctctgtgcaaggatttgaccattgaaatcactcctatgtaacaggacttgggatttggctatcctgacatttctcccttaagggatttattcatttgcttattcattcacatcttctattctatttgttcatttgtttggtcatcagatatttgctgagtgcatgctttgattcaggattttagtgtttcaccaagatatggtatttcatatctgcagtggtctcacactagcagtgaagtataattggaaacaaagaaccatcatgataagcataagttgctaagggacagagaaaagagaactgtgagactccagtgagtctagtcttgaaaaatgtgctgat

SEQ ID NO: 27205 - DNA, 1624 bp, Bovine  19866880405096
ttgaaaacaatgttatttaatgcctatttataatacacacacattgatgccttataataaattacaccttaattttaatggattacctgtaaatttaagtgaggactagatgtattttggcatctcaaaggagttttattgtttcttcaggtaagagttcaacttagagttgaattatatcagagagataattctagcaaaatcatgctggcctgaaatcaaattagcttctaaaaatagcttagtttattctgtaattttaaataaatctgttaatttatttttatcaatttcttaatttactcaataaatattttgacttaaactctgattatgcaaaaataagggaaaagggatctgctgtcatggaactcataataccaagtcaagacatgaaattatagttttgctaaaatatttattgttgaaatcttttgttatcaggaaagaagaacagaaggagaggggaatatatcttcttccaatttgtcctgagatggaatttatatgtgaaaagctgttaaaggtaagaagcatgaaaaaaatataatggcttcttaaaaaggatataaatgcagtcttctgcaaattttcgctcttttgattatgtacttcttgaaaatatcctgtgtagattctcatggaggcctgtccacaaccatgaagaattatctattttcaagatttgctgtctttctaccccttctaaaaaagtgcttcagtggttaacctcttcattcaaaaactaatatatcccagtattccctggaaagcaacttcctttattggcataattccctggatatgttttaagagccttgactaagttgttttgccttttagtttgcagtgtgcttttgaatgatcaatatgcattatggaacaatgcttattcatcatttttcccaaccaggaaagcacattgcaattctggtgagaacatttaagcatacataataatactcacctaatgcaacctttcattactcttcatttttcaacccccaaactcaaagactttcagtttgtttttctattatttttttttcattctttccaggtaaatttctcaatttaataaataataattggaaacaaatcataaacatttatcttcctgtcaaaatcattgtaaaaatgagcagaaacattggaactccaattttgcaattttccagcaagccacttttttgctggcttcagatgagatcagatcagtcgctcagtggtgtttgactctttgagaccccatgaatagcagcacgccaggcctccctgtccatcaccaactcccggagttcactgagactcacgtccatcgagtcagtgatgccatccagccatctcatcctctgtcgtccccttctcctcctgcccccaatccctcccagcatcagagtcttttccaatgagtcaactcttcacatgaggtggccaaagtactggagtttcagctttagcatcattccttccaaagaaatcccagggctgatctccttcagaatggactggttggatctccttgcagtccaagggactctcaagactcttctccaacaccacagtgaaaagcatcaattcttcggtgctcagccttctttacagtccaactctcacatccata

SEQ ID NO: 27206 - DNA, 2065 bp, Bovine  19866880443882
atctccaaatatcctagacatatatcaaagcatatctgtgtatcacaataatttcaataaacatagtagttttttgtgttgtgtagtcatatttattacctaaataaatgaaagttatgattctaaagacaaaatgacattgtaataaacataaaagactactcaaacaccaagtcctaagtccttaatatgtagaaagtaacttaaaatcagaacttacagttcagtgtctttataatgattacagggaatgtatatttacttttataagtatttccataatttacatatgtatgtgacttatttcagagatctttctcatactgtaagctacatgtattaccaacattgatttatgaagcattttctgtgactttcttaatatgctaaaaatttatgacatttgcagattttattatatatgcatgcagatacatacacaaatgtacttatcacattcaatatcatgactcaattttaacatttttatgttaaatgacctttgcaagtatatatgtgtgtatatatatatatataatgattgtgattttttagtgaagttttagaactgtaatctttctgtaggagatagtagaaaatgtgcttaactggaaattctagatcaagctttaaaagtaagaaaataaatgtcaagaaaatctactgtgattgttcataaatcagtgtgtgtagaattaaaaacgtgacagtgttttaagttagacttcatgaaaaacctgtacagtcttgagagcatgtcttgacatttcaagtatatgcagcaactcattctataaaaatgccctacttctcaagacagcagctcaaatatgttgtatatctggaaaacatctgcaaggctgcttgctttcctcaaaattctgtatttcccaatgaaacacatatcaaattattcaaaacagaagatagccctaaaagacagaattaaaagtgggataaaacatcttaatgattacatgctactcaaaggtcacatattatgttaacatctttaataaaaatgtgctttagcaatggatgtctattttttgcaagcattctgattttatagtgcataaaagggaattcagtgatgtccagtttctatgtgcacctaacaatgtgagaagatggtataacatttatgtttatacaggtgcatggtgatgtctcatatagtatataattaattgttaattaatttattgaataattaatgttagtgttttaatattgacatgaattgttattacttttttataaaactatcatgaattgatatttataggtatcctattttcaaatgagaaatttatgcaaataaaatttaggttatatatttaactactaagttgcagacttagggctaaaactgacctgtcttggtcagtgttctttgactgagatagtgcattgaaaaaaatcgtttgttaaaagttgaacctttgagattctctttactgtttgtctttctactggatatcattctgttaaacaaaacttatacacaaaggtaccttctactaagtacagtcatcttctagactgaaagttatttcttcctgttttcactgagactttggtccactattatcctttctctggataacaatcatgtctaaaactgaaagaatcatgtattctcagagctgagaacactgtttcttctgtactaccttctacccttcaatcactcctgacacattcccttttttctgtttcaaattctcctattttcctttgtgtgtgacttttactttgaaacattacatttagagaaaacttgcagaaatacaagaaattcctgtacactccttacacaattcaggagttgtttcagttcagttcagttcagtcgctcagtagtgtctgattatttgtgaactcacgaatcaaagcacaccaggcctctctgtccatcaccaactcctggagttcaattagattcacatccatcgagtcagtgatgccatccagccatctcatcctctgtcgtccccttctcctcctgcccccaatccctcccagcatcagagtcttttccaatgagtcaactcttcgcatg

SEQ ID NO: 27207 - DNA, 1997 bp, Bovine  19866880566594
ttctgtgatttctaatacctatttaatgttcttccgaatgtatccttttctgccaagagagtcagacttgacatttgctacttgaaacaaacaaacagaaaaatctgactgtgtcatgcaaattcactgggggtttatttgatacgaacctagttatagtaatataattgatactctcttttaaagagtaaaaacatcatgatatagttcatgaattcctctttgttgctagaaagcctctttctttctatctttctgatcttttatgtatcttaatatattaatactatcttgtatgatgccttacctggaatgactgtactcagagacactccataattccttttgtagctcaaattcccatcagaacttacagtaatcactgtcctaaaaaagagctagttaaaactggcatgtaccaaaataagaggattggtatattagcaatgaatattttagtgtctacagttgttctacttttcactgcaatacagtgtttcttatccttcacttgtgtaatagaataaatgacatatttctgaggactgatttatttgtcttggtttgtgtgaattgattcatttcagagcattcaccagaatagttggtatcaaaataatgctgtatacaaaacatataaatgcattattgaatgaagaatgaactgaaagaccataagttctcaaagatgatgctcagagcaagaggattaaattgcataaaaatcaagtcactactctgaaatacttagtgtaataaaagcttgagagaaaaatgtaagatgaactcaatttctcagccattgctatgagtctggatgtgcatcctgctgttatgtgaacaattaccatgcctggagggaactgaatgaatgttggcacctattggcagatgaaataaaaacctaagcttattctcctatcatgaggctcacatgccatatgctaaaaactaatacattaagctggcataatgaggaagataacacattgtgttcctgcttgcttacattgcaaaaactatgacaccattatacaaattgtctgtaattcattgatcttccttttttcttgcaattctttgaattttagaagtacctaagttataaaaatataacagtcgatttgcttaaaagtagaagatacttgaactttggcctaaatctttttctctccatttttcttgaatctgccaagatatttgccattgagtgccattttctgtatgtgtctttttttcataaaacagggctgtatagaaaatctgcatctataacactgaaaatcctattttcattagatgggttattcttataattttgctttacattttaactttattactgtgttccctgcatgaaagatatgcaaaatatgtaacctggtttaggttttgggccaagggatcagtgaatatttgactatggattgataattgatacatgggatgtttggaaacttagaatgataacaaagttcattctaaacttagaatgaagctcaagtgagaatgtatgggtggggggaatgagccattgcctcaaataaagagaagcaaatttagttcttctttccaattacccttgtggatatttctgaacataaaaatagacagagcagcataaggtcacaggtatataagagaaatgcacatatgatggctagagcccaagacctcttatcaaatcatccagtcagcagtatgttctgcatctgggcaaacacagtaaagtattcaaagaatataggacacaatttttattctcaaggagcttaaaattcaaacagcatgccaacacaagcagggttatagtatggaaaataaaactgcattagattaaaattaggtgtaatctagatgggataaatcagactattgtgggactcctgaaaaatcagaagactttgtgtagaagattggatttgatttgttgaaggatgtgaagaatgtggatagtaagcaaaggtgtagagatgctagggaaagacaagccaaga

SEQ ID NO: 27208 - DNA, 1455 bp, Bovine  19866880583522
cacccataacttcacccttaatgaggagggaaataataattacctggaaaaacctgtatgcaggtcaggaagaaacatttacaactggacatggaacaacagactggttccaaataggaaaaggagtacatcaaggctgtatactgtcactctgcttatttaacctatatgcaaatacatcttgaaaaatgctggctgtatgaagcacaagctggaataaagattgctgggagaaatatcaataacctcagatatgcagatgacatgacccttatggcagaaagtgaagaggaactaaaaagcctcttgatgaaagtgaaaggagagtgaaaaagttggcttaaaacttaacattcagaaaactaagatcatggcatctggtcccatcacttcatggcaagtagatggggaaacagtggaaatagtggcagactttaatttttggggctccaaaatcactgcagatggtgactgcaaccaggaaattaaaagacgcttgcttcttggaagaaaagctattaccaacctagacagcacattaaaaagcagagacatactttgtcaacaaatatctgtttagtcaaggctattgtttttccagtagtcatgtatggatgtgagagttggattataaagaaagctgagcaccgaagaactgatgcttttggactgtggtgttggagaagacttgagaatcccttggactgtgaggagatcaaccagtccatcctaaaggagatcaatcctgagtgttcattggaaggactgatgttgaagctgaaattccaatactttggccacctgatgggaagagctgactcatttgaaaagaccctgatgctgggaaagattgagagcaggaggagaaggggatgacagaggatgagatggttggatggcatcactgactcaatgcacatgcgtttgagtggaccctgggagttggttatggacaaggaggcctagcgtgctacggttcatgtggtcacaaagagttgaacatgactgagagactgaactgaaatgaactggaggaatactgtcctaaggttatgaatgtgaaatgtaagatgtggtaatagtttaatatattgtagttctcttaccacatggtccactcactttccatttgatgttttgttttttaaatatttccatcaaatcacacactgggttgtttgtgaaaccaatcatatttaacttctataaacttcttaatccagcaaaacttgtgttataaatttacctaaagggtcaaaaatatttcccttatcaagatgtttttcccaatcttggcctatagatttatagcagtggtccatcctaggatatcttaatcaaccatctgcacccatgaatttcacacttgtgatagctgccacatttccaaagtctggcagctaaagttcacacattttaaaactcttccaccaatcttcctaactcttagagcta

SEQ ID NO: 27209 - DNA, 2386 bp, Bovine  19866880654360
atgctggtcctttggaaagaaaaacaaaattgataaaccttttttagccaaactcatcaagaaaaaaaaaaagggagagggcctaaatcaataaaattagaaattaaaagggagaaattgtaatcaacaccacagaatacaaaggactataagagactactataagcaactatactcctataaaatggacaaacaggagaaatggacaaattctcagaagaatacaatcttacaaagctgaactagggagaaatagaaaatatgaatagtctaattacaagtactgatattgaatctgtgattaaaaaacctcccaacaaacaaaagtccaggaccagatgattttacaggtgaattcttccaaacatttagaggagtttatgcatatctttctgaaaccattctaaaaaattgcagaggcagaaacacttccaaactcattctatgaggtcaccatcatctgatgccaaacaggatgatgccaaacatcatccaaagccaaacaaagaaactgcaaaaaagagaaactactggctgatatcactaatgaacatagacacaacaatccttaacaaaatactagcaaattgaaaccaacaattcactaaaagtggcaaacccactttaaaatctgccctgcgaattgactttccaaggccagtattggtcaattgtttcagcccaaattcccttgaaattataactttagctaaggcttgtactctaatgctttgttagtgggtgaaattctaggtagtaagaggtaggtagagatgaacatacaataagaatggaaagaaaccaaatataagttttctattaaagcagtcccaccttcacaatatgtgggcttggactttagagttactgcaacttccactgaaggacagataatggagactgcctagtccttaacccaagagaaatatgagagccagcagtgtttagagatttagtgattaggcagaggaggttgctctggtcatgtccttttttggtcaaacaacagagaaggaaagtaagaattagcgaatctaagtaagtgcattctttgggcccaatagcataaattataacatctaaatatagattatgtacattactcttggaattatatttttgcttttattagtaaattactcaactcatatgcaaattgatcattgcaatcagaatcattttctacatgtattctgtatcctagaaacatacattttttaaaaaaccttataactgtgatacaagtatcattatcttcagtttagaaacactataactgaagctaaaagagatgaaataacattccattatcaggtaattggtgtttgtgattctagcctaggtctgtctgagtttagtcccctgcttattctactttaccatgcaacttaataaaaacaaatcactgcttgttcattactttgtagtataaaaaattcatgaaaataattttaccttatttaaaacttatagaatgtatggcttaattattactgttgttttatttacttgaaagctgacgttcagaatgggctaaacagtgtacccaacttcacattccaagaaatcatgaggtgaaggacatactagcactgatctgaaaattcagtaatctgccataagaataccaggaatacagaaacattttacaatttgtattacaatttatgtatcgcatttgtcacttctcattccccacttttgcctgtcaattttgttcttttttcctatgacaaaggaagatgaaactttgtgaagagctgccataatataggctttattcataaagcattcctacctatggagaagcacagaaaaatacagtaacccctattgcctaagaggaggaaatatctgtaagtcctttttaaaattactaaatcattttttctttgtgcattaagaaagtccaagatgtaacaagatggtctgtgataatagtacagatgcctgagggtttgttgtgaggtgcttaagtatgaagatgtgctacagaggcagagagaactagaatctaaactggtactaaagctattcagtaactatgagacccaggtgaagttgacaagttcttcctatctcaattgtctagtaagtaaaatgagatttcttctaggcattaaaatggacatgtttaacttgtgtcagtgaaaagtaacatttgcaatgtgttttgcaggtgcctagttcagcttccgcaacgtgtggcagttctatggtttaattgtaatagtttcactgcctgttttattgtttatatattccagaaaatggagggtgcttattcatttcaccatcatccctcatgtagtcccacacagttgggcactaataagggtaactctcagctgctaactaattaatgtgaaattgctaaatacccaca

SEQ ID NO: 27210 - DNA, 4202 bp, Bovine  19866880709646
taccttgcttgtttctcacttttcctttaagcagtcgtaaattgagcactgctccttgaacatcctcatttttcatggcatatgttttatccatttcttaaaatgccctccctcacaaagttcacatgagaattttctctttttgaaaatgtcagttcaaattgatgactgtgagggctttctcaacatcttccatcgggtagtaggtcctttctttttactatgtatatatttctattgtaatgtttgccttttatggatctcccacaagactgtacgctcatgacagaaggctcttgtactctttcactggtggattcccagggccagaaaagcaccatggccagaggacatattcagtgactgcttcaggagacgaaggataattgcaagctacagcagactagagaagagttagagaagacagagaaacaacatctggagggcagtgaggaagcttagggagaaccctggagggaacagagcaaaacttcagagtcaacaaaggggagtatcaggcacactccaggcgcaaagacaaactgttttctccatgtaacagttaactgagaaagacaagtgcctagatatgtatggtaactggataaggtggcttttatctaacaatttcttattagaggtctctctaaatcatttacaaattaagaatttgctagctattaacccattttctaagtttgagtgaaaatattttttatcaattttatacaaataagcctttgagtctatttgagtgcatttcagaatgcacacggactatgttgttttttttttaatctgtgtgtagtgtatgtttcttttttctaaaagtcaagcactgcttataggcagaatccatctgtgaaaaaatatagaaaaacaacaaaaaagcttttatttggttatgtgatattcacttatcccagtttgactatgttatgtcatgtgtgactaatgtcaatgcatccagccacctgccttcccaccagccactgacaagctgcagttaaataggagtgaagtacattgacagacaaaattacttttggattcactgctcaagtaaagctttgttgaatccatagcaacccaagcattatctatatctgtctggattactaaaataactcattacattacaaaatatggatcagaagggttgatattcctgaaaaaatatccccacattgggagctgaaatgcggatattcccttcttcccagactgcctgcaaagcaatgacaaaaatcaggaacagactgtccatcaagaaagcagctggaaagatcaaaacagtaaaatatgtagttggcatgttgcttttatacactagccaaatccccacagggaaaaaatgccatgtagatttcagtcaataaacaaatatctgacaagaggtcaaataaatcagtccagcctgttataatatattatatgcagagtaatgggaatagaatcatcataacactagtagcaatgtgtttggttttaaatggactgtgtatctggcatctgctaacctgaatcatatgggactttagaaaaatgttatttggtatatgaaatgctttgaggccacaaaatctgaatatacaaaattcccatcttcagttaaaacaccagtgaagatgagtagaagaaaactgagggaaaactagagcttccaaccaaagtatacagttaagtgtgaatgtcttcattatataaatatctgcatattaatttggcatttctattctttttttcccctttgcctacatgaaataaaagaaacctattcctctatcaaagtttgtctccctttccaattcctgtcattcaaagtacaattcactcctatggtatccaatgtagtcctagtcaagtttcaaactcaagataccaagtggcaactgcttaagttatattgctataccgtacagctactagcagacaaggaagaatattttgttctacctataagccctctttagaagagaaagtggatttctgcaggaacactcagagctttatttctttcacctagcacagtgcctgagtagcagacactcaataaatatttaataaatgaatataacaggaaaaaggaatcattaaatacttgaatgtgtacttactgacaagtagcctagctttattttattcaagtacccataaaagtttttgatactagaaaagtatcattgaaataaatcacatattttctccttttgtatctctgagtttaaaaaattttatatgctactatggatgtactaaaacatgtggatgtggcactttttatagtaattatgatgtcattttcaaaggtaaatttttttttctttctttcaatatacatgcatgaaatatatcacttgcatttttgttaatattcataaagtggaaagttagaaaagagtatttatgaattaattaattcacatctatcattacctcaaaatgaaaaatttttttcattttataaaattgctccagcctccaagtgctagaatggacaaggtctctaactagggacctgaatcagcttaggaagactagggtattacaccccacaccctgccccctccatggtgaagagctgtgaaataactttgctacctttctccttagccaagaaatatgcatgacttccatgaacacctatttaactcaacctgctacactgagcattgcaaataaccaaaatgtgatttctttactttcttgcaggaaacagtatcttactcttccagtgttcagtcacatttaataaagatgaatctttccaacaattcaacactcttggctctttttaaaacaaggagacagactttcctgagatattctttaaatttacaaaccgtggtattctttccattagtgatagaaaagaatattgcttgccaatcagatatcaaagccttctttcctcctctgaggcttcaggaatggggtgcaattattattgaaagggaaatggattgtttaagattggctgctacattgccctgatactgacagggtctgcaggtgtacagagttttgcccactgatataaattgaatctgaaaatagcaatttattcaccaaatcaagccaatcactgcaatgcagttttgtcttttggctcttatttccaaccaactactcttaaccactttgcaacttctattttacagtgaacatttctgttttaggagggggactaggggagctctcatggaaagcctttgtttcagcctttttgagcctttattttaaaagactgtttataattgtactacttaatctagacaaaaacgatcaacacctgttccaaattggtactccagtcccactatccttttctcttcaccaattgccatttgctttcctttacccataacaatgcaatcacattaacatcctttgtaacacaatttcaaaaggcacaccagaaattctacagtaaaactgcatcttctatatgctaacataatcaacttccaggaaataggaaagaacacaaagacatatttgaagtgatttttttttcaacagttacttgaagtaatacctaatatccaagtcaagaatttgaaacaagtaaaggaaagatagtttgcctgaggggaagcaaacagaccaaagtactctcaatttggatcaaagactggatagctaaatggaccctctcaaagatctgaatcaacacatatccctggcatcttgccaggctttccaaatctcttggatggagaggaactcacaatgtctaagcacaggttgttgtcatggctaccagcagccaacagggggaaaaaaataacttaaaaggcagttgggaaacatttaaaaacaagctggactggaaagaatgcatacttaactgcaatttttaggcaaaggctatatctttataaagactcagaaagattataaacaaataaagtaaattatgtcagtaacagacaactgtgttttaaggatgtcccatattatgaagatctctatctgaagaagaaaaaagaaacaaagtaaaagaggatgaggaggaaacttgtcagggaaaacagaagctctggttgctataactgttttcttggcccttcagaaaaacaaaacctgaatacaactgctagtccatgtactgctctaaattctttatcagaaaatcagcaaaatgtgatttttatattttacctttaatcagtatattttaatgtaaagggatgatagca

SEQ ID NO: 27211 - DNA, 1032 bp, Bovine  19866880715805
ctttaaaatctattacttctgccttaaaaacatggacttactgccttccttcctcgtctccttgctttttcatcttttcttgtgtttagcaccatgtggaagagaagtatacaacaagcattgcaaaaggagtttattttccttatacaacaagaatctaggactagggcagtgaccctaagataccatcaacacttctgccaatgtctactatggggtctacaatttttgaaatgtgacttttctcctcaattgcagcagagcatctgtactcccatgcatctcaaagactttccagaatatgagagagaaaggggaaaaataaaaggaaaaggaaaatgacagctaaacctgtctcatttaatccaagaataaacagctctcctgggaatcctgtctaatattgttccatttacaacttgttggccacaaataatatcagttaagccacacttagatgggcaacagcctgggaaatcaagtatttagatgggcacattaccacaccaaactgaattggatttctgttagtagaaaaaaagggaggatggtggagaatgaattttgagtgcacaaccagcactgtctagtacccattctcccttttatcaaaattctgatctttgatttgcttagttatgtgcaacaaatggaggtaattggaatatttaatgtttagcccaaatcagataaatggctgtgattcttaagacagaaaaaaaaaagaattttggtcatgaatttaacattaatgtatatagatcatatgtccaatatttaaagggattacattagaatatatgtggcattcagattattatatttatttaatattaaatcagcattctgccctaatttattagaaggaaactaagatccatttatctaacttcccagcaaaagcttttgaatattatattcttaacccaaatgtccttattatattttcctcaggcgtttagcgattttgttacatttaacagcagcaataattcttattccataaaaaaggaattttacaagcaggacaaa

SEQ ID NO: 27212 - DNA, 1404 bp, Bovine  19866880791041
ttgtcttagtaagagaaagtaagactgtggaatgatatttgggtatctaaatatctaaaatagctaattgcttacctctaaataatatttttacccctttgaggagactgcagagtacaatgctaagttactgaacagcatatgatttgatatttttatatgaatcataaaatgtaaaagacaatgcagaggtatggagttgctatgagatctacaaaaatgtaaaaagctgagaaacatgcaatatgtaaaattgcatgcaaactgaaagttaggaaggaaaaataatttaagccatgccattcaaaaatataaccaaaatatattagcatggaaaatatataaaactattgtctttatttgattacttgaattttgttattgccaaaacgttaagcctttcaaaatcatttataaaaataaatctgtaggggtcaaataaagaacactgagataaacattttctgactttaccaagtattaccattttttgaaaaaaacaaatattagcttttattttttgcacttttatttttcaaatcaagtatttaaagtttgcagttacttttgtaattttccaaataaataatggtggatttcaattaatttgattttgatttataaagtttatagtatgtattcacataaacacaattggtaggttgctaaagtacatgatgttatttaaataatagattagctaaagttaatatcactctcaaaatagctttcctaggctgatttactgtcataatacaaatgccaaaatgtaatgagtgattcaaatttcagtgatacaatatgacatctgacagttaataatgggtttctgaaagtgctgctaaaatgtaatatgcagtacaaatttagcatggctaaactcaatattagtctatgaagataacagtacaactaggcaaattaggtaattttaccatgacaaaatactataattagttttataattacatttatttacatggtgaattttgataatagtaactcattttcaagtcatcattaaatttttatagaagataacatacaattatatgtaatgctataatcatttaaaattattggctgtggttttcatattgtcacacagaaaaaaaaatatccaaatataccagtttaccttcctttcatatattttaaaacatatttcaggaataccaaccatcttaaagaaaaacatagttgagaattatagaaataaaaatgtgttgagtgattttctgttatagtgtaaggaaagaatatcacagacatgaatctaaagtgaatcagttcagttcagttcagtcactcagtcgtgtccgactctttgtgacccgtgaaccgcagcacgccaggcctccctgtccatcaacaacttgcagaaattactcaaattcatgtcca

SEQ ID NO: 27213 - DNA, 1724 bp, Bovine  19866880813649
ttaacacaatacatagcaggtaacatacaccacacacacacatatatacacacataaagcactttcatatatatatatatccttgtccatgcttctgctcagttgtgcctgactctttgtgaccctttggactatagcctgcctggcttctctttccatgggatttccaggcaagaatactggagtgggttgtcatttccttctccaggagatcttcatgacccaaggaacaaacctacgtatcctgtgtctccggtgttgcaggcagattctttaccactgagccactggggaagattatacatatgcttataatcttacatgcacacacacagacacacacacacacatatatatatatagcattttcttcttctttcagttcagttcagctcagtctctcagtcgtgtctgactctttgcgatgccaaagagcacatgaattgcagcacgccaggcctccctgtccatcacaacctcccagagttcactcaaactcacgtccatcaagtcggtgatgccatccagccatctcatcctctgtcatccccttctcctcctgcccccaatccctcccagcatcagagtcttttccaatgagtcaactctttgcatgaggtggccaaagtattggagtttcagctttagcatcagtccttccaaagaacacctaggactgatctcctttagaatggacttcttctttagggatgttaatatttaatccagtgaaggaataaaaccttgtttcttacccccacttgccatttatctctatgggttgctgggtgtgggtgtatgtgtctgagcaatgcccagggacaacactcaggttcttctggtaaaccaacagctgcaactgctttgatgattggcttgaaaaaaaacaagcatgattccaacttgggtaggaaatctaaggggaagcactggattctaaaatcctatacttgtaggttagaactagagaccccatctgatctgaagacctcatttcatacagcaactaacaatggggaatatttcttttccagaagctgggaaagcattttgctcaaaacttagaggaagaaaaaatttcattatttttaatcaatcgatcaaaactaaggcagataataatcagaaggagaaaaatatcattaagttctggtattttaggcttttaaggtctcgtaaaagcctcaggaggtaacaagcagagtagagctgcacgcaacatctccactcatttctggaaccattttcaaggcacaatgacctggatgcactcagagttcctgtatcctcattgtgcctaaaaagaaaattcttttgttgcaaggtgatgtgagagaatgaaaagattcttagagataaccttttaatttcctaaaaacacacatcccaaattatatgaaactgtaacattaaacaaattctcccaaatttcatcttataattaaagacatttttgtgctatacttgttttaagaagtatatgttttacattaaataaaagaacaagctgcctttggaagtgagaacattccatatccccagaagaaacctgtatgttttattgttgataggaaaaggaactctgccaagcagtgaactaatgaattagagtttggcagcactccatgcctgatacaatttagttcaaatttatgaaatctaccatttccagaaatccacttctgcctaaggcctctctgtacttttcagagtaaaaagcataa

SEQ ID NO: 27214 - DNA, 1470 bp, Bovine  19866880910253
ttcattagagttattaagaaaaatatttatgtagttcttttacatagagaagtagttttcttggaaatgagaaaacgtaaaattttccatgtagaactgactataaatgagtaagttttaagcaagaactaagctgaaatagtcttacttttgacctcaccttacattgtacagctttacgaggcattaataatacattgatcagcttatttttgagagtgtggtgtttcaaattctgctataataataggattcctatcaagccaatataaaattttgaacaagtgtgaacacagtacaaaagaatacaattaacccattttatagctttaaatgtgtagatagaaatgaagaaaatttggctgggaataagacacactattttgttggtttacgtaataaaacaaaaattattggtacttgccaattattgttaagaagtactcaatggcactagaagagtcaaaatgtatgaatgcatatgtgaaaatgtgacatacataaagactaagatatttgataacaaggtgtctgtaaggattccaaatcagaaatagtttaccttttgtcaatttgctacttattgaatcttagaaataaatgtagattaatctttttttcaaggttgcatgctattttaaaaattgttacattttaatttcataaaatatcaaaaatctctagtattatctccacccaggattgttcacagttttagagataatattatgcattattcatttttatacttctggctctttttcaagtagtgctcattaaatatgctctttggaaatatttaaactgaatgaattcaaatagtttagaaatatgaaagttattgctcatccattaatggatatacatttctcaaaaaatccaaaataacctacctttggaaagttatgttgccctccaatctgaataatttctggtgcttccatcaagcagcctctagtttatgaagaattaatagaggctgtataatcgtaacaaaaatgttttactcatatgtgagcacagaagatctaaatttatctctgtggtttttgtctgatctctttctgaacactgatggaaaagcagcccatttcaaaatgtctgaaacatgacattccaagccttataagattttgttcctctgcattactgtatcattatctgtcaaaattggaattattttctaaacagcaacattttcttatttatcaatatttctcttgaaatgattttgatttttttcaaacaacctggtttcctcttttcttagtgttacactgtatttgaagcagattgtataacatccccagaaacaaatatattggattctattttttttttcttttcaggatattgagtagaaagttcactctactgtttctgatagtgactctttcatttagaggtgcagacaaaataaagtttactgggcttttggcatctgggttagtattgctataattgtattcc

SEQ ID NO: 27215 - DNA, 1624 bp, Bovine  19866880924070
aatgaagggatggagccaagcaaaaaaaaaaaaaaaaaatcacccagttttggatgtgactggtgatataagcaatgtccaatgctgtaaagagcaatattgcataagaatctggaatgttaggtccatgaatcaaggcaaattggaagtggtcaaacaggagatggcaagagtgaatattgacatttaaggaatcagagaactaaaatggactggaatgggtgaatttaactcagatgaccattatatctactactgtgggcaggaatcccttagaagaaatggagtagccatcatagtcaacaaaagagtatgaaatgcagtacttggatgcactctcaaaaatgaaagaatgatctctgttcatttccaaggcaaaccattcaatatcacagtaatccaagtctatgccctcactagtaatgttgaataagatgaagttgaacagctctatgaagaagatctacaagaccttctagaactaataaccaaaatagatgttcttttcatcaggaagtcaagaaacacatggaagaacaggcaaatttggctttggagtacagaatgaagcagggcaaaggctaacagagttttgccaacagaactcactgctcatagcaaacaccctcttccaacagtacatgagaaggctctacacatggacatcaccaaatgttcaataccaaaatcagactgattatattctttgcagacaaagggtggagaagctctatacagtcagcaaaaacaagactgcaaagctgactatggctcagaacatgaactccttattgacaaattcagacttaaattgaagaaagtaggaaaaaccacttaggccattcaggtatgacctgagtaaaatcccttacaattatacagtggaagtgagaaatagattcgagggattaaatctaatagacagagtgcctgatgaactatggacggagattcgtgacattgcacaggagaaaaagatcaagacaatccccaagaaaaagaaatgcaaaaaagcaaaatggctgtctgaggaggctttacaaatagctgtgaaatgaagagaagtgaaaagcaaaggaggaaaggaaagatgtacccatttgaatgccaagttccaaagaatagcaaggagatataagaaagccttcctcagttgatcaatgcaaagaaatagaggaaaacaatataatggaaaagactagagatctcttcaagaaaattagagatagcaacgcaacatttcattcaaagatgggctcaataaaggacagaaatggtatgggggcattttagttagggactatttatatatttttattttgtaaagaaattaaaagtgatattctgctcaattctgtcttacatactttctgtttgtattgaattctcataccaaggatctgtcacttcttttacataaattcattttatactcagtcacaatgaataactatcataaaaacaaatagcatgtcaacacatttatttgaccagagtcctcttgagataatgtcttaattttcatcaagatttgtagtgattactgtttctaattatgataatcaaataactcattagtgattatgtttcaaaaaggatttaaaatacaaaatgtttctagaat

SEQ ID NO: 27216 - DNA, 999 bp, Bovine  19866880938740
ttattccagaaattcttccaggcaatgctttgttttctaaatttgttgctttggaactccagcaccaaattcacaacctggaccatgctgtctattagtggatgtctgggcagacatccagtaaagctgagtagcttcagtatcattagtgggatgatggtatttcagttcctcttcctttcattcttctttagtttactatcagtgccactgagcttaatggaccaaactgcctgctcatgcattaaaaacagagaagcacattctgtcacaggaaaaaaaaatgctatgttctaatttctatagcaaggagatccaaccagtctatcctaaaggaaatcagtcctgaatattcattggaaggactgatgctgaagctgaaactccaatactttggccacctgatgtgaagaactgactcattggaaaagaccctgatgctgggaaagagattgaagatgggaggagaaggggacaacagaggatgagatggttggatggcatcactgatacaatggacatgagtttcagtagattctgggagttagtaaaggacagagaagcctggcatgctgcagtctatggggtcataaatagtcggacagcactgagtgacagaactgaactgaactttctacagcagacactttaacacacataaagtaagaaaggaagtatgagaatatttatataatgaggagatgttaataaaaccatttgaaacattcaaatacagaatgtactgatttgtaaactgtagagtgccttcacaattaacatacattcatcataatatacaatcattcagtaatattagtcatagctactgtaatactttggtactacttatattaatattaatatactaattactaataaactgtcataaatgaccattgtgtaaaatgatattagggaatattacctagattttgcatttgaatcattatttcacatcatctctggtattttaagtagatcctgacttagaagtaaaag

SEQ ID NO: 27217 - DNA, 961 bp, Bovine  19866880994406
taaggctatattagaacatctttattgtcacttacctcactgcatgcctaacagatagacctttaggaatttttgagttgtggcatcatttggtacatcaaagtaataagcttggatttctaacagctcatatcctgtgatgtacttctgctacataagtccctctacatagagttaccttaaagtggctcattatttagaacctgtgtaaagaaagtatttcctctggacaagaaaaaagtttcattgtttaatgcctcccaggtgtgtgggaaaggtgaaaaactacggctcatctgatgttctgttcatgatttggtgggcttattagttccctgaacgaagactcatctgccctgcatttccatggtttaatttaatggagagattttccaataaaggtagacagaaataaatgcattagacaactcatgcaaaaggaaaaggatttaatcatcagggtttttatatctttgaaataatatgttgtttcaaataatctcaatttctctagcttaagtttattattcttttatctgattcttactgccatctggttcatgtgcaagtgtaaatcataagcaagaaaaagcagagctaattttcagtgttggcttaactaacaaaacctgtgtgatatagatagttatcattaaacatatctatgatgaaatattgatctgaaatcggttactttttcaatgtttagacatgagatgataataattaggattacttgaaaaagggtgagtgtcaatctgtagtgtgggaggctgtattgactttggaaaatgactgtaaagcaactaggattttctacacatttcttatgaatgactttttaattctttcatagcataggctttattaactgaaaatataataattaataaattacctgaactttctcttgcatgtgagtagcttcacataaatcccttgaaggtataaaatgtagcac

SEQ ID NO: 27218 - DNA, 1150 bp, Bovine  19866881003981
tgtttgctctttaggttgacagggacacttttatgaaggcctttatctcctttagacttcttgctgtactaacttgtcttgattagagttcggccgcctccataagtttccttcgaaacatttttattgaagcttattattttcactacttttacatggttagcccttctatataaattctattctactcaatcataaaattaaataagaagccatttaaactccaaattagtcaagctatccctatttctagagctctggatcctattctcctactttttgctcaggagacatatattagataacaaaagacatttgggtttttggaatattagtgaaagtccaaattcctcaacataagtagcatatataaaagcaatcttctttttctatctgtattttttttttaaattatactttatcaaaggtgaaacactaatagccaaagtcaggtagagaaagcagaaaaatggtgtatacctccacactctaatggagggaggaggactatgattctgtttgaatagaagagtttgccaagagacaaaaccttctccagttagtataatggatatcagccaagttttcaaggaggtagacagtatgtcagtacaattttgaccacaagccaaagggataaacctggggccaaataggaaagaattcctcactactctagaggtccagaaaaagaaaggagacaatatcttgagccagaagttggaaatgggaaaggttaactagaccagctgcaacctttgaagttgagaggtccgcagagtaaaggagaatgatgacaggtgtgctgtgaaaatctgtactttgaaaactataatgcttggtgttttagagaaaaatacaccaaatataaaattacttgtagtaaagaaaaggtggatgtgagagttggaatataaagaaagctgagcgcagaagaattgatgcttttgaactgtggtattgggagaagactcttgagagtcccttggactgcaaggagatccaaccagtccatcctaaaggagatcagtcctgggttttcattggaaggactgatgttgaagctgaaactccaatactttggccacctgatgtgaagagctgatttgaaaagaccctgatgctggaaacgattgagggcaggagagtt

SEQ ID NO: 27219 - DNA, 825 bp, Bovine  19866881017058
ttgctggaagccaactataagatactatgcttatgagaaagtagggagaaagtagagaactatgcaaatgtcatggtatttattttaaaataactcaaatagattctaaaacaaattttctgtgtgctttcatatatgggcatagtgatctcagttctttaatcttttcttcaatttaggagtttttatacatcctgtcctctgttattctagtgaacatttaagacttacacctcaattatataaaattcagtgtgcatttgatatagtatcattcttgaagtgatcattttaaaatgaaaagtcaggtggaaaaaagttaatatgtattaattttttatttaaaaatatacagaaataagaaataaaaaattaacttgctttgtagagtagataaaatgctttatgtgaatgagctaaaagagaaggtcatataactattagtgtactagatatggccatttttcatttgttagacagaactgacaatactttataaaagctaataacactctaatgaaggaaacgtatagagtttaatgatgaagcgtgacctttttgagcttaatggatagagttgaaccttggcattaagctcaaaatcatttgaatgtgtaaaacatggtgttaatatctaattttgaatgaattttggacttcccacaaatcccttacaccactttctgagccatttcatcaacagcttgctagactgcatccagttcaccatctgggaagtgtcacttgctacaaaataaacctgctccctggatgacagcaggatacctaagcatctgctgtttcataagctgcacagaacaccca

SEQ ID NO: 27220 - DNA, 1790 bp, Bovine  19866881044018
tgataattaagtgttaatgcttagcaccctaatgatatctgttaaataacttacattttggagccaaatcctggcaaatggaattctattaaaaataacaaaatgcactgaatataaaaataaatgatgctaatctgccattaaaccacatatattttctgatttgcatctcatatgagagaaatctcctattctctctttcctaccaaatatgcgaaaccagtataattagccatgcctatttcagagtttttaatgcttgtggagatttataaatactcaaagggaaagcaaaataataaaaagtagagatgaaggtgaatatcattttagaatatccattttaaaactattcatttgaaagtacattttctaaattttcaaaaaaattctcaacttggaaaatatatcaaaattgtagctttcaaaactttaatactttctatgagtcctcattctctggcctcatattttcacagtctatactatatagagagtaaatatttccaacttttccagtatcatctggatttttcaatttttaaaactcattttaaattcctaaaatgcatattcttaatctttaattattactacatctattgtgacatatacatttaagagcgtgactagacattcttaattaggttctgtacaatgttaaatattaagagacaaatagaaattgttactgttctttcagaatgaataagaggggaaatgtgttctgtaagtgtgaggtcatacttctacaaaggcaataaacaaagtgttcatgtgttgcttccttttggaagtggccaagttgcttcctgatgcaaagagccaactcagcggaaaagattttgatctcagccaactcagctgagaaagactgagggcaggagcagaaggaagcaacagaggatgaaatggttggatggcatcattgacataatggacgtgagtttgagcaaactctgggagatagtgaaggacagggaagcttggcctgctgcagtccctggggtgacaaagggtcagacacaactgagtggctgaagaacaataaaactgcttcctatgttgaaatgaaacaccacaatatcttattcaatgagtgatttttggtttctgatctgcactctgaactcaacaatcaaaggaggaaaatatctcatctaagggtccatttctgaaatcctgttttttctttttcttactttctcttagacatcccacttttcactgttttgttatctatatggttaaatatgcacaaactcactgactagagttctctgaaagaaaacaaaatgtctcatgaaattcattttagagagagacatgtatgaatgttgatagtagtaaaggaaaagtcacctacttagtggagcaaataaaaatgaggactagaaaccctcattggatttaattgcaaaaaactccttaatggcaatataaaagggtaatatttgagtatctggagctatgtcacactgcaatgggctgaagtgtcaattggagtaaattaaatcacaaggaaattaaaaatttgaaaattaataagtaatttccacaaaacatgactaataagggagaaagagatgtagggtattaactagtgagagacgttataattgagaactattttttaaatagagtgtatatttgtttaaatgtgtttagatgtgaaagaagtattcaggataaattagttgaagattagcaggaaaggagaaaggaacgatgaaggtccctgaagattcaagtaggagaagatgaaactcaaaacataaatggagatactg

SEQ ID NO: 27221 - DNA, 1168 bp, Bovine  19866881086555
ctattactatggtaagcactttatatgtatttgtcaccaagaactgtgaaagcgttccactgtatttataatgagcaatcattttccctagattaatgctcttgggacaataacacaatcagcataactgttagataaatattctaagtgaaacattaatccattttgcatgaaagtcagccttgttataattaaatttgtcctaacagctttagaaatctgtagatcattttagtcttcaaatacctcccttttatttttctcttactcatgctctctttgactgtaataattttcttgtcaccatcaaatccatctaaagatccccaccccttccctggatctcacgaatagatagtataacctgaatcttcaggtcttcagatctttgtaccttttctcatattctgtggcactcaagtgggaacaatggttttcacatccatgcaagttaaactgttcagtaatatacatatttctgctgctttgaattgtcaacatcattctggaattttaaggaaaaatcactttcatttagttatttgcagtctgtgtgatcagggtttattttaaaagtatgtatagacataacaaagaagtaaaaatcataatccacatggtggaagaaaagtatttgtttcacatctaattaacaaagaattagttaacacaaaaattaaaatatactaaatattttttagctacatactaataggaaaatggacaaaagttacaaacaaacatatcaaaacatgacacaaatggacaataaatatatgcaaatatactaagccttaggtatcaaaaaatttataattaaaactacactgaaacagtattctgtaggactaatttggcaagagttccaatttgtaagactataaaagtctggcacacttatggtgctcaggatctctcatatactgcttgtgggttaaaactgatataattactctggaaaataatttagtgacatcttgtaaacaagtaaatgcttgtgcatctggtccaggaaacaagggaaaaacactagagaagcattgtttttaatgcaatactaatagaaaccattaatgtttattgaaagaatggttaaataattttacaaaaacagggactaaaaaataaaccaatttggaaactgtgtgtgtgtatgtgtgatgtgtgt

SEQ ID NO: 27222 - DNA, 2294 bp, Bovine  19866881215354
ctgtcaaaactccctgtcttcggtccagatcaaagaaaggaggcattcggtccaagctgataaacaatatctgcatttttcccactgtctttcatctgtggcactaatagttgttaagtataacccacgtcgggtgttttcagaaactgaccaggctcaattacaggctggttgaaaattggtgggttgtcattttcatcctcaagcttaacccttaccagagcagtctgatttaaactgggcttcccagaatcagaggcaacgattttaaagctgaattctttggtgccctcatagtccaacaaagaggaggtctctaacaaatattggttgtcatatactgccttcaaatgaaacgggacctctctttcaataaaacagatcactttgccattcacatctgtgtccttatctgaaactgtaattagggcaatctttgtattgacaggatctttctcagacaaatacacggtgccattgatgggacttataatgtacctgaggtctatgttcggagggttatcatttacatcagtgacattgatggtaaccgttgctctagcaggagtagagctgccatcactagccagtactgtcactttgtgaatagctgtctcctctcggtctaaggacctctgaactgtaatgagcccagtagtattatttaaagcaaagagtcttttggttgcaggcgcaacctgggcaccaaaaatgtaccggatttcagcattactgcctatatctgcatcagtggcatggagctgaattacggaggtgcccacgggagcattctctggaatgtgcacctccacctgaccctctttaaacactggcttgttgtcatttacatcacttactgtgacctgcaggatggcggtgctggacttttgtggggtgcctccatcctctactttgattttcatcacgtaggtatctttctgttctctgtccaagttttgctgaacaatcaattgcggccacttttctccttccggagtttccacgatatccagtccaaaaacactctgcccatttaacaattcataatgctgtacaccattgaagcctgtgtcaggatctgttgctgatggaattggaaagcggctgttgatcaaagtgttttctgggatggaaatattgatgacaggagatggaaacatgggggcattatcattggtatccttgacaattatttttattttgatcagcctgaaaaaatcattggggaggatcaccacctcaagttcaaagaaacactcattctcctcagcataagaggctccagcacagagtttttctctgtctattctattggaggttgtgaaaatttccccagtgctactggatactttcaccaaaggggcatccccagctttagaaaccagtctgtagacaaggctggcactggtccctgtggcagcattgatgtgagaaatgttcagatcctttggtatgtttcctatgggtacattttcaggcaattcctctctaatagtgtaaataagttcttgagctattgcggaatccagccttaaacaggcaatcagagcagccaacaggtaaaaatccctcaggtccatgataatgtatttattttctttttcctggacttagggtttaaaggtctccactgaggaatgaggcacaaattgcaaaaggaagcgtgcatggactggaggatgcattacatctcatcgcttattggagacagccactgtcaacacaatcgtatagacaacattattcttcagtaaacaaaagcacacagtcatgaaatatcacaacacattttccaccgcatattagtaaacatggcagtttgctctgccactgtttgcaagttaactctgtgaataaaaacaccaaatagcccctgcttgttgcatttgcccagagaaaataaaattatctacttttgaattaagggcaactgctatttttacctgcattcacccacactgttggtaggacactgtttaattcaaaacatgcgtccttggtttcctcttcccccctcccccctcttacccatctcctggcttctaacccacctcccttagttttttcaggagctagtgaaaaacaccaagtatttagctatggttcctgctaattgctttgtcacatgtcaaatgtgatgtgttttcttctctgccagactgagtcatctctttcttctaaacaatctttttttcttccctcccagtttttcagctgccttctgaatacaattttactgggaagcaagcattcggacatgctgctgcagcatcagaagcagatgtcaccggcca

SEQ ID NO: 27223 - DNA, 757 bp, Bovine  19866881220691
ccgtaagagacattaacataatccttgttttctagatcagaggctttcaaaggaaggtctatgaaaagcataagtcaaaagaggagttcctggggatttattattgaaactgaagtcatggtaaatcaaacttgcaaatagtgaaaataattttttacctttctacttagagtagctgcatagagagaataatcaaaaaaccactggtttcagtgtttatgaaatcattggtgtcattaagcagaaaattttgagtacagtcatagaagaaagtcacattgcaagaggtttgggagagaaagaaagaggacctggtagataaagcatattgatcatttaaaaaatatgtttgtgaaatgaatataaagacaactgcagaatactggaggttaaaataatttattagcttgttaaaatgggatggaatttgaatcgttgtgggtaatagtgtaatggaagcagtataaagtgaacattccataaaaataccctaaaatagagtaatgaacagtgagaacacaaattggctctgtaagtaggtgtaaagccgagtaatgtaggttaatcttggaaagtaggagagacactgtactcaggctatttcttttaaagttaccaaagggacatagaaagtgactgtgaaatggagcaagatcttatggttcttgtcccctatgccctccgcctgtcttttgtctgtggaaaaactttagccaaagaataagtttatcagagaagtagaaagcagaaacaaagg

SEQ ID NO: 27224 - DNA, 731 bp, Bovine  19866881241733
ggaagagctgatctgtagagctttgtaagcaattagaaaggcttaggcttttactttgattgacatggagatctattagctaggttaaaagggagaagtaaaacaatttgatttacattttttaaaggtcacactgactgttggtaaagggagcaggtggagcagggagatgaattaggaaactatagcagcaatctattcaagaatttgatttcaatgaaagaggttaggagcagcccaatttttaatgggatttgaagactaactcaacagtattttgtataaattagatctacagtatgaaagaagtagtctaggtttttctgttgaaattgggaagaatggtgttttcattaatgtaggtacgttagattgcaccagaagaaggtttggcagtatgtgtgagatcaggaatttaggactgggcttgttaactttgagataacccagggaaatgttaattatgagatatccactaatatcaggcaaatgttaaatgaacagatagatatataaattcaagtgcttgcttgtgagtgggtatgtaaatctgagttgattgtattgaaagctttacaacaaatgaaatatatttttgcatgcatattcagtcacgttcaactctttgtgaccccatggactatagcctgcaagcctcctctgtccataggatttttctaggtaaggttactggagtgggttgccattttctactccaagatgcatctcta

SEQ ID NO: 27225 - DNA, 906 bp, Bovine  19866881252037
ttcagttttgctcagtgatggtaggaatgcagtcatttttgcctgtgttttaagcaaaatatgcagaacaagaatggaaggaaatatatccaagtggatttgatcgccaggaaaatacaggaaaaattaactgtagtcttattgtcactaatcctcaagactcttatcacaactttctgaaaattcctgagctctagcattaatctccttgaaagggagacactcaatttacagtgtattttgcatgtccctaaacaagtcttgaatgatgaatttcactgtctgactgaggtggtttacctcagcacataatttcttatattaataaccttccccacaggagctgaatgaccttctataaatacaatccctcattcaatcaaaaaattaaaacctgtgaccacctcacaattcatcattttttttcacaggcaattgttgaagcagaaacaaaacacaaatccctaatcctcaacccatgtaatataaaatcatgcagccttctgcacttatgtaccatggatatattgaaaattacgtagccttttgtgtttcaaatcaattctattgagtggatttctgtttatagtgagccacagttttcagggcaaaataagagctccttttccaaaatcaatggcatcctaaaacaatagcttcctgaatgtttgtatattttcaagtagtctttaaaaaaatgcatctttatatgactgcctcaacaattatggtaaatttagattatagggttattcttggaatctgcaagacctttatttacataaaactatcagaatgaattttagagttcagtaatgaatgctttctctttgggtaagattgattaaagtttgtactgaatttcactctgcattaaaagcctaaaaaatatacccaactaactaa

SEQ ID NO: 27226 - DNA, 818 bp, Bovine  19866881312185
tttttttccagtcagatggaaggactactgtgaagagaggaatgatagagagcttccaaataaaaaaatcgttattgtcccaatcacattttttttcctagagaaaaatgatgtctttacttatttttggcagatagtcaacattatccaccagctttggtgactgtcagtgcagcaggtcggcagatggattggatgctggggatcatttaacagacacgagttcaggaagaataggcagctgctctgagacatacccacaccaggtgaggacgtcagtggagagaacaatgacttcatgggtctttcttcttggcaaaaactgttatttggcatggaagggacaatttcaatatgctgattgatgactgactgtaccatagaaacacatacatattacagaggaaagtttttatcaatggatttccaatgcattaatacaaatttctcaatggacacatttgttcaaaaaaatttgatctcttagatttgcactggaaactctaaggtatcatcactgggatcagtgtgacaacatgagggtgcagatgatttttttataatcgtaactgtttaatccctcttaatttcctatttatggtgcagagcttgaacatatgaaaatgcagatacaatttatcatttcttttgtgtgatcaattcctaattattactggtttttagattatttttattatacactgtaaacagctttaggaaaagcatattaaattaaaaaatgtgtgtgtgtgtgtgtgtgtgtgttcgtgctcagtcttgtccaactctttgtgaccccatggactgtcacccatgtg

SEQ ID NO: 27227 - DNA, 905 bp, Bovine  19866881348815
attaatgaggctttgctcaagcaacataacatgccgtcttttgtaattttaaaatctttcaatgtcttactgctcttgtgaaatggctttatagtaaggtaataatccaaggaagaaaccaatggagaagttataaagcatggaatattggtatttgaagtgtactttctgagggtttttatttctatgcatgcccatagcaactgggtcaaaaggggtacataaaactacataacatccatgaaccacttaaagaaagtgttgtaatgtgcagaaagctacaatttgtggtcttcataaaggtagttttgtactgctgttccttggtgagtaatgacctataactgtatccagtttatctgtattatattagagagcttagtagtaattgcttataagacaatttataactggatgtgaggaaatatatgaccttattcatgtatgtatttatttatttagcaaaattgagttcatactcatgtacccagcaccctggcacactcaatgctcagttcacagaagtttgctctgctgttacacatttagaggaaagctgctgcataattttgacataggatgctattgcttaatttttaactaaattaccaaaatttctatagaactataaaattattttccttttactccaaacgtcattaagtattatgttgataaaagaagcataaaattcagcttaatgtagccccttcaaaaactttatgattcttttgggaatatatctttatctccatctcaagctctgcatttatcaattgtccactaaaaaaagccttgaaagtcattgcctagaaggaaagtatgcaattttcaggtatcctcaggaaatgaacaatatacagagttgctaaatatttttagtaaccaaagatatttatatcgat

SEQ ID NO: 27228 - DNA, 1298 bp, Bovine  19866881548182
tctcagtaatactactttgactgtgtttggttttttctgtagtaggccattaagataaattggagaattacacatagtttggggataatatgtaaatatagattttttaaagtcagacactggtaattttgattgatggtattatttattatcaggataagttttagaaagctaattaaacctaataatgctcattgattttattggcagcctattcattcaaagataaaatataagtggaaaaaacaaataatcataactgtttatgtgaaggaaaatcaggtttgggaataaaagaactgaatcacaaattagctgtagcccccatacatactacctgaatgtcaaacaacaagtaatgtttgtttagaggaatataaactagaactatgtcttgccatagcatagcctacctagcacattttctccagaacactccagaaacttccctacaaggacgattctgaaacctggacaggagtctaggaatacttgctcctgtagtattgtagtgatttctgaacttcaaaatatacttgcatttatcattatttactgcattgtgctctttcatcttattaaaaactttaggaaaactcaatttatccatattttcagtggaagtattacaaaaatattatgctgtaggtggacaggtttagaagttactttgcaagcttgaaaagttcatatagatggaggaggtataattacagagatgccacatgttggccacaagattttttttttttttttttttggtttttcatcttatgcaacttcatccaatgctcatattctgaatatacagcaacaaagatgccttccttaaccatatggctagatgcttatgatctgttttctgaatattttttccctggatgtaaggtcaaatggaggtttttttaaaaaaaaatccaagcctatttaatgtctaatacaggtgacagtgaattataaagaatttaaaagtgttatataacaaacagattagtatcaaatgaatgccctgtgatttttgcataagaggcattttagctattttgagcagtaactgatggaatgagatgtaagcaatctctggcaaggtgagaagctggacaggccaaggcttagaatcctttttcagagctttgtcagagccaggcattctggggacaatacagtgaatcacagctatatgattaatcaaatcagttctctattgtaaaaagacaaagagatgatgcccacattggcatcagatttggaattggatgcttgtagatgaagaatttgtgtagactgtgccttccaat

SEQ ID NO: 27229 - DNA, 1500 bp, Bovine  19866881604028
ctctcaaaaacatgaatgatttagaaatgatactggaattacttgagcctggtggtctattatattcagttccagatagagttctagtctgcttctgaaaaataactgatatgagttttaaaaagcaagttagtgagaaattgtgaaatatctgataagctgaaatgggatgcccaaaatacaaaattaaaagtcaaaagtacagagagtaagaccctttcgacgaaaaacatcccttttaagtgaatacagtgaaaacgggatacagagaaatcattataggatagaaaacatttcttcgtatagcgtgttactaaaacaaaatagtatttcttgtatattctaaactagcaatagattatttgcttttttatgtgttatataaagaggttttttttgtcattttatgtttctgttaaatttttattcttttctactttacatttctcttaattcaatacaccaattctttttaaattggttccataaaccaagatatgccttgagcaagatgccaaagtacatgtgtgtattcattgtgtgtctttttacttttaaggtcacaacaaggccaaatgagactggtatttcttttgtcattcatacaaaatgatttcctgtggcgattcagttattttcagagtgaactaaatttttcatcagtgcctattatagtgtaaatatattttctagcaaaaggtaaatcaccagtaactgcaaataaaaacatcatagaagaggaaaccgggtaagcaaaggaagtagatatttaaggattctccgcccacccaccaccccccgctgccaacaaactgacttaattgtatgattttatcaacacatattgaaggttctaaggcatttctaagtataaaaatgcacagcttcggtaggtgaaaaactcaccattttacaaatagaaaatatatttaatcaagtgtttaagggtattgtgagaaatggcataaagtagttttaaaatgttgtgtggaagggacagctgattctgttaaagaagaaagttgaaaaagggacctaggactggggcagagggccatacatacacgaggactagcagggtaagtgtggccatgacagcagatatgagagcccacagagcagttccagcagcctgtgatcagctctacttgggcaagtatcaggaatgcggtgaaagtaggatgttcgctttatctcagccacttaaaaagaaagagaaataattatgtatgcatttagaaagaagacatcactttattgccttagtcctctaattagcgtctcaggtttattcttcctaggaatttaaaatgtacaaccttctcatcctcccttgctcatttctaaattataattttgaaagaggttcctccaaataaagtgagttttaatgtaccattaatgataattattttttcacaatgactaatagaagactttattattattgtttcccttggtgtgaaaaaagggggttgttcttgtttaaagaatatgaag

SEQ ID NO: 27230 - DNA, 1152 bp, Bovine  19866881675755
tgtagtgtacaaaagtccttttaataaggacaagttttgtgttaacactgttcagcaaatatagatattaagatgcatccctatacatatcactaaattcccattcaacataaatcactagcatgggaagaaaaaaaatctatcaattattaccagtaatcattttattaataaactgtcaaaataacccactgaaacattattttggttatttacaatctaaactatatccgctaattcttgagccaaattttttttgtgtatataaaaacttaatttgaaatcaaaatagaaagatattgctacattgaatttctttatctattcttcactctatttgaaataatacctcgaattatcagtttttcattgggaaattttttcctataattttttaataacaatgttttgtgtagtgccttacaatgaatcttaagagttcattttatgaagtagtaatagaatatactgcattgtgaatactacctacagaataacgatattatagtaacgggtgatatcaagtgtttacacttataattattcatatattgtaacacaatagggagattattttaagccacattttaccatatttagcctacagttacaaaagacaatttgtttggattatgtaaaaatgtggctattttgcagaaataaaactgaatataaataccagggtagttgctattttttagttgaaaacaaatgttttattttctgtaaggttcctttaataataaaagacaaaacagaaaaagaattaagcacatccacttatcttagagtagtgaagtggggaaagggacaaggcaatgatcattctctaaaaattacatgggcaataataattgaaagattcatttgcatttaaataatgaacaatgtgcttatttgactatgtctacagaagctgcctagtaatattagaatacaagcatagaatgattaggagcataatatcattttctttttacattttgactataaaagcaatataaagaaacctgtcagctgtgaactgatattgcatttttatattattagaatattagcatatgcaaaacaagcaaaccacgttaaatctcctaaacctccccagtaccaattgcccaccattttaatggagcagcaccacatgtcaagcac

SEQ ID NO: 27231 - DNA, 930 bp, Bovine  19866881803406
atgaaaggggccctaaaagtcattttatgaattgtagagatttagaggaagttgagctcattcaagtcagaggtaagaaagtttaaagattgaaagatattttaaatgaaccttgaacagtgattgacaattggtagtcttttatgtgtgggtgtgtgtttttcttcttttagtactccttttgagagtcactgaaatcctttttagtattcttggtatagatctatttctctcccatatttccttttcttccctgtttactcccccatagttatgaacattctgtatcaccctttagaatcaatgttcttgaactatagcaatataagatggtgatatgatgctgaggctcagcagagagattatatattgaaatcattttcaaatcagatatcttacattagaagaaggctgaaagaataaatgttttgtcacaacttgtcataaatgtgattacagattgccacctgctttggataacaagtgattttctagagaagttgtctacaacatggttgcctttatcagtatgttttcttctctcctggcattgtatttgtcatttctaatacaagcttttgctatctattgcagtaaagcaaacaatttgttttctgcttgaaatagtagggatgtgaccccaagctccaaaagacagttctgcctctttttctttttccatgaatgtattggaaggagtgtggtttctgactatttcatacctatctatatttcctctctatattgattgcaatatttttgctaacaaattgggttataaatataactccagacagcagatatgttctaagtttgattatagcagaataactatattttgtgacaggtcagaagaaaagaaaaaaaaatcctgatatttagataaagtgggtcttagaacttccacatgtttaaaaggctgtgaaggca

SEQ ID NO: 27232 - DNA, 841 bp, Bovine  19866880389079
ctcaaccccgcaggaccaagtacagcatgttcgagcccgagggcgtcctggccaacgtgctgggcctgctgctggccacctttgccacggtcatactctacatcctgacccgcgccgactggaagcggcccctccaggcggaagagcaagcgctctccatggacttcaagacgctgacggagggcgacagccccagctcccagtgacgggcgccccatcctggcccctcctgttccgggggcccaggcaggtgtccgtcccgcaaccgccgctgagggtccgggcagggctgggcacagcggaggtaggggggaagtcctctctgagcgcagatttttgggattcaggccccctccgcttcccgctcctcgctgctgctgctgtcgttgttagtcctgagcacgcgttccggccccccccgcccctgttgccacccgacttcctccccaagatggagcagctttgggaaaggctctgggcctaaatgggtacgagagttgggggcgctcccttctcgaggccgcagcgaagctgagacttgctttgtgtgaccccgaactcctgccaggagtcttgcggcccgaaggaccggctctctgaaagggcccagcctttggcagcggagctagtgacattatatgtgaaatatgctgtgtcagggccaggttccccaggagaggggagggactccctgggactctctggacccaggctttggcacagctgcgttctggagccttccctttctttaaccctttagccccgaggcggctttgccttgggggccgtagactgggacagacttgccgtagccgcttcagagggcagcccagagaagagg

SEQ ID NO: 27233 - DNA, 1012 bp, Bovine  19866880420199
tagaaactagcttttctgtatctaaaaggaacaaagtagcatcctaaaatgacacagtagcacattgttaaaagaattcctgttttgaggtattatcatgtttcttggacattggaatattatactctgcatttcttcatgcaaattttggtataataaagtaaaataattaaatgcactaattctctattcctgcattgaggtttggaagagaagagaggtcttttctttttcagatttgcaaatcagatttagtgtggggggactaatttttcacttcctgattgcctatctgacatctttaatctaatctagtgattgttactgtcaagaagcaagggagctgctgttatttagaatgccagtgctgaatcattatgaaaaaccttgtccatgttattacttatgtatattttccacaaacatgaatcttcactgaattggaattgaagcaaactaaacctcaattaacattttcagaaaaccaggaagaaactaaaacacattgccaaaatgttaattgccacactctgcagtctctccttttcttatccgaagcagatttaaggcatagaaacgtcttagtgatttgttcttttataataaattctgtgaaaataagtttctgcggagataagattagtgacctgggggttgaagctgtaatcctctacatagtaccaaaaattaacaataaacaagtaaatttagtatactcataaagcaaacaaatattccattctttctgaatttctcttacataggatatactaacagaataatgatcatattaatattttatgatatactcatacataatgcagttaaaactagtgatctgatatcttcctttatttattatcacatgcaaatttggagaaagagtatatgttacagaggcaacaagcataagctaaaggttaaatgagccctggttctctcattttagcatgcttctctggtggctcagtggtaaagaatccgcctgccaatgcaggaggtgcaggttcaa

SEQ ID NO: 27234 - DNA, 1083 bp, Bovine  19866880502684
caccccccagctacaagaaaccagcctaatgcttagctctccttatcactgtttcccagagggtgcttgagaaagagacattctgccctcgtcatgaagcttcgacacaggtattctggttacccccatttcacaaaagggtaaaccaaggctcagagtggttgttacttatacacagtattgctggtaagttaccaagccagaatttgaacccaggactgtattgcccctaagccctcactctgccacacagccctgacatccacaggccacaccccctttccaagggctcacggtatttttttttatatttaaatatgtatttatttggctgcaccgagtcttagttgtggcacgcaggatctttagacgcgacctaagaactcttagccgcagcatgtgggatctagtttcctgaccagggattgaacccaggccccctgcattggagcatggagtcttagcccctggaccaccagggaagtcctggactcacagaatttgtttcggcatgaagttacacccctctccccacttggcatgttcccgatttgctgggacaagccatccaaggaactgtcctcagtgagaaggctggggaggtctgcagctaaagggggctggccattctcaaatcattgggcttcccttgcggctcagctggtaaagaatccacctgcaatgcgggagacctgggttcaatccctgggttgggaggatcccctggaaaagggaaaggactcccactccagtgttcttgcctgggtcgcaaggagtcggacacaactgagtgactcactttcaggttttcactttcattctcaaagccacgggacacgcagcgttgtccccgaggcaccaggagggggcgcccgtgcctagcctgccatgggcctgccctctgtggctgtcccatccctgcccacaggtcagtcacccacctgttcatctgggcctggagctgctctagcctggagcctagctcccgaggccagcagtctgagtctccctgagggttttgggggctctgatttggcctggggggcacctgctgcagcaactcaggccagaggccagatgcgt

SEQ ID NO: 27235 - DNA, 1051 bp, Bovine  19866880566679
acatcctttgggaatgacttctttcttgcctcctacactcataatccttcaatgccagtcaacttactgatactggatataaactaataacattaaaagaaatctaacaaaatgacccaggaatacatacttttgcacttaagtatcatttaacatattaaatcttctttcctgaaaaatctttaagagataaaagttcacttaataaagacacagtttgatacctaacaacttgatctgactgtaccatacatactgcgagatcatgttaaagtcaatccacaacctatactatagtgaatattttaagaagttggagaggtaaacatggagagtaccatggagaggttaacatctaaatcagcagttaaaaataggtatgaaaaatacaaatcaagatttcaaacaaaaaataagtacccttactgaactatgaaactttcattattctaaaattacaatatctccatctggtaatctgacatgaacaagctgataaatgcaatcagaacaacagtatattctcgcaaaaccagaaatttcctgaaagcctggaaaaatatgtccacaacagatggatcatttagaaaataaatacatcaatctgtcaaaaggagcactagtctaatttcctaaatgaaaatcagtgggagctctactttccaagagtctgtgacattagaaaggccaaagaggaaaaacccagagatgcacataaacagatttgctatgagctagagtgcatactgtcaggtttcctgtcaaacatactcaatgtaggtaaagtccttaccagttaacttcttcacaggttggagccgaacactgatagactgatgtgtgagtaagggggaggatggaagagagcgagacatgccctccataatccgaatgtgctgcataccttcactcacgggaagtggtgggacggcgtagtctggctcaaaagcacagtcgctttctgtggagatgccacctgtgaaacaggagaagacaggacaaaagagctggtgagaagaggttcatctcctaaaatttttctctattaaaa

SEQ ID NO: 27236 - DNA, 546 bp, Bovine  19866880604118
acattgaagggaaggatatgcgtttggcatatcaaacaccccccaccctgctccattcgaagttagtaaagggtccggccactcctgccaccgaaccagggctccagatcatgccccaacccaccgcacacactcactctggccctcgaacttgcggatgatggtgtccaggtaagtgttttggggtgcgacgtggcccctgcggaccggcatctttcggccgcggcctctgcccggagccagcagcgctccggctccctgcttctccgcctgtcctctggctcagctgcgtccggctccggtgggcgccgcccccggggagggccgcagggcttcatgccccgcccgcccgcctgcgtctacacctctgctgccctccccggccggccgctcgccctgcgtccttccctccttggccgcccgggagctgtccgcgccgcggtgctgaaaggagccgcgcggcagcggcggcggggcggggtccgcggggcgggggcaacttttccgggactcagtggggcaggggcggggccctgactcttcagg

SEQ ID NO: 27237 - DNA, 1913 bp, Bovine  19866880640589
tgatggggtcatacggcatgtacttgatgcataaggggcttctcagaaatgtcaaagacttctcacaatactttccagaaagaataaaactgcaagcaggactattctcataaacattggaataacatttctcctcttggactttctgacaggtttccatccatttctctcttctctcccatttggggagctggacatggttcaaaaaattccctttatagagcacctaattttgtaagttgcatatgttgtagctgcttgaaaatttactccacccacactccctattcacatacacacataaataagtttatacacttatatatatatataaccttggatcctgtttttgaggaagaaatgaattattttctacacatagctttctttctggtgtgctgatattaacagtagtaatgtagaatcttccaaagtgtgacaaaatgaatggtttcagtttcaaggtggaattttttaccacttaatataaaacattctggcaatgtctaccaatgtctattatcaagagtagggctctgcaaactctttctgtaaggaaccagagaggaactattttaggttttatatcacaaccactatccatcacaaccactcaactctctctttgtaggactaacacagccgtagacaatgtgtgtatcaatgagtgtggctgtgttccagtaaaattttatttacaaaagcagacagcagggctggacttggcccaagcttgtagttcactgattccctatctagaggataattatttatggcttctcctgttaggctgggtaagagctgaacctcccaatagtagtgtttttctaacagatggcctggaggttcacagctctattgactttccttatgtagatgtagttacacaataataaataactgaaggtcaccacatcacacagctctggagccatgcagtgcctggcctgtgtggccatatgcagcagcactgaatgtatttaaagtgtttttctgctgttccaatctgagaccagattgaagaagtgaagtgaaagtcgctcattcatgtctgactctttgcgaccccatggactgtagcctgccaggctcctctgtccatggaattcttcagacaagaatactggagtaagtagctgttcccttccccaggggatcttcccaacccggggatcgaacccaggtctcctgcattacaggtggattctttaccgtctgaactatcaggggcaaaggaatatgatgtgtgttcagttatttaaacatccaacatatttgttcagacactgtgacaacagccaataatatatcaattaagatccttgtccttaaggagcttgtggtttagtaaggtgtttgctagagctgcccaaacaaagtaccacaaactaagtggcttaaaaaaaaacaaatttgagacttccctggtggtccagtggttagcagccttgcaacacaaggggacgcaggtttgatccctggtctgggaactaacattccacatgccatggagcaacttagcccatgcatggcaactactgagcccacacgccccaactagagagtctgtgcaacacactgaaaggtcccgtgtggcacatcaaagatggaagatctcaagtgctgcaactaagacccagtgcagcccaaaaaccaaataggaaaatcatcactaactctgagtgttactcactcagtcgtgtcagactctctgcgatcaaacttgggtcttctgcattgaaggcagattctttactgtctaagccacgagggaagccctgtcactattattttaaaacacacacacacacacagaaagttattatctcagagttctggaggttagaagtctgaaatcaagttaagagctgggccacgcttcctcgaatgggaatccttcctagacttcctag

SEQ ID NO: 27238 - DNA, 1171 bp, Bovine  19866880642652
taattagtcagttcttattctccagtaaatatcttaccttcaagaccaacaatctaataacaaaaaacatactttttatcagatgtttcacattttaaaatctttactgtttttatatttttcctacatcttaaggtattaaatgtgaggaaacatgtaaaaagtggcaacattagggagagttggattttccctatttctttaactgtttttcaaagatcattgttcccttcctgaaaattccactcagtaatgactccaaagtttttctcaacaaatgttcttctctaagaccaatgtctgaaagctgaagtttaatattcaagttatttaaacactcaaagtattatttcccagagtaaagtaagccttttaccttttttatcctcacagtaatagaatacaatagacttcccaaaacactaagacaaatgctgagaataggaaacttttaaatagataacaaatgatagcttacatttattggggttcttattctttacaggcacagcgctaagagttttaaacatgttatttaatcctcataactctttgatgcaagtggtagtcgtaagggaattgggacttaaggaggtttataacttgcttagagttacaaagtctagtcattgccagtgcgaggattcatttcatatctggtagactctggagcctgtgctcttaatcacaatgctatcttatatcagagacaatataatataaaaatctttactataataatagcaatacaatagcgttattgtgcttagttcagtacactggggtgttaggaatgggaaacagttccgtataaacactaattgccagatagtggttgccaaggcctgcagggaatggaaaatgggcagttgctgttcagtgggcatgagaagtttgagtcacagaagataaaaagtttctaggaatctgctgtacaacattgtgcttattgttaatcatctcatatgattcagttcagttcagttcagtcgctcagtcatgtccgactctttgcgaccccatgaatcgcagcacgccaggcctccctgtccatcaccaactcccagagttcactcagactcacgtccatcgagtcagtgatgccatccagccatctcatcctctgtcatccccttttcctcctgcccccaatccctcccagcatcagagt

SEQ ID NO: 27239 - DNA, 1183 bp, Bovine  19866880672064
tggaagatgaaacaggggttttcagtttctcctaggtggtttgttttaagggcttcctccgaaaggtggagagggtatcaaggtcagggaatgaaggggatttggtctcagtcaggtggtggccgagctcagaaatgaaccctgctccctagttctcaggacgccagtttcccatcttcacaggcgggctccagtggaagcgaaacccgtccattcacgttcagatatgctccgagtgccacgaggcggccttgtccaagccgcatcccccctcggggcgtctcccctgttcctcccagcaaagagaggagggggcagccagattaattccaagggctgttcatcactaacattttctcaactctgactccccagtacaactctctgctaagcaacatgagcaggatttactccactgccaaggtctgcttccccaacaagactgccccctgctggtccctggacccaggtaacgggcctgagtctcctgtctgtcttccaggccttcctgaccttccccgccacccctcggctccctgaggatggcacatttctgcagaggggggcggtaaacccaaaggcctgaacctctgatcaggaccagagtgcctgatgcccccacaccctgctcctccaggccgactgacttctggaatctccagcctccagccccgaccccgccctcacgtgtgcttttccttccccatcacaactggccttcatcgtcgccacctggttttcccttaatgggccctctcatccccccaagagtcctccacaggccttagaccccgccgtagctttccttacaaacctcctctactgctgacttcgaggcagcagtctctgaactgaccctgcccacctgtgtctcagagctcaccaatatcctggcttcctcgcgaagctacaccctgctgctgtatgcctgggagggctggcacaacgccgcgggcatcccactgaagcccctataccaggacttcactgccctcagcaacgaggcctacaagcaggatggtgagcacacccaccagcctctgtgtgggcactaccctcccgtcttctgtctccactgagccccgaaacacacagagcagccattacgatgactccctacacggtccaaggtctcacagatggtggaggccaaacgggcttagccccatcagcctcatgctgc

SEQ ID NO: 27240 - DNA, 932 bp, Bovine  19866880675036
ctcctccttgggcagggccgccttgtctacgttcagcagcttactcagcatgcgcttcacgtccgagtcctggaagttggcgatcttaaacatgcgggcccgcgtgccaaagtacagtgtgtgctgggacttctccacgtccttgtacagctggaaggacggtcaccatgtttgtcgtgtgagggtgaaggagagggtgagggtgtcacatggaactccagggcccagcccccacaacctccttccaaagcccctttaaagggtttggagtcattgaaactttgccaaaagcaagaagggagggaacctgcccgctacaggcaagcaggtgatatttacaagaggaaagaagctagaggttctagcccagacagctttcagggctccaggaggcctggagcctgacgtctgttccgacatgtgctttggggcttccctctctcatctagctctggaagagtggcaaaaggtgtgattccttggccccccagcacccctgcactgtgactcctgagaagaacaaagggagaaggggcaggggcggaagtggtgccacaccatctcctcttgatttttctttgtgatgttggtgacatagttccaggcggccgccatgaactggttccatacaacctgggctgttcgctcgtaaaactccaggaaggcctttgccacagtctcattgtagagctggtctgcagagaaggagatgggcgtcaattgtcctgggagaggcctgcccctgcctggtccctgggtctgatcccacgctccttcgggtcccagtcccacctgagtcctggtcaccctgagccacggcacaacagaagagcacgaggagggaagggccagggcaagtccatcttgttcccacgaccaaacgaacagcagagccggaggaggctgggcccaatcacggtccagctccatat

SEQ ID NO: 27241 - DNA, 1031 bp, Bovine  19866880699975
actgttagtaattcacagctatttacatttcacaagaactcgtgttccattctaagagatcaggctcatcaattatttgcatttggtaacacgttaattatacaaataattagccttgagatgagacatcaacatgaaagtataatgaatagttttgctaattgctcttttctgttatggacagtccttgatccaaattattaccacctccaatgttcagcctgctaaactctaactttcacttcatggaaaagtccaaatcagtgatgacaattagatttctctgtcatgccaaccctgacctgttgattaggactctccagagcactgtgttgaaaagcattctgggggaacgaggcgatctgggcctcaggggcatcacaggatgatagatgagtctgttcacaaaggtgagcctaagttgacaataggtgagccagaggagctgccatctctagcctgagcattgagaaacttacttctgccttggacatcagttgttgttgttgttcatagcttcttactttctgttcccttgaacaatcctacaagtgagctgtattcttggctaggaatataaaaatgaatccgtcatggattgtcttctaataagaaaggcgtaaatggccatacaaatcaaaaagtactgagtgctctaaaagtaacagatacagtgacacaaagaatcagaggagaaaatggagcatttatagaaacagggaggctggggcagagtgtctcttttgagttgatccttaaaggataactagaaatggggggggggtgccaaagtgagaaaggctcagcattttttccttttttgggggtagatgtgaatcacttgctgtaacagtaaagaaggaaatgtgaaacaggggcgggtacaaggggaaagagttcaatgtggttggaatgtaggaaaataaaggaaggtaaagttgggaaacaagggtgggcccgggttgtgaagggcctgggaacaccaggttaggaattctctagaacaatgtctttcacaatagtccacagga

SEQ ID NO: 27242 - DNA, 1672 bp, Bovine  19866880722451
tgcatatggtgactgcagcctgaaattaaaagatgcttactccttggaaggaaagttatgaccaacctagacagcagattgaaaagcagagacattactttgccaacaaaggtctgtctagtcaaggctatggttttcccagtagttatgtatggatgtgagagttggactataaagaaagctgagcgtcaaagaattgatgcatttgaactgtggtgttggagaagactcttgagagtcccttggactgcaaggagatccaaccagtccatcctaaaggagatcagtcttgggtgttcattggaaggaatgatattgaagttgaaactccagtactttggccacctgatgtgaagagctgactcatctgaaaagaccctgatgctgggaaagatcaaaggtgggaggaaaaggggacgacagaggatgagatggctggattgcatcaccgactcaatgtacatgaatttgggtcaactctgggagttggccatggacagggaggcctggtgtgctgcagtccatggggtcgcaaagagtcagacacgactgagctactgaactgaactgatcacttctttgttcactcattaattcactgttaaacaatatatttactgagtgctgactgtgtgccaggaactctatcaatcattaggaagaccaaggtgagcatgataggaaggttcttgtcctcatggagctcactcacattctagaagggaaagtggacagtaaacaagtattcacagataatacattgataaaagattaaaagtaagaagattgctatgaccagtaaagccaggaaggactttcttagataagtgacatgaggaagtctcaggaggtggctgttaggctgagaccggaaggagtgagagattatgctgtgtgatgacagagggaaagcatgctccagacggagggacctattaagtgcaaagaatcaggagtagaagagagcttagcaaattctaggaactggcacatgatcatttatgaccagaatactgtgactaacagggagaatgaatgaacttcattagagagggagacagaagctatctttgtataataatatagggttttgaagaatctggctttgattttattctaatcacaaaaagaagccactgaaggattttttaggaggaggttacacggtctgacttgtattttttaagaatcactttgggtgctggtggagaatggattgacagggagaccaattaagacgctaaaccagtccatgtgagagcctagggtgcagtcagtagaggtggaaataagtggacacttacaagcaaaatttgggttgtagaaccaactggatatgctgatggccacagtgaatacatgtcttacagttgtgggttcttatggttgggcgaacagaaggctattagtgttgattttatgaaatgtggagctccagctgcttttgaaagtctagagacagccaaggaagttgctccaaacacaaaaaaacaaaatgtgctgtcatatcccactaagctggcaggaactcctgaatgctgtgccatggatcttggtttgacaatctaggagagcctgcgggattcccatcttttcattcagccagtgttgcttcagagactcatttaacaggacaaatgagccctctatttcctatgctacttttcagtac

SEQ ID NO: 27243 - DNA, 1926 bp, Bovine  19866880766561
cagttcacactcaactttgtggagttcaacctggagaagcaccgctcgggctccaccacagagattgagatcatcgcaccccacaaggtggtggagcggacccagaacgtcacccgagaaggtcacccagggtgcggcctgcaggccagggtgggtggggctgtgctgggccctacagtccctcctcaggcccgggctctggactcctccagggctgggtgaacagagggagctgcctgcccagcctggtgtctggtctgagctccaggcctcttgtcctgctagagtctgattcttcagacctaaaggcccaccctgagactcccaccctgactcccagcccccggacccaggggagggtaggtcagcagtgccacatcctaggcctggagaagctgggagggggaactggcaggacaccttgggacccgcccaaggctctgccagtcccagagaaggagaagcagagagaggaggtgtgagggccatactgagaagagggtggggagccccagccctgctcctgcccctggccttcgaggtgacagccagcccctaggacaggatgcttccgcagtccaggcagtggggaggaaacctggcatcttcaactcccttggcacgggtccctggggaacagtcaggaatgcctcagcccctccttggccagcccagggcaaactgccctgggttctctgttccagctgaccacactgtccctcctcctggggcctgatgccccagtccccagctgacctctccagagggaagtgcagagagcactgcctaaggttcaggggccctgccactgtctgctctgtgaccttgggcaagagacctgcgccttttctgggccccagggtcccatctggaggaatgacttgaaccacatggtctctgaggactcatttgacattgagggtgctggccctaggaggcactgagaggtgcctaggccagggctgagcaagggggtgcagggcaaggtcaggggcctcctccagctcccctgggactttgcttcctgagggaatggagcagctctttgcctcccacctcctttcacctgaagcatcctctgtgctggagcacgtgggctggaaactccttgtgacccagccactcaccaagtacaagagccctggggcagaaaagaccccaggctgtagggctggacccttggacatcaggcggggcgcggggggccagtgacctgggaagcccacctagctgtgcatctggggacctttcaaggttggtgacggggtgatgggggctgtcgggctggagagttgtgcatggtccctgccccagcccctcttggctttactaacccaccccatattgtccctaaggaggggaggagcctgccagagctcagagcatggcccagagcagggaagtcacaccggcctcaaccagaactcaaagggcctagagggctgtgagcccatacctggactcctttgtcctgacagccctgcacctccaaggtcattggggaggcccctcatgctggccccagaggcggtgggagactcaggagatctgtggtggaggaggtggcaccctgaccagaagcccccaggatggggacacgtcttctgaccccaccgtccgaattctgaccgcctccctccctctccatgtgctctgctgtttcctcctggttggtcttgagcagccaggggtggacatggccatgatgacccaagctctccgtgcgcattcagtcccctttagttgagcccccacgtggactaagaggggcatgcgggatgagggagctgccgctgtaagtcagtggagataactgtgctgtcaggacatttacagggagccgggagaaaatcaaaaaacatgggtcaggtctgtgcagggtcagaggaaacttcccagggaggccaaacaggagctaggccaagg

SEQ ID NO: 27244 - DNA, 1672 bp, Bovine  19866880773038
atctttttctggaagatcaagtaggtaggagacaatctgaaacaagaagttgtgtcagctcgaagttcaggtggaaaactatacactgatactgtgaacctgtgaggtttgggagatatctggataacccagggccaccctcttgcacaccacaggaatcagaacaatttgtcctcacaaaaaaatgcaaagctgccaagatgagcatgcattctccaggtacagtctacatgtttcccttgaatgcaattaacttatacagcccgtgatttaaaaaaaatacatatttatcacatttgagttaaaaaaaagcaatccttctccctcctaataaaactaccagaaaaaaaataaaactaacagaaaaaaaaatcaataagcaaaaaccagaaaataaatatggagaaaactgagggcctgtactttttcagagtagagctgttatcttctttttttttccctcttggaattacaaggactgtttggggaccgtaaaaggagaatgtctgctaacagcaaaggcaagtgacagctttgttttcaggactctgactataaggagcactaaacaaccttccacagatagtcaaagttccaattttacttaatattcccttggggacatatcaggtcagtggaagaggtggctgtctcactgaagcatcccatgcagtgtgaaccagcttgtcctggctagtgaaagctgactcttgaattttcggagttttgcaagctggttgttaaacaaagatgtttattaaaaactaaataacagggagggatttaaaaacaattaaatagcaatgatgggaattccctggtggcccgctggttaagactctgctctcattgccagggcccaggtttgatccctggtcagggaactaagatcccacaaaccaagcagcagaggaaaaaaaaaaaaattaaataataatgaaagaaattacatcaataggttaaaatataaaacctcataacttcctaattattaaattacattttactattatgtatgctcatgaggttatttatattgactgtgtctgcatggtggcagttttacataaaggtgtactcctgtgcatctctttgaaactctgtgttcagtgttggtagcttgaaatcagtcatggtgggggtatttgctgctgttgttcagttgctaaatcgtgtctcacgctttgtgaccccatggactgcagcatgccaggcttccctgtctttcactatctcctggagtttgctcaaactctatactctggaaattggcaaattctgcagatcaggatttgatttagtgcaaaagctcaaagagggttccagtttaatgaatataatttgtatgagggcaaaatgtagtttgacagtgaatcacacaccagatttaaagacaaaattattgggaaaagagcaaacgggtagtggcatttatcaaaccacggttgagttgtaaccacagggttgggtgtggatataaatttagcaaaaattgacaaaagcattcaattaagagtattacacaattcattattatttgtaaactgtgtgtgacatgtttttttatatcagtaaatttataataaatttaagtctgtttgtacacacacacacacacacacacacacacacaaaacattcctactgctctctactcccctctccaaggctg

SEQ ID NO: 27245 - DNA, 1303 bp, Bovine  19866880867347
ccgggtgggatgaacccctccctcttctgtaggcctgttgctcttggctcatacttgttctgaggctctagagatcattctgtaatctgtctgttggggatttggggggctcctgtgggtaggacagaaccctagtcatgtttttatcctgtggctagcacagtgcctggcagcagaacggcccagcaccctcaccacctgtccccgcatccagcccaggtccaccccgtgacatcgtccgtcctaatgccttgcatctgcctgtctggtgcctctcgctcttcgaggcacttcctccagcatctcctctgctcctctggaccgcccatgggggcggccagggcagatatggttaaagccattttagagatggggacaccggggtgcagagagggccatgccagtcaagtggcccacagtgggagtggacaccgaagagagagaagcctgaggtgctgtcccagggagctgggtggtcctgacccctggtctctgccactctgcagctccatggccagcctgagaggaagaggttgggcaaggagcctttggtgtctcttctgcctgctgttccctgggtaggggtgggtaggggcagttcccaagcaagtgggaaacaggaaggagattctggtagaaggtggtcccgaggatcctggagatagtgaggggagccacaggctggggtggcaggggtctctgcatactcccttccctcagccagcacatccagccttgttccaggcacccccccctgcaggatccctgaagctgggcgaggtcaaggttaagaggtcctcagggaggctcctcagaagagagcagggagccaggccctggagattcccccacccctctggctggcaggaaagaatgacatctttggagagcccgtcagcctccatgcccggccgggcaagtccagcgcagatgtacgggccctgacctactgtgacctgcacaagatccagcgggcagacctgctggaggtgctggacatgtaccctgccttcgcagacagcttctggagtaagctggaagtcaccttcaacctgcgggacgtgagtctgggatgggtggcccggttgggggggtggccctcggccagcctgtaatgggccatggccagtcagcctgctgagcgcttgggctgcttggctggagaggacccgtctgaccgcttcccttcttttcaacccccgctcttcatcctttgtcataatcacttctgtgcctcccatggccaacataatgctaagtatgaagatagctaccaattacggagcaccaactatgtggtaag

SEQ ID NO: 27246 - DNA, 1108 bp, Bovine  19866880874547
ctcctctctgggcctaggcatgtctcagtgacacccgctgccaaaagctgggttggatttgtatttaccttcaggaggagaaggttcagctagtcctcatacaatgagatgactctgacatggaaagttcttaacggccctcctacagcccctggcagtttgtgtgtgttagggtatggagccttcagcctgaatcgtgaatacaagactccatatctttttttgttgtcattcagctaatgatttcaagtaaatctataactgctctttgtctcagtttccttatcttactcagggatgccaataagctattattactacagacttttaaatctacacatatagtaaacataaatgctaacatcaatgcctcttgcctgcagtacctatttttcttctccctgtcccatggtttccaggctctgataaacagattccatgtagaatctatggcaccacctatcagtgaccaggtgaaaaccaggtctttaggttgatcagctgtgggcacatgtaggcccacgttgagaaagcaaaaatctgggatcctcagcttatgagccctccactgagggatggcactctcctgatgactctagaaccctaccaagactctggtgaagtctacgtgcagggcagagtcagcggccatcgggagaaacctccttcttcccctcaccttataaaacatgtccccctcttccatcagcttgctcagcaggatgatcatgatgtctggtttggaggtggccatcgcccatgtggctggacctgtagtgtacaggatgcatgatgggtaaaaaactcatacaatgtaagggtggtaggaagctaggtgaaaaaaacaccctgggggggggatttctgctgagagaacaacttgctccacaacactggcctcgtcttttagaactgggagtgtctcagcgcctcccactgccaagaagccgcgttggatttgtattcaccttaaaataagaatctctgaacggtcagagtctgcaccatcggagggcagcagagcctgcatgttgtattcaggcaggcgatgcttagtctggcgttactttaaataaggaacttgggagaaaagggtttacattaaatg

SEQ ID NO: 27247 - DNA, 1207 bp, Bovine  19866880901648
actgtgcaaatttaaacaaataagaaaacagagcttaaaattgcaagttccagccagactggctagaccctagatgatattaagatgcatgcattttctgagttctttgaatttaacacgtgcatctgacaaaaatctcactcctccttcctattatctaattcttatcctctctgtctctgggtgcttagaaaactatttagtgataattcttaagtctgcattattttattttccataagactgattacaacacaattataattttttaaatatgccttataaacatatgtttgttgagtctaacatatggtatttctctggttattttattcctgatgctttgttacagtatcagattgtttcatgtactacttcatgctgaataaattagagagattaatctttattctcaggcctgcttcctattttaatctagaggaaaagctcagtttgtatttataagttttatttatgaattatggtaccaaacacatgcaagagaaatattgggtcaaatttgttatcttagataaatcagggcaatttccaagttaacagcttttgttttcacttcaagaagttgaggagtggggtgacagaagacagtgttagagaataaccatacagtaaccatgaccaacttagtgaccaaacacacacacacaaccatgactgctgctcttgctgctgctcaacctgtctgcgtgctcatctttctttcttaggtggttgcctatcactattgccaagcagataatgcctacacctgcctggtgcctgagttcgtccacaatgttgctgccctgctctgccgctcccctcagctggcagcctatcgggagcagcttctccgagagcctcacctccagagcatgctgagccttcggtcctgtgttcaagaccccatggcctccttccggaggggagtgctggagcccctggagaatctccacaaaggtacagatgaggtgcagagcaggtggaaggtggaggctctggagcccaagttcacctgggggcatgttatagaaatgattatttttatcacactgccaaaagttaaatgttcctacagggtacagttaacaaataaaagattttactcagaggaaaaaaaaaaaaataagaaattcctccaagaattggtaattccttctctctgcataaaaattctcattctcatttccaaatacaatgcattctt

SEQ ID NO: 27248 - DNA, 1776 bp, Bovine  19866880904418
cactccagtattcttgcctggagacccccatggagggaggagcctggtaggctacagtctatggggcctcaaagagtcagacacgattgagcgacttcactttcactttcttcatagaatctagaaaaatggcactgatgagcctatttgtaggacaggaatagagacacagatacagaggatgggcttgtggacacaggggatggggaaggagagggtgggatggaccgggcgaggagcactgacaggtgtccactaccatgtgtaaacagatagctaaggggaagctgccgttcagcacagagacctcggcttggtgctctgtgatgacccagagcggtgggattggggagtgaggggggaggctcaagagggaggagacatatgtaacacatatggctgattcacactgttgtacagcagaaactagcctaacactgaaaagcaattatactccaattaaaaagaattggtaaataaaggaaaaaactcctaattctgactccaaaatccagggtttttttgcattatactatgctgtttctctatatcatatcagtattaaatttgaatctgattatcagcgatatcactgatgaccagaactgagtggacttggctgactcgctaggctagcttccttctccttcacctctcctgtgcttcccttcagaaatggcatgactggccagagagagagagaagagcttctcagacactcaggtgctttctagactaacagacttacctgttcaggtctaagattacttaacattttgtctcaaaagaggctttcacgaatatgaccgatgccgatttataatacagggtaagtacagactcaacttcaatgctgaagtttctgagaaaaattctattaagataacttgttctcacgttgacgtaatctctcatcatattttattctactgagaaagctttgacattttgaaaagttattttaaaaattttctaaaaatgtaatcaattcacaaaagcctcaagggaagaacagacaaaattaacccagcaccatatggtaaaacaactgtagacaccaagaacagcccagaaacgatttctgtgcctcagaacctaaggcttttgtcagatcaatatgatgaaagaaagccacactctgtatgtaccaacagtaaattacgggcatatgaacaagaaggcatgttggcctgcgctgtgggacatggagggaatgaatactttacgcggcgttcatcttcctaaataaatgtttctttgtttaggagatcagctggcttccaagagattttctaaagcagaaaccacggaaataatccagtgagaaaggaccactgcaactgtagctgagccaaggggaaaaaaatgagctaaaccatacatttagcaacagattcagttctctaagccctgaagtggctgtcccagggcagcaagagacaggaagatcgtcccaagcttctcaaaacattcccaagtatactgacatctggaatttactttgaaatttgtaaaaaaacaaaaacaaaaacaaaaagatgtgtggttgaagagaagggcagaatggatagatttatggtagaaataataaaacattaatgacataatcaaggcaagttatggagtgtttattgtgaaacttgtctttttgggggtatatctgaaaatactgctaataaaatgttgaaagaaaaagcagctaaaggaaaaacatttccagtagagtacacaaatacgaatagttttggaaagcagtttttttttttctttttaaga

SEQ ID NO: 27249 - DNA, 1087 bp, Bovine  19866880945944
ccagcctggccccatctgagcgtctctaaaactgatggtctctgtgggtttttcaattcctcaattgtttactgagcacctgctgtgcaccaggcctcagaggacactgacaagagtttcaacagaaaggacctaaggggagaagtttctctagggcccacttgctcggatcatggctgggtcccatcgggaccaccccaccccgccagggatgctgtctctctgctcttgtttctctccccccaccccgaggcccacaggctgcctaccttatagcagtgccggagtttgggatctgagccccagccctgcggacaggcaccggtgaggctgggcgtggggtctagcccaggcagctcaggcgtcacgggcgtgcccaggctctggcggcagatgtagcgagcccggaacgatgtgcagttcttcacctcccacagccccatggcactgcctgtggccagggccacgcagcccccacggctgtaccctggaggagggaggaggggacccacacactgagccctgccccacatccccgaggggcacctccatggcccccgcatggggagccagcttggccatctctgcagggacatgtgctgtggggttgggggtggcagggctggagagagcaggaaggaaatggaggcagaagcctcactctgtgttggctcctgtgagatcttaggcaagttgcttaacctctcagagcctgtttcatcatctactccatctttgaaaaggcttaaaaaagataacaggggacttccttaaaaaagataacagtggattcacggttaagaatcttccttccaaagggatatgggatcggtccctggttggagaactaagattccacatgctgtcgggaatgtgtactgcaaccactgagcccgcgaggaagacccagcacagccaaaaaaataaaaaaataaaagatttataaaaaaaattttttttaagataataaatgtgaaatagcataataggaagcacttgttctatgcccactattccaagggctttacatatattaacccatgcaagccgcatgtcagccccgtgaggaaagaaccattatccccat

SEQ ID NO: 27250 - DNA, 2734 bp, Bovine  19866880982460
gatggaggagcctggtgggctgcagtcctggggtcgctaagagttggatacgacttttcactttcatgcattggagaaggaaatgggaacccactccagtgttcttgcctggagaatcccagggacgggggagcttagtgggctgccgtctatggggttgcacagagtgcgactgaagtgacttagcagtagcagtagcattgcaaatagtattccattgtatacctatagctccttttatctgtccatccgcagttgatggacattgagggtttgtttttttgttttttttttagctattctgaatactgctgctatgagcattctagtgcaagtctttgagtagatacatgttttcacttctcttgaatagacatctaggattggaattgctagatcatagggtaaatttatgtttaacttgtaaagaaactgccaaagtgttttccaaagtgtctgcgccacccacagtgtctgagggttcctgtttctgtgcctcctctctgccgtttggtattgtcttacctcttatcatggttattctagcagatgtgaaatgctgccttgttgtggttttaatttgcattttcctagtgactaatgatggtgagcttattttgtgtgctttttagctattcatatatcttctttggtaaaatatctctttttttgatgggtcctctgtctccctattattgagttgtaagaatttgttgtatattctgtatacagatctttatcagagatatgtttgcaaaatattttcactccgttgcttatcgttttgttttcttattggtatattttgaaacataaaactttttaaattttttattccttttttgaagtatagttgatttacagtgtttctggtgtacagcaaaagtatttcagttatacatatatatttgtatacattatttttcagattcttttccatcataggttattacaagatacttaatatagtcccctgtgctatacagtgggtccttattggttatctattttttatctaatagtgcctatctgtttatcctaagtttcaaatttttccctccccccttttccctttggtaaccataagtttgtttctgtatctgtaagcctatttctgttttgcaaataagttcatttgtatcactttttagattccacatgtaagtggtagcatatggtacttgtctttctctgacttcacgtagtgtgatcatctctaggtcctttcgtgttactgcagtggcattatttcattcttttctatagctgagtaatagtccattgtgtgtgtataccacatcttttttacccttttatctgaaacacaaaaattttgatgacatcagtttatctgatttttcttttttggtgcctttttttaaatcactttaatagataggaaactgtttatatcatatatcataacagtgatttttcttagttattggggtttattttaatttggatattgaaaattatttacttacatacttaaatgttgtctcctatcttcatttctgtctccccttccccatgttaaaacataaatgaaagggataatattagtctaaattgttattcctataaaccttgattattatgttttcatctatcacaatggtcatctcataacactggcttttctggctagcagagattttccggttcttaagctaatcatgcttcttcaatagctctgtcctgggattaggattagattagggtttatactgtcagagtaacatttactgtgttgaacaagatacttcattagagaattatttcttgtcagtattgaatgtaattcaaactgaccactaggtaacctacaaggcaaatcataggtcagaagtagtttgtattgggttgttttctctatctggaaaccatggtttcacgtcctcacacagggaggaaggtaaaccacatttctcaggatttctcagttattttcaaatcttaataggttatacattgaaagtgtttccagaatgtagaaagacaaaattactttcacctgctaactattggatgtgtgtaaacatttgataagatcagagtttccagtagtttatgtgattagatttctaaatctgtttttgaagtaaattttcttagctcaggagggtcctctcttctcattttagctctagagatacatgttttggacttcccccgtggcccagtgcgtaaacaatctccctgcaaagcaggagatgcaggttcgatccctgggtcggagataccctggaggaggaaatgacaacccactctagtattcttgcctgaaaagtcccatggagagaggagcctggcaggctacagtccataagggtcacaaagagtcagacatgactgagcagctaagcacacaaagcgaacacatgttttcctttacgttctaacatgtacatagacgtggttccccaaagtgggggaagatcagatgctcaaatctcctaggtgaacaggaataattgaggatttcaaatacgagatgaccttgaaatagggggaaatgttagtatattatacttactaaattgttctaagcttatgaatgagatgggggtgatgaatgccgataataaaatactttttttcaaacccagcttttaaatttcccttcttgtttaaactttatctcagtgtgactgatgtaattatttattttagagatttaatgatgaataatgatatgaaaataccatttgcatcacttaaaaaaaaccta

SEQ ID NO: 27251 - DNA, 3422 bp, Bovine  19866881109779
ttttttttttttgtagatttctcaaaattttttacctaggcagtcatgctatctgatacatgaccctgtactagttattactcttctcttggcctgtttcctgcttgatatatggacttgttatgagactattactgagtaatggagtgatataagttaaaaggatgtttggaataattttaggcaaaattcctttgtttatgaaatatgtaaaagcccattggttttaagtttatcactgtgctgtgttttgtttctctgagtactttttaagaataagcttttaataacatataaactggaaaattcacaaattatatcaaaagcctttagcatgataattcattaatgagttatcatgctaaaggcttttgatttataagttttatttgtggtcatttatgcaacttgaaaacttaaggcagttctgtagaacaggtatggcctttggctaaagaatttctttaataacttgaaatttaatatttcctaatcatctgcactgaatataagacttagtgaagactgaaatttttattgaatcataattgctcctaacattactttagtgtccatatacttggtatccttgtgctttctcagtgcaacttttgaatgcttaattaccaggtacctagcataattgaatttttttcggtgatattagcagtttattttctctgcccatatctctatcacattattttagtaatttttattctgaagcaggacaaagtgagtggtaggaaaaagaaagatagaaaatgaaggttgaatagtttggggtgccagtagatactctcttgcatgcataccaggtcgcttcagtcatgtctcactgtttttgatcctatggactatagcccgcgaggctcttctgtccatgggaatctccaggaaagaataatggagtgagttgccatgcccttttccaggggatcttcccaacccagggatagaacccatgtctcttccatctcctgcgttggcaggtgggttctttaccactacagcacctgggaagccccaggtaccgtcttacatgcttggtaaattggatttcaatttttttacttccttactggttataaaattgttcatccattccttttactgtgtagctttttcgtggttcccactgaaatgggccaagtgtatttccatgctccattgatgtcttaacttggacttacttgggccagtaaagtgttagtgaacagaggtcttaaatacactcttctgatttaacttggtctcatgcagccctgtgatcttccatgggaagagcatgccccacgtattcgctgaaacatatttttatagttttttctctatagctacaatgagttcaagcacaatttatagggcagagaagatagaggaaaaatatttttaagcagaaaagtaaactaggacatccatactggactaattgcagtattattccttaaggagtattattagagtctaaaattatcagccaagatttaacattggaaaatttcaagtgaaaagaagtatttcactaaatccagtgcattcttctagatacatatatatttttaaaaaacctaattgcgatttttctttaactagggaactattaccctgatgatatacctctttgtttgtaaacatgtaaaatactacgtgcaagtgcccgtgctcagtcgtgtctctttgtggccccatggactgtagcccgccaggctccctcgtccatggaattttccaggcaagaatactggagtgggctgccatttcctactccaggggatctttctgacccagggatcgaacctgcatctcctgcattggcaggcagattctttaccattgtgccacctgggaagtgtaaaatactataattccatataaattacagtaaaatactataattccatataaattatagtaaaatactataattccttataaatcagtctagacatgagactgaaagcccccagattagaaatctgttaagaaagagacttgacaaataggtctaggagatatagtattcatctgatcacagctccagagagaaagagaaaagaaccattggaagaaaagaattagtcaacatagctaaaggaaggacctagtgactaatgagaaataaaaagttaagacctattccggtaaaagttctgaaatccaaagataaggaataagtcctagatttctaccaacagaagttttggggaaagataagagggatctggactatggtaataatagaagaagtgaagagaacatgacagatttgaattctatttgagactgataatctgcagaatagctattgcatttgttgcaaagggatgtgatggaaagaaatgaatgattactagacttttggtttgagtaaatacagaagacatgtaatatttttaattgagacaattgtaaccattttattgtgtacaattcagtggactttagtgcatttacagtgttttgcaaacatcactgctatataatccatcaccccagaaggaaacctgtacctgttaagcattcagtccccattcctgtagtcgttcttggaaacctaatctcctttctgtctggatttgctttttctgaatatttcatataaatggaatcatacaacacatagcattttttagtctggcttctttcacttagtatactgttttcaaagttttatctgtgttgtagcatgaatcaagccttcattatttttattgctgaataatatttcgtcataatatgtcacattttctttattgattcaccagctaatgatgtttgagttatttcagttttgggctattttgaataatgctgctgtgaatgccctggtttttccttgaaaacctgtttcattgcctttatgtatacacttagaagggggttggactggattagatggtaattctgtgactaactttttgaggaactgcaaaaatgttttagacagcagctataatgtctcatattcccaccagcagtgtatgaaggttctagtttttccacatccttaccaacacttccctgttgttgttttaacagcatcacactgagtgtgaagtgatattgcatgtaatactgtgtgcttgttttttaaaaaaatttcccctcagttttattgagatatgatagacaaataaaaattgtatatatttaaggtgcgcaacatgatgtttaatgaatacgtacattgtgaaatgattgccacagtcaagctgattaagatatccatcacctcacatgttgaccctttttgtgtgtatgtgtgagaatatttgagagctactctcttagcatattttaagtatacaatatattattatttgctgtagtcatggtgtacattaggtctccagaacttactcatctaataactgaaagtttttaccctttgaccaacatctcccttttgcctctacccc

SEQ ID NO: 27252 - DNA, 1342 bp, Bovine  19866881142729
catcaactcttcagcactcagccttctttatgggccaactctcacatctgtacatgactactggaaaaaccatagctttgactatttggacctttgttggcaaagtgatgtctctgctttttaatatactgtctaggtttgtcatagcttttcttccaaggagcaagcatcttttaattttgtggatgcaggcaccatctgcagtgattttggagcccaagaatataaaatctgtcactgtttccactatttccccatctatttgccatgaagtgatgggactgggtgccatgatcttagttttctgaatgttgtgtttgaagccagacttttcactttcctctttcaccctcatcaaaaggctctttagttcctctttactttctgccgttagaatggtattttctgcttatctaaggttgttgatatttctctcagcaatcttgatttcagcccttggtttgttattttcaaaaatgatgccatatattcaataaatagctaagccttttaaataattctgaacagtgtttgttttaataaataatttaaataagaacaccaccacccccaatactgaatagtaactataataagttaaacagacaccaaatgatagaataaaccaagctaaaactaaaaagagtcagctggagaggtcagtaaagtccaactaaatatgggcctctttttccctatttctttacgatgagtggtggagctcctgttgggggcagggggagccccagcctgtagtattgtttcctggagcctcagaggtctctgttaccctaaaggctggggaaggaaatgctgatgggctgaaagtggaggagcccgtattagcaactgcatgcaggaccgaggcagattttgtgggatgaacagaattcttgtgggctgagtgttttttgaaacttctctccaagaatgcctgcgacttaaacatttctttactaaaaggggaggaggaatagaatgatttgcaatgttgagaaaaaaatgtttttcccctctagttctccccctccctccaccttctctcatagaggagcagaagaaaccagtggcaaggtaggtactttctaattttaatcttgaaacagccaagcaatctttccatgtaaatcaaacactagtcctctccaagttacagttttgctaagaaggggacatggggacagagctaagtttggacttccagtcctagaaacagcaagaatctggccataccccccagccctacccagggaccagttttcttgttatttgtacatgtgaatgatcttttgttgttgttttctgatgttgatgcggtttctgcttggagggtcctgaaggg

SEQ ID NO: 27253 - DNA, 943 bp, Bovine  19866881160977
cagaagccccagagcagactctgccctttcctgtctgtgctccgggataagcaaggaagttcatgctagtcacttcagttgggttttccctgggaggagggctgagccgagcagtcaactgtgacccctgggccaggctctccaagaagggtcgtccctgcactggctgggccagctactcagtgttgcagagcctcgccctcttttcccaccatgtcattgctgctaatggtcaaggtcaaatatatggccacatggaatgggccaggtcctctcaggctcctttgtggatgtgattttttttttaagaatgcaaacatgcaggtgccttcccgagaggcttggactggtgtctccaaccagaaacagataagctaatcagagtatgaactcaagaggagggatgtcagcagactgtgtaacagctggaaaacgtccacgtaccggcctttaggacaacccaggggatcagaactcgggatccctgctctttaaaagaacgttctccccttgggttgataatgcggtgtgttatgaaacttgtggagctaaagcttggacttgctggagtcgaagatggatcatttgatgtggttcctgtgtatgtgatgacccctgtcagtgaccttccagccttcctccccgagcgtgaatttgtagcatgattgtacaaatctctctgtagaaaatggaggtttcttgttctctgaagtgttaagctctagccaatcagtttctgtcccctttagcctagtgtgtccgaacttaatttctcgctatgtatttaaactttttctctgtatcataggttttgtggcatcccacggtcaggtggagaggaagctgccccttacagaactgtactgtaaccattttttagagaaacattattttcacaggactgattatacacagggcttgtaaaaaaatttttaacactgtg

SEQ ID NO: 27254 - DNA, 1805 bp, Bovine  19866881262488
taagggcaatttatgatgttgattagaaacagatgcttgtttgtcggtgtcccccagaagtagaacctcaggaaggctggagtcacagtgtgagggacaggttccactcatgtctccccagaagtcagctcttacagtccttggccccaggagatgggttttgtttggcatttttgtttttctttgttcagcattttgtttttctttttctctctctccgcttgtctggctctggctttgtctgtctctctttgtccctttctttctctgaaaccctcagttgctctctgtctgttttctcatagacgttagtgcaatacaaagtttgcagcaggtaataaatgcagaagacaataattcaaaacctaagttgatacacttacgaacacaaaccaactaggagaagaaacagcatttgctaggagagcaatattaaccctctttgtaaataaaggaatacccaagcctcccgtgattcagagtggctcttagctctttcttgcacatgggtctcaggtccaggtttcacagcagaactgtggtcagaggagggccacttccacctctccagtcgatgacctcagccttgatgtggtcatggatctgctctgattgtacatacatgaaagccatgagggccaggaaataaatgtctcagtctcctaacagggtggcgggagatagccactggttctggcttcattgagcctgtccaggtcgaccgggtagaatacttgctgagttatttgtgctctgttggtcagcagggtatgtgctatgttatcacgggaggtggaggaagaatacttggaaggtagcaagtgagaggaagcctaccggcttccaccgtaggatggttgtcactctttgggtaatcattggtgttagcactctcggtttcctgtcctcacaggcgcggtgtggctttattcacctccttccaagtcatgagcaggggtttagatgaaccaggggacagtaggtttccctgtgacatgaaaaggaggtaactgacctgaatctgactgttgcttctttctcaccaacaggtctacgacattgcatttagccgggcggggggcggcagggacatgttcgcctccgtgggtgccgatggctccgtgcggatgtttgacctccgtcacctagaacacagcaccatcatttatgaagacccacagcatcacccactgctgcgcctctgctggaacaagcaggaccccaactacctggccaccatggccatggatggaatggaggtgagaaccccacttcaggctcacctaggccttgcgactctgctccagcccggctttgtggatccaggaaagcggttctcagctgacggcagttttctccccagaggatttttggatccacctggagacgttttggattgtcccaactttggagggggtggggggtgcaggaagggggtggtgctcctagagtctggaagttgggggcctgtggtgcccaggaccactccccacaacacacagcacagcgttatcccaccccaatgtcagtagtgccgaaactgagaaaacctgatctagaataagggtgtgtgtcaagaacttggagtacatagagagctggactctgagccaagaacagcagtatctaaaaagtcaaccatatcattcatgcttctggtgccgagtagacgaacaggcagttttccctctgtcatctgggcagagtcttctagccttagtgagtagacggggaaatggccactgtatagcctattgtttcatagaagcagtcagctgtgggtgcacatgatgccgtgatgaatt

SEQ ID NO: 27255 - DNA, 1256 bp, Bovine  19866881349001
acaatcaaacatgacagagaaatctgtggtcctacaccacatatttcaagaaaagacccacaaggaacctagacttcccactcaattcaggctgtaatgaggtcaaagtggtgtccaagaacacttagcagagagccagacattcattacccaccaccacctctgccattgtcaacagagacaccaattaggaagccttgacttccactccaaccgtgtggaaatgagctgcccttcccctccgcacagtggacctcctactctgtggaatctgcagaacagtaatgagacaatattacccttcccccacccccgccccgagggtgatactggtctaagactagtggggaacgggaactcccacccttgcctggcagcagtaagaagtccagtgtggaatctggactactgtccccacccaagaggtatcagagaaagccagcccaaagagaaggttagtaggatccagagtctcataatataatatccaaaatgtccaggtttccactgaaaatcactcagcatatcaagaacctggaagatctcaaactaagtgaaaatagataagcaatagatgccaacactgagatgaccaaaatgttagagttatatgacaaagatggtaaagcaaccaacataaaaatgcttcaaaacacaattacaatagggcaaaaaaaggaagaaagctcctaagacccagaggagtgcatgataacatcccatgctttgagcagattctgtgcccattgctttgttaactgcttcttgcacattctttcattgaagcctccggtggtctcagggtaaaggctttagctccattttctggataaaactaagattcagagaagtcacttgaccaaggtccaacagttaatacccaggagggtttgaaggctgcgattcaaacccaggactatctgactcaaaggtcgatactcttaagccctgcccctctgctcagagcttcccatctggataagtgttatactatgtgggagttggtgatggacagggaggcctggcgtgctgcggttcatggggtcgcaaagagtcggacacaactaagtgactgatctgatctctgatgtggaatatgtctatttccttaaaacccccacttacccatgattgttcagaaggaatatgtatagaaagaagcgctgagagagcctgttcctgaaagactgcccccgccccaggccctccctgcctccaggagcacagctggagcccagagagagcttatgggggag

SEQ ID NO: 27256 - DNA, 2506 bp, Bovine  19866881382796
ctcctcctcctcttcccctccagttgtgacccaagtctgggcaccatcttacgtagattcctctaacatgtccccagtggcctgtccacttccattcttcctctacctcctcccccaccctccatccagtctctatcctacagctggagggacctttggctttgttttggttttggctacagcttataggatcttacttccccgaccagggattgaatctgggcccctagcagtgagaacatgaagtcttcacccccagaccaccagggaatcccctgaagggaactttaaaaatgcagatctaatcatgtcctccccctgaatggaaccttccaggggctttatatgactctttgaatccaacctccaaggctccttgtgagctgggcccacagcccttccgtggctttcctggcctccctgtgttccagctgccccatccccttcctgccctgaaacctctgtactttttgtcctttctgtcccagatcctttctgtcccatttccagcccagctcactccttagcaaagccagtatccttccctaaggaaaaccttgcctccccctcccccaatgacagtttctcagagacccggtgtttccgctccgtcgcacttatcagcatcagggtccactgttaagttctaagacttggggtttgaacccagagagtctcacactagtgcctgtgctctaatcatgatggatcccagggatactcaggggatgaaaaccatcaggacttggttttcatatggttgggctaggagggggcagggtgaaggaagccacccaggttacttgctcgggcagccagctggttgatgccaaacggttccctccagaaaacttgggaggaggagcagtttgtgagaaagccatgtggagtctgaggggctgggggactaccatattcagtgctggcttccaccctagattgagcaacacaaagcccagggccatgtcatcatccagaccacctgacccccatgcccagcggagtgcctgaattggaataggggtgtgatcattgtagagtccatgcgtttatgtgaccacggggctcagagcttcggtcattgctaatcgagctaggttcttttttgtcatgtggtcaaactgcttctgccggtctaactccctctgagtaaccaggacaggctggctgaagccagctgatgaaagtggctacattatttatgtctggaacaagagggctgtaagggcatcgacacccagacaaagagtcctctgagtctgaaaggagcatctgtgcccttccaacaatggacatgagattaataagagaataaaagcaattatactaagagaagtccccaaatggcaaagcaacaaagggttatatcacagcacatttattcatcttctatacacaggtcggggattaagaatcatgttacacgaagcaaaggacaggcagaagttcgtcagtgatgttcaatatctgcgggacatgcagcacaaggtggactcagaataccaggtaatagcaggaagtgagaattctcttccaccagcagtatgaggagagaatcggggaaacggtactggtatatgagaagcagtaacaggtttccaaaagccaaaccccacgcttgggacttccctggcagtccagtagttaagacttcgccttctaatgcagggggtgcaggtttgatccctgctctgggaactaaaatcccacatgtttcaaagccaaaaaaaaaaaagtaaaacagaagcagtatattaatgcatatacgtggaatctagaacaatggtactgatgagcctatctgcagggcagcaatgagacacagacatacaaaacagacttgtggacacaggcgaggaaggagagggtgggacgaattgagagcagagcacggaaacatacacactgccacgtgtgaaatagatagccggtgggaagttgcctgtagatcacaaggagctcaacctggtgctctgggacaacctagagaaatggggatgaggaggtaggagggaggttcaagagggtggtggggagcagcgatatatgtatgcttacggctgattcagcctgttgtacagcagaaaccagcacaacattgtaaaacagttatcctctaattaaaaatatatttaaaaaaaccagaagcaatattgtaacaaattcagtaaagactttaaaaatggtccataacaacaacaacaaaaaaaatctgtaaaaaaaaaaaatctcaaaaacccatacttaacagctgtgtgaccaatgaaaagctacttctcagagtctgtttcctcatctgtacaatggggataattgtacccgccccccccccccattatatcctcatggaaatgaaataacatttttaaagtatttagcccagggcttggcacacaaaccttatcaacaaatgatatcagggcttaaattggataaaccagcaatcaacaaaaaaaaagacattaaggagttaacgggtcaccctaccattttcaaacaacacacc

SEQ ID NO: 27257 - DNA, 1526 bp, Bovine  19866881392615
taaggacaaagattatattcataggtttactctttgatctcttttcttctttttaccttttattatcatttattctggtgacttgggggtggcgatgttgtagactaaacagggtaatattgcgtaatgcagagaagagtttaacctatagttaactagtctgaatgtccaaatttgtactgggcttgataagttatattaccgagatgatgattttatctaaatgtaaagtttcctaagattctaaaaactataatagcctctgcttctttctgttaatctgggcttcaggggagtcacagcctgtaaagtatgagatgggatgttcaggaacagtaccagtttgcaaagacagttgggaataaaagaacatcgtgcactgagggaagttcaaagagtttggtaatggctagagaacagcaagtagggggaagaggcaggatataaaagtagaaaagttggcagaggcaaaatcacaaaaggcataatcattattcatgatgatcaatctgacctttctcctgtaagtggggggaagaaaatgacaggcattaagcaggggaggagcacgatctgactagtgttccgagaagataaatttggaatgcatatataactggcactatggggtcacaggctaaaggcaaagagatagctgcagtaagtccagaggaaagaatgcctgaataaatgcactaattaagaatacagaggaaaagctagattcatggactatttgggacttagaacaaagactgtatccatttaaaagagttggttctaaccactggcattaattttctttctctttttcttctttaaatccattcccatcaggcatttgcccacactacttcaaaaaatttacacttaccaagatcccctataaagtccactgctaaatccaatggtcagttctcagttttatttttggactgattgacaacatgtgatgctgttaatcattctggagctttctcttcacttaactttcaagagcccacactttcctacctctgtggctccttcttcgtcagtcttcctggctttattctttctcatctccctcatctctaaatggtgtactgccccagggctcatttttctgatttgtactctttgctgtgtaattcccttgctcatctcaaacagatccatggttttatgtttcatctatacactgatgacttccaaatttatatctctagcctggacctcatccatgaactaaatccatatttatggagttacctaccctacatctctactatgaatatcagaaggacatctcaagatttaatgttttaatattcctccataaacctgctcttctcacaaccctcttcatctctgtaaagagcaacttcactcttttagttgctcaagtcaaaaaccttggaatcatccttaacccatctttttctctcacactgcacatacaagccaacagtaaatcctgtcagccatacattcataacatatcaaaactacctctcaccctttgctactggtccaagccatcttca

SEQ ID NO: 27258 - DNA, 1214 bp, Bovine  19866881485089
cacgcccagggggcaggaaaggctccagaaagatctagaaactgccatcagtgatctttatagatcattgatccctgtccttgatgccacctggccagcgccctgcccttctccccaactctgcctgtcgaagaactgcttcaggttcatatccatgaccagggagctgttgtcctgaaaatcagacccaggttaagtctagagatgacggtggcagtgatcttagtcttggctaggtggggcaacagaggcctcacagaagctgaactatcagattctctttcccctgggatggttccttcctcacaaggccagctgccccttttctgggcgaggttgacagagcggaggggagtatctctgacagtttgtgtccttgtttgtaaacgatagtctgagtttcctagccagcaaacctgatacctgcccagctctgccgtagccaagtggaggagccacagtgcagcggggcaagaggtagacagggcagaagaggacagggttcttgcctgggatggaacaggcctgaaaattggggccaaaatgtaaagaaaaaattctgctggatcagcaagattctttaatatcgtagttaccgatttgttcctaagctaattgacagtgaccctgtaaatgacaacccccacccaaccctcagactacctggtgtgcatttgagcactaagagacacttcctgaagggcctagctggactgaaccaaatggggacgtttctccactgatcccagagaggccagaaggaagatggaggctgaaggagctagggaatcattctgggctcttccggaatgacagcctgcctatttccttccttacaaatcagatgcaaccaaagcccccggacgccccccacctgcaccccaccccactcaggcgctaacagttctctgagaccgcgaccaggccctcagctcctggtgattcctgtgattcagaataactccagttcctgtgtttacgtttcgtcaagcagacagtttgcagcagccttagaggacctgaacgaggccatcaagctgtgtccaaacaaccgtgagatccagcggcttctgctgcgggtggaggaggagtgtcgacagatgcagcagcagccgccggtgcaacagcagcctccgcagcagcagctcccagaggaagcagagcctgaaccccagcacgaagacatctactccgtacaggacaactcgaggagg

SEQ ID NO: 27259 - DNA, 932 bp, Bovine  19866881523473
aaacaatccttccctctgcagagccaaagggagcagatgccaggcagctgcagcttaagtgcccgtgacagattaaaggaaaatgtgcagctggaaacagctgctgtctctggggctccaccctgagggaagccagaggacatactgaggggaaggggctggccgggaacaacggccgtggcgtcctgagacccggagctgtgggaggggcgtgagggttcaggccccatcagtgcagcctcccagcacagcgcagctgtccccccagagtctctcgttccaagccacacgtgtgtgaccgctgtggagggcaacagaagtagcggcccagtggtgccagtggacagaaattacagactaacagccgcctgccaatgcaagagacgtaagggacttggcttcaatccctgggtcgagacggtctcctggaggaaggcgtggcaatccactccagtgtttcagcctggaaaatcccatggacagaggagcctggtgggctacatgcagtccgtggggtcgcagagtcagacatgactgaagcagcttagcacgcaatcatagtgatgactatcacacatattctagtgctctccttgaaggaattccttcacaatgttcgaaaagggtgtgaactcagaccttttcgggggaattaaccctgaaatggagttttaacaagaaaaataacttcttggtaaaggaaatttaaaccatactacatccattgcctaaagtaaaaaaacatacaattaaaaaaaaaaaacacaactcttgtaaaaattatgaagagaggaaaaagatcagtggttgctaggtgttggggaaaatgggaaagggtgaataggtggagcacagaggatttgaggggcagttaaaacacttcatatgatactataagcgtagataataggttattacacattgtccacaca

SEQ ID NO: 27260 - DNA, 700 bp, Bovine  19866881594728
cccagcggggcccgcagaaccttgatgtgcagccccgggggtgggccggtatccacccctgcgggcagccctcactcagcctctgagaacacagtgggaggaggggtacaggggcctctgatgctgagcctgaggaggcctctcctaggagaagcaggggaggacctgccaaaggccaggaggctgggcagggccttcaggtgcaggaggggcagactctggcgggggccgattttgctcacctgactggttgtcactgaggaagaagccctgttggtggtcttgactgcctggagcctgttggggtgatgactggagaccaccgcctgccttgtggggaacaagagcatcaagtaacggggaccacagccgggactgggcctctctcccctcccccaccctcgtggcaatgaggggagggtggttgcaggcggctgggcacccccagcatgctcccagcagctcctctcctgcgtggactggcagggatgcccaggggcttggagccaggcagaccccagggagtcctgcgagaggctgccttgagcagcagcgtgggggtgggggaggcaggggagctttctctttccttttcctcagggctctgggacccccgccctcagcctgggccaacgtgacaattccccctgaggggtggaagtctggaagtcccaatcccttcgggggtgccccatccatg

SEQ ID NO: 27261 - DNA, 1046 bp, Bovine  19866881666244
tccctgcacacctgttgccaggttaaacaaccaccgagcatgcgtcaatggcattgcgtgggccccacactcatcctgccacatctgtactgcaggtaattactggaggcgggtgatgggaagggagggaaggggaggttttcctctggtctctttagcatcgtaatcctcactctatcccaaggaaggtttgagagatttacacagagtgatgccactgagaacctccctacactagcacagctgagacagtctgaactcccagatgatctcataccctcagcgacaccagagaatctgtgtactgtctccatcatatacagttacaggctcatgttgcccactgtgtgcccccagaatcctggcttgcacaggaggtgcatccaggagtatgagaaggggcagtctccttggctgtaacctctgccccgccgcccccggcccctgcactgagctctgggtgccttgacgggccctaaagaacctgactggatatgcagcatgtggtatgtagttcccatttcaccatctgctagaccccaagagtaccccttaaaaatgtggtggccgtcagagttcttttatcatagaaataatgtctggtattaaaaattaaacaacactgaaacaggccgaggtgtatgaaacaggaggatgaaaggcatcttccctccttcctttcccgtttctaccttagcaatgtagtttggtggtttggggccaattcagcatgaatttgaaagcatgaagcttttcctgtggggagcctgctcatgcctgtccatgttgaggagcagccagaggcccaggcccacccacttcctccgagcctcgctgtggcctgacttcttcactgtggccctcgctgatgtatgcatgtccatagcatgggggaaaatcgcattaaataactgaatcatcagagaggcatctttaacgactcgggtactttaagtggctgaagatgccatgtgtgggatcccattccagctttcttccctgatgtccacctcaaaggagatgaggtgtcggtctgagtccctctg

SEQ ID NO: 27262 - DNA, 897 bp, Bovine  19866881895123
gaccgggaggagagggatggttttttgggtaattcgagcgccttacatttattgcgcactttatttctaatctaatgctgccgctgatctgacaggagataccagtccatggcccggaggttggggacccctggtttaaatcactccagaaatacttgttccccactcttctctcttttcctcaggtggctttagtctttgccagagcctgaatccccacccagaagcatttcagacagcttcacatgcacctgggggctccccatagaccttgttctgcttgggggctcctgcctgcccaggggagggctgggggactccgggtggctctctgtgggcaggaggaaggcttgggactggggtcatctgcctctggcccccggccaatgctggttctggtagagtgcgtgggagaaactcctttctttctgctcatttccatgcaataggccttcagcctttctacattccatctatgatgccctgagacccagcccctggtgcctgggcacagggcactgaatccaggctccaagcccagccggcactggtggggcgaaaaccggctcagctctggccacctggcctccgggacggctcgctgaatccatgaatgaacgggccactctccagagagtggtgtcaggccttctcacaacctcttcttgtcagatcagagatggcttgctcccaggtgtcctggcggagctggcctggcccagcgggcagcactgcgaggccgcaggggtgaggagccggccagccgcaccacatggctctcctggaacagagctggccgggccctgccaagctgcctggagcactagggcaggagtctgtggcagggacaaggtcaagaactgcatctggagggagaggcagttcccgagaaaggcg

SEQ ID NO: 27263 - DNA, 1198 bp, Bovine  19866880200765
actctgatgctgggagggattgagggcaagaggagaaggggatgacagaggatgagatggctggatggcatcactgacttgatggacttgagtctgagtcaactccgggagttgatgatgtacagggaggcctggtgtgctgcaattcatggggtcgcaaagagttagacacgactgagcgactgatctgatctgatttgtagttttaggttttggggaactctgtaatctgccccgggaaagtgcttgcttccctttcagccaaaggcgccttgtttgtacttctttacctgctctaaccctttgctctgcagagagcttcccaagactcagttttccaaaggagactttggcaaggcttgggataccctactcaatgtctgcagacaagaggagtgagacaggacaagaatttgaggctctgactttcctaggatgtttaggaaagagaattctggcaacaacacacaggaacacagccgagtgctcaagtttcagtagttttggaaaaaacacttgattgaaaaggtgcagagatgaggaagcacaaaggtgagctggagccatgagtaattgcagttttcactgtgacagtcatctcaggttctctccttttgtagccagcagtttgggtaatagacacggtattcgagccacaatggatgaggtaagggcccatttccaattaaaaaaaaaaaagctattcccaagggttgggtcgacttaaaggcttggtacaggctgttggtgccaatgcaaactcttgggactaaagctgttaccttctaggccccatcaaaaaatatattcagcgttgaagttttttgaagtgttcaattatgattctctatgaagtgcttctttgaatagcccatgtgcagagtgtgagttaatggggctgaggtaaactagcaggggattttcttgcttttccatctgaagaaacagagacccatccctcccctcctaattcttacaatactgactctcaggaccgccccttagcagagaatgccttagactgagcttggaatgtatgtgtccatgtaaaaagtattacttggtacattttcagaattctcattcttaagtgaagttcggttcctttcagcttgttttatttcttttttgaagtcctaagttaaaagaaccccattagagcagcatgggaaatagatgggggaaacagtgaaagcag

SEQ ID NO: 27264 - DNA, 1660 bp, Bovine  19866880397150
acctaccctgcataatgcataagatatcttattataaatattactgcaaattgccatctggacgcttagggaacttgcgggacatttaaaagggaagcgggcatgtgcccagcatcacatcagtgagcagagtcttcgcttcggttgttgctgctgctgttttatctaccaggaacctgagcaggtgggtcccaccctcctcacctaaagccacccaagagctgcccatcctgagagtggctacttgcccagtccctctccctccccaaatccctgccatgctcctcctctgtgacagcctcaggtacctgtgtcacaggagcccatcctgcctcccaagaacacaaagggtaccatcacctactgctgacctggtcatcagcagagacttctctcttccccttgagtcgatacaaagaaccagttttcactcaaccacagttcaatattcaaagctcccctaaaaaggggataagagcttacagtgtaacccaaagaggggaccattcgttgagtgcgccttcctacaccagtaagtccttctcttataccactatgacaaatccatccatttgggtaatcttaactgaacatctattactatgatccaggtatgatactatctgctaaggcacagacatgaatagaatacatccccctgttgttaggacattcacagaccaaaagcaagatgctcacacaaatagagcactacaaaacaaattagatcggaggtccactttattctaggtgcagtccgaggagatgagaactgtatgcaacaaattcacgttcaaggtcagtggggatgcaaaagattctgtgatcagttctgctcccacagggaaagggtcaaagatggctgcacagaggaggagatgcctgagatgggtcttgagggatgaataggagtttgctaggcagacaaggagaaagggcattctgggaagaagggctgacgtgtgcaaaggctgcagtcaggtagctgcagcacacagagggaactgcaggtgggtgaacaacatgaatactttaagggtgagacgcagcctcgagttgtgcggcatgggccgggggagggggggggaaggcaggtacgtgtgttcttcctttaagaggtcagtgtgtttccacttcatctgtgatgaatgattctcacagagtctttgtgaaggtggaagtagatggaatttttctcgttctttcacagcagaataactggttcccttgcaggcccctcttctcaacctctgttaataacccacccctcaccagagtaaaatattgactctaggataccactgcattcaaaccttatggatcttcctagcaaccaagagatcaccgtcaaactcactccatcctgagatacagatgtgaaagaaaggactctgccaacaaggacttctgaagccctatttctcccctgaagactatacactggttactgaaaatcctgatggtttttctatgcagagagcaagtgacccaattagacctgcttcgtagagagttgcaggttggaggcgcttgggagctgcatgctgtgtgtccatgagagacatcacaaggcaacgacagactaagcccagttgtattcccaaagtaaaatatcttgttgccttccttcatgcctggcaagtgtgccgagcacaaggca

SEQ ID NO: 27265 - DNA, 2924 bp, Bovine  19866880410650
acccctgaagaaatgtagggacctggcccctggcagccctggcccaggaaccaagtgaagtatttccctgacaggtgccaagcatcgtagaccctttgggattgccactggagtggatatcatagatggagaacaccaggctggccaaggcaatggatgtcaaaatatgcaggactatatgacaagccttatcgcccaacttaagcttcttttagcttttgcagccagtttcacagacacgcaccatccacagtggggtccagaggaccccagtgaatagtgagatctcaaggaaagtgagtccgctgagcggagcaggaaggagtacagcctctagacacagtgatccaagtgaatgctgcctccactgcttcctaacctcctacacctcaggttcctcttctgtgaaatgggataacagcagtccctcctattgctttaggttgtcatcaagatgaaataagtccatctttaaaagtgctgccaacaaacctgggaacatgtaaagtgcctcataggtgtctgttattttgtgtgtctggatttcattcccagagtgaataagccttcataataaccagaacgatagctcacacgtatccagtgcttttgacatgcaggcagtgaactaagccctctaattggattactgtacttatttctcacacaaacacccacggcggtgtctgctattcctgtgcccattgtacaaagcagacgagaggaacgttcagtaaatgacacctagtcggctgactccagaacccaaactcctcaacacgatacgccagtggcatgaaaagcacccagagtctcctaaaaaaggttgatgtggggcttccctggtggctcagtggtaaagaatctgcttgccaatgcaggagacacaggttcgatccctgatccaggaagattccatatcccagggagcaactaagcccgtgcaccacaactactgagcctgcacgcctacagcccctgctctgcaacaagagaagccaccgcaatgagaaccccacacaacaacgggaagaggagcccctgctctctccacctagagaaaagccttcacggcaacgaagacccagcatataaagtaataaatataaaaattatattataaaaaaaggctgatgtggggccctatctcacaccaagtattgagcccagatgcacctgctcttgagaggcctccagggcagactgagccttcaggaataaaagcaaggggtatccaggggggctggtgctgtcaaggctgggtcacatggcctcaatatccccccaagaataggaggctgcccaccataggcaactgtgccctctgcctaccctctctgaaggcagcaacccctcaaaggagttacatggtcagtggccgtcaattttctttctgcaaccttgccatctgttgctgctgctgctgctgctaagtcgcttcagtcgtgtctgactctgtgcgaccccatagacggcagcccatcaggctccaccatccctgggattctccaggcaagaacactggagtgggttgccatttccttctccaatgcatgaaagtgaaaagtgaaagtgaagtcactcagtcgtgtccgactcttagcgaccccatggactgcagcctaccaggctcctccgtccatgggattttccaggcaagagtactggagtgggatgccattgccttctccgtgccatctgttactctgcctaaattaagctaatactaagatcgagggcaggaggagagggggacgacagaggatgagatggttggatggcattaccaactcaatggacatgggtttgggtggactctgggagttggtgatggacaggcaggcctggtgtgctgcggttcatggggtcacaaagagttggacatgactgagcgactgaactgaactgacagatcaccctactccacttattttgttttcttttttgtaatttttttacgatagctctttatttcttttggccacatagtgcagcatagtgcacacagtccctagttcccagaccagggactgaaactgcaccctgcttctttggaagcatggagtcttaacctgtggactatcagggaaatccccgctcttccaattcttgaagctaacatttcttaaaaaaaaaaaaaaattaaaattaaaaaaactccaaccagaaatactactaaataaaaatcatcagctatttaactctatatgcacacttacttaacaatttgcatatagaaatcaagactgctaaaaattaattaccaggttctgaatacttcaaacatgtatgggaattatttagagtaaatgaacttcacagaacaacaaaacagtaacaaatcaagctgtcggtgtttatttaatcaccaggacgcatcttgtttttgaaaaacagcagactcaggattgaatggggataaagatggtgatggagcgtgccacttccatgtaaatgctgcctctccaatatgctctttccagcacccctgaggctgtggagactgacaggcacccacacctgtactgggcagggcggtgcggctccactttctagaggaaataatcggagaccagaataataagtagtattcgagaggccctttaatacggtgcagggaagccacgcaggggagggggtagtggcagagggctgagagggagcgacaaccctgaccaggggcagaagcctccttgtcaaggtgctaatggtttctacagactgtgctccaagtttctctctccccagcgcatgcctggtgataagactctgcaatccccacaagatgccaaagccctgccacctccgtttctatcaaatacctgcaggactcatgtggattcaagcaagacagtatgcccaacaagtacccatggaaggttaattgcatctttcctgcccattcataaaaccaatcaagtgtc

SEQ ID NO: 27266 - DNA, 1330 bp, Bovine  19866880417885
ccctcctccaccaccgttcatgcccaaaatgagacactaggagcaaaccggtaagtccaacatagctaatttacacatcctgatcatttgacatgaatgcactaagatgcgtccactagagcagctgtgaaaagagtcgtcataaaatcacaggccgcaaaatgttatcagtcagtgtccctttctcacaacttgtattcagtgccttcccccattccccggcttctctgggatgctgaaggcaaggaccctcactctgcattttcaccaagaaattgatttcccttcaaaagagggatggaggagaggaagaaaatggagaaggggagagaagaactgaagggggaaaagggaagaaaagagtattttattacataaagcatcatcccaacagggggatgacaactgagacagtgacatcacccaacctgcagaataatgtactattattctaattcaccactgaggtaactgatacagagatcagtttgatatgaattaattcatgaggaaattgatgttgagtaacctgtccgtggtcacacagctgataagtctggatttcaatctaggtgagtctcacaacaaaggagatacttggagccaccacaccactcatgagaagagcttatgatgggggataaaagtaacgattaccgtgccaggcagcagcacacagaacccctctgtccaccctccctgagaatcatgtcacccataggacccccatgaagacccgccttctgtgaagaaaacatggtgccaacagaagtcaaagcgaaatgcttggatatgtgtataaacttatatgatttttataatgaacacaaaagtcaaagtttccttccaagtcaatgctgatgtccagtgaacttaactttctctctttctctctctgacataagaaacaacgcggaatgcctgagccttgtggttccttctgtgagtgggttttgtgacgcatgtatacggtgtcactgggcatgttcaggatacctggtggtgccatgggacaaggcaaggcagcacgagcaacagacctgagaagagtcacagctctcaacagagggacaagacaccatgcacagagaagtcttaaccttctcgtccattaacatggccagaatttactaaaatgttgtaatagtgaaagctcttgggttctatttaactgtaattgacagaaattattcatcagacatttatgaacgaagaagacagaatcacttgagaccagttccataaccttggaaaataagaggatataaaaagcacaataaaaatcaaatatttctaggaaaaaggtatacttaaaagagttctaagaatt

SEQ ID NO: 27267 - DNA, 1696 bp, Bovine  19866880430242
catgagctcagggaaatctagatccacaaacagtgtacagggcaagaggcaggctgcattaaatacactggcatgaggctcccaaaccttcatgggattgaactgaaggccagaggacatcaggtgaggtggtctgtccaagtgactcggagtacagcttgcctcagatcccaaatctgccacatcctcactgtgtgaggctctgttttcctttctgtaaaatggcataatagtacccaccacatagggtcattgtgagggctgggctgatgcacacaaaacactcagcacacaatcaataactacatggataagaggcatagagcagcagcccaaggaagaccagcagtcgtgttagcatcattgggttggtaacattagttttgttctgctttttcatattcctctgtctctctgtcagtctagaagtttgtacatgcaagtaccctattcatacccatacatccatacatacatgtatggatatgagagttggcctataaagaaagttgagcactgaagaattgatgcttttgaactgtggtgttggagaagactgttgaagttgttgagagtcccttgggctgcaaggagatcaaaccagtcaatcctaaagaaaatcagtcctgaatattcattggaaggactgatgctgaagctgaagctccaatactttggccacctgatgcgaagagctgactcactggaaaagaccgtgatgctgtgaaagactgaaggaaggagaagaaggggatgacaggggatgagatggttggatggtatcaccgactcatggacatgagtttgagcaagctccaggagttgatgatggacggggaagcctggagtgctgcagtttatgggattgcaaagagctggacatgactgagcaactgaactgaactgaaccccattcactcagtggttcaacatctgctaagttctagactcactaagcaatggcaccccactccagcactcttgcctggaaaatcccatggacggaggagcctggtaggctatagtccacggggtcgctaagagttggagacgactgagcgacttcactttcacttttcactttcatgcaatggagaaggaaatggcaacccactccagtgttcttgcctggagaatcccagggacggggcagcctagtgggctgccatctatggggtcacacagagtcggacacgactgaagcgacttagcagcagcagtagcagcagcagcagactcactaagagttgcctggcccctggggaactaatgggtgaatgaaaacacagtttagcccagttcagcatttcaggccaggggattaggggaagggatgccaagctgaatcagatcaggatggtcttacaatggacccttgtgagctgcttgctatcccttggggccttcattgcctcccttggcaccaccacacctcaaatcatcacatcagtacatagctaccttttcaagtcttcccattttataccctgattatcatgcccctgatattcagtgttcacaggcacttaatcaagatgctgggctggtttattacaacatcttccagctgatatatttcctcttatctgggaactccaccatcgtgcctgttagtgtttaaaaagatcatttcgaggtatcatttcgcttgttcccgatgataattaattttaagaacttatcaagatgttaaggg

SEQ ID NO: 27268 - DNA, 1086 bp, Bovine  19866880433924
ttttcttggctctttgaaagttggataatttcagattatatcccgaaagttataaatgttaagctgtgagaattttggaatctgttatttttaccccatttttgttgcttctttgttttagtgaatacttttcttggatgggcttgaattgcaaattctattttgagggcagcagctttggtcttaatgcagattctttgtttttagcttagctgctctgaatctgttctgtgcctgagtcactcaggggttatacagagataagaggaaacagagtttatagatccctgatctggccctttccctttgaggatccttcctctctttagcacctatgagtgcccaggctcacttttctgattccccagggtttcatttgtttgtttcctgcaaccccacctgtctctgtgcacgcagttcagctccacactaatagccttggagatggggatttgtgtaactctctggctcctcctccaagctagcattccctcctcaccagttagtctgctaacgttcactttctggcaccttcaggcagttggcttttctattacgtccagtattagcaggtttttctcttcaggagaaagggagctgtctttgtcatatcagaagcggaagtcttctttcagaattccatcaggacactgaagagtagaaggatccaatgttagtgtctcaggctccagactggcatagtcctctacttgatataaactcaccagtaaatttccttgtttctaacactactaagggcaataggatcagatcacttctttttctacagaatgtcaagactcactggccttctgaataagcagcctcaaagtaacatacctacactttgtggaaagtttttggctttcggatatgtttagaagggtatgagttaagtctggcaattaaattttcttgttccatgagtaggatacttccctggctcttgtcaccagtattctccaggaaggataatatatatggtcttatagaactcaaacatggagaaggcaatggcaacccactccagtactcttgctggaaaatcccaggacggaggagccggtaggctgcagtccctggggt

SEQ ID NO: 27269 - DNA, 2781 bp, Bovine  19866880519839
ctttatttagctctaactatgaaggttacacagcttagtaagaagcttctctacaggaacattgtgtgctcccatcagatgtgtgataccagccatggtaccagtgtcacctatctaatattttgaagtgagaatgtactttctcttccaagtcatctgtcatggagagcttgaggggtagaaaaacagcagtatgctttccttgtggttctaaccagtgggtgggcatatgaactcctttggtgtgcaccttaacccctttgctttgagttggaggacctttccttgcacagagaacatgttgactctcttattagttaattatttaagttggccccatgacccttccctctcaaggtctgaaagccactcctacattcttgtttctcggctcatgtacttctaaagtttttagaatgtatttttagaacaagtatgcttataagtaggtttttgacattttcaaatattagaattggagcatatttttttctgtatcaaatgcacaatggcagaatgtacccttaatttcaaggagactcattgaaaacttccatcttgatgcataattaccacgagtcaaagtggtcatgattagtcagtcaagcctcacaattaaaatcctctgtttgatgaacttctgaaataaaatgccattatcatctaaaacctcaataatctatgataatgaggctctcgattaattcttttgttcttcacaaaaagattaataatgttcatatttttttttaagtatcaacatctgcaagaggcaaaccatataaaccatatgtaactaatctcttccaaagggagcaagaaacagattttggcatatgttttatggacagctagtattgccctacaataattgttcatgctaattatctttcttgaattgattacgtttgcaataaattattatctttatgattattgttagtttcaggaaaatgttcaagaaataaatggtggttagtataaatgaccttgcactaagctagtatttcagataaatgccacattaagtggataattgctgtgatctgatttttacccttcacagctacttctggtctagctgctgctttagaaatcctgagcacccaggtggaattctacaagtattaagaatacatttgaacagcttagataagtcattaagtttatgtggaatattgtcctggacattatcatgactttaacttaggtggccactagtgactatagtgatgacctttatttgttccaaggtaatgatccatcatgaaagccaaggacagattatatcttcatttacctatagggcccatggctaaaaatacaatatgtgtgttttgtgctcagtcgtgtcttactctttacaacccccgtggactgtagcccaccaggttcctctgtctttggatttcccaggcaggaatactggagtgggttgccatgtccttttccaggggattgtcccaacccagggatcaaacccaggtctctcttattgcaggcagattctttatcatttgagccatgagggaagcccgatggaagagaagagattcccaaatatctaaaattcttcaagacctctgtatagacttacttgaaatatatagatagatagatagatagatagatagatagatattggtatcagctttcaccttctcacaccttctcactgccaacttcttccaaagaacatgtccccagggctctggcttttgttgccatagctctgtcattcctgggacgtcatctgtcacgtgattgtcgcaggaaatgctgctcgggtgcctccctctgggcagcttgagccggggtttagcaaggagactttgaggggcagagcaggctttgaaggagtcttcgggctccaggcactgcgaggggatagtgctccatcgtgggaaagaggaacaagaggcacagttaccattttcatcatctcagtcatttgggggatgagtctggaaagcacccagggaatccatctgacctgaaattctcagcagaaaatcacgtgctcccagacgtacaaggatgccacccggaaaacctccttcagagccacagggcccggcttccacatgggcagctggaccgagccatctcagatgctcagaggcatcagagcttcaggagaaaggcccgagggagcacaaggaagacggccctgtgttctcagcacagcgggatgcgagagtctgcctgcctggagctggatccctgcctgcaggaggaaccagtgtgaggaatccatgcttagtccacagcagctggtggcgactgcccagagccacccctggccaagatgcgggctcgagcagacctggagcatttaaggatcttaggatccaggggctgaggcatgagattgtctagcatctccacagtggttacagtgagaagatggagaggctgtggatgtgggggaatgtggatctgataagtggggatccagtccccgctcctcctgtatggcagtgactacataccatctacaaggtcaggcagcctcttctgcttggcctcccctcacatattatgtcaggcaggaattgtcaagattcccattttgtagagattagtgagacttcagttaggacaggtaggtcacattgatggtaagcaacagagatgaggttcaaaataggtctctgactcagtatcccctgctggcccttacatagactgcagagcatgaggagaaggcgggtggtctctctaatctacagggtcccctgaaagccctggctgggacatgggagcctctgcatcctgtga

SEQ ID NO: 27270 - DNA, 1307 bp, Bovine  19866880552049
caaaactcagaaaatcttgcaactaaagaaccaaatgagaaaaccaactgctcctgctcaaggaccctcccctctccgaccctagccttaccaatgcttagttcagcgtgctggaagaagctaatatgaaaacagaatgtaatttaaactttggtgcttcggagggtaattaaagagttgggctggactggagttgtctttggagcaagccagcaggcctctcagaaatggagacccagtgccggccctttcaaactaatctccttcagccctcctaggtgctgtttgtgcataattacttaatcagagcagcagtggatcgatgcactcagagtgtttgcaattagcgtcttctctaaaaggccttcttcagggcagaattagatgctgagctggatcgacacaaggatgccttcctgaaccgcgttgcctagggtccagcctcctctttctaccctgccatcctcatgctgctgggagccttcagttacacgtagtcttctcctccccagtagggactgggtcccttgtgctgctggttccctccagccagcagcaagtgcaccagtgctggcagggggagtgtgcaaggagcacagaagagcgggtgctgcactccagggagctcgaaagacaggaaggaagagctacaattgctccttgggctacagttttggggtgctgatcaactaggactgaaataggtgagggttgattctgcttagtatggttttaggaacaataaccagtcattctgctttaaaagaatcctggggaggcaggagagagtaactcagctctggaggatgacagcactgggctcagatgccatcctagctgagactggacaggggctttcccaatggtcagtttcctcatgtgcagaatggaggtgatgacaggaaaagtttgcagctttatgggaggattaggctagaacagatttaagtgttcagcactttgaaaccactggctctgagattatttgtgtctgtggatccaccaaatgtaaaaggatgggactccagatcatgagcatggtattttcacatgaaacgatccctgaagccagctagtaagacaagattcctctctgctgtttctcagaggttaggcaacatctccaaggtctacaaacccaagtcccctgattcgacattcacttggcctactcacaccccagatgcctgcacccgggggcactctggccccatatgcaagagagacactcttccccaagttaaagaccacacacctgaaacaaaggtcagaaccacactcccgaccctgaatacaaacaggagtat

SEQ ID NO: 27271 - DNA, 826 bp, Bovine  19866880567032
attttataagtattaaaaggactttctcttcaaggggtgtcaatctattacttataatgagcaataaacatatcggaaaatgtgttggatgaaagaaagtggtaataaatggctttaaattaataggtatttcatccagcactaggcacggagtattgcttgcaaatcaattaaaggccaaaggagagctgaatcattgaactctctctgggtttttgctcacagaggttttcctccaaatgtagtttatctgggaaatcatgagttctcaggtctccaaggagaggcagcttaaaattcagctgggtggtttcatgatgtctcaaacaggctccataaccttcatgatatacaaccttggaatttgtgtgcacctcgtcttttctctgaggcagagattcaacatatttgaactgctgaggtggagaaagtgacttattaatgtttcttagcctacgactgtgtctgttggcaaatgttaggggcagaaatgtgacttgcgtgccctaggtaaaatggtgttcatgagccctcctttgtgactgagcaagtgtgtaagtgaagttttatttcctgcagagaagcaggtgaatcagtcagcacatccacatcactggtgtctctgccctgggtggcatgccttggggttaggaagaaattctgtcacaatcaggcgaaatatccaaaacaagcctgctctgtgatttcccatgaatgctcttgttttctgagtcctagctttccccctgtgagccctacttatgacagagggaagattcaccaatgggcaatgcttgtttcctctttaatttcccttttgtcaggg

SEQ ID NO: 27272 - DNA, 1888 bp, Bovine  19866880574145
cgtctgactctatgtagccccatggactgtagcccaccaggcttctctgccaatgggattattgtggtaagaatactggaattggctgccgtttcctcctccagaggatcttcccaagccagggattgaacccttggctcctgtgactcctgcattggcaggcaaattctttaccactgagcctcctgggaagccccatgatccacatagctaacaacacatattgattccctacagcatgcagacccttgcatgcttttgttacagaaacaattcatgaagtaatcaagtacaaattgggtataagctaaatatctggatttactttcagcaaaattagccaacgatcctaatatttcttagtattacttggtattaattatatatagcataatatataatatatatatcagactttccaggtggcactattgataaagaacctgcttgccaatgcaggagaaaggagagactcgggttcgatccctgggtcaggaagatcccctgcggaagggtttggcaacacactccagtattgtttcctgaagaatccgatggacagagtggagcccatccatggggtcataaagagtcagacatgacttaagcaacttaacacacacacacataatatatgttacttggtaatattcttagtattatatccgtaatataccactgctgctgctgctgctaagtcgcttcagtcctgtcggactctgtgtgaccccatagatggcagcccaacaggctcccctgtccctgggattttccaggcaaaaaaactggagtgggttgccatttccttctccaatgcatgaaagtgaaaagtgaaagtgaaatcgcttagtcgtgtccagctcttagtgaccctatggactgcagcctaccaggcttctctgcccatgggattttccaggcaagagtactagcacagcagtttccaacaaatcagtcagccattcttttgctggttcctgcagagcacagttgtgaataagacatccatttcacctgagcagtcttctgagggatatgaagcagataatagcaaaaaaaaaaaaaaaagtacattacagggttattgtgtggttagactatgggaggtccatggaactggaggatcatagagagatgcacctagcctagcaggagtgacagaagatgtgtggtagaaatgacatcacagtcaagttctgagtggtgaacaggattcaagagaactcaagtgagctgggtgaggactgggaaggcacatagagagtgggttctgggttcttgacaatgagagcatgtacataagttccgaaggccagcaagagtatggcatgctttgagaacaatactggatgttagttcagtggggctggaccatcaggtgcagatagtagctgagcctgcagagctggaaatttggcttttgcactgaaggtaaggagagccattacagtgttgggaggggagggatgtgctcagacatgaatgttagaaaacgtattgagatagcagcgtgaactgccatggggggagttgctggaaatataacctaggacgaagaatggcccactccagacactcttgcctttccatgttccctgcaagtaaaagcccatctgggaaccaagctaacagttgaacaggattttcaattattctggagcaatgctataatctacttcctatgagaagaatgctgtttgccatggctgaaaatgctcaattggtagttctctgggagaaagtactcaatttgcaaaaatttaaatacccacagagtaaaaacaaaagcagctaataagaaatatgtcactgaaattgaacagaagctagaaaagtccaatttcttgttttactttatcttttcaaaagctggttccacagccattta

SEQ ID NO: 27273 - DNA, 1205 bp, Bovine  19866880606005
tacatcttgaagaaaaaatattttttaactaaaagcacgcaggagtgggtctgtccttttcatgtctgagacaggatagacagcctggatgacagaaataaaatactgagaaagggtctcacagttcagcttttattaaaattaaaggaacataaattacaggaaactagaacacgagtcctgttaaaagaatacatgtgaggaactgttttcctcagctagcactgtaaccgatggagcaggtgacaagtgttctttcataagctctgtggttcctaccatccaagcagagaacacccgatcaagggcctgactcatgcagtgtggtgtacagggcgtcagggatcaagtctgcctgccaatggacagccacatggacacagcacccacacagacataacagattcagtgccttgaatttgctttcaaagaaagtattttacacattatgtacgaattaaacaagaagtccaacaaaggttcttattgccactgaaaaggggataaaataacttgaaatctcataaccaaaggtgacaacgtagcaccggggcactttgctgctccaaatgctccagtcccatgaattactgcttggccaatgctgaatctgtaagtcatgagccccatgacaaggggtgcacaggggctctgaggttgtgattatccactatggaagagacctctgacactcccaaatgtcagaggtgccgcgagctctcctgcttgggcaatagatacacagcatggctgaatatgaggggcttaggactctaaatagtgcaaaaacttaaaacaaaaaaaaatacattctaacctcctcgcctctctcggcaaacagaaaaactccagctaattggattatgagtttgctcagcttcccaacttgatccaccaaggtacgaatggggagcacagaggcaagtcaaatggcacctgtcccaaaaataataaagattctttacatgagactaatcgccagataaatacacaaaatagagcctggagtgtagacacagctcaagagacgagtaagttgtaagtatagtatgaacatctgcaaagcacacgctgatcacattcttagcagggtccatgaccactctttgcaagttccttgacaagatgctttctcaagagacatacatcatccagcagcaaagggcttaggcctgaagctctgaagaacaaagatataggaaaga

SEQ ID NO: 27274 - DNA, 870 bp, Bovine  19866880613002
aaaaaacacttaaatatagtattgagaagaatatagaaaaaatatttagtaacagttaagatttcttgagaattctcatttttcattctcaaattggaaaattattatcagttgggaatttggaacctgtgccttggaggtcctctcctagctttggaggcaacctactttcaaaagatggggagtcccttagccctcatatatacaggagagccctctacccacttccctgctgtctttagacatttttgctaattgtttttcaagtctgaattagaatttctcagtctattgaattcgtgctgcttaaaccacatgctatttttgtcttccagttagtgctaataatttccagaaataaaaggagaaaattctgaaggtccaaattaataaattcatgtatttcactgagcacacccatgtcccaagggtcaaccatgtttccaagccccaggatcacaaatatgattaaggcccagtcactctccttgaggaacatgcaatttgttgtggaagatagacacacagtgaactgctttgtgctgtggtgaccgtcacagttggatatgaacgtgattaacgctgggcttccctggtggctcagtggtgaagaatctgcctgcaatgcaggagacatgggttcaatccctgggtcgggaagaccccctggagaagggcatggctacccacttgagtgttcttgcctggagaatctcgtggatagagttgcttggcggaccacagtccatagggttgcaaggagtcagacacaactgaagctactgagcatgctcagatgcacgcacatgattaattcttcttcgggtagggctcccagagggcaaagaaactgcatgggaagcagtcaat

SEQ ID NO: 27275 - DNA, 1744 bp, Bovine  19866880624605
aggtctgagaggtggaggccctttaagatgcagcctgaggatgtggctgtcactataagaaggaaggtcactcagtgaccctactgcccttggatcctgctgcagttaaccagctgaaagggaaagaaaaagaggctgtgaactgctctcttcattaggaagcttttcctggtatatccttattgtattgatttaattcatttcaataaatatcttcaaggatttcctcagcaactggggaaatgatagcttgttacataataggagtatctgattaggactcaggaaacattagtcaagtctcagctttactttgtatttttctgataccctctgacagatgatgtgatttctctgagtctcgatttcttcatctgtcaaggaaagctaatgatgccaagggtgctgggaacatcttcgttcagtttctgcacttaaatgagggccgattgggggccagtgagcccttgacatgttagaatctttggcttcttttgtcacttacgagaaaccttgtgggtggatggggtatggcttgtggggagagatggcagaaaggatcagagggaaaaggggttcaggaagaagttctctgggtccttcacggggttcaggtatcatcagctggccggaaacaggttaacttagggagagggacggtaagatgcaggggccttcttggtgaggaaaagggaggaagaccagatgaggaatccctgtgatcgccattctgtgaacgtttgtacttcatttgcctttaactgaacagcccttgatgtaggtgtctcgttgcctccagtctgcagatgggagaagcagacctaacagaaggcagatgaactgggattagggtgaggtctgccagactgtgaggccctcactcccagccctgaatggccctaccttgtagcgacagaaagggatgggcttgtgttgatgaaacaatggtcagatgtaattttctgctcattagattggcaggtattctaagaaccaagcatgcttggcttggatgttgattgtgaggttcaaatgagcccatgagcgcaaggctctcctttcagccggcgttgtccgcgtgtctctgctactgtcatcgtcactgggtgtccacttccataatggctgagcaggggtggtggggccattctctgtacaggtgcgcacctggctttatccttctttgttcccgtgtgaaaggcaaggttctttctccgcagtgtagagagcaaaggtgctcttgatgctcaccaacaaagtaactcagtgtttatcagtgtcctggtgaacatggacctctctctgatcacacctccctccttctgctatgggagagtcaggaggggagtggcttacacctgctgcagatggcaagtgggatcatctccctggagctgaacttctgcttggggaaatgtcactttcctgctcttgcctcccaaatgcctgagggcggtggattgttgtggccctaaatttaaatcttgatttttttttttcctttttagtaacttatgggtcctttctgacagctacttaggtccactttgtaagcactgtcctctgtcacctgccctgcatgtgtttaggagagggggtgagggtcaggtggaggtaggtcttaatggtgctgcttagggaaccctccgatgggcgacctcctctcatggttcattgctctggataccaaaggtccctcctgttagaatcacacatttgtctgtcttctagatattaggaaatt

SEQ ID NO: 27276 - DNA, 3652 bp, Bovine  19866880661887
aagttgcttgactctaataaaagattcgtttatgttaactcaggcagaggagaatatttgtcggcagggtgcccccagtgtttgatgtttgcattccttttaagtattgcactatattatgtgattttattcagtttctatatttagtccatgttgctccttaattgtagttatgaaacaaagcatatgtgtttgtgagattcttcttaagaacttttgtgtggtttgttgcccaagctgaaagactgctccctggtggcagattctggaattgcaagcccatccttttgaggcgttagcaaaaacaatggagaaggaaatggcaacccactccagtgttcttgcctggagaatcccaggaacgggggagcctggtgggctgccgtctatggggtcgcacagagtcggacacgactgaagcgacttagcagcagcagcagcaaaaacaaaccgcttgaggaaaggagtgagttttctgtgttgtgttttcttttcttttttttttttttgcaaattcccatcccagactacctgaaacaaagtcttttggagagcgatctggaaacctgcgtgtagagtaaacccttcagataaaccttatgcccagagtggtttgaaaacccattgttccacatctaggtttcttaaccttgacactgttaactatttgggctggaaacttcctgtgagaggctgtcctgtgcagttaggatgtttagctacattcctggcctctccccattaaatgtcagtaacccctccccactcccccatctgtttcaatcaaactgtgtccagacatcggccaccgtcccctaggggcaaaatcactctctcttaagcaccactgctctgatgtgtaccatgaacatccagcccatttcagagacagcacgtgtcacaaggtcactaaaagctaagatatgtcaagtgtctttacaggaggctattaatgcaaatgtgggatgacttctgacttgtagtagaataaacatgctggctttatgacctatgttttgattctgaaacagccatagaggagagtcgttcatgaaggatgtactggcattaatgactgtacacttggacaggggcatctgatcacacccgccgagaccacccatgtactttcccaggctcacatgttggctagatgctgcaggtgcctggaacacttggaggagggagggagggacgtgtaacttcatttctcttagaagctttccgaagtagttaaattctactagcttttgagagagggctctttattgtgtgaaatatccttctgtactgcaaataccaattccaagagcgttacggatgacactttctgtgagacagagaatgcactgggcatccatgtggaccacagtctggttaaatgaacactgtgaagtctgttctgggagctagagttgaattctccagtgtacacctgttgcatccagagatcaacacctgaactgaacacctctagtgggaatcagtgagccagggcaggcccctctgtgctcttcatagcagccagagctgagccttctggtcttcttatactgggacagtgtcttgttggcagcctggtatccagggacccaccacagggtgagtccttagtattgcagaagggattgacagcttgttgtctgaaagaagagggttggcagtggccctaaagaagacctgtgtgtgtgtgcttcctgttggagttggggtttcacacagtggggctgagagcctggagcctcctgggcggctatgatgggggtttgagcagaggcagctgaggtggttggaagcaacacttccaaccttacagaaagcaaccaagtgctttctgtaaagctctctgttggtcctctgagtgaccaccaagggaagccccttgccttcagtccttgcttcttcccctgctggactggagtgttgaacttgagcaactcccactgtgtgtggctcttgtgtagagatggactgtgacctttgcatttctactgctctgggtgagcctggactacaggatcctgagcagggaggggaaggaaaccttttgtgatttctgatttctgtctactctctgctctacccccccaactcctcctccccgacccctgagactctgcagatacagctgggcgtggacacagaggcttgacctggaccaggtatgaagagcctctattcaccgctccctttcccctgatgattggtgctcctgaagcatcttcctctgacacctgtggaagtggataaacttcatgatgtacttgaacttggtcgaaggcacttctgctcaaagacagttacctaccagctctctgatgtctaaaaaacctgctttgggagtgtggttcttttgctttaatactgaatctaggacaaatcatttatctggtatgagtcattacattttggtgcgaatgcagtggagcttatttcctgagatgagattgtgctgggagaggtgggtatagatatttcactccccagaggggcaggccagcacaaggagtggaaaagaaaagctgggaggaactaacagggcacatgacttggagaccagagctgatagaagaaatttccactgttgtcagggggcaaggttttcagacaccttcctcagccacaaattgtggactttgaatagctaagcatcttccatgtcagcctgctctgctcttcaggtctgaaactctagtaagaattgttttattgtaaataatccgtgaaggtcctcatttccttgcggggcctccagtttctgctgctctatggcatgtttgttcattacttccattggacactcttcattggaaacgcagtcctgagtaagtggcaagaaggtcacaaaaatgccccttgagatcacaattattccaacccctagtggatgcaacagtgattggctgggccactgagtgaatttatttatgctgtcactcattcatggcgatgaattttatgggatgagctgaaagaagtacccaagataagatattctttagtaacctgaggaataatatgccattccaattcttgtattcaattttattttctttcattggaagaaattcttattctgagagaaatacaggagcgtacgggcatactgtgatggcctagacaggtgaacagggatcaggtggtgcaattttcttgccatagtgggtctacttcagccaccatccttgatggcagtgtttttacaaagtgctttccctggaacgctggttcatccaaacgtcctatggacaagaagtttgtctgatcacggtacgtttttgcaaacctgtgcttgccttgtggggttggctgggccctgtgtgcccactgccctggtgccccattggcaagtgaccaagcacattcctgaggttaagggcaggagacattcttcagggaagaaactggtgcaccagttttaaaaccagccctcaactaatgtggccacagaagctttttgttttcttccctcgacatctcattagaaggagcaagtttttccaaatgttgctacatgaaatggttttctcttggggttagctgttcccacatcactgtgaacgcacagttttagtaaacccgttggtgccactggcagggagtgcagggctctgggagttgtctctgctctccagaatcaagaatcaatcag

SEQ ID NO: 27277 - DNA, 1454 bp, Bovine  19866880662266
tggcctcctacagagatcaaagcaaagactgccttccccgccagggccctcccatgatggtttctgcttgtcatcactgggtatcacctatgatctgtttcttcctggcccagccagtctcttgagatccaaatgctgtgttgttgtttttgcagctgcatcgaaaagttgtatcactgggtttggtttaattgctattactctgctgctgacaaatttatacaaggtacagcaggaaaaaagtctttgggtacttccattttccccaaagagaaaacgtagcctttttcttgcatcatttgaatttttactgctaataaatgcctgctactgctttttggtgtgatatttaagtccaaagggatattgtggagtctgcatgtacatgatttaatgtagaacgtagaattttagtgttggaagggatctctgagggtttttatttcaacctccttgttttatagaggaggaatttggggttttgactagggaagtggtcatggcacagccagaaccaggccgaggttctggtttgtattgtggcctccttgtgttcaccctcttggaatttataaaactgaatttagttccacatacgcaaacatcatccttttcagagcataatacatctgttagcttgaagtaagtgtgtgctgagtccgaaagctgcgagaagtgactttctaccatgtctgaaaccctccatggattgttctccctttacccaaaagagttcctctggatgccatgtgcaaaaatcaacttttgaatttaagattccaaggcgctgttagaagattgtggattaagtcattctgaaaatggaaaacttattctacaacaagaaaaaaaaatcaccctctattaatccttttacgggaaataatgtttgcattcacctttgatgccctcttacctttactcaccccaaattgtatgagattctttagagacctcgtaagttactccctgtgctcttataagcttcctgaggtcctcctgcggcttctaactcatggccagtgcataggaggacgccctttaaatatggttgtactgaatttaagtagactacacagggttgaggaataagtatagttaaaaataaaatgcagtttccttaagtaatgtgaggagagtttggtaactgggtagaatcagtcctatgaggcttcaccagtgaggtgagatttggtcttggttctgaaggatgggcaaaaaattcatgaagacaactctagcagagcaaaaatagcctacttaggaggaagggaatacagagaggagaggaaaaaaagcaagctgcccagagtggagacaggcagcgcattttctgtggactgttgacctaactcaccatgagtcctctcattcccacacttatagtagtgggcccctcagcagccactgtcgtaaagcatctccctgatgcatatagctgctggacccaagga

SEQ ID NO: 27278 - DNA, 929 bp, Bovine  19866880683487
tagttctatcttttccttaatgccagtgactcagcattcacttctccctggcctgcctttggctaagctcctgccatctgccttcctctggggcatcatcacacatggtagtctgctccagcaaagctgcccactttctagactttattaccactctctgggaactcaaaacaagaattactttggctatgggcgcacaccctggggactgacccaggagagaggctgccagacacagaactactgcctgtatttgctgattcattatcagcgtcagacaatctgctgtgagaatgatgataaatgtgtggtgttcttctgaaggaatcacccactccgagattaaagcccgtgccggcagcctgcttgtctgctgcctggagtctcatcccctcccatccctttttctgtagtgcagaatacatcttgaaagaagaaagtgtgtttggttaaagataataggagacccatatccatgtgatttagaaatgtgaacagtagatgtttttattccagacagagaggcagggacaaggtgagtaactgctgaggaagcagggaggcattggagagaggagccctagtggtgaacgtgtaggtgccccctgcgaatcattcaggtgagtcatctaagtgtgtctgaggagggttgaaggaaagccatcccgacattctgtggctgtgtgatggtcaccattacctagccaccaatcctttccggtgggcaaacccttccccagcttggttttagttgtccctgtgagtaaaatgagtcatctggaccagccatcccaagtgccctcataggacttcctttccgagttcattgttcagatgggctcagtctatgaccctgtctggcctggggtccccagtttctctaaggtgttgtgcacagggtgtgtggtcaccctcctgatgtcaaccgc

SEQ ID NO: 27279 - DNA, 1920 bp, Bovine  19866880688821
ctggccagtttcggtggatctatttaattagatttcaacacggcatctgtagccccagtaaattcaaataattaagcctcatgatttcctgtgtgttataaatgtcgctaaaattgccgttgcagaacagatcatttctttggtaattgcaatttctgtcatgaattgtttcatcacttacagcgattagaactttgaaataatttcttaaaattggactcaattgaaattttttttgcattgattctccttatccgtgtttttttttttttttttttcttttctctcttaattatttgtgctagtttacttgccttccaatagagaaggacaagggccagtgctctccaggagccagatgcctgggtttggagttgagctggaagtgggcagtgtccctttagaaggggagcccttcgctgtctggtggtgttggcccctctgggagcatgcatactaaaggcctttgggaagctcagactggcctgtggtgtcctgcagtaactgaggtctttggaggtgatcgtggtggctcctcactctttttggaagtagcctgagaaccgctgtaggagggattttgtcagctgagtggggtcttcccactctgatgaccagttctagtcatttggagcatctgtccagaggctgcagtccactgaatgagttgacagtttttgaggacttgcgctgtgcttagaatagtcttaggtgctgtggatccaagaacatttatctcagtcctcctctactgaaataaagatgatggctgccttcctggtgctcagggcttcgtttggctcttatctttcctgttcatcctaatgcatgattccctctaaccagacaaatgctctgtcacctctgctcatgttgccgttattgctatctggaaacatctttaaaaccacttctgtttcagcaataaatgttctttatcttcacatctagctccccgtgccatctctacttcagaacttttctcagactccaaagctatgagcagtggctctgacctgtgaagaccctgcattgtttctgcctctctgcagggcagatgttaaattctcctttgcacggtggctatttgtggatacctttttgactgcctcagggcaggaagccaaacaacttctgtctgacttcctgcagaggtaaagagttgtgtttacttgctgcaggagtgaaataccttttagaggcttagatttggggcaaatccacaagggacaaatactgctggacttcacccagggtggtggtccgccgtggtgtggtctgacaagctgtgaattcattaggatggttttttgcattttatttattttctaaagttatttttttgtaatttattaatttaaaaatgtggtaaaataagtataagattaccactgtagcccttttaaagtgtagtttagtctccttgagtataatcacattaagaggaccagtcttcaacattcatccccaaattttttcatcttgcaaaatggagacaccaatccccacctctgtagctccttacaaccaccattccactttgtgtctaatgaatttgaccaagctcctcagtgaataaaatcatatagtatttgtctttttgtgactggcttattcacttagcatgaagaacatctgtgttctttatatggttcatttacattgtagaatgtgtcagaatttccttccttttttaaggctgaataatactcccttgtatgtgtaccacatttggttgattcatttatctgttgatgaactcttggattgcacaagtctaagactcttgagagtcccttggactgcaaggagatccaaccagtccattctgaaggagatcagccttctttggatttctttggaaggaatgatgctaaagctgaaactccagtagtttggccacctcatgcgaagagttga

SEQ ID NO: 27280 - DNA, 3481 bp, Bovine  19866880695666
tctccagactcctggcacaaagttgccatcagaagctcctctactatcagtgatatactttacactttacactttattatccaagccttctctgggccacaggcttgctcaaggccaactgtcctaactggatttcagattaaggagagtcactattagattcttgcaatagaggaaagccaaaggaaccaaagtagtgccttcctggaggaagaggtcccatgtttggaacttccagcagtagggtctcacctccttgctgggcctcctccccatacccaaagcttctcccatagcttaccaacagtccccacctctccattccagaaccatttacccaaccatgtacatcaactttgttcagaaccttccagctctgtgtggctgaggaaaaaaatcatgtgaggagaagaaactttataagtaggtttggtctagagagttcttttttccacactctatctatccactgggagcctgtatagcacagcttacctggaggcagtaagcacggcccatcggtcttccttctaagtgttttttccttcttttcttgcttttatcctccttcttcagagcctcactcttgcccagaaaatcccatgggcagaggagcctggtaggctacagtccatggggtgggcaaagagtcaggcatgactgagtgacttcactttcactttcaaagcctcagttcctcacaactgcaggcaccagaatacatacatgtgcatcaaagccatctggttgaaagtacaggcatcaggggatcaaaagacataaggaaactttctaggcttatggtagtgctccatatcttgactgtgacgatacaattgcatacaactactacattttatcaaactaaacactgaaggaggtgaattttggcaattatacctcaatatacctgggaaaaagaaaaataccacagtaccaggctccaccacacatctatagaactgggaccaaaggagcaggaatttcagcaaacttcatcagttcagttcagtcgctcagtcgtgtccgactctttgcaaccccatgaattgcagcacgccaggcctccctgtccatcatcaactcccggagtttacccaaactcatgtccatcgagtcggtgatgccatccagccatctcatcctctgtcgtccccttctcctcctgcccccaaaccctcccagaatcagggtcttttccaatgagtcaactctttgcatgaggtggccagcgaacttcataggtgacactaatgcacagctaaatggaaagcccacaaagaaaagaactcaggccattagaatcagtcagaccaggctctgaatatacttaccagaaatataacccttagcaaggtacaagtctaaatttcctcatctgcagaaagaagataataatggataataatagtacctaccccccagggttgttaggtttcaaggctatcaagcacttagcagagagcctggactgtaataagcactgagtaaccattagcagctataatttgcattgcctatgccaatgctaccaaactatagctctgtgagtccttagttttgaggtcgagaagtcagacagggtaccttgtgccaggaagcatagcccagggcctctcctggagttattcagtggtccctattaccaacaggtcaccaaggacgaggcaacactaaagttaaattaaggcccacccacacctgtatcaccaaaacttcccctcagattcctgactactttatgagtagactcttcctgtagctgcttagcaagcccccagcacagcaagccaggcaaaaaatgaaaaggaactcaaggtccaaaaaagtcaacaggtaaagagaacagcgtcttatccagagatgcctggcttccctcaggactcctcctgtgagggagaagaacccgtgccctgaacatattcaagagagtaatcacctgtggcatgttatgttgcactttaaagcttacaaagttcttcatgtccctcaactccttggacttaagataaaacatccactgaacagtaataacagctcccatcccttgaccttttactctgggccagactctgtattcttgcctggagaatcccagggacagaggagcctggtgggcttctgtctatggggccgcacagggtcggacacgactgaaggcgacttagcagcagcagcagactctgtattcaagactttacatgtagccctctcatttaatcctcccaataaccctgtgtaaagcaactattatccctgttttaaatttgaggtacacataaatgcaacaaatttttgtatgttgactttggatcctgccaactttacttaattttattagctctgatagttttttgattgaacctttagagttttccattaacatatatagtatcacctgcaaataatggtagttttacttcttcctttctaattcggatgctttttacttctttttcttgcctaactgctttggctaggacttccaatactatgtcaaataaaggttgcgagagtgggcatctttgtcttgtctgtgatctcacctttgagtacgttagctgtggacttgacacatatggcttttattgtgccgagttacaatctctctacactcactctgttcagagttatcaacataaacggatgatgaattttgtcaaatgcttttcccgcttctattgagatgatcatatgatttttacccttcattttgttgatttgctcttccacaatgattgatttgctgatattgaaacctggaataaatctcacttgattatgccaatgatcctttaaatgtatttctgcattcagcaataatattgccgttaatattttgttgacaactcttgcatctatgttgattggggatactggtctacaattttttttctggtggcatccttgttttggtaacaggttaatgctggctccataaaatgagtttagtagagttctctcctgttaaaactaataaattcagtgaagttaagaggatataaaaatcaatacaaaaaagtctactgtgtttctatatgctaaaaattaagtataagaaagagaaataaagaaaaataccacatttataactgcatccaaaaaaaaaatccccattacctaggaataaatataatcaaggagattaaagacctatatattgaaaactacattaatgaaagaaactggagaagatacaaatgaatggaaacatattccatcctcatggactggaagaatcaatattgttaaaatgttcatactactcaaaacaatccacagattttataaactctatcaaaatttcaatggcattttcacagaaatagaataatcctaaaatgtgtatggaactaaaaaaaaaaaatatccaaagccatcttgagagataagaacaaagctgcatcatcatacgccttgatttcaaactttattacaaagcgatatcaattaaaacagtatgattagctatccctggtgg

SEQ ID NO: 27281 - DNA, 2067 bp, Bovine  19866880705612
ccaacagggtctccccagtcttgaaaactctccagcttcttagtccattctgtagagtatacttactgcatcccttgtctcaccactcaccccttctgaaccctgccttttggtcctcgggtccacagcagcagtcctgatgctgaatcctggcttcctgtcttcctcctccatggctcctctggggatggtgaccaccttcttccttctgaaaactctccttcctctccttagtggattgccagggttctccacaaattgtgcccatctctgcttccttggttttctcacctgtactatcttcacattggctggttcacattttctatttatttgatatctcttgcaccttttcccagtgacctcaccttggtcctcatctacctcctgcactgcggcatctgctcacagggggtccttcatcttctcttttcctttccaccctgctgtaccccacctccagatcagtcttttaaaatcactgcttggaggaacatctgtccctcccttttggtataatcaaactcatttactcattttcctctgaactgggtttcactctcatgtatcttgttcccaagtcttgaaatacccacttcccttctcaatccaaaaagcctccctagcctacagggatatctaatctgtgataagagtaggggtgaggggagggggtctttctcactggcgttcacagctagccagcaaacatttatggagctcttattatgtatcaggccatcccgaaatgtttcatgtacgtgagaagatggacagttgtagaaaaagctagagaaatcatttcttctctggagaaattatatatattgatatattctaaactcctctttgatggttcacccacaagctaggactgcatactctctagttgttaactgttcttgccactgccatttttacgactctcttaattcctgatcttatgattatgataaaaagagtttttatagaataaagtaaggctttgaaaactggttattaatcctacagttagtatctaccctttaaaaatttagttcgataattccaaatagtttcatagtggaggctggtgttttgtgtttattaaagggaatgctttaaaatggaatcactttgaaatgagacccaaagcatggcccgtcttgttgtaattatgccatgtataatttacaaagaagaatgtactttcatgattctggggaaatgcttacaaaacaaaactcttcattactgtacatattataacttaaagaatttcttttggaagaatttgaatttaaaacatatgctagctactggggtctctcattggggaatatttacatctcagcacatggcataattacatttgccattttcaaaagcagttgggttatgtgaactctgagaagttcaccatgagatctgatgaattttggaaatgtgtacctattgggctccccaggtggctcaagtggaaaagaatctgcctgccaatgaaggagtgcaggagatgcaggttccatccttgggttgggaaggtcccctggaggaggaaatggcaaactactccagtgttcttgccagcataatcccatggacagaggagcctagcaggctgcagtccatatgattgccaagagtcagacagaactgagcacccacaagggtaaatttatctctagtgtaatgaaaagaattatactcttgatgtgagtgagatgagtgtgaagccagctctggtgtttagttagtagttagtatggacaagtcatttcatctctttcccaatcagggctactgtcaggaataaacaaagagtgaggagataggatgaagtccctcctaagtgtcaaaggttattgttgattggatttgtgagacctactattttcaaaataaaacaataaattttattttttaagtatatacttgagcatagagaagagaaaatacagaggaaaaatatagaaaatgtagatttttgctaataaaactcaaatgggtttctaagcattgctttgaaacctgctttttttcactttgagatgttgcaaacatttcccaaatcaaccttttgagaaa

SEQ ID NO: 27282 - DNA, 1150 bp, Bovine  19866880718104
aatatccacatgtatgctttcttgaacttctcttgtgcatttcttgggctccctcagaacttggcagctggattccaagaccatgtaggcagagagagagagagggaggaaggaagaaagaaaaggagggaggaagagagaaagggaatgaggaggggaaagaggaagggagggagagtgggaggaagagagaatgagaagctctatcacattctctgacttagaagttgcagatcatcacacctcccataggttgacacaaagctccaagtgcaaggagaggacctccctgtatgagttgtatcaagatcatataataaggaagaacatattttggctgtgtttggaaaatagaatctgccacatagctttttctaagtttgttgttgttgtttgggggtatatatgtattgccttctggagctgaaacttctaccctaagcaagcatttctatcagcatagatatttctctttaaactcatcattgatatcagctgtttcctcagtgagacattttgggtaataaaaaaatcaagtatgcatctcaagcaatatgaaccaactgaaaacattttcatcccaagcaaagcataactaattcagattaattcaaggaatggtgaatataaccaaagaatttgtagtataactgtgttccatctttgtattttctaattcgcagagggatgttccctcatggttaccatattgttgtaaggttaggccagacctaccttaataaataaacattttttactaacatacttactatttttcatttttagaattatttttattcattataaaataggttattttttaatctatgaaacatattaaagaaacagtaacaatacaaaaccactagtgtgtctaccagcaacagtaagaaatagatcattgccatttactttgaagtcacctcctatcatcccttcccctctccacttcaaagtaacccctgacttctgcgcttactgccacattaattttctttacagtttggcacatatttgtatcctttaaagatatttagtttagttttgcttgcttccaaacattttcatagtttagaaatattccttcacaaaatactatgttctcaagatttatctatgctgttgtgtgtagctggattttaatcacact

SEQ ID NO: 27283 - DNA, 1689 bp, Bovine  19866880719294
gtttctgctttggctagcctcttcattccttctggagctatttctccctcttctccaggagcatattgcacacctactgacctggagagttcatctttcagtgtcatatcattgtcccttttcatattgtttatgatattctcaaggcaagaatgctgaagtggtttgccattcccttctccagggcatcacaatttgtcagaactctccaccatgacccgtctgtttttggtggacccacatggcatggctcaaagcatcattcagttagacaaggctgtgatccatgtgatcagtttggttagttttctgtgattgtggttttcattctatctttcctcagtggatgaggataaaaggtctgtggacactcctgggactttcgttaatatgttctcatacctgagagactgagccactcgcaatgagaaaataaaatccagtttcagatctgtgaaaccaaagtccaaacagagccagaatttggccagtgagttgaagtaaaagccaacttacaagatctttttcatagccaacaataggtttccttaatggtaaacttatatgactttacccctgtaatgataagagctattatttagtatctgttttgcaccaaacactttaaatcatcatcttgcctaatcattcaaactgcaccgatgagataagctttatttccttgttttgtatgctaggaaatggcgacccagagaagatgaatcatgtgcccaagaactaggaataggctctgagtctacctggatccaaagcccttatacacctgactccagcaatgattttcaagcttagattggccaagaggtcagagatcaaacgaacgggcaaggtggaggccaagaagaaaccacactttttagctagtacaaaaacgtgctggaggaagtttggctttgttttctacaagttgactttgacctgtttgatgctgatttgcctctcagagaaagcacttaagaagaggaggagaacatatgctccaaaataaggtgagataagaagtttctgtctgttgatgaaaacatgcgcattttctagggtcaaatgcatcctcttaagaagaacgtgtcttctgaagggtttcctttagtgaattagcacactgtattgtaaacgcctctcctttagactaaagttcttgagagtaggaactaaaaacctaaaacacagcccagcgcacttaaaaatacataaggagcagaatgatgggtgaacgaggaagagagggaataatatccagccacttgctgggggagcagccaggggctcttggccctgtggccatccacctaacacattatgattccacaaacagagattgttggacaaatgaccggtttaaagatctgatccaagatgtttcaacacggcttaatggaccattagtgactatgcctcagcaattcagtgcaagaacaaagatgtttaacacggcctctaaatacaaaggacacaaacagcagttcacacaagaagagctatagatcgccaaacaaaaaagggtgcaacctctctcgtgatcaaaggaacacaaactaaactaagaatcgattttaggggatctagcaaataggccacattttaaaaaatgtttgtgtcttttaaaggaatactcaggattggaaaggatgtcagcagatggccagtatgacagattggaaagttggg

SEQ ID NO: 27284 - DNA, 1106 bp, Bovine  19866880729137
cctccttcttattctccccagtcaagtagtataaaaagatactttttcacactgaattctttggaaagcagtttgcctatagccccttaactgacatctttataaaagtatggggttcgataaagtgggattaacctccctctaggatctataaacctgactgtagtccactttgccctgcagggcagtgcttttctcttttgtttttatctacagggggtcttcagatgacctcaaagaggctgcctgctctcgcttagacttactttcttctgtacatgtgtacatgtctccatggctcactcctggtcgagacaaatgaggcacccacttattttctaggctggtaatttgtattatctcaggtaatcttcagatgaaactacagtattcaaacaatttagctaaaatatgtataaaagagaaatgatctgtcccgtgagagccgagtatatttgatctgtggtagctaaagctgtaaagtatatcatacatgccatcatcatcttcgtaagtgggagtaaagcagttggattgcagaagtggtttccatttgattgtgccactctcttcctcagagttgctttaacattctttggagctgacataagcacctctggaaaggcaaacccctggggaatatctgaactaaattgcatcagccatttgggggcggtgggacagtggaagaaaaattcagtttcccgatcacagttggttaaaatgagagactttccaatcagttatgatgtctatgataaagagacttaatcactaaaattatgggaggatattttttgcatcatttcctggtagggaggcttaaacgttttcttggaagatgcattatacagcagaatgttctttggggggtgtgtgtgtgtgtgtgtgtgtatgtgtatgttattaacatatactgatatgtattatatccttgagtgtgctaagtcacttcagttgtgtctgactctctgccactctatggaccgtatggtgccagactcctctgtccatgggattctccaggcaggaatactggagtgggttgccatttcctcctccaggggatcttttcaatccacggatctaaccagcatcttttacat

SEQ ID NO: 27285 - DNA, 2311 bp, Bovine  19866880731060
gaactaatgaaggatatataattttgatcattggttttagaatattgctggtattattttttatggttctcttttctgataatcatttaataaaattcttatgctttcttcctggcctattctcactatttacttaatggttacttttacaaacatttggaaatgaaatactttcaagtggtaatcttgttctcgccagcttctcagaattctacctttaatgccaatgcagttacttgcataggtttgattagactttgttccagttttcactagtaagtgactgaacaaataaatggcatacccaaggccatacctggcgagtcacacttgagaacgagtctcatttaatcagatatgacaagcccaccatgaagtaacaagggttgtactttgtttaaggaaaatcaaagccttctcacagaaaactacaggcaaatcacagaaatgacttccttacatcggtttccttatctcagaacagaagagtaaataaaagcaataaagaatatatttgaaataagaggttatgaagacttcctaagaagggtcttaagacatctccaaacagaagttaattttgtggattttgctgcttaccacacagggctttgggttttctcaccaaagttcaaggagggttgtatagattacttaacatttcttcctggagttctataaatgatcaggtcaaaacacaatgagatcagctttttggtaactaagagtaatctacagagataatttgtgacccccgtgtttcacggtttacaatgttcttccacatcctgggttaaacttcccccaaaaaacttgtaacacaatattcccttggttaccatgaacaaatttacacttgaccatcttcatctctgtgccttggaaaagacaagccagcttaggaagaggcaagtggataaacactcacatcctattcatcttcctccattacaaatagcttcaggctttagaacacacgtgtgtgcaggcatgcgctcactcacacacagatgtccagcgttgttcatggtacagccagctacagctgagaaagcccagctccacggaaggcaagcttctatctaggtttcattacagaaggcttttaaggcactgagcccagtgggaaaacattactttctccatcatgaaaacatccagataggcccgacctttgacgcccctctcagctatggaaaggaaaccacagcccctgggaagttattctccttccatccattccttggttttgtgccacatgcccggtagaatatattcatagagaaatgcttttgccagtagtggggggcctactgttcaccgtcatgacatctctgcagtctatgttttgaaatctggctttcagaagttcaaaggatttagagattatagttcaaggaagaccaaggcgcacccagggcaggcctggtcttaacactgaaacccggcccttcctacaccatagccaatttgacctctagaaagaatctaacgcatatcttggtctagcagaattattttcaaagactcccagttctttttctatcatatggaggttgaaggcagttcaatttggagttcctaaatgaaactggagtactcttgccaagcacacccatctccccagcccaaactagatcatctctgttaaaggccaggttcctggcatctggggcagaccttggccacatcaggccacccagtgccccttcagtgtgatgcccactcaccgttcttttctgccttgtgttttggaggctcgggctctgggagacatggacatggcccatcacagagggtggtgagacttctgccagtagaacaagcatggaactccaacttgcactgcaaaagacagacaaaacaaagctgtaagaacactgccaatagacccctccccagcctccttgggaaacagccagtgcccttctaaccatgattaggctcacagaagcagagacaaagcaaagggaagttcatctctgttaaaggtctcaattatagaatgttaattaacaaatggctttttatgttttcccaaatgcataagataaatgtctaaaagcactgcatggggaggcttacttttaataagtggtaaactcaaccataactgtctatgcgagtatcagaatgaaatttaacatctgcggtccacaaacacggagggctgaaggctgctccaccatggccccttacccctactacggaggctctgcctgtgtagcaagcctagaccccctcagctgctcagggagcaggggaggaagagtaacggtctacttggtaagtctggatgctgtgtgtgagg

SEQ ID NO: 27286 - DNA, 1452 bp, Bovine  19866880740324
atttcgatgcatgcagtctgcctggtagtgctccctgcatgacagctgccatcccctcccctgtggtccctgaaagaatggagcgcctcccagggagaaatcatgagaggttccattcagtgtccaagtgctcagcacaggtcatgcttttgatgcagacactcatgcaaacttataggctgcctctgcagaagacccaactctcagctgctgcccccctactcagctctcagctgctgccctcaactgcagcccctggctgcactgctcggcccgagctctctgctaagagagctcttgggggcagtgttgtgctagtgagaaaaaagcctcagccttttgcttcatttatgaggcgtctctggccaacctgaatgaatcttggattcttctcaaccctccacacaaggccctggactcaaaagttcacacctcaaggggaagttctgacctcagccttactaattaagtcacgtttgggagaaattctggagtctgtgacataagtggctggccttcctcccctgcaaacaggttttccctctttaaataaaggacactgagatagccccttaaaagtaacaccaatattggggcaaacctcctttttgagggcctttgacagtatagtaagctaaagtcttccttcaagaaagctaattgtagaacaatctgcctcctaatgtattcataaatcagacattcaactcctagaataaattcccccataattcatgttaatcattccactctcgtaacatgaatcatctgtttaaagggaacttttaccaagacaggcaagagccactggatcttgctttaaaaatctctccagagcgccaaaggttttctattattgacagaaaagttactgcatttttaacaggcactttaaatattactcatgcaatcaaagctgttttcctaactcaacttagacagttttcaaacatgtattacggttgaccttattaagtattctgtagcgccacttgcacacgatggcacacaaaagtgcagtcccagaacttctggcagcactgggaaaaagggagtcctcatatattgtcctcgaggcagcagtaaaggctctgagcatggcacagactcccgagggatgccacgggaggcagagacaggggacaggtccccagaagagctctttgcacagaagttgagtgggaaggcaaacaaagatctgggttttttgtacgctaatcaagaatttcaccaagttctctccaagagcactctccaagtgctccaaggacaagatagtatttttcagtcttattaaggtccagaaagtcatgggagtaacccaacggtgtgatgtttttaaaacggaaaatttggaataacctctcatcaagatctataaactagataataattccgtaagtagctgctgtttactgaacactaccaagtgttgtgctaaatagcgtagag

SEQ ID NO: 27287 - DNA, 1893 bp, Bovine  19866880826304
tctgccttccacttcttcccctatctctggccagctggcctctgccttcgcctgtccacaaaccccaaactgcctctgaattctgttcgtgctccttttctaagatgaactttctgtgcttattattgttgctatcttaatatacaaccatctgtgattattgcaggaaaggccccacaatcctatccagagggtgtcatgggcagcaccctagtgtacagcttcccctgtctctcattccacatatatattttccagcccaaaaaatcttagcagtatattctgaacatctttccatgttagcaggcatatttctataccactgtttttaaaactttagagaatgtattcaataaaagcaacttgtatccatgataaaaatttcaaacaagatcaaaggtatgaaatacacagttgatctctcaggtcctctcaagggagcagggaactgtcttggatatccctacaagatatgtatatattacactttttaacttacacaaatagaagacttttgtactcattatgctttttttttttaacctagtgcaatatcttgaagttctttccagacttttgtgtatggctgttcttactctttttgtctgctgcatcatagggatgaactataatgaactataatttagttaaccagtcctctcttaatgaacattaatgttactagtttttttttttttttttttcttttacatcaaatgctttaacagtaattcttgtacgtaatgttttggagtatactcgctggtatgtaagtaaccgtgaaattgtgcttgtagagtgccgtcttagtatatagcacaaagtagctcgtagagagtacacattaaaagatactgccaaattgctgtctagaaagagtaactatttttaaggttgacaactgccttctgattagtcttcagccccccggggcgaaggagggcacagcgtgactctgggggctggagtaccagctctttccacctaactgcgtggttgatttcctgtttgtaatgggcctgtctcttcttcctgtggtagtcctttctgcttcctctgggtccagtttcccccttagggttatgcccccatatttttgctgtgatgtaagttatgctgggctggggaagggtgagtcccgtagttaaaagctgactgggccggggaagacccttgcccccagctgctgatgtcatagttcttctgagtacgagataattgggaaaaggaccctcatattttgcatagcctgtttcttatatctcactgttattgtttgcagggactgcttaatctttaacttcagaggcatgggccaaggtttatggggattttgttgtttggtaattggatgaccatgcctgggccatgagcagagctagttgagagggatattaatgggaccctattaatgaaatggcaattaaaattctttgaacaatgtgtttacatcagcatgccaaagctgagctgaaaccacccagccatggaatggaaaaaccattgaatttcacatgtttgtggagagaaatggccttttttcgattgattgaggcatttaagaccatggaatgaagtgattaaactaaagacagcaaaaaacttcgacaaagcacttgaaaaaacacaaccctctgacttagtgagggttatctggtgaaattgctgcctccagcttggcatcataagataatgatgatggtgatggtcacggtggaagtttctgccatttctgaacacttgcaaggtaccaggcaaggtgctacacacttcaaaactgtaagaggtagttattactttcttaacttacagatgaagaaacgaaaccttggagaaatttagtaacttgctccagatcacagtttgtgagggcaatgccaggattcacgaaga

SEQ ID NO: 27288 - DNA, 1026 bp, Bovine  19866880901711
gtacatgacagagcctgaacctttcctcttctttctcttcctcttctcctgacagcttgtcatgtagtttgacttttgtctctcctggctgaaaaggtggagtgaagaatctgaaaacctttacatattaatgggtctcttccctgtaacaccccatgtccactgttcagtgtaaacccttctcagtagcaatggttgggctctaagccacttctctcagacgcgttacttcctgatatcctaattgtttctctctccctgtagggtgtacctttttttatgtgcagagaaaaataactctatctctaaaagaagcagaaaggccccataataggattagtacaccatggctggtagggccaattagagctgatcgtcttggggcaatattgattgtctttttcggattatttcagtactgtgtgtgtttaaagggaatgtgaacagctgcagctttcagagaccagtcataaacacatgtccctgtttaccaaacatgtatgggcaaccagcttattgaggagcttcagtttgggaaataaacaggagacaattttgtttattttcaatcgtttcttttccttaataacatcttgggcacattccatggttctccatcatttttagctttgaatctaaggccatttgagtttaaaacttgcatctcatgacagattcggaattttctctttcgcttcgcctgtgtggtctagactttgtggcttgaggagctggtgtagtggtgaatgtataattaattgtctcatccctttcctcccagggttggcatcaaggtgggttctctggggttggcggggggcagacagtggcctacctactacataattccttgatggggtggcttgactccagatgagcctcttcctcccttttgcctttttgtcagtcaggataggctaggttagagaaggaaatggcaacccactctggtattcttgcctgggaagtcctgttgacagaggagcttggcgggttacagttcatggggttgcagagtcggacacg

SEQ ID NO: 27289 - DNA, 1255 bp, Bovine  19866880907160
tttgactatatggacctttattttctatcaattcttatctgccaagcagcctaagtaggggctgatcacacaattgcaggtttctgctttccatgtcctgaccaatgtcttttgcccaacttaggagttctggagaaatggagagaagagtagtcaacaaagacttcctcctttcccatccaggaagccccttcagactctcccctgcccctccttcccccaggctccttctctgtgctcctccagcctctcttccaccaggacacatatgacacaactatcgtgactgatctgtctgtctccctccaacagggagctctctgagggctgcggtagtgtgtccagctaccagcacagagctcagaagaggtactgcagtgaatgaatgaatactgccattccttctcatctcccaagcaggtggatgcactttgcagctcaaagagcccaggccactcggaacaaggaaagaatagggtaggaatgaagcccttcagcctcagcagcttttcctgctccaggcattccggctgccctaagcactgccccaggctaagtctccagggaatctgcttcataaacacttacttagcaagacatttaaaacgctattgatttctctcctccaaagcagaggtgagacagtgatagacacggtgagcagttagcaacaatgagtcccctccaccccctaagcagaagttatttccctttcagattaccagcctggcagccctgggagagatgcaacgcactaatggaagcagccgctagaaccagcaggtgctctggctccgatagcggcaattagaggcttaagctcccttttctatgagacaatgaaaaataaagctgatttcagacagtatacttgcttgcaaggcatctttccctcctattaaggaaaaaagacaggaggccacacctctctgggatccaggatcaatgtcaggccaccatggacaacacttttaaacccatcctaggtgttggacaggtaactccatgggacccagtagcagggacatgaaggtgcataaaaacagagcccttgccctgccgtggccaacctacattgaacagagcacctgtacatcatattggtcagacgatgccacactagaataacagccccatggcagcaagatcttcctctgctacagactgaatgcatgtgtccccccaaattcattaaagctctgaccctaaatatgatgatgacattagaaggtggggctttcgaaaggtcatgaag

SEQ ID NO: 27290 - DNA, 1531 bp, Bovine  19866880932276
tgtgtatgccaagcagtgggattactgggtcatatggcagttctatttccagttttttaaggaatctccacactgttctccatagtagttgtactagtttgcattcccaccaacagtgtaagagttttcccttttctccacaccctctccagcatttattgtttgtagactttttgatagcagccattctgaccggcatgagatgatacctcaatgtggttttgatctgcacttctctgataatgagtgatgttgagcatcttttcatgtgtttgttagccatctgtatgtcttctttggagaaatgtctgtttagttctttggcccattttttggttgggtcatttatttttctggaattgagctgcaggagttgcttgtatatttttgagattaattctatgtcagttgctttgtttgctattattttctcccattctgaggagattttaaaagcatacacaaggtgaattcccatttctaattggagatcatctcaaagaattgagcgaggttgtgcctgctcaaattaaattgcattattacatgtaattccagtttttacttttcagtgcctaaaacatcgatatatatacatgtttctcttatccttagaggatgcatcattttgtgtaaaaacaagcatgagcaaaggaattagggctccattattcaggagcttgctaataaagtccttcttaaaaagcaatctttgaaagaacttaaaatacattaaactgggaggaagatgagttaaaccaattagtggtacaacctacaagaaaagacagatagatttccctattaaacccattactgttctcagtaaccagatttgaggagactttaatgtttctcttgattctaatgataatccttcatctggaaaaagaaatacattcagaacttgtacaacatttgtaaatgtgcattagtggagtagcatttataacaataatctggagcagagaggttagcttgatgaaataagcttttaaaacttctgataaaaatccacagattttccatactccagggcaaaacaaaatgttatatatgcaaagtattggtcaaaaattgctaactctggctttacttgtctttgtcaggcagtaggtaagcatttccctaaatgggaaacctagaatagatgagcagcagtgcagaaaatagcagttttaaagacggatttcatagccaaccacatttcccaggtcctcaactaataaagactaaactggaaaaaaatcttgttttcacttaaaatgagataaggcagagccctgggaacagggcagggatgtggagggtcagttcctgcacggcttatcccactgcagagacgcagactcagtgcctgcaaatcacttttgtgttttattaatgtctgagctcaaatggctggtggcagtcagggaaggcttccaggaagaggcaagactagagccaaggctcgtgtgcagggttgacttggaaaaggagaagacattccaggaaagtcttagaaataatgaggaagccaactggaatg

SEQ ID NO: 27291 - DNA, 793 bp, Bovine  19866880946292
tcttatgtatgtagcctgtaaactggcatttcagatcgtccacggaccctgagcagtgagcatgtatgtagcaggggttggtgacccatgagtctggatgttggggcagccagctaatgtccacttgtctctctggaggtcatgatcgtggttggtggccaggcacccaaggccatccgcagcgtggagtgctatgacttcgaggaggatcgctgggaccagatcgctgagcttccctccaggagatgcagagcaggtgagccacatggtctcccagtgtgccggctgccccctagcccccactcccacactgcagatctctgctccctgtttctgaaaacattgtgcattccacagtcccttcctttcccttcccaacctgcacactttctagctgtaccttctgggatcagttcttatgtgcttagggactttaggctaatgcaaatatttgcttgacacaaacaaaattagcaatgcaaatccgagaagaaatccaatgagtcccatagcgacttccaaatatcacaagttggagatcaccttcttgttaaactatcagtatttacatgcctgcctcattcccactttgtcacttatcgaaatgtgagtcatcagccatttgagatgaccctgatgccttggtttcctgtgcctcaggtgtggtgttcatggctggccatgtgtatgctgtgggcgggttcaatggctcactgcgtgtgcggacagtggacgtgtatgatggggtgaaggaccagtggacgtccatcgccagcatgcaggagcgccggag

SEQ ID NO: 27292 - DNA, 2548 bp, Bovine  19866881011940
gaaacctgaagtacagagggacagaaaggatacaaaaggggtttggggtttgtatctctttttaattccaattctgcacatcctcagggtaatatctgtaattgccaaaagacctgctatagtggagggcatctattaaaatagtcgatattattgagtgcctaatttcaagttggcccagttcttagtgctgagaattcaggtttctggcttaatcaagtgaagcgatggaggagccatttgctgagacaagtactacaagaggaagagcaagctgacaacactgtggtgcagggaatatataagcttcctagggctgccataataaatccccatgaactaggtggcttaaacaatagaaacatattgcctcacaattctggaggctggaggtccaagaccaaggggttggcagggtcggtgccttccaagggatacgagggacaatctgttccaggtctctctgagattcctatggtttgctgaccatctttggcattccttgacctgtagattcatcacccccgacttttaccttcatcttcacatggcattctccctgtgtcgattcccacaatctcccccctgtgcacatctatcttggtgttgaaatttgctctttttataaggacctattcatattggattaagagcttaagagttcattttaccttgattttaacctctataagatcctattcccacataaggtcccattctgaggtcccaagggcaagaatttcaatgcatccttcttgagggacacaattcaccgtctaccatggaagaaagggaaggtggtaagcccaggtctcagcagggtgagggtgagcttcctgggcacgcatgggtgtttagaccaggagaaaaatttgaatgatagatataggttaagaggatatgttcatgttatcggttcaaacagaaacagacgttagaaggtcaggtcaggttctcagtgaggggtgggtgtggctaaagccatggcatgaatgagattgccccaagaggagttatagtgcttcagagagtacgggcaccaagcaggaacccagaagtagtgctcttcagagatagataagggaggaggtgttgccaaggcggtgggagaagacctgagagggcaacattgccaagcttcagagaaaagaaggtctgaagaagagtcactgcttccattaggaaatcccagttatctatgactacacaactaacttctccaaactcgacagcttgatgcaacatcacctgttatctctcagttccatgggcaggagtctaagtggggcttggctgagcaatgctcttgtaccatgtgggaccaatgggtgtcaccgtgtggtattcacctagggggtgaactggtctggagggtccaccaatattgctccctgtcatgtcagcacctaggggtgggagatggacaggggaaatggctggacccggtgacatgtgtcctgcagagcgcccactcacggcctctgcagcgcatggtctcaagggctaggctctgtctggcttgtgcctttctatcctcctggtcccagtggaagcagtcttcagatgcaaaatgaaaatgtgggaattctacaaaaagcaggaaaaggtgtcattaaagaaaaataatatacacttaaaaacttgttaagaggatagatctcatgtgaaagggtcttaccacaataaaaagaaaggattaaatgagataaccaggtaaaatctcttagtattgagtctggcacacattaatcatccattatatggtctctatgacttaatcagttctacaaggcttgttatgaaaagcaatatacacatccatttctctctccccagaggcactctggtagctatttttataaaccagcattatcttttggaaggatggcctgggcataaaaggagttagggaataagcctgttctaactcgaaaataataaagcttttaaaatggttaagaccacagaaggggggaaaaaaatcttgaagaaaatctgcatgttcccagctaactagaggatagtatacgtttcttgaaaagaaacagctctcacaaaatcaaatcaacaaaattagaaatgaaaatgtagagatcacaacagacaacacagaaatacaaaggatcataagaaactattatcagcaactatatgcaaataaaatggacaacttggaagaaaagaacaaattattagtaaagtacaactttccaaaactgaaccaggaagaaatagaaaatcttaacagacccatcacaagcacggaaattgaaactgtaatcagaaatcttccaacaagcaaaagcccaggaccaaatggtttcacagctgaattctaccaaaaatttagagaagaactaacacctatcctactcaaactcttccagaaaattgcagagcaaggtaaacttccaaactcattctatgaggccacccttcaccctaatatcaaaacctgacaaaaatgccacaaaaaaagaaaactacaggccaatatcactgatgaacacagacgcaaaaatccttaacaaaattctagcaacagaat

SEQ ID NO: 27293 - DNA, 2559 bp, Bovine  19866881033747
atcctactcctgggcaaacatctgaaaaagatgaagactttaattcaaaaagatacatgcaccccagtgttcgtagcagcgctattcaccacggccaagacatggaaaagacccaagtgtccatgaggagatgaccaaagaacgtggtgcacatgtttttgttgttttcacaactatttgtaaggcctccacaggtgtgtatgtaaaagggaataatagtcataaaaaggaaaagcattgccatttgcagcaacatgaatgaacctaggaatatcagagtgacaaatactatatgatatcacttccacgtgggatctaaaaacttgacacaaatgaacttatctataaaacagaaacagactacagacatagaaaacaaatttatggttaccaaaggggaagcagggagggaaggatgaacagatacaggattatcccatacaggataatctgtacgggattaacagatacaaactactacacatacaaaacagataagcaacacggttttactgtatagaacagagaactatattcaatatcttgtaataatctggaatgaaaaataatctgaaatagacatatacataaaaataacttaatcacttcactctacaccagaaacacaatattataaatcaactatacttcagtatcttcaacacaaaggaaacaagaaaacaaaaccaccacaaaagatacagagcctctcgctacctggaaagtctacagcaggaggcagagaagctactgctttggaagcaggaaaaagggctacagctgagttgcagacaaagggggcaaagccccacctccagtcaggaaactgcaggggggtgtcagcccatatgcccgtccccatctggtttaccctacccgactccctcaaaggctgttctctagctcatgaccctgtcctcataacactgcttaaatcgggatgacaactgaccccagaagacatgctccatagctcaaatccccaaccaatccctccctcgaagtgcagttagctaacgatggacttttgaaccagaagatgatgctgggctgggggaagagtttttagacacgaacatactaatgaaccagaagagaatctcagttgactgagtgaagtgggagaataaactagacaagccaaagaaacgggggcaagggggcacctgtgcaaagtgccccaaaggaggggagcctgggcccctgggagtgaaggataggcacctgacacctacagtaggcatcagggaaactgccccccaagaaaggagtcccacctgggcactccacacctgaccccagagtgtccacatgccatgagacactcaggccagacccaggtttgggacccctgtcctgggctacccttcctcccagcatgtttcctgggctggcctcctgtggggctgctgccccgggtgccccctctacccacccccaagccctcagtctctgatgcttctgcctcacacaagagagcatgctccctgggagcgtgtgctctgctcccttattaatcttgctgtatcttattaaaacggcctggtgcccgcctgttgttcttctgcacagagcagtggggttcatgcgacaagcggcagctgggcgagctgtatttcacttcttttgtgttggaggaatgacctagatgctgctgctctgtaccacagactcactgactcacacttgcaggctttaaccccttccttcccatccagccccaggctcgggtggaagcagaggtctgggcacccacgggacggtgtcagccaagctgacaaggaggcagagctgggacagaacaatatgagaccacttgggactgttccagatgaccacagaaatgcccccctcccaccaatgggtgggtgtcttgggaagaccacatgcagcaggggaggtgtccctggggacccttttcatggaaagtggtgcccacggcttgagtgaagggaggtgagggactcgcggttctctccatctgtctctcttctcagctggcttccagcccaggctgtcatactcatttattcattcactctttccccctagtcattcattcactctgctggttatcttctcagtggctgctctgcacagactctgcggttgactcagaggtaaatgacaccaccataagaagcccttttacggagagtgcagatagcaaaactcccacgggcaccatcctcagccacttcccagagggaaagaggagccagggaggccacacagcagatcaccgcccagactgacctggggcactgaccaggcaactcgggtaagtgcctccacgcttacccgaactaggtaagcggaacttacctagtaaggtaaaaggaactaggaccactgccttagaagctcaggctgctgcaacagatcgccacagacgaggtggcttgaacaacagaaatttccatctcacagtcctggagactacaagtccaaggtcaaggtaccttgggtgactgagttccccagtgagcacacccctgggcttgtagatgggtgcatctcaccatgtcctcatttggaagagagagagagaagcagcaa

SEQ ID NO: 27294 - DNA, 3384 bp, Bovine  19866881044991
tctttttagtgttgctgctgttaccccgtgttataccacgtgtatactttttttggagaatttgttttgagctacatcgcaagcctgcttacccctcagagatcagcaggctgagacaatggtggctggatccagtgccacagcatgcagtggggcgggaatgatggctctgattatatggcttccttattgtacccagttttccttggccagatggtccccaattgtggtctgccctaaagacattctttgcagtagtccatgggtgtgggtctcaggacatcagtgtttggggtcttattggaaatgtggcctctgacagaatttaccagctacggaagcctacagtatccagattataagtgcctaagctagagagagaggtgaaagagactcttaggtccctgagctctactggaaaggggactttctgtgtcaatacgcttgagcttactgcccataatgaaatatgtacatagctaagactcattaatccaattttctagctcaaaggatataaaaatcctgacaggaagaaattcccaaagggctcaggattcatcatattttatttagtttgttttcccttttaagtcctgtttatatgaaaaaccccaaggactctgttggaaaccatccatttctctgacaggagttattctagaggcagcaagggtctccccaagatagcttggcagggggaacaggcaaaggccaaatcgtttggaggcgtcttccccaagacggatgattctgatcctgggaaattagtctggggctgatgcaaaaagtctttgggggtaaaagtcaattctgaaagactcattgttccacttccaccaagaggttgcttaagcagctgtggagaagggtttgtaatgtggttatcacattcatcttgggaaagagacatcactgtgctttatggagagcagggcaaggaatttgatgctggtgtcagtaatgctcacattcacatcagagcccctctccctcctgagagcctgctctcctaacagaagtctcaaggagcccaaaggcctgcaggaaggaccagtcagagccctgagagatcattatgcttctgatactgtctcctccctgctgagtcttaatggggaaggctaacggggtctgcttagctgtgtgcacacatgtgaatgtcacaggccacagaggggcagggtcccatcccaccttcccacagtcgcacacccacgaatggccagatcaattctgggccataagtgtggtccatacctctggacacagtgggtggggagaaggaaacatatggtgggtctgctctttcatgccaccagatcaggacagcatttcagaaggccccagtcaccggaggacaagatgctgaacctgacaacacaagctttgaagggaatcccactgggtcaggggtggtgtggacagaaggagtcacagcatccacaccctggacccaagatctggagtctgaaggatgcccctgggtgaaatggctatggtccaggcagaccttactgctgctgaaatggaaggaagctgaggcgggggagggtgtggactcaggacacagatgactctgtcacaaggccacactgctttgcacaagcagatcactgaccaacacctgtgcatctgtccctggtcctcgacagtcatgagcatcgctaaggagctgttgtgctcttccatgacctctgagacagcaccatgtggacaccagcagagcagggtttccacctcacagtctgccgtgaagagtacatgaaggttccacaggcttcaagcaggagtatcacacatggtggggcttggcatcactagatggctcactcttgggcttgtttacttaggactcttcacaagggaggagtcaaagaactaataaggagtcttaagttcaaattcaagtgtatgtccaaaataaccagacttagtaatcagtggaaaacagactcacatcaaaaggcagacctctgattataaaaccttggaaaaatcaggtaggtcaactcaatacccactagtgtctacctactgtaacaggaaggaggtgcctagttctcacatcattctgaccaaagggtctgggtatgtttttctagaattctggaaggaaaccaaacatagggttaaaagttaggtcaaggaaagcttgttcaagaacccaatgaggcagcctgggacccaagccatttgaggtattttaagagaacagaagactcagaagtaccagcacaacgtggccccatgtagacagtactgtgaggctgtctcccaagaataagggggctcggttctgggtccaaggagtgtaggacacctgggcctcctcttgttgatccagcaagtacatcaggccagaaatcatactatggcagacacagtgtccctcccctgttctccgagtcagcattaccaactggaggaaccaaggagtgggaaaagactatctttttcacagtgaaaccttgacataggaaaaagcttgatactgtgactcatggaaggaggttcaggctgccattcttgtttcttttctgagtcaaattccaagggattttaaaaatcacaagagaaaactaggatcaagtttttacattatgttactcccaacacctacatgtatgtgtgtataaacaaatactgtgtaaggagcttcttcacactaatagcttaaaaaaaatgagaatctttagacagaaccaagaaacagaatatacaactttgtgaaaacaggatctattaactccttctcttaaggaacaccataatgaaattgctcaacccacggcatcatcacatttgtagaaaaataaagaaaaaaattaaagcctcacctcctgatacacatcaatgtaagtttcatgtggattaaaagcttaaggtaaaaacaattaacagtaccaattattgcacaatcaataaagaaggactgtgcatatatcaaagcaaaagaagaaattacaaaagtgttaatagaattgactactaaaaaaggtttatgttcattaacaggcttgctataggcaatagcaagtaccctatatggagtgggtagccattcccttctccaggggatcttcccgacccaaggatcaaacccgtgtctcctgtgactcccgcattggcgggtgaattctttatctctggaccacctgggaagccctagggtaccatatagggatcgtgaataacccttagaaggctatagtgatagtctgttaaatatatagccacaatgtatggatctctacatccacagagaggcaaacgatgagacaaatcaccaccatcttcctatcagttaaaaactctaagagaatactcttccttctctccccactggtagccactagttttttctccacacttgcgagtctg

SEQ ID NO: 27295 - DNA, 691 bp, Bovine  19866881049622
cttaaaagtgctgaatgcagtaaaactgtcgctggcctctcagcaaccaagtacatgaggtgacatgggcatctgtgacaaaaggaagtcagcagccaccaggctctcacacctaccagacctctctgggcacacttgcctctaattatttccagggctgggaacaagctggacttagcataagagccggggaccccacccagtcatagccccctgaaagcaacccagggccctggggacttctggtcccaggaagagagcagcacagacacagcctcgcccctcccgcaaggccagagccaggcagcctcccctagcagagtccctctccctcgtgttctttccagctcctgccccttactcaactcgaagcaggcctgccacgaatcacaggccagcgtgctggcctttgctaccatcactgtgagcggttttgacgtaagaggctaaggagtaatgagagtcactgggtttgatcacaatcacactctgatttgaattgcagttcagcaattacaaggtcctcagtcagcagaggcctgtgggactgggggagggaggaacttatcaaagggaaatttgacccaccatgcatacaggtttcccttccaaactctctggggaaaggggaagtctttttttccccacataaaaccccttctggtgctggggggaagcaaacaagcttcat

SEQ ID NO: 27296 - DNA, 1876 bp, Bovine  19866881057335
tgataggcccatctatcacctagcagccctgcgcaggacctccacagctccccctctgctttatcaatgtcctcaccatgagctacaacaaagagagcctcagccctcttgcttctgacagcacccttcaagaatgcactgattcgtgacaatattcatgtcaaaagtgctctctccagacacctcccagcgcctacagagccaccagctttccacaaccacaagggagaacgcccctccctgagcctgcattactctgtcctgtgggcaccagagcatcctccagcactgtcatgactcatggggtcctttgtgcaaatagtaacttctgcttccatccctaagccctctcatcatcaaatttaagaactgggttaagaccaggctgcagagcatcctttccaccacgcttgtcctctccttactttgctccaggtgctctggccaccagaagtcagctccttccttttaggcaaaatccaaaaagtcacataaagtgtaactcctgcaaataaagaactaagcaggtccaagacctgtgtttcctgctagataattgccactcatatggcccaactctcctcaggttcaatatgggtgaactgaacccttcctgcaaacatagcctcctccctaccactatcccctgtctgtgtctgctagcaaaattctcattctccccagaggtaaccagaccctcagagatctcttgcctcctttctctcaactccactcctggtcaccaagtcctaaccagtctttcctgcttgctgctctcttcctctggccccagttctacaaacctcatacctggacaatgagacagcccctcactggcttccagccttcctctctctctgtctctctccctctggtccatagctggcccagagctcagtgagagcaaagccaccaaatcacctctctgatcacagcccattccacatgcccactgcgatgctggggtagacagtcacccataagcaaagtcatgtcctattaccctgtgatcaccagtaacagtggccatctactatgcacctgagccagaccctttgaatactttattttaccaatcttcacacaactctgtgaggtaggagctattgctccatcttacagataggaaaaatgagatcatatgtttaaattatttttcctccaaacctattatttttccttaaattatttttccactaaacctatttgaggtctcaaaattctgtgagaatctaacaaaagctacagacctctcatccagaaaaatatatgtgcttaaaaattataagaaatataacatatgtgtattatatgtaatatatttcttatggtgcatattatgcttgcaatacaaagtcctgcatcctatttcatgggatgagcagatagagtgaaggaacccatatgccccctattggtgtactgccaggtgaagaatcccagcttaacaacgtctttcactctccctagaagcaggcatccagaattttaagttaatggtcttgaatggttggggttatttttatttttcatctttatcttttagcacattctatccccttagaatgggactaaggcatccagctcatgactctaaagaaagacaagaaggtgggtaagtcattacaccccaattcgcctagaaaagcatattcccatttccctaaatgtgtgtgaggcgtttctcctgggcagccagtgtggctttggaagagatgaacagagcagaggctgtcactgcagggaaagtaacccacaaggttaagaaaccaaccactttgcttcaagatcagaatttaatctgactggtgtcagaaatacttcctggtggcaccaagatttaaactcatgacaccaaaagaacagtgaatgtcca

SEQ ID NO: 27297 - DNA, 1636 bp, Bovine  19866881098175
agtgaatctcaccccaccatctatgactgggcagcagggagcagagtcaagcagggggaatcaaccagcaggaaatggtgtgtctgcagactgtggtcccaaaggggatctcagggctttgcctggcagaatagaagggggaaaaccagaaaggaactggagagtatgcaatggccatccttcagtttcttccagatggtgaaccacttcataccttacaactatctttctatctctttctggccacatgcctgtttcaaatgtggctatgagttcattgcaacccagagctctgatttcttatattctaaagtttgggtccctgtcctgtgcctcaccacagtagagaagctaagccaaaatatgcagaagatgtggtctttggagttaaccagacacaatttgaattcaggctgtagcatctaccaacctcgttatgttgacaaagtctccttatgtcttggcctcagtttcttatccaaaaagcggacaaaataaggcttatcttccatctgtgaggtttctttattaaggcacagttagtgtattgcctgctcaattaatggtagttacttggttctcagtcccaccagtggctctgattaaatcttggcctagaagattcagtgaattgtgcaggagatgacaaactaactccaagtgtctaaggctcttcttttttttttttccccagctaatttagtccagccatcttcagctaattcaatcatttctcattcaccagtggataaattgtcctcatcataggcttaaccatgcagctaatatggtttggagagagattgattaacaaagccataattgaagctcaataagtgagataaatccaaatgtctgtaagatcaaccagagtccagagctgaccattggcaatattcagttacccaattcatttaacagtatttcagcaaatacttattgtgtgtctatttcatgcatgtcaagcttaggactatctcctttgtcaaagttggatattaagggaatgccaactcagccatgctagaaaagaccttgatgctgggaaagtctgagggaaggagggaaggggacaacaaaggatgaaatggttggatggcatcaccaactcatggacatgaattgagcaaactcctggagacagtggaggacaaaggaacctggtgtgctgcagttcatggggtagcaaaaagttgaacatgactttgcaactgaacaacaaagcactcagtaaatgttcattttccactgtcacttcctcactcttgccttgaaatttatgatgtatgatccaactactggttaattgacttgtttccagaacttgagcaggggatggagttatatccagtaaaaaacccaatgtgatttgtgccaaacacaccagatcctttgacacggcaaaagatttccaacaaaatgacagatggtttcaggtttagcacggtatacattgagattactgtttatatcaaataatatattagccactcatttttttcacaaatgctataaactcaaagtgccattgagaaattggggtgcaaactgtatataaaattctccaaagggatagaaggaattcttgaatctaggagccttgtggctcagatttgataaagaactctccctgcaa

SEQ ID NO: 27298 - DNA, 1506 bp, Bovine  19866881105001
tgcagctattgacaccccaaccacccccagccagggtggatctgagaatcagcaactcagggcctcagcagtgggcctgagagccagcatgggggggcacacatgtcgaggataatgtccccgatcctccatcagcctccaggaagcagcttcacggggaagcctaggggaaacagcagtcaaactgcatctccatcagccctgacttcaatttgttgaaatccgtaactctccctgcattttcaagggaatgtgtttaggtgtggaagcatccaacaggaaactgaaatattgatgaagatgagcctataatcttttgataaataacatgccttctaatgccagattttgatataatacaaacaagttgtcaacgtgtgagcaaaaatttgcatccaagagaaaggattaacaatgaagaaatcctgttcgtgccgttcattttttcctgtaacctgaagaaaactgccttccctgaatagtagcatggtctggcatctttaagtcgttgggaagggaatgccttacttcagcttaacaaacatttctgagcaccttcttgatgccctgtactggctgctgcagacacacacagatctggtccctgctttcaaaccaattaattttttaggagaaacaaatctgtgaataagtgagcacaaaatagcagaaaatcatagcaaagaacatggtcttcagcttcagatagatgtgaaatcacaatcctgcacggattttcattagttatggagaccctgtgccagtggtttaacctctttcaccttaaactgaaaagggtggataacgatgcctgtccctcggggttgtcaagaaggtcacatgcgaaaaaaagctctgtgccacttccactcctgtgttccacttggacacactggtgcataaccccactccctggaggtgtgcgtacccccagcctcctagagtgtcctgtgctcagagccaaactcctccccagaaattgctgtccaggggagctgccaaggttataccacttgtaggggtgggaggtgagagtatgcatataaaatgacctttttcaatgtgttataattcacattccataaaaatttgcccttttaaagtacaactcagtggggtttcatatattcacaaaattgtatagccatcatcactaattccagaactttccatttcctcaaaaataccccagatatctcatgcccattagcagccattccctttctcctatcccccaactctcacaaccattgatctagtttgtgtcactacagaattgcctatcctgaacatttcatataaatgaaactatataacatatggtcttttatgtctggcttctttcacttagcaaatgttttcagggttcacacatgtcataacatggtctcagtacctcatttcttttgatgttgatccattcatcagctaatggagatttaggtttccactttttggctattaggagtaaagctgctatgaacattcttgtacaagtttttgtgt

SEQ ID NO: 27299 - DNA, 1563 bp, Bovine  19866881114178
atttcctcctctgaggaacctccatgacccccttccctggggccatgaagctgcacaggattctggaaggcaaccaggctacctggtgaaaccaagaagtcaagatttcatctgaaaccaccatgtgaaatcatggtcctctctggtgacttgtggaaacttcctctgacaaaaggccactcaattctcaacgagttgacaaattaatgactgtttgctgtctccctgctccttttaagcttgctctctgcccaaaccatgctcacgtgaggttcattctgaagaacaaagacactcccagtgattcattaggagtgacttaatggatgattgacaatgaaattactccaaactgctaaaaccttgtcaagctaaggtcccgaacatttattatggcttgtctgtccccatggtaacccgtgcgtgcatcttgcttcccctacctctccagaggggcttgtttactagctgatgacatagcctcactgaatacaaaacagaagattccacccataggattttgctggaaccagggaagaatggcagactggaaggactctgtctctgttctcagctttcatatcaagggtctggccatgctctttgagatggaacaaaggggctattggccgtgtgtctaaacaggacaggtgagtaatccaaaaggcgggatgtgtgtgcctaaaaactggaggatggaagtgggcagggccataggacagataaggacaagaggaagagaataaaaaggtgcttccaaccagaaatactctcctgggaaaagattttttctttccctttcaatccaaggatttgaagacattgtaactaaaagtatcctctctcttacagtagtctgtgtgtgtgtgcaggagatggtataaactatgaaaagcctttttagagggcaatttttcaaccacgtatttaattgctaacaaccataaaacataggtaagataggtgtttatcattccctcaacttttgatacatatgaaaattttaataataaatggaaagaagggcaaaaagaaatatccaatgacctagtagatgaaagtgttaggcaaaaacatatctttatggtctacaataaggggaaaatctaaacaacttgaatgttcatctatatccatccactcaggttgctacaaaataccagagattgggtggccttgaataccagaagtttattttctcacagttctggaggctgacaggctgagataagagccccagtctggtcagtttctggtgagggccctcttcctggcttgcagacttttcactgtgtcctcacatgggtttctctaggtggactcacagagcaacaagctccctgatgcctcctttgataatgacccctgttctattgtatcagggtgccacccttaggacctcatttcaccttaattacttccttaaagactccctctcctaatacagccacaacgaggattatgacataagtattcagtccacaacaccatctacaggaaaaggttatcctaatcacaagacatccatttataaaatgtccagcactataaaggaataagagg

SEQ ID NO: 27300 - DNA, 882 bp, Bovine  19866881118412
cactcctgatgcaaagcgataagacacgccaagcacctagcacagggcctggcccacagttcacactggaggaatcttagctctcttcctgctctgacagcacatttcaagctcatttgcaaatgtagcattgatcccactacaaatatgttttggcttagcgatgagtccactcagaagaagggagagaattgtttaaattattgaaacaccttaatccataagctcacataaatattgttttgaactaatagatttatgcactttgcttctgtattccatcttacaggtggttaatgtctcttgctgtcacctactttaaaaactcaggcttttaaaattttcttttgtgttaaacttgcaatggagtattggattccttggttcatttgaaaataagaggcctttatcaaaatgttaagcttggttaatttgcataaaatatttcctctgcaatttactctctattacttttgaaaagcaaattgcctcagctgcaatgtggggtggttgtaatggcaggcaagctattagagctcatggttgtaggcagtgaacatgtctcaggtttggagctcaaggaaataaattggaatctggcctcgtctcactcccttgggtcatctgagctcatctggagaagaaaaggaagaaaaggaactccggttgccaagtaagggttcacagcaggtagaagtgtgtgcttgggagctgggtgtggctgtgctctcaggcatgaaggagggaggagggaaaacgtggtgtgtctccaggaacaggctcagtgaggcaggtctaatgggatccacacagcctggttcttccacctaaaacacaactcctatcccactattcctctgcctctgcttccttcccaccagc

SEQ ID NO: 27301 - DNA, 3094 bp, Bovine  19866881123608
tggcttccttgagcgtgtgcagaggttctaagttgaccctgtataccatacacctagaatagtcttcccaagaagacagtaaaggatgcttcagattggcagatcttgaaggaatgatcaaacaggtaaagacattttttcaaacaccagttatttctctgcggtgttcagaaaggtttactcagaaacacaaaatgcaagcaactaatttcagcttttgtatctgagtactgtaatttctatattcccctgggagttattccattatgttttcttttattactgtgttcagttctatgcatggcatgaaaagctaactttgagccaccagattccataatgctgattcaatattattttatactttagctaactcttccagggaaagtaatatcgagacgtatttctgtttgagagagctgtgattgtgctcatgtgcccaaagctgagccaaagacatgggtccaagtgtgttcatggtgcatccctggcacgagtgtaaggctctctatacaatgagaaaagtgtccatttattcattatttattaaaatagcttccaatctactctttccagctttattgacacataattgacatataacattgtctacgtttaaggtactccaaaactgtgttgatttgctacacttatacatttcaaaatcattattacagtagggttagttaaaacctacatcccctcacataattgccacttctgttttggatgaagtgagagagaaaccggtatctttggcatgtcctgcataactgaggaggctgggtactctctcacattcttttactttgccttaaggagaagtcatactctgagaaaatctctcttggctccaagctgtaatgcctttggggagggataatgcataaaaagtttccaatatgtccaaattcctctttttttttttttttccttctgttgctctattggtatgttaggacttctctgttggaaccttgacttccgcaaatgctttcttgtctgtgggtgattgactaagccagtgtgttgcagggtctcctggaccaaacctgaaaggggctaggactgattcatgaaccactgtagggtccactgctggggccagaggcctgtatgcctaacacctattgtatgggtgggcgagactgctctccgtttccttagcatatggtgccagatccccaaattctcacaatggcactttcgtttgaggatggatgacaaatggttggagatggacatgacaggggatgtcttattcagtcgtgttgctgatgtaagctgtcagttcatttagaaagttggccaaagcagttgttgatttcaaaccagagaacatctggatgaggtatgtaatttaaaagaattgtttgagattcatcagtgcagtggtattaatgagaagtgggagaatgtataaaggagccttattattatttaactcactgcttgaaatggagatctaaaaccagagtgacatagtatatattttatgtgatagataaaagcaaatacaatccaagaaataatattgtgctcaattctgaatggactacagtagaaaaaatgcatttagatctgggcttctcttcctaacaaacatgaatgttcatggaaaagtgcccagttcagttcagtcgctcagtcatgtctgactctgtgaccccatggactgcagcactccaggcctccctgtccatcaccaactctcagagtttactcaaattcaggtccattgagtcagtgatgccgtccaaccatatcatcctctgttgtccccttctcctcctgccttcagtctttcccagcatcagggtcttttcaaatgagtcagctcttcacatcaggtgaccaaagtattggagtttcagctttagcatcagtcgttccaatgaatattcaggaatgatttcctttaagactgactggttggatctccttgctgtccaagggactctcaagagtcttctccaacaccacagttcaaaagcatcaattcttcagcgctcagctttctttatagtccaactctcacatccatacatgaccccaggcccctaccaaatttgtttccctagcacttacctgccatgtcagactttccctctatcattagggccaagatagtgcaatcccaccatacctcacaccggagctctatgagctacagcacatctatccaactcaaataccgcaacacatctctcacatttgtcctctggccagttcatgattataaaggaggatgggcatttttgcctagaaacctgttcaagtccagcaaatcaaactattgtccagagtctggtgatataatcttttatataatcaggaagacagatgctagagtaaggatcagaaactcaaatacctcccagagtcaggaagggaagtgaatgaatggtggggtttccaggccagagccagttggccatggtggccactgtgatgactgactcaatgtgtcaactccatggactatacagtccatggaattctccagaccagaatactggagtgggtagcctttcccttctccaggggatcttcccaacccagggatcaaacccaggtctcccacattgaaggcggattctttaccaactcagctatgagggaagccccaaagctgggctatggcacccagatacttggttaaacattattctagatgtttttgtgaaggtgtttgtttgtttttggatgagatttgcgtttaaatcagtggactctgagtacagcagattgctcttcataatatgatgaactttttccagtcgttgaacaaaggctgacctttccctagcaaaaagggattttgccaacagaatcccttttgggactcagatcccagttcttccctacatcttcagcctgctgcccttccctgcagattcaaacttgccaaaccactacaatgatgtggaccaattccctcaaataaatacacacagacacaccccgccttgttggctctgtttctgtggagaatgctaatacccacaccttgaaaaaccagccataactcaaatccagttaatccaaacaaaaataggttgatactatgaccaccctatgggccatctattaa

SEQ ID NO: 27302 - DNA, 751 bp, Bovine  19866881271723
ttggtgttaattcttctttgaaatttggtagaattcaccagtgaaatgatccagtcataggcttttctttgttgagagatttttgcttactgattcaatctccttaattattattggtttgttcagattctctacttcttgattcagtcttggtagttcatatgtttcaaggaatttatccatttactctagattatccaatttgttggcatataattgttcatagtggcctcttacaatcatttgtatttctgtgataacagttgtaatgtctcctttttcatttataattttgtgttctctctcttttgtcttagtttagctaaagatttgtcaattttgtttattctttcaaaaaaactcttagcttcatttttttcctattgtcattctaatctctatttcatttgatctctgctctaatctttattaattctttccttctgctaattttgagcctcgattaaacttcttttctaattcctccatgtgtaatgttaggttgtttatttggagacctgaagccttaaatcagataaaggacacaagccatactcaagggaacaaaatgaggaacttcaatagtgtctagggaacacaatacaaattctttagtgacaaagaaacattaggcatgaatgttagcactatccaccgcctaaaacaactatggatggagcttctaggaaatctggcaggaagcctaatattaataaaaattgagcaatagagcataagacaaatctaattt

SEQ ID NO: 27303 - DNA, 703 bp, Bovine  19866881300343
agaagtaggaggccctattctgtcctgagggacccagcctgtttaactgctgctcacaaagatctccaggtagaaaaggaaaataataattcaaggaagcggaccaagtattaaaaagaccaggaccccagcagctgggaggaaagtgagaacggggaaggttggagacttggtggagggctccctggtggggacagaggtgaacctgagactgaaaggtgggctgactcgagagttcactttgaggagaaattaattcccgtacacgtgcagtgcccagtcagccaattccgtagcccatacgaggtgactttactctaagaaagagccaacttgaactactgaactctgaaggactcggaaaaagtgtggttggcaatttccgcatcagtattctcctcccagggccagcccggcctgatagagccggggatgggatgcggccaccctggaaggctttgcctctttttcacacagtgtgtggctttgaaatgtaacgtgacaaggtcgcctgtcacaggcctgagaagttcctcagctgtcgctcccagctctgctccagctgcaaaggggccacgttagaatccaagcccagagcgaatgaatctggagttcactgaggtggcaggtgctttttatagctttcattgggttttgagtggtgcagggagctgacaaaacacctctcaaggcaacggcttca

SEQ ID NO: 27304 - DNA, 742 bp, Bovine  19866881348014
tatggcactaaaatgcatgctgacagaggaaagcgacaaaaaacaaggagcgaagaggagcagacccttcaggactggacactaagggaggcgtcataacagccactgcagcctgggcggaccagcccacagctgccaggaatggggagcggagtgagagcagatgggcacctggcacgaccctggggagcctgacctgaggggtgacggcaggcggctgaagcctagaacacagcgccacaggccttgcgtacagcagccttgcctagtgctgactcagtgatcacgttcttctccaggaacacatcctgcactaaacaaggtctgcatttacgtaatgatagaatgagatcagtgttaagaagaaatggaatgctgttctacgagccacgaagattaaaatgataatatacgtaaagtgctgagcacagtgcctggtggttagtaaatgctcaacaaagcatcagctgttaccaattcttattacgccccctgctcaactttgctactgagcagggtaatggcctagagttctttgtattcccagctggacttctgccagtgcagggcatacaaaagtgctaaaaagacagcactcgattgactctaccaagttttttcagactcataaaaaaagcctttggaccaagttgcccaattcccatccatgccagtcactggcccgtttgatctcagaacaattccttgctcttcctctgctctgtatcccgggcagacattc

SEQ ID NO: 27305 - DNA, 1421 bp, Bovine  19866881460657
cattaatcctcctctcctgcctttttcgggggctataagaggcaccttaaaaggcaagcacttttctcccataggaaatgggctgcattgtggctagaataccgaatctgagcaaatagctctctgtgtgccatcgtctctgaatattttattcctctgggatatatctggccccaggcagactgtgcctgatttgctccttataaggactgttcggttgaggacactatgcatgaatagggcccagtaattgaatgcctcctatctccattcggcttttgatctctctctacccaggccagtgccatcctgcttgaggacttctccccaagtgacaggtttgctccttcaagactccagtccctgacttgatcagccacccaaagcctgcatactttgagaagctggtgggaaattcagtcttctcaagatatagattacctgcacatctgtcagggtttagttatacatgactaattcatcctgcagcatgagatggggattcatttcctttgcaagttgacttggcaattttctctgctcaaagaacatttagaatagacagtgtgcatggcaatcaggaagaaatagatgctattaattttccatttgcaaacttgagattgactatagagcctatatcccattctccttggaaaaacagaccacggcctctcctgtttagagatgtgcaaagtccgaaaatttagaaaagagagccttctattccccagaggctctgaaatggggctgttgttagtggaggcttctcccaagggttggtactggtacctggcagagatgagcatcaccactgtcagcacaagctcctcctcctcctttctgtgcacgtggttcaacatgggatgctggtccccagcttgagtgagcacgtgatctccttcctcagctcattgctaaggaatgaggggaagggctgaaggcacagacttacatgtcaggatatcacgatggacctgcaaaggctggagatcccaaaggtggctagcttcatccagggctcgttatacaatgttctgccacaatggaaatactgtgtatctgtgttgtcccagatggagtcattcactagctacatatgactactgagcaacttggaatgggatgggtgcaaatgaagaactaaattttaacttttatttcattttcatcaatttaaaggaaaatagtcacctgtggctcacggcaattctactggatagcagaggtatctgtgtgtgccaaaaccagtttagcacagaggtatgccgaagccagttgtgtgtccaaagccaattgtgtttagctgtctttgtctttgggcttcccaggtggtgctagcggtaaagaacctggctgccagtgcaggagacataaacacacaggtttcatcccgggtcgggaagatccccggagaaggg

SEQ ID NO: 27306 - DNA, 1045 bp, Bovine  19866881528972
ctagatcataactgttgattcaaactctcttttttattctaacttccagaagagagggacagtgtgtcatatgctgttgtattatatttggaactaattatatgctagccccaaggcccagcactgtgtttggcacacagcagaaactaatttgttgagtgataaataactcctttgtaatagtcagcattgaaatacatcagtacattgctagttaataaataaaatgacctataaatttacatctcctctatcaaatgactgacttagaggagaataagaaatttgcaagtgacagagtgggagactgttcgtaagcactccttcctccaaggatccctgtagcaccattttctctagtttgcaatgagaagaggtcagctgcttgccctcactttgtatggacatgagcctagacctcacctgacatcctctctattcattcgatatgtaaaatcgtcttttggactctgcgggagagggagagggtgggatgatttgggagaatggcacttaaatacatataatatcatatatgaagtgagttgccagtccaggttcaatgcacgatactggatgcttggggctggtgcactgggacgacccagagggatagtacggggagggaggagggaggagggttcaggatggggaacacatgtatacctgtggcagattcatttcgatatttggcaaaaccaatacaatattgtaaagtttaaaaataaaataaaaaaaaatctcaaaggagaagtgacagaacagtggataagagaagcttttttttttttttttttaacagttaatcaaaggtaatactggcacttcaatttttattaaaggaaaaaaaagctaagataacatggaatttgggttccaaaagatagataaaagatggaagaaatgcagttctcctataaacacagataatgttttaggaccagagaaaccccgtatctcaggggtggaatggatctgcgaggttatccagtccagtgaaattatatttgttataacatataagtcttcagtagataagttatca

SEQ ID NO: 27307 - DNA, 914 bp, Bovine  19866881552276
ccatgaagtcaaaatgtgactggcgggaccagtccccccttttctgtttaatagccttctagacctgtgggggagggataggatgaccagttaatcaaaatactctgtgtggaaaaggtcagcatggtggggctcctaccatatatttttctgggagagatattgacgttctgccttgtccttcctttcagtactgcccatgtggtcaggagattgcagcagtgctgtggatccttgatgaccacgattttactgaaagagagtgatggtggcaagtctgatgatatttccctttaccctatggggccactgttactggaaaggtaggcaatgaccctgccgggagctcccaggctctgctctctaagctctcttcatttacacaactcactacacatgtaagtgcttgtgacaatagtaattaaccttcatctggggctgctccgtgtcaggctctgtgccaagcatgtcacatgcatcatctcatttaatccccatagcgactcagtgagggttattatgcccctttaacagctcctttaccagtggggcttcccaggtgaggccagtggtaaagaatctgcctgccaatgcagaagatgcgggttcgaactctgggttgggaagatccccccagggaggaaatggcaatccagtccagcattcttgcttggaaaaatccaatggacagaggaacctggcgggctgcagtccatgggggtcacaaagagtcagacatgactcagcactcatgcaaggaaaggaaaggaaaggaagaacagggaactgaaggctggaaaggttaagccatatccccacgtaacccagttggtcagcgggatgccgggacatacatgcaagggagtttaactccagaggacttttgtttcagtcccctcccccaccaggtccat

SEQ ID NO: 27308 - DNA, 1124 bp, Bovine  19866881740109
tacaactcaagtggaagtaagtttagaagaaatttagtgaattaagtgaagtaagtgaagaaatttagaaatagaagagaggaaccttattagaagaaaagaaataatggaatcctaaatatttagccatcccttacattatgattatcgcatcaaataccttgctgagcatctgaaaagctgaatgaaaataaaatgctattgtacatttactttttttttattaaaagacagtcaattatagaagacattcaagtaatatatatatatatatatattttcagtataaagtaatggaaagaatgtattgtaaaatattttataataaatggtacagagatgtacaacatgaatttaattgaggaaacagacaaaaacagaatttgtacaaaataactggctagtgctgtttagaaatgtcaagtacatagacaaaaatagacttaggaatattccagaataagggaaactgagatgacatgacaaatgcctttacacacaaaaaaaggcattagagagacatatcgaaagatctgcatctgatctacagattacttagtagttttactttttttatatagtaaatttttaaaattttattttatttttaaacttttacaatatatatatttttgattcactaacattgaactcatggctaacaatgttacaactcatgatggaacaaagcttatctaacacatatgttttctccataaggtacttcatggccttcttggacttgagaacagcagcactatccttgggggccatttgaaacagagaaatcaccaacaaaaagtaaaaaagaaatgcaaataatatgacactaaaaagactgagaaaaaaggcactttatagtaggagagctgaaacagagagaactttaccttatttgacctcaactgggactatgagcattgtgtgactcaaatttttcactgcactgagaagaaccagagatcaaattgccaacatccactggatcatcaaaaagcaagagagttccagaaaaacatctacttctgatttattaactatgccaaagcctctgactggggtggatcacaataaaatgtgggaaaagtctgaaagagatgagaataccagaccacctgacctgc

SEQ ID NO: 27309 - DNA, 861 bp, Bovine  19866882098843
cagcagcagcaaaatgtatgttacatttacaaaattcagacagaaaataagataaaggaaaagctgggctggtgcccctggtcttaggccctgaagaaatgaccatccagctgtcctttgtcccttgggcatactgactgttaagtgaggccccaggatgaggtgaagccctagaagggcattcttttcgacatttccatgtggatttagatgctctttcaccaacgttcccctagcagatgagtgtattgattagtacagccccaggggcttggacgggtcatgtctgcagacctagctggtacagagtggaaggctgatccatgagctctgggcttgtatgtctggacttcgctatggccaggcccagtagggactcccatcccctgtgctcatcgaccaactcccaagtgggctctggtgcctgtctctcagctggagccaaaggggtcatacccaaggttgtctgcactgctggctcattggggtctgctttggccatctgctttcctaaggcagggtgaaagcaatcagaggcagggagtcatctccttctccacttggccttgctgggcgagaggctgttagagagactcgttctgcataatgagctctgactcaaggtgtactttcacatttgggcagcagttaggcagtattattacatgtgtgatgagttttaaatattctcatgcagatagccacttgtagaagtttcatcttgaaatctctgactttccccaagaaacatgtagaaatggcaattatagttagcttggaaaagtgacaaggtccagtagaatgcttcatattccatccaagttataacatatgttgaaatcgttaggaaatattcagttc

SEQ ID NO: 27310 - DNA, 1201 bp, Bovine  19866880406395
ggagaagagagccctcgtgtgctgccggcccggctggggcctgcccatcagtcgttaatccttggggtcaggttcctcatctgtgcaatgggcacattatctgccctcccgtgtcaccatgacacatttcaaataagataaatacagtgaatgtgccgtattccatggagacgtgagctgtattatattttgagcacaggggaaattaagatgattcgagtagagaaaaatgagaacagaaaaatattcagacgtttcaagtcagtgacacctttgggagtcacctagtccaaattcctcagtttaaaatgagggtgttgaggtccaggccccaaattcctgccgtttgtgagcatcaaggtcttctacttcccagtccatattctcccagctgcatgaagggggcatttgggaagggaccctgttcctttcaggaactgctggattggagtttggtgggaaagactctagttgggtggggagcaagaaccccagggttgggccgagcgccttgcagagggtccccgaacatccgtcctcggatgcttggaagtatttgccttcagctggagcagtagtgttcctctgggattccaggcaggaagacccaggtggtcctggaagagaagctgaagaagctggaggaggagtgtaagcagaaggagacagagcgcgtcaacctggagctggaactgacggaggtcaaggagagcctcaagaaggccctggctggcggcatcaccctggggctggccatcgagccccgctcagggacgtccagcccacaggtacagtccacctgctccccaggagaggggccaggcatgctctcccaggtcgcaactcatccctgtcccccagcatcagcctcgccaagacacagctcacgtgcccacccgaaacgcgttccttggccatatttcaaggtcacggaccctgaattttttcttctctgtctcactgaacttttttaaaggtggtggaaaccccaagttgttttcttccctttggcaaaatctgagtacaatattgggttggtcaggttttttctgtctgatgtcgtgtctctgggtgccaatcgctgctctcggtttctggggtgaccccacgttctgggcttctcccttcctctcgagggtctcccactcagccccctcttgtcagctctccttaccctgtgccctacctcaggtctgctcct

SEQ ID NO: 27311 - DNA, 957 bp, Bovine  19866880567066
acaggttgtcacaatgaagtcctcccatggggacacagaggaggggccgtttaatctgccttatctgtaggggtcagggattgagtgagagacttcccagagaagggacaactcatgaggattttgaagggtcactcagagactgaaaaggagaaagggtactcagcatcctggagagaagtgcctgtgtgacggctcagaaggcaaaatgcccaccttgggtctggctcaccttgggggtggggcttgacaaggagtagataagaacagactgcattagtttatcaaagatgcatgaataaactggtgctcctaagtgtttgcagggactcgaaactatctgtatatgaaacttaccattgatatccttacagtcacagaattcactcatttagttcaatcagcgaatcaatcaatcaatcactccattagtcattgtcccagagagggtttgaggtcttttccatctttcttcctcttacactgacctcagatgcatcacccaactgcacagacggtggggatgtggaggatgcagatcttttctcgtatctgagcctcaattaattcatctgtaaattggggtgggtgacattgttctggcttctgcctgttgttagatacaaatgacataaagaccagaaaaggttttgaagactgtctgtgctttacagactgtagagcgtcctggcaatgtgaggactcttcatcacactgattaagtagatagagattaatagccaagcatgaaggctgagaattggattaactgctctgggctagattctattatcataatgataatcatttgttcacccagtgaatatttaccgagtgcttttcccatgtcaagcacgtttagaaagggcccgtcctcctgtggatgagccggatgagccgttcaaagccccgtgctttgcagatgcctctgggaaggcacagggggtcctgaggctc

SEQ ID NO: 27312 - DNA, 1498 bp, Bovine  19866880706635
aacaaacacacatgtggcctgggaacaccgagccccagccctcggcctttctgacaccgcccagcagagcagagagggtgccctggaggccaccccggggtgaggagggcagggctgggggcccccgggtcccgtggggcgcgctcaccagaacacgtggtctttggtcgctcgctcctgcagaagggtccacttcctccccaggtcagatgacacgtagagctttagggcagaaggagcagagagggaggtctggttatgaccgaggagcgagcctcttcccagaggcccgtgtgccctggacgtggagcaccccgtggaggcgggtcaggggagtggggagggcaggccctgcagaccagtctccaagaagcagaaggtctggtgggaactccacacccggccattcttgaccccaggcagctgggaggaccctagagatggcgggtgtggcgtgtggcagaggtcctgggcacggtgtgtctgggtgcaggcacgtgggagggacctgaacggcccttaaggtctcctggcaggtgggcgctggggaggaggggcaggaagggagggctggtcagtgcagcaacagcagcgccccctctgcaggctggctggggccttgaccgccgcagtgacccagggcctgtgcttagggttcatgttctgcaatcactgactccaaagacccaatcctttcaactttgaacttgaggtttcgtgagtgaagccaggtggaacaatgagctgacgtggggctcggggtccctggggggagtgttgggcccaccattctcctggacagagctgcccggggcgaggcggagaccacaggagccagcaccccatgcccgcttggtgcctcgatcctgatccgtcctgggtccacccacactgtcagtctgggtgcctggacctctttgcccccttgccaacagtggccctgaacgctgcagatcccatgactgcctgggagagaaacttctggaaaacgtcccttctgtcttttccacagccgcagaaaagcagacaagctcctgcatgagtgcttcctccttgccaagagcatctccaaacctcctaacctcggggactcgtgagaaaacgccccacttcagggtggctgtccctgccgtgaacatccccaagagcctccagagagtcactctgaatggtcgtctgagggacacgctgtgaccttggcaacaatcgtgaacacttgttcctttttttttttttaaattgatcactccagttatttttcaagtgtcttgaagtttgggtacattttaaaaaataattttatttatttatttttggctgtgctgggccttcattgctgcctgggcttttatttagttgtggcgagcaggggccactgtcccgctgtgacacgggggcttctcattgccggggcttgtcttgctgcagagcgcgggttctggtgtgcaggggcttcaggagttgtggcactgagctccgtagtcttggttcctgggct

SEQ ID NO: 27313 - DNA, 7402 bp, Bovine  19866880890824
ccgcacgtcccccgggtccccaaactgcgtagtcacagagttctccagggacaggcggggctgtgggcacaagccgggctcaggatggggctggagagctggccccacgggagcctgctgagagcgcccgggggcgtggggaggtacccccagagagacgcctggacctgagagctccccagcacagacacgcgtctcccagggccccctgccctccagaggcaccaagaccccctgtgtgcatggtgtcgaaggcccagctgctaggttgggcatccctgtcaccttcctgccccagcccaagctcagctgggctgtaacaccttcatgctcggaccccagggcccggctcagcacccaccccatggggtggggcacccacgtcgatcgtggggtctgcactatgacctcgggccttgcagatggggagacagaggctcgaggaggcacagtgactctccaagagctcggctggaggtggctgacttgccgctcgaatgcagaacccgagcaccttcctcacccatccctgtgccccagaaccacagtcctgagccctgagccccacccaggctgggcccttggccgctgtctatggggggctgcagggctgccatttgctgaacgagcgaaggatcctctttgggtcttggggtcccttcccccaggctaaggggcagccttgtccacaaaggtcctcaggacctcccaccaggcatctgtcttcggttccccatggctcacaggacacaacccacaaccctgggtgatgcttctgaggtcgggctcagcccagggaccccctcctccatgaagccctccctgatcacctccactctcaaactagaaatgatccgtccccttcctgtgacacttgtcacaccctaacttgggtcacctactctattcatatatcttccccaggaaaaagcatggtctggtctgatctgattcaccacatgtccaccacactcagacacagctggacctcgagcagatagatgctcagggtggtgggagggctggtatgcacccgcctcaccttcatggtgccgcatgctctgtcctgcccggtacagagggtgggatctgccccacgctccacgccagatgggagcctctggggaagaggggcctccaagggccgggcctgcgtacctgcaggctgtggccgatccaccagtagaagacggtgaggttggggttcaggggcagcagcacggccgtaaggttcacctcctggttgacgccgatgacaggaaccacttccaggtagagggcctgcagaggggctgcaggggccacacaaaggttaggggtcagagggcatcagggcactggccatgtcacaggttgctattggtcactgtcaccatcaacctcatcaccaccaccaacacctctaccaccatcatcactacctccaccaccatcagccccatgagaaacactacactttcatcgccaccatcaccaccaccaccatcaccatcaccaccatcaccatcaccatcaccatcatcatcaactctatcatcaccatcaccatcatcaccatcagcagcagcagcagctccatcatcaccattattagcatcacatcatcatctctatcatgatcaccatcaccaccaccatcatcatcaccagcatcaccaccatcaccactatcaccaccaccatcatctctatcatgaccaccatcaccactatcatcaccatcaccatccccaccatcaccgtcaccatcaccatcaccatcagcagcagcagcagctccatcgtcaccattattagcatcacatcatctctatcatgaccaccatcaccaccaccatcaccaccaccatcaccatcaccatcatcatcagctctatcatcaccatcaccatcatcaccatcagcagcagcagcagctccatcatcaccattattagcatcacatctatcatgaccaccatcaccaccaccatcatcatcaccatcatcaccaccatcaccactatcaccaccaccatcatctctatcatgaccaccatcaccaccatcatcaccatcaccatccccaccatcaccgtcaccatcaccatcaccatcagcagcagcagcagctccatcatcaccgttattagcatcacatcatcatctctatcatgaccaccatcaccaccaccatcaccaccaccaatcgtcaccaccaaccgcgctgttgcacaagccaccgtggtgtggcctccagccccgcctggtggcctccctgctcctgggcaccccgtgcttccccaaggacagctctctcacagggagccgccctgggcctggcgggggcgatgggctcaccggtgacctggacaaacagcactgcctcgtcgtgccccgccacgttctccgccctgacggatacgcggtagacgccggggctctcgtagcggtgccggatgggctccccggtcagcgtgaggttcacgtacatggccttgaagccgtcccccaggtccacctggtacttggtggtcaggacatcaccctgtaagacacaccagggggccacttaggacctggctgcagagctgggagccagcgatgggccattcgctggctcacgcacgtattcattcactcactcactcattcattccccagttctttcctgaaagcgagctccctggggaccccagggaaccaggtctgttctatccttgccccctgccccacccagcctggagggcagggctgagaccagtagcagaggatggaagtagtagccagggccgggtctgcatttcagaaagatgacccaaccgctgaggcagagaggagtcagctcagatgaggtcagggaggcctgagccagggaccgggagggcagggagaggccccctacctgctgcacagtttaagaaacagggagatgtgcgtgcataaaaacttagtctcttagaaaattacaaaacaaaacgttatcttcccctctgctgctgtgattcctgcattttcttttatcttctcactctacgtggtgccaggactgatgctcgggggcacgcgctctatgcagggagggggtcccacgtctgtcaccctccccggcatccccgcacccacacgagccgtctaatcgcccgtctaatccccaccgcgaacatcgcccttccaataaccgcattttcctcgtggagtcttgggaaaggaaactgaggaagcaaacaggaactttttcaacttcgtggcaagaacgagttcttcagtgacttcaggtcctctctccccatcaccttcctatcatatcctcctgccacccctctgcccgcggggggagcacccaggaaaccatgtcctgggggtcaggaatcactaactgtttagcgagcctcttggtttacacctgccaaaccctagaacttgacagagaaccgttatgtaaattacattcgtttacctttcttcacagatcaggtgaaaaaggttggatcacccctcccccatccacacccactcggaacctcagaacgtgaccttatttggaaatagggtctttgcggatgtgattagttaactcgaggtcacacggaattagaacaggatctaagttcaatggctgggtctttatcggaaagaggagcggccaggggaaggaaaggaaggaagccaggggaagacagaggctggaagggggtgcagccctcgcccagggctgcccagagcccccaggagctcagagatgagggaggaccccccttccagagggagcacagccctgctgaaatttgagtttggacttctagcctccagagctcttgagaggagaaatctctgatatttcaagccgcccagtttgtggccactgcagtgatgacctcggggaccttacacaagtatgttctatgatccccattttataggttgaaggactgaggctctgtgagtccagaacctgcaggctggcttgtggtcagggctctctctgtttaaaggcagcctgacagatggggtggtctcaaggtcaacttgctccaggagggaggggtctgcatgcagcttcctgggggaagaaggggcctctggctgagtctggacgtgtggctttgatgggcaggagccacaccacctggggatgctgtgtcctgcctgtgagcagctaagagggtgtgttttaactcctgaaacacttcccttggttaaaacacttcatcacagggacctccttggtggtccagtggttaagactcagcacttccaccacaggggccacaggttcgacccctggttggggaactaagatcccacgtgccatgtggtatgggtaaaaaataaataaataagtaaaaccctacctgatcagcctgagcatctcaatgagagagtagcccctgcttgcctcagctaagagccctcacagcaacgaagacccagcacagccaaaataaataagtaaaattatattaaaaaaaataataaaaaccttgtcataatcaggaaggtaagagtggcaatgtaagaaaatacaaaaaggcagagaagtagctggaaaggaaaagtggtgacgtcagcacaacacccaccacccacggcgtagtgtttccacgcagacctgtgtgtgtgtgtgtgtgtgtgtgtgtgtgtgtgtttattcctgagcgcttcaaaaacactcggaagtctcatgctgagccaactgccaattcacatgtaattgtcaaggatataacacagagagacctatgttcgcggtctccatgtgaacatcttgcagaacacgtatcacggcttggaatccacagtgactgagcccacgattcagtcacccctggggtccctagggctgcccgttcacacccagacgtgcctctccgtcacatccccgactccatggggttagaacctctaacctgttctccatttctatactttcgttatttggggaatatcccctgaatagaaccgctgggattagctttctcattcaatataattctctgcagattcacccaagctgtggtgtagagcctgttccttcttacttcagagcactgcccttgggatggatgtaccagctcaccttgcgtttatccactcgcccgtcgaggacatctggctgtctcccgtttctggctcttatgaagaaagctgctgtgaaccttggtgtatacaggttttcccgtgaacctctttgtttccctgggatacaggcccaggagtgtaactgctgagtcccatggatgttgcatgcttggtttttaaggaaatgaccagctttcccagagcggctgtgccacttcacgtccgcgtcagccatgcaggagggacccagtttctctgcatcctcaccagtgtttgtgggaccaccgtccttcatgttactcattcctgtaggcgcgcagggaccctctttacgctgcactgcgctgatggctaagggtgctgagcatggttccctgtgcttctttgccattccctccgggaacacgtttctccatgtcttctgctcatcttctggttgcttgtcctcttacggttgggttctgagtaatctttatatgttccgggtactagtccttgttggatacggtttgtagttattttctctgtggtcgtcttttcaccttctcaggctctgttttcaccttctcaggctctgtcacagacgaaacgtgtcgcattctgatgaagtcgtttatcacacttcctccgtggatggtgcttatggtgtcaatgctaagaactctgtctagccctagagcacaggtattcccctgcttttttctacaagcttcacaagtttccatttaaggctgtgatccactttgcgtcaactctgcatcaggcatgaggttcgttttcaccggctcctcgtttgctgacgcccgtccttccttcactgaaatgattttgcgcctgagccagaatcagccagacccgtctatgtgggtctgtttctgggttccccatcagatcttatgttcggttctaagatcttcacagaacttggattcccctaaatccagggctgtttccacacctgcactggatgagtgtgtctatggctgtgtacgaatgcgagtgcgtggtcacgtgtgaacatgtgtaagtgtccatgtgtgtgtgtgtgtgagaacaggagtgttcaccagtgcgtgtacccactccaaccttgcgcccactccttcccaaggcttcagcgcgggagccagtggcctctttcggacagtggagggcaaaggactctcttccaagagcatctttctgctgttccctcacctccgcccctgcaggcgagggtcccagtgtgctgggacagtgggcggccacgcgtgtcctgtcctgggtccggacggagcatcccagcagtgactagctgctgggattcctggctctagagggcagcaggtggccatgtttcctgcaagtcagtcctggagctctgggcggagggtgggtcccctctgagggtcccctcgagggtctgggcagggggctgcaccctcctctgcagtgaacagagcctcccccccgcccccgcacacacacacacacacacacacacacacaccaccccagggttgcccgaggctgaagcgtgactctcagggccaggctcaatcatcgcggggccagcaggttgatgcaccctcggctcaggtctgggggctgcaaaccaggaggtgtccacacggagcccccctggcctggacccaatgccagctctgtgcggccccaggtgggtggctgcgcctgtccgagcctcagcctccccagctataaagccggctggtgggagcacagcccgtgggcagggaaagatggaggggaacacacccacacgggcacccgcgcatccagttcttcacacgggaccagagcccccgctttccagcatcagagactgcgttgggttccccggtcccgcctgggcaggcatggacggacgtcttctgcacggagccccctcggttcgctcagtacatttgttaactgaagcccccggtgctcgagagctgtgagctgggggctggggtcccgggtgggaagagggggctctgcacccctttgtgctttcctgtctgcttgtgagcgtttttagtttctatatttggattttctacaatgagcatttgttacatctataatcagaaaaataagcacatgcatattagtttaaatagactcagttcagttcagttcagttgctcagtcgtgtccaactctttgcgatcccatgaatcgcagcacgccaggcctccctatccatcaccaactcctggagttcactcagactcacgtccatcgagtcagtgatgccatccagccatctcatcctctgtcatccccttctcctcttgcccccaatccctcctagcatcagagtcttttccaggagtcaactcttcacataggggccaaa

SEQ ID NO: 27314 - DNA, 2035 bp, Bovine  19866880898837
cagaacggcctctctcagcgaggggcattgggacagaggctggagtgcacccaggagccagtccacgtgggcatctggaaatgacagcagcatgtgcaaaggccctgagctgggactccctgaccaggctgcatttcccgggcacatctcctctctggggccctggagctggcctgtatcaggaaaccagggcccatcagattcagcctcagcctgcctggccgatgtgctaactgaggtacaggggacggggcgggggccgccacacacacaggagcgctgacagctgggagcgccggccctccgtgcagcctcaggcttcccgcagaactctctcggccaggactctggaaccttcggcaggggcagcctcagtccccttcctccggttaagttcgctggccagccccacactcaggcgggatcccacaaagccctcaggaagggcaggcttggagtccgcgtccccgtctcgacctggggctctgaacacatcaaggccacggacctcatcagagcagtggttaaaccccgcttcacaagacgtccccgcactgtctgcagacatcacgctgacactaataaggcaaataaacatggcctttaaagatcagaggcaccggtctacagtctattacattaaactcagcgtcaagggggaaagaaaagacaggctgggattattctcgtcgtggcaattaagaagaaaaaaaagaaggaggaagaaaggggtgtttggagggaggtcatctcacggtgcctgaagcaacaatagcactgcctggatggagtctgtgatggggagaggcaggcctgggccagggcctcccttcccccctctctggctccatgcacacgctcggggtgccctcctgagacacagcctctcccggggcccccaggacacagtcccttagggtgggaaggccgaaccttctcccagagcctgacgggatcacggccaagaggagagcctggctttcctggcctcctcgcaaggctgttttctctgcctggcctacacagccatccccagccagcaaagccttttcctgggggcttatccagccctcctgaagcctcgtggttcccatctgtgagatgggaatggtgaggatgtcctccccgtggggtctgcctcagagtcctcctgttggggcgaatgagcagagtagacttggaagggttttcctggctgtgccaccagcctcctatcttcctccgagtccatcctctgacctgctctactctgaaccccaggagccccggcctttttccagcctgtccacttcccagcccacttcctgttgggttcagccaatgggaggctctggtgggaggccggagggtgggaggagcgagagttcagttcagttcagttcagttcagttgcttagtcgtgtccgactctttgcgaccccagggactgcagcacgccaggcctccctgtccatcaccaactcccggaatttactcaaactcttgtccattgagtcggtgatgccatccaaccatctcatcctctgttgtccccttctcttcccgccctcaatccctcccagcatcagtcttttccaatgagtcagtcagttctttgcatcaggtggccaaaggattggaggttcagcttcagcatcagttcttccaatgaatatttaggactgatctccttcagaatggactggttggatctccttgcagtccaagggactcacaagagtcttctccaacaccacagttcaaaaacatcaattcttcggcgctcagctttctttacggtccaactctcacattcatacatgaccactggaaacatcatagctttgactagacggacctttacaggcaaaggttggagaactcagggttatttctccctctgcctccaaggtgtctccagtggaggctgcctctgctcctgctctggtccctgctagccccggcccctggcttgcgggaacaccaccctctggtttttgtcctcctgctgcagaggaggcagcgaaccccaccgggcctcgtctcagcggcctcc

SEQ ID NO: 27315 - DNA, 889 bp, Bovine  19866880937818
tctccccacaccaggctcagaaagcatttctgcttttaagggccagtgtgatgggatggggtcaccaggatcctctgggaccgcccttctgctaggtcaggtggctcaggcacaggctccaggggagagaggccttgactctgcctttcaaggggggctctacaaacagtgtgtaaagatgaagccaaaggctaagcagctgtgctcaagccgaggctggttttctgctcataaaccttcgggtgggaagggggcgtgggacctgattcagctgggctaacctctcccgtgcgcagggcatgaggcttggagcccaagtgaaatccaccaactcctttctatgggcatttgcggcgagcctttcctgcgccaggacacagttaggcaaccgtcgtcctgtgcccctgctggagcttggtgacctccatgcatctgacaagtgaagggaggtctccagggcagggccggggtctcaggatgaggtggctctgagcccacgccattccttagcagcagcgtgaccttgccaatttgtctccctcctcagttgccacatctcaaaagtgggtacctttatctacctccttcattcacgcatttggaggtgacaaggcatacggcgatgatccagtgtacccagggccccatgccccagggcctgcgaggagagtcaagtccctggactcccgggtcagcggagtgtgttcataaaccctttcctccttggagtcagcaaataacaaggagaatccagttggcaagattgaaagcacagccatgaatatgcatgactcattgagtaatcaaacacccggaatcctttccagaagaagggatcgcagcttaattttccacgacagacttaaattcaaattagtcattatttaat

SEQ ID NO: 27316 - DNA, 1861 bp, Bovine  19866881051359
agccccctccccgacctgaggggtgcccttggagaggctgtgatagtttctgagccatgttttggtggagagtggaagggcagtccccggggccacctgggcggatgtggacaaagctgtttcccaggaggtcagcccagctcccagggtggggcagcttgcccggcctcgcctctgggctgtacctctgccaaggacccaaagcagggccacatcgggcgggaggaaagccgtgtgctcagctttctgaccttcgagacaagaaggggcgcctgcttgggtgacctgcagggacgcgtataaatgtcaagctccctctggtttgcagtgtgtcttctgtccgcttctgggtgaggccacagcccggccacatgacacccttgtccacacggatgcacgcgagccacgctgttctcctgctcccaagatctgggggctctgctccttctcagaaaagccaggacgtccaaaaagtctgggagctgggtggccaggtccacagacaggaggggaaggcaccccactgaccagggggttctcttctcagttagaccaatggggtcactcagatgggtgatgacgatgcacgttagaaccgtccaagttccaaggagccgggatgggtgaccatcagtgatgcattaatcccgctgggctggcctctcccagtccctcggggtcagaaggttctcctgaaacattcagcactcagcagtcatgaggaacggggaccctaactcactccgggggaaccaacagaccaccactgctcctcttgtgctctgggggaatcttccggggtgtatcagtcagctagggctgcataacaaagcacctcagttgcccagcttgcacagcagacattcatttctcccaggaacggaggccggaagtcccagatcaaggtctgactgggctgggtctcaggtgcagcctctctcatcggcggaagacactgctctggcctcacacagcctttcctctgagcacacgcagacagactgttctgctccaaaaaggccacccaccccatcggattagggccccgcctttatgacttcacacaaccctaatagtctccctgctgctgctgctgctgctgctaagtcacttcagtcgtgtccgactccgtgtgaccccatagatggcagcctaccaggcctccccgtccctgggattctccaggcaagaacactggagtgggttgccatttctttctccatataatctcctaaagacactttttccaaacacaggctcacaggggcttaggacatcaacaaatgactctgagggcacaattcagtccataacacaggaactggcccttttcctggactgattcacatacaggtgcctgggcaggggtggggcagatggtcaggtctgcgccctgggaggagctgcagccacgtggggtgcctggccaccatgaactgaagccgcggacacctcctgataactgtggcgagcagtcccccacgcctgccgagctgagggggaaataacatggggtgacttaggtaaaggctctggagccagcccaaggtgggcgttgggtaggtcctagaaccctctccccgccttgccgctcgcttttctgacacaacaagctgcctcctgggaacacggacacaccaacagagctgaacacacaagacacacagcggggagcacaggcgtgagacaggggctcggggaagccatgcggcagcaggcacaggacggcaagacacggacgctctgtgggcggcctggggcacagcccgcagcctcgcacgccttaccttcggaagtacgggatgtaatgatgtctgaacacggaagaaggcttgggtgttgggacagggacaggcagcta

SEQ ID NO: 27317 - DNA, 1866 bp, Bovine  19866881118728
cccttggctgacccagcactccccagaaagctatcagatcctggcagctctgtcacgggctgttctgaggccgcaaaagccataaatgtaccggactaatccagtccatctgtctccagcagatcttttacttttcatgcgggtcacttctgtgagcagatgggttgagaaaggctttggcaagttaccaggaagtgactgcctgcccggtcccccggtccttcccgaccgtgggccgcaggcggcctgccgagtgggcggtgagctctcttcacggctctccctgcgcgttcggtccctaaggcgctgagctggtgccaacaaatacaggcaggaaagagcctcctttccaggctgtgggtgggggagggacatccccgggcagctgtacctccgcaacagagagaccctagtgctgtgctaggtggcagtgggcggtgccccttgtcacaggtaccaccacacacaaggaccgctggcgtcctgaggcagacctacaaccgggctttaaattattccagaaacgctgtttataccacgtcacccccacagcatgtaaacgccttaacagactgcagagcttcgcctccacgcgtctcatgtgctcctccctgcagccctgtgtgtgatcggccaggaggtttcatcacacccctctcttgggagaatgaaaccaaaacgcagagacacggaggaggaacttctccagcgacatccagcacatatcagaacttcgacgagaggcctcctgccgctagcatcagcggtgctgccagcatcccacgtgggccctcccaggatccctccctggtcttacagatgagcaggtttgtctccctagagtccttgggatgcccaaagataggtaataacatttctaacaaaacgtgcactcttgctgagccggttgcataggtgaacagaattcatttgtgttttggaaagatcatcctaggggcgatgcagaaaatgaagtacagaaagtattcaatgtttattacaacgattcaaatgcaatacagtgagtttctagcccagagccagaacagcgagactagagagagaaaaaaatgcacatgcaagaaatgtacaatgaggtctaattagacccagaggtgaaaggagagtaagaaccatggaggggtctggtctgagcaacgaacgagtaaggatgcattaactcagtaaaaacaaaccgggcaggggagtcggatctggaagagagacggggaggagattggacttgagctgcagaagcaactccagttgagggacatagtcattttttaacattcaaccagttttatatcttgtgttggggtataagccaattaagaaacaaatgttgacagtttcaggtgagcagcgaagggactcaaccatatatgcatacgtatccatcctcccccggaccccttccctcccaggctgccacctaacactgagcagagtccatggggtgtacagtaggtccttgtaggttatccactttaaatagagaaacccactcgatcactttttatttccaaagtccagcacagagcagactagacccctgaaactgtggaaaggaggagggaagaaaagcaaggagtgaactcagcagaagcgaccatccagacaccaggggctgggacagaaactgagcgatcaacccaatgtcaagttcaccaggtcttttatttagtcagtgactctgagtgcctggacataggagctggagagccctgcagagccccgggagctcacacagcagggagctcagaactgaatgggggagacaaacgaccagacgatgcatgaatctcagcagaagtagtgcagggaaggggcagcagaagctgtggtgagaggtcatgcacatgt

SEQ ID NO: 27318 - DNA, 2290 bp, Bovine  19866881219121
agagcgctgcgcctgggaggtgggcagtgccaagcccggggtcagggcagagtgggggcgggtgtgagcgtgggtggtgactgtggccgcagtgaccatggcaggggtggccctggccagctgctgtggcgtgaccagtgagtgtacccccggaggaccccacccgcccttacatccagcagcagtgcctgccaagctgggcttgcccgcgtgacccccattgagcctagagacctcagagccttggccacaccttgggggactcagttacggctggggctgagctctgcccctcgaggggctgcctgggccagaccactgcatgtgaccagcccatggacacagccggcaactgacaaaacgctcctcccctccaaccctgcccccagggtcacacccgaatctcaaaaagccaaaccagcatcaagttccaggttaaatggagaggtgcagctgtgagccgggaggccccgacaagggcaccgcccgagggacagaagggaggggtcaactgcggtcccaccagggctcagaccagctcgaggcgctcacaggacggggaagcgtgtgagcagggagcgaggctaggagagctggatgagggaacacggtccattccccgggcctgagcatcagcccaactgaagacaagaacgagacgctcactttgccccggcactttcctgatcgccctcgagcttcctgctccctgccccttgctccaagggggtcctgcatccagactcatgggcagtttggggccagagcactctggggactctctaaagaggaggcgcaggttgtctgagggggtaaaggaggctgaggccgcccaggcgaccgctgaggggccccgtacctcactgtagctctgcctgtcccccaccgagtggctgatgtagggcgagtaggagatcatgtcggggcggtcgatgttgtagatggccttgctcttagggagggcggccaggtctctgtagtccaggatctcatcgcccagcttggcctgagagagggcagggggtgccaggagggctggtcagacccacacccagggccgcctcgcccggcaggcgtgggaggaagcgagtctgagtgaagcgggaggaggggcaaaggcaaggcggcggggaagcctcctggtcctacagacagtgagaacccagcctgcagtctaaacacacactcacacagtgagaactcagctgcggtctaaacacacactcacagagctacgcttgcatacacacagacacacatgtgcacaaacgtgtgagggcacagcaaacacacctatacacacacacatgcatgcatgcagatccacacttgggtgcaaacacacaaacacagacatgcacatacacgcatgcagtgcgtgtgggcacaggaaacccatcgctcggtcatgtgcggctctttgctgcacagtccatgggactctctaggccagaacactggagtgggtagccgttcccttccccaggggatcttcccggcccaggggtccaaccggggtctcccgcattgcaggtggattctttaccagctgagctatcggcgaacatgtacacatgcatacaaacgcacgcatggacgcgcgctcacaaactcctgcatgtaatagacttgtacgcatgcaaacacagatacacatgtgctcacataaaacatacacacagaggacacacacacgtgcatttgaatacctgctcgatgtacgtgcacatgtatgcacagatgcaaacacccagcacacgcacgcaggcctgcacacattatacatgtgtgcacagagaattgtccgcccacaactgtggagggggacgctgacacacccacagcttcacccactcacgctcaacagcacaaccctcaggcacccccacactcgcacacaaccgcacccacccaaagcagtactcatgagcacacctccacacccagccactcgtacacacgctcagggctttgcagcactccctacacacagccaacgggctggcaggtgacagtcagcgggcatgtgacctcacagaggtcaccacagaggcgctcgctcacggcgacaagcctggaaccaccgcatctgctcaggtgaggtcgacggggcggctcgctctcctatgactgggctccgtctaccccactgcccaccagcccctcctcctggctctgggggctgcctgggggcgcgtgaccggacaggcctgggagctgcgcaccaggaggcttggctctcccagtagggctgggttcacacccaaacaccagtctcagccccggtgtt

SEQ ID NO: 27319 - DNA, 725 bp, Bovine  19866881236283
ccaagggattctccaggccagaatactggagtgggttgccatttcctcctccgggggaatcttcccgtcccagggattgaactcgcgtctcctggggctcctgcattgcacgtggattctttacccacggagctgcctgggaagccccaaggtggcttttccctgcggctctgccccccttattatcgtggacgtgaccgtcggtgtttggttggctgccgccctggcctggggtggtcattcaaacacagatctcttgcctgagtgacttggagtgacaagtcggtcaggacagggtgggcccatgctccagaggggagcacctagagcaggagacggggggagcactgagttagagggggacaccccagggagaagaggaagcatgtcaggtatcaagatgaaagcgaaaaccgaagcgcgaccgcgaccggaagaggcggggacacgagcatccccggcttcctcctcccgggcgctcggagccttctgccggcggccatggcgggaagggtggtctcggaacgagagactcgtggaaccctgtcagcggcccctgccccagccagagacccacggggtccccgcctcctgtacctcgcgtggcccagccggcatccgggtctgctccaccagggcccacattggcattctggaagagaaagagagagggcggcaggggcaggttgcagggggcaggcagtcgccagggtcctggcagccgg

SEQ ID NO: 27320 - DNA, 927 bp, Bovine  19866881261725
cgccagagccgggagacgcaggtggggatggcaggacgaggaagggcgaggatggtggggagggagccagcttccagaactcggacattctcctgtgggtggtgggcaagcacagcagtccttgagtggggcggcggggcggggggtggtcagggggcttccaggcgggtctctggatggtggagggggttgctggctgtcctgggtccccaggctgccctccgtcttcctctgtgtccctgccctcctgggagcaggccgcccctgccggcttggaaaggacacccatggattcttgaatgtgggccggaccgggtggctgggtgatcgggcccagaataagggggccgtgctggagcacggctctcaggttgcccgccgggcggcggccacggggtcactcaagcagcatccccccgctccccacccacccccagggctggggcagagtgggaccctcaccagagaaagtccgaggcccggcacgggcacacgcgggccgtgagtgctgccgtgaagctgcggcccgtgacgcaccaggacgcgggcttcctcctgcggaagctcctctgctggcccatgacacagcggtcaccctgcggggggacgcggggtgaggggccgccccactgcggctcccactgccggtctggcctgttccttattcccccggcccgggcgggcatcggggcaggaaaccggggctcaggggcagggctgtgtgtgtgcctgatgctgacccggggcagcccagcccctgtccaccccccagcactcgctgagtgctgtgtacctggccctgctgggccctgagggggtctcaggccccggaagagaggcccaatgcaatcctcaggcccgagggtttcaggtgggcccctgtgaggctgggacgagccacagcctccaggctcaggggccacacag

SEQ ID NO: 27321 - DNA, 862 bp, Bovine  19866881275086
aggcacgctggtgcatcagaggggctccgtgtccccgcaggagaccagcatccctgaggagctgatggtgacggtggtaaagccggggctgcccaccttggccgacctgcacgtgctcctgccgcctcccaggcccacgaggaagaggagcctcaccagtgacaaggtacctcccgcggctgctgggccgggtgccccccgcgtggcgtagggtctgatggtgatacccgacaagcacggggacctcagtcactcttcagcacgtaaaggcctatctctcaccgatcgctgtccctcctcccccttggggctacctcagcgtctcggtggtggaggagtgggcggggggccgggcaccgggctggaccagccccacaacgggcacgtgccaatttcactcccatttcttcggctggacctggtcgcaccaccccagcctcactgcgaggggtgagcaccacccaggggcctccaggacctggtttcaggacatccaactaggattgggactgaaaggtgaaaggggagcccttcacgccttccagggcggctgtagttccacaacaagcagacactgacgagtgtgggtgaggacgtggagggacttggcccctcggtcactgctgagatggaacggaaaatggtgcggccgccgtagaagctgtctggcagatcttcaaacacgaagctaccacataacacggcagcgtcactccccagggatgtaccgaagagaagtaaaaatgtgtgtctacacacacactcgtgcacgggtgtccgtgaacccaaagtagaagcaacccaaatgcccacccgcagacgactgggcgaggaggaggcggcccagacgcacagcagaaca

SEQ ID NO: 27322 - DNA, 1146 bp, Bovine  19866881280295
ctagacagcatattaaaaagcagagatattactttgccgacaaaggtttgtctagataaagctatggttttttccaatagtcatgtatggatgtgagagttggaccataaagaaagctgaagaattgatgcttttcaactgtggtgttggggaggactcttgagagtcccttggattgcaagaagatccaaccagtccattctgaaggaaatcagtcctgaatattcattggaaggactgatgatgatgctgaagcgccaatactttggcaacctgatgcaaagaacggactcattggaaaagaccctgatgctgggaaagattgaaggtaggaggagaaagggatgacagaggatgagatggttggatggcatcaccaactccatggacatgggtttgggtagactccgggagttggtgatgggggacagggaagcctggcatgctgcagtccatgcggtcacaaagagttggacatgactaagcaatgaactgaactgatttatctgcctatcacctattaccgaatttgtgttggctatgagattataaagtaataatttttttttaaactgcctgtttttcttaagattccaaattcactagatcagtataatgagaggtttaaaacatcgtattgccgctcacgggaatgaatgaatctgacatcaccatgctgtcaacacccaggcagacatgtttgaagccccctctccctggatctgagctggcagctcgctgctccattgcccctgccctccactctctcccgagttttccatttcattgcttcagtgctggtctggacctgggcaggggtctctagtgcactgttaccgcccgcagtttggaaacgctggtccagacgactccgcactccaggactccgagggggagaggacgccgcccaccgccccgtccgcccggccgaagcggcccctcacctgctcctgccgcaccacgaacaggacgtcctccccgggccgcacggccaccgcctcgccgcggatgctgatctgcaggccgcgcggcggcaggagcgggcactgcagccgcacggggctctgccgcgggtccacgccgccctcgcacacgttggacaccagcttccggtacctgcagccagaaggcgggtcagcgtccgaa

SEQ ID NO: 27323 - DNA, 1216 bp, Bovine  19866881405386
tcagaacaagttctgtgatatctgttgttttggatggagtatgaccattccctttgcttttttttggctgtatggcatgtaggatttaagttccccaaccagggatcaaaacttgtgcccctggcaggggaagcgtggagtcttaacccactggaccaccagggaagcacccattcctgtcttttgatttaaggaagtcagttggctcttgctgaatgtcgaggatgcggcagccactgccgggtgttttcacatatatggctgcatggctttcctccgctgctgtaacaaattgccccaaactgagtggcttaaaacaacacagatttattatcctacagtagattagaggtctaacttggatctcatcaggcaaaaaacaaggtgtccgcaaggctgtgttccttactggagaatctgacggacagttgcttgcaagctcattcacattgtccatcaaatatagttgctgccacctgtcgggctgagacccgtttccttgctggccaccagctgggaggctgcccccagctcctaggggcgtctgtctgggaccccgtctgaggtctgtagcaaagtgctttttgccaggtaatgtgacatactcacagggcccagggattaccacgtggtcatcttgggaaatcattattctgcctcccacaatcacccaatccatttatgacaacatccagtgacactgttattattgccctcagttcacaaataaataaaaggcatctgtgttttaagcaaattgttaggaccatcaagattccagttaaatgacaagacagttcatctgactcacccttgagctgatggtggggtttatagcagcaggtcagtgagaaagcagcagagtaaattttgtgttttggagtatttaaatggatgggctgctctgattatagaagttttgccaagaagtcattaaagtaattcctctgttggaaaaaacagccacgtgggggatttgggatgtgaaggacttttcctcttggggtgaagagtgcacaattccatgtccagttctccagtggaaacagctgagtcgacccaattggggattcatgttcctgaacttcagagcatctgtttcaagactgcagcaaacccaggaaacagacttcatactttcagtgatggtttgaagtgaggtgcgtcttgtggtcaaggaagcaacaggtgatggtcacgagcgtttaagaccaag

SEQ ID NO: 27324 - DNA, 1125 bp, Bovine  19866881418999
atccacagggacttttcaaggaggaatctggtgttgcacaatttggctaaactgagcttcccggtaaccactggaagtggcagagtttgagcttgtaactcccaaaccgactgctgaaggagctcaccatgggaggagcagcagccctcagcaggctcccctaggtctctggggatgcagggaccaacgcagactgtcagaacattaagcttcttctactaggggtgcttttgctgctcttaaagcttgtgtgcattgtatctggaagaactcattttaggaaactcatggctgagagttttgagtcctggtactagctccctccagagttttcaccccagtagcaagtacctctttcactgacactggctatgtgtcttatttgggtggcaacaggcacttggctaggccacggtgggaggggcccctagaggcctctaagcctgggcactgcttcactaggtcactgtcttgaaccagactcaggggtggctctgcccaactctgtttaaagatggtttcaggggtgctttttcgtggacatgcactgtaccttcctactggaacttgaatcctttgttttccagctgcttggggctcttgtgtccaagaccctgcagtagagtcagtagaatggccagaccccagcattctctcttcccttatagctaccaagactgtttacctcccagaatgtttgaagttacattacagtgaaattatttgaaagaaagaaaaaaaaaaaacaataactcatcatttccaaggatgacttacttaaggtgcctttttctttctatttacaatcttctgtcccctaaggtaaattttcaggattaaataaacacttcaaatatattgtatatggctttggttgtaaacctcatcacatgctggcagagcagtgctccatgtgacctgagaacaaacccagaatttctctctgaccatgaagtagcaggcagtggtgtctctcctgagcacccccttcatgctgtctcctgcaggataaccacggctgacagtgtgtggacactgtctgtgctgagcagagatagagacagtgctatgtttttacaggtgttctggccagtgtttctcacttggggttcctggaccagcagt

SEQ ID NO: 27325 - DNA, 1462 bp, Bovine  19866880469283
ctcctaggattcttgagccccaggaagctgggactgcagtggacttggagtttggggtccccagtgattggagagaatctgtccaatcccccaggtcctctcttccctgctaccccagctccttgcaggactggtggggagggaacaggtcagcaccttgaatttggccacccccttgggcccagacccgggcaccccacagctctctgagcccagatgaaacttgttggcccctctctcagcattgtttgtatttactggttcgttgccaaaatccaaatgccccagacccttgccccgcaccccgaaagcctccaacactgagaaacgtccaaggaagcttgtttttagcagttcattctaaaaccatttcctagtatggtagataaggctccaggcccgcacccttccacagcctgtttcatgatcagaggagaaacccccaggctttcatctcctcccggcctggcaggacaggcggcttgtttatcccctggcggagcggtttccgcgaggtcccccagagtgccccaagggggcggggacccagagccgggagagggggaccggcctcggagaggaggcccgcggtgcacgtgcaaggggtgtggaggggcgcagggagcgggcaggacagaaggcttgcggagcccgcctctggatggctgtgggtgctgggcacaggtgagacagggcttccctgccagccaggtgccagggctgagcgccacacgggctgctcagagtcacgtctcccctccctgtccctctgaggggttcacttccccccaaagggggttggttttcaggtatcttttttccatcctaaatcacagaagcagttcagagggtttcatctgtggtttcatctgttgcaaccgagaggacctgtacagtacaggggggagtccagggcaagtcgcggctcccaggccagcctggcccctgtggcctgagtcctgcccttctggggcacactcccatgccaggcctctgggctccaagctcagcccctctggaaccaaagggcacatgccatcagctggggcaggaggctggcaggctggtgtgcctcactttcttccttagccttttgcacacagcaggccctttatccttctggagccccttaggtggggagatgagggggcccagggtccccagtgcctgcgtcctccatggtccagaaacagccaccacaccggaccctcagagagatgaagatacctgtttccacgaaggcaggggtgctcactgagcccgggcctgctcatcctggagcagaggacctttgacctctttgccctgagaccacctacctcatcctcccttctgacttctgagggctgctgccctcggaagaggggaaagggaggcagaggctgggagacaccttcctgccctgccccaactcactcagaacctcctgaaggctattatcagctggaacccagtccacatc

SEQ ID NO: 27326 - DNA, 1035 bp, Bovine  19866880476801
cgcgggcctgctgtctcctcagacggccccgcgctccccgccccatacttagtgttggctccaggagtttgtgggggacgtcagctggagcgcacaggccttgtctcgttcccattcgaaagaaaaatctctgcatgccttcagccccaccatgtatcttcttcggcgtctgggggagggcaggtggtcagaacgaggagggtccttgggttccagcccgtctgatccagctccctggcattttaacgccaggtggaaactgaggccccggactggggaagtgacttgagcatagtgtctttgtccacgaggtgaggggcaaggaggaggttcaagttgaggtcttctggtgtccccttgtccaccctggcccccccactcccgagtgtcccaagccagcacagtgggcaacctgccagtcccccttctttctccccccacccgcacaaacataagcgtgctcaccctccatttttacagcaaaggatgctaaggtggggagtgtgagcagtgcccatagaaccaacaagagcagatgccagaaggggaaccacaggatcgcaaccagcaggcccgggccttctccacctgaccacactccctctctaagaacgtgctgggggagggccagccttgggctcctctgagctctacggtccctggctccctctggccactgactttgccctccgccgccgccgcccgggacagccgtacaacttaacagtgacttcgagtcttgccaagacaagcccaatagttagttttcagactccagtccttgccaagcctgaaatagtaattgcctgaaggattccaagaagctggactttatctgctgcagagactcagtaaatcaaaacacaggtcttatctctcggttctccccctctccgttgtgtggtctccgaaatgaaaaatgttacctaatggccgaaaacagctggcctgatgtttaattatttcaactcactaacctggtattctgggccaatcagtcgtacccagggagtgggtcgggctccttccggctcg

SEQ ID NO: 27327 - DNA, 1512 bp, Bovine  19866880492095
ctctcagttggttgttgtcaacttccaatgactggccactatgctcctcgtcttcaagacttttatctcctttgcaaaacttctggaaccactgctgcactgtgtgttcatcagtcattcacgggcctaatgcattgtccatgttgtgagttgtcacctctgctttacaacccattttgaacttgagtaaaaaatcgttcaaatttgctttttgtctaaaatcgtttctgtagtctaaaataaataaaaataaacagcaagtaatgtcgttatcaaaacaacataaagcgagaaatgtgaattgaaatgatgtttaacaaaaccacatttaagaatgtataccagtatcaaacggcaaagttcaataaagcaaaaccgtaattacttttgcaccaatatgataaaaagcagtagatagtttcttatgttaatagcatcttgtcttttacccctttaccagcccctacttctgagaagcagtgactttcacttcttttatctatttcatctgatatttacctccatattttatctttatttgatcaatttcagacagtaactctttacttcctatacgagagaagattttagctcacttactccacctttcccttctttacatcctcccaatatcattatatcacagtttttaaaattaaatacataatcaatattcacattatcaaaactatgaaaatattgttcacggtagtcaaatgatttccttccttcagcttttttatttttttaaaaaagttctttaaagaaatcttcaataaatctgtgtagcaccactcaatacaatttcctatgaaacctgccaggtgataggtcaattcttttcctcccctgaagatatctcttccggagccttccagtctcctccttcaatcaagacttaagctgctctttaaactctcttaactgccagtatcctgagacttccctttactgtcatcctaggaatttgatttgcttgtcttctatgttggtctccagtttcctgggtctcagatcttcctcctgttttttttcttatttcatctttgtggttacatatcctccagtagttcccattttcatccatttcctcagcctctctggactcctgctggcctaactgccttctttcctatcagtagctctgggggtactttggtttgaactttcacctctctgcttagtcatttgtaatttgtccatatgcttttcacagtcacgtatttgggtttaatgtagcagatgtcttagtttaattgaaaatgaaactatttctctttcttatttatcttttaatttgggctcaatttttaagaggcagagaaaaaattcctttgccttcctgaaaccagagtcttcattactctctaagacaaagtatgagattttgaagtgctctgaacccacgtgctttctttccacactcacacattcacatttgagaagctctgagtcaaacattcctaacaataatattgcaaatgtagaaaataataaatgttttttcaaagt

SEQ ID NO: 27328 - DNA, 1864 bp, Bovine  19866880528108
aagcccaggtgttgcctggggtcacacagtcagtggcacctggacttttgcctgcatctcagttctgcctactaacactgtgtcgagtcactggtggcctttaaatggttccatcccccattactacagtaaaggggctgtcatctgggaggccctgagaccaggcattagtgctgaagcagacaggccaatgggtgcccctgaggttagtttggggcccaggggctgggttcttcaccctgggaggtatttggacccttctgggctcaaccccctgtggtcaaaccctggagccttgggcgttcaggagaaggaaatccagccccgggcggctggacaaggctgaagacaagagggtggggacctggcgctgacaaaatacccttctcttccagatcatcctcaactccatgcacaagtaccagccgcggctgcacatcgtgaaggccgacgagaacaacgcttttggctccaaaaacacagccttctgcacccacgtgttcccagagacttccttcatctctgtgacctcctaccagaatcacaaggtacagtcccacaaccgcccccagcgcagacacatttctgggccacgagggaggcaggcagtgaagccccggtgcaagatgggcagggcagtcgcttcaggaacccgctcagtctcccgcagagccatgagaaatgaaagacgtgcgggggaaggagacgaggctcctgatccccagcacagggtagctgtctgtggtccatgctggggacagacagagatggcaactgggaacaccgggagcgtggagcttgccttgtggcttcactgtggggcccttttgttctgcagtcttctccctggtgggattctgggcctgcagagagtagggaaggagggtgggaagaggagccctttgttactgccagcagcgggggagcaggtgattgagccattcagaagcccttccccccggcacgctcctggcacatcctggcccacctcccgccccggcccgaccaccccagactgtcttctgatccccgaatgggctatcccatttcctccttgcctgtgcccaagctgcccttccctgaaggcttctacacctgtgttgggactggttgggtgtgggggaaagattttaggcagaagagggacaagattgtccctcttgtgtcagattgtgtcagactggcgtttaggacaggcaggcagaacctgatgtggcagttgtgcaggatggggagatgtgggtgggaagctgttacaggccccaggagagagtgacgaggggctgaattcaggagcacaggacatagaatgggggtctgccgctaggagaacgggtaagaggtgcggcgagaacttcaaggccggggaggcttctgcaagatgccacttccccagatgctgcccggggttctgaatgtgcctgtggttggggtgcggggcagggccggcccaggcctctctcccatgactcctctgtgcctcctctcctgacagatcacacagctgaaaattgagaacaaccctttcgccaagggattccggggcagtgacgacagtgacctgcgtgtggcccggctgcagaggtgggggccaccccgcccaggggggctggggcgggtggatggagttcaggcacatgaatgcggggaccctcagagtatctcccctcccttcccgtctccggctgactgtctttccctcacctccagcaaagaataccccgtgatctccaaaagcatcgtgaggcagaggctcgtctccacccagctgtcgtccaagcctgacgtcagccccctgcacggagctcaccaggcgctccagcactaccagtatgagaacggggctcacatgcagtttgctgcg

SEQ ID NO: 27329 - DNA, 4608 bp, Bovine  19866880544340
tttgtttgttttaatgggagctgttaaacatgcaaccaagacctgtgataaaccattagcattaatattgtaaaatgctaggcagtttcattcacctaaaattttatttaatcatggctattttgcttatactcagatatttttttctacatggaaagattttcttttcttgtccttcaaacatctgggaggtgatatcttattcttaatatgacccatcaaagctcttgtaatgttagtacctgcacctttatgccaagttttttttaagtgtttcggtcatttttcagagtgctggaatatgtgcatgactttttgtggttggtatttgttttaatccaacatcggctgctttcatgtcattaggctaaatctctgactcattttgaaaaatcaagttagacctacaaggctggtacctttttcaaaagtattttactgaattaatgtattgtaattgttggtaattttggtattgaatctttagttgagatgaagcaaattgcattaatattgcatcaaatatcaggctgtcttcatccagactttagaataatttcaacattcatgtcttaacaatgaaattcaagttgcaccaatagcatgattctggtatttgctttaaagagagagaggaacagtccatgagtcagtaaggaaactgctgtaaaggaattttatttagacatttatttagaattttatttagtgggaaaaccagactagtccgactacattcgtgtaaaataaaggtcttatgtatttagaaaatgctaacaaatgcacaagttgccaagtactggaaatgctaaaagctcagaaaattgatatgaaattcacatgttctactgtcagaaatgtatttgttttcttataggtataaagaagagaaattatttatataccagcttgcatattttcttgactcaatataacaccaacaaatcaaatatatgtacataatttttctcatttaaaggacaaacttatgaatccacatattcataaaatttatcctttaaagcctgagaagagagttatagtcctcactgtctcagctaggatttttttttttttttttttgcctttgattactcaataagaattacacatagaaacagaaaatcaatatgtctacttctgcttattttcaaaattgaacattgctctgtattaatttcagagaaggtatatctaagcgtcagctgagagaggtttagtttggtttagttttagattccttgtgatagttgtcacctctaacagcaatgaactatcaaaaaagtgagatttcttatcactctgtttttattccgagaagtagtatgtgaaatgagggagaaaactgtggattgctggtgaatgtgtttctaactccttttattcctgacttaaaatcagttggtaaacctgactcatgatatgtggatttttattgaattaagattagaaaaagtccaggcagctccataatgaatatctttatacagagatcttgcgcatttttcaacatcttcaaggaggtgggagtgctacagtgaagcgcaaacttttggataaggttgaaatgagtcaacaacagtgaaaaggcccttggcttcatccgtttcttttcagagtcagggaaagggagggtctttgtgttttcacttgagtcttgggtttggttattctgttttgtttgttgtatttttacctaaaagacacacccctctctacctgtaatgtagtgtaaggttcaagacaaacatggtatagtcgtgttttattctgattaattcctacctttaagaaattctgccattagggctctcaaaacccaatcctagaacagaaaagttctgtgtgcctgtatattacatgcaaaggatttgtttctgtaaattagtgcccacagtcaaattgattcctttgagaattttctgcaattgaagtccaagaagaacaaatgcagtagttatgattcaaataaaatatttattgacagtagatgatctgtaaatatctttgcccaaaatgcttatatgctactagaatcaaaaatagaaatgaagctcaggaaagtacagttcctgaaagtttgttttttatggtctaaagtagagttgttgtttggggtttggtttgttttgcacaactattgcacgttatagtgacctgacttcttaacacatgatctgatttcttgatcagaaagcctttataaagtacgctgagtggatttttttcagatgttactaggtgaccttgtagaagtccctgctctggtcatacaggaaatatgtggcatttacgtaattgctgttcgtttccttgattgttcctatccagagtttccatgcgtcgcttcagtaaagtgcgttcaggcatcggggcgacagctctgtttcccctccctgtaactgcttctggaccgtgtgcttggccgacttagcaaagcgtagaagtcagctgcatctgtgtgagccagctctgcttcgactgggagcagtcgagaataccatttgttttcttttctaaatatcacagaagttttattttccattcaccgaggcttttttgttttttcctgctttgggctaagggtgtaccaatttttctaacatctatacatacttccaaaatgtgaaacaggtcatggccttcttactgatcatagtggatagtgctgctgtctctctagctgaaactgtgaccttggttgggggacgggtaaaggccctgctggtggctgctttcctcactttttggagctttgatgtatctctgcaactggtagaaatgtagaggggtgttcagggaaaggcagctggctggcagcgtcagattaaaatatttctgacccacaaaagtaaccaaatgcccatatttcttcatttaacataattaataccttgtatttccaatgactttgataaagtgggcttcctcctcccacaccctccccctcccctgtgtcaactttgggaagactgcaagagatctatagttaaaacactctgtagatgatgaagaatagtgtgtctttaaaaaaaaaaaaacgaacatcaaaagtctcaattaggttgctgcctagcaggaagcttataaccacattaaaatagaaaagttatttcatttttagtatactgtatttcagcagcaagggttgcaatcgaaaagcaatatgaaacactttggtttggctgccaagtaaatccacattttgttataaatgtgtaattacaggaaatatatgaaaagaaaagtgttaagcatttcttatcaaatactggaaaagaggagtttggtgcctttggaatttaggaaaaacctgggatggattttggtcctgttacaaggcctgcttgtcgcatttaatttaaagcagttgttcttctgtcattatcccagagcccagggcttttcaatactttacaagacagagacggtgccaccaaatgtgcctgggagtttaagcggtatttgatcaatcacgtgattttatcagttactttttcttttcttgccttctgcacctcagcatacacattttagagtgaaaatacagacgatgtatttattttaaacaatctggcagtggttgagctagccatctggaaaggtgatgtcagccctaggcaagggtggttgctggttgagggtagtcatctgtcccttcccccgcgacacacgcacgccagcctccgcaaatccagtttaatggtgcctgagttgctgtttggttggttgaactcattctcctcagctgacatttaactagtagtttgtgctggaagagtattactactgctttctctggccttcacagacacgatggctggacaaagatgagcagccctgatctgctatgatggacagagttcaattatattactccctctcagaaaggaaaaaaagcacacatttaatgccatagctaaattggattccttctactaagaaatcctaaatttgtgcttaatagccagataaatgtagagctgatttacatttacaggctgattgtagatttggttcattgaatataaaatttggtcggtatgtagatggttttactccccccaatgatatgtatgtatctggtcctgcagtgtttttttcttaagtaaaaattgaagacctctctttgggaaatatcttgggtaaataaacttgacagggactgctatgtgtatagagctgccgctcttacaggaatatgtatggttcaggaagattttggttctctctgggatgggagtaagtgagagtcattctggagggagggcttgcgatagaattgtggaagtgtttctgacacctaggtgtttttgtttttttaattcccaacagagagatgtttcaaatgtatttgcctccacagaaagaaaattttctcctattacatggttccagggaaaggacagatatacgtaccatattttatttggagatgtcctgagagaatccctcactgcctttttccatgctacagtctgttatacagcagcaagaccaagatgatcccagtaataaaccttattggtatggttcactgatttttttggactctgcatttatttcagcagacttctctaatagcattttgcagttttcagctttttg

SEQ ID NO: 27330 - DNA, 1738 bp, Bovine  19866880567144
catcagccaagtttggctttgatttatctcttgcctagttggagggtagattcctggtgccggaggaatgggcagcgtctataaatgtatctccccaggaagaggcccacctggggcgggggttgctggggatcagcttgctgggtggcacctgggaacagggacctgccccgcaccacatcctctctccatcgggcagggtcaggtgatgggcctggagtgctcagagtgtcagccccccaagaggcctgggctgtgctcatcctgccctggagcccacattcagtatcagcatcaaccatgactcaaaggtgcccagtccccaaggacacgcaaggactgatgacacccagcggactggcgattccactgtccactcactaagtggggagaggcaggtccgtgcatgtcccttttccatttctgaagtggagctagtaacactttgccctgtgtcaaaggaggggagagattaagtgcggttcctgccagctctcctccagcactgccccactcttagttgacaagatcaagagctacagcgccactgtttccctgaagggtctgcctgggacgtctatgcctagtaatttacagaagaggagattaacaataatacacgtgcacactcctctgccctgtgcactcagggctgaggcagcagcttcttcttttttttaatggagagagatgtcccagagccagggaaaggaaagagaatcatcgttccttttctcactttgcaagagcacagtgcctgccttgagaaaggtactcagttaaggtttgtatggactgtgtttggaagtcagggcaggtaagctgagagcaggaccgggaggaatatcagaagccaaatcaggaagacaacaaaacagccgtgacagagggtcaaggccagaggagtctgtaatattttaagggacaaagtgacaggatacaggagaaaaagatcaggagttagtgttatagtggagaatggaagcagagatacaggctccaacacagaggagctgtgtgtgtactggctctgggcaagccaattatctttctgggcctctgactcctcatccataaaagtggaaaaccaatacagtctcacaggggtgttgcagggtgtgtgttagataaatggcatatggtgagctctctgcacataaggggtatgcgtgtgtatatgtgaataacaagtctgcaccatgggaagcatcatcatagatggtgactatcacgacgatcctgagaggcatgacaggcaccactccagcatatggaagaggagctgaaagctcagagagattcagggcggctcagggtctccgagtgacagatctggaacacaggctgctggtccttagctagctcattctatcagctgcatctgccctggagaactgttctagggagaaatcacccctgtgtttcttaacttgttctgggaactcctgtcaccttcatccatggccttttaaacatgcttcccattcccaacctgcccaagtttctcagagtatcatgattaaagctataacaaacctagacagtgtattaaaaagtagacacatcactttgctgacaaaggtccgtctagtcaaagctatggttttcccagtagtcatgtacagatgtgagtgttggaccataaagaaggctgagcgccttgaattgactccttcaaactgtggtgctggagaagactcttgagtcccttagacttcaaggagatcaaaccagtcaa

SEQ ID NO: 27331 - DNA, 3107 bp, Bovine  19866880603500
ggtccctggaccttatggtgatgtcccccacacatttacttttttttttttttctaagagattttgagttgtaaaaggatcccaaatgatacaaaacaataacatggtagtttttgagaaaatacccatcagtgttaccttgctaaacattttcctttccaaatgtctatgtagcctgttcctcttgaattgaatctcctcagaaatagtagtctttgttccctgaaacaaagattttttcagatgaaacccctgatgaattccgtcgtggtatatcatttacaacccatgctacctgtgtctatggtggtctgggttagtctgtattgatatcaccagctgtaatttgcaaccaggcagataattttattaatgcaaattgcctcacatttacagcaaatgctttaaaaattatgatgatgtcatgattagtaaactgagtcatcattaacaaaagtccttggtaaacaattttccaactttctctagtatccagactgttggataagcaattttcacgactatattctagggctcgctatgcctttgaaaataagctgaaggtcctcaaagatccaaagctttagggcataggaatggtcctccatcctaatgaattcctggatggcagcagagaggaatatgtctgtgaacccaaggaacgcccccaccactttctgccctgaggccttacctcctcccactgtttgttcctgaagcaattgtggtgggtgaacctcagaagacacatttggaaaatccaagagaaatgcaaattcatgcaaggatttcttttgacgctttacccatcactgttcagtgaacatggtccaaaaaccttgtcacaataagcttccttctgaaatggacattgcttcctttcctcttatcagtctggaaagctggcatacccttcccttggtgaggcgccctggcacctccgtgcggcattcagccagagttcacaggtggcgggctgcatccatgctgcggaccaaggagagacacgcaggttcatgttgctctcctccccgacaccaccatctacatcttgaaggaaaaacagaatggctggaggtgaggcggggaaacagattttttttttttttttccctagtggtcatgcttctatcttaaagatctcccctgtgcattttcagattctcagttctttgctgtcctcagtggtgatttggtagtggaagatgatgtggcaatagtggtaaagaacccgtatgccaatgcaggagacccaagagacaaggggttcagtccttgggtctggaagaacccctggagaagggcatggcaacccactccaggattcatgcctgggaaattccattgacagaggagcctggtgggctatactctagcaagaccacatcgtattatggataggaaaagttttaagaaacataaaaataagatgcggaactgcattaactaaattcaggaaggacagcctctaccggacactttttttaactaagaattaaaagatagagaaaatgtttgtttcaattatatattattagtcatcagagtatggtaaaatgcattaaaagtctttggaccttgtaaacatatattaaagacattactcatcagggaagaatcagtgatttcaaagtatcattatcttaaaagctttagaaacatgcacctttcaaacttccaattaagttaaactaatctgcatcaatctaaggaaatatttagactctcagagtcaggaaattaagccaccagttcttaaattcagagcatacctctacgtctgtcttgcttttgtacttaatgtttgtagataaatgctaagaaaatgctcgagacgaacagtgtattcaaatcaaaagtgcatagaaactaaaaaaaggggccaggataatggaaccaaagggacaggaatacaatgataatttgtcaaaaacaccttttccatactcgctatcctgcaaaacatgactgatcaactatagaaagtaaggtaataaatagtgcctccctcccaaaacacttttagcataaaatggctacagacattttagaagaaaacatttaaatgactgaatgatttgtacatcggcatttcctacattttatttacgttcatatcagcaaacacctacttgtacttttatatgtctaagactcagtggataaaaccgtgaagaaaacccagttttattcttttctctcttgccctcaaaatgtttaaaatctagaatgacaaagaaaagacagactcctaacatactcctaacacatccaacacacacatttattacttctccaaggaaatatctgagtaaaacaatctagaaactgtcaaaatatctaataaaatattgatgcttgagtgacacttgctttgatactgcagagccagagtaaagtgggaagtaagtacaattacacagcagatccgggtaaatctgggatcaacagagctgataatttcaagtcttctgcaggtctttatccagcttggcttagcactgttcttctcaggatagggtcttctgtataaggtatctgggaaatgcatacctgctgagcggtccccaccatcctccagctgtgatcatctctactacactggcagtaagatgagaagaggtgtctgagaggctcactgacgttccttctagatatgacattctatgagcaaagctaaaacgtttctttcagtctgaccattccaagaaagaaaacacgttatttaacttctgtctcagaccagcacattctctaagacaatgtctcaattttggcaaaagaccttaatttatgtctctttatggattccaatatcatgagctaatcctacacctaaaaaaaatgcattcattatgtaagctttctcttaagcaaatagaaggctggagagtaggaaaacactgtttgccattcaatgcggcgtcagcagaactttccattattaaggaggaggctgcccatttctagataatgaggacaaatttttcatcatcattgtggtgcccttcatttcactatgtcactctggaagtcctgtactagtctgaacgtcctatactctccacctttgcctcttgtagcatcaacaggttataaaaataata

SEQ ID NO: 27332 - DNA, 1128 bp, Bovine  19866880606053
aagtcctcacaggaccactgaaattctcttgggaatgggtttagggactttgcttgctgcgcagaatgttctttcagcccagctcctagggaccaccctggaagactcctgagtagccactgcaccagtcctattagaactagtgacctcaaacaagggctggcaaactgtggcctttggaccaaatctggcctgcagtccatttttgttctatctgtgagtcatacgaaatggtttttatatttctaagtagttgaaaaaaaaaatcaaaagaagactctttcgtgatatatgaacattctatgaaattcaaattttggtatctataaatacagtcttgttggaacacagccatacacatttatttacctattgtctatggccgatttcctgttgagaatccctagggaagatagaaggacggaggccaagacaagtaactggacaagtgttcttaaatttgtagagtgggctgctgcccaagtgctcaggcctgggttatccctgggtcccaggggtggatgagctcgtccagaatcaagccttcttgcttgaggatgttgaaagatacacatccatggcctggggcacttaatgtcatctttccccccaacagcgtatattagcttcgccttagaagtgcaagtcaccttttacttattaacagctctatttcttaattgtgtaaaccctgttatgttggaatctgtgtaatgacaatctgatgggacttctttgaacatacatagggtttacttcctcttctgaaagcaacaggaacgtgcctgtgagtagctttggcttgctgaggccttcctgggagcggaggatggaggcagaagcactgtggctttaattttctggctaattcagacagcttgtagcctctgggcctggtgtggcctggcagtcgcttgcactttccttggccagggtgggcctggcctaagaatgccagtgcacattaaagcctcttaccgtccccaagagttagggcggcaagggatcaaaggcatacgctgcctggctaaacacatcactcagtgtccagtgatgcggtgtcccccggtggcctttgagcgcagtccatgatcataccacttctgggctactgccaccttataaaag

SEQ ID NO: 27333 - DNA, 732 bp, Bovine  19866880675385
taccctaacacatatatttcatattttctatttccaaaaaattggatagaaaactcataatataaataagggtgaggggaaggacataccacttgtattaaaagccatgcagcacactggtttttcatgagcagggaaatgggccacgatgccatcactgtcagagtcctcgctcacaagcacctgtacagaaaggaagaggcaaacggaagttaaccaattactgaccttgaagagacacaacaccactacatccctgaccaagtaacaggcttccgctacatttgaagattattcttcataatacaaggtgggcatgccacttcagaaatagggaaaagatgtaaattgcccccagcgaatcaatcacataacctctaaaaacaactggttgacctgactgcagatgacaatgatttcttgaagcttcagttcagaaaaaatgaaaagcctaaaatcagctctatacagctttatctaaaaatatgaacaggagttcttattgtgttatggcctgctgaaaaactcttgcccgtgactggaacagaacagcaaaaaaaaaacacaaaacaagttaaatacaaacaaacaggcatatatatatttaggggaattaccaaatattttttacttaaagtacaaacactgtggtctttaacctctagtttttagacagacacaacacttctttgaaaatactaccagtagaacaagcagtttggtatgtcaaat

SEQ ID NO: 27334 - DNA, 1753 bp, Bovine  19866880702859
tatcaaccaaaataatacgtgttaagtgacccaggatcaaggtatagctggttacacaaaggattgttaaggatcttcaacataacttaaaaagcagaagttttaaaaaacctgatttaaaaaaatttttttaattaaaaaaaattttttttaaataacagcacaagattcaaaaggctctcaaaatactaatatattatgtatctgtttcatttcagtcttttctgcaatcctttagagaactactcttccccaacacccatgtgatgtcggtaggactgttaatctgttaaacaaggtaccactctcataatgtgggtagattcagaatccaggcctgtcaattaaataaagtatgccattcctgtgtagtcacactagttcaagaatgagtatgagattcaatctaggccatccagagtaattataggtgactatcttttttttccaggttacctagctggaaaaaaagctagcaaactatagttatcactgtttccattgggaagaacttgcctgattataaagccaccacaatagtcaagtatttttttcataagtcctaccaaagctgggtttgtgtcaatggcaactgaaagagttctaatacaaactgtcacaaagcaattgccactgagttattctgaggaacaataatatacagagggctggagatggctgagggaaaaaaaatgaaggagtaggaaatatactggggtttaaaagatgagtagaatttggatttggacagacagagagtagggcaattcaatacatagaggtgtaatcaaaagcagagatacaggaaagaacaaggtatcctcaggggattgtgaggtaatttttcaagtgctcaagttggaagtctgtagcagaaaaggctgaaaaggcagattcaggttagaccattgatcatcttgagaaagcttgagaaatatggactttatccatatgagatttttaagcagaggaaagatgttataaaagtaatattagaaagactgatttggcattgatatatacagttggtcaaaggaaagagacctagttgaaaggcaaccaaacaaaaggatgtatagttggaggagctgaaggcaaggaggcagaaggggctgagaaagtccttgtgataggctgtgtgcatgctcaaccataggggtattaaatataatgccattcattttgaacttccagaaatagaaagctaatgagagttgtacagtcagttctaaaaagaggagcaataatataccattattcattctttgtcttatgctgtaacaactggatgtctctaagaaccaggtaaataaacataaatgttgtatccaaagttcacttattcaaagctcacaaaaaataatttgcatagtatgcatattctcccaacgtaagttcttcaaaacatagatttagataaatattttataataattctttatagctatcataaagtgatacctataaatgagtctcaaatggagataattttgcagccgaggggatatttggcaatgtctggaaacatttttaactgtgacaactgtgagtatactattggtatctaatgtacaaaaccagagacgctaataaacatcctataatgcacaggacagcccaccacaacgaagtatgtagcccaaaacgtcattgctgtcaaggttgaaaaattcttttataattccacttcagtactaggtccttaaaagtacttattactttgataattaaaatgacaatgtctaaaattcat

SEQ ID NO: 27335 - DNA, 2181 bp, Bovine  19866880712106
ccagactccccccaggtacagcttgtccagatgcaaaacggcagtggaccgttatggtcgcaggaagaaccaaacgaaagcgctttagcttatgtcttgtgtgggaatattatatgatgctttgggggcagcgcaagggagaagagcaggtggggcagagatgaccctgtgtcagttacccaatgaaatctgttatctcgtaggcaatgaggatacgtcatttttctaattatatattgcctgtgactgttcttctgggaatgtggaataaaaggaaagtgaaaccagagacgtacaatgactgactgttagaaaactttaataattaattagggagcatctgcggtaccacagggtcagggtgcgaggaagatcactggtccgtttaatatatagctcgggtcaaacctgctcccttttatatgtgttggagtgcttcagctgttgtcgcactggtacgagagatggctcataatgaacagagtagccagtaatacatcgtgctattgctagattattctatgtgtgaaattcagcaaattcctttacatataagtggaaacatttataagttagaaaacttctaggcttccatagagatagttaggtgtgttatttttgacctgaaagccttctcctttttacaaaattattttttaaaagtccagagtttaatttttaccagtttgatagtatgaaagcataacctgtaaaatttttcaagtctctgattactactattttatatgtgtttgttggctgttgtatttcctcttctgtgaattgcttgttccttaggaaatgccttagtccgttttgcttttggattacttgtctttgagcctttcttcttaaaaggcaaatattattttctgagctaagaaactacctttccaagcagaatttcttcctcagatcctgagtgctttctgatcagaaacagagtttggtaaagagccttctcttattgtatggctgctctataaatgctgtttttaataagtaccgaaaatatattgaagtttgtccttggatgagggtttatcactgttggcctttgggtgaactttgagcctgagctgtttcattcaaggcagcatgatgtcatttaactcacaaatttctctgttgctagaaaaaggaatgttgttcccctaaataacctgaaggactgaataatactggcacaacattattcacctctcaggtctccactaaagacttcagcatggtaagggttttattgtttgcagaggatttgtggggatatgttaaggagtaggggcaagcaaaaactgagtctggtcctgaatctggagaatactttattctgcagcccactcagctgccagtaagacccagctcacactcacttttccaaataaaaaccttgggatccatttttgtttcttcatattgaaagactctctaagtttctttctagtgctgtttgttcaacatatgaactgattttaggctttgcaacagcagttaaagctgaaagttgcatctcagataaaaaagtagatgccatttgggtcagccctgctccacacccccttacttgagaagtagatctctctgattccagtggcactgagcttcgtttcaggaagtatagcagttttttttttaccatctcctaaagttgggagcttggagtttcgctagcagcggagcctgtgcttgatcagcagctgtgtcctctgaagcttcgagaatttattactgggagttcaagagatgcaggaaagactagaacaagaacataacagaatcagatagattgtcccttcattgagtttataaataagcccggctcattgtgcagcagtatgctttgtgttagtttttagaaaaacgatgcttataacctgtatgtggttagtctcttttaactttcaaatgtattgtcaactctttttcctttcattgcttttaaggatgaatggtgcctgagatcaaatagttgttcctttcatttctttaatagaatatctaggtcctctgtcccctgttgtaaactcagtagttaggaggatctaattttttcctgagtatccaaaccgtggccaatacacttgagaaaagtaattacctgttctaatataaagtgtattaatattaatgataaaaatgtactttctctctttgaactggaagactagattcgttgcagat

SEQ ID NO: 27336 - DNA, 1649 bp, Bovine  19866880723764
cagaacaccgagaagacgcctgtcgggtggtcctcctcggacataaacactgagctagagccctcactcacaacacagatgtctaggaggagcttttgaaaaaaggagaggcaggctggattgtaattctgtagagatggaagggttatggctttcctaagtgcatatgtgtgtgtgtgtgtgtgtgtgtgtgtgtgtgtgcttacagctgcttgcctggggcaaggctcacccaatcatctaaggatgcaagaaactgccctagtccccaaccgctggactcagtggcagacaacagtaccaaggccaaaggcagcataagaaagagctgtctggcaggggtggggtgtggtcacaccaagcctgtctgcttcatccttgcccctcggggcttgcaggacccaccgacactcgccaagctctaaagcctgcagcagggcagaggcaggtgcgctgccttagcgttcgtcgcccaagggctgctgaaaccttagtgggcaaggcggtccctttccctggagaaggctgtccttcagggcaccgcctgtacagcacagtggcggaaccacagcaagtctgtaggcagcagcccatggagcaggggtcggttccataggaactcccctctgcactgggtttcacaataccagagcttccagaatggatggcaaccagagtgttaactagagaaacacggtgggttaagacaaacacacgcaccctctcccagcagagaagccccacactcacaggcgccgctcacgaccaagtcaggctaggagtgcgagcccacctttacctgttccgggtcccaccacgtcccggctcggggactcagccatggcgtcggccagccgctcccgcaggccctccttcggtgtgctccatggaggccatgtgccgcagcccaaagccctctggccagctcccgcacacctccagcagggtcacgctccggtcgaaggtacctgcagcacacacggggacatccgacctgagtcaccttgcagagagggcaggctgttctcgccgctggcccaccgccacctccccgcccccgcccggggcctgtttcagcccttcccgaggccggaggaaggaacaccatgaaacatggatgcacggggcagaacgagacggctcatgccaccagctcagggcatggagatttccacgatgtggggttagtagtttttgaactgttttcgtttttcctattgagtggcctgtaagatctttattccctgactagggatcgaacctgggccctcagcagtgaaaacatgaaaaagagtcctaagcactgaactgctagggaattccttgaactgttttcagaggatctatagggttcccctgaagtattcagggactacttcaggctggaggtcaagggcagcagaattcttgcccaggttcaagcaaaactaccctacttgactctgttaatgcaacagggcttcccctaaagcttcatttttaaaagggcttaccgagttcacattaaaaaaaaaaaacaatgctttcaaagccactatagcctctaatctgtaccaaacgtcctcgtctcacatctgaagctcagaaaagttatgtcccaagatccaacagcaggtttgggggccgggtttggttcaaggacttggatg

SEQ ID NO: 27337 - DNA, 2453 bp, Bovine  19866880778657
atgtttttttagtctttaaaagagcttttttgcccctttttttttctgtatttcatgatattttaaaagaattcaagtcaccagttgtccttaggaatattttataatctggatttttctgatgataagattcaagttaaagtgtttgataagaatgttttgcaagtgatattgttacttcccatcatatcatatcaagaaacacatgctatcagtttgtcttattacttgttgatcatttagtttaatgttgattaaactgctgtccatcagatgtcattttgcaaaatatatctcagtcttgtgtatcatttaaaatataggactataacatttttcaacaatctaaagtgttcatattaccttttgaatgggcttccctggtagctcagctggcaaagaatctgccttcaatgcaggagaccccagttcaattcctgggtagggaaaatcccctggagaagggaatggctacccgctccaatattgtggcctggagaatttcatggacagaggagaatggtaggctgcagtccagggggtcgcagggtgtcagtccgactgagcgactttgaatattctttagaatactaataaaatttgtagtttctcataatcaaatactaagactagatctgtataaatatagagaaattgtatataactaaaatttgatgggtctgattttctatgactatagatctttgagcgtcagggaatttgtgaaacagtagttcctgtcataagtgaatcttagagacttacctatagcagatggtgtgtgcatgctcagttgcttaatcatgctggactgtttgtgattccatggatggtagcccgccaggctcctctgtccatgatattcttcaggcaagaatactggagtgggttgctgtttcctcctccaggagatcttcctgactcagggattgactctgcatctcctgcatcttctggattggcagagagagtctctacctctgagccacctgggaagcccgtagcagatggtaccatccctcatgtcttattttggattcatttctaacttactcatttcctttgttcccatgatccaacaaaattctgttacatggttaattttgtaaaggtattgaggaaataagtaaaacctaatttctgtcattctaagagaattcagtctgcctgaagaacttaggcagactttaggtctaaagtaaaacatctgtgacttaaatctgggcttcccagctggtgcagtggtaaagaatctgtctgccagtgcaggagatgcacatttgatctgtaagttgggaagatctcctagaggagaaaatgacaacccactccagcattcttgcctagaaaattccatggacagagaagcctggcagactacagttcatagggtcacgaagaattggacacgactgagcgaccgagcacccttgcatatataactaattaaagataataggaaaaagcccaacaatttaaaaataaattttctctaaagtcgttgattgatctttttttgacatacacaattaaggctcccaactaaatgctaatttgcctgccttattttggtataactctaatactgacacatttatattctaggtttgggttggcaccattgggtcagggcccaagggtcgcagtctctgtgctaccttccagcacacagaaacatttgaattccaggatgaagtgggagctcttttgttatctgtgtgccagactattagccaaggaattttgtgtttcctgccatcttacaaggtaagggagtatttttgtttacttttgcctttgaataatcatatgacattaccatgataagcttcctaggatcaaatgcaacagagtaattacagttttttaagcatcatatattattttgctttttattggttaagatactgcctgcttattctgtcactgttttacctggaagtccaaaagactgaaggtgttcaagcattttagtggggtgtttttgtatatgtgatttttattccttggggcaacttgatattttctgattaaaggaaaaaggatcattatttttcactttgataaactagactatttgaaaatttcaaaatatgaatttaacatacgattttctttaatgcccatctttttgcttcatgtatttggctaggaaaaaaaactgtttttcttgtttttagagtcgttctgagttttaatattttcaggagttaaattgagttatatagtatattttagtcctcctaatactcaaagcattaaaaccacatataattcctgagggtattatcatagtttatgaaaatctaagctaaatttcagtgtagaggtggtactcccttttcttttttctaggaagttatatatataaggacagtagtataatatattagaatgacaatattgatacctttggctcttctggtggctttccctctgtatatatactgcta

SEQ ID NO: 27338 - DNA, 2508 bp, Bovine  19866880784891
ctaactcccagtcagtcaattcagtcactcaatcatgtccgactctttgcaaccccatggacggcagcacaccaggtttccctgtccatcaccaactcctggagcttgcgcaaactcagggtccattgagtcggtgatgccatccaaccatctcatcgcctgtcgtccccttctcctcctgcattcaatcttttccagaatcagggtcttttcaaataaatcagttcttcacatcatgtggccaaagaattggagtttcagcttcagcatcagtccttccgatgaatattcaggactgaaactcatcaggactgaaatttcctttatatttgactggttggatctctttgtagtccaagggattctcaagagtcttctccaacaccacagttcaaaagcatcaattcttcggcgctcaactttctttatactccaactctcacatccatacgtgactactggaaagaccatagccttgactagatggacctttgttgacaaagtgtctctgctttttattatgctgtctaggttggtcatagcttttcttccaaggagcaagcgtcttttaatttcaaggctgcagtcaccatcagtagtgattttggagtccaaaaaaataaagtctctcactgtttcatttccccatctatttgccttgaagtgatgggaccagataccatgatcttagttttctgaatgttgaagtttaagccagttttttcactctcctctttcactttcatcaagacgctctttagtccttcttcactttctgccataagggtgatatcatctgcatatctgaggctattgaatacttctcccagcaatcttgattccagcttgtgcttcacccagccaagcatttagcatgatgtactctgcatttaagttaaataagcagctaagggacaaataattccaatcctaaaaaagtattacaggggataaaacagtggaaatactctacaattcatttaatgaggaagcaaaactatagggacatctcctgaacttaaatgcaaaaaaagattcaaataaatgctagcaaactgaatttagaatatatgaaaagatacactatgtcaatagggatgtagagtaatttactattagaaatcactttaaataagctttatattaacaatttaaaagagaataatagatgaatttttgcttgatgcaaagaaaatttcattcatattttcaaaattcttaacaaattaaaagtagaggtgagggatggtatggagagggaggagggaggagggttcaggatggggaacacatttatacctgtggcagattcatttcgatatttggcaaaaccaatacaatattgtaaagtttaaaaataaaataaaaaaaaaaagaattattcctagcttctttgcatttgtaaaaagggtcatttctttaattggttattgttggcctgtagcaacaccagcaatttctgtatccagcatccttgctgaactcttctattagttctaatagtttgctgattctcctggattatctatgtagcaaatcatatcatctgcaaataaggtcagttatctctctttccttccaaatcttacatttcttaatgctgtgcttactttattgcattgactagtacttccaaataatgctgaatagaaacggtattaatgggcatccttgtctcatttctctttgctctctcttcactgagtaaaaccaccataaattctaaagctgtgcctcccagcttccatttgtataagtaactgtatacaaattaaaggaggcacattagccaagagagccatgtgactaccatgtgcctcagagcatatgatgtaacattctaataaagacatgacaagcctcaacaaccacagcctacagtgaaatagccttacatgaattgtgagccttggcttgggtatagcttatttacaaaataaggttcaaccaattcctgcataagccaccatcagttcatattccagaaactgtggagacgatcacatcaaacactgcatgatttttaccatgttagcttttgaaactggggggaaaacaggcagaaaagaaataaacagaaataaacagcgtgttctctctcttttaatgaatgtaataacagaagagtaatgaggttggaaaacagatgtggacaaaggaaaacgcatgctacagtgtagcccacacaatctggaaaggaatgataaaaaaaaaaaaaaaaaaaaacaactttacaagctgttttgagtcttgaattaaaaggagtaatcaagcaaggctgacttataaagggtcagggggtagcatcctgcagcagagaataagcaggactccttctccttcactgtctcctgcccagctgagtccaggaaggaggattttttcccatgcagcagcctctctgaacatatttttgattccgggtttaataactgccatctaacctccttcccctatccacccgctccccagggaggtccttccctaatgggtggcccttttcagtct

SEQ ID NO: 27339 - DNA, 2843 bp, Bovine  19866880798157
ttctgatgtctattttgtctattaatataacagttcctgctttcttcagttttcactggtgtattatttccatccctttacttttatcctatttgtatctttaattgggtttcttgtagacaaactatggttgaatcttcccctttgatccaatctgacagtttctgtctaattttaattgcgtctttaggccatttatatttaatatgacttttggtatgttggatttaaatccaccatgatgttgtatatttactatttgtctatatgtttttttcaggggtggttccttttattctccccttgacttcttttggagtaactgaatatttttaggattccattctatctaatttgttattagctatataacttgtaattttagtggtggatttagcatatgtttttaattaatcgttaaagatcaccttgaaggaatatcataccacttcacatacagtataaaaaccttataactttttaacactgccttaaagcaatttaattatgatgtgccttatgtcatgcttttaagttctgttaggcaaaactgcaatagtttagggaaaattttgcctcactgtggaggaaaaaactttctgtgtattatccccatttgcctataaattatgaggttttccactattaccgctggaaacagaggattcccagtcctgtgagagcactggtaaatgttcactctaacccttagaagtggtcccttcctgggtcttgggtagtttctcatgtgctgatcagtactcagctgaaggcctataggatgtcctctgcagatctttagagctagctatctgtacagctctctgttctctggtactgagctctgtgaatacaagtttcttggcctccccaaactcccagcttcatcttttccactgaggaagactgctgtgctctatgtggatttcccctcccttgttaccatgcgtcctggtcatgagccagcacaactgtaggactccgtttgttttgcatctctcagggtaactgcctgatacccaataccttgaaaaccactgtactgtacaattgtctaccttattttttttcaggtggaaggatatgtctgatacatgcatttactgcaggccttgtaaaattccatgtgcagtgtatccaactaatgtttagaaaatgaatgccaactatttcacctttatgaaaatcaactgagagaaactgaacaaaatctactttaaattaaattagtaaaatatgatccatgtccacaaatatccttagcttaaactccaattcatgatcttatcaccaacaccaatttctgcttctcagatggtttttaacatctacatgacaaatgaaaaaatatgctgatttttctgatttcatgtttatttatggagattggtgttaagattttctaaagtatactgaggaatccttaactaaaagaatcctctcacagcagttgcaaaaccccaaactaagtcattacacttctgtgtaaaagactggacacctgttatcttcattctagatttcatacacacacacacacgcacaatctgttaagtttaaaatgatttactattttgcttcaagtaaaacactttaaaagtcatttaaaaacaggcttattagcaatacaaggcactgtctaaacacaggaatgaaaccgggtatttgaattgttgaacagacacatttcctgtttatgagatcttaagaactaccatgaaacatattccaattttaaataatgtgttagatcaaagcacaataagaatcccttatattgctccttaaaatagatgatggtttcagatggttaagaaaagaacaggctcctgcctaatgtgcccatggatgggagcatatttatccacactagtatcttgaggtgagatttttctgtttgtgggcactaagaaactaggagaaatgaccagaaatcagctttcactactctggatctttcaacatcttaggacattactgatgcgaacctaagtctttgcaaaacgatactatattgtaattagaatataaggtatgagcagttatatttacagtgactataagccctcaaaagaagttaatgaactgaggctgaccttgatcactgactcagatcctgcagcacagggcagtacctgctccctctcccacattggccaacctctgctgcaacagtaatcaatttgccgtcttgatctctcaagcatatcatacattttttgatccatcattaagcctcaaacttgtggcctaattaaattactgaggaaagacactttggaattctagactttggcaggagaaaaagcagagataaatatttgagtaaggtgagaaaagtattacctaatctccatggggttatttatattcaaagttgctgttcaaaataaaattttatttgactgcattttttaaacacaaacgatgtccaaccatttgcagcatggtaattaaatgccaaacataaaacaaaggagaaggaagaaagagaaaaggctcaagggataagacagctccacatgacaggtgtaaacagatatggaggtggtgtctaagggtcatcaaggtgatcttccagagtgtagaagttacatgggagaaaatgtggaaggacagaaaaaagcttagagtgagagaaatgaaagaaagacacagagagagagatcagaaaaaagaagagtcaagcttgatcttccaaataaaataacctaataatgaattttgtcaataggcataaatttcagttgtttccaatgaatgataaaagccactggggaaatcaaattacttctagaattaagagacaggcagtgtcataccagagaggaaagaaaacaaac

SEQ ID NO: 27340 - DNA, 1426 bp, Bovine  19866880824663
cttttgttaccccatggactgtagcttgccaggctcctctgtccatgggaatttcccaagcaacaatactggagtggattgccatttccttctccaggggatcttcccgatccagggactgaacctacatcttctgcattagcaagcaggtcctttaccactgagccaaccaggaagcccagagtgctgggtaggtacccacggtatcatgtcagaaacttaaaaatactgatgatggggtttcatttttctctcaaaaatctaactgattacatgtctgggagagagggtagttttggcaagagactggccatgaaaagatctgaatgtgaagtccagatatgacaatattgtgctgtataaatttatgcctatatattaatcttgctgagttctaccttctcttaaggtggcaggattacacattctaagattatgattctctcttccctgaactcaaagcatttactatctgtacattaattgtgcaattgatcatagaatgctttgtggcatttcgtcatcttttaagtaattcaaatgcatttatgtctcatctttcccaaccatagctccttgaatcgagaaaggcacagttttcttgtctcccacactgctaagaacagaaagacacagaaagcattcaataaataccagcctatttcatagaatgaatttctatttcatagaatgaatcgattctttaagaaaatgctcagagggctgtcacctagtgtttggaggctccgtcacaagttgccttttaactggaaggaattgggaaggaagaatgacgaagccatcagttacaggagcttctttataggacaaaaatatgccaggaaggaattcaaggctttttgcttgttgttgttcagtcacacagtcgtgtctgactctttgcgaccccatggactgcagcacaccaggccttcctgtccctcaccatctcccaaagtttgcccaagttcatgtccactgtatcggtgatgccatctagccataacccgccaaaagaagctaccgggaaaggtgttttgttttccaaggatgaaaaggaactgggcaggggcatctccctgactagcagacaccagggaaagacttatcaagagacttggtttcctatgttcattgctaagtccaagcagcaattatctactttagcaatgatcattaccatcacaaagaattaggcgcggcccatggtggcagtatctggatttacaggaccttactttgactccagctctagtacttggtaactgtgctgatattactcaacatctccaagtctcattttgctcatgtataaattataaaataacaactccttcctgagtccattcaagaatcgagcagtaacatggacggacctagggatgaccacactaaggggagcaagtcagaaagagaaagacaagta

SEQ ID NO: 27341 - DNA, 2182 bp, Bovine  19866880923370
atcattccagatctgataccattttaggaaaacaattcaccagtattttcaaagaaatctcaaaatattcatgtcatctaattcaggaatccataaatgcacagaaaaaaaaagaaatctcaaaatattcatgtcatctaattcaggaatccataaatgcacagaaaaaaattatataactataagaaaaatgtttttaaaatatttcatgaaatttaagctaaatatgagttaaaagagcagggttcaatatatgacaggacgtgttaagactagcaagaaacgagtgacttttgcgttcatggctatatttttttccttcattttataaatgtataagcaagaacatgaataagcactaaaatcagggtaaagtagttaaaagaaaaattaaacattaatcactttatttaggagttaatggcagaaaattctcttttgtcagaggtaacaaggaattgcaatcaacaccaactgcactggtgactaatggcccattaaggagctgtcatcagcacagtttcgtggaggttcagtgtggaagacatgagtgcgttcctcaccggtcacaatattgtggtttagaaaattagggagtttggacttgctttttttcaaagcacatcaagtctagcctcgttccagtaagtctattttcagctaacagataaacagctaaacagttactgaatgaagtaggtcactttccttttaagtaggcacacaaacacacaattataccaaagaagagctggaaaattatcgctggtcacacaactaaaaattattcagaataacaatacagtgagctatcctgaccaaagtgtgtgacgcagataagtcagaaagaaattgaatacttgagaactatatctcattggtatattgtaaattaactaaataacaccgacgctgcctttactgtttcagatttctcttcactgagctaaccatcataactttttcatacccaatagagaaaagtaagccattcttacaaagattctgaaatctaatatatgctgctgtaagcaaaaagccattcagtattttcctttgactgaaaaatacgtaatgcttctctcatcaaaccccatcatggaagcatttgtgatcaatcttgaagtatttctgtatttgttttacataaaacagtgtgacctttgattccctccctgtggtttgttttaaacagttgttcttttctgaatagttgtgctttctattacatgctgtcattcagattcacgatgtcatccctattattagaactgttttgttgtatacttcacaattcaaaagaacggtgattataaggataccttataatcagcataaagtttacgagccatcatcaaaatgaaccctcgcgcatacacaaaaagaactcacttgacaaacatgcagggggcagctctgtgacatgaaagggtctttgaatgcaccagggccttcactcaagttttcttaatgactaatattctctttgtgtcaagaagattcataaatgttcaaaaatgcaaagggatgtcagtatgggtagaatgattcaaatcacacacacacacacacacacaaatagaatccagaagtcactacttaaaatatgcaaagcttctttccaaagtaattagattatagacttcgacctagcaaacagacataaataccttaaactggacaaacgcaaaccttaaaatcattacaagagaaaataaagtgtgatttaggaaccttaagagattaaatacctaatcatttaggcaccaattctcaggtgacaaaataattctgacttactttctaaatttgttcgacacttgtgagtgaacagggaagggaaaatctcaatacaattcaggagagaaatgggataattactccacgtaatcaaacctcccagagactgcaggctactcactttagcagcactaatgactgtggcggtgtaagactgaatgttgtctccacaggctccaccacgggactgatgacatcgaatcaactgcaaagagagagagagtgaccattctgttccactgtttaactctacaggctcttaggacagagcttatttaccacatagaatggtggtgatgggtgggaatatttgcatgagccctttttcgacaaacagctaaaagccctgctgagacacttttacccctttttataatctatc

SEQ ID NO: 27342 - DNA, 1299 bp, Bovine  19866880925491
ctaaacggcataactaacagagtactcgggactttaaaaccacaataaaataatagtcattctcaaaacgaagtgaaaactgtaaccccaaatttgaaagaatcatagacaaagtgatggaacaatgtgagaagaatgttaaaatcaatagtattaaaatcaatagcaataggataagaaagagcaatagtgtcaaaatgataaaaccgtaggaaaaaggtgaacaatgaaaatactaatattagtattgacagaatactataatataatttattattgatgctatagtgaattattaaaataaatgttaaccaaaatcttaagagcaatagtactataaataaagacagcaacaagaattgctagagtaatatgacaatttatgaccaaggttttaatagtcccaacaacagtataaataatgatagagtaataagaagtagtgtaccaatgtgatgaaaaagaatcagagtattaagagctacaacaatatgacaaattatgacaaagtaacaagaagtaatgatgtggtgaaaaataactagcgaattaagatccataacattacaaataatgacaaagtaaagagatattgtaacaatgtgatgaagaatacctggaatattatgaacaatcctaacaaaacaagtaacggtaaaataacaaaaagtattatacggatgtgaagaaaattaatgtgaatattgagaacaataatattatgttatggtaaaaaattttggaaactgtgaccaagaacagagactgaagaaccagccacggaaacattttagggatacagagtaaaaataataatagattaacatgacctattggaagactgtatttaatgattgcctaagtattagtacaatactaatagaattactaacgtgccaggaggccctagaatgatgtgacaggaaagccataacaacatatttgataatggtgaattaacaaatcaaaccagtactttaaccatacagtattaaaaataaaagcactaataactagtgtgtgataggatagttttaatgttattgaactggccagaatactactctgataataaagataattaaaatgcttaaaatagtataaactattaacaattcccccgacacaagaaaagtatcaccagtaatctagaaatggaaagaaaaatgctatccttagaaaacgagacagctgaaaagagacggacccaagcgcacagggcgcggagccgaccggccgcgcccgcagagggctctaggagcagggcgagcgccggccgcggccctcggctgatgccgg

SEQ ID NO: 27343 - DNA, 1101 bp, Bovine  19866881012532
tctgattcggaaaggccacacacgtgttgcttagaatggcagattctcctcactcaccaaagacacagatctggacatcagcaaaatactttagtcagtggtactttccagcacactctgtgcctggtgtgtagcagggctggaaaattgccacagagacattcaccatcgtccttaaaacacagcaggggtcatttagaatgtcaggtttaaaaaccattttccctgcctccctctccctaaacaacgtcagctttttagctagccttactgagagtcttcattccttatcgatcctcaagtaacagcaaaatgaaatgaaaaggacgttgagctctcccaaatgtcctcatctttctgtccccgctaacatcggctcttctcagcatcttcattctctgagttgattctccagttgaaatctcctaccttgagaatgatgatgaaaaagatcattgatgattagtcccactgcctttctgaactacttgcaaaagggagtccgatccaggcccccaaaggggatggcacgcaggctgcttcagtgcctgtgtcttgggctgcaccctcccacctttccctggtggctcagctggtaaagaatctgcctgcaatgtgggagacctgggattgatccctgggttgggatggtcccttggaaagggaacagctacccactccagtattctggcctggagaattccatggactgggagagtaatgggacttgaaggctgagctttaagtccatgggttcacaaagggtcagacacaactgagcaactttcactttcactctcacgcccctatcagaacagagatttcagtgccctcaggtacaagctaccttccaggtgagagttgtcacgtgtaatttgacccttacactgccaaagatgagattctgatcaaacctgggataggtatttgtatggattatttcatggcagttccgtagcattcttcagagggtttgggttactttcccaaaggaatctcaatacgtgtgccactttggtagggcagttagcatctctcgaaatgttcgcctcacattcagatatcagagaggttagttcgggccgggtcacacaataagcg

SEQ ID NO: 27344 - DNA, 1159 bp, Bovine  19866881033869
gattgggaaaagactcccccttcggcttcttactacctaaagaggacacttagtgcatctgtgataaccgtttgacattccttgtatcaggctgacttttcttatggcagagatttttagtcacgagtgaatacctctaaataagagtttttaatatccacggtagggtcctaactcctgaatcagagggcctatgccagagagaccttggaaaaatgttggtatggtgcctgaaacttttcatttgccgtgaaacatgttcttaattatactttttattccagtccacctcactgattaaattaattactttctcctctgttcttaaacttttactgttgtgtttatcacctcgtattaaaggtagttgggaaccatttccctttcaaaaccgtgagctcatctttgaactccccacagcaccctgaacggttctgacacataataggcactcaataaaggttaatgaattcaacgtttcagcatggaatattgaaaccaaatttttgaagttgagtagacatagtagttggctcctaggagggggactaagtgcctgggtaacagaagtgaaaagacgactttaattttaatcttttagactacactcatgcgttatccttgcaaaacataaatgaagctcttaccagctatcatatttttcagaatttggcaggttaccgtcggaagatattattgtttatttacttacacaaataaactgaggttgctgctgctgctaagtagcttcagtcgtgtccaactctgtgcgatcccatagacggcagcccaccaggcttccccgtccctgggattctccaggcaagaacactggagtgggttgccatttccttctccaatgcatgaaagtgaaaagtgaaagtgaagtccctcagtcatgtccgactcttagcaaccccatggactgcagcccaccaggctcctccatccatgggattttccaggcaacagtactggagtggggtgccattgccttctctgaaactgaggttaaatgatggttaataacttgtattttgttaccttgttggtgatagaacaaagatacgactctgtgaaaccttcagtttctccaggagattgaacaccatcttgaccacagtagcctaccccttttattgaagtctagttgattaaa

SEQ ID NO: 27345 - DNA, 784 bp, Bovine  19866881051523
agtcatcagggaagcccgtgaaccaatacaacagccaacaattaaatctggtaaggaactgggacatctcagtggtgaaaaaatagaggtaaaatatcttcaacaatcccatctcatatctttgcactatgtaagccctacagaatttagatgcaactgtgtaggaggttataattgactgagattaatttttccctatttgttaggacagaggtacaaaagaggactaaagagaatttatagaaaatgaagttacatatgttgcaagcctgagtttaatggaccaacgtaagcaccttctagctaaagaaaaatagtatcgtttacatttcccaactattcttaggggtttcgcaggtggttcagtggtaacgaatctgcctgccaatgcaggagacgcaggttcaatccgcgggtcgggaagatcccctggaggaggaaatggcaaccgactctagtattcttgcctggagaagcccatggacagagaagcctggcggggtgcagtccatggggtcacagagagtcggacacgactgagcaagcagcactgttcttagatagttaatgatcctgggttaggaaaagggatatggaattttgaaataaaattttctgctatgctctatccctacttttagtataatcatttaaaacaagcctatccatctaactacaaagggtacactgtcaactttttttacagaatacaactccaaaagtactgcctgtacacacaggcatttgataaatatagatcaacaacccagggcaggctgagcag

SEQ ID NO: 27346 - DNA, 1582 bp, Bovine  19866881078068
tagagcatatatgctttctgtttaagcagttaagaagtgtattagcccctatgataaccagaaaaaccagagcgtgaataccgataaatgcaagccttccgtctcggaaagtcttcacttatttgattaagttaggtgaaaaacagagcagtcatgcttgtagcctttcttcctttcccctttcctttcctctttttatttctaatgcgaatcggaagtctatgtggagcagtctggctagccccagtctaacctcccccatctggaaggggactaaccagccttggggctacttcccaacccttcccagctgttgggttggggttttttgtttttgtgggcttgagaaagcatatttatataaatgattgccatatcctttgccagctgttgaccctgctcttgtcccggctggggcatggttttcatttttagcggccacagactggaactgaccctgatagagttagcacgctatgcaaacagctttacgcgctattgctgtgacagttcagacaatggatgcacagtgtaatccaagggaccggtgtttccctttgggcaaatgtcacagaatccagagctggaagtatcagttgaaaaaataaattctgagatgcactgtgttatggaacaacttctcttcagttattcagactgcaaagatttcggctagcatcatagcagggatgcatcagcagcaacaaatgagttttctcttatccacatatgaatctgagaagtgccctagatagatctgcagaggcaggggtcgcaatagttatatgagaggttaaaaaagaaaagctatattttcagttttaaacctatgtataaatgcttctgatgctaatgtccataaattaaaaaaaaaaaaaaaaaggtccttgtaccttaataggagaagaagataaaaatcagtttgggcttttggtaattattaagacatacatatacaatcattcctaaagatccaacctgatcatttcttaggcacattactaaccagaaaaaaaaatctatgtttaatctgtggataactgtagtcacagcaaactagaaagtttagaaatattatcagggagagtacaggtgggggaggggccccacagggacaggagcggtgaatattccattaaggataatgcatcctgaacaaccagttttcatctgcagctaaaagggaacaagagaataaacagcaaatttttacaactttcataaattttcttaagtccttctgtccacaagcacaaacgtatatgtgaagaataaagaagtttaattaaaaagaagtagactgttaatgcttaaagtgatacacttcaaaaactgaaaacttctaatatttgataatttacaggtcactcagtcattgcaacagatcattattttgagagtctaattgtaaagagagaacagcaagacagctagcttgtcagaaagaagtcctgtattatgttccctctctctgcaagcctgcaggctggccggctatggcagatggagtctgccatacataactgtaattaaaatgtgaaccccatcttagaggtcagaatagactagttgacaaacaggg

SEQ ID NO: 27347 - DNA, 1167 bp, Bovine  19866881132638
catactttgcatttcttaattaaaagagagaatgagcattattaattattgtcatcctcagcacacagtatagttatgtgtgagtagctccatattaaatttcaagaacaaatgtaaacttacccttgattcagcaaggtttctagggtcacttatttcagcaccaattaaaggacgtgggaatagagactgggtgatacaatttctgcactgtaagtagctggttaaagaacattctttcatattccagatggcatttaaagataaacctttctccatgcgcacaaaaaaatttaaaaaggcctttcataaactctgaaccaccagattcaacatctcaatttctcttttaaaggtctaatagaaagtgaactgtacattaagactggataatgtttttgaaaaccattagtttaacatatttattttaaaaagggaaaatttcaacaataatctttagtctaacatagacaagtatagaaaataagctttaaaaaagccatagctgacatttgctaatgtctattgtgtaaattcaaataagtttactctcacagcaacaataagtgtgtattattgtcctcattttccggattaggaaactgggtttcagggagtataaattagaatttaaagacagtagcctggggtttaaaatgtccaaatcccaactcatgcttcaatccatctggcttagtgccctcctaagaatcaaaactggttttcaagagaaaaatgtaattccttgttttcaaataaaaccatgtataattgagaacactatgaacaaatttctgtattgtacagtaagaaaaacttgcttatattaattaaatgtggaatggtacccttaaaaactttaacaccagttagttttaaaacagaaatttgattatcacgtaaaaatatgagaatgtaatctgtctcataatagaagctgtaatagataatacatgaagattcataatctaagagaagactatttaaaaagaatactattttaaatgcaaatagttcctcagtaattagaaaaactaaagtaattctgtccaacctaccctggaatatgtctatggaagcaacattcttccttttacagtacacattcatagcaacaataggtatcatcattatatatactgcttttaggacaaaaagtttctccat

SEQ ID NO: 27348 - DNA, 1447 bp, Bovine  19866881173727
attgaatgtggctgaaaggacacagttgaagtcacactgttaagaggtaactcaagaaaaaggactacaacacgttactgttgatgactgggtggctcaaatcacacccaaaggcagaacccaggtacctgacagtgtaaaggaggagctcctaggagaataagaacattccttgcttagcaacccagcctttaagattgaattagattgtgttgttttgtggttttatttctgaaagtaaaacttgccagaaattaggaatcaatttcccaaaataaaatactttttgttttggtgtgatggtatacagtttttggcttccctggtggctcggtggtaaagaacctgcctgccaaggaaggagacgcaagagacacgggaggatcccttggaggaggaaacagcaacctgctccaatattctcatctgggaaatcccatggagagaggagcctggcgggctacagttcatgaggtcacaaaaaagtcagacaccacttactggctaaacaacaacaaatatggctaaaaaccatcgttttcagtaaccatgtgtatgttgtattgatttttttctgctcaatgtattattttaataaatatctcatgaatgaagaaaaaaaaatcactgctttatgttgcccatatctaccaagggggagaagaagaggaggaggaggaagaggaataagctaatgatgacataggctgctgctgctgctgctaagtcacttcagtcgtgtccgactctgtgtgaccccatagacagcagcccaccaggctcccccgtccctgggattctccaggcaaaaacactggagtgggttgccatttccttctccaatgcatgaaagtgaaaagtgaaagtgaagtcgctcagtcgtgtccgaccctcagcgaccccatggactgcagcccaccaggctcctccgtccatgggattttccaggcaagagtactggagtggggtgccattgccttctccatgacataggctagtcaaagtcaaatgtagtaagagatatttaatatgatccttttttcccctcactaacaaatatgtaccttttcttccaaagaaacttggtatacttgaattcatattatacttaacactcacctgggaatgtaaaacattgtgtttactagctatggatcatacaagaaacatttttttctgaattttatacccgattttaaaaacaaaagatatgacacgaatggtattctaattccatctttaaaaactttcaagggaagttatgtttcatattttaagagtcctgaagtttcttgttcttatttcaagtgattgtccaaaagcaaaaatgtatttgcttttttaaaagatcagctagtgtgaattttgaatatcaggtttctgctttcacagataaatcatttgtatcaaattcatctgtttcttcttccatcacaagtggattgca

SEQ ID NO: 27349 - DNA, 1118 bp, Bovine  19866881222540
tttagaactccttctttatataataaaaaatatttcagagttaacctttatatatatttacttttaaaagttttttttttctttactttttacctaaaataatttccctaggtaaaatattggcagtattttaaaggccatttggattgtaagaacttgaaaattttcaacaagttgaaataatgtactcatacataaaagttaattcattttaaagaaaaataacagactgaggagatagaattttgtttatttgacctaatatttgctatattaggtcttcccaggtggcgctagtggtaaagaagccacctgccaatgcaaataaatgtaagagacgtgggttcgatccctgggttgggaagatcccctggagtaggaaatggcaacccagtgcagtattcttgcctggaaaattccacgcacagaggaaccttttgagctataggccatgggtcacaaagagtcagacgtgactgaacacacatgcacacatttgctgtattgcctcaaataacttaaaactcagttcagttcagctactcattcgtgtcagactcttcgcgaccccatgaaccacagcacgtcaggcctccctgtccatcatcaactcccagggtccatccaaacccatgtccatcgagttggtgatgccatccaaccatctcatcctctgtcatccccttctcctcctgccctcaatctttcccagcatcagggtcttttcaaatgagctgactcatttgaatggtggacaaagtattggagtttcagcttcaacatcagtccttccaatgaacacccaggactgatctcctttaggttggactggttggatctccttgcagtccaagggattctcaggagtcttctccaacaccgcagttcaaaagcatcaattcttcggcactcagctttctttatagtctaactctcacatccctacgtgaccactggaaaaaccacagccttgaatagacggatctttgtggacaaagtaatgtctctgctttttagcatgctatctaggttggtcatggggtaacagtaaaaatctcaaaaatctttttaagattgttgtaggaattaaatgagataatgatgcatgttaagcactg

SEQ ID NO: 27350 - DNA, 748 bp, Bovine  19866881608515
gttattagggtgagcctaagaaattgctgtttagaataagccaaaaagtcctatggtttgagtagattgattagtttatgtgtgtaaagaatatatgcagatggtagtctcatcttgctgtctagctcagtgagggtaaaagttaagaatctaatattaaaaaaaaaagttctgcttgggtcataagaaatcttaggaatcgtttataaaagattacagtagtgatgattagtgatttttgtggtaacagtattttttttttccttcagaacaaatacataactatagttactttttctaaaataggcattttatttcagtgtattcctttgccaaaaacaaaaacgagactagcagatatcaaccagctttgaatgtgatcccaaagtagataatactttttctttagtctgtttccgagcttcccaaattgtaaattaaaaacagggcttacggagttaaactggggaagttttatttgggcaaaaaataatgtttcctccttttcttttaggtgatttggcagcagcagtgtttttaagttgctgacattaactagctttgttggggataggtcaggctttgaacttctaagataatccatgggtatgtgagaagttcctccctaagtttactgagttttctttgttaaatggtaacaaaggatcatgcaagggaagtatagctttgatacacagtgaaaatggttaaggcctgtatatggggtttttggtaattatttaactat

SEQ ID NO: 27351 - DNA, 815 bp, Bovine  19866881676802
cctgcggcccacctaatagccggaagctaatatccgcaccccatgcttatgtgagagcacctgtcgtgtagagaaagcaccagtctggagctcagtttggagagtaggctgggagactctccagtagctggtctcatcatgcctgggatcatctctgagttatcatgggtgtcatgatcatcacacgctctcatcccaagggcttgtgccttgaagagcattgtttaatgacaagtttactcttggtatcaggcctccccggtggctggaaatcagatcagcagggtctcatgaaagtccaaagcggaggctgagccacggtctcctaaatagcgagggtgtgattagacagtatcagctccgaggacatcccagctcccccatgctgcctcacccactggtcttccctgcccctcgacagtggtgcacaaaagagcacatgtgcccccagcctccccaggaccttgctggctcaccagctgtcattggcaggcctttaatgggcgtgtgaaaccccagaacctgacctgtttctcctctggggagacagtgtaacacaggatgcccggtcgggatgaaggattcaggtggctcacctgtacgagcgtgactctctgttaccattaaggcagattgttttggttcctccagttcccagaatctgggctctaaaataagtgcacagaagacggtaggaactgatattgcagcattttctgctcacttacttagctttttccttcctctaattttagcttttttttctgcctacctccatctctcccctcaccatgctggcccgagaggtataacct

SEQ ID NO: 27352 - DNA, 976 bp, Bovine  19866881816159
gagaggggctggagaaaaggagcccgaatgttctcaagccagtgtgagtccttagttatgccttaagccctcgaagagctgacggccaaagggaaacagggtctccttcatcggacagtgactttaagttctccgacaacgcgagagggtgaataccatgccagccacagttcaagacagccggatttctgaatgctcacgaagccctgatgtcgagtgtcaaatggggccagagtgttctctaagcctctcagaaggctgaacccagagagtttatgcccttaactgcagagagcaggatcctctctgctacctcacatctctgccaagcttgatccatgtgagaaactgccttttctcccaaacacagataaaagtgagctccacaaaatttaaataaaaacctccccaatatgaaaatttcctaaccgtctgactgctctactcctaggtcatggttttgccaccagataaatctctactatcagccttcatagcctgttgagttcaatgttgcttgtgttagtgacagtgaatttgtgtttgaaaaatgaactactgatgagaactcctgttgaacctgtattgtttgttattctgaggcaaggatttggcccggcttaatccggggcttcaaagccaattgcccttgctctgtatacagagcgtcagagcccagtggcgtgggtgataagagaagtaagggttgaagacactgggaaagtgggttggggagagagtgctttgatctctttctaaagtattttctgaaagcaaaagtctatcagaaggaagtgtcttcaaaaaaaaaaaaaaaaaatctcagagaaccaactggtcttccaaaacagcatccattccacacaccctctttcctgcccccatcttagggaaaatatttctgaaaaatgctttgagtgaagtagaaaactctgtgcatgtgtgtgtgagtgtgtgaatgtgtgtgtgtgtgtgt

SEQ ID NO: 27353 - DNA, 1855 bp, Bovine  19866880413372
cctgctactggattcccaaaaccgaaggggttatagaggtcatgtgatactcttagtgaaagtgaaagctgctcagttgtgtctgactctttgtgaccccatggactatacagtccatggaattctccaggccagaatactggagtgggtagcctttcccttctccaggggatctccccaacccagggatcgaacccagttctctcaaattgcaggcggattctttactagctgagccaaaagggaagccaaataatactggagtgggtcacgtatcccttctccagcagatcttcccgacccagggatcaaaccagggtctcctgcattgcaggcagattctttaccaactgagctattagggacgcctgatactgtccgtactctctgttagatcttcctggagtctactcaaatgcgcacagatccctacccggggctccagtgaggcctccacccagctggctcagaggaggagcgggtgggaaggcctgggcccgggcagttcctttacctgtttccactggggggtgggagcagagcgaccctgctcgggcaggcagctggacggctggctgaccccacgctcctgtgtcggctgtgacacacaggccagtgtggggagggacaccacatggagaaaaaaaaaaaacaaaaaaaacacacattaaggtagaagacacaaagataaccctcacagcagacagacacacatctaagaactgaagaagggctcagagaattaattctacaaagttacagttataaagaaaaatatgtaggttacacttgtgaaaaaaaaacaaaccctcaactaggtcaaaaacaaatgcaaaggagtagacagacagagctgtaattctgagtatccttttcccaagctcactgctctgagcctaaaccactaactgccacttggaaaatgaggcgtgcatctcgaggacaaacttcctctggcagacagcatcccatgttcccgaggtgggacggggcctgggctgcaggctcctcggcacggacgcctgaggcgtgaggatctgagcgagcaccaggcgtgagaagacgttcaggtggtgggcccggcctggtccacaggaacaggggctgatgacgtggaggaggtgaagaggagacgcgcgcttaagcaccaggggtctgggaagaagctttcggtgtggaccgcactatgccagcacctcctctcatgagaagccagagtgacttctggacgagcaagaggagagacgagacgggacagacatcgccggccagccctcagcaggactcgggggagtgaggtcagtccacagagtgtcttgacaacacgcccactcttgacctcgccaaggacagtctaataaggcagctctgtcagcagagtgttcacctccatgcttatcatcagcgatgagaaacaagtcaacactcagcaccagaagaagggttaagaaaggtgtagagtgcacactttggaagagactcgtaaggagttcagaacatggaaatattgcccaaagttacgggaagaaagcagaacagaaaagtgtacaacaatgacctcaactatggaaacgaagacgcactgaggaaagacccgaaagagacacggcaaaacatcagtaacactataggggccttaattaccaacgttattcttttcagcattttcctcaataagcagaagcagaggtttctgtgactgaggttgatcagggcaagcgctggtttattactcatatatgtatgcgtgtgcacacacacctacgtgcagagactgagatcccaccacactgcaaagggcccgggtgggcgtctgtcacagacaccctgagacctgcctggggacgcaataacc

SEQ ID NO: 27354 - DNA, 1712 bp, Bovine  19866880586676
cccgtgagttagaacctagtccacgtcctctgtctctggcagcctggcctgcggctgctacctgctttagcatcttcgtatgtgatgtgcttttgatgtagaaaccctcttttctattctcagtctgtaactagtttgtctcaagcttcttacactggctgctgcaggttcgtgggcctggcacaggtttccttaccctgacctcagagcacctgcccataggaaacatttggagaacaggtagagaaagaaagaaaaccccagatggtacgttttccccttgaatacaagaccctcagttgcgggttttgaggccctttcttcatccagaggactgccctttacacctcgtatggtggggaaccagaactgaagtgtacaggtgggggtcatggggatcagaaacgctgtccttccagtccctgcgacagacatgggacgggaggaaggctttcgttgtctgtcatgttacggaaagatgatcttaacacacaaggctgtctggctgggcgctgcctgcccccatccctagacaggcctgcgtggcacttgggttctgtggtgggcctgccgagtgagcactgggagaccaggtgttactgcaccagccgggacggttgcacggcaggacgcctctgacccatcctgggttcctgccatcaggagggggttattaccagatctcccactgcttcccaagtctgcttccatttctggaaaacctgttagtgaggcagagacttctgcatccagcttccctgcccagtcccgagagtcgtagcaaatgtgatgtatgcacgtttacatatatacacacatgtgcttatactgctctagcttcgtgtgtataagtacacgtttacatattgtgccctgagtaataatcacaatcctagtggagctgtttctaaagcttctctttccttagttctggtttacctggggacctagcctatcttagtgttccggtcggggtttggagggagcagagaagccaggctcctggtggaggtggagactgcagggtgagtgtctcagaaagcaagcagagcatacttccagcaccagagaccaggggcacagggctctctttcaggggccctgaggaccgcttcgcttccaaggcatgtctgactccctgggcctgttactgcagcttcctgctgtctcttggtgtttagtgtgtctgtagacagtggaatcctgtagtctctcctgacagtggcctcagcgtggccttgaaggcctgaccagtgagttaaggggttccacaccccacttttcctgagccgttaagcagcagtgggtctccaggcatggtacggaggccagagctgtgtcagggatgcccgcgtttctacctccggcctgccttctgtgaagcttcatgcttgcctttaatctgtgctgttgtgagttttggtgtgtttctttgtgagctgtttttatttaattgtgtaactttgttttttccgtgaaactttgttttctgtgaaactaaggtgttgtgcttctaatttttttttttaacaaatgttaccgttcttatttaagagaataaattccaaacaatcttcaggtttctgagtatttcttttcctcctctttctcctgattggagggtgggaagggcccactcaggcaggtctcaggagtaggcttgacaacgctgtgcctcaggatgctcgctccggggccaggtcgggggagag

SEQ ID NO: 27355 - DNA, 1236 bp, Bovine  19866880587596
gacatgctcacgccccccgaggaggagcagcggcggtctgtgcagtcggaccagggctatatctccaggagctccccgcagccccccgacgacgacgacgatgacgacagggagggggtcggggaggaggatggggggcagccgctgtccccccagggcctggagagcctgcgcagcctcctagctgctgctctttttccaggatcttagcaagaaccccgggccttgggcccgagggccagccatgcgcggccctccccccagccgggcggtgagtgagcacgtgtgtgcctgtgtgcacgtgtgggcttgcgtccgtgaggccgcacctttaaaggtagccagcttgactgtgggagaaggaaatggcaacccactccagtattcttgcctagagaatcccagggacagaggagcctggtgggctgccgtctatggggtcacacagagtccgacatgactgaagtgacttagcatgcatgcattggagaaggaaatggcaacccactccagtgttcttgcctggagaatcccagggatggaggagcctggtgggctgccatctatgggatcacacagagtcagacacaactgaagcgaattagcagcagcagcttgactatgtccccttagcttttcttcaggtccccgtgtggtcaccttccatccccgagaccccatggcccattcccaggagctaaaggacagaccgtctgccattccttcctttggcgtttatcttgggtccagtatagccctgaccgccaaggagctgctcctctagtgggagggtccagggagcacacagggtgagggcaagatgtggaggcagaaggggtgcttgtggggggtggagggcaggtggagtcccgagtctggggcaggagggcagtgtgtaactgatcctgccgcagaaggtgagcccatgggcccagcttggggaggcctgggggccaggctggggctggggcatcaggccctgatgctaaaggccggggcttctttaccaggatgccctgttccctgcagaggaggctgtagatcagacacactggtcattttcggagaaagattggatagaagtgaatgagccctgatggcctcagcagggcctgaaaccatgtgtggtcttggtcagtgggagagctttggccaaggatttttccaggattgcgggctgagcccctgggctatagcatccgggctcaagaagaacaaggagcccccaaccctgtg

SEQ ID NO: 27356 - DNA, 1688 bp, Bovine  19866880596144
tcgaacgtggtgtgtcctattgaaatttattgctgaattagaagtagttgtgagtcaggtattgggagagcccagaacaccaccctgtagagcccgggcattccagagagcagggtgaaaaccagagttctgatccagagtccactaagcaagactttccagcacttttgtgcaaatgtgcatctccggttcatatacaggcagtggtccctctgttgggaaattcccacaatggacacaggaactcggagctttgctttcttcatttcaagcacctcacttcctgggttgtgttcccacctggcgatatcaccttctcttgggcttcgtgtctctttcctcttgctggtgtgcttgctggtggccgagcccttgaggaggccttgtgggctgagcagcactggtcagctcctttcctgaaccggccatttggtctcagtccatgggttctctgaggtgccactggtggccgagctgccctccagagaaggctcacgtgcatctagacggcaggtctggggtcagagcctcagagaagaccgagattcctgaggtgtgtggtctggagcagctgggaagccctctttgttttcggaacctactgggacagcctcgttcagcgttgtggtgtctgtgtcccccagggggagccctcgtgtggaactggaggctgctgggttgtgagatgaggaggaaagggtggtgagctgcagctgactgcgcttgcatttgtcatggtcctggggtcaccctcaccgcgctgtgacggacaggagtgctggtgggcagctgtggagcgaggtgccactgttttctgctctctggggacctggtgaccttgagggccacagggcctccttcactcagacccgtttagcagatgtggttctgctccacttggggtaagtgtggacaggcgagctgagggctaacatatcctctttaggcattcgcatctggccttcagccttagtctggggcgtctgatatgcgaaactagggaagttcatagcctttgacctgcccctcacattttctaagtctgaattagatgaggttgaatcccagcaggatctccagcagagccaaggccctgtcccagctgctggttggctacacgctgcccccttccgtcccccaaccccccaccaccaccttggttttcgggaccacccctggcaccaggaggcctgtggctgaagcatgtttgtgggggtgcctgggggaaacgcatgctttctgctgcctccctgggtgtttcttatgcttcatgcccttgactgccagggactggggggccagagggttacctgatccaataacgcttccccgattccttgttgtagactattggggagagtcttattacactgacctcatcgacttgcatctgggtggtatgtatgcagacctgttacagaactaaccctgctgactccccccaccccccgccccccgctcacaaacagcaagaagtcagcctgataaccataaccggatggtaaagcacaggcccttttccagctcaaacagagcagtgtgctgactcggcctcacccatatgtgtgtgccgggggagacctgagacaatccttgctgctggggtattttaattctctataaatttagaggttcaccagccacagcatcagcctctgattcgatctgcatcccagtcccactgacag

SEQ ID NO: 27357 - DNA, 1176 bp, Bovine  19866880600939
tagccaatcttctgggataaaccctcatggaaaagattaaaaaaaaaagaatgtctatgtgcatataactgagtcactttgctgtgcagcagaaattggccgacactgtaagtcagctacgcttcacttgggctgccaaggtggcactactggtgaagaacccgctcgccagcaagaggcgtgaggagacacaggtttgacccctgggtcgggaagaccccctgaaggagggcatggcaatccacttcagtactcttgcctggagaatcccatggacagaagaatctgctgggctacaggccatagggtcaaaaagagtgagacaagactgaagcaacttagcacacaagcatacttcaattaaagaaaaaacaccagcaaccacgtggctggaccagccacactctgcaaggaacaaggtttctgggggataatggacccctgggaggaccttgcacctggaagccacagtctgctgttatttagttgctaagtcgtgtctgaatctttgtgaccctatgaactgtactagccagactcctctgtccataggattttccaggcaattctggagtgggctgccatttccttctccaggggatcttccggacctaggaatcgaactcgcgtctcgtgcatgggcaggcagattctttaccactgagccaccagggaataatttacattaaaaagttattttttgttaaaaggaaaaaacaaacatcaaaaggcctgggcctgaggacagcaccaacctgtaaacccagctgcgtcagaggccagccggtcacagagattggactggctggtttgtagtggttactccagagctgggaacctggaagactccaagctggacgtctccctttccaccaacagctgcccccaggcgaggcttctgcagctgcatcgagccagaggcacagtccagggggacagtggctccaccccgcctcctctcttgcccttggggggggatgtggacagcaggctgggaggctgggaggctctgctgcccttacctgcgcgcggtgcagccgtttcagctcctcctgcttggcctgcctccgagctgccttctgcacacgccgggtcagctttggcgttcagctcctcctccgtgtaagttctcggctggaggggacaagagggtttcttcggtcagtggcttggctg

SEQ ID NO: 27358 - DNA, 4409 bp, Bovine  19866880633872
taacctgttacattgactaaggtaactctgagatgacccgtctcaggcacggtcctgttagtgactcaacctcgggagaagagacacagtccccccgccccccctgccatgtgaggcgcaggccgtgcacggggctatgccgtatccccagcacatgccgaccacaacctccgtggccgtcgctctggcatctgggctgtgatgagctctgtgtgagcctcctgctggactctgaaagacaagcaggagcctcaagggtggcccctctcctgctttttaacttcaatggtatttaggagactgtgctgaagaagagtacgtcccctgggctgaagcccagtatgggagctcttactacaagcaggtgacaaagaggggccatgtgaccagtgagaagtctgcagccagaacccaggcgaacccaggctacagacagtgaccgctggagagacaccccaccaggtggccaccaacagaagggctgcaagccacctcagggggtcagccaagctaccctcctgcttctgtacaagagacagcttgcccacagtcatgggcagggcctgggtctcgtcttatatttactttttaaaagactacaggcagcatctttatgaggggagccgagggaagcattgggcaagacctctccacgggccggcagggacccgggcgcggagggcagggcagtacctgagaggcggtggagaccgcagagcacttgggctgcgggaccaacgggaagaacagaggagcccggagtaggggtcgtaaagcgcacgctcttggcagaggggggaggctccaggccggagtgcgtcagcagctgaggggcccacagccaagccctcctgcctggacccccaggtgcccacgagaaccctctgcctctgaggctctcacgggacccattaccccggggacgtttggcaacatcggggggtgctgtcaccaaaggggaaggtgctacgggggctgatgggggaggctacgcaccctcgggggcacaggtgctcacagccggggttgcccagatgccacagacaagactgaggaagcacttgacaccctagaccctgaatctcagaggaacccaggccagggaccgcccagcagaccgcgtgcacagcctctacctcaagccccggcaggtgggccgcccctgccctgctgacccagctcctcaccccagagcgtcctgcggatgtccaaccagctgctgcccattcggattcagtcgagacaactaaaaccctccttctttctcctgggttcccgagtcctggcagcaggtcacggtggaccccgaggaggaaaacctatttcttccgcagagccagtgccaacccgaccgccactgctaggatggccatggcagccgcccctcccaagagcaggagggacctgccctcgggcagcgggccggccttctcgaggtcgcctgggcggggccctaccctgagtgccccctgccctccagtggcctcttcccggctcggcggggctgaagggggctccgctggggacttgggtggcaggacccccttccgctccggttcagaagcttctgctggggctgcttctgcctcctcttcaccgagctccacaaacagggacgtcgtgggactggccctggggacggccgccatcagggcaggggccggcgcggccgcctcccccacgccctcggggatctcctcccgctccacgtgcacgatgtcggagttggaggagttgttctcgctcttctctgcggccccgttgctatccaagctcttgacctcctcggggtccactgtgacctgctgccaggactcggggggcccagggacaccggcaggctctccgtgtgccagctctggctggcggacagtgacacgggcaagctctcggcctgccaggaagccgtggccgtggagggcgactccgggggactcacgtgcgtggagctgtcgctgggcagaatgtagatgtcgttgctgtcctccgcggcacccgcggggcactcctcctctgactccaggttaaagacggtgccctagaagaggagcacgtggtcagcacaagggcactaaagcaacctctgcgaacacacatcaggaaaactccctcctaagttgagcctgaggaacaaacacatcatttacaatgatggcgtttctggactgaacacactcgcctgcagaccaacgcagaggaggagtttccaacaagatggttctctaagcacgtcctgaacgctgcatcagcagaaagctgatgcacatcccattcgacttcacacacacttaacacagtaaataacacagcccggcagaggaagcagcacaggcaggcagctggtgctccaggctcaccactggctcagcagaccaggacaatgttttggcagcggctggggaggcaagggtgagtgggagcctggcccaggagaggcccagaaacacggagcaggggactgaacaagcctggagtgaccagggaggggctggcagtggacagagggctcagagctacggcctgaactccgctgcacgggaccgcttggtcacagatggagctgcccccatgggcggcacaggctcctgcccttccactggtgggagccacagagaggcagcgtggccgtggccacgagctccggtcacagggaagaacggacttcaattttggtgcttaacaaattgactgtctagacatgaagacgagtcacgcgtttcacgtgacaccgggcagccctgaccaggggctcatgttggagatggacgggaggtctcgccgagcctggacgacaccacagatggtgacaagaggctgcagagtgtatgcgagcacactggctcccactctgtcaaggagaataattctgttcttcagccaagaccagaccctttctggtcagacatggttaactccctgcgtccttgtccttagagtcacatctgctgatgctctgcgcaccactggttctgcagtcacaggaggcatggctccactgggcttggagcagcctcatgacgactgttcaagctgactccagaggccctgagagtcagcgtgctcccggaagggtactcccagcaagggctgaaaagagaccctctcacagcaaaaaaagtgaaaacagtgaaagttgcacagtcgtgtccaactctttgcaaccccatgggactgtagtctgccaggcttctctgcccatgggattctccaggcaagaatactggagtgggttgctatttccttctccaggggatcgaacccgggtctcttgcattgcaggcaaattctttaccaactgagctactagggaagcccaagagttggtttaaaaagcaaaagcaaaagaaacataacaaaaaaggtaaaaattttaatcctcagaaaggagacttttgctaatttttgtttttggccactgggcatgtgggatcttagctccccaatcaggggttgaactgcatccgctgaagtggaagtgtgcagccctgacctctggaccaccaggaaagccatcctgtgatggtactgttttattaaaggctcgaagcccaaacaagtgaaacgggaatttcagaagttccattatgatgaaatgagggaaaagttaaactaagaccgcatttagtacagttacttttctcttcatttttaacaactcaaagctgaaagttaagaaccttctgtcgctatctagtagccttcttcaccacacagcactatcagcagggctgtcaagacaacagctcggcaagagccaggggctcaacaccagtcaggctcagccgctttttccctgctgtcgcggactccttacaatttatttctgtatattggtcgtgacattttaatcatgatttacccaaaattttgtgctttatgtaagaaattttaaagaaagaatagatgatcactgaaacttttgcttctggtcagctaaagcaagaatctcaattggaggcccctccggcgacagtcacggtcactactggagggcaggctgtctcagagagaaggcgccaaagagaagcgggggaggtcttcacctacacgcagcacagcaacaacttcaatcactttcagcacaaaatacttgtatcactgcaaacagcggtatctttagtcccactgacacaaaaacacaaaggaataaattcaagggctcaaaaatataaaattaattgggaccaacaagagtttaacagagaactgtgttctgtttaaacagatggcgcccaagaagtaggaactcgcccaaggtccctcagctactgtgagaatcgggcaaccatgtccttctgaagaccggacttaattcattttgccgtcaaaataaggaaaccgaagcaccgaggagggtgcacacctggcctgaagcccacggcgggggctggtgctgaccgggccggctg

SEQ ID NO: 27359 - DNA, 1444 bp, Bovine  19866880636977
tggcagtccagtggctgaaactccacgctttctccgtacacggggcacgggttccattcctggtcagagaactgggatcccgcacatcatgtagcgtggccaaaaaaaaattgttattttaaagaggaaaaattatttttattagcaatgtgtgatcttattaagtttcattgttaaaaaaaaaaaaaatcaatgagaatcggtacaccacagtttcatagctgagaagtatcccaacagtaaggtcatcccatacgggaaacattttgggttcaatttgatgtctttaaaaaaaaaaaaaaaatcaataaattgttttagagattctttatatacaagcatcaacacagagcactcaagacactgcttgtaaattattcttcagttaacaaatctgatgaaggtgtctaagcattttcaccttaaagaatctgaagaggagggggaacactccccactgaacttgataaccagcaacacatacagctttaggttctgggctcagcttatctacaataaacacaagacaacaggctcattttagaactcaaactgtaggagacacatgtcatctggggtgctttttcctcctgttattttgcgtctaagcataactttccactgcactgtgagactatgtgttctattcaacttagtaaaggaaaaaaaactaagcccaaaatataatgtataatcctttcaacttctgtctttatgtcaaagttttcttagcaaaatactagagggaaatactccaagatcatagaaaaaaattgtcataaccccttgtaacattacagtctaacttctcttatcccaaaaaataaacactgtccttttaaactattaaattacactgaacagcatctatgtttcattgctacggtcaatgaagatggggtaatgctctcaccacattcttgagtctaagtacaattttccttctactttcttagacactttggaaaccatgcataacccctagtaacatgcagtaatgcacttcttgcactttcaaggttgacaaattttaaaagcttttttaaccctataccatctatatatttctgctgatagtgaacagtgtgacatcaggaaaaaagatacctgggtatcttatacctaagaagactacgtctgaaaaaagcaggaacttccctaactaaataaatctatctataataacctaccactaagaaaaaggtgagatcataaagaagaaagaacagaaaatggacaaggaataacaaagaaagaaagaagaaaaatccatctccaagttctcagtgactggggtggggggaagaaaagtactgaaagaagactctcatgatgccatatgtatccagaaaagtgtgtgtgtgcagggtgattacagttccaagaagctggaatttaaactaagactgaggcagcagcacatagagaaaggaggcccctttaa

SEQ ID NO: 27360 - DNA, 1991 bp, Bovine  19866880649896
cctaaaacccccacctgtccccaggaagctggggctgccagcagccgagggggcccagccctgcccacccacccctgtgtccccgcccgacagggagccaaagggcccccgggaggagcacagagacctgtccagcagctcggggctgggcctgcagggcagctcctcccgcaccaggacaccgggcagccagagcttcaacacctctgactccaccatgctcacgcctccttccagcccgccgcccccgccgcctgacgaggagcccgctacccttcacaggaagccagccctggcagggcagcttgtggcctcagcacccccacccccggctgtatgtgtgaggcccccgcgggagcccacccagcccccccaggaggaggcgcggaagtctttcgtggagtgcgtggatgagattccctttgcggatgatgtggaggacacgtatgatgacaacacatgtgacgaccgcacggaggactcgagtctgcaggagaccttcttcacacccccctcccactggccccaccccaagcagcccttggctccggagaacggccgggggccagagagtgcggtcccactgcagaagcgggggctgccgctggtctcggccgaggccaaggagctggcggccgagcgcatgcgggcccgggagaagtcggtgcggagccaggcactgagggacgccatggcccggcagctgagcaggatgaaggagatggacatagcagctgcagcccccaggacccccaggacccctgcaccccgcagagccactgccgtgccccccaagggccccgaggaacctgccccgaggcacgaagccacaagtgaggagctgctgtcccctccctcggactcagggggcccggacggctcggtcacctcgtcagagggctccagtgggaagagcaagaagaggtcgtccctcttctctcctcggagaagcaagaaagagaagaagcccaaaggcgagggccggcccctggagaggcccagccccggcactctggaggaagcggccgccaagcccaggtctctgtggaagtctgtcttctcggggtacaggaaggacaagaagaagagtgatggccggtcttgccccagcaccccgtccagcgggaccacagtggacgccggcaagcccagggcatctcccgtctcaagagcaggttcggcgggtgcagccccacccccgccctgggcgcagctgggggtacaggctctcccgtccccacggttccctccgaagaccccctgcctgtgccgccctgcctcccctggggttttctagggaggaggcagctaaacttaggaggttccaaaacaagcgaatggctgggcaggggccacaggtggatgtgctttctagggaaggcgctgcagctggacacagcctgttggtgcatgtgggctcctgcctgggtgcgtgtcagcattcaggcctgtggctctgggtgcggggacagaaccaaactggggaggaccacaccttactcccgacccgggccgccagggggtgggccccctggtcatgatctgctcggccccgcccccagagctgcagacgcggcgccagctgagctgctcggaggactcggacctctccagtgacgacgtcctcgagcggacctcccagaagtccagaaaagaggtgggcgggccgcgggcgtgactctgtcccttgttcagcccccacccccacccctggaccccagccagcccagtggtcaccccctgcacccgcactcactgtgcccgcgaggcacacctttgcaggagcagctgttgccctgccagagcacgtcccccttgctcttggcgcgtagacccccgagtccatccagttcacctgtgcccttcctccagccgcgtcagttagtgtggcttcattcagaatagaagcacctgtttacttcaggcaagacttcctccaggagcctcggaagtggtgctcatccgaagaaaggggcttttgatcccttcca

SEQ ID NO: 27361 - DNA, 2039 bp, Bovine  19866880652341
tctggcgacgcacaatgtgactgctaatggagggtacggctccacggaagacatcgctgtccccaaatgaggcgccttctatttgatcatctgccggtgtggctcatgcatgcatctgggttgtgttcaccagctctgcacgtggcacatgtccatacttattacggactgtaatgggttgcgggggtcggggggggaaggtgggcaggggagttgaaaggattagctccacaagactctgaccctactgagtattaaagtcttaaaaccagactcacacacctctgccagccatcacccacctcagtgctatcgcagcctacaccggaatcctgcagacaccaggttccatgggcagggaacgtggatccacaaataaactgcgcctttaaagatcctcagcaacctaaaagcagctggtttctggtatgaaccagtcctcagaaagcaactctcacttcatccataaagaacaaagtccaacaatttgagttttgtttaaaaaaaaaattaaaggataagagagaattgctccacacagataaagactcggacacaatcgctggttcaagaacagggcttgggggttttcaaagcggccagaaggcaggcagttttacctgctctgctaatactaaacacggctagtcgaggtctgggtggagtggagggaatggccctaagcagaagccctggactgcagcagcacagagcagatgcggggctcgcggtggggcctctgcaccaccaaggcacaccaaacccagcacagctgacctcgcccgcacaggcgagcatctcccaccctgtggcagctagtcttccaatgtcggaggaaaccgcggccagaggaaacccaggcatcctcatctctcctttccctccctcctcctttttatttaaaaaagaagggcagtatttctgtgcctaagaaatgtgattgcaagagtcctgtatcagaaaacagcaactgagacattgctctggcaaaatttccaggattatcacttacccgctgaaagtaatcataaatccttccttctctcagaagaaaaagaaaacgatgactaacttttttaaaggatttcagtaatacctgggatctctaaaagatccttaaactggcaccagatggttataatttcagtgtttaagggaagctctgaagtgacatcacttttacccagtgatcagagccagtttcttaccatatattagggaggctttatgttttggtctcctgcctcaaagaaagtaccactccaaaccaagtattaatactgtgatgacggtggtaatgatactactgaaaatagcagctgcaatttattaatcacattaccacatgcccaggcacatctcagagccaattatctatctttcctcatttaattctccttgtgaggtaggtacaagtatcaggctgattttacagatgagaaaaaggaaacacagagaggttaagtaacttgcccaaagtcaaacagtaagtgatacagctggcgcttaaccccaggaagtctggaacctccagctgaacagcctctgtccttatatctgctagcatcttcatcccgaaacagccctttgagtcatcactatcatctgcaaattacagatggggaaaaagaatgaagaagggccatcaaataatctgtccagcttgtaagctacagggtcaggagtccgctctgggtctctgaacccccaaggtctacattctccacttccccacagtccagggcagtctgaccaaccaacacaggacgtctgtagagacagcagttcctaggaccagagaggtaacactggtcctgacggcataataccagtagggaagaatgacgaaccatcgagccataggcaatctgctgtctgctgtccaccccatggctcttaaacagaacctactctgtcatatcctgctcacgacccacagatgtgcttattatttcccatggtatctccagtgtggcaagacttacccaatctcatctcccactctccccgagaagcccagccctccagtttggccaccc

SEQ ID NO: 27362 - DNA, 1227 bp, Bovine  19866880782528
catgcatgtgtgtgcatgtgtgtgtatgtgcccaccactccccgcggtcaccaccgcccaccctggtgggactcttacccgcttgtgatgatgcctcagtgtggtcagaaactcaaacctgacacacagacgctcgttggtgttcagctgcaggatggacagctccgccccctccaggtagaggacgctggctgaaggtcgaggggggagaggagcacaggtgagaccaaggatggctagccgccggggggcggggggtcattttctgtctgctatgcgtgccgactaacccacccctgctttctgcgccttccagctccctctgggctgggttagccgctgcctctggacagctacctctcactggacagggacgaagatactttaccccgggccaaaagggaaagctttgcaaattcgtggctaggctgctggggacagactgtgggtgtcagaggggggtcctcgactttgaggacggagcatgagcctcagcaagggactcactcggccatccacaggcctgggcgccctcgtcacccagtcttcccaggtgtgcacacggctccacccccaagaggctgaggtgtggggggtgctgtcagaagggccagcctgcagtcagatggttcatgaccgatgtgttttccagggtgatgaagatttggggctgaagaaaggccttcagtggaggatggtgggttaacatctagaactctgaaaaaggactcactgcctgaactgatgggtcctttctctgaactggcccccgtgtctgagcacagggccgggagccagggcctctgagtctggtgggaggactaggaggcccagtctgtggacccaccagaggtggggagcaccccgaacgcccactcaccatctgtctgcagcgtccactcgatgtgaaccacggggagcaaatgtccttgctgcgtgtgggcgaagcgcagctgggtctgcacgttttttggggacgagggggtgaggttccgagggtggatccagctgtcgtccaggcaggtacctgggagcaggagaggcagaaatcagaggcttgcgggctctaagggacagagatgcagcccaaagaggatgcctggcggggtccaggagccttcacagtcaggccatgaccccaagaccaaaactgggctcacagttctcttgatgcccttcgggggtcgtggcaaagctctgacgttacaggagagatgacaaagcatg

SEQ ID NO: 27363 - DNA, 3703 bp, Bovine  19866880888574
atatggggggaaaccctacgaaataacgatagtaagttgacaaatactaagcactcaaatggtattatttttatccttattttctctaaattcctctgacattaccattaccataccattaccattaccatacacactagccctctctgtttttattttggctgcaacaacttgtgggatctcagttcctcgcccagggatggaacccaggccccggcagtgagagcaccagaagaatcctactcacgaggccgctggggaacttgctagccttattgattttttaatttttttgagggtgctgactttgtattgtaatcaggtggcagtgaggacaccttaaatgtgttttgcgtttctctcttcccgtgcaagcgtctgggcgcgtgaaggactgtgtctgctaactgaccggctgttagcagcagcaacacgtctgtgctggcatttagaagctgataaacattcccacatgttgactcttcatgagctaatggtctgggtttggggctgaaaaggaaaatgaccacatccctgaagccacttcccaaattatgggatttaatgagccaaggaaattaaattatcctctaaagtgtactttctggtttacattatgactggatggcagccgttgctaccatcagattttttgggaaaattacacacagaactgggttcaaaacactatgattttacttgttcgttcacgtgtatgaagaatctactacgtgaactgtcggatgcacagatgtacaccgaatagggccctgcccacaaagtctgtgatctgtcaggagggccaggccggggaaatgaagaacaattacaacatgaagcactaagtgagaagtggaataaaagtggtagaaagtgtgaaagagcttaagagggtcaataagtcaggaagggcctcctggaggaggtgtcgcatacactgggctttgagggcgaatagggtttgggatttcggtagggaggtgggagaacttcccctctggtccggtggttaagactctgccctccagttcatggggcatgagggtccagatttgatcccttgtccgggaactaagataccacatgcagccaaaataaataaataaatagtggaggctggtcaacagccatttgagctgagtgatgtgaaaaagagctagagcttgaagaggctgagctggcagaggaattgttgggagctggattcaggaaagcttcacaagcttccgggagcttggagttagtagattggacaggaggagaccccagaggcctctgagagcagaagaaggtcgtgtgagatttattgtacaatttgtgattaattggtggtgaggtgcagaggagaggaagcaggagttacagctttgtcctggtgcgtggtgagaacaccaattcaggggagcaccagggcaggcagggtgcagacaagtgaaggactcatcagctatttagacatcaaagtctggggagacatcaaagagcccaccttccagagacaacaaactggaatcaggagtgttgatgctggtgctgacagggccaccgagtcagggtctggggggactgggactggggctggagctcggggggaaaagcaggaaggactcagagctcactgcctatgctggatgcagctcagaaggatcatgtgataaaatgcacagaggaaagaaggtgaacaggccaagctgagtcacctccggggagctggaaaatgagctggagaaggagacagagaatccaaggacaaaacgaccacaagtaacatcgattaagtgctcatcatattccaggcacaactctaaggtcctctcaagtattaattcatataactctcacaaccacctagcgaggggagcaccactagtagaatcagggacagaaacagggaacagctgcggaccccccagtgaggcccagggccaagggccatgtcctggaccccccagctgttttgcctccaaagtgggggtacaggccagggatgaaggcatctcaaggtggggtggtctctgggagacggtgaaggacagagaagcttggcgtgctgctgtccatggggttgcagagctggacatggcttagcggctgaacaataatactggggctctggctgggttttttttttgttgctgttgtttgtttgctttgtggctgtgctgggtcctcgttgccgcattggctttctctagttgtggtgcttaggtttaggttaccccgaggcatgtgggatcttagtccctcaaccaagaactgaacctgtgttccccaagtggggaggctgattcttaaccagcagaccaccagggaagtccctggcttgggtttttcactccacttgattatctttgtgcagaattcaggtctgtccccccactggtgtcctgttagctgcttagggattatttttaacccactgaggtaccagggagacctcggatccatcatctttatgactctccagccatccccatccaaggactcacacagacagtccctgattcttcttgaccatatttggcctctgtactgtcgacaacatcctctagaacaggggaggctcagatctcctttctcaactcatttatttctttgttcaccagatagttatcgaaagtctgctatggggcaggtgctatactagctggagaagatgaacaatgatcaaatggatatatatttgtgagaaaatcagagagcgtgacgtgagggactggagaagaaggaggaggtgagggaccggagagggaggaggaggtggagctatttcagagagcggctctgataactaataaggacctgctgtggagcactgggaaccctggctcaacactgtgataacctacatgagaaaagaatctaaaacagagtggacatacgtattaatatatgcagaactgattcactctggtgtacagcagaaaccaacacaacatcgtaaatcaactagactccagtaaaaatttttaaagggtcagggctcagagtaagagatgacaaagatccaaacactgtgaaggatccaggcaggggattcgccctgggatataaacagctcagaaatggggggtgtatcctgttcatttcatgcccctcagagcatcctcggctgtgtctcagtaaacattagggagcggcttcttgcaggtataactggggaaaaactactgactgttacactggactagagagacatgtgttgcccagaaactttttttagagggcactttattaaaactagaaatacccagtatttttatatgggatgtgaatgggcagggatgtgaaaaaggtttttctatattttaatagagaactcttctttgcagcagtaactattataataagattttattgaactaaccaattattagaattgtgcacattttattacaggtaaatttcattacaattttctgccttataaaaataattattttgggacttccctgcaggtccagtggttatgactccatgcttccattgcacggggcatgggtttgaatcttggtcaaggaactaaaattccaaaagccatgcagcacagccaaaacagaattatttcaagtaggcaatacatatataaggtttaaaaatcggaaagcacaaataggaactcaatgaaaatatcttcctccacttcttgctcttgttctgcccagacccatcccattcccaccccctcccccacgtgtggcta

SEQ ID NO: 27364 - DNA, 2325 bp, Bovine  19866881073848
cttcagcctgggctggcttggaactgctggcctggattaacagaacctggcagaagtaaggctgtatgacttctgaggcaagacagtgaagggcaacccgattcccacctggctctttttcttgggagagatgcctgggaagcctggagcccacatatgaaaagtctgggcaccttaaagttgccataatgtaaagaccacgtgatggagataaagagatgcatccaatcagtgattggagctgagtgggaggagatgagccatccctgctgagcactgctgaggttgcagattcatgagccaaaataagttttttctttttagatatttttggtgtggaccatttttaaaatcttcactgaatttggtgcaatattgtttctgttttgtttttttggtccagaggctgtggagcttagctccctgcaggattgaacctgcaccccctgcattggaagtgcagagtcttaaccactggacctccagggaagtccctcaaataagttttatttgttgctttaacctggtgtgttttacggtggtttgttatgtagcagtaagtaactgggaaagtttatttaaaggaaatataaaactctagcaacttctcttccttggctgatgcctgtgaagttggcagccatctccaactccgcatcttggctgctctcagacccttcatgaagtccaatgatcatcaaaaagagggccacaaagttcatctgacacctgtcagaccgatatgtgcacatttaagcagaactggaggaaaccaagaggcattgacaatggggtgcgcaggagattcagtggccggatcgtgatgcccaacatcagttacctgagcagctagaaaacaaagcacatgctgcccagcagcttccacaagttcctggtccataacatcaaggagcttcaagtgctattgatgtgcaacgcatgtcgctgcgctgagactgctcacagcgtcttctccaagacccacgaagccactgtggaaagggcagcccagctgtccactggagtcacaatcccagcgccagactgtgcagctaagaaaatgaatagacagctcctttgcacattttgtttgtgttaataaaactgtaaaactcagacaaaacaataacaaacaaaacaaaacaaaaaattcagcggcagtgttttacagcatcagtgggccaaacacatatggggttgagctgtcgggctctgtacaggctgaagctgggagctccagcgcccatcagtgaaacagttatactggctttggaaacaaagcagtttgaatgcctttgaaccttgctgcacatttttggaaaccatgtcactcttgttaacagtatacttatagtgtgttccgctcataaataatctttaatacaaatattcagagcttcttcttaaagaccatttaacactcaaagagaacaccttaagtaaaacaaacagcttcctggtagaggattatatttatttgatggcaaactataggatattctagactctttttttttttttttttgatgacgaattcaggtgaaccagaaagagattccagatacctgctaagagctcaaaccaaatgtgcgtaattgggatctattgttggaaagatagtgaactttttgggaggtctgattctttctcctccttctgatgaatgtcactgttgctgctgctgctgctaagtcgcttcagtcatgtctgactctgtgcgaccccatagacagcagcccaccaggctcccccgtccctgggattctccaggcaagaacactggagtgggttgccatttccttctccagtgcattaaagtgaaaagtgtaagtgaagttgctgttgtgtccgactcttagcgaccccatggactgcagcctaccaggctcctccattcatgggattctccaggcaagagcacttggagtggggtgccagctgttaagctcctataattggcaagctctccatggagaggatccaacagagggcaagaaagtctgggtttacccaggaaaattgtgactgtctgaagctttacatgggatcttcgcctccatgtcctatttactggtcttccaaaatttctattggatggcaaattcctttaggaaaaggggcaagttttattatagctgtggaagctggcagagaaccaggatggatataacaagtcagttatcttgttaaggatgtgagaatagcctcggggtctagagaggctggatctaaatcctgctggtgctactcactagccgaatgacttcaggcaacctagccttctcagtgcccccagttttctcctctatagggagtgctcataag

SEQ ID NO: 27365 - DNA, 2884 bp, Bovine  19866881084295
aagccccccgtggggccaggaccttctcaccagccccgccctttgggtcacatgatggattcccgagtgatgagacctcccctccccccaaaccagtggacagaacaatccggcttcctacctcacagcgttcctccttcagggtacctgcaccccccgtgtaaacctggcgcacagcggctccagccccctgcagccccggcactgggttctctgtttggagctccggccccagccctgcggggtgtgcagggtggggactccatgctggacagccctgagatgctggccatgcagcagctctcctcccgtggatgcccgccaggcgtgccttaccacccccgccagcctgcaccgccccgcctgcctggccctttcccacccatgggcctggtggcccccaagcctgcctcaggggaccctgggaggacacaggacagcagtgacgtgcaggagcctgagaacggccaaggtaatgtgtgcatgcgcaccccctccccccgcatctgccctgttaattagtgacccatccttttatgcagactaggaaacaaagtgtcaactggcctctggtccctttcacttgcacatctctgggttgagcccgcggtggtccgaggatttgcggtaaccgtgctgcacagctgcattcttgctgtgtctccactcgtgctgagccttcccgtgcttatttcactctcagaataagctttgagggaactttgactagtattcttgtttgtatggatggaagctccagggcacaaaggtggttatttgccttcattcagctcttaagtggggagaccgattcaaacccgacacagcggacctggcatccgtgtgtgcaagctctgcgtcacccagcctcacttgaaaaggactgtcctgaagtgaccctcggggagcatgtcctcagggctttactcctggcccagttctctgcatgcctttctcagtgggcccacatctgcgagcgccggggctgcggagcagtagtgagatgggcgcgtcgtcaagagggctctagaagtgccgtcgacgagagtagtgaactcaagtgcaagagactcctctgtgtgactccggctggttgaggacggacatctagcatgtgtctgtgtgggagccgtggcacctgggcatctacagagtgatgtggttccttatcaactgggtggagggccaggagcgcagactcccttcaggtgatttcttgggaggggaggctgactctgtgaatgccacctgcagcacgactttccaggcatgatttcagatgtgactggaattcagagctttggagggagagtctcaggggcagtctgtttgcttcgttgccatgatgtttgtgttgttttgtttgcctttattttttcttaatgaagtatagctgatgtacagtgttgtgctaattagtatctgctgtacagcagagtgatagttatatatatatacattcttttccatattcttttccatcgtggtttgtcgcaggatattgaatgttatttctctgtgctgaagtcagatgttgtttatccactctgtatataatagtttgtctctgccaaccccaatctccctgtccctcgctgtcctgcccacccttcctcttgagtcacaagtgtgcgctctccgtcctgcgagtttgtctctgtttcatagataacttctttttgtgtcatgttttaaatcccgcatgtaagtgataccatacatgtatctctttctgatttacttcattttagtatgtaatctctaggtccatccatagtgttgcaaatggcattatttattcttttttatgactgagtaatgttccacagtgtatacgcaccacgtctttatgcgttcctctgttgataggcatctagagttgcttccatgtcctggctgttctaaatagtgctgcagtgaacatcggggtgcgtgtatctttttgaattatggttttctacgaagggcttcccttgtagctcaggtggtaaagaatctgcctgcggtgcaggagacccaggtttgatccctgggttgggaagatcccctagagaaggaattggcaacccactccagtatcattgcctggaaaatctcatggagagaggagcctgtgggctgcagtccatggggtcacaaagagtcgggcacaactgcgtgactaacacttactttctgcaaatacctgcgcaggagtgggattgtaggagcatacgttaactctgtgtttagttctttaaagaacctccacgctgttctccatagcgtctgtaccaatttatattcccaccaacaggtaagagggttccctttctccacaccctctccactgtttattatttgtagactttttagtggtgtccattctgactggtgtgagttggtacctcattgtggtttaaatttgcatttctctagttcagtgatgatgaacatctttttatcttggcctcttggctatctgtgtgtcttaattgaagaaatgtgtgtttaggtcttctgcccatgttttgattgggtttgttttttggttgagttgtatgagctgcttgtatattttggagattaagtccttgctggtctcatcctccgcagctatattctcccagtccgtagatagtctttccatttcgtttatggtttcctttgttgtacaaaagcttgcaagtttaattaggtcccactttttaatttttgcttttatttctactgccttggaagactggtctatgacagtttatgtcagagaacgttttgcctgttttcttgcaggagttttatggtgtcatgtctttaaggggttgtgcgtttatttctgtgtctgttgtaaggcgttggcatgttttttgttgactgaatgataaaagtgcaccttttcatcatt

SEQ ID NO: 27366 - DNA, 1794 bp, Bovine  19866881093348
tttccctgtgctgtacactatatccttgttgcatgtttaatattgttttgatgaccatctgagtgctgcagtttcttgtataactagtttccttatttctctctgggacaaatattagcacttaatgtttcagctgctaaatgcatttttattttaaagtagtcttatctcatatgacgccatcatctgtacttatttcctgtgataggggtagtaataagctgttaggcatttattttagaacatgaaggttccagtagctgtgcaaaacattaaatatctgaatgagtaactttagctaacttccaaagtcataatttcttactgcctgaaaatcacagacagttgacacactgagatagcctttataaaaagtgactactcaaaaaaaaaaataaagtttacttcaggttaaaaaaaaagtgactaaataattaacactaaaaaaactaataactcaaatttatatagttgatcattttaaaaggattttgaacaaggaaagaatactatttttattttataagggaagacacttagactgagattacttgaccaaatattttagacagtaactcagatcttctaactccaaattctgtatctttttcatatacagaatcttctgattatatactttgtaaatttgtttgtgggtactattatccttgattaaatttttactctggcttcatttatgataaaaatcactgatctttccttttgaacaaaaggaatgaggagtaatctttgaagatgagtcataacactttttcattttagatatagaataaagtgaatttaagcaaataccctggtcaccagcagcttaaaataaaattgtcaaatctgtataatgaaataataattaatttatttcttggtaggcagaagaagagttcaacattgagaaaggtcgtcttgtccaaacccaaagactgaagattatggaatattatgagaagaaagaaaagcagattgagcagcagaagaaaatgtgagctttgaaaatcactgggctgagagggtccagcaggtgcactggggtcagcagatacgggttctggttttgtctggaccactcactgcttatctaaccttggtcactctgcttaacttccctttcctcacttgggaacatggaagcctcactggattactgaaatatacagttgaaataactgataaagtcttgccacttggtaagcactcaataaatatttcgtaatatttgagaataggtgggtataaagcactgcatatatttcagggagttctgtttgggtccgtacagagaaaggtatttgcgtatctgaagaagggtgtacatttttttctctgcagctctagtgatgatacttttccatgccttttgcagtcagatgtccaatttgatgaatcaagcgaggctcaaagtcctcagagcgagagatgaccttatcacagtgagtaattagtccctttagttatagtattataaaatgtttgtctattatcgagaattcactagttcatattggattaaggacttgattaatgatttttagagagaaaacctttggttagcaaatcagtacagtagatattgtaataaataaagaaatgaataagatatgtgtcccattttcaaggactcactgctctgacaacatatagactcttctgagtcacataactcatgatggaggaccgtagagtgcgggtgatgggggcttgaggctggaaagcctgaatggagtaacataggggccctgagtgcacgtgaggaacctttgagtactttcagtagaaggg

SEQ ID NO: 27367 - DNA, 825 bp, Bovine  19866882173681
tcacagacacctgagacctgcctggtgacgcaataaccccttgtccctccccacacagacgccgcctcgagtccagagccctcggggggtctgggacattcccccatctcaccagccccctcctctgaggtcagaccaggtcctggcgggtgagtggggcctacctgtctcctcacacccacagactgtggaggcgcgttctcctcaaacttggccagcagctgggttgccatgtacttcactttgttctggttgccgagggccacgtccatcctccggtcggtcagcgtgctcaccagggtgggccttgctcctctgtggccccggggcgtgtcctcctgaggaacatgggccccgagagccgcctgtgtcagagcagcccccctgcccccccgggcctggcgcgatggctggtctcaaggttagagcgctccttgcggttctcatctcaagatggactcagggcgggggcagcaatgaagaggcgctccggcttttgctggtgtggccacatcccgggaaggccccttgcccttcaccatgtgtgtgaccccacagagaaaggaaggctacatgcacacgagtgtgctccgggaatactctccagagaacagaggcacaaggccacagcaaacatccatgcccaccctcctcacgtggatgaactggaaagatccagcaataccaactcggacattgggggattaagccaggaagaggcatactacagttgctccagcaaatcccaggcatttctctcacctcctctgactggctggtctttctcctcttcccagcaccatccaggtctttttccttcttgtc

SEQ ID NO: 27368 - DNA, 1409 bp, Bovine  19866880420857
aataactccaagcgtttcagacatgacgtattgacaataaggggcaaacgtgggattagcgccctccaaaagacagagagggcttttgttccatctttgtcagagcagaagtccccaccctgtgttttgaaattcacatcaactaccctgtgccaatttccacatttccagattttaataatgtggccagggttagatttttagtttcccccattctaggtcagggagcagaacgaatgtgaggaagggggaacgggcagggaatcaataaagcatcggaagtacaagggagggcgtgtcatcctggtctttcccagaggtcagctaagcagacagacaccctacactgctgtcccaatgggaaaagccacacacattctcagaggtttgggttttggtggtggttgttttcaaggccatcttgtcaagctgtatttgccaaggttctcgttgccgctcggttgctcagtcacatccaactctttgcgagcccatggacttgcagcacgccaggcttccctgtccttcaccatctcccggagcttgcttactcctagatggaggtttcttggttttgtttttgttgtttcttgtcttaatatgctgcagaatttcactgagcttgataagcaactaaaaagaaagcaaagggtttctgaaagtgccttatgagcctggaacctggtttggttttggaggcatgaacattttgtcaaacaatactgaaacaaatccatttccgaaacagaatagcttgggacttctagaaacccttgtagaatttactgtcaactttggtttggtagtatactcatatccagcatcacttccaccgggagaatgcgggagcctaggggcaaagggagacactgtatttttgtttaatatggaccatttttaagacctttattgaatctgttacaacattgattctgttgtttatattttggttttttggtctctaggtgtgtggaattaggggatcttagctccctcactagggatcaaacccacaccccctgcagtggaaggcaaaggtttaaccactggactgccggggaagtccctcagggggacattttcatcaactagctccatatgtagcccccaagatgcagataagcccagctgggcttcctgagtgctccgtgtcaggcctgccttgcacagaatcacccagctatggagtagaggaacagacaagaacccaagtctgcctctccaaacatcctggtccctacagtgcagagctgggtggagctctagccatagaggaaggctcttaggtcccccaagcatcccacctcctgcactaagatccgcagtctttgagttaagtacacacgatagcccagctggggacagaggccacatctcagcctaggtcaggctcaaagcggctgctctga

SEQ ID NO: 27369 - DNA, 2815 bp, Bovine  19866880492057
attgaatatgctaaagcctttgactgtgtggatcacagcaaactgtggaaaattctatatgcaagtcaagaaaaagcggttagaacaaacatggaacaatggactggttcaaaattgggaaagtagtatgataaggttgtatattgtcactctgattttaaacttatatttagacttcagttcagtcattcagtcctgtccgattctttgcgaccccttggagtgcagcataccaggccttcctgtccatcaaaaactcccagagtttactcaaactcatgtccattaggtcggtgatgccattcaaccttctcatcctctgtcatccccttctcctcccaccttcaatctttcccagcattagaatcttttcaaatgagtcagttctttgcatcagatggccaaagtgttggagtttcagcttcagcatcagtcctttcaatgaatattcaggactgatttccttaaggatggactggttggatctccttgcagtccaagggactatcaagagtcttttccaaaccacagtttaaaagcatcaactcttcagtgctcagctttccttacagtccaactctcaaatctatacatgactactgggaaaaaccatagctttcactacacagacctttgttggcaaagtaacatctctgctttttaatatgctgtccaggttggtcataactgttcttccacggagcaagcatcttttaattttatggctgcagtcaccatctgcagtggttatggagtcccaaaatatatagtctcagtgtttccactgttcatccatctatttgccatgaagtgatgggaccagatgccatgatctttgttttctgatttttgagttttaagtcaactttttgactctcctctttcactttcatcaagaggctctttagtcctttttcactatctgccataagggtggtgtcatctgcatatctgaggttattgatatttctcccagcaatcttgattccagcttgtgcttcatccatcccagagtttctcatgatgtactttgcatagaagttaaataagcagggtgacaatatacagccttgacgtactcctttccctatttggaaccagtctgcacattatgcaaaatgacaggctggataaatcaccagctggaatcaagattgtcaagagaagtatcaacaatctcacagacacagatgatatccctctaatagcagaaagcaaagaggaactaaagagctagttgatgagggcgaaaaaggagtgaaaaagctgtcttaaaagtaaatatccaaaaaactaagatcatggcatctggtcccatcacttcatggcaaatagaagggggaaaaagtggaagcagtgacagattttattttcttgggctccaaaatcactgtggatagtgactgcagccatgaaatcaaaagatgcttgttccttggaaggaaagctatgacaaaccgagacagtgtattaaaaagcaaagacatccaccttgcccacaaaggtccatctagtcaaagctatggttttccagtagtcatgtacagatgtgagagagttggaccgtaaagaagactgagcaccaaagaattgatgcttttgaactgtggtgctggagaagacacttgaaagtcccttggacagcaagatcaaaccagtcagtcctaaaagaaatcaaccctgaatattcactggaaggactgttgctgaagctaaagctccaatactttggccacctgatgcgaagagccaattaattgaaaaagaccctgatagagggcaagattgaaggaaaaaggagaagggagttggcagaggatgagataattggatggcatcaccaactcaatggatgtgaatctgagcaaattcaggagagagtgaaggtcagaagagcctggcatggggtccgtggggtcacagagttgaacacaacttagtgactgaacaacaacaagtcgggctaagctttgaggtttagatgtgagaggtagttagtttatatggctggagtaacgccttcagggtcctagaggctggtcagaaaccctgattgtgctggaaacatctgagctgcagtcccctcagatatgactgagaccggagctttggtaaacatgtccctgaagagcttgctcatttcttggaaaagggacttccagagagttctcagagcacataaatagcaggcccacacagacaaaggtaaccattcaaggaatagagaagtatgttctcaaaaattacactccaagccagagttgtggttcagaaagggggttttatactgttgctgttgttgcttcattgacctcagaaaagatgtgctggacagctgtcaacagtctcccgacagtgagaaggggtgtgtctcatggcagtgggcagacatagaaagatacaaagggcccatcccggccagtcttggggtgcccttaacggagccctgggttgagtgaagagcatttctgtttagaagcaagcatctgggagatgtttctatgttaccagtcatgacttgtaatgcaggtttctccccactgccttccagctgggattgccatgcatgtttgatgaaccaggaatctaagtcttgagatgaactctctcaactctgagcacgttaacacccaaagtgagagggagcgccaacgtggccgggggcacttggaggtgaaaccctcagatcctctcagatcctgctgccttgttggacacccaggttaatttctgcacttcatcaatgtctatgccaggctaccatccactacacgccatattctgggccatgccccgttgacaacctgcttatttc

SEQ ID NO: 27370 - DNA, 872 bp, Bovine  19866880548435
ggggaaggaaaagggaagcggggtggggcatgatggcaataaaacagaacccgcaaatttaatcgaagctgacagtatcaaatatgtggctgaaccaaaccaacaagctattgattgtgtaaagatcatctcggatttcagattttcaagtatatggactgcactttccctctggccaagacatacagtcttggagcccaagaaaacattctctgacacatgtgcacacagggaaacttttaacataggcaagggcttttcagaaacataaatggatgagctgatcatttttaagtctctggaggctgctgcccttgtctcattgggccagccaggaacttcttaaagaaaggagtttttatgaggctggtgggtgcagtaacacacaacacgtggtgagggggtgcattaaatagcaccccacgggtgggaagggaagtagcagagaaaggctaacctggcagaaaagatctggtagtgtggggaggagacaggaggccattcgtccccatcaacacttgatcctctctgggaaaggagttctgtcacttctggcaaaaagacttgatttggaaactctgcctcagccaaaacgctggcgtttaaagctggatctaaataatgcacaccatgtgtgttggttcctattataattagtcgttgaagactgacaaaacagtcagtcctataaacactcatggctttggccagagagctcttaaagcctcatttatttttgtgattttgcattaagtgtaaaactctctcttacctcaaagccttccatgccgctactcaacctaccatccaaaaataaaaataaaacagccaacccacaggaacgaataacaaaaaaactgaagagattaaaa

SEQ ID NO: 27371 - DNA, 1133 bp, Bovine  19866880567773
acctaataaatttttataaataatgtgtattttaaaatacataaataaaattgtgtagtgtgtacacttctgtttaaagtgtagagagtccagcttctttcacagagcctaacatttctgagatttattgtgtcaggaatttcaacacccacccttaggtttgatcatttcctaggcaaactcacaggactcatcttgccatgctggtggctctgacttgttgcaggaaaaaggatacaaagcataatcagcaaagggaaaggaacatgagacaaggtccagaggaaaccagacgcaagcttccaagagtcctctctcactgaagtcacacaggacatcttaattctcccgatgggaaatcaggacaacccgtgtgtaatgttatctactagggaagcttattagatactcagttcctgaagtatctggtcacatgtgcagcatctggcagatatgaaccaaaattccagactctcagaaggcaggcaggtattcagcataaactccactgtttgtacactttaggcatactgagtcatttttggacagttctggaaatggtgggaactcttttgaaatctaagcttagagttactaacccagagccaaacgcttaagcatatctttttaaggacagcagtctcaagcttgctagtgttaactctgttctgaacatttactcaggttgttgcatctgtaagtagtccattcattttcattgctgaatagcatttcatctgcagacgtaatatgtggctggtggtgggaagtaaagtccaatgctgtaaagaacaatactgcataggaccctggaatgttaggtccatgaatcaaggcaaactgggaagtggtcaaacaggagatggcaagagtgaacatcccacattttatgaatcaataaactaaaatggactggaatgggcaaatttaatttagatgaccatatatctactactgtgggcaagaatcccttagaagaaatggagtagccctcatagtcagcaaaagagcccaaaatgcagtacttggatgcaatctcaaaaacaacagaatggtctctgttcatttccaaggcaaaccataaaatataacactattccaagtctatgtcccaaccagtaatggtgaagaag

SEQ ID NO: 27372 - DNA, 5132 bp, Bovine  19866880621967
atttttcaggcaagaatactggagtgggttgccatggcctcctccaggggatcttcatgacctagggatcgaacccaggtctcctgcactgcagatggattctttaccatctgagccaccagggaagcccctctctgagggttagttctcgttaaagctagcagatgactcagagttccaaggagggccaatctctgttcccacacatctgtgccccgagtcttcagaactcatagacccaggcccagcctctgatcaccagtgggaggggcacctcctccatcgtattgcacccccggtggacacagcctgaaggtataccaccctcctctctgacattactgtgtctgatattgggggctgttctggacaattgtccctggcatgtttcatatgtaagtgtgtgtttgtgccatctgcacatatgtgaacactggtagtggcatctcttattgagtacgagtacactgagcaaacccactccagtgttcttgcctggagaatcccagggataggggagcctcgtgggttgccgtctatggggtcgcacagagtcggacacgactgaagcgacttagcagcagcaacactgagcaaaggctgtgcttcagaaaataataacttatggcgcaaagcaacatttatcccaaaagaatgtgcctgtgtgcatgcatgtgtgtgcgtgtgtgtacacattgcagtgtggtagagggagggagggacaccctgatatttattgatcaccttcattcatctgggggcttccctggtagctcagatgtaaagaatctgcctgcaatgcaggagacctggatctgatccctgggttgggaagatcccctggagaagggaatggcaccccactccagtattcttgcctgggaaatgccacggacagaggagcctggtgggctacagtccatggggttgcaaaaagtcagatgtgactgagaaaccaagcacacatgcacgcaaccctcaatttttcagtcttcactcttcaatctttcccagcatcggggccttttccaacgagtcggctctttggatcagatggtcaaagtattggagcttcacctttcatatcagtccttccaatgagtattcagggttgatttcctttaagattgactgtttaatctccttgcagtccaagggactctcaagattcttctccagtagcacaatttgaaagcatcaattcttctgcactcagccttctttatgttccaaatgtcacatctgtacatgactaccagaaaaaccatagctttgactatacggacctatgttggcaaagtgatgtctctgctttttaatatgctgtctaggtttgtcatagctccatctttaacacttattggcacttacctagccccaggactgttaggtgctttatctgaattatctcctttagtcttcataatagcttgaggagacaagtacaaatcattgccctcatttttacaagtagagatactcaagcaccaagaggggaaataagtctctggggtcctgcatctagaaagtggcaggatctgggcagggggctgcagagcctgctgggaatcccagcagcacccggcctggctctaggagctcatgcacagcagaccagcgactgcatctccgtcctggtcggggccttctgtcctcattcagggtgatgtcacatcagtgggacgggacatctcacacctggaccgcctcgtcctcagatctggattccagtacatcctcatcctcccatccctgccactcaaatccccccactgccctattactttggttttagtgcactgagcccctgcccgcttatgccacgcctctcttctcttgccatccagcctcttctccaacatgaattccccagtcactcagcctttctcttgtaggttacaaccccttggcaaaatcccagttctgagtgaacaccgccccgcccacccaccgtcttctggcctgcactgggctgttgagtgtttctggagatcgtcagatgatacgattggcttcttggctctgaattcatgatctcagtctgtgagcagccatcggtgccaccaggagaccccactgttccctctggaggtctgctccgcccccagccccctgccacgagatgacaacaatgctcacaacctcctgttctgccctggaactttccctctagttccgaactctcatcttcccaccaacaaactcaccaatcccacccagacaggcacctcttctgtttcttccttcctagatgggtggagaaaagtctctccacctgtgctctggattcatccctccagctactaaggaacttcgctcccaggacttccctggtggtccagtggttaaaacttggcctgccagtgcagggggtgtgggtttgatccctggtcagggaactaagatcccacatgcctcgtggccaaaataccacaacagaaaaccgaagaatattgcaacaaattcaataaagcttttaaaaatggtccaccaaaaataaaataataaaaaaaaaaggactgcactccctctgcaggggtgccctctgcagggagctctcgctcactttcatggtcctttctctaggcgacttcagtgcacagacatgcccctctcatcctcccagagcccctcctcccctcaacagccaccccgattcctccattctctttccatgcacacacatggcccccactctcccagccccatgcatgcccagcgccactgcagcctggctgtgctcccaacgctcttctgatgccgcttggtcaaggccacccatgaccctgtcttgccggtccagccccacccactctgcagcttcatcttagtccttcatcactggtgaccactccctccctccctccggaagcactctgctctctcagttcctaaactgaacactttcccagtttttctctgacttcgctggccagtccttcatggggtcctcctttttctgagccctgaatggtggccctccttacaccccattgggctctctctcttcactttccctgctcacttcccaagagatacctttcagtgttgttgctaagtcgtgtctgattcttttgcaaccccatggactgcagcctgtcaggatcccctgtctatgggatttttcaggcaagatactggagtgggttgcaatttccttctccaggggatcttcccaaccaagggatggaacctgtgtctcctgcacgtgtctcctgcattgcaggcaaattctttaccactgagccacctggatataaacaccattcttgggacttccctggtggtccgatggctaagactgaactcccaatgcagtggggccaggtttgatccctgttccaggaactgcatcgcacattctgcatcttagacccaacacaaccaaataaatattgaaaaataaataaatgagtaccattcttatgacaaccaccccaagtctgaattctcaacatggacttctcctgggagctttcttcagagttgcaggtcccaccacccactgccatctccactgggaaatctcagacattctaaaactagcacatccagagcagatgcaaattccctgcaagacctgtcccatctctccctagacttcccccatctcagacaatggcacccgctctccaagttatgtaatcctctcttttatcttcttctcttatctaatccattggtaaatcttgtcgacttgctctctaatatatcttgaatccagaatccacacttaacacagcctggaaagcacagccgtagcctcagctcagcatagtcttcagagatactccttttatttgtttgtttgtttttttactttatttttaattgaaggatacttgctttacagtattgtgttggtttctgccaaacatcagcatgaatcagccatcagtatacctatgtcccctccctcttgaacccttctttccgtttttactttcctttcccacactagctcttacccacttaaaggtctcggtgaagaggttcccatcattaaatccattttacagataaggatattaaggaaggttcagagaggtttaaaaacttactgtaggtgtccagctggtaagtgggatctctgggcttctccccacctgcctgactccccatcccacctgccttgtgactggttcatggctagaggagtgaggactgccaaaggtcagccttggagcatgctgccagctccatgggaactaagtgttctctgtgggggctgaagagcatagataatgctggactttagcgttcaagtcagcagggctaagtgtgacttttgtttgataagcttggattttatgtcgttaggagcaaacaaaccataaaatagctgtgtgttttaatgggcattttggagcgcatcccagcttgtggggctctgcccaaggacaagagtgaaggaggcaggcaccgtgggagggggctgctcggcttccatacaccacccgggctgtgagctgagccacgtggacaaacgtcttcactgcttagagcttccctttccttatctgaaaagtgggacacagccagcctcatttccactctgtcaatcaggaactaccgtaatgacccaaagcctctccacttagaaggctctataatgatgaaaacactaacagtgatcatgataaccaacttatcctgacaccacgtgccaggcgagatgctaagagctttattatcttttaaaattatcccagtttatatatgaggaaaatgaagctcaggcaagttcaaaactatgcccaagctcacagcgtttgtgagtgacagtgccagacccagcgaggcttcccaggccttgctcttagccactaggctttgctgtggagggctgaggatgatgatgtgagggatggcagtgatgaagatggcgatgatactgatgacggtggtgatgatgatgatggtggtgatgatgatgatggtggtgatgatgatgatggtggggtgctgcgggtagggatcactcttatgcttcatggccccaggctctttgttaattacttccccccttcagagcctcttccacaggtccaagcctgccttggccaccttgccacaggggctaagtgggtttaactgaaggaagaggtgtaactgaaggactgctcaaggga

SEQ ID NO: 27373 - DNA, 1390 bp, Bovine  19866880641472
aaaatgttaagaatttttttctaatgtagctatttggaatattaatctcattacacttatggcctgtggctcagcccctagactatgggtctttcttattggaagaagacccacaggtccaaacacttcttattggactttagttgtaaaacctgtcataaaagtgatcatgcaaaccaaggcttcagcgattaatcgtaacttgaaagagcacacataaatctacttgatgactcagagacccctcaagtgtttccatattgctttctgcagtcgtctggatgacggattcttctcagataagtgattatttgtgtttctttctgtcttagggtccacaactttctggagcaacacctgcagctggtgataaagggtcggacacgcaagtacaatcggtgccttcatctgactgattttcctcccggagccgttgcagtacactgtcataaccgatgtgtttttccccattttagggaacaaagggtgatcacgatttccaaatcagaatattctgcacacccgtctgtggcagacaaagctgatgttcagcaggttgtcatgtattgcaaggagaagcttattcgcggagattcggagttttcctttgaagagctgagagcccagaaatacaatctacggagaaagcatgaacaatggggtacttgcagtcttaaatttgagatagcctaggtcacttaacatgattctcatctctgagtaattacatttgtagtagataattcattgtactgaaagaatctcaaaaaaaaaaaatctctagctcattccatcagaagcctaaaacctttgttaaacactagtgtagcaactacgtttgtccaaagcctaaactgatgtcttgacagcaaagcttagagctgaaacagcactaaaggagatgtccatgccaacgcagagatacttttaagctttcacataacatctgtatggatctgagcttctgtatctagcaattctaaacccctgggtcagttatttatactgtaaaggattaattaagagctagagttgagaagagatttttcaaagtctgcagctgttataaataagacgttcaggagtcctctgatcaaagcgctgtgctattcacggctgtgctgtacagtgggccctgactctgcggggaagactggatgttagcagcagcgttggctcttcagtttacagcacgtgtttgctgtaacaacatggacctcagaggaaaatgaacctctgttctcaagacttcgacaccatctgactatttgtgctgtgccccctgtgttggccaatttttgtttattcattatttctcgtttggttaacaaccgagaggacagtcagtgacccttggggaggaccctttcgtgccttgcacagatgctaa

SEQ ID NO: 27374 - DNA, 820 bp, Bovine  19866881015063
tttccccccccaccagatctccaccaacaacaaaaacctttttcctgctgcttcagcccccaaaacactccttttttggaacaactgagccaggcagctgttttgtatcaagtccaggggttttctatatgacccagggagctcagacaactggcaggccttcctgcattaaggggtaatctgagaataatttgccataaaacacccagaagtgccccagctgtagccagatatgccctagaaagcaccacttgcactgtgcggactttacaaaataatcataattttagaacacacattttttttaatccatttttggaaactattttaaaggaaagaagtaaccggcaccatctgagaagaaggccacagggaacttcccttacaggtacacagactgtccccaagcacctcttctcagcagctcagtcagtgaagaatctgcctgcagcgcaggagatctggttcaattcctgggttgggaggatgccctggagaaggcaatggcagcccactccaggactcttgcctggaaaatcccacggacagaggagcctggcgggctgcaggccaggggtcacccagagtcggcgcgactgaggactaagactttcaccttcatctcctccttactgcccgatggcccaagtcctgtgctgccagggctgcacggggctccacgtttacaatgtgctctcacacacaggctgccgaggcaggtgagaaggatgagtccagtaagcgcaagcctccaagtcacctgctggtgagtattgctccttcctgggtgaagtaccagaaccttctagactaggggcag

SEQ ID NO: 27375 - DNA, 1795 bp, Bovine  19866881041041
ccatattcatgcctaaggaagggctgcaaagcccaaactaaaggaagcatcgcatcctgtgcagagagccgattcaaggctctggctccaggacaagacagggccacaggcagccctcccccatcagcctgagggcacacgtggccaggcagcccttcttaggagccggtcggctcaccgctggtgaaacactcgtgaaccaccgggatctgatccagggttgcaaacagaggaaatgcaaagtaaatgtggggctaccataggacaccggggataccaactcactctaagcaaatacttaaaaccacgaaggcctagcctctcaaacactgggcttcaacctgtcctcccaggaaccggtcagctcacagcgtgtaaaaaaaagtcctcaagggttcatgattcattcactcagaagtaaaaaccaaaatttaacgatggccaagaagcagaacgtgcacagggaaaaggaaaaaaaagctactttaaaattctcaattctattcatgtgtgtgcactgagtcactttagtagtgcctgactctgtggggccccgtggactgtagcccaccaggcttcctctgtccacaggattctctaggcaaaaacactacggtgggttgccatttcctactccaggagatattcctgacccagggactgaacccatgtctcttaagtctcctgcactggcagatgtattcaccactggtaccagctggtaagccccaagtacagaccagggggcacccaccacaggcttcacctctcctgagataagcaggccagtggcttgggttctctctccaatgagcgtatttcatttcctccattgctgtgaattggccccaacacactaacgatcacgtgtgtgtgtgtgcctgggtgcacgtgtgttagccctgctgctctctgtcccttggcaggtaatgactttcacagacagcttcctgaacccgggaaggaacccaagtgtgccaatctcatgcactggcaggcaggttctctaccaagagcaccacaattctattcagccaatgactactgctaacgttagaacagtgagcaaaatacccccttattttgaaaaaaactgcaataactttaactgcaggaaaaagcagttcaagcctgtcttaagtgtccaaatctttctttctccaactacacgtcttgagctacagtcaagtttctgcctaacccaataggccatccctctcaggtgtccctgacacagacctggtcccaacagagccagtgcagcgggggtgtccagatgtttctccatggtccaaatatctgccaaggttcttctcagggtgatgtgcaggttcatgggcaggtcaagggtgatttggacctcccttgccctcccaggccacttcctagaaaagactttctttcctattttgcttgtttgttctggggcctggcagggttagaattacagctcatttccagatgaactgacttccctgtgggtttcctaaagtcctgaaatgacagctcctttccacggaaaggaggaaggaatgtttcactctgtcatgctcagggacctgctggagcctcgacagtcactgagcaaggaaaacagtgaccaagtccctgccagctgctctctgcccaggagctcatacaaaaaagccctcagctctcgggaggtgagaacttctgtctctgtctgatggatgaggaaatcgaagctctaagaaacatacagatctgcccaagttactcgtggggctgagaacagccgggtaccgctcagaccccactccagacccgtgtgcaa

SEQ ID NO: 27376 - DNA, 1189 bp, Bovine  19866881074045
agttaaagcaattaacaggacagcagggggcagaggggaaagggaggtcaacactttgcagaatttaagacattaaataagccagaaataaatatacaacattcctacaagttacagcattatcaaacagtaggacacattacatagaaaaagaatcgacaatatttacaaccctcaattctgaaaaagttcagcaaaaactgatttttttttttcttttagtcatttaggctgtacaaaattttacaagaaagggacacataataattgcacagacatttggctcagttgataagtaaaatacaacttcctaatctaataaatagtcaaaatatatacaatattaagaaggagaaacagaagaaaattgtaatccgctatgtacatttttttttaaaccaagaaaaaaaaaatcttcatcaattcaggtctagggaggggcccagataatttgcaaattcactcatgaagctaatttcacgtgtttattgcattcctgtgaaaagtcacaggacagtttctacaaatgtcatatcagacaagtgatcaaggcacaaaacctgcattaagtttccaacaagggaccgaattatttttgctctctacaaaaagtcaaaggaaggaaaagtaagacatcaaaggtacacccggccatgggcataccttctgcagagaggaggcatcatgatcaacagacacgtacagtacagggatgtctagtcacctctcaagtcccgggggcaacatcctcgttttaatacctctacagttcatagattctctcatttcctcatcagctacttccacggccagcccagggggcctggaggcccccaagcccaaggtagacttgcacgtgggtgagcaagcgctcggccccccagggcactggtgctgaaggaataaagtgctccagtccaagagactggcccgtgaatacggagatcctgggggggagcggcccagaaccaaatacgtctttggtgtgtgtgtgtgcagcaggcccacggacgccaattccgtggaccgcctcaaccgcttgcgtggacttgaggatccagcggacgggttcaagacaaagggtccaagaaacacaagctgagactcaacacagcttttaaaacaagtcaagaccccaaaaagctacttggggaaaagaaaatgtttagaaggaagaatattggagtca

SEQ ID NO: 27377 - DNA, 1750 bp, Bovine  19866881088134
taatataaatgggataaaagagataaagtgaaagtgttagtcactcagtcatgtctgaccctttgtgacctcatgggctgtagcccaccaggctcctctgtccatgggattctccaggcaagaactggagtgggtctccattcccttctccaggggatcttcccgacccagggatcaaaccttggtctcctgcattgcaggcggactctttaccttctgagccaccaggggagccctaagtcttccgtaaagaattccagatgataatggccccttcaggagcttcattttccttcccttgataatgagttggacttagaaacctccttctattttaaagaatcaagtttggagatggaaaagagtttctttacagtggagaaatccatagatcccacgttaaccacatgattagggttaatatcatcagtaataagacaggttagtgatgtggacctctggtacgatgtgatgagaagagcacttctctcttcccagaacccacagccccagtccaatcatgaaaaaacatgtcacacaaaaccaaactgagggatggtccacacagtaccagactggtactcttcaaactgccggttggtgaaaaacaaggagggactgagaaagcatccgcagccagacgaggaaggagccatggagactgagtgcagtgtggcacctggatggcgtcctaggacaggaaaaggacgttcatagaaaaactgataaatctgaatcaagtctgcgttagttaattcttgttgtttagtcgctaagtcctgcctgactcttttgggaccccacggactatatcccatcaggcttctcagtccatggaatttcccaggcaaggatactggagtgggttgccatttccttctccaggggagcttcctgacccagggattgaacctgtgtctcttgtgtctcctccattggcaggcagattctttacccctggcgccacctgggctacagtccattgggggttgcaaagagctggacacgactgaagtgactgagcaggagcactgtactccaataaaaattatttctttcaaaaaaaaaaaaaaaaaccaagccaatctcccgagcctttcctggctgtgataagttcctgctttcttttgtctggagcgtcagtgttagcagagctggtccactttcaggagccagtgtgatcccctattcacacgctttcgtgtgaatggcggctaatcccctgtagggatggggaagctgaggctggtttgtgactggggtggggagaggggagggcgaggcttctagactcgggtttcctgctgttctagcgtccccaggcctgaactgtcgaatggggcggttccacctttgtccctcactgagggaccttggctcaaaggcggtctagtgacggtgcccccagggctccatcataacaaggccctcaggaaaagagctctgtacttgccattaagtacttgcgtgtctagaacaatcgtgtgctttgttcttggaaaacttactgtctgggccttatcccatttcggttttcattaaccttgatgtttgtactaattttgctttagataattatcagcattgaggaggaactatcagctgactctcattttcaggagggaaaatctttcaaaataagttaccaatcgtgtatctccactaaaaccaacttcatgttgcttaaaaacagatgaaacaaaacaaaaacttcagctttataaaatgacggagttttgtgtgtatgttt

SEQ ID NO: 27378 - DNA, 910 bp, Bovine  19866881301018
agaagccccaaatacagcaagtgagaaatcaaggagatgattacgtgtactcactctctatcgggaggaaatcctttttgaaaagatcccatctatttctttcaaactgaaatactttggtgatgacaaaataataatgatggtctctgtgcttttttttttttcagtttcctggcatttaacatggacacagttggtcatctcacctttctgttgaaagcggtgcattttcgtgaaaggattcttcagcggggtttggtggcccgaatttattataaggtaaagatacattgtgttataataatatttttccttttgacatgtgtgtaaggcatattcttgctggtgaaagtgttagtcctttagtcgggtccgactccttgtgaccctatggattgtagcctgccagactcctctgtctgtgggatttcccgtgcaagaatactggagtgggtagccattcccttctccaagggatcttcccgtccctgctaaatgtaatagaggatgagtcagcaagtcggacacaactgaagtgacttagcacccatgcagcaataattacaagcttctggaaatggctagaatttctataagccattttgcatgacagcgttgctcactgtggaggtcctgatgcttctgatgagctctgtgtgtcatctttagagtgggagttgacgagtggagtaaattttaagccttactaaaaccaaaacatcattgtctgtaataatgaatacattattttcagggtgggggggagtgcatggggcacatgtggaaattaaccactgggctcgcctgagatgcactctgtttcctactgaagtgcccatgatgttctgaaaaacataaaaccttgcatcagcattgatgggaggtctagaggtaatttccaccgagtgtg

SEQ ID NO: 27379 - DNA, 1229 bp, Bovine  19866881393854
ttgaaaccaagtttcaaaaaaatgtaacatcttctggggcttggggagtcagtaagatcatctcttctttgtcatctgcttttcctgtatttgaagatgaaacaaagaaaagtatggattaccacagccaaaaaataaacttgcaggagccaggacctttggagaacgttccatgagctggtttcctacaaaaccaaatgaagtgcctcacactgatgagtttctggatgattcagctgtggggggtgtccactgcaacaaaagcctggcacccagccccaagagcccaggagactttaggtttgccatgcagctcgcatctatgcccttccacaggcttcccgtggactccatgcacccactggaagataaagaaaatatggtagcacaccagcacacccatgtggctttggattctttcaaaagaaacaaggtggaacccttgaaagagaaagttcagtccaattgaagagataagtcgagacttagtgtgccccacagatgtcccttctgcgtccttgctccgtctgggccagcttgctgcagccatgctgaccagcaaggcagagtggcaccccctgactttgccattgcagaggatccgtccagaagccagcgctgggctccaggctgaatcgatgcaggctggcttgcttgggaatgtagacgctccaaacttcactgttgagagaattcctgagatgaggagttgattctcaaacttttagctgggctttctaaaccagtgagttcctatccaaatacttatgaatggacatgtaagcttccagccatcaagcccaagactgaattccaattaggctcattgctggtctatgctgatcaccttcttggagaaggggcttttgcccaagtctatgaagttacccatggagatgtgaacaatagcaaaaataaggagaaatttgttctatatctgtacaatatagaagtgaattttagaaaaaaagttaagctgatgcaagtatgttaaatggagaacactcctgaactccaggtgtgcacgctctccaaaacaatgccatccagattccaaatgtcgagggccctcaatgtgaatagggagcaaaaaaaaaaaatccatcttacaaaggaaattgagcatcctacattggttcaatgaagtggtggaccaactgcacattccagaaggagaattgctttctgctgtcctcgagcagggagggaggaagaatacattacaatag

SEQ ID NO: 27380 - DNA, 2560 bp, Bovine  19866881499171
ctgtatgtgtaacctgtaacctgtaacctgcagactctgccggaccagtggcccaaagggtcctgggcactcaccatgcctccggtgcattctcgacagtcctgcaggcagctgacgttctcccaggtgctgtaggccttcagcccggccacaagcgcctgcagtgggcgactgtcgacgagctccttcccacggaagatgtcctcatccagaagggtgccggcatacctgcaagacaagcggagatgggcgatgggtgcagtgtgtcccgagcatacgtgctcatcagggataggggtctcacaactcctttgggttttggtgttgggatgctcctaaaattagttttcccttttctgaaagaatttgtgtaagatcagtgtgtttccttttttcaagtatttaatggatttcacaagcaatgtcaaagctattcaggttttctacttctttttgggtcactttcggtactatgcatctttcaagaaatttgtctatttcatatatgctgtcaaatgtattggcattacattaacatcacattaataataatgatatttaattttatcctttcagtgtctgtgggatctatagtaaagttctctcttttattctagatactggtaacttgtgtctatttttttctgcatcagtctagaaagatggtaccgatgatcctacacgcggggcagcaaaggagaataggcttttggactcagtgggagcaggcaagggtgggatgatttaaaggtctttcaattttatttatttattgaaagaaaaatagtttggggcttgtttattctctattatttgaccatttcttgtttcatttttattattctttgtacttactttgggtttaacttgttcatctttttatagtttcttaaaatagaaatttattccagtggtcttagacctttcttttgtgtggtaagcatctgaaggaatacatttttctctgagtactatcttagttgcataccacacattttgacatgctctgtttcatgtccattcaaaatattttctaatttcccggtgatttctactttgacctatgcatgatgtgtgttatttggtttccttgtatgtaaggatcattccagatatttttctgttactaatgttagcttaatttcattctaaccagagaacatactttgtgtcgtatcagtcattctaaatctacatggtctgtcttgatgcatggtctatgtaccctgagtgggtattctgctcgtgcccagcagagtgattgacagatgccactgagtctgtcagtaacgctcttcatacgatttacagcatcgctggtcttctgtttcatcagttacccagagagaagggctgacgtctgcaactatacgtgaggatttgctcatttcccctttcagtcctgtccacttttgcttcctctattttgatgccattttgtggaatccatacacatttagactgttacatcttcttgatgagtagactccttagtcatcatgaagtgagcttctttacctctggtaatgttcctttttctgaggtctactttatccaatattagtaaatccatgccagctcttttacagttaatgtttgcaggtgtaagttttttattctcatacttgtaacctatttgtctttaattttaagtgagtttcttgtagaaagcatctagttcagtcttaatttatcatatcttgacaatctgaaaataggagtgtttaaatcatttaattcaatgtaattattaacgtgacaatttaaaactgctgcctcacaagttttcccctgtttatcccatatgttcttttccctctgctccagtcttcttttgattaactgaataatctttagtattccagtgttatattttaaactgttactcattttttcagcaatttttctatggcctaaaacatgctactttaacttatgacattttccctcaaatagtgttacaccacttcaaagataatgtaggacccttgtaataatacagtacataattccttttcattctcccatccattatgccactgctgagacaaaaatatgttctatatatgttacaaacttcattgctatttttgctttaaactaacagtttctttttttctttatcaacgttactgaggattaatttattcccaacagattgaattattcaaagtgcaccatttaaagagttttgacaactctatgtacccacgagaatatcaccaaatcaacctacagaatgctttctaaagaatgcctcatccctttttgcagtccatctcctcctcctcctcccatctctggacgaccagcgaccagctctttgttcgtatggattagtttgcattttatgcagatggggttatacagtgcatgtcctgtctggcttttctcaatcagcatgttgtcatgagatccatccgtccacccatattgtaccacgtattagtagttgtttcttctcattgctggccagaattccattcaaacgcatacattacatttcatttatgcatccacttgacaaacattttcattccttccagttggagctacaaca

SEQ ID NO: 27381 - DNA, 1192 bp, Bovine  19866880503536
ctggcccccggtcccaggcctcccagcgagtaggaaatggccgaatgggtggggaagccacaaaagctgaccctcaggcacacaaaacccaccagagggcagggcaaagagagagcattatttttaaagacttgtaacaggagcctcaaagtttgctacagactccccagcccttgggcctctgcagactggaaccaaaaggagccaactctcaaaggcagggataagcccccagcgccgtgcagtccccacagagccccccaacagcgcagaccagcagcaccaggcccctctctagagctgcagcaaagatgcagtctgaagtctgccagaaaacctgcgagactctgtgtcacgctcacctgtgtagacgccagtgacgatgtctccctcctcgggacgcgggctgtccgggacccacggctcctctccttgctccagccggaagatcagatccggcttggggactgggtatcctggcccaaagagaacagggggcagctgcagggctgtactcgcaccccgacccgcacaggcctgcctccaccgctcctgtcccattccttccagaacctgcctccccacctccccgctggaactcccacacccccaactcccctgccaagccccctccacacaccaccgtccacagggggccccacccctctcctctgcctccggactcctcaccccttgaggcctctaaggggagcacagagaccagcgctgggccagccactccccaggacatggaacctgggccacggtgctgccgggccacagtgagcccctcgcgacacaccctggccggaagccaggctggtccccagggcttccctaggaggtgagcaggcaccagcaaccccttctccaggatcctcgggctccacaaaccaccctcagacagctaagccccaggcagccgtcaggctaggatgccccctgcggacggagggctctgctcacccaaggacaccaggatcccatagttttcccgcatgacctccttgtagagctcccgctgctctgcgtccagcctttcccactcctccagggagaagtacacagccacgtcttcaaaggtcaccagcccctaggaaacaaagcaccctggccactgcccttccctgagctgggtgagaggcaggggcgcacccccatgaagacaggacaggagatcacttggcgggaa

SEQ ID NO: 27382 - DNA, 1240 bp, Bovine  19866880527576
aaaaaaaacctttcagctagaatacatagatatcagatcagaatccacagtggccctttgtctgctgacctgagctcccagtgccagcctgggctgggccaggactctgtgcacttccccaggtcgcgtctcctgttgccgagggtggggtgtgcgtgagctctttggggggtgtcccatgttaccctgagcactgtcactgtctgtccccaggtcccacgatgtgaaaaatggaggcgaacttactcattccgcccacagccccggccagtcctcgccccgcccggtcatcagtcagcgggttgtcaacagcaaacaggcagcctcgggattcattggcccacagctcccctcgcacatgatgaaggtaacctcccgagcagagggtccagccctctactcagtgctgcagtggtggccctgacctcgtccacagctgagtttcgtatccacaaaaatggattcaggccgtttattagaaaatacttcaaacgtaggggaaatctctgaggacgaacaatgtgatccagaaggaagtaggggtatgagtctgtctaaacactggggatttgatctcccaccctggactccgttcacttcatggagtaaatattgaggggttctcgattcatgctggcctccaggaagagatgcttgtacagaaagaacagtcgcgttgcctccatttagccctttcaggggtgtgacgttttctgcctgctgtctggctgggccctatcacacccctgagggctgctcagagcgagcagagggtatgctttctggttcctgtgacatcagtgtcctcagtggaggcctggcttttgcttgacgtaaatgttgagaccgcagacgtgttgacatagcttgtacacaccgtggaataatcctgccacctgtgccatggtgtcataacagcctttcagtttgacagggagccacagcctcagtgctgtagggagctggccaggcagcaggtcctgtgctgggctcggcctgagtgacgtgggacaggccaactgcagagcatctgccctgtgtggaagggcggctgctgctgctgatttgtcaggaaatgtttttgcttaactatgaagccttcccttgtagctcagttggtacagaatctgcctgcagtacaggagacctgggttcgatccctgggttgggaagatcccctggagaaggaaatggcaacccactccagtatccttgccggaaaatctcatggacagaggag

SEQ ID NO: 27383 - DNA, 1111 bp, Bovine  19866880567929
aaccttctataaatctaatttttaagatgtcggtggcctgatatttcagaactgccctgtggctttcactcatgctaattaagccatctcccaaatttcaaattttaatattttcactgttggatgaaaagggtggtatttctcatccagtacccttcttttggacacttaattagactgttgtagagaaataacaagggtaagacgaaaaaagcaaaaaacaaccaacccacatgaatcttcttaaacatctgtttttgtttttttccccaaggtgtaaaaagatggttccagcttcaaagagattcactatacatagatcttctaatgttcttactctttctctgaaacgttttgcaaattttactggtggaaaaattgctaaggtgggtagataatattattaacaactgtttatgctgagcctttcaaggcttaactgcccagcagctacatggaagttttattacctgattttctaagttcttccagcacttgttagtggaataaaatgtcaaagaactgagctcaaagtttgctgtgtgtgtttacagagtgtgtgtgttttcgtctgtatcccttagctgactagactttctgaaggtcacacctggtgcttattatccgcgtttgggcgtcatagttggtgaaggtgctgagtgggttcagggaacgcttatggcatttcaagtccaaagatttcccagccagaccttgccattctttgaccagagtttgcttgtttattcgtttgttttctgattggtagtatactgacctttcccattttcttcccactttctgaaactgaaagtggtcagaaatccagtaacatgcggaataaataacctgctcctgaattgttaaaaataagcaatgacttcaagtccagacttgtgattgttaactgtccgctttgatgggtttggagaactcacatagtctggatccttacttgcgtaaagaaaacaaatacagggggattgcactaaagacacgtagagtcaggcgtctccgggttaggtctgtcttccaaaatgaggctgcggtgttgggtccctgctggagcaccacaaggcgccatgtgccctgagcctcccgccctgccctg

SEQ ID NO: 27384 - DNA, 2850 bp, Bovine  19866880605121
gcatgggaggcaggtagagagaaaagtgaagggtgatggcctgtttccggactgtgtggtggggtgggctgaagtggaactgaccaagtcccagagggaaagcaggtaggtaatgcaggagacctgggtttgtttgctgggtcaggaagatcccctggagaagagaatggctacccactccagtattcttgcctggagaatcccatggacaggggagcctggcaggctacagtccatggggtcataaagaatcagacacgactgagtgattaagcacagggcatgaggttggaggtttggtgcttagtttggggcaggttgagtctgagaagcccctggggctttcaagtcgggctgttcagaagataatttgatatctaggcctgaagccccagacagagacaggcactgagagtagagatgtaggtaagggacttccctggtgggacagtggctaagactccctgcttcccaggcaggtggcaggggtttgatccttggtcagttccatatgccccatggtgagaaaagagatgtaagtatgaccaccacccctcggagtagatgggaagggccagggggtgtgtggactgagaaggagagagcccactgtcttctgacagatacctcaacgctgactgcctgcctgagcagtgggcatctccctctggactccactccacacatggaccacattcctaggctcgctccactctccggcaagcactgggtgcgccgtctacctgcatcaggtcttcctcccatcggccccttcccccagagcctgctgggcagcagttatgcgggtcaagtctggatgtgtttctctgcttgctgtgggacggcctctccttcgggagggttcttttgcatggaggaagaaagagagattgttcttccctgtgtggctgctcaccagagctggaggggagtaagcatgcttgtatacttggaagctcaggggttgacctccctccaccactgctttttagaaatgtctttaattgttaaatgactatgggcgcactgtaaaaaagatatatagctcagaacagaaacaaataaatatgatagactccctgcccctcatcctgctaatgtctttacaccctagtgacaattatctttccagatttcacacacacacacacacacacacacacacacagtatgtcatgctcatcaattggttttttgggtttataaaaatgtactagacatatttttacatcaaaatgtatatagctcaacttcccatttttcctttttcctataaaaatcttacaagtttatggtagaagatgtggaaattcagaaaaaaaaaaaaaaagaaagaaaacccaaatctgccagtatcctaaaatctcattacccaaagataatgattaacattgaggaaaacacaaaatttactttcactggacaatattagaagaagaaactaaagttcaaaagcactatggaacttcaagtagatttttcttcaaaataagagacactaatccttacacatttcttaactttaagttaaatcgagaagtttaagctgtaatgttttattttaatgatatgatttctagtttcttaatgactgctagtttaggaagaaaataaacatttctctggtaaaaatcaaaaggtacaactgatttctaaacaaacagactaaactcatctacctatgcatatatttttaaattaaaaataatttttaaaaaaagtaggcctactgttaggataacttgtcaagataaattattgacatattcaatcactttcaaaaagaacaaacacatcaggaggaaataattatcacttactcctgatacaaaaccgcacagatgatgtgtgagccccaagcactcaacagttaccagcttcttcccacaccacctgaccaatggcagcctggctctgtggaatgagaaagcagcatttcctacacgtctttaatggctcagaatcatgccacagtttagatcacattttatctggggtgtgactttcatgtcagctcattgcctttcccagagtcactaattacctttcttatccttgttgctcagaagtgctgcatgccttaattccatgatggtgcttagcatgctagcgtattccacataggattgactagcactgttttctttgaggttgttcttcacagactcttctgatgtctcgttctgattggagctaattgctcattaggtcagcttcgcagctgtcctactggtatttctgttcgttgttctcctggattagttctatgacttttggagtctgttgtcttctttcttggattctgttttcatttttctggggtacatcctcaaggaactttttcagaaaatgtggagtcccactccagagcctgggagcagcagcgccgtatgggggtggggaagatagatgtgagtggagaggccacttcctgtttctctgcagttttccccagctttgggtggtggccgttgttgggctccagcttgcagttggtgaagggaagacaaggaggtgtggaccgtggccccaggcaccctgtcctccaccaccctcagcctcacggtgagctcgctgcttcttgcctcagtgtgtctgccgctgggctcagtgagcaggccaggggcaggccatcaaaggcatggtggtgggagagctagctacagggaaaacctgcctactgatcagttattcaaacaatgaatttcttgaagaccatatccccactgtcattctgctaatgtcacgatagatggaaaatcagtgaatcttggcatatgggatatagtggtcaagaagattttgacagattatatcctctgtcctatctacaaacaggtattctctcca

SEQ ID NO: 27385 - DNA, 1225 bp, Bovine  19866880628163
gctcgggccgggactcggcggtcgctttccccggggcgggggaccttgggggcgaccttcccccgcctcctgtcgccaagggcgtccacgccctcggagcccaaccgccgggtgaccaccctcctggcgtcttccccaggtggtgcggattgccaggggggaccccgggaaaccgggagggcaaagtttggaattggggataccccgggtccaggaagggcggccgcggagagaaggttgagcatcgtgacagttttcttggctttaggtccaagtggtcacgggggtcgtttaagtgaggagggggcagcgagggcacacgcgtgttagaaagtaagggaacgtgacggagtcagcggaaaacaataagtaaaaagtcagaggagacgagggtcggagtcgggaactgctgcccgcccgcaggtgggaccagagagaaccaggctgcccgtccgacgctcagtcacctcttgctggaagattcgctttgactgtaaattgtttagtggaatacagattcctgtcgtgtcatgctgcgaattacgcctttcaaaccgaataaggcgtctgcataatgtctatggatggagtgagtcgttggcttgggacacaaagggttaataccactgttttttacaggaacactggaagtgaaggatctctctgtgtgtgtttttgctaaagatctcctaaatgctgacagacggaatcatcagaatctcttgtaataagggagcgtttggggaaaagaaaaaaaaaatcttaattacaggctgccggagcagctgcctgtaagaatcagcagcattgaacgcttcgggatgaagtagttaatcaaggtgctttctagaatttaagtgatgctccagggggagatgtttgcctcgcagtaagccggcggggctgggagggtgggaagttggcccgagccctggcatttgcggagttcacttctcctggttgaagctaggggtagcactgtggccccgagtggctgtgttgtttatgatggaaagttctgtgggaagaaggagcccaggtgcacaccctcctccagccagactgccgtctgaagcgtccaagagatggattctccctggacgccctgcttcctgcctgtcacagctggggtaacggtacaggcagacaagcagctcctccttagaaaatgaagactgaaccactataatacttaaatgtttaacattcgcgtccaggaagcatg

SEQ ID NO: 27386 - DNA, 1593 bp, Bovine  19866880672802
tgaaagtgaaactcgctccgttgtgtccactctttgcaactgtatactccatggaattctccagaccagaataatagagtgggcaaccattcccttctccagcgaaccattcccttctccagcgaatcttcccagcccagggatcaaacccaggtctccctcactgcaggcagattctttaccagcttccccaccagggaagcccagatgtttaatctcagaataatcctatgagacacctttattaagtgcattttacagatgaggaaactgaagctcagagaattttaggaacttgtctaacattgcactgctgctgagttccaaagccactgtttacttagttttttattatttacttttagttgtgctgggtctttcattgctgctcacaggctttctctagttgcggagagcaaggctactctttgttgtggtgcgtgcgcttctcgtttcgatggcttctcctgctgtggagcacaggctctaggcacgtgggcttcagtaattgcagcacacagactcagcagttgtggcacatgggctgagctgcttctcagcatgtaaaattttcccagacaagggatcaaacccacctcctatgcactggcaagcagactcttatccactgtgcacactcagctgctcagttcagttcagtcgctcagtcatgtctgactctttgcgaccccatggactagctgctcaggtgtcaccaactctttgccaccccatggactgtagtccaccaggcttctcgatccatgggattgtccaggcaagaatactagagtgggtggccatgccctcctccagaagatcttccagacccagggatcaaacccgtcggctcctgcattgcaggcggattctttaccactgagccactgcagatacctagcagacacacagcctccaaattgtacagcactcccacggtggccttggggccttctcagagtccctggcctcactgaccaaacaagagctcctcacaggcccggctccctgcgcgcccctgcggctcaccaaggccacgggaagctctggcgtgctggagtcccaaggctttgctgttcgatctcgactactatcaattaggacaacaataaagaagttaagtgcttttctattttccttacactcttagcttaaggcaaaaacctctcaacaagggcaggttacaggcccaggcggtcctgccaatacttgcttcactcataacattattaagacttaacaaaagctggaactcccccaccccaagacctcacagtcaaacatgacatcatcaggggctgctgtccaactcctaaaggctttctaaacagaaatgactcactgggcatacattttgttaaaagcttagaatgttaaaacaaataaaaaagaacctgaatgagattcaaagtcactacctggatgtgtgacccacaggcaactctaccacttactggctgaattttttaagtttcaacttccttatgccttggttttctcaactgtaagatgaatgcaaaactaccgactttcatcccaaaactatgtgagcactgattcaattttcagtctacaccaacaaactgcatggta

SEQ ID NO: 27387 - DNA, 743 bp, Bovine  19866880774358
tctttccctgggaaaagatggaaaggacatcaaagaggctgcatccagggacaattccaaattacagggaccctcctgcacatcggtggacacagccataaggcccctcccatctaggtgcccagcctgagaccaaggtcaagaggaacctctgagaagtcacctttgagtcccttggcaccaggatttcagggatgctctgttcagccagctgactgaacagaggataaaagggtttattagcagggtacctggcaaggattagacacccagcaaatactaatttcccctcctctccttagccactgaaagccaactcataaacacagcagaaaccagaaaaacaaatagaccaacgcttacaacgtacccacgtgtataaataaatgtgactgtatttgaaaggcagcagcactcttcccagccctatttctcctttctctcgtaacatgcagtagcaggtagaaagatctcccgaaggttgctccaaagcccatgcgagtggatgttccggtaggcctggggctccgctgctgggggcctggccacgtggggacagtgctggcaccaggctcggtcgcctttgtaccactcgttagtggtctggttggtggcggccaggtacagacagaagcacagatagccccccaggaggaagctcagcaccacgacaaagcccaccaggaagacgatccttgggaaggtcaggaacaggtactggggacaaagaagcatcacgttag

SEQ ID NO: 27388 - DNA, 1019 bp, Bovine  19866880859627
cttattgaaactttgtattaggcatcataaaaaacttaaaacgttgaataattttattaaatgacctttattaacattaaagggttaatgtttattaaccctttgacctttaatcttaataaaaccagattgtgatgcctatatcagccaaatttagggtggtgggttatttctttagaaactgtcttttgcttcttgcattttccgaactctcccattttttgttgtctgaaacttttgtttttctgatctcaagtgtgatacatgctaacgataaaaatgagaaacgctgcagagacatgtgtgagcctgtcccccagaatgaacactgctaacagtttgatataaactgctccagagcgtctgtttactgttggcactgacgggattacccctttagtctgttgggccacttgctatttccactccatcttgctgggcctgctgcgtgtcgtgcgtcagccagtttccatgcctgtttccttcctggtagatacttcgattttgtccctgttttatgctactgtaaataatgctgcggtgggcaacctctgtttttttgttttggccacactgtacggcttgcaggatcttagttccctgaccagggattgaacccaggccctcggcagtgaaagcatggagtcctaatcactggaccaccagggaatcccctgttgtttttttttaattgggggtggggagggcaatagcttggtgtgcacatgtgtaaaactgaacactataatgaaaaaagcctttttacataaaatttgcgcttggctttatcctctggaggcctctctccttttgcggacaagcggcagtgagtggtcatgtgctctcggtgctcttctgtccccaggctgctcagagtgtcaacaaggccttggagcagtttgtaaagccggaacagctcgacggagaaaactcgtacaagtgcagcaagtacgatggcggtgctggcgggcggggagggcaggcttggggtgacagggcttggcgtgtctgcctgaccg

SEQ ID NO: 27389 - DNA, 855 bp, Bovine  19866880895134
ctccctgcccagcccctctgcacaccctcgggcgcctgttgggggcgctgagtgggacgtgctggctggtcagacatgtaccaacaaggccccggcagggggaggctctgcgggagaggaggtgggcgctggactaacaggccccgataactgtttacctgactttcccaccaggaaaatcaacgagttctacagatgattattcaagaaggctcattccaggccttctgcgagcggatgcaccctggtcccacatcctgctgccctgagacagccgtcttacctagtctcctctgccgagcctttggctttgctgccgagtttgaaggtctctaagattttgtcttctggaagaggtggcaaaggagcaggcatcaactaggatagaaaaaaaagatgtttttcagcagtgagtgccacgcctctgcctcctgtaacccagccatgtgacccgctggacacgagggcagaagggaagcccgcctgcccgccaccccacagccgctcaccttcccagggaggccgtttgccttgggaaaggggtgttctgagtgcagcgcgggctggcctgggcaaggggccccgtccgagggcaggccgttttccgtcgggtcgctgtccagaccagtagcaccatttagagccacaggttcttggagctcgtgcggggaggcgtcgccgtcttcagcgtccagagcaggggagcacgcgctctcggtcagcccgcggccgttctcctggccgaggcccttggcctcctcgtcagactcctcggaggactcggcgccgtaggggaccagcacgccagcgctcagcctgggcctgccgttcatcagggccggagcaggcctccct

SEQ ID NO: 27390 - DNA, 1600 bp, Bovine  19866881006249
aatatgaaacatttaaatcacatggaattgtgtgtggcagaaagttggtgctgtttctgcttgtctcccagactttgctttgtattccttagactttaaatgcatatgtgtatatacaatctttctacatatgtttttcttttttttttttttttaacaattaggatcatattatatacactgttcaataccttgactttttatatagtatattgtagatatcttttttgaccgactggtactatattattctatatcatggtaccattgtatggatatactgtaattaattagcccctgcttaggtttttttttaatttcttacaactacagattgtctcagtaaacattttcataatacatttttgattgtttatgccactgtttttttagcaaggatagatttccagaggggggattccaacatcaaagggaacgtacatctcaatttttatagcagaaaacttggacattttggaaaggagctaagtgtcgttaagaaccttatcctctggagaaggcaacccaatctagtattcttgcctgggaaatcccacggacagaagagcctggcaggctccggcccacagggtcacaaaaagtcagatacgacttagtgacttaacagcaacaacaggagtacccgtaagagtattacttcattggctggcactgcacacacatacacaaaagaaccttacctctgatttctcttggataccgtgttgggagattcaactcatggattgttttgtcttattggaaggtgatatgagaaccttgagttggctgtgtaacttgaatcatacgattcttgtaaaactgaagtaaccttgagtccttgggtttgtgtgttttcaacaggagttcgccaagatggttcaggtgttacaggcatactgcatcatttcagcgggcgtccgtataagttgcaccaatcaggtcgggcagggcaagcggcagcctgtggtgtgcaccagcggaagctccagcatgaaggaaaacatcggattggtgtttgggcagaagcaggtagcggtgactgattgtataaaactgttttctccctcttgtgattatggcaagtttcttttgttccttttcaatagaatagagcattggagaagaccccgacgctgggaacatttgaaggcaagaggagaagggggtggcagaggatgagatggttagatagcatcactgactcaagggacacgaatttgagcaaactccgggagatagtgaaggacaggagaacctggtgtgctgctgtccatggggtcgacatataatttttttaatatttatttgactgtgtcaggtctctgcggcatgtggggtctcccttctgtggcccacggactctccagttgtagcgttctggctcagaagttgtggctcgagtgcttagttgctctgaggcgggtgggatactagttccccgaccagggctcgatttcacttcccctgcattgcagggcagattcttatcccctccaccaccagagaagtccttgtgggcgatgtattgataatggataagtaggagccccaagtgtttcgcttcgctaataaatcaaaattactctaaaactgcaga

SEQ ID NO: 27391 - DNA, 1528 bp, Bovine  19866881018951
cctatcactttaatttacagttccagaagattgctacaaccatgtccgttctcagattcaagtggtttttcatatccttttggatagcagaatgattgactcttttttttaattggcagcaccagttgccgttcctcttactttttgttttgtttttactgagctcttgcatgatttatcttctgttaccatcctaaataaacattttattaaacctagaataaattgtctttttttcctgaataagggttttggaacatcctgtgtcaggatgggtttttagtctttgtttttcgattggcaacagctctatatagggccgcaaacatttgttcttcccttaatctaaaacctcttttttttttttaattgcagttttcctcctgattttgccattgtattgatttgctgcatattttttttgacttatgcaaaaacataggattttggtttttttgtgatgcaccataaacgttaaagtattgaatactaacagtgcttacaacaaaaagtagtagtcttgtttactgcattaaagtatcttgtgaaggaagggaactggatggatttgacttttatctagtgtgtctccaaacatctttctaaacaggtagtataactgcatagtttaacctcctgtccttatcgctctcaccccgcctccccgcccatgtctttgcttttgtgtatcagagtatctttctttcaggcattctagtttagtttctgttttcatcctttttggaagattctagtggcaaggaggaagggtgggaaatcctggcctacgtggagcagaccccagcgttcccaaactgggggccgggggagtcttgtttttgtgcatgtaaatcacacacgagctgggctcgttcttaggcgagcacagagcaaggatctgggacttgcggaagcatgggagtgtcgacacctccgccagccatctgcccaaggaaaagtaaagctggctgagatgccgccaccatcctgtggtcgaccagggtgacgtctccacaggtaccttgaggggcgcgggaccggggcagcggcctcacgcacgcgggaacaaaggcattgtctgacgcacctcactaagcactgtttctgaattactctcacttcctgaataaaggttatcaggtaattcatactttttatcaagctgttttatttgtgtgaatttgtgttttttctttaaagataaaaataaagcagaattaacagatttactcactaaataattctgaaaagatgctgggtgttggctgcttacagacaccaatccaacagtgtctagtccaatcacggggtttgaaggtttcccagggaattctctggcgggccagtgcttaggcttcagtgctttcactgcagtagcccaggttcagtgcctggtcggggaaccaggatcctgcaagctgttcattgtagccaaaaaaacaaggtttcctgcttccttacggtctgtcaaagagagaaacgggtagagaaaaagttgcaggtggaaagccttgctagggaagatcca

SEQ ID NO: 27392 - DNA, 1047 bp, Bovine  19866881087148
atgcagccccgcaggctaggccgcaaggaaatcccctgtgacctctctctccttcctccagctgcacggccgccactgccatgccggccaccaaccagggatggccggaggacttcggcttccggctggggggctcgggtccctgctttgtactggatgtggtggaagggagcagcgcacacgccgggggtctgcggcccggggaccagatcctggaggtggagggactggccgtggccggcctgagccgcgagcgcctagtgcgcctggcccggcgctgcccgcgcgtgccacccagcctgggcgtgctccccggccccatcggaggccccggcgcgggatccggctgcgagccgctgaccacagctttacgcatccagcgctcaagccgcggcctctatctgggccgcgagttgctacgcctggccggccgcaagcgcccagacgccgtgcaccgagagcgtaggcgcaaagcccaggagttcagccgcaaggtagggcgcgcagggcggggcagggccctaagggacaggcggtctggggtggggctctaggggcgctgttctgaggggctgggcactgtgggcccagagcgtcaggagccggacaggccctcctcaggccaggagtgggagtctggagctaaggaagcttctaacgaaagatttatcagaaatatagtgatgctcaagcttccagtcctgtccttaattttcgtaatttttgtttgcttgatttgtgggagttgcttttctttttctttttttaattgaggtaatacagatatacagtaaagcacattcattaagtgtacagtttaaggaactttacataggcatacacccttgtaaccaccagcctgatcaaaatgtagatgagtagaatacagacaataatattggtagaaagcagaacatagaatgattccttcaacccacaggttctctccatctcaatatgaagctccgagatttcaggtattagaagagagcaactcttaaggactctgggggcaagcggggcaggaagcgaatccctgcattttca

SEQ ID NO: 27393 - DNA, 1424 bp, Bovine  19866881100994
ttacctttgccgaacattttaaatgatgcaggactcacgagagaaaagcaaattaagaatacatcctataaaaataaaacacaaggagctgttggggagagtccacagcgaggaaagcgctttgtttctcagcgcagctgggggcggaccacgagcccagggcaacgcggcgcacggcggcctgctcccgacaccccccagcgcagccagccgcccagaccagacccagcgcgcaaagggcccgtcaggggagaaggggagtgggggagagaaatacggtcagctactcaggctccaggaggcctctgtcccccccttcccactcccaccggaattagcgtgacgctcagttcctgcacagggacaaggtcaagtgtcagggtcccacaccaatactattaaaacgttactacaaatggtccctttttcactaagctccctaccagaatgttaagtacattttcacaaggtcacagggttccagttaaactgcttcttacgaactgccatccaccctggcaccaaggccgggcgccccttgggcaggaggacagtctggggcggaggcggcatctcgctggcagtcagggctcctgaggccaagcatggcctctggagaacctgcagtgaatcgtggaagggcctaaacttggggacgatcctggtgctccaatgctcagcactccatactcccactgtggggggcgcgggtctgatccccggtcagggaacgaagaccccgcatgtcacgtggcatggctccccaaaaagtgaaatttaagtatctccctaaatgcctaagaatttctaggatgcccggtttatgaaacattgccctggaaaaccatgctacgtggtgaatggacacagtgcccgccaacacctgttcatccagttgatctctcgcacctgaaagggaaggaagagcacccacaagagctgctcgtcaacgacacgaaaggccagcgcatgcacgagtgtgtccgagagtccccgccacccgggctgatcacgacacccccaagcaggacggtaagctccccagcacgcagccgcgccccacaggccccgcaccggacaccaaagcgggaggaaggaaggagcgcccgcatgggtgagtcctgctcccgccaagcgctggggctgggtgagctgcagcgggggcctccgcgccccttccccggggggggccctgctcaacaccccacctggccctcaggaggggcaggaggcagttcccagactgctggactgcaaccagaaggcaggctgtcccgcaaaccccccaccttgagtagatcaaacaaagcactcaaggagtgtgaggctcaacaagaaatcctaggaaaactaagtgaaccgagagaagagataaagcttgaagtcgatcgaaagttttacatacggcaatcggcttctctttg

SEQ ID NO: 27394 - DNA, 668 bp, Bovine  19866881125533
ctcccgcattgcaggcaaattctttactgtctgagcaccaaggagtatgtgggataagccatataaggcatttacctcactacctaacacacagccagcacttaaatatcagctctcacaatcgctgaaattactttgctgtcattggaaacggtacaactgaacccctccgaactatgcatgaattgagagatcatctccaagccaaacacactggtttcagtacgtggactttgtaacatccattttgactgctcaaaggtcttttttggttcttcttacttcctggatctcagctgtgctccagggagacaggtgaggcctgaagactacagccaaagaggtggtgttattattctagaggcgaaaataggtagaaatcaatcaggtacatggaattctctgccacccgagtcatttaggactccatcttttactgtctctgcaaaaattaagttctttaattctccaaacgtttattacactgaggacatggcatcaaaaatatgtgtaaggaagactgtacttttaagaaatcatttaaaaattcgccattcttaagctcttagagctaacgaaacgcaaaaccgtgcaaggactagctgagaaagatgggtctcactgcctcccagcagcgtgtgcacgaaacgtgtactcgcgaggaggag

SEQ ID NO: 27395 - DNA, 1567 bp, Bovine  19866881178332
tcacctgttcagagggttccccaattctcctatgttcagtgctggaactcgcccgggagcatgacctggtgttgatgacacgcccgcctttgctctttgagcgccggctcccagcccttgacggcagtcccacgtgtgcttcatatctccctcttagccttgatccgctttctctgggcccttccccagccatctgacgggttctcagcagagctgccctctttcctaagtgatgtcttctcttgggggcctggcgtgttaaagcaaatacggaagaaaaatgagaacccggtttccgagcagtggtagatgagagtgaggcactgtgactgtcctgccggcggccttgaacatccgggagcttctccccttgtcgtctcccagctgttccttaattctctgtccctttaatttcagacgacctgagaaccctgtgctccaggctgcctcataataagtaagtgccctccccagacttgcggctgggctggcataggggtggaggcggggtggggggtgtgcagggcagggcggaccccttgtcctggctgccttgggtagagctggtctgcagggtctagggcttctgtgtgtaagggaccccccaggacctgccgatcagtgggggagggggtggatgtgatagcgtaacgcacaggagaggaagccccagcagagcggccatcgggagggtgagaaaagcggccgtcttgctgggtgtcagtgaagaagctggagtgagctggagtgtcctttgatgttgttgttatttagtcgctcagtcgtgtctgactctctgcgaccccatggactgtagcccgccaggctcctctgtccatcgaactctccaggcaagaacactggagtgggcagccatttcctcctccaggggatcttcccggcccagggctggaacctgcatctcctgctagtgtcctgcctcgcaggcagatgctttaccgtttgagccaccacggaagcccctgagtgtccttcatcgctgacgaagtcagtgtgggtgtgtgttgtggtgctcttgtgtcaccattggtgacattatggtggcacagcccttaggggggcaggacagggacatgccctgggccacagcgtgtgggttaggccagcgccctgacattgggtgccacagaccaggttccgagtgcggttctacctgtggtttgtagtgacgctgggccgccttgtcacctcagtttccccctccgctgatttatgtgcctccagggtcatagtcaggtttaaacgaggtggcatttgcagagttccttgtccacggtgcccggcagtctccccctcagtggtcgtggttcttgtcctaatttgggggaaagccgtggtaaaagtggcgaggagcaggaaccgtgtggtcgcacagctgctggtaagaattccagccttgccacttcctatctgtatgacctcaggcatgttctcgctccctccgttttctctgtaaaatcaagaaaaccatggcacctgcctcgagccccccctgcctcccgtgccctgctcccgatcatgggatttttgtgacgattaattgagt

SEQ ID NO: 27396 - DNA, 607 bp, Bovine  19866881194014
gtccccttcttctcctgccttcatgtttcccgcatcagggtcttttccatgagtcagctctccgcataaggtggccaaagtattggcgttccagcttcaacatcagtccctccaatgaacacccaggactgatctcctttaggatggactggttggatctccttgcagtcaagagtcttctccaacaccacagttgaaaagcatcaattctttggcgctcagctttctttatagtccaactctcacatctgtatatgaccactggaaaaaccatagccttgactagacggataatgtctctgctttttaatatgctgtctaggttggtcataattttcactttgctttaggaaatgtctaataaaaggactgaaatgacatgcagtgaggctgtaaagtccattttctttcttagggatgaatttaacattaaagttcttcaggcttttgtggaactccacgagtttgctgatctcaacctcgtacaagccttaaggtgagcattcatcccctgcgtgtgaagggaggctggttgggcgagtggctgggcggtgaccctgtgggtaactccagataccagagagagaaacggggtgggggggcgggg

SEQ ID NO: 27397 - DNA, 1439 bp, Bovine  19866881277565
caccagcagtatttaagcatcccattggatcctcaaccttgtaagcattttttttttaatttatctgttctgaagagtatatagccatatcacattgtggttttaattcgtgtctccttcctggttcatgtagcactgtgttcatgccttggatcagccatacagagctcctctggtgcaaagttcatgttcgtgtaaaaatatccccttattccatttctgcatgggcttccctggtggttcagcattaaagaatccgcctggccatgcaggagacagttcagtgcctaggttgggaagatcccctggaggagggcatggcaacccactctagtattcttgcctggagaatcccatggacagaagagctatgggattcagtccatggggttgcaaaagagtcggacacaacttagtgactaagcaacaataattccatttctgcacagcctccgatgcccttctctgttcgcatctacttaggtcacttaataaagaggccttcggcagagatggagaagcctgagccagaaaagaaggatgatcctgccccgttaaggactcgtggagaagagaaaagagtagtgaccatttccaggctgagagaaaccttttcccttcgtcactcgactgagaacaagtccccggggtccgaaggccactgatccgaggcggggtttctccgaagcagaaaagcagtgcccagtttcctagagctttggggccccccctgctcccagaagcacatttctgaacctggggaggaagggaggacttctgctcaggggccccacgacttgatgagcagagtggagatggaggaggactcggggcacggcagcgcatctgccggctccgaggaggcatccagcacccccgagacaagcagtcaccccagcactgaccgggtggcaagctcccccgaagacaaattttcccaagaaaatatggagtctcgggaaaagttacctgaaactgaccatcgtctctcaggcacaaagtgccatttaaaccaagaagaaagcagctccacatctggagtcttgccgcagcccacaaagctctcatccccaaatgcaaagcgttttacaaaagaagggattcctttaaatcccagtgtccttgcagagtcggtgaaagcccagagtgcgtcagctacagtggacgtagctgtgaaaattaacaagaaaatagtgccccttgatttttccatgagttctttagccaaacgaataaagcagttgtgtcagcaagaacagcaacaagaaagtcaacagaattataggaagtttcgggcaaagatttgccctggagaaaatcaagcagcagaagacgaactaagaaaagagatcaggtaacaattttctttaaagaactcttaccatgcagctctgcaacctgaaaccttgcaagaatttttttccttatatttcatacag

SEQ ID NO: 27398 - DNA, 1708 bp, Bovine  19866881421466
ccgccctcccggctccgaggacatccttctcgaagtcccggcctgcagctgtgcctggtggtccagccttgaatatccgcgggcagacaaggggccccacgtgctccttggtggcagtggcggtgttggccgttctggaagccgctgttttgtgtcataacaggaaaggaaaagctaccacttttttattgagtttttttctcagatatataggattatagcttttatatgcctttttatattctgaaattataatgaaagatactttctaacagtagtatttttagaatggcagctataaatttaacttctggacacacgtatatactgtgcactgagaacaagttacatatacacacatatgcagcaactggggagttgggtgcggtgctcaaggggaacccgagggtgcccccttgtggagggagatgcccgtgtccttgaggacacgcactgggcagggtagggctccaggggtccagtcttgtgagtcatccagctcagtcttcgtggccccacagataacttttctaaagacacaaatcataaactttggtttggggtgtttatcctgtaactgctgaatcccaggacggacagtgtatgtattgaaccacatgaaactgctcacatttgacccgtttctgatacccacaaacagcagtgtcacgtggtccaaccagacacatggttcaggccagctgtgacccctgtcttcactacttaaggcccgttggccaaacgaatacttacaatgatcagatatgttaatgtaatgtgtagacatataaggaactagagataatcttccgccgtgttttgagagatttgatctattacaggaaggggaagagcaggctgggggatgaaggtgtatagcacttaggcttttctgtaaatagtttaaaaccccaaatatgcactggtggtcagactggagaagatccctaaccaggaggttgtcagatgctgctggctgaaggagagatgctcaagcatgcggtgaggagctgggcccatcatgccgcatagatggcccaagggtgcacaggtggggcattcagggccaggccagtgacatgccttttaagtttcatttccaccacaaggacccctgcacattatatgtaggaccccctcgcccacatgggctgtttcggtggagggtcccttccctgggggacctctttccctgccccactgcgaagacacccaccttgttcagtctgtacacctgagaggtcatcacctctcctgtgcaaaagccaagttcaagaaagaccacctcagcctatgcatggagaggtgaaatagagaaaacgtttcctgggagttgccttgatgctgagactgaatggctgttggctcccagcctcgtgcagcttaaagtcacactagactgcaaagggggccacgcccaggaccctccaccagacatcaaactgactgttttggttcattcccaagcatttaggctttgctactgtaccgatacctcagattcaaacctctagttctgagaaaggcaagtcagcattcctgaaaactcctgactggcatatatgcaactctggctccagtcttccatgaaaagatgctgctgccgaccaaacactgctgacgacaaccggcagcgccctcccctcgggccagccacgctcctgggctgcctggggcaccggctccatcagtatttcgcgtgggacaa

SEQ ID NO: 27399 - DNA, 1009 bp, Bovine  19866881435844
attttcctaaggggatgccaggccgcgcgctgacgccaggccgcgcgcaacccccgccaggttgccccggggcggggtttcccggcggcatggattaatgctggccgtgcctttctgatagatgctgtcggttcccgaatataagacccgcctgcgcagcctccacttccaggccaccctccaggagaagacagaggagatccggggcagcctggagtgcttgcgccaggcctccctcgagctcaagaacagccggaagcttgctaagatcctggaggtcagggccaccccctctcagatcagtctgcctgcccctctggcccctggggcttccagcttggaggcccatccccagaggggccagggagtgggggaggacctgctctcttgttctctccccagtttgtgttggccatgggcaactatctcaacgatggacagcctcaaaccaacaagaccacgggcttcaagatcaacttcctgacggaggtgagggggccggtcaggcagtcatccatctgtttgctctagcactgaggctcccaggcaggaagagctggctacctgaagccagaatgtaacagaagctaaggttggggcttgaaagggtggggaggcaaggtggcttctccaggccttggagagacagagtggtgggagaggaagggacaggggagaaggctccaggaggaaagggagagtctcacctggtggaatctgtgccctcaacaccagaaccactgtcaggccagtcctaccccagaaagatctagaaccagaaaaaggacaactcaaatatccagccttctccctgtgtgtctgggactttccaccacaacacctttggttgcttttttaagagaggaaggacaagtgcgtatagatatgaacggtttagggtgtctgaggctcagctgggccacagatggttccagaaaagcacaaagcggaaaaaccatgaatgatgctcccattttcgctggggttagaaaatcttgggctccatctg

SEQ ID NO: 27400 - DNA, 2639 bp, Bovine  19866880557324
agactggtaggctgcagtccatggggtcacgaagagtaggacacaactgagcaacttcagtttcacttttcactttcatgcattggagaaggaaatggcaacccactccagcattcttgcctggagaatcccagggattctggagcctggtgggctgccgtctatggggtcgcatagagtcggacacaactgaagtgacttagcagcagcagcatgaggttaaagtatgtcttttaattagaaaccttggagtcatctttgagtctgtttttgtctctcatctactcactcaccttggtcaggtccttatgcctgaaccccaatctctgcttcccagttgttatacatatgcattgttacatatgagtaagtaaacataaatatacatatataactggagaaagaaatggcaacccactccagtattcttgtctggagaatcccatggagagaggagcctactgggctacagtccatggggtcacaaagagtcagacaccactgatcgactaagcacacacatatacacacacacacacacatacatatataacatctatatctacatttgtgtatgtaaacatacaaaattttatatgtgaatacaatatatattcatttatctctctgcctttgtttgttgctatgagacagtcatgtttccaaaatgaattattggtttgatctaaatgatgttcttactaatcacttctacagtggcataaagttagccaagatagagaatttagagcatagagagagagaaagagaatttgctgatggggaggtggggagaaatgggcacaaataggcaatgaatcagctttcattgaggaagtttcttctcactcaatagaacaaagattttgaaacagatattaggaagatgtgatgcagaagtatagcatcctgttggcttacgggtcttcacagactctggtaggagctgactcatcttaaccttccttcccctggaaccctaggaaacgccaggatccccagttgacaggcccatttctgaaagactgtacaactttcaagagtaaaatatgagtgattaaaaaacataaaggtactagatattaatcaatgtcatactggtgttctggattatcatatttctgaaaataattagatttataaatatcacatgctccttgattaatagtctaagtatcaacaacataccatcacatgaaagtgacgagtcatggcattagggaagcgatggaatctgtgatccacgtgtggatttggtgagcattctggctcatgggtggtgccagtcacacaagcctcacatgtgtgcccgccactgcaggattctgccttttataaactctgcccacattctgcctgggcagtacagcactgactaaaacactgaaaatacccctccctgccaagaagccagcagtcacttctatattctgtcttcctccctacaataaactcttcataaaaaatgtccaagcttgttctctctccaaacttcacaatgtgatttaaaacataaaataatctcaaacacataatatcttaaagaggaaaaacacacatttgttgggaaataggttacaaaaattctcttctgcacaagcctagtatatcattttttagtacagacctttacaccaaatttgcttggaactactagatgtgactacaacttccttatgcactattgtgtgacaatcactatgaaaactaccactttacaattcagttagttttaaaactcactgtcataagcaagaagaattctagagttgaaggaaaaacacaaaggaagtaatccaatagcattagatggcctcaaagggaaagaaaaaaaccacccaggaaaatacagaattcccatgtattgctatcttctctttttgcataacaaatcaccccacaacttatcaacttgaaacagaagcaaatatttaccatctcacagtttctgtgggacaagaattatctgggagcatcttaagacataacgtacatgacagaattggtaacagttttagagatttatcagtcctgacaagaatgcaatgactgcatttcagagttactctacagaagtcactatttcctcacacgtaaagaaaatacagttcacctgctcgttaatgttgatattaaaggcccacagatgccatctttcagggcctttgtcccaacgagaactatgtaagaagtaactagacctgcctcaccccttgactcagtaacataaaaagctaaggtataactggatcctctggacctaaatgaataggcatgtgtgcatgacaagtcgcttcagtcatgtcgcactctttgtgaacccataaactgtagcccaccaggctcctgtgtccatgggattctccaggcaacaatactggagtgggttgccatgcccctcctccaggggatcttcccacccagggtttgaacctgcatctcctgcaactcctgtgtcgcaggcgtattcttcaccactgaggcaccgaggaagacccctaaatggatagcaggaagagtcaattaggagaagacttttctttaagagaatccagccatcaccacagacatcacgccggttcagaggatttgtccccgagagagtttatcaggatgtaccgtagctcccagtcaacaga

SEQ ID NO: 27401 - DNA, 3496 bp, Bovine  19866880568008
catttacacttcccctgacatcaatgcctacgctagagcaggaagacatgataaaatcatccgtagaatcagaactagaggcgacggcagaaactgcatctgatcacttttaggcatctcagagatgactgggggagacgaacaaacaaaaataagagcacacacgtcaaatcaatgaaactgacttcatttgagatgaggcatctctaggaaatgatctttatctgagtagagcttttctaaaggggagatagggaattccagcttcctctggctcccaatatgttgaatattcatcttgggcaaccgaatgcaatttgcataatacggggcccaggtctgcagcaagaatggccttcagggaatgagaaagaagtttgcagaaagactagagcatgtctcagctcaacaggaagggaatccacggctcacattttattttccttgacaggattttcccagattttgctgaagaaaatgtatcatatttcatgggagtccccagagaacccttctgctctgcttaagttttagtggtgtgtgtgtgtgtgtgtgtgtgtgtaaaatgtacgtatgtatacattttttctgacaatatttaacaacagagttttaaagaattcataggaagatgacaggaaaacccaaataagagaatctcctctgaggctccatgactttaatctgtcagtttttgctcaagggataatggaaagaagtatttccatcttaagtctctattgcttggacctctggcagatgcgaattctaactgcattataatatatatacacagcacatctgaatgcaaatcacttgtaaacagtaaatattgcagaagagaatggaaaggtgctcagatggtaatacacattaatacaaaaccaagatttgtttacatttaaatgcgatatacattttgatattagaaatattttcccagtaaaaacacttaactcaatctcaattcttgttttttaaaagaactactctctcctaaattttctcttctagaattacatttactctgtttctttttgcaaaataatcttttataagaaactccctaagaaaagtacatttctaaataataatagaaaaggattacattaatatcaatcctttctaatagcaattaggtaataaaatttcatttgggtttgaaagtggacagatattactgcatttttcttagcctataaagtatcagcctattgtgttctttgccttacatttaaaaagaaggaaagaaaacaatctgcttatataacatcaaccacttaacagaaaacttaaaatttggaatatttgaataaagtggataagatctcttaaaaaaaagtcaatcccttcaaaatttctcaattttcgatgaactgggacatataaaaatatgcaaacacacaactttaagaggtaatgctcctcttctgcttgatacactgatacattaccaaacattgctgaatcatgaattaacagctcctaggcattgtcataaaggtcagacactaaagccaaactgaaagcattctcctttttgtggtggctgcatcgctgtgttggtggccaagaccttggatgtgttacttactgatgggtagaggtaaccttctccattcatggctacgtacaaccccgtcttcactccctggattgcaacgacgcgcagtcccactggtatgaggttgaacagtgctgcgaagagaaagacggtctgtcaccaacgggcaggggaagcagagcacctccccccatcacttttctgtttcatttattctatttgagagatattatgtccgttataaccttctgagaggctcccaattcattaccttctatctctctatttaagaagtttctgttatgagtaaagatagcacttgagctctgatttgtagatcttagcaggctccctatagcattctgaagaatggtgggataataaacagaatcaggcctgtaatcacgactccagcatcacagtctccgacaccatttgataccagaaaaaatcagctaggaagactctcaaagagcagagttttattttaaagatttttgttttttttttagtgtggaccgtttttatagtctttattgaatttgttacaatatggtttctgttttatgttttggttttttgctcacaaggcgtgtgcgatcttagcttcctgaccaaccagcaatcacatccgtactccctgaattggaaagtcttaaccactggaccaccagggagtcaccctaaaagaggagaattttaaaagcccaaattgagtgtttatctggtcttttaggtggaaggtttgcttcattactgcaatgttgtacaggcaagaagttaaaaaggtaattccaaagctaaattactcttgcagaaccaacacgacatgccagcagagcccagaaaagatgttcacctgcccaagtgctaaatttagaaagaactaatcacaccgaacggcgtaagaatttcagagagggaatcttcttcattaatatttcataaaattatgagtgaacacgaaaacaaagagggaagagtgttcaattttaccccctgaagagataagaatgtttccatgttctatttcttcctttattgaccaaaaatgtattcgtatgtaagtttcacattgcagatagcaatgttatcatgattttttttaaagtcctaattaacatccttaataatgcatttccttgccagggttatatatgactgtgtagtgagcattttagcatcattcctatttttccctttggccacatggcatgtaggatctcagttcccagatcagggattgaaccctcaccccttgcaattaagtgcaagagtcttaaccactgaatctcctaggaactgtctaatatcattcttggtgaagactgcttgaagattttattatagacacatttataagattatcattaattatgagaggttatctgctcctatttgcattcttaattcaagtctagaattaagagaaccatcccagaagaggcaatgaaagcactaaaatgttgaagtaaatgtacaaggaaaatatcttaggtttaggctcttgcttgtattccacgaagaataaataatttgaaagatgtgggcaattttgacttaaatctgtgggtctactcagtacataattttaaatggactttctacattgtgttctatttaattccgaggcacatggtttctctgatcgagttgggggagattacaccttctcttccggttactatatgttactgatcttgggatctcaagatgtctgtgctactcagatgatgaaatgagaatggctggccatgacccttgagaattatccctacaagaacattcaggggcatcaggttttgtgggtattcactttcaggatgcaaactagcattgaactgtcttctgtaggattctaggggcttataatacccttatggaggaatgaggcttctgttgcttatttctattatattatttaatgttaaa

SEQ ID NO: 27402 - DNA, 1262 bp, Bovine  19866880569448
tccataggtttgcaaagagttggacacaactgaagccacttagcacacacatgtttttatcgctaattcatttacgactaaagaaagcagcatacaggtaaatttgagactttccttctgataatactttccatgatcgtatgaatgggagaaattcaagctcaaagtctggtcggagcagaggacagcatggtttccattcagcctggataagccggctgtacggaccatgctgctgtacaatacaaaccacacggaagaacagggaacccgtccaagctccagcagatactcaccctttcccgagcacaatatgccatctgccgattcacacagactattgctctgttcctctgtcaggttacacttcctcggatgctggcagagcgtcccgaaccatcctttctcacaaacacagcgaccgcaggaacacgtcccatggcctgcgaggcagtcacggggtggggcgagaggaggagacgggtacacaggccgtgagtcacactctttaaaggagacatatgtcaaccagggaaatctcgtttcctatcgaacaaacacactctccttaaccacagtcgatctggcatgtgagcctttaaaagaacttcacacccaagttctagctgaacacagtcctcttgaatgtcgcatcagagatggactccggagagaaagaaagcttggaacaaattaaaatgcaaggtgatcatcctttctggatacacagtagggcccgtttgcttcgtcaccaggatgggtccccctgcttgtcctcactgtgcacaccctgatacccagaccggtccactgcctgccacatttcttgatccctctcttatttccaaataaaaactgaaggttaacttccatacgaatggcatccaggattgtacacctctctccctgtgcccctctgtttgctaataacaacagatataagtgtaagtaatggtgtcttccgattgttgaacagaacttaaaaacagcaccaggcttagactcatattttttttccccttttgtttgtgtcactggttcctggtttggggatgtttatctttggtgtagatgcaacatgatatctgtgaccattaatccctggcatatacatcgggccaatcgctggccaccaacaccccacgtgattgcaccatcttccacgttcgtttctcttttttccaatcaatgctctgttctttttacctcgatgtgcatatcggaggccagatctctccaaagaaacaaacaaaacagctatt

SEQ ID NO: 27403 - DNA, 2750 bp, Bovine  19866880631124
aaaaaggaaatacgtgctcttctgctagcggcccaaacctgaagcagtgaggcttgtcttgctgccttgcttccttggcccccagtccacatccactgaagtcaccggtcacttggattctgatttatcaataccctctcagtccttctgctagtccctattccaattgctgtcagctcatctctggctgctcttctaacttgcattcctgcaggcagcccctctctgaccctctgacccaatttccctgtgcagcgaagagtgacattgaaagtcatatcgccttcagataaggggcaggcctgtcacgtgactggcagttttgtggtccgattcctctcgctgtccctggcagctccaaggtcctagccacagtgaattacctgcacctcctcacaccacctgtctgttaagtggactctgcctgtgtttctcttccgtgcatgtgtgctaagtcgcttcagtcatgttcaactctttgagaccccatggactgtagcccaccaggctcctctgtccatgggattctctaggcaagaatactggagtgggttgccatgccctcctccaggggatcttcctgacccaggaattgaacctgtgtctcttacaatttctgcagtggcaagcaggttctttactactaatactacctggaaaaccccatgtttctctccctgttgggatcaatcttctctctacacctaattctaactcagcctgcagttcttggcctagatactactcctttccagaaactctttctaggaattccctggcggtccagtggttaagacttcccttccgatgcaggctgtgggttcgatcactggctggggagctaaacaccaaaacacaaaacaccaaaacacaaaatagaagcaaacttgcagcaagttcaataaatactttaaaaatggtacacataaaaaaaaaatcttttaaaaaagaagaagctctttctgctcaaatgccctcaactgggcacaatacccttctgatagacccctggcaaggctccctcagcactcccgacccagacagagatcagtaggaaggggtatggtggaaagagggacctcctacaggtgagaactttttctaaaccctcccccaacccactatacctgcctcccatccttaaaagacctcacacatcttggcttacaagccagcgcctcagactttcctccacacactgtgctctcctgtaatggcctgtttacctctgagtcctccatacaaggcagtgagctcactgaaggaaagtaactctgtattttgttcatttttgtaattcccagcatagagtgcatttcaagcatctagtcagcacatacatattgatatttgttcttttaaaaacatccatgagtctttttatacccagttcaatgatttttaactctttatggtttcctttcctctgtgtttcttagtttattttaaactctgtgttatgatgttgaactcagtacatctgcatgtggtgtgtgtgtgtgtgtgtgtgcacgtgcgcacatgctcagttgtgtctgactgtttgtgaccccatggactgcagcccaccaggctcctctatccatgggattctccagcaaagaatactggagtgggttgccatgccctcctccaggggaatctttccaacccagggatcgaacctgtttctcctgcatttcctgcattggcaggcagattctttatcattagtgccacctgggaaaccatatctgactgaacccacagtttgataccccatgcaaaattgtggttcatattaccccactagactcactttcctgtacacttgaaacctacaaaacactataaaccaactatactccaataaaaattaaaaaaaaaaaaaaaaaacgacctggaaggaattttattgtttcttaatattttgattcagtaaagaaaaagtggaaacttaaacaaaggttgccaatgcagctggagctgtagcagccacaacgacagtggtgaacaacacttagtaagcacttgctgtttgcaaggcactgtcctaggcttacatttgttattcacttaattggcaccaggaccctatggaggaggaacacttaatgtgctcattccaaagataagataaccaaggtatagagaagcgaagtctactccataattaggaagtggtgcaaacctgagcagaccgacttctttaactaattaattaattacttttattgggaatgtgattgctttacaatgttctcttaatttctgctgtacaatgaatattactcagcataaaaaagaacgaaattggtcttttgcagagatgtggatggacccacgtctgtgatacagaatgaactaagtcaaactgactttcaaatccaggctttgaatcaatactaggttttgtagggttgaaagtgagctaaaacatggtattgtgaatgttttctcctggaatttttcccagtgggaatcacatagtcctgctggacttgtgttattaacaatgcataagttaattggctataccccaacacaaaataaaaagttgaaaaaaatgcataggtgtgagtgaatttcagggatttttccattcagggaaattttcacttttctctgaggatctggacccaaacagtcaattgcgtcttgtaaacaaagacatctagggtcctttcaagatgggagtcagccgtaggggcaagggttcaaggaaaagcccttcgttgtaggatgtccctctcttttgcagccaaaccctt

SEQ ID NO: 27404 - DNA, 1535 bp, Bovine  19866880747357
agcaattcataacaattgttttagtttatccctaaggttaataactttcattttcattcaggtcataaattttaaaattgaagaaatggcgtataatttgttttcaaagcagtgagtgtgtgtgcacgctcagtcatgtctaactctttgtaacttcataaactgtagcccaccaggctcctctgtccatagagtttcccaggcaagaatactacagtgagttgccatttccttctccaggggatcttcacgacccagggatctaattctgggcctcctgcattgcaggcagtttctttaccatctgaacctctagggaagccccttttcaagagaagactagaaatctcaattttatttaagtcctcctgatttttaaatgtgggttcaattggttcagattagatcagatcagttgctcagtcgtgtccaactccttgcgaccccatgaatcgcagcacgccaggcctccctgtccatcatcaactcccggagttcactgagactcacgtctatcgagtgagtgatgccatccagccatctcatcctctgtcatccccttctcctcctgcctccaatccctcccagcatcagagtcttttgaatatgctatctagacaaaaatgaagggggaaaaaagaaaatatgtgtgcacagactttgtttcatgatgttagaattatgactaacagcaagcctgatttttgatagccctcttgcagtggcagtctggggcagaaagcaatattttctttaatttttttttccttcacaaaaatgaccttgatcttagttctcctcatgaaataagacttcactgtgctgttcagagtttttactttttgccggaaacttccaaggtgcctatctgtacgataggcagcgatgagttgtgacgtgtgtcctgtatatcaattgtcaacccaagtgacactaaaatgaaaagctgtcatttggtaccagaaaccgctttgctttatttcctattatttcagcgatccaaagggtgtgtaggtttgaatcggggctctttacctctgatataagggtttcaccagacgtaagaaaatagcttatagttcattgtaaatggtcatctttttattacctcccctaattctgtgtttcttttcttttgacctattctgcctgaattcttcttagagtctgtgttgttagtaagatgacttctggcttaatattccctgtgagaattacagatctttttactgtacccattttgatttacaatttgctttctcatttgtcacaaataaaggctaaatgaggcttcaataatatcttctatttagccttatcaggtgccatcattcattatactcattctctaggaaaaggtaatgctgtgttcattttgactttaaacgccaatatataacatatctagcttctcatttgaaatccagagaactttactttccaaatggatgaactggactcagtggcttcatgcccttaatgttcataaatcctaaatctgtaggacctttttatactgtaggtttcaggaacat

SEQ ID NO: 27405 - DNA, 683 bp, Bovine  19866880752778
aaaaaaaaaaaaaaaaaagcatagcaattctcagacgttgcagacatagagccattttgttcccctgtgggttgtgaggatgcattttccaagtcccatataaatccatgaagaattaaatttcttgagtttacaacatgcctttcattgagatttaggaccatagaaaggagctgaataaaactaaagctagacgtgtgatgcagtgcaagatgagatttagggcctgaggctatcatcaaatgaaggaaatagattcagaaaatctttttttttttttccttttctccattccattttcatttttatttagctgtaggggtagtagataattgctatttccttttagaaatgtagactagctccttaggtaagaatttgtgttccctggggatttgacactgaccgcaaatgaagggtatcattcaagtcaaagatttttaaaggaactcggaaatttttcagtgagtttgatgtgcacaaaggaaggaatttcagagaaaaagagtaacttcaggcagaacatcatggagagttttaaattgacaaattctgttctcctattctctaaatgcctcttagctcaatcttgtgccctttccctccttttcatgttgtcactcactttattttcctctgagtccctacagagacgtgaagctagtttccagagatgagagtac

SEQ ID NO: 27406 - DNA, 834 bp, Bovine  19866880779755
ttacttaggttagttttacacaaaaatatgactatactgtacctgtcaagtgtcacctttttaaaaaatgttttctaaattgcatcaaccaactggtaaaacaaaatctaaaaatatgtaaagaactactaaaacacactcttagggtcaatactttataataaaattttctttattatatttcttcataaacctcgagtttgttttatggcttctaggtttttccagtgattttgatgacctgtcttatttttttgtttgtatatcttccttagatgagaacaaatcagatttagcatattactcaagcgcattaaatttcacaagagaaatgtgtggttatagctgtaaggcagatgttatgatcctgtcaaattgctcgtgctaatttcgagccatgtcagggaggttgctgggagacgtaagaggagcacaggaaattacagggagcctgttgataacaacatgtccttgtaccgtcacctaagataatccctaacctgtcacattaccaatgctctggttaaaacagaaggcctctattgcaggtttgaaacttcccaggtggcgctggtggtaaagaacccacccgccaatgcaggagacacaagggacatgggttcgatccctgggtagggaagatcccctgaaagaggaaatggcaacccactccagtatttttgcctagagaatcccatggacagaggacgccacgtgatctatggtcagacacaactgaagtgacttagcatgcaggcacattatgttattaaatttagttctattgcacagttaataaactacagtatagtgtcagcataacttctatatgca

SEQ ID NO: 27407 - DNA, 1248 bp, Bovine  19866880786127
tctgacaatctgtttgttacttctggcagaaggttctcaaaattaccttattttcctaaatatcctgcaacatattttaccattttattgaaagtcttggtcttctgttcctatttttattttctaaacagattcactcagagctggtaaccatgtgactggactcagaactgagtttcacagattgctacagaactagtgacttaattgccagtactcttgcttggaaaatcccatggatggaggagcctggtaggctgcagtccatggggttgttaagaatcggacatgactgagtgacttcactttcacttttcactttcatgtattggagaagaaaatggcaacccactccagtgttcttgcctggagaatcccagggatgggggagcctggtgggctgccgtctatggggttgcacagagtcggacacaactgaagtgatttagcagcagcagcagcagcagtagcagtgacttaattgtgcagtcctgagcgagctattgaagtctttctttctagttaaagatttccaatttcaacctcataaggtgtactgttttgttatgtgaaaggaaagttttttcctaaaagtcccattttataaaaataatgcattccagtgtcagaactgttaaaaaaggaaagtagcatgccttctttatctttcttttatatttataatcccagttaaagtcaatagatgtatatttcaaaaatgaaggcacatttcttcatcttcacctctaattcagttcaaggtgaattatgggttaattctctgctgatgatggttgttcccagagattcaaagtccttcactgaccactgtatccttttggttcttataggaagagttggtttaaggaccagagctgcttattaagtaggatgacctctggcttcttatgtggtagaatctatgtggctaatctatgtgtaaaaatcgtgatgttttctctttgcatgaatttaaaatttgacatgcacagttttgcagttacttgtgttttagaaattattttcctcatatataatgtcattgaaaatgctggaagactttccttttgaaagtctgttcagttatgatacaacaattgtagatagcttatatcaaattagcacttgattattccctccacagatttttttggaaattattcattttgtcttataatgccatgtgaaatttatttttagggggatagttcctacgtgaaagatcgctggtgtgtttttgatggattt

SEQ ID NO: 27408 - DNA, 780 bp, Bovine  19866880813686
atgttagagatcatatgactttggtgttcatctcataaaatgccttaggaaccacaaaaatcaacactcactttccttagtcagttaattctttagggccctacccacagctactagaatgagtctaaacctccacgcttttcatgcatgtatattgtgcattacactgtaaatggtgagaacacaaacagggcaagactcttttccccactggcattgatagtcagtatgaagtgactttggacaagcaaccaggaagagttttatgactcacaggaacaagactagcaggataaaaaaaattcttgagtcattgaattcaataatgtgctttgcttatcagagtgctggattagacttgctgttttatgccatactcaccattttttcctttggtgtctaagtagaacattattgaaaaataaataggagttattttgtgtgggtgttttctagtttgtttcttttactataaatgaatttcatttctcttgtactcaaataaaataatgttaatatacttctctaaacactctccattttggcaggatttcctgttccaaaaatgcattagggcaaccaagaattttattaatgcaccaataattcctggggtggtttgggggctctatgtagctctatggagaagggctattacttcaactgttcaacactcagaggctttggagcataaagacatttatagctataactgatccactgaaggaaatttcatatgtagaaatttgggtcataggatttaacatactttcagaagga

SEQ ID NO: 27409 - DNA, 2138 bp, Bovine  19866880814975
tcattacacacacacacacagctaacttgctaacatgtgctacagcaaagcttacaattttgtacatggaaatttagaaacacagttcagttcagttgctcagtcgtgtccgactcttttcaacccccatggactgcagcacgccaggctttcctgtccatcaccaactcctggagctttctcaaattcatgtccatcgagttggtgatgccatccaaccatctcatcctctgttgtccccttctcctcccaccttcaatccctttcccagcatcagggtcttttccaaggagtcagttcttcggatcaggtggccaaagtataggagtttcagcttcagtatcagtccttctagtgaatatacaggactgatttcctttaggatctagaaacacagccaaattaatttatcagattaaatttttaaaaattcatttccccaagctttgattgtgcatagagtaaaagtctgcagttgatagcattctctaaaatcagatcacttttcaactaagaaaaacaaaataacaaaaataaaacccagagcatgctgactctctccactgatgaatgtgcctgcttctcaccttgagttttctggatgcccaaagctgcctgcagactgcaagcagccttacctgccaccagtcctacatcccccaaacccagcctgtcagtcaaaaggtcttcacaaacttgtaccatcatgaccttctcctgacttgagaagtccatgtctctttccatccccacatccctgtccatctctgattagcccacacctcactttctctctgaagtcttccactaaccacgttggtttagaaggacagctcttagtaggtagtatgtgtgtctctagcccacattcttcagctagtcaatcaagaatggccatcttctttgtccagtggctttcataaatgactattaagtcttttattattgttgagctgtttgctgtctaatctctggagaaggaaaagccaaccactccagtgttctggcctggagaattccatggactgtgtagtccctggggttgccgagagtcagactcgactgagcaactttcacttcagttttgctgtctaatctaccttgaaatccacataacactgtaaattctatcaggaaggaagtgccttaaactccctagtaaatttgggttctcacattgtctttcacacagaattggaatggaatgaagagttttccatttgtttccgtatcggtgggctgaaggactgaagccggtttttaaaactggtaaaaatgttggaatttctaggctgtgtgaaatgatcttagaaaaaaaaaaaaaaaaaagcacatgcttaagcggtgtttctgagtgtagtgatttcaagctcagctcttggtcttggttgtgctgctctttgtcacctgcgaccaggatcgctaagcagtgactgcagactgtggatcgtgttctcctctgtggcttcaggctcctcgacttgtctggttcttctccaggacactacgttttgttttgttttgtttttcccagggggcagagcaaatcagttataggtcagaaacgctttggggtgaagaagaactttgtgtcttgaagaaagcaaaagagtggatgtgagtgcacagaaccagtggggacgggcgagaagtagttctctgtcccatctctaaaggacttgtgccaaaatgcgctctctgagtaatgcctttcccagtggggttttttttccctcttctttttatagaaattaaaagtatgaatgtgatgccaaagccacaaaccacaaatccaatttaagcagaggaaatcaggacttaagactcaagcgtgcatttggaagggtgggggagggcggaaggaggctgactctcaaccaacttctcacagacttctcttcctcctgcccactcggcaccctgaaaacatgtccaaactgcaacattgcttattaaattagcatactatgactctataactctgtgaagttgaagtagaaccaaaagaaaatggaaatacaaaaaaaaagaataaaaagtgtaaagtccgtgcaaacttgctctcagacttgagtggatgaaactccctttaaaatgtgcctggcttataaacaacagggacctacggtaggacttcc

SEQ ID NO: 27410 - DNA, 1419 bp, Bovine  19866880856819
accttctggtgctgcctttaaaatgaccggagtctcagaagggacttacccctgagctgaagcccagaggcttttgtttcttctgctagtcggctgggcatccagttgctaggggaggttgtttggcgagcatgtgggatgtttccgtgggagaaatggagatggcttgcttttcatcactaagtgggctcggcaggaaacactgaagaatatatttacgttaataggagtatatgtttgtccagcacattatattcccggtgcccagctgtatttattttaagttccctgttgttccaaagacgggtaagagaagcatgtgttttaggtgtgtatctatgtgagggtgtgtgtatcccacacatttgcagatttatgaccaaaagtttcaatgcttctttaaacaaaagctagaactgtattttttttaagccactccttgtcacagatagaaattgaagttaccggctcttagaatcaagaaggcaaatttctgagcaggatcagagaggaagttctaaggtagataaattatagagctataagagaagagacttcctgatgaggagtttggggacaatgatgttttcagaccagtgttgaagctgtttaagaaaatggactttaatttttcactttagcctagagccctgtccagccagacacgactgaagtgacttagcaacaactgcccagcaaacctgggtattataagaccaactggattgttttgaaccttgttgttccatggaaggtcacgttatcatgatttaacctgtttgcttctcccctaatttcatctgaatatcttttagaacccagttttaaccagctctagagctccaattctgccatctatttgagtaaataagcacagttcttctagataggattattttgatatgaacgatgatgaaaacttagtgtgttttctttaaatgtaaaccagtggattattttataaatatgaacaataaatgttctgaatcatatgagtcatgaagaaaggtttgctttacacttgtgaatgttaggatgggggtaaactttttaccagtgaaaaagacatctgagctgtctatttcaacatttgcaaccctggatgctcccttgacattcgtgagtttgcagtgatatgcaagcctcagtgatctgcaagaaaaatatatttgagggcacttttgctaccttatttttgatggaagaatggaaaagaaatagaatagaaggaaggttcatcaggaccttttcttttatccttatatattttctatataaagacatatattctttagtgaataaaatgtagataaaccctgtgagtattagaaaggaatcatttttaatttaagcaaaataaatgttgaaactatattgtgtaaattgtatattaatatataattacatgggtatatacta

SEQ ID NO: 27411 - DNA, 1536 bp, Bovine  19866881017091
taggagaaaaaaaaaaaacaaacaagtaaattccttattctgcttcagaggacctacgtgatcatatctttgcctgcagtcctgacctctgacccttacccatgtcactccaggcacaacagctgtcttctccctgttcctcccgttgtccactcagggtcaccgtgtgtccaggccccagcgatctctctccagcaacctccccatgcggacgctcgctccctcacgtgctgtctctctgtcctcctccctctcatttcatctaagcctgctgttccttgagcgtcccatggaaaatggagctgctcccacacaaacgttgtcattctcttctgctgctttattttactttcaaagagttttacactgcctgaaattgcatgcattttcagttggcctgtttattttgctttcgttcactggtctatgaacccccaagaagacaaaacttggtcacggtctttgatgtaccctcagcataacgcaatcatgatagaaacttcaagtttaaatgaatgaatgagtgtcatgcatgaacactgaataggggcctttaaaaaaatttaaactccttattgaatttgttacagtacttattttgttttatgctttgttttctggggctacaaggcatgtgggatcttccactccctgaccagggatcaaacccacaacccctgcactggaagggggagtcttaaccactagactgccagggaaatccctatagtggctttttaaggttgcattacatttctaaggaaatagtgaagagttgggaactaatacttagttgcttggcatagcctctttatcagcacatttacttatctatctaataacattgtagagtatctgtcaccttcacttaatagctgaagcctcagattttagaatttaaggaatttgcccaagggcatatactcagcaagagactgccagaccctgagacctggtttttagcttccaaatttgttaatttcatcctgacacagatgtgaaataaaacttacagaacttttaagaacttaaaagactttgtcagttcttaagtaagcgtttattattataagggaactctgattcagaagctgggatgagagaaataattaaataaatgtttatataagcagagaatcaaaccaccatgtgaattaataaaacctaattatttctcattcttctctggctctccgtctttccaatttcccttgattatgggtgtctctttaaaattcagtatgtgttcttttcgatccatagtttgtccttcagaaaattcattcttttttatggctttgcaacttaattttgcatttctaaaaccgatcttgtgcttgaactccaatcctatctcctaatacatagtgaatgctatcatattgtaatctaggcatcctgtccctaagcaaaggcaatattcctccaggaccaactggctctttgtcctgaattttctctaccactgacatcgtagtccagtcatgaaggagtcaccgtattaacactaaccaaaaaggagtaatttcatcagtt

SEQ ID NO: 27412 - DNA, 1032 bp, Bovine  19866881054362
tgaacttgagcaaactctgggagatggtgagggacagggaggaccagcatgctgcagtccatggggtctcaaagagtcagacacgacttagggactgaataaaaacaacgtatctgagcttatagaagttaaaggtttgacaccttcccagtggtgtacagtgggattgggaatcacatttactgtagtcaaacagtatgcaggaaagactctaagagttaggaaagctttaaaacactgagtgggagaagtcaaaacttttgcttctcagaggagcatgaattctgtttactatgtatttctggctaagattactcatagcagacaccgtccacacatatactgaaagatcttcagagagcaggctttttcatctggtcaaggcagtgtatcttttgataatcatctgattgataaatttgttttactgaccaattctatggcatatatttccactgaatttctgaaacagaaatccaaaaccaaaaaatcatttggcagcatttattcctttggaaattatatttgaagatttatttatatttttctgcaatgtttaatcatgccaaataataagatttattaattatgtagactacattagaattccagcatgtcattaaagttttacaaatgaataaattaaaatccatgaataattcaaaaatctaatctccactgagctagcaatataacccaataaaattattcactgtaaactctccatgtcattgtcacccaaagtttggtctataggccaacagcatccacaggagaaattctcagatgtgaaaaatctaagacctcccccagaccttgtttaacataaatgactcaagatttgtgtgccctttaagaaggacagccctaaggatctataaagatatatagtaatttttttcaactggtctcctttccaaatttaggatcatcagggacctgaatcaaggaagaacattcatttatttttctgatctcctgagcccttagttcttagctggtgaaacacactttctagagaaaagtgtatct

SEQ ID NO: 27413 - DNA, 2033 bp, Bovine  19866881092834
ttttttctgaggaattgggactggtttgccagaaattcagccgagtgactactccaagacatctgttagctccctgtcattatcccaaccatcataattacacacccactgaaatgatcataagatacttcagggctgaccctgcaatgctgttagtcattctgttactgcatttgtgtcatgctaaagaaattctgagctgggatacgataggaaaaagaaaaattagtatttagaatcgtatcacttcagcgctgtaattaaagatagtctaacacagtgattcataatcttttctggcagaagtgtcagggtcatggtccctttgagaatctgatgaaagatacagcaatagatagtgctcttctggcctcccttcaacccgtctttctacttggaggcagagctgagttcagcaggagacagagccctccccctcccgcaatgatacccctcttccaggggactggtggaccgagcagggacacacccagacacccttggccagggcttggattcttgagggtgagagcaaggcacggggactgtggcagagtggcaagtgtgacagcacagccatgagcctccaggggcgtggaggctgacgctccaaagtgacggctggttcgtggcagtgccttgcttccctggcttgttgtgtgagcgagctgtccactctgagcctaagcccttggaataaaatattttttcatctcagtgaatgaagttggtgacctttattagcaatcaagaactctaactggtagaccccggatctgtccctggaaaaatacataccagcatgcatttatttttttgtaaaatgtcataaggatccatgagtctctacaatttatttaagagacgaggaaactcaagtacactgaggctaaatgacttgccgaaggttagcaaagtagacattagccatgtagccgtgttggtgttagaacccagattttctgagctgtgcataatattgcctgctctgcatgaacacactggtcctctcatgggtagatgcgtgaatgacaactatgatccaggctgtggacagaggcaaactacatacagcagcagtgagcgtagttgacgagtccacggcagacagacgtgggaaacaccagtcacaccattcctgagacataatccactcccggttaccagggcaacatcagttcttaagtttgagggtacatgtgtttatggtgaccatttaattaacattttgaggcatataataagtttcctgactacgtattactggtttctttgacaaccatgaacacactactggcatatgtgtttattttatttttcacttgaggaagaattaattaatttactcaatatctattacttagtcatagttcaaaagattgaacacaaatatctatcagatccagactcattaataaaattatggtatataaacaaaacagaatattatagcatgtgaggttttaaaaactttttttggttgctcctcacaacatgtgggattttagttccccaaccagggattgaacctcagcccttggcagtgagagctcggagtcctaaccgtggaaccatcagggaactccccataggggtttaaatttctacacttcactggccgtatattctacaactttctctataaaattcaacctagtgttcactagcctatttaaatttaatctctccataaaccctcccttgtcctccctgattagtttagtcacctgtcagaatgcagtgttctatctaatcccacagtacttagtccacaccattagtagatcactaaatgcaagctttttactaaatacatgcctgagccctactctaagtagtgatctctttgtttcaggctgtgggtggattcatgcactgacagactttattttcttgggctccaaaatcactgtagatggtgactacaaccacaaaattagaagatacctgcttcttggaagaaaagctataaccagtctagacagcatattaaaaagcagagacatcactttgcgaataaggtctgcatagtc

SEQ ID NO: 27414 - DNA, 2739 bp, Bovine  19866881242682
ttcctcttattagaaatgaaaatacctggaaatgttttattaatatagccagcagttttacataaagcaattggttcctgcctttcctgaatcattacttcagttctgaaattcagtatgtttcgatgctgctccagatgtatgtatttaccatttagaaaagaaagtgtgtccctctctagactccgtgaaatcaaattggcatgaaatgaactttggctccaaagcttctgctgacatttatttgcaaaggtttctgtggccaatattcctgctgccgaggtgacattaaacctggctggtcaccagggagaactgtggcttttctcttcactcattccgggtgtgagaaaaaaggaactacttcaggatatgccaaccttgtttgatttggctttttctgccccaagcaatccttgatatttacatttcagcaaaagaccaaaaaaactaaactaaaataaaaaactgaattcccagcaccagggagacaataatcagggggagaacttaacactgcctggctttttcttaaaatgtatgttaagtccctcttcctaaagcctctgatggtacatagataccttgtgtgctggggctgttgatgtcgatcatttttatccctggatttggggtatctttaacataaaatataaacatttatcttagaattctggttcccaatcttgactgggaatgctttttaattcctaatgctcaggctgcatcacagaccagctgatcaaaatgtctgtggttggaaccaggagtccagttttttaaacctcctaggtgcctacagtatggagccaagttcaagagtcactgtctcataaacccacatccccaagtgatgtcatccgtcttgatgtgtgtagcagatgaggaccctaggctacaggtctagatgttctggaaatgcatggtgttttcttataacttgatttaattttaataacaagttgcacactccaacctgtgtaattcggccactgtggggggaaagttgatcttagctaatttaggtttctttctttccctaggattgcaagtgagtttcaagggaattgaaactagctggagagggtgctagtccaggctgcttcttaaccccttgagctggccttagccaaaaggacatcagcatatctgtccagcgatgggtctgtggtccactgggtctcctaagcacttcccctccgccttgctccatcccacatgaagggctctctttctcccatgccgggtggtgtgtgaggcattgaggtgaactggctgaatctgccctgaagccccatccaacatttttctcttccgcatcttctccacacttgcaaagtggctcccacgaggtttgctgtttcagacaaaatgagagagatattgaatgaaaatattaagaaaggaaccagaattaaactggagcttctgatcagcaaaaccagagtctcctcttcgtctttagacaaaagctgtacattcctttttagttgaaaagaaaccataaaaagaagcctcttgtcttgaagcagttttttcacatgggaatgtttgattgaaaattatcattgataagtatattactatcaaagttcaacttcacattttttgctgctgctgctgctgctaagtcgcttcagtcatgtccgactctgtgtgaccccatagacggcagcccaccaggctcccccgtccctgggattctccaggcaagaacactggagtgggttgccatttcctcctccacgtttttttgctagacacgtctaatttgtctctgtttcctcaggtacctttgtcatttgtctgcacaggatgaatcacctttaaaactgtatcaactggtgccacctccactggatcaggcagacttgtgttaatcccattggtgcttcctctcttgtcattgagaaattctccctaattattgatgtggatgaattacttcattttagagaatgtttgaagctgatttatggatgatttcttaattagtatctttactgagtacgcctcagcttgtctaactcagttctgcataaccttggccttcagaaaatatgattctcccttacaaagtccaagttaaagatgcatagcttttctgtttctattgttgtaaccacaatatccactaatcatgtgcctgttatgtaccagacaccatgttcctactttacaaagattgtcttgtttagttcgacagtctccattttactgtcagatgaggaaactgctcaaaacacttgtccaggtttattcagcttgataatcacagttaggacctgcttcacactcttaactattagacttagacatacaaattaaggcagttcttgatgtttgaaatgtttttgtacacatatgcgtgtgtgtgtgtgtgtgtgtgtgtgctcagtcatgtccgactctttgtgaccccatggactgcagcacaccagtttcctctgtctttcactgctcccagagtttgttcaaattcatgtccattgagttggtgatgtcatccaaccatctcatcctctgtcaccaccttctcctcctgcctgcagtccttcccagtatcagggtcttttccaatgagtcagctcttcgcatcaggttctaaaaattaaatatgttcaaattcataatggaatttcaagagaagcttggaaatgttttggaaataaaccctttggaggtaatgtgatcggtactatcgagacttccacagaaagtgtcttgatcctgtgtctg

SEQ ID NO: 27415 - DNA, 2014 bp, Bovine  19866881259106
atatagatatagatatatagatagatattttttttttaagtctgactctgaaggaccaatgggatacaaaggttaagtagtggaggaaagggctattcttaagaaaattaatttttaagtattaataggaaaagcatgtgatcacattgggtaaataaactctccattggctttagtactttaggttggaccagatcattcatgaatttatgctctaaggttttgattaaagaaaccactcgtgttacaacaaacataagaatcatgtgccccatttgtcagtaatgctttttcccggtatggtagatgttgttcatttgtttatttcatacttcaggtttctacttctgcctttccctccctgaatgctcacgaaaaactaccacacctatgacaggttgcgtgattacttccccgctctgtgtgttcaatttgtgtattattgtatcatatgacatcttgaatcaagcactgctagtaccaagctgttatcagcagctgatgccagaaatattcatttataacacttctcagcatgcaagtgagagcccttcaaatcacagccgcctaatttccagtcattgttcttttcttctttgcatattatacggcaaaaagaatgcaaaaccaggggagatttattagaaaataatgccttgggaaaatgttgtaaaacattcgagtccttgttcgtgaaggtcgtgagacttgtgctgctttagaggcactgtcttggaggcctgttctccttcctttcttttttccccaaaggttttcaaggtggcggttttttgttggtttttttttgcagtctttgattacattaaagtgcaaaccatttagatgtctggaagtaagcaacaccctcagcagagaaccaggaaatgaggcgtggagccaacctttgccccagatgtggtccctgtgtgttaacacgtgggtcgggaccatcagggggaaccaaggcaatggaagagtcagaaggctttcttctctaaagaagggccattaaaaaacaaagtcaataagtaaggtttgtcacttcctcatatggggagtgctgagcctgcagctctcagtggatttctcatacatgaattcattttgcaaagtcaatgctgagacttggtggccaactgataagacaccagaggctgccatggtggagaagagagggccttcagtggctttccagacacctgacctccgtctgtcaccgttttctggaggaagaacctcggagcctactgactggtgggtgaaggggataccagaggtggaaacgtgggcttggcgaggggacagcaatctgtggacgctgtcttcctgctgcctgaaaaacttggggttcatcactttccctcccaccttcactgactccagagagactgagcagagggctgtggaagaggacgaggggagttttcatgtcatctggatgaataggtatcaagtgctctgcaaatccctggttcctgcacagtctccagcagagcgggcccagagccacccccgccagtggaaggaatccaggcctgttgctggggtctactgcgttcagaagagatgctcaaactgcctcttggctctcagtgctgtcttctgctctgctgttttttccataggttgactccatatttttttgtttttctttaatttttattttatttatctgtcttccctgggctttgccgcagcatgtagaatctagttatctgaccagggatcgaacctgggagccctacactgggagccttatccaccagaccacctgggaagctccctgactccagatttttcaaaatgtattcatgtatagatgcttcatattttgttgcatctcaggctcagtgttttaggtgaagtgatttcttctgtctggttttgttaacttttggcttggaaattaccaagtcttaccaaagccttaaagaaaaagctaagaattcatgtttgctgagcacttactaagtgtctgatagagtaaatacttcatatacgtgaaagcccaaaa

SEQ ID NO: 27416 - DNA, 845 bp, Bovine  19866881260202
gtaagaggagtcatacaaaataaagtaagtcaagatgaaagaaagtggcccatagtaacatgcaaaatggggataagaatgcatcacaagatgcattttttaaagttttatattaatgtgtgatgggcaggtgaggaggaagttaaaattatatcattggggtttgcaatttggtgtatgtgttagattagaccatttaccatgattagcatatcatcagagaggtggcatgtttaagacttaaaataatgaattacaagaaatgttcaaagaaataatttatttaaacagtaaatgataaattttatgcaagctgaattaaaaccaaagtacactgggctaagcataactttaaagctcactgaacttaaatgctaacaattacatttgttttcaaatcttaaaccctcacacaccatatcagcttcattatgtttaaggctaagtcaaggtactttcttttctgcctttggagtagttttctatcagaagcaatactgggaacacagtttaatcaacttaatcaacactatttgagcaacagaggaccctgaatatatatctaagatgtattttattgaccaaaaaattggcaggtagagatgccagttcgatccctgcatcgggaagatccttggagaaggaaatggcaacccactccagtattcctgcctggggaatcccatggacagagcagtatggtgggttagcatccatggggtcacaaaagagtgaggcagaacttaatgactaaacaatgacaataacgatacatggagcttcaaaaaaaacaaaaacaaaaaaacaattaaattactccctagaaacatatttaataaggatgc

SEQ ID NO: 27417 - DNA, 974 bp, Bovine  19866881313342
attttgtgatggtaaaacattctttttgtcttaaatttaagttgatctagacgtaaaatgcataaaatgtgagcctaactctacactcacaaatatgcaatatcggcaataagatatttataatatataatatggacatatataaaactaaagtggacataattttaaatttatgtggaatataattaaaaattttaaataaattttacatgcatgtattataattcatatttccattttattattatatgcaattttgaatataattattttaggaaatatatgcaaatggttttcaacttttaaaaatttttccttgacttgcattcttggtgacatttaaattttgtacactttgaacacagttacatgttgttttttaattctttagaacattgctgccaataaaatatgctacagaccttttttaaaatttaagcttaattagtgattttgctaaaatgaaatcaagaaaaataaaatctaaggagtaatgatatcattgtttctataaattacaaatgtgtttcttaagaatactaaatcactggcccattgacagaacatccaaaaataagcaataataatgaaattctgtcatcttgcattgtttgcttacacttactcacgcaaatcttatagattgatgggtattttaaaatcttgtctttatgaagacatatttgcttcccttgtggctcagacagtaaagaatctgcctgcaatgcaggagacctggggtttgacccctgggtcaggacaattccctggagaagagaatgacaacccactccagattcttggctgggaaatcccataggcaggggagactggcaggctagtcagtgggctcacaaagagtcagacatgactggtgactaacacttcactcctttgtcaggatagaagagagagatgtagtccctttcagtcaaggtagtccaatgagcttgacgtctgaggttaggggatta

SEQ ID NO: 27418 - DNA, 923 bp, Bovine  19866881372609
atagtttgaaggcatgcatgcatgtatcctggcagggtacagtccttaagagtcatgaagaactggacacttcaagtaacttagcatacatgcacagcttcaaaaaataaaataaggtgtaagaaattaagaatttcttctccataatgtgttttaaattatacatgcatatttatgtatatgtaatacatgtataattacataatgactgcattaatttttgtgaattgagaagaatagactagagcacctgtaaatcatttcacaattttaaaaacaaatttataatcctttttaaatagagacagtcaatatttcttcttaaaatcagattcaaaatgtcagctagaatccactttaccttggacttacttgaactaatatttcacagttcaggacaattctcatttgccaagaagagtttgaggtttgtttttccatcaataatgtcttcattggactttgaatcacaagcatttataaaactaccagtgttaaggggacactaaaacatatcagctgaagaattgatttcatttgctcccaactctgtccagaagggtaggttccttgtcttatttatttagacaaaacgtctctagagctaggaagaactatctgttcggttttacaagcttagagcaaactttctttcttttttttccattttgagtctatacatgtggagtgatattctaaatcacgtgtcatttaccggggcttgctttaatattccatgaactataattcagtttaaacaaaagagagcagtcagaaaaacacattagacaaaagttattcaaattatgcttaccgagagtattctgaatcatctctcagtttgttgtggcctttatttagctggaagtgctaaaagttgagtttaagtttacctttattatgactcataattttacatttct

SEQ ID NO: 27419 - DNA, 829 bp, Bovine  19866881666570
tctgtatatatacatcaagacttgtttcttcccaactttccaaagtttgcaaatgagggttgggccttacagaatacgttcactgttatgacttgatctctggcctgaaggctcaatatttccatttttgtttctttttcattcaggttgcctgaaccccttatagacctcaagatcttccagcaaaatataatcatgacctggagtcttggtttcacagttcataaaaagctagatttttaggtaatagaaattcagagttacaaccgttctgactattatttcacctcacttgaaaagagataaggaagctgatcaaggccagattgaagctaagcctaaaatgagctgtgcctactcgttgaaaaatgttcccacactctagagactttattctacctttaaaatgctcttgtccatctcttcacaagactttggagactggagattttcagagtcttaacgtgttgatgtgaagataatatggaaagaaagcttttttcaaaactttttttaccctcaacagcttctctgggggaggaaaaagaggattttatctcagtcaaaagggaataaaactgttggccctgacaaattagggttggaggggatcattgaaatcaggaagtgggaaagttgggggattatccctaaagcctggatcagacaaggaaatcagctggaggcagtgcagatttaagtgaagatgggcacgcttgggtcaagggcccgggctgattggagcaaagagatagaacaagaagaaatgggaggaaatgttttaatggattgaagacagggtggatatgagtggaaaatctttatttca

SEQ ID NO: 27420 - DNA, 1030 bp, Bovine  19866881870600
agatcctgccagacgggccgctgcctccttcgctggactgggtctcatgagtgtaagtggggcccgaccagtggagctgaatagtcgatcccctcttggcagtcctgtggcctgtgtttgtctgtgtctgtctgagaatcctttgcctaagtggttccctttctacgcacgtgcagtttgagccctgactactgataaaaacaagtcagagcactctacaacaaaggcgtggctctcagaggtcctgataccggtcacactgtgttagtattacatgctatgctaatcctaattttacaagcagaaaaagttcctacctctgagaggcacaaatagaaagaacaacacagctggggaaaatgctgactgagaaaagctactttttcatcacatatacaaaaatcaatccccatttttcacttgaagtagttcagtgtctagtagacttttggaactggagtttacttgtcaaatggtccatccaagataccatattaactttagctgagcttaaccagttttaggaaagtactttgttatagcctgaagctaaacattccagaagcaagagcagtaattagaatagtttcagggctaggggggtaagtttaaaaatgaaacgtgagatcttttcatgagttgtgacaaaaaagatatcctaggcataattgtgaatatcatgaacatagaaagtcatttacttctgctgctttgtagaaataattttgaaatgtaaaggggacaactgttttacaaacaactaaaaacaatcagattcttccaataatcatggaattaaagaatgaaatatggtattttctgaagcagttaccatgaaaagtcaatgaaatgccccaagtcttttttgtttgcactcagatcgctaaccatttactaaatgagcttatggtaaacacttccatgcctagaaattggaaagaaagtttttaaaagtacgacaaatacatttctaaaataaggtaacaccgtacctgaatgagaccaagaagaagccagcatccttcacaga

SEQ ID NO: 27421 - DNA, 1100 bp, Bovine  19866881891255
aatgttcttaataaccaaagaggaggtttttaattaataacattaattaaataattaattgaaaagaggagaaatgagtaagtaatgcaaaagatactttgaccaagaccctgaaaagatgaacattttgagtgattagagcctttcttgattatggcaacaaattctaagaatgagatctgataaggcaaatatacatgagttactgtgtatttttggcactttaaagagctacccaatatgcaggcgtgtccctatttaaagaaaatcccgtaaacaaaaatccagaattgtaagcacaataatttagtagttcttttcgttataaaatgcatccccacctaatagaacttgctattcaattcctaaaaaaaaaaaaaaaaacacctttaaggcacaattgaattcaggaagaaaaaagaaaaaaggaacatctatttttgaacaccttttctgaaggccatccataagaatcagccacattctgccctcattgacatttcaaccaggcggaccatggaacatttgctcaaggctaattgcaactgtctagatctgtaatgaagcctttcctggataacctttatgaattacagtaagtcaggctcccctctgagtgactggctagtcaataaacttctccctttgataggttattaaacatccactgtcgttgcattgatgatattctgttctcaaccgaaacctttagttaagtgatgacggcaagttgtgccctttctgattccaggctcctgccactgtggaaagtgcctttgttctgctgaagaatggtacatttcaggagaattctgcgactgtgatgacagggactgcgacaaacatgatgggctcatttgcacaggtgccgtatcaaccaaccctaatcgctctttgtcatagtcggcagtggagaccacactcactgtgccctgccgcagatggcagggcaggagagcctccttgcaatcaagacctactgttcattgaaagtcactacagaaggggaggggcattgattcccaaatccagaggaatgcacaagaataaagccaaattatatggctgttgggaaacttccacaaagtaacccctctccc

SEQ ID NO: 27422 - DNA, 1143 bp, Bovine  19866882066048
tgattttggatctttattcatatatcctcaataacttgtatatactgttcaggtttatattattggagctaatccaaatatataagaagctatggatttaatcttctttacttgagtgctttcagattaagagacgttttttctgtccctaccatctatactaatgaagtatttatacaacagcaagaattgaaatggagccacattttaagtatttctaacctctgagaatataacacaatcatgttttcagtcactacgtcatgtccaactctttgcaaccccatggactgcagccttccaggtgcctctgtccatggattcctgaggcaagaatactggagttggttgccatttccttctccaggggatctctccagctcagagactgaacccatgtctcctgcattggcaggcaattctttaccactgagccaccagggaagaccaacataattatactctctttaaaataaactttgagagtttttttttttttttactgcatataactatctgacatgacataatgttgtaattaacataagtaatttgcttatgattaaagtggagtttatttcaaagagataatatttctattcattctattaaaatatatatattattttgttttttttttatttggtttatttatccagatatttaacatgtgtttaattttctttggtttgaggttttggggaaaggggggtcaggggtggggataggccactgactaaatcttttgcttcatataatattttgggctacaaaagcttgagaaactcttatttgctgaggttgcacagatcatttaggcaaccaaaattattttttttaaagtatgcatgaatgataggaaacttcccagataattgtgcattctcattttctttttgactatataatatgtaatttacatgttcccaatacagctgttacagataagacatacccatgaagctacaaaagacaaataaaaatagaaattgagtctacttgcctataaaatgaattctttaaaaggagcccgacattggaaacacacacacacacccttattttcaaaaggatctatatattttttctaaatgtgggaagcattggcccttggtgatatcacagaacatgaaaacctcactg

SEQ ID NO: 27423 - DNA, 1601 bp, Bovine  19866880390224
cattatactaagcactttaattattatatatatgtactattaatgttaaacatacatgctaactatataaatgtctgctatatctatctatctaactataatatttcaaattcatttctcaaattacccctggtgctagttttcacctatctttggtttattttttgtttgtctgtggcggttttttctttaagatttttttgatgtaaataatttttaaagtttttattgaatttgccataacactgcttctgttctctgccttggtattttggctacaaggcacgtgggttctgtgccttggtattttggctacgaggcatgtgggtcccagctcccaaccagggatcgaactcacagcctgacactggaaggagaaatctaaccactgaatcaccagtgcactccctcccttatcttgggactctgttccttccctgcatccctttcgtcaccaaccagattcaaaggcatgtcatctcttccttgagttactgcagtcaacacataaccccgtgtcttgcaaagtgagctttctaacatacacaactgaccactgcttgcttaaaattcattagtgcattcctgctgcctatggggggaaaattccaaaaattctcatgtaatatacaaagtcactcactagctgattccctgcccagcctcagattccacttccttctctgctgcttccttttagctgtcccaccctcttctgaggcttctacacagccactgcccctcagtgcctgtggcagtcaccctcgttattctatacaaccctgcaaacccttgcagagaactacccagcccagaaaatcagatgccgctccttggtaagaaatctcaaccacactcttactcccgtcctgttacaggtgtcctcggctattcacttacaaggacacaggcttcctgtgaacaggaagacatcgctgtgtcttacagatagcctggcacatacatgaacctcatgtatgctgtacacatgaatgaatggacagataagcaaaaagcaagtgaataaatgagtaagtgcaggataagctgggctgcccaaatacatgaccaggttctagtgttgatacagaaatctcctggagacatgtcagaaatgggtaaacactgcttcatggactcatgtcaaatcattattgattccccagttcatatactagtatgatgatcttgacatctgttgacatctgcattattatgctgattttgacattttctgtcctgtatgctcagagcttcccagacatgatgtccaaaggttatgttagtcttaatatcttcagtgaaggcttaggagttcagttacaccagttgcttcctgatggaagagaactgaataaatcatcctctaagacaaataccgttaagtcccctacacacaaaccaattctgttctgaaagcgcgttttgtcagtccagcaaagttagcctaggtatccaactaacacaatcagttgtatagtactgtactgtaataggtttataatacttttcatacaagtagtacattaaaaagcaaacacaaaaaataaaggacacattttaattttttttttttatctttatttttatttatttttttt

SEQ ID NO: 27424 - DNA, 1004 bp, Bovine  19866880408146
tggctacacactcaagcccctgttcctcctcatgctcctacttcttcattctagtgattattcaagctctcttcccactgcccatgtcccctggttctggaagcatcagatttccaagcctagacagccttggtctcaaaggatcccaggcagctagggacatctcccaccttggcatcccagtgagggaagaggggataaaacactgacattccccaggcaagctctccttcaaatgggccagaagatgggacatcaaagatgggtaacctgggtttgtccaatgggctatccatctgacagcaaatatctgagattcccctagacagtcaactcttttcctgtggaagccctgacaattttgcaatggcagttttcctgaagactgagcacatcaccatgcccaaggctcatgtgtgcagacctccagccaactactagatctagggctgaatggaatggctcgggaccttggtggctgctctttgtggcatggcattccaccaagcccacagggtccagggaacaaaacaactgtgccctaaatagaatcaggacaagctaattcccaaccccttttgtgtaaaaatagtggaaaatggaaacaagcacacagagcaaggatgctactaccatcctgtcccctgccccagaaacccagagctataaatcaccacgtcactacagtcgcacctggagaggatggtgtaaattcaggttcacatttatagggaatcaaattattgctttattcccagggagatgaatgagagtgacagagtttccagagttgtaaaaatagatggatgcttcctataaaataactcacagacgcctacgataatttacaagagatctggcagtctgggagcaggcaagtgaaattccagacagaataccacactattttccagtggtagagtaaatggtttggctattatgataatacatttcagcacagcaaatatatctccccttaatagaaatacattagacaccattta

SEQ ID NO: 27425 - DNA, 835 bp, Bovine  19866880472712
ttcccttgtcctttggtcgagagttgcaataacccgtggttgacttatggtttcaacctacggttgagaatatgtttcttatcttgtgccctgcctatgaaattgaccctgacatagtttccatcccgctcattttctcttaaaatagggaggaaatgaatgaagcattgtctccctcccacccaaaatgatgaagcccagagtggtaggagttcattctgagaactggacaaagtcagcaacccaccttttttgcaagccagcccaggctagttctgcctaagcagaaagaaagtgttagtcattccatcctggccgactctttgtaaccccatggactgtagcctgccaggctcctccgtctatggaattctccaggcaagagtactagagtgggtcaccttctcccttctctttttgacccagggattgaacccaggtgtcaccatctgaaccaccagggaagccctgagcagatagaggggctctcaaaaccaagaaggaaagttgctttgtagttctgacctgaggctgtggttgacttcacactatggagactgagttaagttggcaaatttctctccattatcatccatttggcaactcctatagtctgaatttgtgtcccccaccccagccccagattcacatgttgtaatgccagtgcccagtgtgatggtattaggagatggggcctttgggaggtgattatgaacagtaatgaaggcagggccctcatgaatgagattgatatccgtattaaaaaggcctgagaactctcctgttccttccactatgtgaagacactgagaggtttgcaacccaaaagagagtt

SEQ ID NO: 27426 - DNA, 902 bp, Bovine  19866880517174
aaaatgtgttttattttaattccatgattgttttcttcccctggacaaatattttaaatgtgtatgaacccccaactgccagtctttccattttcatttccttcagtgctttaaaggagagaaggatctcatctctcagaatacggataaacattctgctttgtattgtgttccttttccatgactcttacgttttgctcctccatccatctagagtttattttcgattatggtatgaggtatgtaccttttgtttcaaatgtctgtcccttattctttcaaaatgattttggaaataactttctcttatttggagctgttcaatggaatatattttgtacttttttatacacaagtgggcttgttttctaggctccgtgctatttcctattttttttccattttcttttcttttatttgttttttttttttttttttttaaatcattgaaaatgacttttgacgcaagtccccagtctgcccgagttaaaggcatgatgaggaacagggcacagctcggccccctggggagtcaaagtgggtggggcagtcaggtggtgttttgcagtcctgtgagttgttttcagaggacctgagaccccaaggaaaggtaaggaagtgcccgtttctgggagagtcagacggcagtgaagagatgaccttgatcttattggtgggcaggggttctcctctctagagaagacagaacattggagagagtgagcagcacatgcaggagaactggggaagttcttaatttgggggctggggaaacagcacagaaactttgggctgagtgatagaatctccagagtgaatcatggaagaggctggagaggaaggaggaagcagattgtggagcatgttatatgccaaacctgccttgggtaggaactttcatc

SEQ ID NO: 27427 - DNA, 1689 bp, Bovine  19866880518964
aaatatttaaggaggaatgagtaggcaggttcggggaggaccctcaaccctcaccccttgtggtggcagctgctagcttggccacaaaaagccactcctcagcccgtagtcaccctgagaattccactccagggggcagctacagaggggtgctaagctgctgatttttagttactaacttttgggttgaaaggggaaagaaataagatgaaaaggagggagaaagaggatgtgtgtgggggtagacaaggaaggaagcagacccccgtgaaacaggccggggggacagagagccgaataatagtcacatgcccactgaccggggcctctcactttcctgtctctactggcaggacgggctttccaaggctgggaccgtgagcgaaggatttgttcatggaaatccaaagggagagataatgagactggccggaggccccctctcatctcttttctggaagctctcactcccaggggcccctttcccctccaagaacctcccaggacctggatttcattaaataccaggaggtaaaatgctttctaagcatctgtgagatttgaactcttacaagcccgcatcagtggttctcaaaactcaggccttggacgggcatcgctggcagcgcctgggggcttgttagagcggcagaggcagctggattcaatagcagtagattggaaagtgtctctccttcagtagttaccctcgtctgctgatgcccagctaaactgcccttgtcctgcagaagcaaggggagaccaatattgaccaagcacatcgctgtgccagggatggcggcaagcacctcattaagacacctctgttctgcagaggtagagactgaaggtcagagaatttcaatggcttgcccaaggctgcactgctaggaggtaatggggctggtgtctctgaacccaggtctaacccctctcttctgactgaacagtttttctggagaagccgtcttccttgggggagcctccctgctgggaaactgagtccaggaggccggtcagcggaggcagtgtcttaaaacgcttaaggccctttgagcagagcagctgttttcatgtcttttgatttgggggtatctttgcattctgaaaaattatcttggacctcaaaaacctttttttactgtgtgtgtgaaacccagtgatatttgccagagtagagactagagctaagcaattcttaaaatattaattcgttgaaggcctgatgctgaagctgaagatccaatactttggccacctgatgcaatgagctaactcattggaaaagaccctgatgctggcaaagattgagggcaagaggagaagggggtgacaaaggatgagatggttggttggcatcatcaactcaatggacatgagtctgagcaaagcccaggagatagtggaggaaggggaaatctggtgtgctgcaatctatgaggttgcaaagagttggacacgacttagcggcttaaaaaccacaaacaacaataaacccattacatattaacataagtaatgtgtttgggggaaaaaaatcaacctagatttttttttaatagtgagaaaatggcattgttgtacagtttcgtaaatctctactatctggctgcattccatagctgcatctaatctattgagatatccaatgtcatttagcttctaaaaattccactgtgggcttgtgag

SEQ ID NO: 27428 - DNA, 788 bp, Bovine  19866880568468
ccctgtcatcctatctctcttcactctgtcctccaccattgcagggtggccaggggtcttcttcaggggatcttcttccttttctgtttgcccatgagcccagcaaaatagttggtagataaacagttagtgaatgaacagataaaaaccctcctgtcttcccaatatattccttccactcttcttatgatcaaaggcatcatttatctcctcttgcaattagaacatcggtgatggcacctccacacttaaaaaggacaggatcctgaacacaactgcctactgtctcccttgattgactaatctgagctcaaattctgaaggctgctggggtccagtgcattaaccaggcccaaattctcttttttccttccctcctcatcaagccctgcctatactcctaggaaagagggatatcatttttcgtaacagcaaaccttgcaaaacaagatatgggctgaagaaatgagatgtatgaggcccctcttttggatctctcattattcgggaaaatgcacactttgctggatggcttaattttctctgtttgagctcaattcatccaggaaggagcagcacacctcattaacttactttccacacagagcagtctccgaaacgaactgcccacttcagcacttgagtctgcgtgcaccctgcctatcaactgtattggggcaattttcatgaatcaagactcagcctgttccatgcacagcaagggttcttacctcggggtccagggagccccaggaaaagctccagaaattagatacagggtgttgtgg

SEQ ID NO: 27429 - DNA, 2287 bp, Bovine  19866880582014
ctgtctccctgtctccttctctgtctgtctgtctcccctcctctcacccccacctcctcccagaacggcgccatcatgaacagaggcacaggacgctgcctggaggtggagaaccgaggcctggcgggcattgacctcacgctccgcagctgcacggggcagaggtggacgatcaagaactccatcaagtagtggggggagccgggcccccgggacagggcctgccttgctctggaccagccacactgggagagaaacagcaagacaccggggggtgctcagtggggcttctccagggcagcctggggcccccggtggagactctgcgtcttcatcaggcatccagcttcctgaggctcatgcacccagggaaagacccctgaccgttctctgggaacccagaagccgtgtcttctgcagcccgatgtggatctggtaccaaggagcaagacaacacacctcttggtcatcttcccacctgccgtcaggacgggactggcaggggccactcctttttctcatctcacagcagcttctctcctcagccttcaacaaaggggagggggctgggccacatcctagctcctcctcctccaagaaggcagcgaggccctgggactcagtttcccccaggttgcctctgcccagatgcccatttacagcccaagatcaccaccccaaaccttccagccggtggccttggactttgctggactcccacccctgagatgacctgggaggatgcttccctggtcacctgggcgccaaggtgcctatgtgccagcttttccgcttgtgtcctcaagagggagccagagagcatacggccggcctcggctgtgaggggccccggctggagctgttctgccctgcctgcccagggaccgagcatcccccagacacgccgttaactgccgccgcgggggcgccaaacagcctccacctggaacttaaggactgccatcagcacggcacggggggccaggactctggagggtgctcatctcgtgtctccccgcactctgctggctgacgggagaaggcagccgagtcctcgcggaagagtaatcctatttttccgattgccctctggttagggtgcacttataaatcagagttaatatatggacgcgtgtgcatgcgtatgaaggtgtgtgcgtggtgtgtgtgtgtgtccgggtgtgtgcgtctgagtgcatggtagaagaggcgtagaggtgtgaccctggacttgtcgctttattgcccacccggctcaggtcaaggatgcgaagaagcttgcccgaggtgggggagggggtggccacggtcattggccgggaggacgtggctgggccttgcccgctgtgccgccccagatggaaggctgcccttccgccggttcccatctgtctccctcatgctgtccggacaagcccggcccagaaccaaactctgtccctgcccagtttggggttcacagtgtctcatttggtggcatcttactggtgaaggttccccccaacttgtgaaataaatacatgtgagcaattcccaacgcagcctggttcgctttttttttttaatttttaattggaggataattgttatgttggtttctgctgtacaacaacgtggatcagccataagtatacatatattccctccctcttgagccttccccccacctccccccagtcccacccttccaggtcatcacagagcacccagctgagctccctgtgttacataccagcttcccactagctgtcatgggcttgtctgatggctcagtggtaaggaatctgcctgccaatgaaggagacatgggttcgatccctgggtcgtggaagaccccctggagaaggaaatagcaacccactcccagtattcttgcctgggaaatcccatggacagaggagcctggcaggctacatttccccggggttgcaaactagtcggacacgacttagcgactaaacaacaactagctgtctattttatacgtggtagtgtattatgtcaatgctactgtctcaattcatccccccgcctccccttgctgtgtccacaaatccgttctctagtctgcctctctgttcctgctctgcaaatagactcatcggtatcatttttccagagctcgggccaggaggcagttcctaggacttggcagagggcttctggttgattaaaggcaaagatggttcaccccgtggtgctgggacacagccagcctgcccttgcactcatctccacccaaagcaggacagagcttgacacttggcatttgcttgctaactcccta

SEQ ID NO: 27430 - DNA, 3112 bp, Bovine  19866880614301
ttttcttattactttatcatgcaaacattataatgaggatggtgattagcagctactgtttactgaattttatactaaatgccgggcccaaagggagcatacattacctcagctctcacagcacacttaggaagcgtcaggaaagcagaggggaagcagaccggatggagaggtaagtaaggagtcaaaccaagcgtgaatctggaagtccaacccccacccccagtgacttactctcaagctctcctgcctgactgtaagcacctaccccagggggatggagaagtctaaaagaatgggcggatgggccgtgaacagaacgtggagggagacgaggtggtaacactgccgttttacagatgacaaaacggatgtgagctggtgaccaaactgggatatgacctctagcggcaatactggagacactcagaaaggaaaaacaagccctcctgtttccaccccacgaagccgtcgttctcattctctgcacattccttccaggccctattcatatgtacacatctttataaataaatcacagttcggacagcatcttacattatgcttactttcacttataagaggttgctattaatatttcagatatatgcatgcttctacatggtattcataattataatgttaatgaatgcatgatactctgattcaatgtaccatcatttcaacggccattccattcctgttggcctttgaggtggctcccaaattcttaatattaaaagcaatgaggcaatcagcatttttatgcatgtggaactttttttttctttcagattgatggccttaggatagattcccagaagggagattactagctcagaaggtatgaaatatttttatggctcatgagatgcacttccaaatggcttttcaaaagtgtgactctaaatttacaaggccaccagaatgctgggagcctatgggtcctggcaaaattttaactatttcggggaacaagtatttctttgcaaaaatttctcctctcgaaatttcacaattcacgctagccttcacctactggtttcctatgcttttagagtgttttctgccctttattttttcctcaatttttttcatttccagaaagctaatttgaaatactgatttacacacagggtttcatttaattatctctaggctttgcccatcagagagccaaaaatcccaaacacccaactggtgcagtccccagtatccacagaaccgttcatagcaacacaggagtaacacaagccttcaggggccccaccacttcccagccagtgtttctccaacggctcgcagcctggggctgtatattctgcctgcctcttcctttcccagcagcccaaggatttgcttgcagggtctccattaatgtggacaacctcagacccttgccctcctttacatcttgggtgacaggcagtgcaaaggaaaaaatggcccagcagtccccacatcaagttggttttgaaaagagcccatcttttcagcacatactcttaccagggctgccacagaatcctctcgattactatgcagagtgcattcagttagaacaaaccacagatcgcaatcacacgatttgtgggctgtgacaaaggttccacacagccggtggggagaagacgagggtgactggatgcccaagactggaatgtaattactgaatggcttgttgtctatgactccataaacaacaaacacctgggggatttgggagtgtctagggtggggctatgggacacggacgaattgcttttccttagaaatacccatttcttcatggggcagtccttcccaacagatggatggtttctttggttgatttccaatccaagttttggcaatgttaggcattccacaggctgtgttcattctgagagcttcatccccacaaagctctcgtggaaactcttttattcgtcaccccaagcctaagaagttggaacttggactatcaccattttacagatgagaataaagaggctgaataatctgctcagctcaacacagctaacaaaaagcactgtgtgcgtgcgtgctcagtcgcttcagtcgtgtctgactctttgtgaccccatggactgtagcccaccagagtgaaggtcaaatttgtgtctctatgacttcaaacctcagctcctgccctccaagctcccactctctcctaaaagaatgaacaagtcccagaatgggatgcaatggtctcagatctctgagggctaggaagagctgacagggtctgggtgctcagtcaaagccagaatgacaatggcaagctttctccatgatgagagcagacccatgatgagacacccaagaagaactgatcgagaaaagtccagacaatgcctgcacagccaggagaaatctgtactgaatacggatgggcatggcgtggtgggggctggaccccggggcaggggtgggggcagtgggaggtcaggagaattcaaggaagagactagactgaagaccaaaggtggatgggcaggaaaacacacaggcctgtcctaatgagataaagagagcattttctggggccagaaggacacgttccctgtccgcacctggaagaaacctgagcagagtcttccacctcccacacgcatcccctgccttcaggggaactgccctaacaaggcagcgtctcctgcagtgccgtttctctacctgcctagagcccaaggtcggcccctgcaatgttcttttttctttttttttagttttttttgatgcatgtgtgcttagtcacttagtcatatccgactctttgtgaccccatggatggaacccaccaggctccctgtcctcggaattttccaggcaagaatattggagcgggtttccatttcctacttcatgggatcttcccaacccagggatcgaacttgagtcactttcatctcctgtattggcagcagattgtttaccactagtgccacctgggaagcctagtgtggaccatttttaaagtctttattgaatttgttacaatattgcttctgtttcatgttttggttttctggccacaagacatgtggaatcttaactccctgagcagtgatcaatcttgcacctcctgcattggagggcggagtcctaa

SEQ ID NO: 27431 - DNA, 2173 bp, Bovine  19866880660090
ccctctcaaaccccccccacccccatcgcacccctgatttctgctgttttaagccacccaagtcatggtactttgtaactgcagcctttgaaatgaatgtgggtactatataagatagaataagaggtggggcctaatttagatcggggtatgtgtccgttagagttctttgggagtaaacaatagaaagatgtgctgactcatttaaaaacaaggaatttaatcaaatgaaatcaatttacttttagcccagaaaaatcagagtaaacgctgaataagcaagtcttggaaaatcagaaaccatggcggttctgggatctgggagcccaaatgaataggcagactcaccagggcatcactctcagaagaagtgtgttcccactattctatttccttggactcatctgaccaaaattcaaagttctgagagagagaagcaaattggtttagctttcatcatgtgtcgactccttggaggcctggtgggaattaattaggaaaaccgggcatcttgacagcccaacccatgaagactacttgcttcgccaaaagcaaatcggagtgctagtaagaaaagaacagagatacctggaaggaaatacagagtaagtgactctctggggaagtgctctttctgctgactctgaaaggctgattagaaaataggcagacggggacttgcctggtggttcagtggttgagtccacactcccaatgcaggagatgctggttcaatccctggcggggaagctaagctcctgcatgccttgcagccaaaaaaacaaaacacaaaacaaaagcaatagaacattaaattcaatgaagacaaaaaaaaaaaaaagagagactacaggttgagggatgacaggaatgaagacaaggtcatcagaaaaagctttgtatgttcaaagaactagccagtatagagggatatcatgggtatgacattaactgagagaagaagcctggaagaagaacacctatttaggtgagaagacaaggattttcatttgggtgctctttagtttgagaaatcccctaaaagcataggaagtcattcaacagggggttgaatatacaagttatggcttgtgagacaggtctggatgcccatgtaaattgcagagttattgacatataaatggaaacggggatttagggagacagtgtaaaagaagagaatgggtttcacagtcaagccttgaggatttccaacatttacattagtggtagcctctaaagcaattcaaactccacctccatcagtagagatgtttagcttctccttccaatatgcacatttacttaaaattaggtacatgagccgctgtcctcaaatattctgtacattatggatttttttaattgaaaccaatttaaataaaaattaatataaatctaaagaacactgattcggaggttggggtagaagaaggtgagccaaccaaggagtagccagagaggcagaggtaaaactagcagaataggatgtcatgacattttttaaagtgtttaaaggaaaaggtagtggttataatatcaagtattgctgagccatctagtaagattaggaccagagaaaaagtctttaggtttggtacctgatagatggtgttgactttgataggagcagtttccatggagcgatgagtttcaaagccataccagagaaatgaaaaataaaggcatgcactcatttcattgccccacctacactgcaaggtgaaaatcatcaccgtcattgatagacgagagaatcaaggctcagagctgtaaagactgccgtggcttttatactgcaggagaaagagtgaaaatttaataccaagcctgcccagatttataatgttgggttcttccatggaagaaagctaaaaggtataaaatgtcattaggtagaagcagggcctgggttaaagtgggaacgattggtcataaatagtccaatgttggtggcagagcattctgggaactccagttgaaaagtagagcagaactcctcattcaagagtcctgagcagaaaggcaggttcacccagcctctaagaggtgatataggacttccctggtggtccagtgattaagactccgagctcccactggagggagtgagggttcagtcctggttggggaagatcccgcatgccacgaggccaaaaaaggcgggaaggat

SEQ ID NO: 27432 - DNA, 666 bp, Bovine  19866880748088
agagaaaggtacagagatattctatgtatgcccagaccccacacaggcactgcccccgcttcccaatcacactcaacaccaccccccccaacatttgtcacaatcaatggacctctactgaacatcattatgatcccaagcccttggtttccatgagggttcactcttgggattgtacattttgggagcttagataccatcagttttgagttacagaattgcagataaaaggctacaaaagcctctactacaacttctgttagagtaatgcttattgatctgaaaacaagaaaagggtattgggtctaactgaatataacacacactggccatggcatccctctgggggtgatgtcatgtatgataagaccatgggctactcccagtgagttcagaaactcgacagcctggaggaagcaacaggaacacccctgctcagatgttatcagtgcctctactgaacacgcaatttatacactcccgtgccgtaagcagatagattctaggacactggtttcacaaaactagcccccatcaaacagatcagagacttaaaagattttggccaagaacctgtgcactgaggatgacagagagacaaacacaagacgacaacccaacagggcaaagtcgaccgtttccctgcagatgggacctggtcttcag

SEQ ID NO: 27433 - DNA, 1602 bp, Bovine  19866880772345
agattgaacctgcaccccctgcattggaaggcgaggtcttaaccaatggaccctgagggaaatcccaatgcagctgcatttttacctaactttgtgaataaaacaggcaatgacctctatcttctgggacacccagaagtttgctggttatggagtgtcaaagaactttagaggagttataaatataaaaatatgttatgcattctttttttaagctcaaaatttgatgacctattcttagatgataggtgactatcaagagcatatggcatccagaagatatttccaggaaaaataaacatacttaatttgttccctcaaggtacagatgacattttaacagtagatgagaaagcaatgttttcccccaaaaatagaagtgttctattggagagacattttgaaaatggacgttgagaaacatttccatgattaatgatttgtagctgaaagtgctggagtttgatttataaaaattcatatctgcacacttcaaaaacttggaaatggatctgtctagtcttttaaacattttccaaatgaagaatttcgacaggctttgaacctatttgttaaaaatattaaaatatggcacctttcagttagtttacaagaacaagtggctgacatcatgaaaaatggaaatttacttgctgaatttcaacaaaaacctttgcataatacatggatgagattgaaaaatgagagtcataatttagtaagcaccgtcatcgatgaacttcttccagttggctctacacatctcaaggtaccttttcagctactgagcccaagaataagtgaattaaaaccagacatttgaattactgtaacacaaagtattaaatcaagattttgaaaacagtaaaatatatcgcctcacactgctctgattgaaaatatgactagtcatgatattttaatgagaacaaaaaggcctcctatactattaaataaaacactatgaaaactattttttaaacactgcttatttcatcttatcatctcatgcttttacagatgatcccctcagtactgtagtctgtgcatataatttataaatcaacaactatacaggtatttgagagtgtgctcaaaatttttcaccaatcagcataaacatttttttttaatgagaaagcacaatctgttaaatggggagaccaaccacatagcttaccaacttcaagagagaaaacaataaatacgaaaatgctttgaaagaaggatagagtgtcaaagaaagacaaagcatcatataagaaaagaaagggacttccctggtagtccagtgcctaagaccatgttcccaatgcagggggcccgggttggatctctggtcagggaactagatcccacatgtcacaactaaaagattctgtgttgcaactaagacctggagaagccaaataaatacttttttaaaaagagagagagaaagatctaactagagagagctattgttgtttctgacccagctggtcaaaaatcagtattgctttggtgtcatctaagctgaaagtatccagtgttcattataataaggctttgttgaacaaaggcaatagtttaggtatcattgcagaaggcatgcttatccca

SEQ ID NO: 27434 - DNA, 882 bp, Bovine  19866880914078
cgaacttaattaactttttgttaacccaactaactcattttcgccagctagttcagccaaattgttgaactgggagccccatgtagacacaaagaaaacatcctgggaagggaaaagttaccaggagaaaggaaaatgaatccagtcgagattctaatatgcctttcttcctacccacaggggaaagcacttacatcttcccaaacataattaccttcctggtgtttaatgaatacaactttaactcacacaatacaatttaaatctgctagaattcaagacacgggggaagtttccttgcgctcactgatctggaatataaaagtaaagctttaaatgtctagagattattgatttggttgttgacttgggcaagtccagtggggtgtcttttgaagcaattacccaaagtgtctcaatatgttaagcaaatctaaaaagaagccccagagaaggaccctggctggtgggaccagtggcctggcaaggctcatgcagtctgaggaccagaacagaccaatggttttcaatttttggaagatgtaagaggcccctggggagaacattaaaaatagagatgcccacttcaattcatggactctgaatctatgacaagatactgaatctgagtatctacatatattgttaaacaagttagcagagaattctgatctacatcaggtacaccaagtgtacttgaggactttcgacctaaaccagtggtgaactacatattacttagttctgcagcagaagagcctttcctggattcttttagcttttgttgttgctattgtttggttgctagattgtgtctgactctttgtgaccccatggactgcagcacaccaggtttccctgtccttcactatccccggagtt

SEQ ID NO: 27435 - DNA, 1054 bp, Bovine  19866880932346
acagtggataggaaagggtcaagggggcagtatgagggtcagcaggacacgctggccaatggagatcgaaccatggaatgctggctctagaaggagcaaaatttacaggttgtttattccaaccttatcgttttacaagagaggaaaccagggcctgaggtggtcaacccacagaccaaaccccagatccataacatagaacagaggtgatgacagaccagggttgggaggaagcttgggcatatttccaaaggcctggagacacatgtacgggggaaagtggcatgtgccatcagcagcgctgtcctttggagaaactgacttgcttggaagctagagaggtcttctgtttgggcttgtactgctgcccagaacagtgaagcgtgtgggtgtctactcagcctttgagcagcacaccatgcaaaaaaaagaaactcctccctccccacattatttgtttttccatttgtttctcatccttgcatcctcgactaaggagcagctatctttcttcagagagaatatgacgaagaaggctgtgcttggttcaggaggagttctggccccccaaaagtatgtgggctgccacataattactctgcaggagagtgcgtgtttagggaaattacacccttctctccccactttgtcctgggcctgaacaacagcgtgctgactcatactaatgatgctgtcagaggctttacctgtgattttccgagcagcagcctttgggtcagcagagcaagggttgtctgatcaatccacgggcccatctcctcccaaagacctgtaaagaacaaaatgtcagcacgcccagaagggtgaacagatgtagcagactcaggcaacagcatgcaactggttttgcaagtttgtaaagctctcggtgacagtggacacaggaaagggacgaggggaaataggatcagggctggcaggacactctgggcgatggagttagaaccacagaatgaatgttggctccagaaagagcaaatgttatagatcgttgaattccaactttatcattttacaagaaaggagattgtga

SEQ ID NO: 27436 - DNA, 1117 bp, Bovine  19866880955975
catagagtcacaaaagagccgtgactgagcattttagtgagtgaatgagcgagaggcactgctgataaaaaaaaaaagtattcatataagtaaaaacagaaagaaggcatttcccagcactctctactcccgactctgtctctcttttctttctagccctcatccctgtcttacgtaggtattcgtttgtcagtctccccagaaaataagctttagtgtcctggaacattgtgttcccagagcctacggcatgcctggcactttgtagatgcgcaaacactatgttgggtaaaagaacaaactagccagtgaatgaatgaatactgcttgactactgctgattctctgacgaagcagtgcttgcaaacatcaagcttgtggctacccaaagagtaaaacgactcagtggtgaagaatcctcccaccaatgcaggagacgcaggtgcgatccctgggtcaggaagatcccctgaaggaggaaatgggcaatccactccagtattcttgcctgggaaatcccacagacagaggaggtgggatacagtccatagaactgcaaagagcagaaaacaactgagcgaccgagcacgcgcgcaaaagagcagaaacaaggcgtgctttgggtccatctagcaaggtgtgcctgagatgagtcagagagattaactctgcctccattcttgagaggcatcctcgtttcataatttaacggacccacatccacatgtgttccctaagaccagcgtggaggaataagagctgactcttgtttgcagacccagacaactcaaatgtggttgtttttaaaatacctgtctcacagctgtccctgaggaatttagctattatttgaatcctggaaagaaaaaggcaccaagatttgttgtcggacttctagaaaagagaaattccaagggctaatctcaaatgtgcggggtcaagttttgcaaggaacgtggctcttgatcaaatttaagggcttcctctttagagggtgtgtgcgtatgctcagtcactcagtcatgtctgactctctgcagccacatggactgtagtctgccagattcctctgtaccgtgggattctctaggcaagaaaaccgggaagggttgccatg

SEQ ID NO: 27437 - DNA, 1246 bp, Bovine  19866880958418
ctgtaataggtggagaagcccatggagaagaagcccaagtccccaagtgaccacaaggaaggctacctttccaccctgagcatccacaatggatttttgttgaattctcaaagagagacttcccttgtggtccagcggttgacagtctgccagtgcaggggacacgagtctgatccctggtctgggaagatcccacatgtcgtacagcagctaagcctgtgcaccacaactcctgagccccgctcctacagacagtgctctgcagcaagaggagctcccgcagtgagaagcccatgcgatgcagctaaggagtagcccccgttcgtggcaactagagaaagcctgcaatgcagcaatgaagacccagtacggccaaaaatgaattaaaaaaaaatacttaaaaaaataaactcgcagtgaaaccagcgagattaagaggtttgcctcttctagcagccagaattaccagccctagagacgccccatcccttgttttgacttgaaagtgtgtagaacttgaaaatgtctacaggaaccccaggctttgaatggattagatgacctgaagcaagtggcctcccagaggttccttccaacctggtaatttcatttctgtttctctctcagaaaacaatccacttctgagcatcgttggaggccggttactgagtctgcatgctgatgatggccgcgatgtgcccccatcccatgtggtcctctgccctgcatggggtcactttcatgttaggcaaatggctgaaatgtttggccagcagcagcacggataaagggaaatagtctttaaaatttttcaacagttctccccagcactgctttgttcttgctctctgaaagcggtatccggcatatcttccaggcctggggtctattggaacaattgtaaaatgtcatctcttctacctgctgacttctgcggctgtaagctgctggtggccgggctcccacagagtccgcgggaccgaatgtgtgaactcacttcccattcacagaaagcatggtccaaaaaggccagcctgaccgaactatgtctctctgctctctggctcaaagaaaacacaggaatgtcattgtatcatctcgaatgtatccccttcttttcccttttgtgaaaatcctgggatgtgtggggttgggttctgatagtcctcagaatgccagtgaatggcattgatcttaacaccttaaagaaccagcagctccaggtgcttcaaaggccgcctccagg

SEQ ID NO: 27438 - DNA, 675 bp, Bovine  19866881165589
aatgataacttgttggctttttcccgtaagcctagagagatttctttttttttttttttcctcttgttccaatggaaggtagacattaataatctttaggagagaaagttaataattcaatatgatgcatcatgggcacatctgtacaaaagtatatctgtcaatgtttcaggacatttagagaaggaagtgacaagtcatgttctaccgcctctaggccctccagaaagggtagaggaagccttatccatcaagaaaatggctggagttctttctaaactttttggtgaagcatgactactcagaatggatagctttctcttttccctgttggatgtctcttttgaaataggcatgaagacttgtttctgatttcactggatggatgaaatatacattgaagcttgctgttatactcaaacataagatatcatacattttttatttcctatgccttgaagacccaaattcatcagaaacttattaattcaaacttgccttaaagctcctgattgccacaggttttaaaaagattatagctttgctctacaagcctacagaagagccctcacattattaataataatggctaacatttataaagttcttactctgagccaggcgctccgctgtatattttacgtggcatcatttcgtttaattctcatagtaagt

SEQ ID NO: 27439 - DNA, 1375 bp, Bovine  19866880083657
atggcatctggtcccatcacttcatgggaaatagatggggaaacagtggaaacagtgtcagactttgtttttctgggctccaaaaatcactgcagatggtgactgcagccatgaaattaaaagacacttactccttggaagaaaagttatgaccaacctagatagcatattcaaaagcagagacattactttgccaacaaaggtccatctagtcaaggctatggtttttcctaggtcatgtatagatgtgagagttggactgtgaagaaggttgagcactgaagaattgatgcttttgaactgtggtgttggagaagactcttgagagtcccttggactgcaaggagatccaaccagtccattctgaaggagatcagccctgggcgttctttggaaggaatgatgccaaagctgaaactccagtactttggccacctcatgagaagagctgactcattggaaaagaccctgatgctgggagggattgggggcaggaggagaaggggacgacagaggatgagatggctggatggcattactgacttgatggaggtgagtctgagtgaactctgggagttggtgatggacagggaggcctggcatgctgtgattcatggggtcaccaagagttggacacgactgagcaactgaactgaactgaactgaatgttctatatagggcttccctagtggctcatatggtaaggaacctgcctgcaatgtaggacacctgggtttgatccctaggctggaaagatctcctgcagaagggaatggctacccactccagtattcttgcctggagaattccttagacaaaggagcctggtgtccagaggagcccaggacccatacagtccacaggctggcaaagagtcgaacactcaacaactaacacttttacttttcactttccctggtggctcagtggtaaagaattcaccgccaaacaagagacgcaggtttgatccctgggtcaagaaaatcccctggagagggaaatggcaactctctccagtattcttgcctggagaattacatggaccgaggagcctgacgggctacagtccacgggctcacaaagagttagacaggactgagcatacacacaatgttatattgtatacgtggtattctagggcttctgaaagggccctaaactttacaattccataaatagtaagctttttcttttttttttactgtcagaaaacagagaaaaaataaaagaaatatcggttagaggaccagctgatttttcatcccaggtgagagaagacaggcagccattaattcacagaagaatataaaatccacgtccacgaacacacagtcttccaaacaacaactgcagttattgggaaacattcactca

SEQ ID NO: 27440 - DNA, 1203 bp, Bovine  19866880405119
acttttgatatatggcagttgtaattccacttttactgatctacattaaattgtattaaggtgagaaacaccccttaaataaataaatgagagcttactctggttgaataatttcaatttagaaattaatgtgttaacatggcctgtgagtcactgcctgtcttctccaagtaaactctagtgatggaggcaggctgtgttcactttatattctactgccctctggctgataaaacttgctgccagaataagagattagttaacattcaacatatgttaattaatgtagtttattaaaatgtgttattgttgcctttattcattcttagtacataattcattgctgtaagggatataataaaactattagggctttccaaacagtcatcaaaacctcacacagctgacttagattttaaatagtaggattcctttattcatctcttgctgcttaaagtattttttctcactgtgtggcaaaccataattcaaaagtttattataccaagtgaataaggagaatgtatttgcaaaatgtgtgggagatttatcccaagaaactcaattaaatatacttaaaatacttacttaaatagactaaatcttgtaaatctatgaatttgggaaagcatgcaacagaactttcttaatcaatatagttcattccttctacaaaacatgatgtctagtacctggataggctgagaactttcttttaatgaagtgtgatgacatacatgtattcccaccaggtgaactgatatggctaacaaaaattaaccatattagcttctaatcttcttgtatcgcttatggtaagctgggaagtttttgtggaaacaagcctaaaatcttagtgcgtgtgtactcagttgcatccgactctttgccaccccacggactgtagcccacccaccaagcttctttgtccatgagatttttcaggcaagaatactggagtgggttgccatttcctcctccagggtatctttccagtccagagatcaaacctgcatctcctgtgtttcatgcattgcaggcagattcattactgctgagccactggggaagcccacaatcttaacacaaaagtcttttgctagcatattcaaggtcaactgcactactccataaaaaatctagattccaccaagatagcacaagttgccatcatgtcatttgtgttatcttttcaacatgtgc

SEQ ID NO: 27441 - DNA, 2659 bp, Bovine  19866880438869
attttttacgctcctttttacatgtcagaataatggaaatctgctgggctgcaacggagagaactggtagatcgatacggttaaattcatcaaaacaaccccaggatccagactgtgccagtccttagaagggaaattaaatagaaaactccaattagtacatccaattagaaagtcaagaaaaatagccttatgcaactgccaagacaagccagaattaaatttgttcaaacaaaaagttgaacaaatagatcatatattaaacgcccctgaaataatttgcaatgtaacactttttagcaatgcaaacacccaacctgcagggataaaggaacagcacaaaggtgagtgatattgacatttgacccacacaacactggaaagattcgggtttttccaaaagttttataaagttggaaaatgacactaaaatgcagccagttgttgaaaaataaatcttaacaagatagtccacattagcttacatttttcagcgaataaaaaaatataaccctcacctttaaaaatccgtccaagtcctcggaaatccatctgatctgaacaattgaaaaccacgacgtatttcccaagacaccgtcccatatctttggtcgtttctgtttttcctgttcctgcaggaccagcgggggcaccccccatgctcatgcccagagcttgagccagtgtgatgtaacacctggaaggatacaggaaccactagaaccacaccactggcagctgaaagaggcctcggaggcatcacagtgacacgatattcacacaaaatttaaaaacgaagatcctgcccattgtcgccacttaacctttccagaacctcaccctaaagtacacttatccttaggtatattaacatgtgttgaggaaaaggcagtagtctaaggtcaaacacatttgaaaactcttaaagatattcaacaagattccttatgataatgtatattgacaatttccagttatgaaaaagcatacataggatttccaaaagttatttggcaactatttcacaactacctcgaacatctaaacaagagtattctaggaaacagggcctggcttccccggtggttcagaggtaaagaatccacctgccaaagaatccacctgccaatgcaggagataggagttcaatccctgggtcaagatctcctggaggaggaaatggcaacccactccagtactctcacctggagaattccatggacagaggagcctggtgggctacagtccatggggtcacaaggaatcagacatgactgagtgcacacacaccaccacacacaccacacacaaagtagattaatccctttttgaatctaagaatatataatttgaccaacatgagaaccaatgatcacaggagatttaaatcacacattgctaaataatcacactgtaaatttatttctgggagcatctactaaacctgcaaatatcttctgctgtatcgtaaagtacgatattaacaaataaaagattctggtgagagaatcaagaatgcctgtgaaggaaaacaaaggaactgataacttgccaatgaatccttcagtttcccagcatcatccaccgctgcaaaaggaggtaatctacaacagaatgcatctgagggctttctgatggccaaactcaaaagctttcatctggacttgaaaaaatatttcaaagaaaatgaagtgattgtccagcaataaagcatgggaatgagcagcgagcacacccactggaaacccctagggtctcaactttatcagatctgggttcgtaaaaagacaagtaaatgactcagtcctgaagcaataaatgagcctggattcacagaaggtaatgtggatgtaaaaccagaaggatgcctgatctcactttgattctgcctttcaacccaaggtcttatctttcctcttgaacttttgttatcccttcagagcagtctctgtaataacagctaacatgatgttataatagctctgactgttagaggatgcacactgactgaaaccgcccaccctggccaggcaccatagtaaccatttttgtgagttattttatgaaaggaggtcctggtaagaaacagggaactaataagcccccaccaatgagaagagttcgagaaaggtcaaaaggagacgccatgtgtctgaccacctctcagaatcctcctctctggaatccattttgactgaacaatgtggacaccaccagaaagaaccctgagtcagaatgattgctcaaagacaacccaaaagctaatcccatcaccataaaactcaagactgtgagccacgaggcagagcggttctcctaggttcccctaccctactgctctccaccgggcaccatcccaatacagtcttttgcattgtcagtatgtgtgtctcctcagacaattcatttccaagtgctaggcaagagcccactctcaagccatagaaggggttttccttccttcaacacaactacaccatgtcatttaaaccccactgaagttgaacggttctatgaagacctacaagaccttttagaactaacacccaaaaaaagatgtccttttcattataggggactggaatgaaaagtaggaagtcaagaaacacctggagtaacaggcaaattggcctggaatacggaatgaagcaggacaaag

SEQ ID NO: 27442 - DNA, 1915 bp, Bovine  19866880455292
cgactgagcaacttcactttcacttttcactttcatgcattggagaaggaaatggcaacccactccagtgttcttgcctggagaatcccagggttggcagagcctggtggactgccgtctatggggtagcagtcggagatgactgacgcgacttagcagtagcagcagcatataccctcccatatatttcaaatcatccatagatcatatatgatgcctaacacaatgcagacgcaatgtaaatagttgacataatgtggcaaattcaacttttgtttttttgaactttctacataattttttccccaaatatatctgatctgacattagttgacaccatggatgcagaactcaaggataagcagggccagctctatatcactttttctgggcacacattaggacttagcaggtgaagacaaccttcttatctgcttaacaattctggagcactactgggataagaagaaaaacaaaacaaatagattactgtctcagaaaactcaccactcaatctcccccactcagacttcaaagaagttccattttgcattattcagggacatagtgttttattttcgaggaaatgatgctttctgcaattcattctaaaattttccagaacaaaaactcagaagaaacagaaatattacagtgagttacagtgaaatataaatttatgacaactatgttcataaatgattacgtttatgacttatttacttagtgtgcagataatggtttaatttattgagactttaaatctaaaccttcacattcattttaatttcaaagatttccccccaccacattttcactagtcatataatcctttctgattatttcttctacatgtaaataaggtttcctgtttatttttaatttttaaattttatctgcccagcaactatcacttcatgaatgcgtttttctagcttttttgaagactgaaattatttttagcaagttatgtttgtctaactctaaatgtgtttacacttttattctctaaaatactgttttttgtcccattgtctctttttttgttttttctttgcaaccttcagctccattgttgtggactctttgccaacagcatgcaagatccaatgacaacaatctgccatgcaatttgcatgaattgctttcaagacttgcttataaacatgacagtttgcctagctgctgtcacatgtactgtgttaaaatttcttcccattgacttcatgttgggtggaagaagagttacttgtaatctagggagcaagtctatgtttctatcttatggttaaactatgaaaattgccaagggttccagtgtcataactaattaggtcctagtatatgattccttagtggttaggcttttctcctagattcccaaacaaaaaataactaaaaaatgatgagttatttttttcaggctgcaataattccataaggataattaaacatttttaaagctatagtgaaggtaaatggttattagcaatttccccctccttttactatactcaagaatttatatgtgttgaatatgtagaaaacactgtttatgacatgatttcctttaatctttacttaaaaatacaacacataccagtttctcaaggatacacctacagatggatcttattgtataatatatgatattatatggtttgtaatgtttataactagaacttcatgagaccctagaaataacttcgtaacaagtgaattaggaaaaacatcctatatgattatgatgaaagttatattactcaggaatgatgctgagacagtgttccaccccttatccaagagggatatgtcccaagaccatgagtgtatgtctgaaactgtgggtactaccaaatcctatacatttaggataggataggatataccaaatcctatacactatggttttggc

SEQ ID NO: 27443 - DNA, 1988 bp, Bovine  19866880494620
attataattaattaagagagccaagtctctgatctcagaaaatacattaaggatgagttgacaggaggaagacatttctaaatcaaataatatgatggcaaatagatggggaaacagtggctgactttattttttggtgctccaaaatcactgcagatggtgattgaagccatgaaattaaaagacacttactccttggaaagaaagttatgaccaacctagacagcatattaaaaagcactactttgtcaacaaaggtctgtctagtcaaggctatggtttttccagtggtcatgtatggatgtgagagttgaactacaaagaaagctgagcgctgaagaattgatgcttttgaagtgtggtattgggagaggactcttgagagtcccttggactgcaaggagatccaaccagtccatcctaaagaaaatcagtcctgaatattcattggaaggactgatattgaagctgaaactccaatactttggccacctgatgcgaagagttgactcatttgaaaagaccctgatgctggcaaagattaagggcaggaggagaaggggatgacagaggatgagatggttggatgtcatcaccaactcaatggacatgggtttgggtagacttcagcagttggtgatggataaggaggcctggcgtgctgtggttcatggagttgcaaagagtcagacacgactgagtgcctgaactgaactgaactgaatatgatggtgcttagtagcatatgatataaacctaataagcagagtttctacataggttatatatatagttatattgataatgagctaggtggtgaggaaagtattatagaagacagggagatattacaaaagagcatcccaggaaaggcaaaaacattgccaagggagaacagggagaaagacttgatgaagttgaccttggaagccaaggggttcaagtttccaagtatagctagagattactgaatgactttacagtgggagttgcatgatctgatttaaggttgtaaatgatcactatgatcactccaactgctccatggagacaggctgtacaagtgcagaaaagacttaaaacatagaagactattcagattacaggagtgcaggggagaaattaagacatcttaaattagcactaggcagagagaagtggctaagcttgaggtattttgaatgcagtcaatcaaaattcttgataggttaatagatttgctgggggcagatggcaagtgaaggagaggtgagaatccaagatgacactaaggctgacttgaacctttgcatcagcacttttgcataaaacgccttaggctgctgttcatatctgcctctgccaatcctaacaacatattgtgggagccaattctccatgtgtctctcacatttctgtacattttatgagcactaactgcattcattctggactatcttttcaaaagtacgtagagaaaaagccttcaaacaaagaccatgtgcccctcagaaacaaagcagaggttcgcttgctatttgatatcatagtgatcacgtctgccacagaggggaaagccagacaggtttacttctcactattaaataaattgggtttcctaagctcatggttcccatcttgtaatataacctgtgtgtcacaatcacttcgggctcagagaagcagtataaatgctgtatgctggatactcctattactttgagtaataagcagtcccttttctctgacccaggagcctcgtgtcttctgatagcattgataacgcccatgaaagtgtggaaagctcccttgttaactcgcaagtagagtaaaacctcagattcttcctagttcttggtatttcccaccaggagagtgaaggagatactctctcttcattcccatggtagacctctgcagttttctaatgagtcatttcctcattcttatcaccttctcagaagcttcagttactgagaagtagcaccatcttaccagacgtgttgaga

SEQ ID NO: 27444 - DNA, 1280 bp, Bovine  19866880528566
ctaaaagaattatctttctggttgatgaggcagtcaaatcttgagttttctatgacggatgagagagaaaaatgtcacaaaaattcctgaactgcatttaacatgatgagagtccttggtaggtaagtccattgtgtacataaagccacctgcctatacattggagaaggcaatggcagcccactccagcactcttgcctggaaaatcccatggatggagaagcctggtgggctgcagtccatggggtcgcgaagagtcagacacgactgagtgacttccctttcacttttcactttcctgcattggagaaggaaatggaaacccactccagtgttcttgcctggagaatcccagggacgggggagcctggtgggctgccgtccattgggttgcacagagtcggacacgactgaagcgacttagcagcagcagcagcctatacatatgtgattttgttgtttgtatcccaattctaatttagtttcatctttattccaaactcctgggagatcaggaattcctgatgggaaattttgaatactgttttaagactccaagattggagcagtagcttagtacaaatatccatgaagatccaacgtgaaagtagaagattatgcatagtagatgatttcccttcattttctgcaatgtattatagctcttagaggtttcattttttaatgatctttgtactaattcattgtttgtgcctggggatatcttaagccttgactaagtttctctgaaatgtctgtgcctttgccaggctgccatcatatcctccgccatagtcttcataattcctctctttttagtgagttcttgttcacgtttcaagtcacagatcaaaggacacatgtcttccttccctggtggctcagtcagtaaaaatcttcccaatccagggattgaacccaagtctcctgtattgcaggcagattctttaccatctgagccactagggaagccccttgaaaacatacttgtatgtaatattgttcttaatagctgaacaaacttgtagagaatacttttgagtctcagcctgtgaaccctttgccagatttttcctcttgcctgtcttggagtgctcaaggacactgctgctttcaagagccgtgttacaatgcatttccaactgtctttctgctattaaatgtacagtgcacaacaaggagtacatttctgcaatgtgttctccaaaaagtagctttgaacatgccacatcaaaagcaaaatgagttttggcggtcttaacacaacatctgctcaggga

SEQ ID NO: 27445 - DNA, 1456 bp, Bovine  19866880568741
ccttgactagatgaaccttttttggcaaagtaatatctctgcttttgaatatgctatctaggttggtcataactttccttccaaggagtaagcgtcttttaatttcatggctgcaatcaccatctgcagtgattttggggccccaaaaaataaagtctgacactgtttccactgtttccccatctatttcccatgaagtgatgggaccagaatctcagttaggtgcactcaataatctgctcacactgccttgcaggtcacaaggcttcacttagttgtaaagccttcacttagccttcacaactaatgcttcacttagttgtgctgaagtttaccaaatattgacttgcaatgtaaaactgccatctctgttcaaggctcatgattctctgggtgctttaaataaaaatggaaggagtaatttttttttaatcttattgctatttttggctactctgattctttgttgtttcatgggctttctctagttgtggtgctcaggattctcattgtgatagcttcccttgtttcaaatcacaggctctggagtacgggctcaggagttgtggttaatgggctcagttgccttgcagcacgtgggatctttccagaccagggattaaatccgtgtccccagcattgccaggtggaatcctaaccacaggaccaccagggaagtactggaatgaatattttttaagtaactgcatgatacttttcatccaaaaaagattaattttcaacttctgatgtaaattttaaaaattcaccacatttatagagttttatagttcctctttcatttcctctgtccctagaatccatgactaattaattgaaagttaaagagcatgagaattttcatctctcatgcagtttcacagcatcgaaaagagttgcagtttgtgagcactgatggccaagaactgttcctatctcctgcaaaaagcagggttgccatttctaatgtttcctaatcttattttcaggcttgtcttacgaagtacacacagatattaaaatgactgcactgggagaggtgagaggtgaaaaatcctacatattctatgtgcatcctgcctgaggattaagggagagaatttgcttaggaaatcaaatcaaattattggctgtagaacaagctttggctctatcatggcattgcactggagatcaaatgtttactttaataactaaacctgtgacctgaacctgaatattttccgcaccaaaacttacccccattttgatccactcaatttaatcatcccacagacatttacttctgacacaaaatgctgcaaagtagaagtgcaatagtctttccaacacattccacaaacagaaaaatatcagagggaggaggcactagaaactcctttcctcatagtgatctgagcatcaaaacactaaaaaagaggaattttattttgaattacagacaaagaaatgcagt

SEQ ID NO: 27446 - DNA, 2258 bp, Bovine  19866880718754
agagttggactgtgaagaaggttgagcaccgaagaattgatgcctttgaactgtggtgttggagaagactcttgagagtcccttggactgcaaggagatccaaccagtccattctgaaggagatcagccctgggatttctttggaaggaatgatgctaaagctgaaactccaggactttggccacctcatgcgaagagctgactcattggaaaagactgatgctgggaggggttgggagcaggaggagaaggggacgacagaggatgagatggctggatggcatcactgactcgacagacgtgagtcttggtgaactccgggagttggtgatggacaggaggcctggcgtgctgcgattcatggggtcgcaaagagtcggacacgactgagtgactgatctgatctgatctgagtgcaagtatagcactataggtttgaatagcacttggtttctacagttttcctgcagaattttcttcaggcatgtgagagagcagttgatatgttaataccatgagtctttaatgaccacacctgtgtatataagctggtgtgtctaatatacgtgcaaaatcatcatgccacattttctttcacatattctcccacagccttgctctgagagacctgggggatttttctatctcagaaagtactgttaacatttctcaagttcttttttccccttgagagacatgccccacggttcctaatatttcagagatgcacttgtcaagagtcactcagatatcatcaccaatgtccctcagaagcaaagaatgggtaagcccttctgaataatgatacgcccttctccctggagtcattagcaaaatacactgttctttttctccagcttcttcggttctacagaacggaacattcgatgcaaagtttcttcagctgtgcactctcatattcaagcccgaggctatagcatttttgactgctacaatccagctggttttcagtctgctctcactattaactctattataatatttataatactgtctattaaactgtgggtttcttttccccacagacactatcaaattatcctctatctttagttcattctggtgtattagttctcttctgaaagagggcagacctgttgacagggaggactgttactgacattctttgccaaaattacacccactgtagctagaaaaagaatattctgtctgccttgactcaaagccaccaatgccaccaattccaggagctgttagatgcacagctagagtcttactcaaaatattagctagggtgggtctagcgcacttgcattttttgtttcttttttgattgctgaatttgttcttgttgatgttactgttcagttgctcagtcatgcctgactctttgtgaccccatgagctgtagcacgccaggcttccccatcctccactgtctccctgagtttgctcaaactcatgtccattgagttggtgatgccatccaaccatctcatgctctattgctcccttgtcctcctgccctcaatctttcccagcatcagggtcttctggcaggtgaattctggctacaatgcttgcaaggcaccatattctgaaataaattgaacttctttcaccttctgaaaatagcagagagaaaattgtgttttagagatacgttaggtgacattagcaaagtgatgcatgcatgcatgctcagttgtgtccaactctttgccatcctgtggactgcagtttgccaggctcctctgttcatggaattttccaggaaagaatactggagcgggttgccattttcttctccagggtatcttcctgactcagggatcaaacttgcgtctcctgcttctcctgcattggcagacaaagtgatgacagaaataaaatgtgttcaagacggatcaatgtgcaagaagggtccttgagaccatttcttgctaaggaaattgctctgaacatttttataatggaaacagacaggtactgtgctgaacacacaatggctattgcagaggccacttgagatattagagtgaagataaaggtaagctggcagggatttttgagaacccaaaggccatcttcgtatggagagagttctctaggaagcatagtaactggatattgttttgtactggcaggaagtatttttgctcatggaggcaaagagcaaatccagtaaatcaactgagacaaaatggctctagcagatcctaggggctcaggcatatgggcatgcactcaaggcattaataataaaattttaataa

SEQ ID NO: 27447 - DNA, 2395 bp, Bovine  19866880854952
tgttatcctcatatgtttatattcatctagtgactaagctgtttatttgttctgagtgtctgttttgtatcagttctctgcttcccttttctctctctctttttgtccacgtggactcttagttccctgaccagggacaacaagaactcatgccccctgcagtggaatcatggagttttaaccactggacctccagggaagtcccacttttcttctcttttaatgccccagtgaagaatattctttggagagatgacagattgggcagatttagatccaaatgctcttttgtgtagggcattatactcagtgccctatactcaatcttattttgtgtttcaaagcatttaccttattccatgaatctgtttcttaatcctgacctaatggacagcatatgagtattctcagaaacacactctgtataagaggttcctctaagactgagtttctcagcttcggcaccattgacatttggaactgaatacatttttgcaggggtgggggacagtcttgtgtagaacggctaacatcacccttgtcctctacccacaagatgtcagtttcacctcctaccccattataacaaccttaaatgtctccagactgctaaatatccctggcgggaaaatcacttccaactttaaagtcttgctccaagaaggaataagattttgccaggaaatcggggggaaaaacttgatttgtgcttccaagtaactacattttctgtctctgaatctggaattcattagatcattatttagtgatctcttttgcttctcagatttacctcagggtgaaccaactaaagcaaaacagccccaaagagctaaatatatcagtatatttagaggttctgtgatacatacatgtaatgagtttaccatatatcaccagccctacacttttattaattcaaatctacaaatatatttgacttaactgtattatatgtgtctttaaatcatttgcactgaagaggagaagtgtatacgaaggtataaatttaggtatgcctgcacatatatttatttatacacatctcattttataagaatttgagttcgctcataagagggcattaagtaaaaaggaataaaataatggactagaagggaggaaaaacatgaaaaaaagttaaagtatacaattctcacatagaagtatatgtcaaattgtaggtaagttttcttctgttcaagtagctggggtactatttatctgctagttctgctgttctgcttcttaagggcttcccgggtagctcagccggtaaagaatctgcctgtaatgcaggagactctggttagattcctgggttgggaagatcccctggagaagggataggctagctaatccaatattcttaggcttccctggtggctcagctggtaaagaatctgcctgcaatgcgggtagacctgggtttgatccttgggttggaaagatcccctggagaagggaaaggctacccactctaatattctgaccctgagaatatcatggatgatatagtccatggggctgcaaagagccagacacaactgagctactttcactttcatataattatataatgtaataataacgtatcacatttgtataatatatattaccttagtgattagttcatagaaatgaaatttaagataaataattctgcctgctgttcccatcctgaacaaatgaggacttgagataaagtacttgatagtttctatgagaaggagaggaatcccattatacaaacacagcatttgctttgaatttattctttagatgtgttgatagtgtgtatgtaataatgaggtttaaaggtgccttcaataaagaagatgtgttatagatatacaatggaatactactcagcagtaaaaaaggatggcattttgccatttgcagcaacatagatggatttggagggcattgtattaagtggagtaagtcagacagagaaagataaacattgtgtgatactgtttacacgtggaatctaaaacaaactgtattcactacaacatgctagtgaatgtaacacaaaagaaccagagaacaaacccctagagcacaaactagtggttccagtgggctgggagaaagaccacctggggtgggggtgtgggaggcacgcaccactgggatggactatacaacgtatggaatatagctgatgttttctagtagttggaaagtaatcttcagattcattttgatatttggcaaaactaatacaattatgtaaaggttaaaaataaaataaaataaaaaaaaaaactgtgtaaaaataaaaacattttaaaaaagtggaaaacaagagaaatgaaaagacaaccttgccttgctgctactgctgctgctaagtcacttcagtcgtgtccgactctgtgcgacc

SEQ ID NO: 27448 - DNA, 1906 bp, Bovine  19866880862344
aacctcaggtatgcagatgacaccactcttacggcagaaagccaagaggaattaaagcctcttgatgaaggtgaaaaaagagagtgaaaaagcactttgtgaatgaaaaagagagtgaaaaacttaaaactcaacattcaaaaacctaagatcatggcatctgatcccatcacttcatggcaaataaatggaaaataatggaaatggtgacagactttattttcttgggctccaaaatcactgtggacaatgactgcggccatgatattaaaagacgcttgcaccaggaagcttgggctttactggtggctcaactggtaaagaatctgcctggaaagtgggagacctgggtttgatccctgcattgggaacattccctggagaagagaattggctacccactccagtattttggcctggagaattctatgaactgtaaaaagaaagctgagtgccaaagaattgatgcttttgaattgtggtgttgaagaagactcttgagagtcccttggactgcaaggagatccaaccatcctaaaggaaatcagtcctgaatattcattggaaggactgatgttgaagctgaaactccaatactttggccacctgatgtgaagaattgattcatttgataagaccctgatgctgggaaagaatgaaggcaggaggagaaggggaagacagaggatgagatagttgatggcatcatcaactcaatggacatgagtttgagtaaactccgggatctggtgatggacagggaagtctggcatgctgcagtccatagagttgcaaagagttggacacgactgagcaactttcaattttctcctagaaagaaaagatatgacaaacctagacagcatattaaaaagcagagacattacttggccttcaaaggtccgtatagtcaaagccttggtttttttcctgtagtcacgtatggatgtgagaactggacaataaaaacgcctgagtgccaaagaattgatgccttcaaactgtgatgctggagaagactcttgagagtctcttggacagcaaggagactaaaccaggtcaatcctaaaggaaatcaaccctgaatattcattggatcaactgatgctgaagctaaggctccaataattttgccacctgatgggaagagctcagtcattggaaaagaccctcatgctgggaaagacaggaggagaaggggatgacagaggctgagatggttggatggcatcactgacttgatggacatgagtttgtgcaagttcctggagttagtgatggacagggaatcctggtgtgctacagtccatggggtcgcaaagtgtcagacatgagtgatcgactgaactgactgaacagatgaaaagaacaatggaatgttaatttcctatcactaacaaaacacctctccaaccacaaagctatttggcagcaagtttccaccaacttctattgaaaccaaaaaaagacaataaagaactgcaattttctttacttttttattagcactttggaattcacagtcaccttttctgttgcttatttttatttcctctcttacctgcagctaatgagcatcaccgctgactaatgcccagcagggtgagtacagttcttccacaaaaatgtgttcttaagtcataaaggactgactgtattataaaattattgctttattactaccatgctgagatgttcaatgtcacatgaggaaagatttttacacattagtcacaagaaacaaaaaagtaacacctaactgaatgtgagaaagatttttctttcactttataagggaaatatttttgcaacagtgttgactagatgcaacaaaatttctaaagtattacttttggctgaaagagcacttgactattaattctataaaataatcacccccctggga

SEQ ID NO: 27449 - DNA, 1622 bp, Bovine  19866880868491
aggtgtttgggctgcaccccaacgcggacatcacctaccagagcaagctggccaaggatgtgctggacaccatcctgggcatccagcccaaagacagctctggcggaggggatgagacccgggaggccgtggtggcccggctggctgatgacatgctggagaagctgcccccggactatggtccttttgaagtgagttgatggcatcctgacagaatagctgtgggtgtgcgtggttggttggttgtgggggtggtgaggaagcagtgctacactaagtcactcagtcgtgtctgactctgcgacccacggactgtagcctgccaggctcctctgtcaatgggaattctccaggaaagaatactggagttggttgctagttccttctctagggcatctttttgacccagggacggagcccacatctttgcatcccctgctttggcaggtgcttctttactgctgtgccacctgggaagactgaggaagaaggcaggagggcaaaaataatttttctgaaattaaagaaattatttaaaaacctcacttcttgaagaagcagtaaaagaagtatttgaacctatcgatgtaatcatttcaaaatacaaataataaacctgatgagagagttaatcttcatagttaaattataagtgtgtactgatgggttaggattatttttctataatgtctcctggaggcacttcacactgtcatttgttcaaacgaaaatgatgtattcttagagtaaagcatcgattattttacaaaaataattcaggccttcttaatttcaggaagtctatagttatatcattaactctgcagcttcttcatcacatcggttttgaaaattgatttatcatttttttaaattaatgtattttatttaactgtgctgggtcttgttgtgcatgcaagacgtgagagctagttccctgacctgggccccctgcattggaagggtggagtcttagccactggaccaccagggaagtccccccaacttgtccttttaatatcaagtaacttctaagtgaaactgacagttatgaaggttaatttttttgacattttagcatgtattgtgggaagatttaccctgaaaacatgtttaactctttgctaaaagcaaaagtaagtggcttactttccttgtagtcttaagagatttcttggactaaccttgtgacatttctgtcataggagcaccaagtttctttatatattgccctttccacctggttttcagaaggaattctgcattttgtttcttatagcatcctattgttttccatgtagcaggccatttcggttgctagtttttcactatagactgaactcaaagaactctcaccaggggaatcatttcccctggaagaaactctgatcacttggttggagaaaatcaatactgtaaccagctttcataagcgcctttcattatagcatcaggaaagcagtcattcatgtctagcagtggctgaaatatttataaagcaacgaaagtgcctaaaatatattaagtgaagtggtagtcacacagacgtgtctgactctttgcgaccccatggattgtagcctgccaggctcctctgtaccatgggagtctccaggcaagaa

SEQ ID NO: 27450 - DNA, 1321 bp, Bovine  19866880892555
ctcaatgagatgttgattgatgctcctcccattagtgagtggaacctccaaggcctgcccaatgatgacctgtctgttcagaatggaattattgtcacaaaagcatctcgctatcctttgctagttgacccacagactcaaggcaagatctggattaaaaataaagaaaaccagaatgaactccaggtaatctttgtttgaatataaatgggcttccctggtggctcataacctaaagaatctgcctgcaatgcaggagacctagatcgaaccctgggttggaaagatcccctgcaggagggcagggcaacccactccagtattcttgcctagagagtcccatggacagaggagcctggtgggctacagtccattgagtcacaagagtcgggcataactgagctactaagcacacgcatgaaacgtgctactaagcaatttcattgcccaaggtcaacagtatctgagaattatttcatatttagtataaacagtatctgagaattatttcatatttcatatttgttattaacatttagatattaatatttataaaagagtgtctaaaaattgcattatttggattcttgtttatctctcctaatgctgtccattaaagggttcagactcccttctgttagggcctaaggctctccttgataaacagagcagggcagagctatgtcacactaggtgtgcggcaaataaagacactctatagttattccatgattatttgtcacaaatgtggtggtagtggggaaaggcagtattgtcacacagagcttttacctgcttcctagtaaaaggaaatgatgccgtcaaatgctctggagattctttagaaaactgaaaatagagctaccatatgatcctacaatcccactcttgggcatatatctggggaaaaccataattcaaaaagatacatacattccagtgttcatagcactacttacaatagcccaggcatggaagcaacctaaatgtccatggagaaatggatagagaaggtatggtatatttgtacaatggaatattactcagccatacagaagaatgaagtagtatctttcacagcaacagggatggacctagagattatcatacaaagtgaagtaagctagacaaagacaaatattatatgtcacttatatgtattagtagaatcttaaaaaatgatataaacaaacttatatacaaaatataaatagagccacagacatagaaaacaaacttacggttaccaaaggggaaaggtgatggaggagggataatttaaaagtttaggattaacataaatgcactactatatataaaa

SEQ ID NO: 27451 - DNA, 1496 bp, Bovine  19866880928929
atcgctgctgtagacctcacgacagcccaggcccccgaacactgggtgctgcgtggagttgcccttctctgcgatgtcaagtaatgtggggcgtgtccctcacccagtaaatgcaggatccagagtatcacaagctctgttcttctgtatggatgttgtgtacatcaggttgattgtacggtgtgtgaattgcatcggggttccctgctccttcgctggatgcttgcttatatttagtctgtttcaccgttaatgaccaatcactgtgtgttttgaaaagctatctggtgatttaaaagtaaggtttataactttctattcaagcttggccctcaaatccagagtaatatgttttcttctttcaacgccaaagactgactagggtaaatagatggtattagtatttccctggaagggattattcttctgttaatgtggtttcggtgacagcccagttctctaagataacatgacaagtttgtgctaattctgtttctgttgccttttgcatttaggtcaggtaagagatttcttttcatgactgaagttgccagttaaacagatctgaaaaatggaaggaaatagaatggtgggttaagaatgtgaatagatgaatagacaatgcatgtaatcctatagaataaacatatggaatagtgttcaactccactgataattactaaagagcgacacttaccttacatttgttataattaaaaaaattaaagctaaagtgaattgtgatgaggtctttgtaaaagtgatacattcagactccttgaacaatagaaatcaaccaatccttttttgtaaaatgattaaataactaagcacagaaggaatcataaaaacattcacatgctttgacccttattttctctcctagaaacctaccaaggaaacaatttgaaagactgaaaaaatgatatataaaaatgtatttaatagcataaaaataataaatgcccccaaaggtaaaaataagtctatgcttaaggaaattagaggatattagacagccatgacccactccagtgttcttgcctggagaatcccagggatgggggagcctggtgggctgccatctatggggtcgcacagagttggacacgactgaagcgacttagcagcagtagcaacagcagcagacagccatgaaaaacaatagtgaagatttcataatgtagaaatggtgagcacaggctgttaagtaaaagataaagttagcaaaatattgagtattataactaaaatgtatttggtgtggacaaaagttagaagataatgtggaaaaataaaaacagatatgatcgaatggtaaaggttccagttgacttgaaaaaatgtaatgactggaagaaaaattaggaaaaggataaaagtcttagtgggtgaaaaattcacagtgatcttttattaattaggaaaatactagtgtaaggggcttctcagatgtttttactttaaatcagactatagattatacactgtttcat

SEQ ID NO: 27452 - DNA, 958 bp, Bovine  19866880982896
aatctgcctgcaatgtgagagacccgggtttgatccctgggtcgggaagatcccctggcaaagcgaatggcaacccactccagtattcttgcctggagaataccatggacagaggagcctggcaggctacagtccatggggttgcaaagagttggacatgactgaacgactaatactttcacagtataataacttaaaaaccttctatcttgaaaaatgttaccaagttaagaaatttgcaccagtctttcatatcaaataagatacttagacaagctttgttattcttgctatcagaacagctgtattgaacaattaattctctcaacttccagttaactttgggccctggagtatctagatgaggtgacagataacccagatattttttgtaaattttctccacaatgtgttaagtaaatgtatctttgtaattatctcagttgcatgcacgagagttgtttatacacaacttttacactatgctctggccataatgtagatgtcttatccaaacagactaatttgatcggaaacataaaacttttatgtagaatattagtttgttggtcattcagaatgaattagtattttatctaggaatggttttgttttaatttaagggctgaaaatgaatactttttatttactatctggagaagaaaatggcaacccactccagtattcttgcttcggaaggtccatggtcagaggagcctggtaggctacagtctgtggagttgcagtcacagacacgactgagtgactgaacacagatgagaccaatttgaaatgaagctcagtatattttaactttttattttatctattttttaacaggacagttatatttcatggacaattttgtatcctaagactgtgcattcctgtacaaatgccagtaacgttccccacatcatttttgcacccaagaatgtccttttttggtgatcacata

SEQ ID NO: 27453 - DNA, 1549 bp, Bovine  19866881032595
atcctcctgccctcagggtctcgaatgccacattctctttacagtggaacctgtttttgtctttaatatatgtgaagaatcattttgctggagcatctatgagctctttccattttcaaccagctgcaccattaactcagctagctggacaattacgtcaagaatttcttggcattcaacactacaaattaaaatgaaatgtacagaaatatatgcaaacatgtgctcactcactcagtcgagcccagctgttcgcaaccccatggactgtagcctgtcaggtacctctgtccaaggaattttccaggcaagaatattggagtgggtagccattactccaagaaggggatcttcttaacagagtttgaacctgcatctcttgcgtctcctgcattggcaaggggattctttctactgagccacctgggaagctcacagaagtatgatttaagtcaatatagagtacagaaacttgatttcctgaaacaattcagtgcacttttttacacctatatttcactctaaaggactgaacaaaaagctaaaattttaatcatcagttttaaaataacacatatatttatgacactgttgtttatttactagatactcaaggttttaaaaagaaatgcttcaatagacttccaatatctagttcatgttaatatctgaaatttcttgtatttcattaaagttgatgtgcctgtggcattattcatgtttgttaatgttaatgcttgtggtgttgcaaaaattgtgtaagtcacgatgttaggtttgtggctgatgatttgagtttcttggatctaattataaattatatgaaagatgttccttggcttcagtggagagtaaattctattaaaaaaaaaaaaaaagaaacttttggtcatttttttaatgatattactggacttatccattctttgaaagagccctgttgtcatatttatcatgtgctttctttgatttgcttggcctatttattgaaagaaaggaaatttattaaaaacacacaaattgcatagtctaaactagaaaaatgacatcattttctctcagatctagagaatagcacagttgcagtttatttcttgcttcaaaagtctctctcattattatggacaaccacatatcagttaaagcatttgtccagagttactgataagaaatcatctaagccactgattgaatgcagattcattcattacttagtcatggacagaggaatttcatcctactagtgattattaaaccatttagttcagcaaatatcaagcatgttcttctgtcccctgcatgtagcagagagtaggtgtcagtatattcctgtaaagggccagagaacaaatatttcagaatttgtaagccttaaataacctgttacatctactcaactttgttgtcatagcatgaaagcagccatagaaaatatgtaaatgaatggggttggagtgtacccataaaactttatttacatacaggcatccggtgcatcaagtcagatttggcccctggactgtagtttggcaaccactatcaaacagtg

SEQ ID NO: 27454 - DNA, 1435 bp, Bovine  19866881091633
tccaactctcacatccatacatgaccacaggaaaaaccatagccttgactagatggacctttgttggcaaagtaatgtctctgcttttgaatatgctaagttggtcataactttccttccaaggagcaagcgtcttttaatttcatggctgcaatcaccatctgcagtgattttggagcccagaaaaataaagtcagccactgtgtccactgtttccccatctatttcccatgaagtgataagatattaaatgtagctccttgttctatacagtaggtccttgttgatttttacatatatgtataaatatatgtgtatatttgaatcctgaactcttaatttatccctccctgcccgtctcctttggtaaccacaaacttgttttatatgtctctgagtctatttctgtttttcaaataagttcacttgtaccattttttaagattccatgtataatatactttaaatctttttatttgattttttaaaacttactatctatagtctcctatgtacagaattcatcttacttgagaatagtttcagagtttgagagatttgcataccttttttgaagttgaccacagaaaaataattcttgatttttgtcacattaatttagctgattttttccaaatgagcaagaccatatctcagcaaatgaaagctgttaatgaggagaatcaggcagtgaatttcagatataagatttaaagtgtgtgcatgcatgcttcgtccttcaattgtttctgactctttatgatcccatggactgtagcccaccaggctcctctgtccatggaattctgcaggcaagaatactggagtgggttgccattcccttatccagaggatcttcctgacccagggatcgaacccaggtctcctgcattgtaggcagattctttaccgtctgagccatcagggacccacgatttaacctagtagaccagaaaccaaaagattttgagctgtgacatttgaagcacttccagattacattaattccttcgtcaattccagcatggtatcatttcccccccttttgtaacatgcaattttcttttccagatgataaaaaagtgctttggtcaataacatataatgaggataattatgataacttggggtgcagtaagatatgtattttcaatgtaattttgtatttttcatgttttgaatatctgctgacagatagtacactgcaaactggtgcagtgttgcctaatgatggttcattctacatgtgagttgtttaaaatctggatttacttggtatagattgtggaaaaccacatcgggaaatgaggatgaatcctaaagcgattacagccccacagatgttcggtcggcttgatgtggcgacaaatgattggaccgatgggatattttctactctttggaggaaaacattgagggctaagaaaggtaggag

SEQ ID NO: 27455 - DNA, 1195 bp, Bovine  19866881109957
ggcttaggaggtgtgggtggttcctctctgaattccatcattgaaagtttaattatgcagagcaactgtcctctggaaatgcagctgagctagttcagctgtcctaacatggtcttttgacctcagcctctgtgcaacttcttggaatgtgttggtttttaattaccaggcatagaaacatgtattaaattgtgatatttgccaagaattgaaacccagatctttccccagtgatcagtacaaagcagctgggctcaatttttctgtttcaagttagtaacgcctgtaattgctctgtgattctacatgcaattctttttccttgtcagaacatccattgatagctcccttcagagctctcaaacaactaagtttgttgggattcttctgtggtttgttttgaaatggcaggaattatgagagccattcaaaccgtcgttctggttatttttccttcctggtactcaggtttcctgacttgtacaacagttgaacatgagggttcaagtcatgcaacctctgtcacgctacagtattcttgaagcagatgatatctattatcagaatgtcatacagctttcatattttactctattataaagttgccagttattacatttttttgccaaatgatgcatgtctaccttttaaaatgccctataatcctaagaatgcaaacacaaccaattctcaatgttttagcataaaagcaagaggtagaaatgaccttttaggtcactgtatctaccttgttgtcaggtcacaacacggtccccagggaaatgatgcactaaatgtgtcatactttcttgcatggtgatgaattagaatgtctcagacatttagactgaaaaactttcccaagtcctctgatgcttgaaatacattttatatatagtaggtcataatgcatatgctgcaaaggtaaagaaggcaaagcagaatgagaaaatgggcacttgatggaattttaataaaacatctatgatattgagctagtttcttaaacgaaactttctttttcagtgcaataaaattccttagccttcttttgcttaaatctatttttctccataaaatatatttaagctctgagctagtgacaggattctctgtggcttatttctttgaaaaataattctgacagcgccacaaaaggactattgaaggattcttccctccggatgtaaccata

SEQ ID NO: 27456 - DNA, 1424 bp, Bovine  19866881142959
gagaaaatcctggtgaacaaaaaatatttcaacagagcaagaggaagcactgaaccaaagaaatctatgagtctctgggtcacatgtccaaagtatggtagcattctctactgctgttgtcgaacagaaatattaggttggtatctgtctgtgctgttttacttctctttatgaatcacattcattctccatcttaatctgtcacctcattaaagcatgtacacaactaaaattttctagttcatagatgttgatgaaaaggtttctgaagtaaaataattattctaaaattcagaataattttccctctggaatctagagcctgtcgagctgtcagctgtgcaatgaggcttgtcagcagcaaagctgaaatactctgcaaaatccaagtggctaattacatgttgcgttattttgcccaattgagagtctccaacacatcccccaaagagaggataatgaaataaaaacagtattatccatgctgtgccaagggctaaaattaaaacaagtacttttgatgttgaataaattaaacagagggtactgttgtgtttcttaattaatctcccttgaagtgtttggtattatagttctcaaatctcaggggaaagattgtcctacctgttgctcaggagggaacccagtaacatcaagctgtcttccatgttggcaatgatttctgacgtactgtctcctctcaggaggagctctccacgggttttaaagctgccaaatgtgaatgttttgttgtcccattcgttaatcacttgcttcagcttttgttcaatgtccctctctttcacggcactgatacagatgtcctattaaaaatgaaagctctcatttaatcacaccaaaagtcacacatccttcttgaatagtcaattcagcaaagatcctgtcttcactcctttttttatatgtatctataaatacttatatatttccagatccagactatagtatgtcctctcccacatgatgtagcagttcggatgcctgattttcacccaagcgggccaggttcgactcccagtgtggaaaggaagatctctgggggcttccaggtggtgctagtggttaagaatgcgcttaccagtgcaggagacataagagatgggggttcagtccctgggtaagaaagatgctctggaggagaaaatagtatccctctccagcattcttgccagggaaatcccaacgacagaggagcctggtgggcaacagtccatgaggtcgcaaagagtcggacatgactgagcgactaagcacagcacataacagtgtctacagagatatatagataaagatttaccctaatttgtaaaattttccaccaaactactccagaataaagatgacagaaacgatgtgcagaagtgaagtaccattcagccatgaggaaaaaggaaatcctgcca

SEQ ID NO: 27457 - DNA, 1430 bp, Bovine  19866881159295
ttgttgcagagtatgggctcaaggcaccatgggcttctgaagttgcagtgagtggacttagttgctcctcatcacatgggatcttcctggaccaggaagcgaacccatgtcccctgaattggcatgcagattcttaaccctaggaccaacatggaagtcccatcaaatttctggattaactggaaatgcacaactttttatccaactcattcaggttctttggtttatgagtcagtgtttattgatacactcaagattaggaccaagaaggaacatgtcagatgtgaggtgaacacctctatttgagcctctcaacaacatggaggcacatgaggaagattaggaagttaggagactgaggaaaagactaaggcaagaatacaaggatgttcaatcacaatgtacacacgtatctttgcttttctatgccttgtgttatatatctacaaaattagaaatgtagatgtgttggactgaggtcccatctcgtcaaatattggaagatttcagcattcagagaagggagaggatcaaaatataaaaaatgcagatactgttctggctatggcccaatgcctggatatcctatgatagcatacttcttaaacctggccctttatgatcaggccaacctgtgttcaaattatgactctattattctgttactaactgagtttgaaaaagttaccaatatctctcagctgggatttcctcatcatggagatgatagtagtccattccttatggtattttttgaatactcaattacataatacacttaagtgttagtcactcagtagtgtcagactctttcgaccccatgaactgtagcctgccaggctcctctgtccatggaattttccaaacaagaatactggagtggatttccatttcctcctccaggggattttcccaacacagggatagaacccaagtcccctgcatttcaggcagactctttaccatctgagccatcagggcagctcagataatccacttaagtccttgtaaatatcttgtgcatgataatattaaacattatcattatacatatcattacttttgttatgcccccttcttaacatgagggatgacactaaaatagagttaggttatgttatcagtatcagtatcagttcagtccttcagtcatgtctgactgtttgcaaccccatggactgtagcatgccaggcttcctgttaggcactgttttacaaagaattttgtttaccctttgtttcatcttactggttcaaaagacaatgatttcacccagttcagatagtctcataaataagacacagaacgattattctattgtaggtgttacaaagaccagtattaatcaaaaataaatgtatgctgtagaattcaatacatacatacatatatatatatatatatatatatatatatatatatatatata

SEQ ID NO: 27458 - DNA, 1104 bp, Bovine  19866881235017
aaattaatatcctgctggcaccaaaatatttatgtgtgtgtcatttttgttacatttgcctttctattatatgaaggaaatgtatggatgttagtctttcttaaaataatagaaaaagttgggacttagaataatttgaaggactttatccagattgataggatggccaaattgtttgtggaagtatatatgaccaagtatatacttggtcacagtccatagccatcaacccttctggattttgtgtgactgacctttcctcaaccacagaaaatcctctgatctcagccccttccctcttacaggagctaactgaatcagaatgtaaacttgacctacattcagctcatccaaaggttggccatcaacttataatactgcctggcttgaaaagatgagctggactgaataatcaaaataaccgtggcaattaaaataacttaaataaatcaaccctacaaatgtagttcatgtaattttcctttagattctaggttacctctgctttcaaaagtcccaatttaatcaagttagacactttcagataaaataatgagagtctaaaacttatttaggtagagtatcttcttaataatataaactcttggatgttgaaagatctggattctggaatttctatccatattcaggggtccttgatgatctgtaattcattctccaaaccatcatccatttgtgagaatgtccacatgctgttgcaatgcattctgggtgtgtatgtcagcatctcatctcacgccaggggattggttgtggttgggacacacagcagcaggcttacctttctgcattttaatgagtgggaagtctcaacactcattaagcctgaggttctgagtgacacattagcttcatgttgggcatggcggtaaagctatccttggtttggtacaacttggtgaagtttacttaattggaccatttagaatgaagttggaaatgctcttttctttcaaataatggcattttcactctcagcttaaagtttttttttctcatttagatgtaactctgaaattataatattagccagtagaaaaagtgattgccaagagctgtaaacattagaatgaggagacaaat

SEQ ID NO: 27459 - DNA, 845 bp, Bovine  19866881360851
atattctaagacggttgcttaaattttccttattctttacagtgtggtaggattattgattcacctaggccttgcaatgattcctcaacctgagctgaagaaccctgagcactgaagaaatctttaagggacaaccagggctgaaggtcgcaagagcattcaaggatctcccataaacatcagcattaaaatgcaattacaccaggaagtctgcaagaaaatcagtgcgcactctaaaggaaggctcaaagacctatttccctctttaattacaccaaaaaagattccaatcatacctcaagaatagggctccaatcaaggatagaagaactcatgaaaaccatcccatttcttgagacggtagcaggcgaagcgttgtcaatgttatgaggttcaaaaacaatcttgcagtttggagccatgggaatccgatcgccattggcaagggttagtgttttgttatcatccaaaacggaattcagattttcaatccagatggcatctactggaccatcaagaactatccagatatgctcccctaaaacatcccaccaagggcaggcggaagagcatacagacacatatatgcatatatacataactactatgcttgaagaaatatcataacaatgtaattttaattaatttttaaataaagctttgacctaaatgattatcttatttctttgcataggggtcttccagttctttatgtagcagctgtttaaagcacacaatcaaaacaaaaagtcatttgttccctgaaaagatgctcattgagcaccttctctgtatcagcattgttcctgagatagggtataaaaaagacaacatcctgcctgtca

SEQ ID NO: 27460 - DNA, 1229 bp, Bovine  19866881390498
gcaaacagtatgcttaactattaggagaggagattagcacataacagcctgaatgtgccacctttatttccattacatcagaaccaacctttcataatcttttttacataatggggtgagacatgatccagaaaattattatgaaaataagagcttcatgcctcttatctaatgtcatattttatagtagagggcaaatttcatttcacatttcctattctcaacagctaccaaactctctttctcatccctgatctttctttaaaggcaaaagtctgcatgacaactgaatgtcatgaactacatgagaaagaccatttgcaatcaacaaatgtagcaaaatttgttaaatatgtgatttgtgttcataaaaaccctcaaaactactaagcacttctactagtaatatcacttatcatttctgcatcaagagattagtcatcttcaatttaataaccaaaagaagcataagacaagtgagagctctcgatgacgctacatgacatttcagcattaaaaatgatcacgtaaagaatttcaaaataaagtctcattgcctccataacaccttagctcagatcatcagaaaatggccgaaaatccggctaaagactgaaaagaaaatctgacaatttctcttcataaagatgctctttgcctgaattttatcttttcttgaattcattcacactattcctggtgggtaaacacagagagtgtctagtatttgttcttctgtatatgccacagcatttataaagcatttaccaggtcatcaaagatatctcgctggtgcacatgaatagtaatcagagtctcatatttaactcgctccacggagctcaggtccttggttgtcatgtctatcaacatggtcagtagctccaggaaagactgattggttttctgcatgatttttttatcaaacttggcatttcgaagggcctcttctgaatcccgtgtccatatcatttgaattcctaataatccaaccttacggaaacaaaaaaggctttatgagtgtatggcatatgaatatatttaaatagaaattacaacagttgcgattattatgcaaatgccaagccatcctgtattacaccagcttgacgggttgcttcaaaatctatggaaaccctatgcatattgtttacctgacaattaaacatatacagccttgtgacatggctacaatttttttcatctcccttaaagtcatacctctccct

SEQ ID NO: 27461 - DNA, 1132 bp, Bovine  19866881627975
agaacctactgtatagcacaggaaactcagtgctctgtgatgacctagatgggaaagaaatccaaaaaagccgggatgtatgtatacatacggctgattcactttgctgtacaggagaaactaatgcaacattgtaaagcaactatactccaataaaattttaaaaagtaccatactcttaattctgtgtatgaaaaattgtgtaagtggacaaaatcgacaaatccaggcaaaaatgtgcattttgaactgggtgatttttgatgtacttttttttggttttatattgaattaggtcttaaaagaagtgacaatgaaagcacaggctgctgaaaaggtcaaagctgaggtccagaaggtgaaggacaaagcccaggccattgtcgacagcatctctaaagataaagccattgctgaggaaaaactggaagcagcaaagccagcattagaagaagcagaagcagccttgcaggtacatctttgtgatataacagatgtcatcttctagggcctcggaggaagattaggcagaaaagatgaaatacaatgaagaaatgttctactgtttcagaccaaagctctcttcactggaatgatttcaagtggtattttctgcttggagatgttatttgctttttttagatattgcaggtggcacttcacatattaccttctcactcacaagtgatgggcagtgccatataataggggtctgggtgccaccttctcatttcaactctgttactaataagctgtgtgacgttggaaaagtcacacaaaattcctaaaatagttttgtcactcattcattgaggatgttagagtaggttagtaagatacagctttctttgagtgtacatataaattatccaaacaaaggactgctgatctagtgctacgcattaaggtcaggctttgatcaggcttccaacacaatgcaatatgtggcaatatcataaatgatgaaattagaaatgaggttggattctgggaaaatatgttgactctagtgaagtaggctatgtcttcaagggctggccctttttgagactggtctagtttgagatgttttggattcaagtcattgtttttactgtttcgtccctggtggtccagtggttaacattctggt

SEQ ID NO: 27462 - DNA, 1141 bp, Bovine  19866881752473
tgagttgccatgtcctcctcccaagggatcttccccaacccagggatcaaaccccggggtctcctgcattgcatgcagattctttaccttctgagtcacaagggaagcctggatatatgtatctgtgtagctaattcacttttcctgtgcagtagaaaccaatgcaacattgtaaagcaaatatactgcaataaaaatgaaaaaaaaatagaagtctcatctaaaaatttacattgattaccactttatttacctctaaataaaaccgattttcaaaggttataaatgaatgttatgcaagaaaatttaggtacctcattctctgttttccagaattagggacattttggggtttttatgagtaatttctatcatttcaaacatttctggaattttaaaataatcgaccgtgtcttaggggatattttcacagatgtttctgttgaccttttcatttaacagaggacaatagagagctatgtggataaacgcatgggcaccacatatggccctccagcaggaaagaagatgactatcttcattgatgatgtgaatatgccagtaatcaatgagtggggagaccaggtatatcaatcctgttgggcatcttatttgcttagttcatcattgatttattttttgatgagtaaatggttttctgtttttttcaacttgcaattcctgaattccaattaagtccgttatttagatcctgggatataaaggaatgaccttttaattctgaaagttgtctttcttaggttactaatgagatagtacgacagctgctggaacagaatggattttataatctagagaagcctggggagtttaccagcattgtggacatccagtttttagcagctatgatccatcctgggggtggacgcaatgatataccacagcgactcaagaggcagttctcgatatttaactgcacgctaccctctgatgcttctgtggacaagatctttggtaaaatgaatgtcagtggggcgtggaaggggagaatccctgcttgggttgcaatgagaaaatatccacccagaggtccacacagaggggagcactgagtggttccctagtctgctgtctttatcactttcaagagtgtattttgtttgtaaaagcatttttatgt

SEQ ID NO: 27463 - DNA, 1637 bp, Bovine  19866880569067
ttaggataatggttgcagaacgttgatcataatagttcatcttcattcctaagcccatttgcaagcccacccaggacacattaagcccagttctatctgttggtagtactactttgctagagcacttggtaggatattagctctcactacacttgggtttatttttctggttctcagcctaggattacttgagttttaccttctggttgtcttgaagctgccaaatcaggcagacaaaaaacattctggaatcaggaatgtggtgttttgcttaaagacttgtaactgagcatggctcaccacttctggttctgtgcggaggctggcctaggtctataaatcctacttgaggaaggtagtatctttccaggaaagatgattcatctcttcagaaaatgccagcccacctggattgtactcttggttcttcaggaagccctgagaatgaagtatgtcatcaatacagagatacacagtgagattttaggaaccattatagcagcaaaatttttaaagggacacagataagtaatttgataccgtaagcaagtttacattctattcatataaagggaatatgcctaagtgattataatagataacagtaaatttaacagtaataataggaaagtaggtgggctgctgtctatggggtcgcacagagtcggacacgactgaagtgacttagcagcagcagcagtagcagcaggtgagtcctgagcctggggttgggaggcatatttctaagaaggctttctagaataggtgatgggtaagttgggtccaaataaatataatctgttacaaagggcaggaaattttgtgcagaaatcgtagcctgagaaaagtcttgggatcaaaatacaatatcgtgtttagggaacaagaaacaatttagtattttcagaagacattatataaagaagagtgatgggaactgaagttgtagatacatttagggttccatcctcgagagtcttggaaacaacgtaagggaaatttgagtgtagcctgtgggttatagatagatcttttagatctctagtaggaaaggtgatagatttgatagatttgcagttgtaataaattccctggttctagaaaagtaagctgccctgttgtaaggacagttgggaagcctcaggagaggcccacatggtgaggcactaaggctttctgccagtagccctgtgagatcatcatctatgaagtggatcttccagtcctggttaagttttcaaatgactctgaatgtgactgtggggagaccatgagccgacaccatgcacttaacctgcagaaactgtgacataagtgcttgctgtttcaagtgtctgcatttggcataacatggtctacaacagtagattgatacactgccttttgaggagaataaaacttcagtgcaagtagacaagttaggaggctgttgtagctgactaggttagaaataatataggtatagtttaggggaggtaaggcaatgccaaagagtgctcaaactactgcacaattgcactcatctcacacgctagtaaagtaatgctcaaaattctccaagccagccttcagcaatatgtgaaccgtgaacttcctgatgttcaagctggttttagaaaaggcagaggaaccagagg

SEQ ID NO: 27464 - DNA, 1162 bp, Bovine  19866880625060
ttaaggacaaattgggaagaaaagctgagttatggagatagagactgatttgagatattgatactataatgtaccatttgcagtgaaattgattccttgctcaagtatatcttgttcataaccacatattgacgtgtcaagaagcaccttggattctgtaactaatttgttatctggacactgtaatggatacagtgaaaaaattgtcttgtgacccatttctaattttccaaacaactttaaaatacatggtttaggagccagctggaatattgcttctttgctatagaagcaatccttttgaaactagaggggaaaatgaaagaaaaaaacaaaaccggtacctggaatctgtgaattttcatggtgctggacaactttaagaaagaaaagtaagaggtttaggaaataaagaccaatttaacaagagaaattttacctggcagtactgtttatctcaccaatataatggcctagttagagttttattttaacaccctatttattttagcagtacttatatcctgaatggatttgaaaagtgagtagattttttttttcaggaagttctaaaagtacataaagatttaatgatgtgttaaacagtcaaatagtctttataattcacaaaagactttttcacacttgaaaagggaagaaggcctcaccgcctctatttttgttaaaattataagaaaacctgtacattaatctttggagcaatttgagaggaatcaggaaactgctatttatagtgatacaattatagaccaagagatgacatgtggaacttggctaaaaggtagatgattttgttttaaatttaacagtagtgctttggttgttttccctttgtaacactcagatctactgagaagtcagactgtgttctgtgatgaggtggtaggggaatagggtaattttagtcagaggggatatttgcttctgatgaaatgatcatttttagaaaatataaatgtactctgaaaattgagtgccagattgtatgagcactgcttcaagtatttttttaagagtaagaataagaaagaataatacaaaaaaaagtctttgaactttggtatgaagtggccagaaaaatgtagagaatttgggacaagtttttgaaaatgagattgagattgatggtaccatcagagtt

SEQ ID NO: 27465 - DNA, 1312 bp, Bovine  19866880741418
cctccttataatgaagcaacatgatctgacaattctggtcttgttgcattttcttcatcatttccttattctctctctctcatatctctttttttaaaaatttttttttaaattttattttatttttaaactttacataattgtattagttttgccaaatatcaaaatgaatccgccacaggtatacatgtgttcctctcttcgtggagcttcagcttaggtgaaagctgaataatcctctctgcctactgtcaataaagggttagcaagaccctcctccttctaaatctaatttctatgtcctctttgtgttttgaaaggaaactttatatgtgtggaatgagcctaagtggtgcattaaaggaatttctttgcctgagaaaaagttgtcaacctgtgaaacagttgacttttggctaaaagtgggagcaggagtgggagcttttacagccgttttgctggtggctctaacttgctacttctggaaaaagaatcagaagtaagtaacttccaaataagaatgaggaatctcttttattgtgaaaattttaggcttaatcaccatactcaacaatttctcccagagccaaaagaaatttctcctagttgaaagagttatgggaaaggtctttaagaaggcagatggaattgttgttattctgataacagaaagactggagaacattagagataattgcactggactcactgtttttatgagatagagaagaacagaggctccaggctactcaggtagatgggagcagagctcagagcgaaaggcagattttctctgtgtgtctattttattttcatgacatcatgctgccttcttgccccatcattgttttttcagtttattgtgggcaaatatttgcaaagaaacagtctaagcatgtaggcaagtctcacctttatttactccaggacttcaaggatctgaagttgagtattgagtctaactaccaattatatattgatacattatatgattaggctttttaaaaatgatttacctgtcagtggggctgtgaaagttcttttttgtattatctaaggacagttataatctgaggtgggaaacagaaagcaatgagtgaaagaaatagtaagaccaaatcacttgcctatgtacaatgttctcatcttatgaagtaaactttggaaaactgcatattaaattagttcccaaatatttgtaaatgatgaaaatttattcatacctctaattttctctgtcttttcaaaagtttgtcacaattggccactttatgtgatgtaaaataagtgtaatagaattaactatattgca

SEQ ID NO: 27466 - DNA, 2099 bp, Bovine  19866880800508
aaaagatgataacgtttttataacccagaaaaatgtttttatgaggctacctgtataaagacttacagaaatcaatgtctatgaaataatttaagatgtggaatacccctgtttccctgccaagaattagctccaaaaggactaaggccttctctttttcagcagcttataataatgactggaacatgcaataattattgaaaatgcaggtgttagttgctcagttgtgtctgattctttgcaaccccatggcctgtagcccatcaggctcctctgcccatgggattccccaggcaagaatactggaatgggttgtcattttcttctccaggggatcgtcccaatccagagaatgaacctgtgtctcctgcattgcaggcagattctttactacctgagccatcagggacccatatttaataaatgaaggaatcctacttcaagttttacatttactcaatggctatcttccacattgaaatattaacattaatttctcttcatatctcataccttaagatttaaggattactattaaaaggattactttcaacccataaattataccattttcctaaaggcactttgaacccaaacaaaagaataccataaaaaatttttaatttgcacatgaaaagcgatatcaattgaattcaataagtccttactgaatgtctattatgttcaaggcactgaacaaggtactgaggagaatacagaaaagaaaaagttaccatgtcttcctaagaatttatcatctcacaggagagataggatatgtccatatgtgactatgctgctaagtcactttagtcgtatccgactctgtgtgaccccatagacggcagcccacaaggcttccccgtccctgggattctccaggcaagaacactggtgtgggttgccatttccgtctccaatgcatgaaagtgaaaagtgaaagtgaagtcgctcagtcgtgtctgactcttagcgaccccatggactgcagcctaccaggctcctccgcccatgggatttttcaggcaagagtactggagtggggtgccattgccttctccaatatgtgactatagtagcaggaaaattcaggagttcaactgtgaggccctagagtgagcaataatacttgtggctggcatgaatgcagaaagtatcatatttaaaaagttgcttctgttctggaccttaaacaatggttaaaatttcagaaagtggagagagtcattctagactgatgcaggggtagagagacggtgtggggaagctcctgagggagcagcgtgtgagctggctaagctgaaaggtggggtgtctgtggttcagaggaggtacagctctgcgagtggacagaacaatgattaatatctctccagtgcatgccaagtcacttcagtcctgtcaggctctttgcaaccccatgaactgtagcccgccaggctcctctgtccatagcattctccaggcaagaagaatagtagggttgccattcccttctccaggggatcttcccaacccaggaatcaaaccctcatctctttacgtgtcctgcattggcaggcgggctctttaccactagcgccacctgggaagccccacacatctcctgtaggccaagggacacctctgaaagcatataagcagggggatcctcaagcacaatgtgaagacaactatgaggaaataaaggtttgggagtcagggagatgagcgggctcgtatggcagccattcgggtgagaggtaatgatggcctaaactagggcagcggcaatgggaatagaaaacagaatgaatcgaacagacacagagatgacagtgcctggtaggtaagaaatagctgttggatgaaaaacaccagccaacacaattaagctaattgtcttcctccttctataataggaagggtcatgcagtatcaaatcctggatttaataaagggaaagcggggaagagttaaaaggctattttttaggaacttgagtggaaagaaaatgtaatattccaggtgctatttaaaaacaagacttagaaatgaaatcaatattttccacatgattagatctgatagtatttatccacccatagtaggttaaacca

SEQ ID NO: 27467 - DNA, 1300 bp, Bovine  19866880803492
gctcctccgttcatgggattttccaggcaagagtactggagtgggttgccattgccttctccaataggtgctggtactttccccaaaatcctgggacagaccaaattctgccacttatatagggtatttgaccttaggtgaggtactttgggcttccctggtgcctcagacggtaaagaatccacctgcaatgcgggagacctgggttcgatccctgggttgggaagatctcctgaaaagggaacggttacctactccagtactctagcctggagaatttcatggactgtatagtccatggggtcgcaaagagtcagacacaactgagggactttcactcactcactcacatttaagtctttccctggtagctcagtcagtaaagaatttgcctgtagtgcaggaaacctgggttcaatccctggggcaggaagatcccctggagaaggaaatggcactccagtatccttgcctggaaaaccctatggacagaggagtcgggtgggctgcagtccatagggtcccaaagagtctggcacaactgagcgactatcactttcactttcttttcaaggtacttattctttctaaacctcattttccttatttgcaagtggcataaaaatagtgcctttctcacaggtggttgtcaggaaaattaaatgagatgatgcatatgaggccctcttcaaggtacttcgcacattgtgagctcctagtgaatattagcaatcagagtgaacattggtgcaactttcagaaaaatccacctggacattaagttgaaaaaactacagtctctttagaatatatggaattatacttctactctattgtatactaaatctatgctactacttcagtttaaatgtatactttcaagaggaatattggaaaattgaggtgaatgtaaagtcagatcatgtgaaaaattgtggaagaaattggggacacttattttggagaaaagaagattatgatagaagaagctattggaagggctgtcactgaaagaggaatggggctggccctgtttgggcccgagttagaactgtggctgtgacacagatattttgctcccctgaagaaagacttccttacatgactgtctgcacttctcagctcactgaaattttttttaaagtctggaaagtcatttgagggagactggccaagaggattcagggatttgagatgggatttggctcagtgatctttaaaggccaatcctttcctgaggttcagttgttgacttctttacagtgcttaacatttaaaaccttaaaaaaaatctgcatcc

SEQ ID NO: 27468 - DNA, 1017 bp, Bovine  19866881052981
ctgtgttggttcaacctggtgtagcaagacataacgttcttacagccattgtccagaggtaaaaatcctttctctatttccattgtaattggataagctcatttttgttgaacaggagctcattttcagatactgcaaaagatactgcagtctttttttttcctttgccaaagagccatatgctgtggagtcattctctattgagaactctcttgatcatgagtctgtaataaattttcacatgagtctcggctgagaaggaacccatgctgctttgccattgtagaacaactgcaggaggaatatatgatataacaggtgtctcatatataatcttataaatagctatgttatttgaaaagatcatagtagctatagtataagcagtatgtctcttgcaatgggtaaaaaggaaaataaacctgtaatttcctgcttttagacctcatgtctctccttactgcaactacacttttataaagtaataaatcaaatgaagcatttagaaatttccctagcataggaggcttatatctgaaggtagaataaaataagtgaccagggttttcctaccattttcatattcacttggtaggaaaatctgatattatatagatattttatttttattaaattttaagtagaaatcacatagtttatttaacttctctttattgttatttaaacaaaaagttaaattcaagtcaatgaacttttttaaagtcatagattatacactataggtttgcagtgagtaaatctgtcatttccttggcaacaggccttcagagaccttctcagactcttaagagctattctttctaccccctcttcaacaaatgaccttttacaagagacttttaagcattaacttccttgatagcctgctgcccctaccctgcccctgcttatgtgctcatccaagctcatcctaaactcctttcctccaatcctacaggatgttccttctcttatttaaggctaatctattcttttgtgctttatgatctcatctcc

SEQ ID NO: 27469 - DNA, 2172 bp, Bovine  19866881059756
gtatttctttcatagaagcatcaggcccctcaaaaaaaaaattactaaaggtgaaggtaggaacagacatccgatagcagtagatctcagagaccctgatatcctaaagtcatacttgtaatgctgttcccacaccccacacacataagcaaacagccttcatatttggaagagaaaaaaagaggtcattctttgttttgatcagctttagaagcaaaggatcttcccagagctgatccccaaagtaaggcaatcaagaacggatgctgagaatcttaatatctgattttttaaaaataaaagcctttcctttcccatttcacctggcagtgtcttgttctaccagcatgggtgtacagtgtaagtgtacagctgtccccctcaaaatggcatcattttgagggggacaagctgggtgaacatgtaaggtttcacaccataaaatcctatagggcctgtgcaggttagaatgttgttgacactgatatgagtttgcatcagcatagactgaggggagaagagagaaatggagtgtgcccaatagtcttcagacctattatgtacccagacatggtcctacgggatgtgtagttctcttgctcatggtgatcattcaaatatatgtatgtcattatcattacaatcagccaagaggcttctgctaactaatgatgcccagatttgggtcccagaggagccatgggcatatggagattgatttttttctgccaaaaccttattcagaaagtcacttgtttaggtgataatgtgtgaacagctcaattaatagaattattcattattaccaagaatttgcccattataaaaagaaagcagtagtctaaaaagatcaagggagggacttcccttgcagtccagtggttaggacttcacctcccaaggcagagggtgcaagttcaatcccgggtttgggagctaatatcccatatgcctcagggccaaaaaaacaaaaccaaaacaaaagtgatattgtaaaaaattaaataaagacttaaaaaatggcccacatcaagcaaaagtcttttaataaaacaaaatggtaaagggaacagtcttctagcatcacagcataatgtgccatggatctgtagcaacagaaaggtaactgcatgagggccagattttgtacttatcagtggtcaagctttgaagataccccagttggcaggggcaagccactgttcaactctgaatagcactttataaaagacaaaaaagcacataataccaagtttcttctctacactgatagttcagaaaaacagtataacatacctgcactttacagttcagggagtctcatgacgactggccagcaaattagcaagttatttggcaacccacactgaagtgacggtcttcttcgccacaggcataagtatattataaacataaatcctgtctgaccaatgtaggaagagcctagagtttgcagcaagttaagccatttgcttcgggcagaaaacacctagtgcatccaaatcagatagacgtcaatccattttcccttaagaaagccaagtccacagcactcctgaaaacctctttctactgcctttctctccctcattgaggaaggaaggacagtctgcagctataataggtaaccccatatacatcagggaactgatgtttaatacctctccttttatttgatatttccatttacttgtctcacaaccactcttacacagcctttaaatcactttccctttacttctactatcttcctaggttttccccaagtaactatagcccacctcctttaatacagagactggagctgcaagggatgatatggatcatgtattctaacaaacacattcatagatgagaaaaccaaggtcccatctattaggtactttatggaatttgataactgaagtcatagataaaactctcaaaggcgtctctgtggctcctctggcctctctggagtttctgcctcggttcagttacagaattcatctcagagaccattctgacagtgagaatcttagcatctgcaaattcagtgatttcttttttttaagttcaaagctttctcttaaacacagcacatgacgtcatctttgttctaacagcacgggtgcagacttgtgttcctctcaaaaacccgtggcaaggagttcagcaccataaatcacgtct

SEQ ID NO: 27470 - DNA, 1118 bp, Bovine  19866881269208
gaagccctcagcgaacattgctatctgtaaaacttaatccaggtagcaagaatatagtctcgcaaacagccaacaaggagatgaaaagcagttttgcttgttaaggctaaaataattatatttctctttacaaccaaactacttcctaccaaataaaagagctggtaaaaatggtttgtagactagtacaagtttgaaatttcttcacccagctgaagcagtcattcatctttatctaagaaactctgagcatttcacacctttgggcatttattcctaatataaacaacaacttgaaaaatgatggactcgaagtttccagattttaaacacactaagaacaagagaggcaaagtgacctgctggtgattctaaaggctcagtagggcggctctgggaagacccacaagacctcactgggtctctgacctgggtacttcccccacaggcaggaaacctgctgtcttgtcacatgaattaatagttcatttcagacaaccaaagagctgaaataggagtctttacttgaaagtcttactctgatttgtgatttgtgctacttcatggacataaaaacacgaatgggtatcacagatctgtctccccatctggtggaggctgtttcttttgaatgttaataatacatagcagatagattattagtaatattttgtattttgcttaacagtttcaacgtaccatgtgttggtgaatataacataatggaaactgctttcacaaaatatgttgaaatacgtgccaatttgggagatgacactctagggtcagaaacagttggaatttgtatctgtctcaaggagaaaatgagatctggagaatataattagcagtttctattttgaagcatcttatttttccttaaaaaagcaaagaccctctacaagctgatgcattaatcccagtgatttctgtcaaggtccagatatactggtggccagaccatacctcacttcagaattaaggagtcaaaacatggggcttagatcctccacagactttgctcaagagctacccttgagaaagatgtttaaaagaatgttaaatcccccactccctccaaaaggacctctcccttagttcctaacagtgtctgaatt

SEQ ID NO: 27471 - DNA, 715 bp, Bovine  19866881282518
cttatagcatgttctaagtacaatctggaaaaaattaagtcactttattcactaggctgaaagccatgcttttctctcgtcctagtctactgctgcacggagtctacaaaaccacagcgatatgctcagacctcctggggtaaatgccgccatatagcctatagcaagaaaaaaactccaattgggaaattcaacatgggggactaaagcaaattgtgaatttgtaacatagtactttacatatagaactgcgaaaaaacaataaaccaaaaaaagactctcctgtaaatgtcttagactactatctctgaatcaagcatccaagagtcatagttttcataatgcttggatagagtatttttaaaaactttcagcttcatctaatataaaattaacaattacagttccccaatcgctgattctacaaatattcttaaatctatattatcctactcagcttgctatttgctaagtacatcacagtataataataatatattttataaaagcagttctgcttcatctgtttctgttgggaaacaagcatgaggattcttacataagggaatcagaattggttttccttacttaaatcctgggatatgcaagtttaagatcaggtaatcattatcggaacctccagccccactctggatgtgatctccagccacctcccaacctagaaaagataaagcttatcagcaaaaactccaga

SEQ ID NO: 27472 - DNA, 2552 bp, Bovine  19866881334187
ttgaagttgggtgtgaccctgtaactaatttctagtcgataaatgtgaacagaaacacgtgccactcccaggtttatacttttaggaagcaggttcaactacttcatactctttttctcctttcactgggtggatgctgatgagaaggaggccctaggaactggtacagcttcaagagggaagggacatgagttcctgaatcagcgtgtggaagagagatgcccatggaccaagaccttggcctgctgcacgagggagacataaactccattgtatttgaatgcttacataatttggatctatttatccacacacgcaagcctaccctaactaataaaatttgtctacgcatcacagagacatcagccacattctctacatttaaggaaagagtaaaagtcagcagtgtgaaatagtaggcacagaatcaaccagagaaggtggcataaaaacggcagcagatgttggcaagagacatgatgagcagcagctggaagagcggaaccagacacgcctagagagctgctgctcttcagttcagttcagtctcccagttgtgtccaactctttgcgatcccatgaatcgcagcacaccaggcctccctgtccatcaccaactcccggagttcactcaaactcatgtgcatcaagtcggtggtaccatccagccatctcatcctctgtcgtccccttctcctcctgcccccaatccctcccagcatcagagtcttttccaatgagtcaactctttgcatgaggtggccaaagtattggagtttcagttttagcatcagtccttccaatgaacacccaggactgatctccttgcagtccaagggactctcaagagtcttctccaacaccaagtttcaaaagcatcaattcttcagtgctcagcttttcttcacagtccaactctccagctataagagacagtgttgagggtacccagtcctgtacagttaagaacaaactttaaagcaattacatagtttctgcatatggtaggtgtcttcagaatattcaggttgtgtgtagatagacagatagataggagtatgttatacatggggcttccccagtggctcagtggtaaagaatctgcttgcaatgcaggagccacaggagacatgggttcaatccttgggtcaggaagatcccttggaggagggcatggaaatccacttcagtattcttgcctggagaatcccatggacagaggagcctcgtgggctatagtccataaggtcacaaagagtcagacatgactgaagtgacttagcatgcatgctgtatatagatggcttgcaaatatgtagtcagaatgattatcctccaaaacatgaaaatactacagttgaaggattatggatgagtgttttttttccatctgaatcatctaaactgtttaaaagaaaaataccatccatttatggtgaaagtattttttcttgactttgaaggagacaaaaaaaaatcttccttttaattatatacttccatgagaatatttaatttctatgcattcaataaataatacagatgtggttcaaagttctgtccaattcctatttggagtttttcaagaaatgaatatttatataccacacagactatgactggatgtttgccgttccccagttccccagttccccagttacgtaatcagctcctttgaaggcagacgctatattgtactcatggattgtcactggcacttggcacataggaggcattaaggaatgttaagtgaatgaatttatgaatgcttgagtattccagtagcttttaatatgtaaattcaatggtaattgataaattatctcagccttagaatcttgttccctgttatttcagttctgctaagtgtatgatataaagtcattgactgatcatacttaagacacctaaacagtgttcttttctttttcttttactttacacattacagctccattcatcgcaaataaaggtgtagatagcattgtcaagtttgacacttttggagatggcatgggacaatacaacgtgttcaacttccagtatgtgggtggcaagtattcctacctgaaggttggtcattggtcagaaaccttatcactagatgttgactctatccactggtcccggaactcaatgcccacttcgcagtgcagcgacccttgcgcacccaacgaaatgaagaatatgcaaccaggggatgtctgctgctggatctgcatcccttgcgagccctacgaatacctggctgatgagtttacctgtatggattgtggccttgggcagtggcccactgcagacctatctggctgctttgaccttcctgaggactacatcaggtgggaagacgcctgggccattggtccagtcaccatcgcctgcctgggttttatgtgcacatgcatggttgtgactgtttttatcaagcacaacaacacacccttggtcaaagcatcaggccgggagctctgctacatcctgttgtttggagttggcctgtcctattgcatgacgttcttcttcatttccaagccgtcaccagtcatctgcgc

SEQ ID NO: 27473 - DNA, 1296 bp, Bovine  19866881342820
aattagtgcttactatgtggaaaacattgtgctaggcacagaaaggaagatacatgtatagggcatggtcattcaaacaatttataatctggtgggagaaaagtataatacgcacacacacctttaaaacttttaattaaatttagaaagtgagtgacgagagaataagacttaaccactagaaatctaatgagaatactttaaattagacacaagaggaccgggctaccatagatcgatctgtaagttaaagcagacttgcaatattaagccaggatcagtttaaagacctaaaaactctcacttgagtttcagataagcatcattatttctctaaaatgggttaaaatacaatgtttacttattgtactcttcctacaactttagttcctgtaggcatggtatatatatgtaatccttgaattagttaaaaattttactgtctatattcaggcaatctaattatgtcattattcatacagtcttcagtgatatttagttcaaagttctgggcttcaatataattatcatcttttccgaaagaaactgattcatcattccatcaaaacttttcaaattgttgaaatgatccatcagttgctcttgcatttaaaattgtaattttagtatcttctaatgaatgagtatgagtgagtataggaatttttccctcttaaagcaatcggtttttattttctacatttcttaagtcatcataaagttttccagaggcattatggtttccttgttacactgtgatttcaccaaataaagtgcctctgtaggttagaatagtctccaaaacttgtgtttatcagcagttcctatgttgccaacctcttgaatattgcagctcaaaaataagacaaagctacttacagcaacagatcaagagactggcaaagcttagtgtgtctagtctattaaattatccaccaccatatgactgaaacctctggactaccataaaggaagaataagaaaaatgaagaatatatattcagtgttggggtaacagtcaggctttctaagactatctataaaaatttttgaaaatctgtcaaaggaaaaaacatcagaactaaatcagaggtcagaattaaaatcaaaggccagattatatgcagcacaagttttgagtgtggggattaaatggagaattacagttcatgtattttaatacccctgattctatcttttatttttcagtacacatcaccctcttaaagacctgtaaggatttttttttccagttcttaggtagccatctttagtagttaggacttggggtatggg

SEQ ID NO: 27474 - DNA, 1456 bp, Bovine  19866881877684
gatatatgcagatatgtaagtgtgagaagggcaaagagaatatgtgtgtgtgtatgtgagtgactttgatatggaagttacaagcatgcacctataattttttatctggggaaactttacatctttcatcaaatgtttgaaagagccaaggctctaaaaacattagtaaaatcacagaaatatccctgaattagaatttagaagttctagaattctagaaattctggaactccaaaattccctaataagattttcttgtaacacattcctcttctagaataaaaataattctctgcacttcaaatactaatactttgagtcttttttcaccttaatatgagcattggcatgaaagggagagcaggtgggagacatgtgatggggagtttgatacatcatgatgcacacattatttctgaataattctaaacccatgccatgatatttaaagaacttaaggtcagtttattgaacaaaatgcttcctctctcactaatttcaactgctaattttaacttcctctcagcaaaactgttcaactcctgatgcagagaccaaaccaccatctgcactcactctattatttccatcattaattgttggctacaaaaatataaaaatagtgcagctacagcttttccttctgaatggaatacaagctttcttttcaattcctttatttttttatcacctgggctaagaaagatttactactaaatgcaggtgttcatttctggctttcagccaaagtttctgcttaaggtggctgaattggagtaggtcatcactgatgcacgttttttgctttaactgtttcttacaaaatgaaggtaaattatgataatattctcataatttctgagcctctgaaataacttaattctcttttctatgtaattttaatcattaataatcataagtaataccttacgattgtctatttgtacatctatttgaaaatattagtataccaatagctatcaataaggtttaaaaatctaccttggtaaacagttgggcagtcgaaagtgaattacatatcaaaatttgaatattattttctgaaaaaatgaaattaaggcattctcaggataacagatttcaggatattttagagatttataaaaactaaacatattgcttacacataataaaccacagaaatattccttctcacaaattaaaaaaaaaaatggaaaagaaaaaaatatggaattttggctcatctaatttcacccaggatacttctagattaaattcagcaaggttgtttggatacttaaaaattgatatttatgttatgtatgtatatctatggaagttcaattcagtagctcagtggtgtccaactctttgcgaccccatgaattgcagcacgccaggcctccctgtccatcaccaacactattaatccttttatgtgcttttgcatttcacattaatgccaaatacatta

SEQ ID NO: 27475 - DNA, 1407 bp, Bovine  19866881954145
ttatgaactgctttagtatctggtatagtaatggaatctgcctcatggtccaactctgtgcaaccccatagacggcagcccaccaggcttccctgtccctgggattctctaggcaagagtgggttgccatttccttctcctgcatgaaagtgaaaagtaaaagtgaagtctactagaagtcaaaaaattaatgtgcatgaatcaggaaagatggaaagaattcagagccttctacagtttctcaacctccccctttactttaattaataagatgcaattttttaattgatcacaatgaaaactcataaatatggtctcaaaagttattaatcaatgagatactcaaaacaacaacattaagtctgtccagaagacacttataccaccagagcaactatctggtatgcagccttgagccagaaagggaatttagatctcttgaagtagaccatgcactacacacacacacatacacacacactcacacacacacacagcatgtctccataggtgttgtctcatattgcagacgcgggtattccttctagtctagaccactcctttccctggtgacagccaaaaaaaattaattccttctaaaattacccacttacagaaattttcaaatcacattgtgaaggtgtttgcttactttgcctaaaagaccagccctgattgtcatttctaatcactcatctaacaattattgaaatgcttactatgtgcctcttactgtgctaaatattaaagatgaataagacatggtttctgccttcaagacaactaaatcagtatgtgaaaatcactaagatagatgaactcacttactatttatggaagcaccatgaacaaacatatacattaggctggggagacaagactcatactaagaaaggacaaaccacagttcagaacacaagtgctgttgtcatacagaccagggcctggttctgagatgttcacatactagtctcatgacccagcctctttcacattcacttctctcacatgtaaatgttcaataaggacccacttgatttggttaaattaaatgagatgatgtatggaaagcacaagagtagcactactcaagtggatgcatatgtagcagtattcataaatatagcttataattcctctcttagatgattataataaggaacttttgagaaggtactaaagggtattcattttccagtaagagaaggtacatataatgccaaatgcctcaatggtcgcagaaacctgcagccttactcacttcccagcagcacctaaaattccagaaactaaatacaattggcaacccactccagtatccttgcctgggaaatcccatggacagagggaccctggcaggccacagtccatgcagcaacaagtgtcagatacgacaaccatctccat

SEQ ID NO: 27476 - DNA, 1516 bp, Bovine  19866880459642
tactgaaatagaaacgtgtgtgtgtgtgtgtgtatgtgtctgtaaactttctacaatatagagaatatgtgaatgagtggcaaaatcaggaatgggaagattgatatgccttactgattagaaactacaggttgaataaagaacttatgtcaagaattgttctcaaaaagttaagtataggcaacttctcagttcctcactagtataatgagatgtgtccagtggacacattgctggtggaaagaggatggacagggcaatgaggttccctcctggttatagcaagtctggttttaaactactctaactgctaacacagcaactgttcaggagaaaacagttgttgagtatagtagaattcaccctgttctgaggagtctgctgctgctgctgctaagttgcttcagtcgtgtccgactctgtatgaccccatagacggcagcctaccaggctcccctgtccctgggattctccaggcaaggatactggagtgggttgccattttcttctccaatgcatgcatgtatgctaagttgcttcagttgtgtctgactctgtgagaccctatggcagcagcccacgaggctcccctgtccaggggattctccaggcaagaatacaggagtgggttgccatttctttctccctctgaggagtctgagttgcctcaaacagaggtgcctggctgtgagcttcccactataggaggtacctcagtcagttaaccaaaaattaatgagcctagctcttccagtctccttaaagccaacatgtcaaagaccaggaaaatttctcatagttagaagtttaaggcagagaatccaaaaattttaagcatagtgtattgaacattctgttagtttttattatttggacatttcatagaaaatttatatttttcaagaatagatacaaattttattaagattgaaaatataaaagttaatagtatagaagaaataattagtaggttgaaagacaaaggagagagagtccttatttcaaccaaacagaatgaacatgtctaacaatcagcattgttttgatgtctactcaggcagagaaagccaactacacagcagggactacaacccaaattacttgaccatcttcaccttatgaaactccaggggaagcataaagaaattaacagtcatgttagaacattaagcatgtttacagaatttgttgccactctagcaatacacagatatgcacaaaaccactgttagccaacaaactggattatcagttgactcttcaaaaaaccacccacactcaacaagtatatttataacctgcactgtttattgtctttttttccactcaaaagaataaaccatgaggaatcaaatactcaagatggttttgaggtaaaattgctagttaacgagctgtgctgaattgtttcctcagccacagttataaacgacttcagacatgctggttgtttcaaatgagccacgcactggtgaaatgaagatagaaaaagacacttttgaacaagatttgggga

SEQ ID NO: 27477 - DNA, 1392 bp, Bovine  19866880469315
gcccagaggtctcttacctactgtaagagaaagttggatgatcacttttcctttcctgacaaaaattggaggctgttcgagtgattatctgccatctgttgtctacagcagttcaattgctgaagagtcctctagaaggggggagaaagagctcattcttgacggaaggttgaatgtacattcagaggtagattcagctgagcaagtgcccggctaatcccctttgcacacagggacaaggctgccaccaactctaattgattctgaaatgaatctgtatagaaaattagaaggttttggattcccatgtgagcttcaataaagagccaggatgtaagcctgacagctgaatggattcagaaatgaaaatctgataagcggcttaaaactgtacttaagtccagaaatgatttgaatgctgttgttaatggcacattgtatgttgtcacctagttaattatctctgaagatgagttcttgtggaggagaagagatgccattcttccacagcttttcctcatcacatatttattaacttccccctctttccaaactatcatcgctagaaggcagaaagaaaggattaggccactgcagctcctctgtggctgtcagttcactgtgccagacttcaaatatgaactgttgcatgtactgtcactgacatttccttttacatcttcatttgcaaatgaggagctgacatttgttaggccttgtatttgcacacagtcccaccacatgaaaagcaaacactgtcacactggctactttgtttattcctttgcagatagtatatggcctatttagaaattttcttcagaattttttttttttaactaactgagatagatagtcacagagctacatgtcctcatattttattcaggaagccgtctgcgctttatggagcgtgcatggcatttgatagctatttaaaactgtatttttaaaaccaatttgcacttttctggcttatattctttgggtttattttctctagataaatgtaggttcattttgtgatttaagagatcaggtttcttacctatcaattttcttgtttagtaataggaaaatattttccgccaaatgaaaacaatgaagtgaatcttaaaaccataatgcattttctaaatattgtttttggtttattaaagtttcatcttttcaaaggagcttgacaatgtcaacctactcaacatcattaagacaatcatctgttattattaagggcctttcttgaaacagaagcttgaagacagcctcatagagcagtacgtatgcctagaggtaagctgcattcctgttcagaaacgtacaggcttgcttgctaaggtggtcacaaagggttgattacacacttaactcccaaagaactgagaattctgt

SEQ ID NO: 27478 - DNA, 1105 bp, Bovine  19866880495512
taattggaagtgtcactctttggtttctcatccaacagttgtggcttgtgtggatgtcatgttgtactaatcatgacctctttcatgttaagagcggcttctcgctgcatgctcaaaagaaaactatgcaatcagttaccgtttccagattgtaaattgtaaattccctcgtggctcggatggtaaagaatccgcctgcaatgcaggagacctgggttcagtccctgagtgaggaagatcccctggagaaagatggccaacccactccagtattcttgcctggagaattgcatggacagaggagccttgtaggctgctgtccatgaggtcacaaagagttggacactgagcaactagcactttccagaattatatgcagtaccaccaagacctggatcactacatttctataataatttctaaagcaaaaataaaaatactttctaagccaagtattgtatgtataaatatatagatataatttgtcttataaaagcattacagatatattttaacaaaagataaaaaattagtttgacatttttagagcatggtactatctgagagaccaaacataagattttggttttatactgatggaaaaaggtaatttatgcaaacatgaaagcaaattatctaagcaattatgaaaagatcaatgataagcaaaagtgaaattcttttaactatcattgccataaggataagagtgcagccagtgtccaattattgaaaataaaatggtataaaattaaagtcgaaaaaaaaagtgaaaggttaccaaactagctggtaagcaaataaattaaataatcaaaatagtgaaagatcaaaagtaattgatacttttcacagtactttcaaagaatcttagtctaagcagtctaggtatctggttgaagagtattgttttaatgagatctgcttactcctttcactgatttcagattgctttgcttataggaaataaagggaccataaaatgttaagtttgtgagagatatttaaataattagtggaaaggcacaaagtgacccatttacatttttttttttcattagtaaaagcaaacaccctactaaaagatctttaaaatttccttttt

SEQ ID NO: 27479 - DNA, 2509 bp, Bovine  19866880542582
tggttgagttttcccctttgtgtctagttgacctgtttctctttactgcccaagttttgctgttgttctgtcggtctctgacaaagttccttgctgcacagtttttacctggtgttagtggttattttgtatcgttggttctgctaatacatttgtaatgaatttaagagttaactttaaagaaaacttttaacatcttaatttaataaagctcttcttccttcatttatgctttgtgaaggtctgtcttattttgttttgtctcattttgtttttgcaaatagcatctcttctctattgaaggactcttaagggaatctttgccctgaattgtagtcaacattatcatcctatatgtcagtgacaggcaggggtgcattgtctgctccctttgttggggaaagcaatttctcatctcatttccaagaaagttgacactatattgggaagtgacttgatacttccggtaccacatcgttaaacagcttcctggcagcaaaagttcagggataattgcatctatctagttcaaactaaattttatccagacttcatttattctaaatggcatgattaaacttgatatatacaaattcacaaacatattagtcaaatccatgtaggtactttaggttttatcttaattttcaagtactaatatctaacttcaatctctgtgacttaaaattgactctatgacctgaaatttttaaaaagacagttaacctgagttaacactgaccattgaaaccatgcctttggtcttttttattttactaagatataagatattatgtaattatggctgtatttcacatagttttgatacagaaaagcaattaaacattctctttgcaagttcccagagattagattataaaataagaatggtggtatgactccctgttcacatctccacctgcattttgagcttcttttaatgattgcctaacataattcccaccagactcattttttatgtttttattttctttccttctaaatttaagtgaagctattataattgactttacatacctgggaaagacgcttgtcttcaagacatcacttttcccctctatttttagtcagcaatttttctacctgaaacctttttaaaaataagcaaataaataaacttatcaaattatatatacatcaaagagacctaaatgaggtattattttcaaatacgtatcccaaagtttttttcaactaattctccacttattccaagattcagttaattgaaggaatacaagcttgtatttaaattccaggtgctatagatgtcatctctctggttctttctaatataaacacattgtgtgaaaagccattacctcttactgtgtttttatttgggtggacaattaatttaacaacttatacaataaaaaggaacatataacacttactttaaatgaatttgattgatttttatatgtaagtactttcagttctggaattaaaaaatattactcctaacagtgcctgtatatatttgatcattataaaaaggagatctttacactcaatttctcctccttcacttgccttagtaaccacatcaagttaatattaactactgtttccaaaatgtcacttgttactttgtaatcaaatatcttattcattcactaccaatgcaacatgaatctatctcccaggaaattgaccaagttccagttgttttttctgggattaaaatatgctatattaaaaaacttcatgaaaaatcaaaaaatgcctgtataaaaaataattagtattaagaaatttaactgtgagagaaaatatgttaatatacaaataactactgcaattatttaaaactaatagagacattttttgtatttctgttatggaaagtgagtaacaaacaaataaatataataaataaaatgtaaaataaaccctatttaaatgaagtaaaacagcaatttttaaaaatgtaggtaccttattactcttttgtactatggacttacctctagtgatttgtttatttttcatgctgttatctataaatagtaatatgaagtgatttgtcaaaaattaagttctaaaaaaacatacatataccaagcatatgtgttaaaatgctttacaaaaatattagagaacagactctgatttcaaatcccttttcacccctaaacagctctgtgctcattatcattcatgtagcatagctgcaagtcagtttctttattagtaaaatggatataattataatctaaaagggttaatagaagaatgaaataaagagtgcatacaaaatgcttagcactatgtttgactcatgtttgatagtcaattcaggataatattaataatagtaatttttagtagtaatgataaaaaaatcacagagaaaaataagatgaaatggcagatagttaacagagcctgaggtctgctcctgttcaatacatataaatatatcaaaaagtaagagtctcaattaaataggaataaagtctaagagataatcacattactagaa

SEQ ID NO: 27480 - DNA, 1008 bp, Bovine  19866880569273
tgaatcgcaatattcatcttttttagaaagctatcttcttcaatctacttatttatgatgcattaatttacaggacaatatactaggaagatgactgctctaattcaccttaatacctccagtaatgggaactcattaccagttgaagaagtctctaatgtgactacagctaatgtgttcttgggactaatttagaaaacttcagggaatctgctgctgctgctaagttgcttcagttgtgtctgactctgtgcgaccccatagtacacaccttcaaatataaaatatttgagtgtgtatgagatgaactgatgtatcagtatttgaatacatgtgaaatagcaccctatttctcagtattccatatttcaagctattccagtgctcctcccaatcatatagcttcacctcttgtattgagatgatagggtagaatgtaaaatagcaagaatcttgatggaagttaaaatcttagcttttagggaagggatataaagaacacttgttatataatagagttagatgtgcaattgaaggggcttccctgatggctcagatggtaaagaatttgcctgcattgctcgagacctgggttcaatccctgggttgggaagggcatggctatccacttcagtattcttgcttggagaatccccatggacagaggaccctggcaggttacagtccatgggggtcacaaagagtttgacacttaagtgtgagtgataatttctattccctgaagacctgataaataaccttgcccctgaggaggaagggagtcagagagaaagtgaaagaattaaatgctgacttgagttcctgagaaatatgggtattcacaagttcaaattttgttagtggggagggttggcaatgaaaccaataattttgagtgaaacaaattgatatataataaatgattctccagttatcactcctgctcttagaaaaggcttaaataattcaaaacctggagatcccatcctcatagatcagtttttccaa

SEQ ID NO: 27481 - DNA, 2205 bp, Bovine  19866880605200
cctggcatgctgaaattcatggggtagcaaagagttggacatgactgagtgactgaaacttgacttagtacttagtaactgaacaataataaaaccaatttggggtaaaaagaaaaaaaaagtgctacttaatttttagtctgcattctgcttgttttctattacattttactcagttggaacaacacaattagatttcagtatttttttctccattttgttctcctaggctacactgaatatttaaattagaaaaaactttattgatttttttcttttatcatgaaaatgttcctctcttattaggttagtgagcgtatttcttaatcgaacttaaatttccaacctgaatttctttgtagtacaacctaatgtcccatgcaataatattatacctgtatttgtgtcaaatctaattatgaagtcttgatttgtgtaatgtgcgagaaattatttccactttccctaccatgcaaacagatcaattttctcattagccttttccatcagtcttgattgctttaaacttatgcttttcatattactctgtttcctggtcaaattttgtccttacttcatgtatagacagatttatcacattttaagaaatttattcatgtggacaaattaactatataagtcagtaaaagtgtgattttttcactattttaattattatttactttgtcccatcatagtctttctacaatcttgaattgatttatttttgccttttactttatttcataatttaagaacaaataaggagataagccacaaagtaggtgacaataaaagatgaagaggaaaaggggcacaaaactcatgttaggagcacagctttggataaaagactctaaggggaattctttgggcactatgctctgacgaaaggagttatgtggtggtgaataattttcccacagatcttttgttccttgatgtatttgatgcacaaataaaaatatgggttgaaagtttgcagaatgtagtttgtgtgtttacaaagggggctgtaaagtgaatgtgctgatgtgtgtgaaaccagacgtgctatagataatgggcactattaggaagatatgttcagaaaagggtgaatgcttctgtgaatgccaaattgtatttattgtctgcatgtaacaaccattcaccaagtccatattcaaagtgttttttaataaatgctttcttacaagaaagttgattctgtttcatcagtggaaaaattacagtttagttcagtttagtcgctcagtcatgtcggactctttgcgacctcatggactgcagcacgccaggcctccctgtccatcaccaactcccggagtttactcaaatgtccattgagtcagtgatgccatccaaccatctcatcctctgttgtccccttctccttctgccttcaatctttcccagcatcagagtctttaccaatgaattggctcttctcatcaggttgcaaaagtattggggcttcaacttcagtatcagtccttccaataaatatttacaatggatttcctttataattcactggtttgagctccttgctgaccaaaggactctcaagactcctcccacaccacatttcaaaagcatcaattttcagtgctcagcctttttcattgtccaactctcacatccatacatgactcttggaaaaaccatatctttggctatatggacctttgttggcaaagtgatgtctctgctttttaatatactgtgtaggcttgccatagcttttattgcaaggagcaagtgtcttttaatttcatggctgtagtcaccatctgcagtgattttggagcccgagaaaataaagtctgtcactgtttctatttttttccctatctatttgccatgaagtgataggactagatgccatgatctttgttttttgaatgttgatttttaagccaaatttcccactttcctctttcacctccatcaaaagctctttagttcctttttgctttctgctgttagggttggtatcattcacatctctgatgggtttgaaatttttcctagccatcttgattccagtttgtgattcatccagcctggcatttcacatgatgtactctgcatataagttaaataagcagacacatccacagctgagcatcatttccactttgacctggactcttcattctttctgggagttatttctccactcttccccaataaaatatt

SEQ ID NO: 27482 - DNA, 1026 bp, Bovine  19866880746980
attaaaaaaagaaaaaaaaaaacaggaaaaaataatgaacaataagagttgtggttagagaggagttaaaggaacttttactttaactcctctatgtggtacattttatatatatgacataaatacatgagataagcataagttcatgaaaattaagattaatagaaagtaaaaaagatccacagactgtgttgatctgaaagaaaagtttattcttttacgagcaattcttatatgtcaagaaaaatggcaactcaacatatgtatgaataatctttgtatagtaatttctagagtttggatttatactctatgcacacaaaattttatctagaattatagcaaggagaaaaagttgcttcttataatatgtattacttgtgttttccaaattacttggttcataaattcatttcataaaaggagtcaagataaaacttcaacataacttcattgagatcactatatatggtgacagtcataaggctgaagaaatgaataaattattgcatcatctctccctttgaattattcaaccttgtttcttactctaattctcttatttaggattgggcggcctgttagtttagttactgatcttgatggtctgcctttgccttcacttttagtcagtatcttgatactagtaggtgtatcaacttcttataatagtctatatcttttaagtagcatcatgatattcagtgttctttaacattcagtttatcttttgaatgttgaacctatatatcttcatggggaatctgtatatcacttgtggggaaggtcagaagtagggtctaagattatgaagtataggaaagtcaatgctttggcttaagatcagagttacaatcttggcattcttcacctagtcaagtactacatagacacatttctaattaacactgaactattaatacctactggaaaaggaaatagcaacccactccagtgttcttgcctggagaatcccatggactgagaagcctggtaggctgcagtctgtggggttgcacagagtca

SEQ ID NO: 27483 - DNA, 1027 bp, Bovine  19866881051622
tttgaacatcaagttttcctttaaatgagccagataaatacataatctggtcattcagaaaataccatatgctatgatactgcattggagaaggaaatggcaaccccctccagtgttcttgcctggagaatcccagggatggtggagcctggtgggctgccatctatggggtcgcacagagtcggacatgactgaagcgacttagcagcagcagccagcagcatgatactttcattggaagataatacaaaataggtaaacagttaaaaatatatatgaacttaccattaaccaggttgctagtgtgtaaaaatccatgttttttagcaaaataggacttattattacactaaaagtcagctgaagtgtcagatatcattggtttgtaaagtatccttgatttaaaatggaagaatcagctcttgaaacaaagagaaaaatgagctatatctttggaatattcttttttgaggcccattgagagaactcttagagggctcctgtgtcttaggcatttttattcatattgagtgaaacccagccctgcattgtcatttgcaaggtgcttgtttaagttatctgaagctgaattatgagagcaacttcattctgtaagtgtttttgctttttctctctggctcttcacttatcttcaaagtctctgctagggtacttcagtggctataatgaagtgaatctaaattattagtttgaggccagcaagagacctgacatgcacacgaaatattcttcatgtttcactgagctaatcatcctaaaggatttattctgtcttgtataagctcttactcagctttcatttttttctcttaagtgtatcttggggtggtttagctcaactaagttttaaaatgtcaacctgaaccttttagtagaagttgtcacttctttttttttagttaacatactttgttgatgatttcaaacttaaaaaaaaaaaaaaaacattaagactcttatcagacaagacttaatagtaccctatatttaacacaaaatatacata

SEQ ID NO: 27484 - DNA, 1926 bp, Bovine  19866881180006
aattcaaacatgtactttaatttcccaaatgtggtatttctttactagaagaggttaactttggatttttgccagggtgtgttagaaactccttaaaatattgcctcagtagcatttccttgcttctgacataggcaaacaggtcaggctcagttaatgcatagaaaattaagtattattgcaacatgtattaatgaaaagagttaacaaagaaatttcaatagacactattgacgttgtccactgagaccttttcagatgataaccagtcctcagaagtaacacttctgagtatattgtaacaatgttaattttcatctaagatattaaatttaatatgtgttccgaataatattttacctgctgaatacatttttccatatcacttgattttttttaagcttagaaaatatgtcagatcaatgagaatgaactgtagctgcctcgcttaggaagggaaggaaaaaaaagcccaagttatgtttatttcatcactgaaaggtaccttgagtcacagggggaaattctatgatttccttagtgattgaaagctttctctatgattttcaataaaagtttccaagacaatggatgtctttcataaacactatgtaacctagtgttaattttatagtggacttctgcatacatgaactagatcaagttcccttgagaaattcccgtaagtgtgagctacagcatattcatcaggtcattcatcttaatcttctaccgaagaaaaataatgttgcatgtggagagtgttttaaagtgactgatgaggatattgaaagaacaataaattgcttgtcttaatgaaaatatattgatgtggaaagtgaaaatccttctctagttgctctaccttgtttaaaaaagaaagagagcataagagacaatgatcccagatcctcctgccctactgtgctcactgtgacaagccctaataggtagtgactccaatagacagaccaggaaccaagcaacatggatgtggcaagcatatcgcatcctttcccaggatgcatctgtaaattcctgtatacgtcatcaatgtaacttacctcacaaatagaatatgatgaaaattaatcttcttactttcaacacacaatgatttggttactgctttgctctctgtatcgctctcttatcaccaacaacataccatcaaactggccatctttccttttcccagatacacccattttgctttcatctaagggtctttgcgctagctgtgccttctatctagacctttattccatgaaatttcacaggctgacactctttgcatttgtaaatcatttctattgatatttctcatatactttggatgaataatttactgtccttgcctcttcagagtataggctccatgagacgtagaacttctctgtcttgttcactgctgtatcttcagtacctgtaagagggtaggccagagaatagggagtccatattcatttgctgaatgaatgtgtcagtatatcaaaacaaacaaatgatgaaagcataatacacataatacaatgactatcacaaaatgactaccatattatagtttacctaaagtagctaaactttaaatcagatactttcaataaaaacaaaaaaacagatgcctgactcttgaaagtggtgtaaagaaatagggaacatttgaatctttaaagaggcatgacatatttatgtatttttcataaagggtcattggtttaaataaagttgaaaatacttgcttcagtgactactatttaaaacctaggtagtcccccatgtttcctacatatgtgtacatatatgatgacatagaaaatagtgtgtagtctcagtgataaagggagtaattttttagcttccttttaaaacccaaaggctggtatgttcttcctttacctgttgcagcaaatcctttttgtggtg

SEQ ID NO: 27485 - DNA, 722 bp, Bovine  19866881820528
catccagagaatgacttgaataatgaatccttttaattactggaaaagcatgaagtagaccttaagtattttggaggcaagtctagctctttgtcagtacaaaaccctgactcaagaaaaaatggtgaaaaaaattgttcttttattcctgggcttaagataaagcaaaaagaagaaatcactcaaataaaatcttaattatttatcagaaaatctattcagattgaactatcattctgagtatttccttttagaaggtgataatttctaagaactattaattttatgattcataatcaacagctcagtagaaactcagcttacataattaaagctcatgtatagaaattgtacctgtctatgaatcatgttactgtggcaatcattattttagtttacaccaatattattttgatatttttctgacttactttaactattggaattaccattaaaacatttcttctacttctagggtggctcactcctcttttctaaaaatgatctctttatctgaaaataccaatgcattccatagagttgttaagaatttgcaatgtgttgggaatgtgaatacctcctttgagatgttttttatatggaatttatttttgtagattgatagccttttacttagagctggttatgttacttttttttttttttttaggttttaactgcatggcaaaatacacttttgcaaagccttaaaaatagcaaga

SEQ ID NO: 27486 - DNA, 1448 bp, Bovine  19866880495330
cccaccaggctcctctgtccatggaattctccaggcaagaatactggaggggtttccattcccttctccaggggatcttcccgacctagggatggaagccatgtctcctgcattgcaggcagattctttaccaactgagcccaccagggaagcctcaacccttatatgctagacaataattattcctcaccatcagcacattggaggaaaaggaggaggatagggacatgcttgactctttgtctttttatgggtggggcttagggggcagcagtgaatttactacatccagatcattcttcagttctcttgagttacaaatacaaatatgttgtttactatataatgtcttttaaaagaaaaaaaaaaacatttttgtctatgtactgtaggtattgttgcaactaatgattatgaaaagaaagtctaagctgctatatcttttacactcgccccatggaaacatcagaagagagtggcaagcctaaaataagaaaggagtctcagcaaatggtactctagaaatcctcctaaaatctcaagctccagcttcactgaaataaaacagttaatggaagtgtcatccctgcctcccctctgagccaaatagacctgtctcaaactgcaacagatgtgtgtacaccagaaggaggaaggtggcatctgtgctgtgcagcactgtatattttcctttgaaatcctgagtgtggtctgattcagactccgttatgttttcgtgttgtggagctatgtcgacactgaatatttggaaagctattgtttccacagcttgcgctgatttatgcttcattctgtttggaggtctttgtactagctcaaacctgaatatcatgtgcagtaatgtactagaagactttttctcactactttaaaccacatgctcttagatcatctaagattgttttgttaactgcagttggattatcatttacaaaagaagtttcaagagattcaaataaattaaggaaattccatctaaagctgtaggcatgaacacatctaatcttctctagtctggcaaaacaataaaataattgtgagaaagtgtaaaacttctcttagcaacatgttttttttggggacagggtttaataaaatacatgacttcaaagctattttcatgttaaaaataaattaactttctatgtaagtcagttttcttttcttcttagagatagttacaaaaaattataagtaaaaatttttagaagcaaagaccacatattttctagaatgaaaaaagctattttgaagctaaaagggagggaaggaatcatctagacaaaatcctcaatttccaaaagctcctattttacagaatgcatcagtgtcaatttcatggacagagcagcctggtgggctatagtccattgagtcccaaagagtcagaaaaaactgagggactgagcatatacaacagacagcag

SEQ ID NO: 27487 - DNA, 2493 bp, Bovine  19866880504845
ctgaagcctgcgtacccagagcccaagagaggccactgcagtgagaagcccacggactgcagctaatgagtagcccccacttgcagcaactagagaaggcccatgcacagcagtgaaggcccagtgcagccaaaataaataaataaactttaaaaatattgaaaaaaaggagactactatgaataattatatgccagcaaattggacaatttagaagaaatgaataaattcctagaaacgcgtaacctcaggctgagttgaatctatgtgtgtgtgtgtgctgtcatgttggactgtttgcaaccccatggactgtagcccaccaggcttccctccatggagttttccaggcaagaacactggagtggattgctatttcctcctgcaggagatcttatcaacctagggatcgacctgcgtctcttgtgtctcctggtttggcaggtggattctttaccaagccctgcgccacctgggaagcataaggctgaatcataatgaaatagaaaatctgagcaaactgattactagcaaggagactgaatcagtaatcagaaactttccaacaaacaaaagtccaggaccagatggcttccctggtaaattctaccaaacattcaaagaattaaaatcagtccttctcaaactctccccccaaatagaacagggcagaattcttccaaacacattttatgaggccagtattatcctgataccaaaaccaaataatgtgccacacacaaaaaattacaggccaatatccctgatgaccacagatgcaaaatcctcaacaagttcttagcaaactaaattcaccagtactttaaaaggattatagaggagtggtggggagcggcggcagcggcaggctgaggggacgcgcgggcagtggagttgccctttcgcatggccatagtggggacggctgctgctgcgccgccaaacgggaggagcctccctagcagcatggcctgaccttcggcctgtacctgctctttgacctggagcagtcgcagtgcctcaaggagagccatgagggcagcggccctggcgtctttaggccatgggaggagctgactgaccgctccaagtttgttgaaagtgatgcagatgaagagcttatgtttaatattccatgtactggcaatgtcaagctcaagggcatcattataatgggagacaatgatgacttacacccctctgagatgagactgtacaggaacattccacagatgtcctttgatgatagagacaaggagccagatcagacctttagtctgaactgggatcttacaggggaattagagtatgctacagaaatttctcatttttcaaatgtctgtcatctctcaattcatatttcaaaaaaatttggagctgataccacaaaggtcttttatattggcctgagaggagaatggactgagctttgttcacatgagatgaccatctgcaattatgaagcatgagccaatccagctgaccacagggtccatcaggtaaccccacagacacactttatttcctaaggtctggctaagactcccatagaggcgttgtgtcattgaagaagtatgacatcctgttgggaaggacaaagagagatggggcttcaaagagagttggctgccacagcctctgccaagctttgtctttggggcttgctgcagaaacctggcctgtggaaggtaccacacccccaggaagggttgtgtgggtagcagggaacaatcgtggttctctagggccctacagaaattgggtcttgggctgatcagtatctggcagccatggataatgcctgccttcccagtttatgtggccatgggatcccaagtgtcttgttgctttgtggcaggattattttatgacttgttttttaaaatggaaactattcctgggctgcggtaaactttttgaagcctcagcattgtgtttgtattaaccatcaggagggtctccaactagaaatacttgtccctgcttgctccttctccctgtcatctttcaacattcttgtcaagttgctcagcttggagttgtcagtcatgcacagtgtcccacgttatagcttgaagagcaggaatctcctgatgttgcttaatagcttgagagggtctttttttcctgttgcccaggtaagcggtctgaggagagaatggcattgtttctgtgtttgtgggcatcctggttggggtaagatgggactttgatatgtttccctttgggatatccttaatgttgatcagcttctaactagtgttgtaagcccagtggcagaaattgggagatctcacttcttctgttcttggctttttattcactgtgactaataagcttcctaatgagtccttgccagacttaaaaaaaaaaaaaagatcatagaccatgattaagtgggatttatttttaaaatgtattcaacactttgcaattccaaaaaggttcaacacatgcaaaccagttaatgcaattcaccacgttaacaaaata

SEQ ID NO: 27488 - DNA, 1026 bp, Bovine  19866880569432
ttgtgtccactctttgcgaccccatgaatacagcacgccaggcctccctgtccatcaccaactcccggagttcacccaaactcatgtccatcgagtcggtgatgccatccagccatctcatcctctgtcatccccttctcctcctgcccccaatccctcccagcatcagagtcttttccaatgagtcaactcttctcctgaggtggccaaagtactggagtttcagctttagcatcattccttccaaagaaatcccagggctgatcttcagaatggactggttggatctccatgcagtagctttattagaattctatgcacatctttcacagttataatcgcaatatacataaaattgtatgtatactcctcccacctaatattacaaggtaaacactattacactttgctacataaccccacttttatagttggttaagtctattaatttcacgaaacataaatatcttagctattctgatattgagcacttagatgacggtatatttttaataatataaataaggctgaatattttgccattttcttttttaatgataatagttaacttccataaattacacattttgaacagttgttgagtattagaaagaaattagataaatattctgagcagaatctctgaaatagttttttcagaggacttattggagacatatcttttgtggatatatatggattgtttgagctgaaaagataaggccacccacagcacagatttgttttcacactccatctgtttggtatatactgtgtagattaggaaaaagttctgaccccagtgagacagaatgtttagtaatatttctctcatattcttcaatttctctgtgagtcactttctccagatgcctaacaagattgtgagctttgcaaaaatcttccaaaaatggaatctgcttctcaaaaaatgaatacagtttaatgaacacattgcattcattacaaaaagtactacttaaataccaaaatatatatgttacaactacatagaagtacaaggta

SEQ ID NO: 27489 - DNA, 1241 bp, Bovine  19866880683245
ttgcctaaatgttggattcaaattaaattttgatagggttctttagagtatttcacacatgaagacagatgttaatgattacataatttttgaaatgtgttataaattgattaaatctaatattggttaggaagcactttgttacatggtatattaccgttccttgactatgtctcagatgatatattttcacaaatggctattttattagttcattcactcattgctttaaaatgttcctaaataaaaactttgagtcaaaaataaaccttggaacttggattactcttctccaattgcctccttagttgccagttattgactttctcttctttctacctcaagtcagaacccctcatttctttctccaccctccccttcctccatgccccaaatttcctctatattacagtgattctccacatgtgatccatagaccaatggcattaactggggcacagggtataagagcaaaacattaagccaagccctgcatcagacctagtgcatcagaatctctgggacaagagtccaacaatcagtgttttgggctgtgataatgctgctattgtgtgagagttactattttatatattgtagtaaccatgcccatgaaagtcttatgctacaggctgaggctcattttgctcaagataaatagtgtatatggcattctatctgttgcggtgctcaatgtagctattttccttatttctgaggactactctaaggatgtaacattaaattaaggctgacaaagacaaaagaaatgagatatgcccagaacaacagataggctttttgaggatggacaaactgcaaaaagtccgtgacattaaaagtatgttgtatgtaagtaacttgaagtggacaataatcattcaccttagtcaacacatggaaaggatgagagaaatgacagaaaataggtatgtaggagccagatctggcttctttcatttagaaaaacatgtgaaattcagaggtattatgtgaattgatagtttgtcctccctattacttgagtctagaatatcaatcaatgtggtacagtttctttaaacattcaaagtaaaaaggttagattttattgtaaaaaaagatgagaaaagcctttgtgggcaaagagcactggagagacataatctactggtgtctgtaacagataaagatgtttgcttgtactattacgagtatatttttgaaaggtctagtaatgcaacaggcagaaaggaaaaata

SEQ ID NO: 27490 - DNA, 2571 bp, Bovine  19866880703686
tacctgatcttctcagttataagatttacaattgatctccataaaataaaatgagattgttatgatattactaagcttaactctatcttcttaaattctatatcgacatgagaagaaaaaatcatgagatctagcttgtttccatagtcacaaaagatttcttaatttctttgcctaaaattaccttcaagtcccatcttttttatttctatgttgtaaaagttttactgtattatgatacttatatttttttttgtctgtggtaggcagaattctaaggtgacccaaatttcctgcccctttgtgtaatcatcttttcttgaatttgtgcagaatgacaaatcactttggttattatatttggtcatatggaatttaacagatgtaactaaggtccctagtcagttgactttccattaatgaagaggaagattattcaggtagcctggtctactgaaatcagcccttagaagtgacgagagagatccgaagtgagattccctgctggccttataagagcaaactgccatattctggagaaggctatgcagctaggacctgagaatgtcccctagttgatgtctaaacagagacctcagccttacaaccacaaggaactaaattctgccaataaccaatgaatttggttattggcagatgaaaatatagctggactggcaacttgaaaacagagccctgaaaagagaccttcacaagagaacccagtttacaacatgcctggacttttgatccacagaaaaatatgagataaagaatgggtgttgttttaaaacactcctttggagtaatgtctaaagtcactaggtttgaggtagcttgttacacagcaatggaaaactaatatgatatcttttctctgctgctgctaagtcgcttcagtcgtgtccgactctgtgcgaccccatagacggcagcccaccaggctcccccgtccctgggattctccaggcaagaacactggagtgggttgccatttcctcctccaatgcatgaaagtgaaaagtgaaagtgaagtcgctcagtcctgtctgacgtgtagcaaccccatggactgcagcccaccaggcccctccatccatgggattttccaggcaagaggactggagtggggtgccactgccttctaaagtgtaacagaaactcagtgaaacttggcatgtcaaggaattgttattcctgtcagttcccagttttatgttcaatcttgaacatatatttaaacacagtaaaggagaggatacaaggcctgggtctatcctgcttagaagtatgtaacatcgtagaaatttaaagaggggttaacttctactgggtcaaacactcactttacaagggaaaaaccaaaagatgttaatttattttgtaatcaacccttcaaagcatggaataaaaatataatgtaagataaaagatagtgcaaataacctagtaattaaagcttttttcaaacgtattttaattctattatgatgtacttatcagtgaactattcagatccatttgttttatatccttatactacttcttttctttcttcccgatttctgattatatcattgcctatgagcagaagtgagcactgctggaaaaaattatctatgaatatcttttaaaatttattacaatctgtgatcaaagatttagtgaaggacaggatgaagttaatgtctcaaaattaagttgtagtactctggataatattgcagtatacaaacaaacaaaacaaatcataaaaattttaactttgaaacatggtactgcaagtcctttttataaaactgcaaaatgagaatttttagctaatgagtgtgacttggcaggacataaatggaaatatgtttcattggccaacatgttctggaggcatatgagtatctaaatagatgatgctcaaaagagtatttttggcatcaaagtgtctccaaacattttgatcaggaatttgattgccatatgtccatatcctccaacttaaatgatgaacatactttaggtctcttgggatatttttagttcctggcagtactgactcctttacgattaagcattttgtcttgcaaaatgtgttcttttcctcactttcataattttccacgtacattgatcatttcaatatagactgtctggaattaaagctaaggtaatgatttattgaagctcagtattgagagaagcagccatagttagtgtttgcttttgaatagtgcttatgaattccactgtcatgacactcaaccatgaaagcttccatatactgattcatctttagtcttagatgttcatttataatccctagattacaaacatataacctggataatatgtcattttcatctttgtttccctacaaaatctttcaaaaggaaaggtatctgaaaatatttgcaaatacattattgaataccatattcagtaaatgctacatatttcttttgtttcaatagatcacattattttaataaatatgcaaatgtcatcaaaggtagaaatctgagtttggggggaagataattggacctgaaaatgtcttttgcattagaaatcctcaaa

SEQ ID NO: 27491 - DNA, 2132 bp, Bovine  19866880735050
ctgcaaggaaatctaaccagtccatcctaaaggaaatcactcctgaatattctttggaaggatgctgaagctgaaactccaaccattttggctgcctgatgcgatgaactgactcatttgaaaagaccgtgatactgggagagattgaagatgggataaggggttgatggagaatgagatggttggatggcctcaccaactcaatggacatgagtttgagtaatctccaggaattggtgatggacagggagaactggcatgctgcagtccacggggtcgcaaattgttggacacgactgagtgactgaactgagaaagctggacctgatgaacctatttgctgtgcagcaacggagacacaaacatagagaacagacttttggacacggtgggggaaagagagggtgggacaaattgagagtagcatgcaaacatatatattatcatatgtaaaatagatagctagtgggatattactgtatgatgcagggagctcaaaccttgtgttatgtgacaacctagaagggtgggatggggtgggagatgacccaggaagttcaaggggcaggggcatatgtgtatctatgatgattcatgttgaagtgtggcagaaaccgacacaacatggtaaagcatttatcctccaattaaaaataaataaatttttaaaaattgcttagctttaaaaaaagtgcttagcttatgtaaagtgtttactgcctatatgtaagtatgtttacaaatgtgttttccctttaaattcctgtaaaactctaaaacaaaggaaaaaaatgatcactggccagtttgttaagtggttgtcagttttgcattattaataaaaaatgaagaaacattttcaaataagtattccatttcctacctgcatgcatttcctaaatgaatattgaaactaattaacactattattacatttaggagaaaagagatactattcagctccttgttcacctcttaataactcgcacactactataaagtacttgaatacatgctgaagagcagagtctaatagttactggtttacatctcaggcaggttaataggttttcagacttcatttagcaccacattttcagaccatcataagttttaaatttacttccatgctgacagtttaatgtttgaataagcaagggcttaacttacttttaacttctaaaccttaagacctctctcttaaagctataaaattgacatttcagcatgatttttttttcatgatgtgtctttcaaacgtgcacatgttacaatatctaaaacagctgtccatgtttacatttaaagtctttcaaatatgtatattttttcttcaagatgccatttgtgtagaaaggaaaatacgcaaattgactgcttttttacatcctttctcccctccctttctccttcattccttttctctctctctctcttttgttctgatatttctttcagttttcttttccttctcttttttctttctttcttaggtacttcagataactagcaattattcatgcagcgtgaggaattccagagtttaaatctgcactctgcctttaattcttgttagggtttcacatgcatatatcagaagtgaaatcttctactatgtatcatgctcaaccaagtagaggtcaaagaactaaatcattgcattcatgaaagtaaaatgttgtgcttttcaattgccatcattttgggagactctcacttccaattaccaaagtgaccttcaaatctgatactgaccaatttgtagtaaaatttattacaattgggacatgacagtacaaaataaatgacatggataaaatacctgttttgatggtaataagattttatattcaactttatatattttatattcaactttctgcttgattgtgtttttcctgattctttattttgtatttttttataagattatactgttatttaaatgtgtaaactgttaaaaattcttaatatagaatcatagatggctaacgatttatatcctttgtcaaaaagtattttgtatcttaatatttcacattttattatagaggggagcacttgtaaattccagacaatgaaatattacatcaatgtttcatagaactaatttggaatttccttatgataca

SEQ ID NO: 27492 - DNA, 1980 bp, Bovine  19866880861153
ggaagggaatacaaaaatttacctagtgtttagcctataagtttagtctattattatattgtgaatttaactgtcaatttgaaaaatatataactacttcaatatgtttatatacttctcctttatttatggaggtttaagtgcactatgttttatcttacagatatgaaaattaatgctactaattatggttaatatttggagaatgtgtctaagccttttcacactacagtgcattacgagcaggtacaattatcctgcttttaatgaggaggaaactaaacacaggatggtcaaacaggtaaatgaacatcacacaactttacagaataatgcaggatgtgagtaggcagtgtgacaagaaactctgctctaacatatactgagttccctcccattgaataaaaccattgttcatagagagtcatccgaaatcaaagtgaattttcaagactataaatgcactaagataatttgaaatatgaaatgattatattatttccttattcaacctgacttgaggtgtccctctaactctgtcagcattggaagccctatctccctctggattaatctatctttgtatctctatacttatgtagaaatatatttgcctactttaaaaggaaaaaatattaattctttaggtaagtacataatatactttatttagtaatcaattattgctgaaaattccacatgtatgggtccagatgtataagtttgatttcattttttgcatatctttcaatacttttggcatttttagtttaatttttaatgtatgagatattttagtgtcataaaatattaaacctttttctaccttttttgtttgttttctccattttaaagtggtcctttagctacattgacataatggctgaataattttctatatcttacattcattcacaattgtagtccaggaaagatatttacccattaatctcaaccaagtgccaaaattgagactaaatagctcttataaacttcaagtgaaccaggaattagagctgttcatgaaagaagcatgtacttagagttcatgagatgtggctccccaaatgagtatcaggaacagttaatataagtaaggacaaagggatactgaccacacaaaatcaataactgtagcctatatgagtaaaaaaaaaaaacaaaatcagattatcactgctttcttgaagtttgtattcttgtggatgaagacaagtaaatatatatatgtgtatatatatacacatatatatatacaagtaaatgaatatatatgtataaagcaggtaaaggtgagagttgatatattataaattacattatactaattacatttggcaaatctgctatcagactgcactttttaaactttaccactttcctatgagctagagcatttcataaaatttacaacttcttttagtcaatcaaaatcattaatattaagaaatgagttactcatactgatctttatgacatatacagtcaaataggaaagacgagatatgtaaatacattcagttttcagtatttttgtacttaacatcttttaaaagttgaaatcataaatcataataacaatcaagtacaagaggtttaaagctccaacagttcaggaaaattccctataagattaaatagatgaacagtatagatttttaatgaaaatatgatataccagcccaacatagactaaacaacccaagtaaagaattttggtccatttggcataaacataagagaatgatgacaacttaatcctgtgcttatataagcaatgtgtatctggagaaattgtttgacaacgtgcagtggaatagctgtaacatttcaataattactgatatatatcttattttaaccaatcttggtcagattccctagtgattccctaatcattttaatttatatttatacttgaacaaaaatattggttttaagataattctttttagagtatccatttcatataatatatat

SEQ ID NO: 27493 - DNA, 860 bp, Bovine  19866881083914
actttgaagctgaaggaaattcaaactaaaagatgaaaaatacggaatcttatagtcaaagtgtgactacttatcgcaactagtaagcattgttcttgattagtctgattttttatctggtaattcagaaggactggaatatttttgcatgagtactattattgcaggctggttactttacttcacaacctatcttctgaaagttcaacaactcttcgggtttttttcttataatttcgaatgcattaagacattaagcaagtcagggctgtcaggtgctatttgtgttttgcttttcttttctattcctatgaacagagggaacaatatggtagagtacttgcttacatcaatacttgaacctaatgaacaccatctggaggaagagaaacctgaatattcgcatacattgggcatatataaaatattgctgcaaaactgattaatagttgtatttaacaggccacaattagctgtatttacatcttggtgccagtgggaaagtagaaaaggaatacttatcattgcacccgtgccttactttgaacatgctgttaaccagtgtagtgtggttaacctgtgtgaacaatatttctgaaaactctaatgtgaaaatgaatgatttctttctttccattctctgtagcagagggtacaaaagcacactagataatttatttttaaaatgctttaaaccctgttttatttatatattttataaaaggaaaataaacactttttatggtgaaaggactcaacatgtttcctattaagatctgtaaaatcctaagactattttcaatttgaagctttattttagaaatacaagtatatattattttctataagacataccaaag

SEQ ID NO: 27494 - DNA, 1236 bp, Bovine  19866881153558
aacatataaaatccaggatctactgaatactgtatgctaggatataaattaaaatttgtgctattatgagttagcctgaactcataatcttccataataattcctttaatttatagtataggtgtgtatcttatatgatcaaaatttgtcatgtaatgggaatatggttggggagagttatatgagaaggctgggtaatgagagaatcatgtgagaaattttgcttccttgagatagcacacttttctagacccctttcctctgattatccttttctgatatttatgaaacctagaggaaacaattaatgactaagccaagacctcaataatctaagcaatcatttttattacagtctgagtgccaatataacacagtttgcagcagtttactaaaatacaaatttcctctgccatttatttttaaaattcagggaaagccttaaataagatttaaaaattcattacttaagaaataggaaggtaatgatttccaaatgacttaataattttgcatattaaatattacaggacttagaatgttttgcaatacagtattaatttacctgagaagttattccataaggaataaaaaacatgtgtttctaactaaacttattaccttaaaagcttgatgaatgacaactatgagaaaaatccccttaaaaccatagactaattggttgaatataaattctcttgggtcagaaaaaacagctgtgcatatatattaaggcaaaatatgaggcaagaggaacagataacagcaaataagtctgtcattttatgttgaatgatacaaggattcaaatgtttcctttctcttctggattaggttcataggcccacatgttctatgtcaatgagtaatgacttgctgttcttttccccccatccccatttatgtttcctttcctcatttcagttctcagtgtctgctcacaaccttggctgagttcagcctgccatatggaggcaaatctagggagcaggtttgattttccccctatatgcccttgtacttttctgagcctccattaagcccgatatagctttaacatcttttctacattttttttgtatctacaagatttaaaaaatattgcatcctatttttgcccaacttttactgtccccatgccatctttttacctgaatgcaaggagactgatatttttgacgtgaaatgaatgatgcgggatacaaattgaaagggcttcccttgcctctggggata

SEQ ID NO: 27495 - DNA, 2615 bp, Bovine  19866881204405
ggaaaggggcatcgaatgtttgtttttctttaaaaaaggaaaaaagaaaagacatcctctttttctattcatgactcttctagtcttttcattcttcaaaaagagtgaaagtgaagtcactcagtcgtgtccaactctttgcgaccccacggactgtagcctaccatgctcttccatccatgggattttccaagcaagagtactggagtgggttgcagtaaaagaaaatcaaagctatgtataactgtgtccatagtggttgagattgcatgctttaatctttctggaatttcaaattcctactctttccactctgcagtaaagcgtatagcttttctcagtgaatgcttgtgcttcaaattaggagatgatgtggaaaggccagcccctatacagataagttgacaattctaactgaaaacaaaatatagtagacatttgagatccccagggagaacttggcatatgccgtatgtaaaggccaacattaactgcaatcaatgtcttacccacaacctcaagctctggctcctctgcttttgcacatgagcaagccactcagatctcattgaaaactctttcttttttttcctgaaatgtttctaccagaaaaatccactatcctacaaacaaattgcagttgatagtgattgattttaaataggaaatgtatataaactcagatatattgtactttgtgaattctaccaaatgtccttatgcaattgacaagttaaaccttaggtgtaccactgaaaaagtagctgaaaaaaacatctgaaatttaagtcaaagagaaacattaatttattaagatgatgaaatgtttatcatagatgcagattgcactttggattctctacactatatataaataaagtatatgtgcaagaaaagcagttttatatttatcatttcctggaagacagtgtaagatgctattcagtatttgtcaaaacaagttgcaccatgcactccagccacaccaaactacatatgtttcttgaatatggctccagttcatgctgggccttgtgcctagaatcatattccttttactccttcatctctctttcacacatatatgtatgcagacacacacacacaacatgacctttttctgccttgtaaacagtgattcctctttcattatcataagcttcttatagtacgtttgtttgctaatcttttaactgcttgcttagcagtgaacctgctatctagtaaataatgaatagtaagtaaaagaagaaaggtatatataaatgaaatatattcagtaaaacactgtgataagggttcatgatatgtagttctctaaaataacaaaagtttgggaacttcagaggacttaaatacgaagtaagcaagaatgttttcaattatctctaattcatgaagaatctgaatattaaaaacaattctaaacatgaaataaagataatgtgaaatcatcatagcaaagtgaaactcaaatattttctgttgtggaaacctacacagtctgtgtgtgtgtacccttgttttatatagggggaagaaataagtgaaactatagtgattaaggcataaggcacataaactttctacaaagaatgagtttccagcaatgataagattatataaaaagctttctggcatgatgaaaggacatttaatttttagaagtcacagcaggaaaaactattagcagtataactaaacacataaagtcaagttaaacattgcaagacctgtgcacatggaagctttttagttaaaaaatatattaagaatcaagccttaaagaaaattgccttttaagtttatagttaaaaataaatacaaagtaccatagagtttaagaaaggtttccttctttcatacctgaatgtaattattgtgaaatatatatataactttttatgattaaaattgcattattgtataataatattcaataatctaagatatgcagatgacaccaccattatggcataaagtgaagaggaactaaagagcctcttgatgaaggtgaaagagtagagtgaaaaagttggcttaaagttcagcattcaaaaaaagaatgtcacggcatacaatcccatcacttcatggcaaatagatggggaagcaatggaaacaatgagagactttattgtggggggctccaaaatcactgcagatggtgactgaaaccatgaaattaaaagacacttgctccttggaagaaaagttatgaccaatctcagttcagttcagttcagtcactcagtcatgtccaatctttgcaaccccatgaatcacagcaggctaggcctccctgtccatcaccaactcccggagttcactcaaactcatgtccatcgagttggtgatgccagccagccatctcatcctccgtcgtccccttcttctcctccccacaatccctcccagcatcagagtcttttctaatgagtcaacccttcgcattactggagtttcagctttagcatcatttcttccaaagaaatcccagggctgatctccttcagaatggactggttggatctccttgcagtccaagggactctcaagagtcttctccaacactacagttcaaaagcatcaattctttggcactcagctttctt

SEQ ID NO: 27496 - DNA, 1992 bp, Bovine  19866881206103
tgatttcagagcccaaaaaaataaagcctgactctgtttccactgtttccccatctatttccctaggaagcatattaagaagcagagacattactttgccaacaaaggtccatctagacaaagctatggtttttccaggagtcatgtatggatgtaagagttggatcataataaagctaagtgccaaagaattgatgcttttgaactgtggtgctggagaagacttttgagagtcccttggactgcaaggagatccaaccagtccatccttaaggaaatcagtcctgaatattcattggaaggactgatgttgaagctgaagctccaatactttggccacctgatgcgaacagctgactcattagaaaagaccctgatgctgggaaagattgaagccaggaggagtggggaccacagaggatgagatggttggatggcatcaccaactcaatagacactgagtttgagcaaactcccagagttggtgatggataggaaagcctagcatgctgcagtccatggggtcagaaagagttggacacgactgtgtgactgaacctgattataaaaggtcacagtactttattaatatatatatatatatatacatatatgtatgtatgacatactgtgtgttgtttgtatacatatgtttactattgtttaaaaaacagattttttttattctatcatttgtaatttatttactcattgttagcataacaaatctccaactcatgtaaataaattttggagaatactatatgcttaaaagttatcccagtttttcttttttctcctctgcttttctttctgaatcagttggtgtttttgagatccacatctaataggaactcattactctctgatttcccttatttgtttccatatgcaggggatctcctgtgccatgtaaattatttcaaaaacacatacagaatgtttatattgttaataggtgcccagtacctccagatcatacctaaatctgtataatttacatctattatccatggaataaaatcatgtttttctcctcttcaaataaaattataattgtcaagtgtggcctcagctgactaggtctggatattcaagggtcccgtgaataaaaccaaggaaaatataaacttattattccccagtggatattatagacacagtaaagtacacatgtttactggagttaaatgtttggaaaagactcacatattacagtaatggaaaaatactctaattatgtagctggtaatttgtttctatgcagcttactttttcatatgtagcttactttttcatatgtcccttttatttaaatgttctaccattcactaggattctatgaaaagtgaaatgtttttattcaaaacacatatactattttgcactttacaaaaacaataaaaacaccaccaaaaataataaaagtaaaatagaaaaactgacaggtactgatattatgctgaaggctggaaaagagcatatttgtctgtgatacattgtggtacatcctacatcagaaaccatttgataaagaagaaaagggagtagcagagggctttagagatgggagttccagagtcaaccggctgtattgaaaacatctaaagttcatggaacttgtcctcatttactggcatggactccatgcccaaagtgccactatcatgaaacagataaagtaatactcagctatatacctttcaaaacatcagtttatatattgatattcaagattttctacaatgtggtttaacttacattaaaaccttcgctaggagaatgtgcctattttagaaaacaagttcgtctactcttcatgctggtgactgtctattttttcttgattttcttgcagatacttggaaaaactttagaatatcatacaatcacccttcagtatccatggtggatttgctccagaatgcccatgaatatcatgaaaatccatggctgctcaagtgtagtatttgcatataacctacacacatt

SEQ ID NO: 27497 - DNA, 820 bp, Bovine  19866881232860
cgtcttttaatttctggctgcagtcaccatctgcagtgattttggaacccagaaaaataaagtctgacactgttcccactgtttccccatctatttcccatgaagtgatgggaccagatgccatgatcttcgttttccgaatgttgagctttaagccaactttttcactctccactttcactttcatcaagaggcttttgatttcctctttagtttctcattctcatatgattttcaggtgtacatctaagtaggaaaataccatttcttgttttaagtgacatcaaggttgcccatattcttggctgtgaccaatggcgtggaaggaaaagtgatgtatgtcattgccaagaagagatgttaagaaccatgcaatttttttttttttttttttaccattatttcctttctctgtgcagtgagaatgacatgactgatagtggttgcttattccgtttggattccagaatgagtacatgtggaacagagcctcagctgacacacagcttgcatacagtgtgaacaaataaaaaacttttttttttttaaagccagtgaaattttgggagtatttgttatgacaaaatggatcaggaaaagctaatacagtttctgacctcatgaagcttacagacacaaaaggaaaaccatcaaactaactggaatatttcttgtattctacttaagtttaaatcagaagggactccactggacatggaaactttacatattgcaaagaaaacagaattcaggtgtctctgcagaatgctgggcatcttgcccatatttcttgtatatgtcttcattctatccaaactca

SEQ ID NO: 27498 - DNA, 1323 bp, Bovine  19866881332926
tattaaaaataaagaacaaatttgaaacatggtttaaagcctgtttataactcttcaactcctctccgtatatcctcttgcctcatttactacttttcaactaccctgatcttatttgtaatgctaaatacactaaacaaattcacatatcagaatctttgtctggattattattgtcacatcattgtctcctttcaatcattagctggaaatttttatatgttattcagaacaacatatcttagacccactttggtatattactggaattcagttgttattattagaataaattaattgttgaatatatggtttaattagactatttaataagctggtgaagagtaagtggtgaacttaagaaaacttcctgatgaaaaccaatttggcggatgtgaaaaacaaaagtaagtgcttttcaataaaaagtattaactcctgtgatttaaaatacatccagtgtattgattactccaacatctatatattcagcttagttttctctactatttatttcctctgttacctagtgaacaatttacactgtatatctagactccaatttatctaaaatccatctcattagcttcctcctgaaatttgctattctattctgccaatagttgcatgttactttcccagggaacaaaactctaaaaaagagatttattgacagagatcaacatacaagttctgctgaatgcatgctgaactgctgaagagtgtccaaattcagttcagatgttatgccctaagcagcgaaggtaaaagaaagcttctgctcccaaaacaagtagatatacagcaggaaacctcagcatcctcaccattaaataagatcactctcacattccaataccagttgaaaagtagtagcttgaaataaatgtattttattaagatcagtttagttcagtcactcaatcatgtctgactctttacgaccccatgaattgcagcacaccaggcctccctgtccatcaccaactcccggagtccacccaaacccatgtccatcgagtcagtgatgccatccaaccatctcatcctctgtcatccccttctcctccttccctcaatctttcccagcatcatggtctttacagatgagtcagctcttcgcatgaggtggccaaagtactggagtttcagcttcagcatcagtccttccaatgaacacccagggctgatctcctttagaatgcaccggttggaactccttgcagtccaagggactctcaagagtcttctccaacaccacagttcaaaagcatcaattctttggtgctcagctttctttatagtccaactctcacatccata

SEQ ID NO: 27499 - DNA, 1058 bp, Bovine  19866882122979
atagaagaaaatgtaatttaatacagctacgattacttgcattgcaaaaaacaacttgcatcttgaatattttatctacgactattctttcacacaacttctcttcactacaaaagagaatatttaattaattaaaacaaaaactacttcttgactaagcataaatcatatttttattaagatagttcatataacaaatattccaaagctagcattttaccataaaataaccatattttaatatttaatattaacattatttaatattctctgctgtgtttgcttaggcaatttcctatgtggtttcatttggcatttttcatttttctgtcctgtcttaatgatccagaaatttaaaagaggttatggcatattctgtaaatttgttcagaccttgaaatattcaaataatgggcaatatacctttgtaaagcataagcatgttagtctttgattctttttatggcttagactgctttacgactttctctcaataaaaaccataaaattaaaatgaccatgcaagggtttatgaagcgcctctgacccaatatggtgaagctaatggtaacaaaattgtttcctaaatctgctaaaatacctggagggaacaattttacaatacaaggcagacaggaggtctggaaaatccatttctggggaaacccttcctctggcagctgcatatagaaagaaaagtgtcaatgttcaccaattatattttaaatattgcaaaatatatgtcaggcaataccttagctagtgttccttatagagaaacaaatgagaaaaaccttgacaaaagttatggtacaattattaatgagagcatgaacattaatagttactagagcattactcaagtcccatctctcattgcatttctcatctaatagtagaggcaagaaatgagtgaaacttcggattactgaattaaatacctctcaccattatgtcatgaaaataaaaataccatgtgaaggatctaagtttataggaatggaatttaccctcaaaaaatagtaagagtttttctccaagcgtcttaatagatttta

SEQ ID NO: 27500 - DNA, 2004 bp, Bovine  19866880396508
ggaaatgtttaagttctgtgaaaccaaactaacaccctaattagagggaataatcaactatttttaggaatagagcacaaaaactattgataggaaaaaataaaatttaagagacaaaaaatattaggaacacaaactattaaatataaagttaaaaaataagttgaacacaaactataaatataatttaatctataggaaaatctgatttataatggaaagaaatatgtgtaggttgccaagaataaaatattttgaaaattaaatgattctgcatcttagaatattaaatactgtaacaatattaccatatgaggaaacaattaacctctcctgacatcaatggcaaagttttttaaggcaactgaggtgtgaaaacagaaattgaaattttaaatataaccctaaatgaattgagcagtttgtattagtgacatttagaaaataatgtcacttgtctaaatatttccactcattgtgaaaaatgttacaatttgtggataaattatctactatctaaaatataatatagaaaaaaatttctaaagtgttcttttttgttttcctccttgattcaagctaatgtatccagaataccttaaaatctatttacctatttgtttaaaaccgtactcttaccttattttacatatttaacatttgttttatacaatatagtaacttaatataattatattgctatataacatacactttgactatttcctttaatctattgaaaaaactgtagaattcaaataaatacaatagactactatgttgttcccaaaaccagatgttttgaataatccattaactttcacactaaaaccataggaatgtcctcaagaaaagcttcaatcacaaagatacattaaaaacaagaacctagtgttcaattctcttatccattccctattcattttaactgtgtaaaatctaaattcaattgtaaactgtgatcaattaaggtaaaattttcaaccaagttatttaaaaaatacttattcagacagtatctaatagtttgttggcttgctggctaatcctctcttttattcatatttaataaaccatgatggccaaagcagatttcatcctctctctttttctttacttgctagggataacactataaaatcatatctactacttaagttaccgtttatttagagaaactaaagatctaagatgttaaatagcctgctcaaaggtcatacaactcactcttggatgagtcaagtcttagaactcagggatctagagtactctttggtgccagtgaaagtgaaagtcactcagttatgttggactctttgtgaccccatggactatgcagtccatggaattctctagaccaggatactggagtgggtagcctttcccttctccaggggatcttccaaccaagggatcgaacccaggtctcccacattgcaggtagattctttaccagctgagccacaagggaagccactgctgctgctgctaagtcgctttagtcgtgtccgactctgtgcgactccatagacggcagcccaccaggctcccccgtccctggggttttccaggcaagaacactcagtgggtttccatttccttctccaatacatgaaagtgaaaagtgaaagtgaagtcactaagtcatgtccgtctcttagcgaccccatgcactgcagcctatcaggcttctccatccatgggattttccaggcatgagcactggagtcgggtgccattgccttctctgcaaaggaagccaagttgtcctcaattcctaagtatgcaacaatttcccagtaatttttaaattgcgagcagatgctaaatgaacaatgaactttgaaagctatataaacatgaagtttagagtgataatcaaataaaacttaacaacaaagtccttttagcacatgcttaatggatgcgcaatcatatcctgccgcaaggtaatcgggtaaatagtgagcaaagatcataaaagagcacagttagtcttttaaa

SEQ ID NO: 27501 - DNA, 3223 bp, Bovine  19866880405641
aaaattattcatcattaaaatgaaaggaaatttctgacacatgttacaacatgactagacctcaaaagaaaatatactacatgaaagaagccagccacaaaagtacaaatattttgtgattgcatttatacaagttatctagaacactcagattcatagagacagaaagtagattgccaggacctaagagggagtaggaagttattgtttaatgaatatagttccatttggggaaggtgaaaaactttatggagacagatggtggtgaagattgcataataatgtgaatgtacataataccactgaactgtacacttaaaaataaagtgctaaatttcattttttgtctatcttgccataataaaataaataatgtcagtccttaactcatggcctgaaattgttgaagaaactatatgtacattaagtctattcttagagcattttaaaagtttaatgtatttaagtatatagagaaaaaaactggacaaacactgatattaggcctttagtgattgcacattttttaggaaactgtaattctgtgaataaggaaacaaaaagaatatgaggtttaagtgtttgccagcagatacctgccttctctttcatcagtaatatagacgacactccattaaacaaacatattgccctctttgctccctccacctgccccttagcctgtgttattacttgcatcaatcttgagtcacacagaattacttaagcctctcagagctatgctctctgacttttagtattgtacacttccctcccatagcatatttgttgctccataagtaatttagctagaaaattcttctagcaaaaggcctgttaagtttcactactgttttcactcattaagttgagacagttaaggaataaaaattccataacaaaactgaatagcttatactctgtaaaagccattgttcattgcatattgaaaattttatattgaagtcttagaaaaattctagttttgaatgctattgtaaggtaattttccattgtaaaatacagacttagagctatatatgtgtggatacatgtgcatttctttgtcctcaaactcatatagacgtttccaatcttcaatggccatagtaccggttatactttcatcacacagagatgggaaccagcccactcttccatgtgatatgtgttaaacagtgataattttcattccatgaaataaactattgcagaggtgagtacaccctaaaattacactgagtcaggaaaaaagattacataaaaacattaccttaatgagtaactgttcaataaatatttctcatggaatcagataaatccagggtttcttttgcactcttattaggtagtttggaagagatgaatataattatgggagaatgggccagatggcacatttgaaacccagtgggataaaccagatggaatgctgttattttgcccatttatctatgaatagaaaataggtagggggatggttctggagcctgttgataataatgattttctgaagatttcctcttgtttctgtggtgggtatatgtataagtgtttgtgagtttgatgtagctatagtaatgcaaaataggaaaagtaagcggaaagcagtttgtatcattttacagattccttctgaaaaactgtgaaaaaaagatgtaccaattttaaataattatgagaaaaaagaaagcaaactgtcaaacattttgagctaattagcatttgtcagtgtaatattctgaggctactttatgtgagctgtgactctgtttgcggtgtttgtgtatgtgagagaaaataaaaatagaaattaggttccaaagggagcatttttacatagagaaatgagtggttttttttagaagtaaagacttagtgagttactgggattttaccacctatctgattgtttgtacattcagcacaatagtcctttatagtttgcaccttgaaaaaggggtagtaattttcaatgtttagttagttgttttttttttaagggggtagagatttgctggattttctttgactcaaataacaaacacattggcagcgtagaaatccataacacacacacacacaaacagacaaaaattacatccaataatacctatgcttgctataaaacatgtactgttatagtttctattatattttttctttcttctagttattatttaaatgttggttgtatccccttaaaatgattttgtgacttatttataggatacaattatgaaagcattgccatagagaatctgatcaattaaaatgattttgctaaaatgctcatccttaatcttgagtatattatttctttttgttttacatttctggttatcaaagtcaaaagttcctaaaataatctttcctctcaatgaaagccctaatggttatctgtcaatcgtactactatattttgctgctccttgtttgtttaagataaacgtttccttaaagaagggacacttgatataaagcaggcaagttagttaaatggcagtaaacaaactgcagcctagtttgttctaatataggaacattgccttgcctcatgtaaaaactagtaagagtaatgggaagcaagttttaggcagtggtcttcctctaaacttgtcaattgctgttttcctcaagctttaaccttaaggcagatcaaaaagtgagccaggcagaccatgcatttcagcactgatctccaccccctgaagacccagcaagtcaggctagtgtggttcacactggttcaacctccctcttccttcattgtctctttgtgcaccagcatttttcaagttcagttccttgctcctgcccttcttatcattgtgcttttactttaaccttgagctcagcagtcccagttggtataactctgttacttgaagcaataagcaacttttcttttcaagttaggaactttttgtactagttttttgatgaaaatattttactgctggaaactggtctaattccctcataagacttagtttacaatcctggtttccagaggcctttcccacctgcaaggtgcttttgaataggctactttattcacttatctatagggtgctttcaaaatgcttttgtgaaggtgtgtgcctctgtgccccatgaaacctttccaagcagagtaagaccaaacatggctaatgggaaactagaatcaggtttaactaataacccaggacgtaaaatattaaagagataatacaattga

SEQ ID NO: 27502 - DNA, 2933 bp, Bovine  19866880509427
aagactcttgagagtcccttgaactgcaaggaaatctaactagtcaatctctaaaggaaatcaatcctgaatattcattggaaggactgacgctgaagctgaagttccaatacttaggccatctgatgtgaagggctgacagaaaagatcctgattctaggaaatcagaaaagactctgattctaggaaaaattgaaagcaggaggagaaggggatgactgaggataagatggttggatggcatcactgacttgatgaacatgagtttgagcaagctctgggagttggtgatgggcagggaagcctggtgtgctgtagtccatggttgcaaagagttggacatgactgaaccactgaactgaactgactgatgtgctctgggtcatcaaatggttaacgtcttccatttggttgagtggggtaggagtttacatctgcaaaaaaattcagaaaatttgcatcaaatactgttatctaggtacttcagaaggagaaggtaatggcaatccactccagtactcttgcctggaaaatcccatggatggaggagcctggtgggctgcagtccacggggtcgctaggagtcagacacgactgagcgacttcactttgacttttcactttcatgcattggagaaggaaatggcaacccactccagtgttcttgcctggagaatcccagggacgggggagcctggtgggctgccatctacggggtcgcacagagtcggaagtgactgaggaagacttgccgcctcacctccccaggccccatgggatcctactgagttacacaatcaccagcaaccaaaagcaatcacatttatgattacttgagagcaagtgctcacatgtccataatctcctttggaaaaagatagaagggtgacttcaaggatataatggaaagtaatcctacaaattcctgtgtttaatgtttgccctttgcttcactggccattgaaccaacacattatataatacatgacatggctatcttcaaaaatgtaaatgaaaaggagaaatatatgttgaaatagtgaaagaacgttaagcttacaaagagtggcaataaaaagagagggagaaaagtgagtaaagttagttccagtattcactcacctttggtcatatcacctacagtgatgatgcattgattatacccttgctcttgaaaataattctgttggccaacagcagacttttagactctacctcaccgctattgaatcagaatctgcattttaacaagattcaaatatgattcagctgcacatgccatttttgagaaacactgttttagatcacaaagtgatgaagtaatgctgtgacttgccaaagaagaaaaaaataaaaactttctaaaacaatacagaacatgaaacaagaatatatatggaatcaccagattaactatgccatataaagaaatttctattaattctgtaactatgtaatacatcagttactttataaagctaggaagcaaaatgaaaataaattgtaagtgctatttcctgtttggtgaggaggatgtcagcagaaatacaggcaaagatatgacaactagctcttctcagtactttttcctgttaatcttatgccttctaataaccctataagatgtcacataagctaatattaaaagcaacaaattatacttttacttattctgcttgaatgatgctcattaatattttatgttatatacaattgctatcagattttatgtgtccaattaatattacatacaatgatatttttgtgaagaaaatagctgaaggaagcagatgtgtgggttcttaaaatgcagctgttattaaaattaaagaatataagcaatattttggaataatttcttacattttgtgtaacataattatataagtattttgtcaagagatctaaattttcttaaatttctactgcttggagctttcaacaagaaaacactggcatagatttataggcaaggatacaaaatataaaaatgaggcaacattttgtataaatttatgagacactgaaaagtaagagagcctcatttttttttaatataccaaagaactataatacatctgtgttatcttgacacattttgactaaaagaagattgtttcatctttcactctaaaattttttaactgaagtttaatctaattttcaaatgaaaaaatctcagaaatgactttggttaacaaaaatgagatatttcatagtaaacatgttgatagaaagccttataccctatatgattaatttatagttaaaaaatagagttgagatactatgatctttcttccctttccaaatgttggaaattcttactctgaaaaactgccgaaatctcataaaactttttgtggtaaaaattttaccacaaaatcataaacagatattttccaaacaagacatgtgatgtttacctaggcttatcctttattatggcttccctggtggctcagacagtaaagaacccgcctgcagtacgggagacctaggtcccatccctgtgttgggaagatcccctggaggagggaatggcaacccactccattacttttacctggagaatccacatgggccatggagcctggcaggctatagtccatggcgtttcaaagagtcagacacgactgagtgactaagtgcatcctttattaattttactttattttttaaaatcaataagataaaaacattcttctctggaaaaaagtaaaactcaatggaccatacaaatatcttcctgtcaaatacataaaattcaatatccttttcaagtcaagtctttgcatagagcacgacaatagaaaagctgaatttatgttaatttgttatcattgatatatttttaaatagctttataaatatttaatacatgctagaatcaaatattttatgcaaaagaactcttttcctaaaaatatcat

SEQ ID NO: 27503 - DNA, 1320 bp, Bovine  19866880519947
ctttggcatcatatacatagtatctgttcactcatttgagcataactatcagtttcatgaagacatttaatcatactttgtattctggttttgtataattgtaaaatgatttttatcagtagatggtttggtttatgtttgtctttttagtatttctgacaatctgggatttagaaattttagttacaaactctctttgctcttacgtaagcgatgttgttacatcagatgttgattttaagtgactcattgaggacagaggcaggggatgatagtgcaattcttccttaaagataagatgcatgatcacattatttaaatctttcttctaaaggatcaaaataattttaagtttcaattcttaaatgtaaaagaaaaacatttctaaaaaggcaaaggcaaggaataagtaatcttcaggacatcttaattctcagaagtcctttcacaccaactcttgaaataacaatgaagggtcagattcaaataaaccagtttcttccctcagagagcttatactcaaaagacccaaactgaatgcaacctatgataataaatatgaggcgctttatctaactgatagacagtgatctgtactgaccagaggatttcttgagtgacatggtaagaatactggtaaaatgaggatgacagtgtacttgagttaaaaggataatttcttttttttctttcctctttccactcctctctccctccccttgctttctttgttgacagtaaagttctcataacatttttcccctaaagaatccgacaattaaatatctataaatcttggtgctggtgacatgtttgtttctttaatttgaagagatacactgtctgaaatgctacttatatttacatccatgtgtgcaagttgtcgctcagtcctgtctgactctttgtgaccccgtgaacttgtaccctgccaggctccactgttcaagagattattcaggaaatcttcccaacccaaggatacaaccaaggtctcctgaccctgtgtctcctgaataagcaggtgtattatttactgctatgccacctggggggccctatatttatatccactgatgattgatcctcatggtaccttcagtgctgaagtaacaggtgcagtgatagtgcctgcaattttaacagtcttgtttatacaccctatgctacgcatgtattctggaataggatttatcaaattgtatttttctttttcaggggcatttttgttttcctcttatttattaaggattttaaagctctagcataagttttgtttttcttaccatttataatttaacatggtgtctggccctctgg

SEQ ID NO: 27504 - DNA, 658 bp, Bovine  19866880548827
tgtgaagagatttacagattgagtggacactacttggggagagcctaaaaactagcatacactaaagccttagaattattctagtttccatcttgctaaactgaataatagtggggcccagctgcatattttacttcccccttcataagagagggcttcattttaagaacataatatgcctaaaagaattcttaagcttctcagacagagaatgatggtctcaaaaaaaattgttgagcatatatatgaaaatgagtcctattattagatgaaacaaaatacagatatgtggaaaatacaatttcctgtaacatttcttcagaggaaactacttatgccattatgaaacactcttccccaatcatttattatggtttattctctataaatattttggtttccagttataaatgtagttaaaatatccagtgcatcctgctatctggtttccatcacactaaagttatgtttgactaatgactacttgtataacttcttgttttacaatatcctttctaatcctaaatcattctcaaagccaataataggttctgatgtgtcatgtcactcagcataaagttcctcatgtatttttgataccactcagacaaaggcaagataactctcaacataaaatcgttcttgtgaactttccaag

SEQ ID NO: 27505 - DNA, 1332 bp, Bovine  19866880569471
aattccatggacagaggagcctggcaagcctgcatgtacatgtagtccacagggtcaaaaagagtcagaaacgactgagtgattaacactacccttaggtaaattgcttaagagtgctgtattcagcttccctcaagtgtaaataaatgacttctgcctcatgtaactaggcaggggcagaggagggtggtggtagaggaaggaaggcaccaattaaattttgctacttaagttgaaatatgaaaaagtgctcactcacgttgctctactttcttactctagctttgaaaaaagtcacagaatttagaattgtaagaaatttattactgagaacatttagaaggagaatgttatgctgaggaggtagtgagaacaactataattgagaacagtctgtggtcaagtacaataagtttcaaaggaggtatctcacatgaggattagttagttcaaagggcaaggtccagagaaactaggtttagtaggttttgagtcagaataaactatcattgggtcagcaagagcttcaacaacaagcccaaaaatatgatatatcaccttgggcatagggtttctctgataactcctaagaggccaactgaagctccttattcccagagttccaggctctctcgatagttctcatttcctataagtccctggtagctaaaagacttcactcagtagatttaacacatgttaagaaattacgaaaacaacataaggtttatttttctgaaaatgaactttctttttattcacaacaggaaaaaactcctcaatctaatagaaatcttagccctaagttattactttctagtagtctctgaaagtgtatgtttggcatatggtatattttactttagttttatgcttaaaggtattcgaataaagaatgtatttttttaaatcttaaaaagaaataagtaaaatacatttctaagaacttcataattattcactgttcatttaaaatctagccttttgagatgtgcttatgtattatgcatgtctttttacagaatctaactacagaaattccatctctcaatgccttattcaattcatttttggtacctttatttttccaaaaaaaaaaaaaaaatgtccctaatcatatttccattcttctctcattataggggttgtctctctctgtctaaaaggcattgctgtcacctctgaagtgttaaatatcacatggagaaaaaccatgattaaattttcccatgacacacccatgactgctgctgctgctgctaagttgctttagtcgtgtccgactctgtgcgaccccagagacggcagcccaccaggctcccccgtccctgg

SEQ ID NO: 27506 - DNA, 895 bp, Bovine  19866880582038
ttattttacaaggtagcagtcctgttgataatttcttcagaatgtgatatacttcaaaaaagaggacaaggttaagtttaagttcttcatttatggaatatgtgtagatttaatgaaatttctctctataaccaaatgataatttagctccaattaaaggctggaaagaggctgcagctttatgagtccagcattgttatgttaaaatgtttaggactcttttcatgattatgattaataatatatattaaaaattaagaagtttaaactgcaattaactgtggctcagagtataaagtggtgaaggatttctcagttcttgtgcaaatgttgaataaatgttgaattctttggggaaataacttgaatatccattgattttactagtacagtaattaaatctattccctaaggaaatacactttagtgtgttgagaagctgcctattctctgtgtatcttgagccaggtaagctgtttcctggatgtcagccctgggattgcacactgtccctaccatcattgcctacaaatgaggatctggtctccatcttctcttgaaatttatctatatgttccctaaacaccttgtctgttaatttacaattgtattatatttagtaaaagtcaaggaatacacaaaatatacagtttatttaggattaacattaggatttagcaaagggccccatacagatattgatgataatttaaaaaacctaaaaattttctaatagcgttcactgctttcccaaaacaagagtataactggattattcttcagctttccccctgatttgaatctttaaaattttcaatttactctataataagcactagtggggagaggggtattaatcaaatgatgtatgtctgtctccattgattttatattt

SEQ ID NO: 27507 - DNA, 2315 bp, Bovine  19866880681312
atctgggacgctattcagttggctcctgtcatgttagtaaaattggtatttacttattctaaagctgttgtatggtggtttagaaagtctgtaattaaaacccccaaaggttgtggcttcttacaggtttctaaacagaacccaatctgtaataaggagaaatacagtgatcagtgtataacagttagacattttggggcaagacattttcagaacaagtgctataaggctaacagctaaattacactaaaaataaattcaagtatatttttcaaatcagatagagtgattattataagcttttaatggaaaaaaatcctttcacttgacagcatagtgtaacatatttatcaggagcaaagtgtaatgttaaaggctttggaggttatcagaatacctgggttttagtatctcctcttctacttatctcataccagtaaaatagggataaaaatatcagtattacctatgttatagagttacaacaatcaaaagagtatataaaagtatctttaaaacaacaaattaatatccagatattaattttattaattgtataaggtaattttaaatttttttatattttaaattttgttagggtttgattgatttacaatgttatgttaatttctgctgtacagtaaaatgaatcaactatacatatatccactcttttatattattttctcatataggtcattacagagtattgagtagagttccatgatctacaatggtcctataaaattgtggtttagtctctaagtcatatccaactctttgcgaccccatggacagtagcccactttccaggcaagaatattggagtggattaccatttccttctccagaggatcttccccacccagagatcgaacctgggtctcctgcattgcaggaagattctttaccaactgagcctccagggaagccatgctatacaataggtccttattaattacctgttttatatatggtagtgtgtgtattggtttcccaggtggtgctagtagtaaagaacccacctgcaaatgcaagagacataagagacctgggttcaatccctgggatgggaagatcctctgaaagagggtacagcaatgcactccagtattcttgcctggagagtcctgtgtacagaggagcctgacgggctatgcttcatagagtgacaaagagatgaacatgactgaagagacttagcacacacacatatataatacagtgtatatgtaaagggcttcccaggtggcactggtggtaaagaatccgcctgccaatgcaggagacacaacaaactcaggttcaatccttggggtaggaagatcccatggaataggaaatggcaacctgctccagtattcttgcctggaaaattccatagacagaggagcctggcaggctatagtccatggagccacaaagagtcagacatgactgagtgaccgagcacacacatatgtaaaactcaatcttccaatttatcttccctcttttccctctggtaaccatgattgttttccacatctgtgactctacttttgttttgtaaataagttcatttgtaccattttttaagattccacatataagtgataatatgtctttgtctgacatacttcatccaatatgaaagttctttgttgctgtttagttgctaagtcacgtccgactcttttgcaaccccatgaactataatcgccagctaagctcctctgtccatgagaatttcccaggcaagaatttcctcctcctgaggatcttccctgacccagaggttgaacctgcatctcctgcattggcaggcagattctttaccactgagctaccagggaagcctatgacaatctctagggttatccatgttcctgcattattttgttctttgttaaggttgagtaatatttcattgtatataactgctacatctcccttatcattcctctgttaatggactttaggttatttccatgccctgactgttataaacagtgctctagtgaacattgtggtgtatgtatctttgcaaattatggttttccccaggtatatgccaaggagtgggatggccttggtgtcacagcaatggcgacataccatgggatcatatggtagctctatttttagctttttaaggaacttccctactgttcttcataagtacaaactaaagttgctcagttgtgtccaactctttgtgatcccatagactgtagcctaccagactcctccgtccatggaatttttctggcaagagtactggagtgggttgccatttccttcttcaggggattttcccaacccagggattgaac

SEQ ID NO: 27508 - DNA, 1354 bp, Bovine  19866880725362
cattaacatgttaattttatgagtgaaaataaaattttatcatcttaattctcatttctttaattattagtaagggtgaatatttaaaaatgttcattagacattgcaactgaataattaacaattctgcaagctacagagaaactcatagaaatattagttgaattcatgcaaaaagaatttttgttacattagccttttatttaagcattgttttatactgtgtaatgccatttacctatgactatattttataataacatctgaattttcaaagtccttttgttatgtccttgttattaattggattcacttaccacattactgggatgctgaaagtttaacaatgccaagcttttatttatgacagactgtgttttaatatgttgaatcctgacttagataccagatttatgttataagagtaaaacaaatgaatgtgattcatcccctactttaagtagttgaccatctagatagtagtatagaaagccctgggtgcagtcaaatagaatcaagcctggggaacagaatctggaattagtcaatcataaaattccaaatggaacataaaatttactttgtagtttaatttattttgccctgttgctatcttagatgttaatgaataatccttcctggccacctgtggtgaaatgagtatgttgatgaaaagactgaatttgaaattatggaaaagtttattgagaaggataggtaaaaataaaggaaaaattcatttgttaaccataagaatagacaagggaatggaattcacaattagaatggaatttgcattccgtttatcatgtatgttaatttatagacttgttcagtgaaccctgggatgtgttctgccagcccctacttccccataaagcagcagattctggatctcctcaccctgcaggtgtcacaattaattaaaccagtgtttctattttgcaagtattatgattatgatcactaatggtgattagtctagataatattgtcaggttctcactttccagcttaggggtattgctttcattctaaagtgttgattgtttcttatctaaatttgaaaataagattagatgctttttaagctgatgtctcctatattgtctaactatggaaatttatatggtaatttaaaatctgataagctatgagtggcataagcctgcataataaagcaatcataagcattgacatattgggcagaattcaactcagtttgcaaggggaaaagatctccatcacatgccaaagacttagaagggacattgaaaatacaattcatcaagcagaattgtatttattttatccactttctgcacatgtcggaaaattttatttggaatttcaa

SEQ ID NO: 27509 - DNA, 1551 bp, Bovine  19866880773644
cacatactggagtggaagaatatatcccatcatatgtctttatacctgaacggcaaaatgagaaaacaaaacaaaaagaaacctcacacccacagcagagagatgataatttctcatctatcttttctgcgtgtttatcataaatcattttaggatacaccttttcaacgcatagctgctcttaattagatccatattgtcataggaagtaggattctcctgttgagtgtggccaccagcagcaaaacatccatttgcctataattgattttcaggtttattcaaaatgctccatgaagcgtagcatattgaaatgacttatcatgtttattggaatatcttgaggataaaagttatctttgaatgatattagcatattaaatgtagtataaaaagatagttcttaaaaattattttaaaatagttttactattcatcttttaattttttccacaatttttaaactactgctctttatgagaatatgagtcgtcaattccaaatgcatcagtgggagggtctacgtgaactagtaggctagcctttaagaatagataagaaaatgacagttgacttgttcttttataagcatcccaatgcagttcagtaaatatccgtattatcttattattgcctagagattctaaagacctgggatacaaattataccatctgacttactttagaaaattctgatatctcttttctttgagaaagaactcacaatctattttgaaaagttaacatctaactgccaggttataatccaatgaattgtctttcttagagatactgagtaacacacagttgaatttcatttcattaacttcatataaaagtgtgtattttacattctgttttcagcagaaaaataagattttataattgacttatataaatgattgtagagaagcaacatatggaactacatgtggagaataaagggtgatggcattatttgagttaacataacccctttgtgtaaaattatatgcttactacaaaggtagactcatgcgttcatttaactttatttgagttgtcaatattatgaacaacagaaaatgagtaagatattgttaattactttcaaatagcttccaatctagtaaagagaactgtggctagaaattgctataacaattattttaaactatcaagagacataagataaaagtgttggcaaatttcatcatgcaaaagaggttcagctattttccaaaaattgtttctccaagtatattttcttcttttatccttcttttcttaaaagaaagaaagccagggcaatgaggcttacaacctgcatattttacttcttcctatttcattgtatatcttaaactcctggtacttgcaaatctattaaatagttggaaaacaactgctatgaaggaaagaacatgaggtttgaagcctaacaaagacggattgaaatctctacttttaggttgtagctaaatgagtaaatcatgcaattttgttaattgtctgtatgttcctttgtaaattggggtaataatacctcacttaaccgtattaaattataga

SEQ ID NO: 27510 - DNA, 781 bp, Bovine  19866880859960
ttaaactcattataagatcctatgtaatcagcatacttgagtatatcataatgaaatttaaagaataaaaggactacaggcatataaaacactttggcttcaaaaattattactcaagaaaccttatctgaggccctactatgtattaagcatgttatgtatgcaaagatgaaaaatatgaccctaagtctaaaatagcttccctggtggctcaaagggtaaagcatctgcctacaatgtcagagacctgggtttgatccctgggtcgggaagatcccctggagaaggaaatggcaacccactccagtactcttgcctggaaaatcccatggactgagaagcctggtaggctacagtccatggggtcacaaagagtcaaacacaactgaatgactaaaatatttactcactccttgcacagagtagatagtaaggagataattaaaatgaagtgtaaagaatgttatgagaaaagtaaatacgggtaactacaaggtttgggaggaataagtaaaatgggggatcagggtctgtacccagattaagagggagacattagaaaaagtgatgctgattcctaaaacatcagtaagagttaaagagtctttgaagggtaatccatgaaaaagagcaagcacatgtgaatatgtaggaggagaaagccttatttacttgcagaatccaaatctatgatgaagataaaggtagatagtgaaaatttaagcaaagtttacatcataaagcctattagagcaagtgaagaagcttgcttagtagcctg

SEQ ID NO: 27511 - DNA, 1717 bp, Bovine  19866880859977
aataaccatctcctccagtttaagggtcaaatctctctaagcaaagttttgaagcatggagtccatcattactcaaaatgatctaattaatggtaaagtgatccaataagcagctatttgttaaaatttgaatttcattactactaaacatgtaatttataatgtcatgatggttactttaaaaaatatcatgcttgtttaatgaaggaattctgacatgtaaagcacttccttattctttcttgattaagctggtgtagccccagggcacaggaaatatcgactcatatggcagggttgataaggatcaactctccctcctcacttggaccagcaagctgctagtgaattcagcagatgtttctactatctgggccaatggaaaccttatggacctttttccttcatctcctcccaggagcaaatgttaacacagcagaaatttggatgcagaccaaataggaagcagaagggttggtgagaaagtagggtacactcttatccataaacagcagtcatctgtggtttgaattgatgattgagccattttaatggcttatttctgttcatttgctatttaaccaaatccctacagacccttatattcttacataacagtgtttaccttaatcctataaatttaatccttgaatatgctagttgtttcaagattcaaaccaaaacaaaacaaaacaaaaaccaagaatatgaatatataaggtaagaaaattgttgatttctaataatttttcttatctatatagaaaaaccacctaactgtaacttgtaatttactaaacttaatttatattttttgatgtcatattaaaaatagcaataataggcccagtttccataaaaatttccgagaaaaactaattaaagggttaagcttaggactcttcattaaggataattcttattcagttgaattttaaatgaactttcttaagaacccaatttgattaaattcatgtagttgttcctcatctctccctccatctccccacactcaattacattgacccagtggagtgcccatcaattttgtatgatttagatttttatcacatacattcaaattctataatttagagttctactttgcccctacacaagttttctctaatacactaatatagagagaacattttttaaaagaggtggaggtatatcttagactctaaaactatatattgcctcaatttattttaacacatcaggatatatttcctgctgataaagggataaaatgttttggaagaaatttgagtagaaaaataacaatgttgattcatttttcatttattcaaacttgttgattgaatattactatgagtaaggcacattaaaagcaagtaaaaagaaataactaaatgtttaagcacacaacttagtatagtaattgatggaagttgcttcaataaggtcagcattaacaatgtcctataatgcactcaatcaactccaaaagccatattgagaggctgccctacaaaaggcctgtttcatctgtttccatgattgctttagaaagggtatattgttttgagcaaaatagcaaagtgtaagtagctaaaaaaattttggcagtgtttttaaatgcttcctgtgtgtagcatttatgaaagggggtggttagaaaagatatttactcataagtttcgaatgccagacatttaacagtttttccctcttttattctaattgtcagaag

SEQ ID NO: 27512 - DNA, 763 bp, Bovine  19866880870981
ccaaagtgtgtctgactctttgcaccccatagactgcagcatgcccggcttccctgtcccttaccatctcctggaacatgctcagattcatgtccacagaatcagtaatgctgattcagcattatatatgctgatatttagtatgcttatatttagtatgtatatattagatatgttcatcaacatgtttatgtgttatatactatgtttatatgttataatatgtttatattatgcaatatataacagcataacaaataaacagtaaaatccaatgatgtcagaaagcagacataagatatttgaaggttattttacactactcaagaaagtatatgcataaacaaaaatagcattacttaaacaaacataattcaatctaactttcatataattatatgcatacttacctgtcttttccttggcctttacaagtgtgtttggcttactgtctttttaataaaatttatttctggcaaatattttatacatgaaattttttattttcataaaattaaaatttaaagaccacttctttccatgattgttttgatgcctgtgacttccaaatgaaggaaatgctttcaacatatgaatgggggttaaaatgccatctgtaccctgcatggggcctcatacatactaaatattgggatagcttttcaataacacttctcctaattgaaaagtaatagaaagggatactatatatatattcaaattattattagcatgaagctgccaggatataatatgtaaacat

SEQ ID NO: 27513 - DNA, 1534 bp, Bovine  19866880933490
atatggcaagtcaactgcccaatatacttaatttatctgaaatttaagatatatgtataatagatcatgtttgatattaatcttcttacaaagaaaaaaaatcacagtttccaaattgcaaacagaggaggtctgtgaggaaagatgacaaagacagatttcatactcagaatgaaaataaaaccagtcctctaaaggcagggaggagaaggcagtggcaacctactccagtactcttgcctagacaatcctatggacggaggagcctggtaggctgctatccatggggtcactaagagtcaaacatgactgaagtgacttagcagcagcagcagtagctaaaggcagggaaatgacagaggaaagaaacagacattgtcaaagtacacacacaggaatgacatttgcaagttctttccatttcatagtgagttcatttgtgttatccttgcctaacccttggtatttgtctggtataaggacagactcctcaactctttgcagcagcactaatgttattaattcttcattaataacaatggtaatggtgtgggtcatcccacttgttaattgtcatggtcagtattggccttagtcattgaagtaggctaatacttggggtgggcttccatggtggctcagatggtaaagaatccacatacaatgtgagaaacctgggttcgctctctgggttgtaggagggcatggcaattcactcaagtattcttgcctggagaatccccatggacagaggagcctggtggactacccatgagatcgtaaagaatcagacacaactgaccgactaagcacaatacttggggtactgaaagagaaataggctaaggactatgctgcagaatagtccaggaaagctctgacatgtgggtagattactgtatattctaaaccataccaagtcaggataaaaaggatatgaatgtcacaagtaattatatctcatgagtggctcatctcatttctgcatagaatgttgcattgagtttctcttattccttttcaacagctatcagttttctcctttcttcactccatatttaccacaaaatcctttctctccacctagaaatattctactttgcatttaaagttttggagcctccagctaaaggacacttcctggcatttgggtttataaagtgaacataggcatgctaattatttttgcaattttattctttttaataaggtcccctaagcattgccctgatttcaaaaggataaagatgtatccaggctcaaaatttgctaaaaatctcttttaataaatccttgatccaaataactcagtttaaatcatattaaagtacagcagctattgcagattaatatcttgaatttaaaatttttaattactgattatatgtacaaacctctccatcagtttatattcaattatttgataatatcaattagttgatatttttgataactgtgtatttaatgatcttaaaaacttaaaatttatttttaatatgctgacaactaaaccttgattattttctgcctcatt

SEQ ID NO: 27514 - DNA, 1963 bp, Bovine  19866880993458
tgccaaaaggagcagtgctgaccatcaacacgattctggtatttgagtttcatttatttcagacttcttatttgctatcccgagggccacatatcttcaaggcttctgcatgtcagctgtgtaattgctgtaataataatctggtataaaagtcagtagctttttactacccagaaaaataattttctgacatttctgtgttgtgtccaagcaacagttttagctactagctacgttaatcacaaggaataatttataggaataaattagtggatgagtcttaaaaccatctttttgtgctatttcattttcaaagtaaaatatacttgtctcagtgcttgttgccaggcacaataaggcatgctctgagcccagggaatgcaatcagcacctctggaagaatccatggtctatctattaggaatcttggactgcaaacgagggaaaccgaagctaactaagcagaggaaaattttatgcagtaatttatggagctcacaaggataattggatgctgagaaagcagggcagaaactggattccaggtagcagcacataatgggcagtttctttaggtcaccattgcaggaatgaatctgagcagcttgtctaacctttttccaatcttgattggccaggtcatcagaaaggatccactagggaaaatgttcccaggacaatattggaatggttacagagaaaatacacataataaatgtcctctctgtagggacataggagagtggaaagtttcagtgtcatcagtctccaaatggagattgagatctctggcattctgttgcataaaaacttttatttctcacagaaacaaaaccaaaacaagatgaattgttcttaggtgggccatgataactttggtctttaacagtgagctaactattttaagaaaaaaatatatatagtttttcttgtggagagggatttttgtttgtgttgcttattgtcatattcactaagtttaatacagtacctggaacatgtaaatgatttttcagtatttttcagtacttgcaataagcaacccttttaataatctttcttagttattttttgatagacttggcttcttaaaaaattaagaagaaactacctttgtgtatgaaaaactgaagttttaatcggatttatcatggccaacaatctttgtctcaggagagaaattccaattctcaaaacatgctttcttggaagttcaacctctactgagtttcagttataagtgagagcaagaccattcagccatccatcttcaggagcctaggactgttcatatgattgaatatgttcatgtttagagaagcatgcagtaatatgtgatactgtctaggcattgcatcaatagcttctatctcttagggtcttgaacattccatctcattgagaaaaaagaagattctagcccaaagaagggacatattattaaactgctaactctcaaatatccagaatagtttgttggaaaaaaaaatggccaaacctcttctggtattagtacatattaatagaagggtagcatgagtgaggcgctttcactgatcttgggcaaggctattggggtataagtaggaggctaatgaaaaagacaaacatgaatccaggtattggcttaggctgtcagatggatgttggagttatttactatgatagagattatgcaaagggtaggatcaaggaaggagctgattacaggcagggtgactgaccatcccttactttttaataagtagtcattgtcaaggattctgatttctgtgacaatttggactttatcataaatgtccaattagagtacttgtgtttgtttatggctgttccaagtcttaaataccctgtttctgctgggatttgtcctatttctttttcagagtgaagtgttggtagtgaggcatatctcatcaaaacccctgtgcttcagcagcgctccagtgctgcttccatcaca

SEQ ID NO: 27515 - DNA, 1535 bp, Bovine  19866881180340
aagaatgaactgcaaaaaccagctaaaaaatgtgtagaagatgtgcaaataataactttacatagaaaaatataagaacacacatacttgataccagcaagtctaaatgaactaaaataccacaaagtacaaaaaaaaaaaaaaaatccaattcttaaaatgtacactagatttataacatacctttaatttggagataataaattagcttcgtacagaaaataagattaaaattatatgcagaatttgcattttgtatatcaaaaagaaatactagatagcagcttcatatttaaggacagaatatatagtcttggttatatggtaagctattgttatgctattcctccttccaaaagaaaactcacaaatcattgttttcagtggtggagggatatctattgataaaatctatttgtgagaatcgaaacttgggtttctagccatatgtgaccatatgaaaataggctatctttcattaacgtaagcaattgtttgaatttctaagttcatagttttatatgtattcatatttttcatttgacaattttaacttaacatacttctattttttaaaaccaaagtaacccttagagaagatgtaagcaatggaatgcaaatggggaattcttttgtgcttttcttgtgcagtatttactcactttccaccttgttatctacaaaacatgaaaacgcctccgtaggcacaatacttcagtctgacaagttgtcataatactcaggccagtgctggttttgtgattgcttgatgtgtcaaaaacatttgatggattttttaaaatctggaaagtctgtgttcattatccaaatcataggattttctcagatttccatgggaaagaaaataaaaaagacttgaagcaacagaatttagtggaaattgaatatcttctcaaagcaaacttgagtcttattttattgcaggctttcactgttacaacagagtaaagtaactgcagagtaaagaaccaagagagcatgtataaagacataatacatttcaagtataaattactttgtattatagatactagacaaaataagtttaacaaaaatttaattcagattttcaaagtcagttatcaattttgacaggtagcctgtttttagattattaacacaggaatatgatgtgcctttaaaattatttgctccccatttcttttaaaatgtttcattcataagcagacattattttattttacataaaaaaactcagaacttgaaaatagcttcatatactggtttatataagatatttatgaagcataattcataaattatgaataatcatttttatattattatgtattctatattattataaagcataatcatttttaaaatatctaattataaaacatagttttgataatctgagaaatacttatttcgttacagtggtactagaaaaccagtgcatatttgctgtcacaacagaagacaatttatgtactggtgcttgaccacagcaccattattagaagatgcctctcactggtaaagaacattag

SEQ ID NO: 27516 - DNA, 1720 bp, Bovine  19866881194636
ctgtgctcatgaagaatgcttccagacccatcgtctcatgcaggaggggagtctgcccattttccagatgagataactgaggtccaacaattagagtgactcaccctgggtcacatggggccagatcgcccttgtctgaagtcagagtccctcacatgtgtcatctgggttggccttgcctggaaaatcccatggatggaggagcctggtgggctccagtccacggggtcgctaagagtcgggcacgactgagcaacttcactttcacttttcactttcatgcattggggagaaggaaatggcaacccactccagtattcttgcctggagaatcccaggcacagaggagcctagtgggctgccctctatggggtcgcacagagtcagacacgactgaggtgacttagcagcagcagcagctccatgaggccaggacaatgaattgtcttgtttcttgagatccagttctgttctcagttccccgaccagggattgaacctggggccatggcggtgaaagcccagaatcctaacccctgaaccaccaaagaacttctcccaccgcctcttaattctcacctcaacccccttttaccgaaatactaacagctgacaattagtgcttcctaacacccggcacccaccaccccaaccccctgcaaagtgtcttgtgaacattttccttcttgttcattgaggcctcatgaccatatcacaagtgttgggggtcaggtgtgggctgcaggccctggtttatctcctccatgacaaccatggaaaagtttacgctggaggctgacaaggccaggctgtgttggtgaggaatgtggagggcctgaggggactgtcggaagacccgggtgggccaacggggtggccagttcaaagcaggtgactattctttttaactttaaaatttgtttcatatatatgaaatttgaagtgaaagttgctcagttgtgtctgactcttggtgaccccatgggctgtggcccatcaagctcctctgtccctggaattctccaggcaagaatactggagtgggttgccatttccttctctgcactaagacctcttccttcccccaactctgaccatttgaatgtctacatctatacctcaacgtttttctcttttgatctgtattctcttggatctttccatcattctaatctcaccaaaaacattgcctctttaaagagctgtctttgtattcaagctgaagtacttaccttaataaaataaatttcttaaaatggagactaaagccatactgaagtgaattgaaaagagaatggaaaagctagaattaaaattttacatgtgaagaaaaattgagcaaagcggagatcaatgtgttggtggtggtgacaaggttattggcatgattcctatgaacattctgcatccctccttcaggagaaagccttgaccattttatccacctccatatggtgtaagcaaattcagccttagatgtatattttcatctgaattattttctttggttgaatttattggtctttgtttcccaacatctgtttcttctcttctattctttaataatagatgaaggataatgggaagtatccaggaactgacactgattagaaatatacctgacagtgagactccaaattcagtttcaatataatctaaatgtctctatttggaagaagttacttacctgtaaaataatattttacaaactctcgtagtgt

SEQ ID NO: 27517 - DNA, 1273 bp, Bovine  19866881232027
attattatgctgaaatgatctcttggctatgatagatgtattaaataagatttgcatgtgaaagacctcaaagtttttgttaatactttccaaaaggcttttaaggagtttttaaatttatctctctttagctgtatagctatatttcacctaaatctaaatttatcccttagttgtataacgaagaaactatgtcatgcatgaagcataacattttatttgaagataaatttctagtttacaatgagtcaaatatcagattacataaaaatatctgtatttttagggtgtattcagatacacaggtatttgcctattgcaaagtatccattggaatatgctatcagaaactagttcacgtgccattgagaatacattactaggattcttatactctggttaggcagccaagagatttgaccatcttttccaagatgacttttggctaagatggaagataattatgcactatttggtaactgttcaagttaaacagtattcctgccttgtatctaagagagtgtttattaagtgaacccaatgtccatcagatgattatcccattttgaagaaaacagattacatggaaaaaatttggaatcctactctgatagtacaaaagtacaaagtaaagttgctcagttgtgtccaactctttgcgatcccatagactgtagcataccaggctcctccatccatggaattttccaggcaagcatattggattgggttgccatttccttctccaggggatcttcccaaccgagggattgaacctgggtctcccacattgcaggcggatgctttactgtctgagctaccagggatagtagatggcttttatttacccagggtggaaaagtacataaatagtgagctaaattagcttatgccacacattttattactactttgatgttactaaaataacctcatgttgaattatactctatgcataagtaggtttattcgggtgtgttaaaaaataataataactagaatatgcaattaagatgcgcaggtccttatatgacttttagcatgttattcttcaaaagttttttttaataatgttttatcctccatgaattatttataagtgaagcatttcaattataagaatgaaaaatgtagatacgaattattttaaggaaagaagatgtaatctaaacaaaacgaaaagacaacccatagaatgggagaaaatatatgcaaataaagtgaccaaaaagggattaatctccaaaacatacaaacatctcacacagctcaa

SEQ ID NO: 27518 - DNA, 899 bp, Bovine  19866881316622
cttgatgaatagggtaaaagaaataagacttaaattatgatggtaaaatatttaggaaaaaaatcaagtgtctgttactcgcttagacaacctaactttacaagatatagttgtccaaagtttcatctaactttacttctgaagatactgcttggaaatgctgttaatgaggcagtagtaataatgaaatacttcccagaaagatgattcattattcagtgcagtacagtcaagcaagttttcaagttgtgtaattgtgatagcagcagaaagtgacaaagatagaagaaattgtacctttttttacagggtacaatttaaatatggtgtttgagaaatgattgggaaagacattttccctgaaattagaaccaactcatctgccttgctttctttttcacagtgtttcatcataatgttttcccttgttgaatttaaatgactgtgacattcttcttcctaccttggcatatttttcaaggagatatagtcttagatatattaataattttaaaatatgttttaaaatattggttttatttggcaaaatgattataatactaatcattcatgggtcaatttcttggaagatctttcttctgcaaactactgttgaccataaaaacaaaattgtgactttgaattatattgtatttgtttaatgtagcatgtacattttcctggctcagagtgggctgcttcacaaaactgtataaaactggcttactttttaaattctccagcacagggtggtacactgcatgcataattcaacttgttgaagcatcctggaaaatttttctttattgttaaaattgtagcaacaagtagaaattaattacttgttataacacaaagagcttttatgctatattccaaatgttgttttatactgaagt

SEQ ID NO: 27519 - DNA, 1449 bp, Bovine  19866881356411
agagtgaatctttgagctcagatgagtgggtggggagcaggaaagcgaagactggattatggacagatgtacagcctagcaaacattcaaaagggattcagctaaaatctgtttcctcatatagaaacagacctgccagttggtaaattaattctgtgtgctcataatgagcattttcctttggagaagttttctttagaagtatagatggaaaaatatacagtgtaggaagcaaagggtagaaaagacatccatatggaacaacaaacagtgcactaatggaagagccctatggttactgctctcatcttcagttgagagtttccagacagtaaactagtcggatgactcttaaaacagtaccttctttaatcgctgagataaagcatagcatctttggacatgaatgagcagggaaagctgtgatgcctgtgggaaaggcgtacctctgactggatgaatatgctgttgaactctacagagagaagtggaatggatcaaatagtggagacaagggcactgctttcattataaagctttttgaaaggtggatttgtgcaagcatactcaacatggagctgaggctaaattccatctctttaagatgaacataaagtgaataacgttttacttttcaagacaaaaattcattcagagataccactctgcagtatcaataaatgtgtctatggtacctagatgggtcactgactaaactgtccatgaggaaaaccctcattcctgtctgaagggatgaaagacttcacccacccaacaaatgcaacatttaaaatattttctcttgcactctttatatatgattttttttctgttggttgcagtaaagtaagccgaacagagtattatacctgtggcatttaggctttctagatttttttatgtgcaaaaaagcctagattatagctttataaaatgtatggaactcttctccttgagtatatatgcattcattcattagcaaattcaagcagtattcaatggcccagggaggacatttttggcattcctttttagaagcaatggtattttaaactagcggaaggtattacataaaacctgctttatagcctcttacaaaaatgtagtttttacaaatattgtaacaacagatcatgtacttattccagaatctaagaattatcctgtaattttctctgtctctctttccaattcaacagcatatcctgctgacactatttcctgaccatcttccgagtatgtctcctcctttccaccatcctctctcgcctagactattgtaacattgctaatgggttccttgcttcccctgctccaatctagttcccacatggatgcaatatataaatattttatattcatagtcttcagtcttactctatttaaattttgccaaaagcatttcatcacacttagtataaaacccaaaccttattatgcttatcagtc

SEQ ID NO: 27520 - DNA, 2244 bp, Bovine  19866881364378
aatgaagtacttagcaaataggcaatttaaaaggctttggagattttacagaagttgaaataatctgaaaaaaatattttaggaagattaacctaatcctgacaaagaaataaataaaagtgggaattctctggcagtccagttgttaggacttgtcactgttatggccccaacttcaatccttggttggggaactaggatcccataagctgtacaatgtaaccaaaacaatgaatatataaaaaatttaaaaaaataaataaataaacgcacatacccagaaatgcagggatcagttttgaagtaatggtggaaataatctgcagtatagaatgacactggcaatgaacaaataggtttggttatagaaaatatatactttactagaagcaaccaaatcatttaaaacctctttttaatacctgatggctcaggtatttttgttacctttggagtttataaagtggtacaagatttgttcataaaatctattctagttgctaggaagagatatgaattattttacaacctggggacatggtaagtggctgaactttcccccttatttgtaaaattattttacatgaaaagacaaatagtagaacaacagtgtgtaatttaagaaaaatcacaccaacagagaagtcacagctgggaagaatctttgcctccctatgcttatttcaattaatcataagaaacaattacaaaagtgtcacaactgtcctctagactctaaatttaaacatgaaatagctcattcgattataaatttttccataaaataatccaaaccattattttattgtgaacacaacccaaatgttttagtgtattctataaagcaatgggcttgaaattattaaaaagtttacaggggaggaagtatttccagggttacattggaaatgccattatatccagttttcttgaagagaggactactttcaattggattaaattagaagtaagatcctttcttcaaaggattttaaatgcccctctctttgttacaatgtgctggaagcctcagcaagcagtatgagacccgtgatactcagatgagcacaacagaataaccatactccttttctagtgttttgcagcaggcagccacattcgtgcagaacatattggaaggaatctttgctttcacaaagctttctcaggaccctaaaataaaacttgtatttaagatgaaccttcaggcctcacaggacactatgggaacttctgaggcttgtgcagttcacgtgctacatggcaagggggaaaaagagctttcagcatttcaacatgcaataagtaagaacccagtattatccaactctctgcaaattgaactaattcaaagacacacacatttgaattgaaataattcaaagatacacacaaggcacagggtgcagtatccaatgactgatgcatcgtatggcaggaaaatgaccatcaaatcaccaacacagagagcagccatacagcctcaatggtctagaggttgcctgagttttgttgggaaatactgcctgttctaatatgactgaccaacacagtgatgataatcccctcagctgcagacagggctgcttgtggtttggaagctatgggtatgctaaagcctgtcacccataacttccagccacgagcagccttatctttttacccctatgtgccatataaattttgtcattttctatctgagccaagacagggaaacacttgggaagcattgagctaatggacagtacaatatatgaagttttcattacttattatagattcagtcatccttaatgctcttgatggtatgcctgaatttaaaacaccttcagggggcttccctggtgactcagtggtaaagaatctgcctgccaatgcacaaaaccaattggttcaatccctggtctgggaagatcccacactccttggaaccaatagacctgtgcaccaccgctactgaacctgtgttctagaggctgggagccgcaaccaccgatgcctgagcaccctagagcctgtgctgtacaacgaaagaagccactgcaatgagaagcctgaggaccacagctggagcacagcccccatctgctgcagctagagagaagctctcatagcaattaagaccccacacagccaaaaataagtaactaaataatacaatttaaataaacaattaattaattaaataaaacacattcaggtatgttcaagacgagtagtgtgtcctaaactaaacatctatca

SEQ ID NO: 27521 - DNA, 1004 bp, Bovine  19866881370908
aatgagagaggtgttgaagctgaagagaagagagaggtacagcatgatcacccagctgaaagaaggaacacactgggactagagtgtgattcctggaaaccttctaagctagtggacataaatttaaagagaatccaatcaacatgctttgtgtgtgctcctttgcaactttattgaacttcaggggagtatgggataatcttcacaatagtcgtatttggtaggtactgttaccactcccattgtagagcagaagaaacgcaggaacaaagaaggattaaggaaattacccaagatcacagcattagtaagggtcagtctgaattctaatccatacatagcttctaacacttaccactatacctactgctttcatgaattatgtattccatgcatacactaagtgtctggtcagggtaatgagatgatcttagtgccattgtccaagttaaagagtgcagaaatgggagaaagttcaagtatggggatggaggaactaggaaatcattggaatttagtagtggaggaagcctgtgactttttctgaacaaagtgctggctttcacaatattcatattttaatggagaaacaagcaattaactagaatggaatggaactagagaggagaaatgctcaccactcttgaaggaggtgggaagaaaaggtgtcaaaaaatacctcccagatggcaagatgattagtcagattcttgaagaatcaacacaaagtccttaggtaaagaacagcatgtgcaaaggcatggaaaatgccacttgtggggtcctgacaacactccatctgggaaaaacggtggaagtgtagagactacacagaaaggtgggcagggaacagctggagagctatctaaaaatcagagggaggggtgtggcataggaggattcacattttatgaagaaaacactggactcaatttgaaggacatattggaaagagaatgggagggaatatttgagacaatgagaccatgttagtgatattacag

SEQ ID NO: 27522 - DNA, 1160 bp, Bovine  19866881379970
ctactattgtaattcaaactttcacttagaattgaaagcaattatgattaaaggctttcaattttgatttttcattaaaaagtagcaatacaagtctgttaatgctataaaggtaaatttgtttaagagtgtacagttggggatttaaataaaatgtggttatttaaaacccttttaatttatgttccattgctccctgctgttagaacctgtttcagaacttaattatcttgatggctacgacaaaattctgtgacaaattaccctaggaaatataagaacataatttagaacaaaaaggttttaaattaactggcttttgctcaatggagttctgtcagacaatttttgttttgtaactgaatattgattgagagagaaatggaaaagattacaggaatcgtcattcatttttgcaaaataagttgtagtttccacattccatatcaaataacaaatcatatagcaccatctaaaattttggggcattgctcttttccaaacttgctattttataaagaattttagttttgtgttcactgaacaccaagcagagcatgagtctctcttagcttggttgctgaacatgtgatttaaataggttttatatattagaatgccctttttttattctcatggaccaaattaatctgagctcaattgtagaactctaaaaagtactgcggtggaggtgtcagcaacactagcatcaagatcagcaaaggcactgttaaatgtgacattttgcaattaattctagcaaaggtgttcagtcacatcatcccttcagtataatttgtatttgacccttgataatacatactttcttacatttcaagttcattgtttttaagaaatgattttcttcagaacctcctagacttctggtcttaacttggagtgctttttgcttttgcagttgtcttttctttgtactgattcatttaagtagagttaagcaaaaatatcagatttaataccagatttattgtctactgtatcactagtcatattacttcatttatattgggaatgttctttactttattaggttataaatttcttaatgccaaaaacagtgttttttcatgtttatatctttagcacctagcatgatatctgtcacataatggattgaaaatatatgtttaatccctgaa

SEQ ID NO: 27523 - DNA, 2835 bp, Bovine  19866881534474
ttttcctctattactttttgggaactaaatgggtaacaaatgaataagcagacaataaaatgtggttactatagtttgttcctgttataatacaaaccatcactaaatcctagagagttgttcatatgtaattatgccacagcctctattttattcttcactgtgaagttatctgatgtgcaaaaatatctaatttgtgacttaataacatttattccaataaagttattgtgcacaaaaggaaatgatgtccttacaacttctaatcagtttccttgaagtgtgaacacagtactattctgtaacatttggtttctgtcatctttctcaatttataaattgaaactgattctacaatatcatcatgggaaaatagatgctatttatttgaaaattattaggtagcacaattctgccagaatgttaaattcacctagaaaaatggccttaataaatttttaaaaacatgaaattctgttggggttaagagaaggacagtatcacataaaattaacttaaaggctagcaagtctggcagagaacctgcagtaaaatctgcttatctaatattgattttcagaagttgagtgagaagactgaagtggatatttgatatgaaataaaaaacctacctacccacaccaccattttggattgtttaagacttagaaaatagttctatatattgcaagaacagggaatttttgtggggaaaaataatttacttaaaacttgagaccaaaactaaactgaccaattgatgctgcttaattataatgagacaaaataaataaaaggaggaaaacactggagtattctaaagatgggagatcatgcattccataggtagctattctcatgtaacatttttagaatggagccatgtctttaaaatctaccattaagtttcagttaaaccaaaaatagtaatattttaaagcaaagcatgacaaatttaatcaagtaagattgttataagactgaaataggactgtagtaggactttttggattgataaaaatacatgatttattattcttgactcaatggacatgagttttagcaaattctgggagatggtgagggtcagggaggcctgacatgctgcagtccatggagatgcagagttggacatgactgagtgagtaacagcaactatttgaagacttcgatagcagtgtattagctgtttcaaaggaagagggaaaccactagttttgttcctccctaaaagatccagcaaaatagttaatttttataatgaagataatataattaataatagttttatttttcaaacttggggagaatcagtggctactgatttttaaggtttatgtcatgatgtgaagggcgttttttagttctacaatagaactgaatccaggacattgggattggattgaaacctctcagagaaaatacaacacagagtagtttttttcataaagttggaccacaatgaaggttgagggccaaataattgacatgttctggattgatatgatgctggagaagactcttgagagtcccttggacttcaaggggagcaaaccagtcaatctcaaaggaaatcaaccctaaatactcattggaaagactgatactgaagctgaaactccaatactttggccacctgatgcaaaagccgactcatttggaaagaccctgatgctaggaaagattgaaagcaaaaggcaaaggatgcaggagaggatgagatggttagatagcatcactgactcagttgtcatgaatctcagcattctctggcagatagtgggagacagaggagcctggtgtgctaaagtacagagggtcacaaagagctggacaaaagttagcaacaacagcttgaataacaaggacataaggacacaactgaataacaacaataatatagatgcttaaataattcctggtctatacagtgactttattttttttttaattagggatagttgttttacaatgttgtgttagtttctgaattacaacagatgaatcagctatatatgtatatacatgtattgcctccctgttggaattctgtgcacccctaccgcatcctacccatctagctcaccacacagtactaagttgagcatcttgcactatatagcaggttcccacctgctattttacacatagtagtgtatatatggagaaggcaatggcaccccactccagtactcttgccttgaaaatcccatggatggagtagcctggtacactgcagtccgtggggtcactaggactcggacacgaccgagcgacttcacttttacttttcactctcatgcattggagaaggaaatggcaacccactccagtgttcatgcctggagaatcccagggacaggggagcctgtgggctgccgtctctggggtcgcacagagtcggacacgattgatgcgtcttagcagcagcagcagcagtgtatatatgtcaacccctatctctcaattcatcctgtaattccgttccccaccccatgtctatgtgtctgcatctctatttctccctgcaaacaggctcaccagtaccatttttctggattccacaaacatgctttcatatggaatatatacttttctctttctgacttacttcactctgtatgatagactttagatccatccacaactctaaaaatgacccaatttttctcctttttatggctgtgtaatagttcattgtacatcttatccatttatctgtcaatggacatttaggttgcttccatatcctggctattataacagtgcttcagtgaacattagggtgcatgtgtctttttgaattaagttttctcagggtatatgcaaagaaaa

SEQ ID NO: 27524 - DNA, 647 bp, Bovine  19866881637723
attttgtaagtaagcactaatggaagtttaaaagcctggtaaaaaaagaatgagtgcagagtgttataatacctcctgctttttcccttgactgaatataagaactgtgttaatgcaatatttcttgcctgcctgtttatcaaaccatggtagggtcagtctttctgggactaaactggtagcctctgagtataaagaatgtcaggtaaacggatgtaaattgtctgtgtcctgacctgagggcccagaacacagcatcaagggacaagtgttccacaaacccagcccattaaccaaaaaagccctctgcctgtataggaacagaaggttaccaacaacatgcaagttaaaaacctcactgtcacttagtcacaatttctcttccatgtgtaaaacaatgcattctgtgagccaacattattcagcttgcaaattctgtctgctcaattctaagactaaagttccacctaaaaggtctgattaagaaggaaaaatagagtagtctccaggggcatactaatttcaagcttatgtgagtgttcccatagataaatttaccaaggttacaatgtgcttgcttggcaatttatctagattactgagaagagagtgttgtaggaaaaaattctctctcaaagctaaaataa

SEQ ID NO: 27525 - DNA, 680 bp, Bovine  19866881756721
ttttaaaaaatttcctgtgagttcgatttctatattttcatttaagtaaataaattaaatcatcttgcttaattatcattagaattttcatattttattatgttcaaattctgttcaaaacaaaaacttatatgttaacgttatgaatctttgagctggacagttaaaagatctttatgtatctgtgcaatttttatgcaatttgtgattacctttctactgttttaggttaataatgaaaatatttcaaaggaggtatattttaaagaacagagctgagaagtctgatactataatcactgtttttctgaatttacatgaacaaacaggtaaccagttatggccaggatttgaaatagagccttcggatatttaactataatctgctttacctttttttccctccactctatttggctgatacaactccagtgttaatcttcaattaacctatattaatttgtctactgattaacagaaataaatctctattgtggttgtgcttccctctgttcgtattaggaaaggggtgacagtgagaattatttcaagtatcggaaagagtccttgacccagttaatagatgacataaattctctcatttgattccttcctgcttagcactccataatgtaaagattcaaagccttttagggtgacaaatcgctatttgaacatca

SEQ ID NO: 27526 - DNA, 906 bp, Bovine  19866881815233
tactgtaataagtaaataaaacacctccttgaacagctatagggcttccccggtggctcagctggtaaagaacctgcctgccagtgcaagagtagcaagagacatgagttcgatccctgggtggggcagatccctggagagggaatagcaatgcactccattattcttgcctggaaaattaagcctggtgagctacagttcatagggttgtaaagagtcagacatgactgagagcacacacatacacatgaacagctatatatcccatatacagttgatctcccgtaacttaagtatgctgagttttaatatcttgttacattactttcttcagtgttccttagtgtatttaacatatagttagtgttctctgtgctccataaatattcgttgtatgataggataaataaatattaaaggcctaattttgtcacacaccctgaaatataaattgacaaattacatgtgtatatatatgcatacaaatatacatacagcctttttccatgtcattttaataaaactttgctttagactctatttaaatttagagaaatttttaaaatctctatcactttgctctttcttagtttacttgattctttaattgcttgctttctggagttagcctgatattcttgcaaggctgcaaaaaatggtgcaaacttatccaaaggtcagttcaagctcatgttcctttggcctcttgccacccaagggataaagttcctgtagaggactatgtaatcacttcagagaatattggtgtttgaaggagcgaaaaggactaaaatatatgaaaaattcatggtccttcattggcattcatgctgttagtcgattttcatcagacagtaaatgagaagaacctgaagtcttgtttgtgttaacagagctcttttatat

SEQ ID NO: 27527 - DNA, 663 bp, Bovine  19866881981369
aaatacaacataaacagaatgctggagatatggaaaaattgatcaatacttatcattattttcttttatagaataaataccaaatatacatttatttggcttacttattagagtgttttagacatttgattaaaatgaatgataattctttagctatagcatgtagagggcaaccccacaccatttaaagtcataattttaatataatataacagctttttttccacctttacttctataaatggagaacagtgctgcctgaaagctgtctgggaattcagccaaagaaagaagaggttgcaaaaactctagggacttgaaagaaaagtagctggcattagcttggtcctcactttaaactaaaattaaaataaaagacagacatgtacagtaatctctcttttaaagaaagaatagaatgcctctatagtaatgtcaagtggaacagtttgatcctggcccaagttatgcagctgttccacaggaaaatagcaaaggcttcagtccaaagcaggcaaataaggcatgattgttcataaacagtcactggggccctcacatttagaacaaagaaaacagcattagcatacaggaggccagtttaggaacatgagtctcagtatgagtcgcaccatcgttttgtacttatacaaaaagcaatgt

SEQ ID NO: 27528 - DNA, 1401 bp, Bovine  19866880084106
atggtgactgcagccatgaaattaaagacgcttactccttggaaggaaagttatgaccgacctagatagcatattcaaaagcagagacattactttgccaacaaaagtccgactagtcaaggctatggtttttccagtggtcatgtatggatgtgagagttggactgtgaagaaagctgagcgccaaagaattgatgcttttgaactgtggtgttggagaagactcttgagagtcccttggactgaaaggagatccaaccagtccattctgaaggagatcagccccgggatttctttggagggaatgatgctaaagctgaaactccagtactttggccacctcatgcgaagagttgactcactggaaaagactctgatgttgggagggattgggggcaggaagagcaggggacgacagaggatgagatggctggatggcatcaccgactccatggacgtgagtctgagtgaactctgggagttggcgatggacagggaggcttggcatgctgcgattcatggggttgcaaagagtcggacacaactgagtgactgaactgaactgatatgttagttactactactcatgatgtacagaatgattcactggaggacacagtaaatttcataggtaaacaacccttgatcaatcccttgggagaagctacttatcttgtgaccaaacatcagtcactttcccagaagtcatggaaagatgccagtgccacctcatggaaatgctcagaacccagagaagattaaaaaatactagtgccattcaaacttgaacagtagtttgtacacatttagcattaattctattaaatatttttaaacacaaatcagaagtgcaaatccaaatacacataggatgctaatacacagctccctgtcaaacactttgcaatatacacagtcattttccctctataattcacacggattaatgttactgttctcacctcgtcttccagcagatgatcagtataattcccctttttaggacactgaacactttcccctacaaaaaatttaaattctaacttgttgagcttttttctttttttaatccctgaagaaaatggactgggaagaggaaaaatgatgaagtaataacacccaggtgcttcctacctaattaaaagaagtttacagctgcaccatagtgaatcatccctgtggattatccacacgtatccttcaagtggcacgtagctccatcaagagccatattccatatgctttcctgaaaactgccgtctcttagctttggtaaaatgatgactatcaggtaactaatggtattttctgcttcctggctttcctccctatggacatctcagttcatttgtatttccttaattctaaaaataattaagaaaccataagcaagaggctcag

SEQ ID NO: 27529 - DNA, 1863 bp, Bovine  19866880143581
agaaatatcaataacctcagatatgcaatgacaccacccttatggcagaaagtgaagaggaactaaaaagcctcttgatgaaagtgaaagtggagagtgaaaaagttggcttaaagctcaacattcagaaaacgaggatccatggcatctggtcccatcacttcatgggaaatagatggggaaacagtggaaacagtgtcagactttatttttgggggctccaaaatcactgcagatggtgattgcagccatgaaattaaaagacacttactccttggaagaaaagttatgaccaacctagataacatattcaaaagcagagacactactttgccaacaaaggtccgtctagtcaaggctatgatttttcctgtggtcatgtatggatgtgagagttggactgtgaagaaagctgagtgctgaagaattgatgcttttgaactgtgctgctggagaagactcttgagagtcccttggactgcaaggacatccaaccagtccattctaaaggagaccagtcctgggtgttcattggaaggactgatgctgaggctgaaactccagtactttggccacctcatgagaagaactgactcattggaaaagaccctgatgctgggagggtttgggggcagttaggagaagtggacaacagaggatgagatggctggatggcatcaccgacccgatgcacatgagtttgggtgaactctgggagttggtgatggacagggaggcctggcatgctgcaattcatggggtctcaaagagtcagacatgactgagcgactgaactgaactgaactgaggagttaagattttatggttaaagcttcctgttatttagaggatgaagtgttgattttcctgtacaacatacattctcttccccctcaggatgagctagctgctgtaacaaacagcccctcagtcctattaaatgcttacctgcatgtccactgtgctttgactggggcttgttctcaaacagtctctcagagacccaagttgagggaggtttcatcttaacatatgcttccttgatcactgcaatagtcaggtgggaacaagcagaatcacaaataggcccccacaggttcttccagaagcaacactaggttacatttctaggccaaagcaagtcatttgtccacatctaaattcaaagaggacgggaggtacaaactcatctaattccctgaagtcagaaagctaaaaatacttgatgaatagcactccatgccttcttttttcaacaaactttttattatgaaaatgtctacaggaagaagttggcttggatcagctgccctttttggatcaactgatattgcagggaaatctggaaatactttctttcatatgaccagggaaggtagtggacatcatggttgaccactcacagaataggtggtcatggttgtggatcccaattccagaattgaggacactaggcaaaggaaagcacctgggtcctctccatccacctacatactaaaaaaaaaaaaaaaaaaaaggtagatgaatgaatcctgggctggatgaatcacaagtcggaatcaagattgcccagagaaatgtcaacaacctcagatatgccgatgataccactctaatggcatgaagaggagctaaagtgcctcttgatgagggtgaaagaggaggggaaaaagctggcttgaaactcaacatgaaaaaacaaagatcacggcatccagtccaatcacttcatggcaaatagatgaggaaaaaatggaagcagtgacagattttatttttttgcgcgggcgggggcggggggctccaaaatcactgtggatggtgactgcagctgtgaaattaaaagacgcttgctccttgaaa

SEQ ID NO: 27530 - DNA, 898 bp, Bovine  19866880351256
tataataagttgcactccgagagaaggattacagactcagatgttgactacagacaaaagtgatttttaaggagtttaagggtgacgtttatatttagaacaagctgggccttctggggttgagtcgagaaactgctactggtcattaattaaacaaacccctgctgtgtctctccgtggagcgtatgcatgcgtgtgttcccgtgaaaagcaccagtgggtggttgccatttgcagcttctatctctgagacttcaggtttttagcttgtgatttgtcactgctgatttctctgcccttgtagtcttaacccatatggcacctctcttccaatcattaggacatggaaccttagttttagattctctggagtaaggatcagcaaattttttcctataaaggccagaaaatatatattctaggctttgcagaccatatagtgtctgtcaaaagtatacagctctatcaagtagcccaaaagcaaccacagataacatgtgaacaagtgagtatgagtgtgtcccaataaaactagacaaaaactggccacaggtgggatttggtccatgggttacagagcgctgctctgtaggattaatctcttgcagatgacatcccggtcaaccctcaagtgactttcatgtacacagtggggcccatattaagacaatcatacagagtatagcctcctaatctgttgaaaagcaaataataacacaaatgaacagacttataatatctttctctttcaagtgtcagggatttaagcattttaattccaatagaagaaaaatcaggtggtctatatgctgtatctattactacagtgaggctattaaacaaatcatccccaaattcagtaactgaatacaacaccgatctgtcatttctccaacat

SEQ ID NO: 27531 - DNA, 1004 bp, Bovine  19866880422818
ttgaaaggagagtgctaatgaagcttgtgcttagggagcagtgcaaattagatcctttctgaatcagatggtcttctcggatgataatgcattatgagaggtgccggaatttgttttcttcagatttaacaccatttaagactataagccacaggcccttaagaaatgaagcacacttctacattggacttaccttctgcaaaactctgaggcctagtgggcctcctaaataattcataaaagtttatagttcagggcattacatttaaaataacctatacacatataattctagaatgcagctcctaagatacttgtggcaggtactcattgatgattctcttggtggtaaaaccatgaccactaaaactctttgtatcagatagcttttggtataaacatactgtgtaacaaactgctcacatatcccatagcctgtaataataacatgtctttctctcagtcacaggttggtgaaatggctttaaggcaggctgtgggttaatagatcttggcttcagagtatggggttgggtttggatctgttctgtttatttcctctttcttttgactagcagctactctggcattttcttctgatggtgcatcaatcgagtgtgaaaaggcaaaccagactgcaaagtacatggaaacctctgtgtcttgtcatcctgcccaaagcagatcatgtggttagatccaacattaatggtacagggaaatatactgtatccatatcaggagaaaagaaaactataaatttacaggggaaaagggcatgggatgtataatttttatgcagagatagcatgaagaatcatgaggcatggtgttagtctaccatactgtgttaggttttataggtccaaccatccattcatccatccatctgccctccctccttctctttctttctttctttttctttttgtggtaaaatatacataaatctggggcttccctgggtagctcaactttgtaagaaatctgcctgcaatggcagg

SEQ ID NO: 27532 - DNA, 1221 bp, Bovine  19866880444190
atgggagggaggttcaaaaggaaggggacatatgtatacctatggctgattcatgttgatgtttgacagaaaacaacaaaattctgtaaagcaatgatccttcaattaaaaaaattaataaaatttaaaaaagaaaaaaaaaatttctgggcacaggaaaaagataaaaagaccatctcttccataagcactgtgtggtcagagtttgaattttggtgatccttccaaattcttgctgagaacagaaacctccttacaactccttgtaaatcctccccccgccctcctttcccaagtccactgagggggagcatcatctggtctttacctgtaaagctactgttcatttcaggaacatcatcctcttcctcattctccgcgtggactatgccagcattttgcatatcattgtaggacttggttcgctttggggtcgactgcttggagccagagtgaaggttttgcaaggcatccgtcgtgatcactttcccactgactggctggctaggagggtttgggtgtcccataatagtttcctaggtgatggagagacacatttgcatgttttagaaagaatactttgtttttctcaagtctgcaaatccaaatctcttagccccttcaaaaaaaaaaaattttttttttttttttttttttagattagaaaaccagaacaaactgtatttcatttctggaatgggtaagaaaacatgttggtcctacccagttagacatggagatttcagaagccaggaggaaagctgcattgtggtggggaaagaacctactagggatgaaaacaaaagcggctgtgcagaatggaaaagcttcatcctcattacatttgaatttcaattggtcaccgtttcacatatatgcactagcataatgcagaatccaatttggagtgagtggcacacaaaataacaaattcattaccgccagcacccttacaagctgacacagtggaggtcaccctcccttaataaggaaactcctcaagagggaacccaagcagtactttttttaaaaaaaagagcgtgaacaccacgtggcacctctttaactgaatggcaggtctgactggcacagccatgtgtggctggaacaaacccttgcctagctttcacaggaaactctgggtcagcagtggcagagtggcacccttcacgggtcacttgtttggtcagtgcccattttcatttttagccacttccctct

SEQ ID NO: 27533 - DNA, 2790 bp, Bovine  19866880453017
aatcatccctgcgcagtgaaagattctccttgtccactgaagcttcctgatgctcaggctcaacaggacctcacctaacattcaaattccactctttatcttatttaaaaacaaaaactcctatctcatgtgaacaaagtttgttagggcaataatcctgtgaaactgttcattgccggcggatgtcattaatcaatttgtttacacttggtctagggtaatttggcagttataaaatctgttgattggtttctaacagataccaagggcttatcccataaattctgcagctgtggaactaaggacattagggctgtcccttcatattttggagtatataccaccacagtggcaccccacccctccacttcagaatagatatattacagatacagcatacgttccataaagcaaagcatcgtcttttcttgactcagcagttcttagctgcaaagaccatgattcatctggtcaggtgaatgccagcttccaaatgagaagaaaaaaaaaagaaacagcattagggagattcacctgtaggctctctctcaccatttctcctctaagcctactcttataaagccactgggttccagaatcaacatcaatggatctgacttttctagcttttgaccctcaaagaagacaaaagtgaaaccagagtcttgtaaagagaatgatggggacgatgaatttcgagactttatgaagtcatggaccaataagtgggctggcttctctcagaccactcctcttgactcaatgcctcttccaccctccagtccaaccacagtggtctcctcacaacccctcaaatatgtaagcttttccataatgacgtggagctcttcctcccagattttctcatgcttggcactttctcagctcaaggatcacttcttcagagtagctttcctcatcactgcactgaaagaagcccatccagcttattccagcaatattctttcaacacttcacccccattttattgtttccttaatcctttggactctgaaataactgcttattcacttaccagttcacttttcttttttgtttggttgcactgtgcagcttatgggatcttagttccctgactaagggtcaaaccagtgctctttgcaatggaagtgcagagtcctaaccactggactaccagggaattcccttgttgctgttgtttaatcactaagtcctctctgactcttttgcaaccccgtggactgtagccctccaggctcctctggccatagaatttcccaggcaaaaatactggagtagattgccatttccttcaccaggggatcttcccaacccagggatggatcctgagtttcgtgctttgcaggcagattttttaccactgagccaccagagaaggccagggaatgccctacaagttggcttattttatgtctttctcatcttccacataaggtgtatgagagcaagaccttcacttgccctgttcaccactccatccccagcttctggaagagatcatggtacttactaggtgcaaagagcacttgacaaggggtcagatgatttgggtggcatttccaacaatgaacaactttgactcatttccccatcttcctggatctccgtccctcacctgtaaaaagaaataataatacttacctcacagagtacctgtgaagatcattgaaacaatgatcctgaaaatatatttttaacctgttatcattacatatgggagaaatcccagggttttgtaaaagacctggttagtgaatggatgaatgaaatattatgaaaagtggagagtcttaaccacttgagatgattaaaatttaagatgcttatcccactcagaaaaaaaaaaaaagtatggaagttactaccttaagaagttacatcagttgactgtacagattctagaaagttaaagctgaaataaacgacaagttataatcaagtgagttttacagtcagatttctagagtcctggggtcttcttggaagcccccttggagtctcacagtggtaaaggggaaattgtaatagatgggagactgaagtgacaggaattcatgcccttcctccccagtccagacggatcaactccatttttatgctttttgccctgtttcagaagctagctatttactgctcagtcctcttcccccacttccttcctacaccctgattttctgtgcagtggcagtgggcccaacttcaagctgtggggtctgatcagagtcattcacgacaatcctgtccctcaatccctgtctggctgggagctatggattgacacgtgacccaactatggcttctcatggaaacatgagaagcccgtgatgctgaagctttggggaaactttgatttccttagtagtagggacatgagtggctggttctgaccttgcctttattcccccgcctcccttcatggccagcattgtgtctgcttctccacttgcagtcttgtcaccatgtgtccataagcatgatgggaaagcctggaatcgcacacatggaatttgatcaatgagttactgaatcaatgccagcaaacatctggctccagaattcttgccatgtgaggaaaggaaccccttactgtctaagctacttcatttgggctttcgttcagttcagttcagttcagttgcccagtcgtgtccgactctttgtgaccccatgaatcgcagcatgccaggcctccctgtccatcaccaactcccggagttcactcagactcacgtccatcgagtcagtgatgccatctagccatctcaccctctgtcgtccccctttcct

SEQ ID NO: 27534 - DNA, 1349 bp, Bovine  19866880458795
caggcacttccctcctgtcccccccgcccccgctcagctaccgcgtctccagggctcccagcaactgcctggaagggcttccctcaccctcagaaaccgcccgcccgcgaggaaaggcgaaccagacgggaggcaaagaggagacaccgcatttctaagaggcaagaaagaaagaaagaaaggaaggaaaaaaaataatccaagcggcgcagagtggactctgatcccagagagcacggtcgggcgccggaacgtggaccgagaagcaccggaatgcaaacaaagctcgcgggcgcctgtgcagggctcgcggggaagcccagaaagtttgttttatgatggcttgagtgagcgagtgtgtgcaagggagcgaggctgccaagtttctctctcccgctgcgttgtttgggggggaagatgtctctcccatgaaccagcaggggcttgggggcttgtgctgtggggggcacctgtctctcattttatcattatttttttttggcggaggtaggaggggtgtaactcatcatgtcgaaagtgatccagaagaagaaccactggactagcagggttcacgaatgcaccgtaaagcggggaccccagggagagctgggggtgacggtgctggggggcgcggagaacggagagtttccgtatgttggagcagtgacggctaccgaagcggcggggcttcccggtggcggcgagggccctcggctgggcgagggcgagttgcttctggaggtgcaggggatccgggtgtccggcttgccccgctatgacgtactgggagtcatcgacagctgcaaggaggccgtcaccttcaaagccgtcagacaaggtaagtcgggacgcgcctcctggaggcgcccccagaaaagggaacccggctgagaagcctcctcccgcccccctttcgatttcccgcttttctcctgcgaacgcgctataggggcgatgttgaggccgtgtgcccagtgatggtgaaatacaccaagttgttgagaggctgtggattgtttgcccacctgcgttgggaagaggggcttgggttagctcggggaagcgcagagatttttccctggcccggtttgctaacctgttatctccgacaccaagtgcagcagtggcttgcctgcaccgggaggagagttggggaactgaggcaggggcaaagtggacgctctcctggttccctgggcgagtgttgcagcgggcgtaactacggcgttctttgatctcttagctgttttcagacctggagaatgggtatgaaggaggtgagggtctttgattgttggacctccttaatcagaaaatcagcatcaccccgtgaccggccaggtggg

SEQ ID NO: 27535 - DNA, 1379 bp, Bovine  19866880560100
tggaggctctgttctgtcatctctttgggcggggtggggtagtcatggatggtcatcagatgaagggcctgggggaaaaatggctttatttttcctttctgttagaagaagtggcagataagaactactgcctcattaatgcttccctgcgtggagacggtggcctccttcgagctcctgtctagtgaaagggctctcatatacaatagaacataaatacgattggtgtggattacaagagtaataagaagaaattcagtgcttttttagtggtctcttggtttttaagaatacttataatgttttaaactgttattaatctttctaaacattcctttcaaaaaggaaaaaaacaagcagtgggtatttgtgctttaattgttcatgctgtagttttgtgtattccttcagcttcacctttttgataaatatgaactactgttgtcttattggctctgataaactgaatagtccctggacttttttttttttgctttttattatgagatgatttccaaagactgttcaccacaaataatattcatttatcttactaaatccatgttcctaaaaatgctttaatcttagggcgtgcaaatagacaccccttctccttttttttttagctgttgattttactgacgttttttcgtacgtgtggtcaggacaaagtaactataaagtacatgcactttagattgtcatgggataggagagcatgtttaatgagggtctgctaaagggtctgattaaaattggaatagagaaaggaatcactctgtccatcctcatggcccccactcccctcagcataagtgtcctttggagtcacagctggggttctctccgtacagccctctggagaggcgagacgcagaggtgatgggggctgtgggaagtgctacagcctgctgcccacccacttggacttggccaggaggcagtccctggctggctgaagcagctcctctgtgacccaaaccggacaggagagggaacccagcaacctgtctgaaagcaggccacactgctgggtgaaagtcagcacttaggggacacaaggcctgtctgcagtcttggtgatggtcaagtgttagaagttacccagaggtttgtctgtctccttttcctctccaagggagagacatcattaccttctcacttacagtagtatgtggaattaagtacagtcttttggctaaggtttcactatgctggcaaaagcccgataatttgagaaggatttatttagtctctggactagaaagacccctggagtatgcctgacttcaggccagaagaaatgaagttccatttggagcatcccttgtaagcagtattgctaaacatgaacctggcgtctgttttcactgggactt

SEQ ID NO: 27536 - DNA, 1413 bp, Bovine  19866880565934
atagctcttaaaatctagagcttccaagtcttcttaaaccatgataaaggagctgtacaccaattcgagatcagtaagcatgtctctcaagggacaggtgtaagccggttaatatgacagctttgtcattttttctttcccaactctcttgcgaacaggtaaagtttcaagtgaaagctttagattttcttttgtagtaaacactagtggataccagctgctcttcctgaacatttacaaataactgacttcatcaatgtcattttttaaagatatgcacaactgccatgtaatctagaaaaaatacaaaacagtcaatgtgacttttaagggacttccatgcttgtttttaactgaacatttaagtttatcaaagggatttattaacacatctgtaattcagattgattcatctggacactgctgttttgacagatgggcatataaagaatgcggtattcatggcattcataccatgtgaaggaactggatcagagacttggttaagaatcttcacaccgcccttcacaataaaatgaaatataaggaaaatatatttccccctcaaaagggggataaattaagggtacaatgaaggtgctcccgttgactttaattttcctgtttttcctggagtactttgccttgcagggaggggcagggaatcacacttaatgcggctacatgttgcaatttttctttttttcaaaaaagcagattaagaaacagcctgtgggaatggcagaaactgatctggaataaagcaaaatactgattaaaagacaagactaatgtaggttcattcaataagatattgtgaagaaaaaaaaaatctgtgatagatactgaataacatggagagagaaatcttatcattatcctcatttagttgtgaggaagaaatccgtgtgaattttaacatcaattaggttctacgatcactcaattatggagcctctaatcacacacacacaaaaaaattgcttctcatttgtgctgctagatcctgttccttagatgtcctagaaagtcaaggcctaaagaggcaccattccaaatgtttcggtctgcttctcattctaggtttagagcagctggctatggcagaattagttttttttttttttcctggtgaaaacttttaaaaaagtaaataccaaagtcttgatataatagaaataccgcttgatataacagaaataccatttccatcaaggtaaaaatggcatctgagctagagccttgtgttcctcgggtgtgttagaattgtctgtcaatccatgtagccctcaccagcacttcagaacacaatttgttttactgcaaaaagattcatacatgggaaactcagtcataaatatgtactaacgagaagagcagggacaggtcaataaagcagtatcttcacatcag

SEQ ID NO: 27537 - DNA, 1311 bp, Bovine  19866880570638
ttatgttttctgcatgacaggcaggttctttaccactgatgctacctgggaagcccttgaaagtatatctttaactattaatgcttatttgggggccagtttctcacctagaaaaatgaggtgaaagatagtcatactatctttgcatttttctgatgcaagtcagatcctgtgttataacaagttcagaagtaaatctgttcttatgccccaagtcttctgggaggtaatgcagactgttgaaaggcatacaagatgactttaatttgagagctatataaacattggttttctcctggacagttctggaccttaaccaaataaaagacaatgtcacagctaattaacatgttctcagaaaataaaaaggtgtattttgaacttctctacacccaccgaacatagcttcagaaagtttaggtgccaagatattaaatacagaatgcatcttccaattaagtcatttttataattgaacttgagaagaaacataaagcaaggttaaatcttatcagggaaaagtccaaaaagcttccagatgctcatatgtttagcccctgagggtaggttagaattattccaattagtgataggttagtggtggcatagtttttaaagcatattctcaggatgctgctttgctttgattttccacatttaggaacaaagtttagatgggattcaaaggggatgcagaggtgcagtttgatggagaggcaggtttgcaaactcagtctggatcatatctgtcattttgtgataaattggacctaaatgtgtcctttatgggaaagttgagaaaaggtgataaaaatttttaaatggcctaagccatttccagtaaacttcatttacactctttggttatggtgaggctgtctctttagttaaacacaagatttccaggtcctccatgtcagatctgttacactgggatagccatcagagggtcttggaaacccctgaggtgacagacagaatctctgtgcatgcctttgtgggcatgtgtgtgagagcacatgtgttctctgttggagaaatgtccaaactctttcagtgggacagggctgccggaagacgggtgtgaggtttccctcaggtaatcctgtagtggccctcacagggtcccagaggcttcgtgaagaggagcctctgtacaaaggatgtgagagcttccagagtctgagtccgactttaaccgtaaactgaacttagtgataatggtcggaacccacatctgtcatttgctactcgtttgaaaagcgggaaagggagggcatttaagagaaggatgcaactctcaggtaaccc

SEQ ID NO: 27538 - DNA, 1415 bp, Bovine  19866880571635
cacttttaaaatgagagacctaaaacaatgcattctgctttcatttatttgtctattattagaacacttgcagggagcaatcaatacagtgaaattgtaaacgaagcagtctgcatgactctcgtacattcattttcatgggaaaaattaagtgctacgaatataatacaattccagtagggatttgaagcagtgtttggaaatgaaacgacatccattggtctttaaatgtaactttgcatctccttcaggaataatttgcttttaaatgatcaataaagatttggcgagcttttcgagtaacttaactgtatgtacaggttcaaacattgtttaatatatagagagagactctcatgtgaatcacagtggtcagtaggataattttagggtctgttctcttgctctctatctctttctcacttactcactctgtctcttgtccagagctgttaatccagatatgatactggatttaggctccctgggaactcctggtaaatgcataaatatattgagagattgcgtctttttattaaattttagcaactctgcttccttcagaaatcttcaaaggttatgtatctgagtggagaacagtcactgaggagatttcagtgctgcttgctgaaatagagatttgactaatgatagtaaaggttatatagataagatagtgtatttaaccctcaaatgaaaatgagttggcacgtttccagctcatcctcatttgctaaatcttttctcatatgccttggtctgtcagctctggagaaaatggactgagagtttgtactcatttttgaaaaggataaatggaagtgaggaagggccattatactgataggaagggtagattggaatttaaatcagaccgaagatgaggaatggtaacagtaggagttaaggctagaaattttgtttcagcagccctgcattgcccttccacgggggacagcaactgacagcaggggtgcctcggcctcctgcaaacatgaaggctgtcccgttgcctccacttcctccttgggggatgaccttctgactacctgtcctctgagcttttggactaagcaggcagggaagaaatagcccaaactgggagtgatttatttttgttttaatatgccatataaagctactttgtttcaaaattaagttgaaaaacccaagaaagggactagctgaagatttaagcagtcttcaaattaccacatctgctacatctgtccctattaaccagatggttttttgataggctgaatctcattgcaggagagatggatgagttttccttgtctggtttgtctcttggtttgtagttgccattgacagatgatgttacagcagagatatctgccctggtgggcaaatccaatttattgttgtgatttcttttacccagtatatagtgt

SEQ ID NO: 27539 - DNA, 699 bp, Bovine  19866880591374
tcttttggcccttgaacttgagcattttgacaattatattcttccaccaaccaaataccatgtaccaaatatagaactttggtgatcaatcagtaccgaaacacattacagaattattttatcttctctgtcctctgctgccacttattcccaatggcattacagtttctaaactactcccccaaaatgtttgtttttgttctcttcttcatttcaggaagattttattagaattaagtttttaggaggtagcagggtagaaccaactttctgatattactatcgcctttttatttttcccagtctaaatcaagaagagctaagaaaatctcatccagctctctttattctaagcactggtacaggggacaggaagagtagctcatttcctttgtaattccatcaacaacccgacagagcagtcaaaagacttcctttgatcgttagagacaatgggatcaccaggtttgcagagaaccctcctggtgtctccattactacagacacacaacatatttgcagacttggttacaacatgcctatcacttttttacttcaccttgtctttgatctaggcttggtcaacaagaaagtcccaaacactttctgttcctggcatccctctttcttccctcctttttctgagtttcttcccacccccagaccaatgggaacatcaaacagggatgagtaataata

SEQ ID NO: 27540 - DNA, 1044 bp, Bovine  19866880594388
gatgtgaaagttggactataaagaaagctgagtgctgaagaattgatgcttttgaactgaggtgttggagaagactcttgagagtcccttggactgaaaggagatccaaccagtccatcctaaaggaaatcagtcctgaatattcactgagagtgctgatgttgaagctgaaactctaatactttggccacctgctgcaaagaactgactcattagaaaagactgtgatgctgggaaagattgaaggcatgaggagaaggggacgacagaggatgagatggttggatggcatcaccgactcaacagacatgagtttgggtaaactccgggagttggtgatggacagggaggcctgacgtgctgcagtccatgaggtcgcaaagagtcggacatgactgaacgactgaactgaactgaactgagggcagtcccgagttatacacaatcctgggagacactctacccatcagatcccactcctgcctctcaattgctccctttccctctggattcagaaaacaccccgtagagttctaagatgctccctgggagcaagtaccatctgttgaggactgatgaacccaaagaccaatagacgggaacaggccacagggacagtcacacgtgtgctgtcactccctatagtttatttaggcacaatgtcccataatccaggaccgtggttaatagagagatggaagtccttgcacagcgcatgacagctgaagggcacattctttttggaggtgttttccctgctgttcactttgttaccctggtaattgggggaagttgctatggccgtatttgctgctgacagatttgttttgcagtgcgttgtgagagggtgttaaatgcaggcctgtgaagaaactgacgcaactggagataatttggggggtggggtggaaataagcaattgtgacttcctggtaagcacagactgaattgtttttccagcttagtttttacctctccccatggccctgtatttccagtgtcagagaccatgggtatcctcctgacacagaaaaggaaagagca

SEQ ID NO: 27541 - DNA, 1450 bp, Bovine  19866880594880
aaatgttttttgtctagatgctggctcttaatgtcagcagctgactggactggctcagggaatttttttttttttttttaatgctggtgcccaggccccaggccttgatccctattctgattccaattagtttctacatcagaatttttatatacttccacaggtgatttacacagagagtacaggtcaaactaccatctggaatgatgcagcgtggaaattaaatgttaataaaaaggagctaagtgaccaaacgaagttttagaatactctagcacagtgttgtccatgttcgaaataatctataatctgccttgtctagtatggtagctactagctacagtggctagagtgactgaagaagtcaatttaacatttaatttcaattatttttcatttaatcgagaatagatgctactataatggataacatagctccagaggtccctcaatgcatctcagcatccttggtttgcaacagctaaaaagagggatatggactgtaagccacaaggcaaggtagataaggccttactgttcatatccatcaggaccaatttcccaaaatggagctttgttaacaattcagatgctctgagtaccttacaggaaaaaaaaaaatcaatgccatagaaagtatgtccagccaaatatgctttgaggacacaagtcttcagaatcattctttatttgctctgtataaagcaagtaccacctgcaagccatggctgttatatacaccatatcatacagataatgcaaagaaatgaagacagttaaggatgtgaagaaactgcatcttcatatctttggcatctactaaagtatatatacatatatatatatacacacacacacacacatattccatggattgattagtaatagtgtagaaaatataaatacatttatctaatatcgtgaatattgtagctaacaacacttgaggaatataaaagcttagacacaagttacagtctaaaaatatatgtgctcagtcgctaagtcgtgttcaactctttgcaaccctgtagactgtagcccatgggctcatctgtccgtgggattttccatacaagaatactggactgtgttgctatttcctcctccaggtaatcttcccaacccagagatggaactcaaatcttctgcattggcaggtggattctttaccactgaaccacctgaaaagtcaaaaaaatatccacagtctaccaaaaagcctcacttctacttcaataagaattctaaaaattctctgataagaaacatgcctgtgtgttaactttccttaatttgggctacaagactaaatgtcagtagtcattctagagatgtgtgtatttccctaaattttgccatcaagtgagagggtttttcaaaagctcagattatttgcactttgcatatcaaatgttaaaatattttatatcgaatttaaaacttaacg

SEQ ID NO: 27542 - DNA, 2087 bp, Bovine  19866880647216
catcaattcttcgttttctttatagtccactctcccatccatacatgactactagaaaaaccatagctttgactagatggacctttgttggcaaagtaatgtccacagactttagagttgctttataagcagctctgacaaaaccaaggcagggacagggtgacagaacagccaagagagaagctgggaagaatccatcagtggattaaaaattagctacaagtggtaatttacatatggatcattaggattcaggcacagttaaaaacagctcacatctggttttatttggactccctgttttgtctaataaacaagtgccaaaatgtaaggaattctcatttggggcttaaaaaaaaaaaatcaagttaacacaaaggtatttttttcaagtcatacgcaaagcagggttagttttgggaatgcagacatacagctagaaagactgctgctgctgctaagtcgcttcagtcgtgtccgactctgtgcgaccccatggactgcagcctaccaggctttctctgtccctgggattctccaggcaagaacactggagtgggttgccatttccttctccagctagaaagactaagtcactgaatcaactcaccatgagaccctgggcaagtgacttgattttctagaactagcttccttaataaaatggggaaatatgtttcctatagtaatctcacaggattattttaagaatcaaaggaaagtattttgttcaggaaagatttacgaccaagacaagatattaacaaacatgaccaggagaagcaaagcaggtccacctgagtcgacatctggtcaaatctgtccaatgtgttacaaactgcaggataagagtagttgccagtcaccaaaacagaaagaaatgcagttcccatgtcatcaagcaatccacccacagacatcatgaagaatgacataggctttatttagtctaatcatttaaaatgcaacaaagctatgaagttcaatgcttcattaaaaattattcagacttgacaaacttgaatttcacaaaataaatccaatgaaatggaattgggatcatgctctcaccctccccctccccctgcccaaacaaagccaaagaaaccaacaaaaaccatggttcatgttttttaggtaacttctattaagaggcgatctcaatgtatgttctgtagaaagctgataggtatgtgcagttttggaggacaaggaggtgatgtacagaaagcatgggttccaggggagttctctggtaaactaagcatattccttaaatatggtactgcccacatactctaatagagtacgcactttaagttcctgagtaaatgctggaatgaaaaacatttcccaaacatttgtactgagcatcctacaggtaagtatttaatgcgagacacattgaaaatatggtagaaaatatttaaagatggaaatacatgaaacagacctcttttcaaaacatagcaatgcacataaatagcagcatgggagggggagttctactgctgactcagtatcccaagttcccttcctactattcaaggagtactaaggttccttgaacattattaataacttagaaaacattcatatggggccaaaatgcaagtcatctaaaactggagagtcaattaggaaggatgggaggaaggaaggaatgaaggaagaaagggaaggaaaggaaaacaaaaaaatcagactcttctttctctcctaatgatgatgaacaaacttgctttcacctttttttcagtcaagagatttagacttacaaaaaaattcacctcggggtatattattctaatcaaccaaacatcagtcttcaggggatgcaacatttgactctaccacaggtcagcagacagaagttaggcaggaaattctacctaccaaaggccttctgtgaaacatgttaacggtaaattggtaatgaagtcgacccattgttttacagagagtaatgtaaataaatctgaacccacaaatgaacacatcctaacaagcatacttcctgatttaatggtttctgcaattgcaaatgtggatgctatcagggcccatgtagataaccttaatgagtg

SEQ ID NO: 27543 - DNA, 1136 bp, Bovine  19866880697222
tttcagacgctccttgaatttgtatgcaaaactgtgtgcttctctgcagctttgcttcagaaaggctcaacagctttgtatcccattttcaatcgaggccatggcccataatttagcagtacagacacttgagtagaaatggcatcattgaatcaagagagagctaaaacaaactccagttattttttaatctagcagtgcactaaagccagtaggtatatcccactgtccaagtgcattcagtgtggctaaatgttcaataaaaattaactctttatgattctagttgtagtgtatataaattattggaaaacaccaaaaataagatgaatcacctattcatcctagcagtctggaaggatattttaatacatctttctgtagtctttgggtgtgtgatgtatgtgtatgatataacattttttaaaaacgaatttatattgtctggcaggttttaatctgcttttcatgtcttgtcccatgttgcttgatagtcttcacttttacaatccattcgtttttaatcaattcataattttccatcttgttgatataacaatatgcttgctcattcctcggttcttggaagttcaatttgtttccatttctgccttctttaaataacactgtgtggaacatcttttctatgtatatctgtgtgagactctttgtgttcccttaatacaaatcctaatgataagtttactgagttaaagtcagttgtaatctttgaatcctgcatttagcgttatgcattgttaagtcttagaataagaaagaaaacttgtagggtctgaaatgaaaatgtgctcaaaagtagtcttattctctttgaattctatctaagactagcctctgaccaagttcttagtcttctttctgtggcttttctgtgagctacctctgtctttctgaatatatataagttccttgctccttacacatggcattaccatgttcagcagtggtaaatgcatcattttgctctgcacacttctaaggaatcccttgtgtttgatgatgtaaattagtgacatagcatatgttagaatactgaggcgggaaaccaaatgtttccattaaaattctcaaatctagagactaggtgaaaaggggaatgactatcacaatgaaaa

SEQ ID NO: 27544 - DNA, 1426 bp, Bovine  19866880714517
gttatcaagtttaaatagctctttgttgagggtggggtggatgtgttttctccgtgttacagattcagaagtagaggtgtaggtgttctgtaacctgcccagcgttgcgcagagaggtgtagtctctgtgagtgctggggtccttggatgttccgctacatggggccaggtaccgatctccggccctgactcctggcccaccatggcaaatgtattcagtctggtcaatgaatggacataggtctttagctacataaagcagctccatttttgatgacaagtggaccacttttgggggagggggggaatcattcctgagaaaacagatgaattttgcaccattagatgaatctctactgattgacatggaataaaagtgaagtgcaaacatggtgtttctgattggttttaaaagtcttgagtttgaagtcatgcttttcaaggtgtttgaattcttcctgatgtaaatgattgaagtggaacaagaaggacttaataagtaatttagaattactttactgtccttttaaagtcttgatattcttttcagtcaaccaaaaaaggcagtctataaaattaactttaagtaaagctcagtattctacacttcttgtgaacttgccagttggtacttataatctctctgaaatgtaattgactttgaaaacagtattgcaaatatgtatctgtgagatgatgctgagggtcttcatggtagcatccccagcagccgtgtaagtgctggttctgctggctgcatcttggcctccttggatgtagactgctggagtgaccaagggatgcttacttttactctgcaggtttagcctaaaagcaatgattcagaacggctatttgagaaatcaagaaaataccagagaaagagaaaatgtatgattgttagccttcctgaaatttaatggcccttgtcaatgggttaagcctgcattcttgcttttatgcatggtttcaagcctggaaataaggactgaatattcttttttcctttctcactcctaccttctgatagcctttacaatttataggaaaacctaaggctgaacacctgtgagtttgatggctgtttaattttttaacctttagaggactgtggaattacttaatcacccagttacccatattgttaattgagggagcattcccatcacaggattgaagaagacaggtctgtgaaaggtagcctggagatttaccccccttggctgttgcacttatttaaagcactgtagaggtgggttaaatgcagggtcccacgtgctggaaggtggttagttaggcctttggttggtaaactattgtgggtatatgcagtgggttattagagtaattgaactgtgcttccataaagaggagagtttcattatcagattcttgttgaatactgtcataatagcagctgggcaca

SEQ ID NO: 27545 - DNA, 1892 bp, Bovine  19866880756945
catttatcagtcactagcagatcatttgccatttgttttctccagaggcacactttgttcattggaaactttagaaattcaggcccccaggttttctcacttctgtagatcacacccagagtgacactttgaaggtacactttcctgtgaaatttcctgggatccctttgaagttccaggctctaagagcagatggtgctgtccatggattttttcttctgcctcttctcaaaatcccccttcctttccctgaagggagcagatgagcccattaaaacaggtgctctttctgcccatatgcctcctatgtagtatgtgacgtgatttctacaagacgggcttcctgcttcccctgggaacacaaaagtttacctttgtcctaaggaaaaccactgacatgctgttggtatgggatggttctgctttctgtggcccatccaaggtaggatggcctgcagtcacctccagctaaagcagagccacctagcaggatttctcagtcttggaaaattctgccgaaaagggatctcttttagtgctttccattaggtcttcacagctattttcagcccatctgaatagctttggttgaaataaattataaattgtcatcaggagcttggttccaacattcatattcattagattttaaggtttaatgatgatgtggacctaaaacaaatctttgatttcttctttttttagcagtcaaatggagtctcttgatttttgactttttaaatactgttttgtgggcacatttggctcctgtcaatggtgtggcttttttaaaaagaagagttttggcaactagccagcacagaagagcaaatccctctttatttgtaaaacaacttgctgggtcacttgagcctgggattttttagaagtgtccatggactgcttcttcagagcaaacagactaactggttaccacaatatgctttagactggttgattttgcacagttaatggaagggccattaattaatgtttagtttattgcctcaacaagatgtgaatatgttgttgtggaaagaattctagattaagtctgaagcctgcttaaaatagtccatccactccctgccccttatttccccactggaaatacttcacttgccaatatttgtgtgtgacagtcaagagcacggaggtgtctgaatctgtataatacccatctcttatgccttcccttcagcttcatgctgttctcattcagcattatagtttggagaccattcatgctgtcactaatagagatagcttgtaccttttaacctctgcttcataggttggctgtccctgagtttatctagaacttccagtcgtttccagattctttttgtactagtcacgctgcagtgaacagcatgtacctgtaaaactttgaatgtgggtgtgaatatttcactatgatagaggatccaaagtaccctttattttatatatgaaaatcgtaagagattgagaatttgagatggtcagagttttagaactgataagcagagtgtaaattgaagtcgttttccctgactcctccgaactagttgtagattctttacaaagttttgtagagggttgttggaatcctgggcgatgacaagtctagcaaaagctcactcctgtgaagtattgtttattccaatgcactaagatcagtctgaattagagaaaaatctatatttaaagatgtaatattagcccattttaatgtgtacacagtgactcaaaactaatatcacttgataaaattccttaagggaatctcattaatgaacaaaccaaagcacctaatgattatttttaagaaaaaatgacacatctaaattgctcaagacagttattctcatccataggcaaaatatttcccctagcatgttaaaatgcaa

SEQ ID NO: 27546 - DNA, 849 bp, Bovine  19866880765324
ccccttcagaagctaagtatcctgtctgttttcaggcttgtacgtgggcagatgtttcagagtctgtttacaaacatttcccagacatattgtcgatcagcaggtttcctcaattaacatgcagcttcttcagtctgttttctgtgttctgattgtatgacaaaatgctatagggttttgtagatgcagggacagagaagtttaccaactcagcagagtccagggaagcctgataaggagtctgagggcgaagtgtacagcatggaattcatttaaaattgcacaggaagcagtttggttgcagtcttgacttgagtaagaacacgggccagttgctgcgtgcctatcctgccgggtcccgggcagtgcacacacacattcactcacatgtggtgtcttatggcatcctctgaagagtttggaagagagactggaacctttatttcacagatgaggacagagtggctcagaggccatagaattgaccgcagtttggacaaattctcagtgccccccaagtcatactctgttgtgtcaggctccaaagccctacctgctcgtataaacaaggaattattgaatgagaagcgtgttctggggtgtgttggatttttgtgaaaggaaaaagatatggatgcattgtctcaaaacacgagcacagagattctgagagtcatctcttaaatatgagagacaatgtaaaattttgacatggtccctgataccctgtaagtcatgagttctattgctgctgtttttgttattgatacagaatagcggaagactgtgtagacagcctctgttcttgtacttaatatggtgggcatggttttgagaaacacgggttgg

SEQ ID NO: 27547 - DNA, 1188 bp, Bovine  19866880812402
aacctccatttgtcagcctggtggttttttttaaatacgttgtccctgagaaacatggtagaatttgtttacttctcttctgccaggaagtaacccttctggctttgttagaagtgtggtttgtaataattgtacccaccccagatggctcctgaaaaacctttgaaatgccatctgccaggcgtgtgtccagcaggcagcctgtcattctgctgaaagaaaagagagggcggggtcccctcccaggccctttctccctagcatctctgaatgggagcctgatcatgtggaccaggcccagggccggttgctcagaggataactccagtaagctcctgctggcctgcagagaggaaaggttttgtctgggtagtaaaccctgaaggttttgtgggtggagatgaatactcccccacccccttcccctgctgtttaaaggccattctaagcgtatttatttccaagggaaaatggtgtctgcatgttttcatttttcctctacaatgtaccattttcccccaagttcttgattattttcaatcctttcaggaaattaagtcccagaggttaatgttgtctcaacagttactctgacagattgtttcagaaaacatgactggaagaaatgtcaacgataagatgattataggaaggggagaaaaaaccaaaatattgtctggtgtggaagactttaaaaaaacaaacaaacagatcttctgtttggtcttcctcatttacccgcatttggggagctgggaatggagggatggatttagttaatagaattttggtatggagacttgagtgtgagagttgccatatagaacatatttaagacagattctttcacagcaagtttcaaagagattctgttcttgccctagacgggaatttcccagtatgatgcatgcagacttcgtgttttccaaatagctggctgaacagcttctgcacttggctctgagacatcacaccctcctcctctgctcctgctttgttgacagctgcctcttcatctcctctgaggatcttttcctcttcttagtttccaaaaattgtaaagtttttgtgtttaagtcagacttcttgactgctttttctatactgtctctcccctagattctctctcttgccttcaaatgccagtggtttagtgataactctcaaatttagggcccagccacccat

SEQ ID NO: 27548 - DNA, 1743 bp, Bovine  19866880824871
acattcaaaataataaacacatcaactgttggttagcagatgctaacatgcccattaaaatctaccaccactacaaataaaaagcaggatcacctatgtttaccacattagatttaaataatcttagagatcaaagatgtttaattcctttgtaaactcctttaagtcaatgatcaatgcctcttacaggttgcaatgatctcagtatcagggagagccttgatcaacatgttaagctacagaaaaaactgacttatcctttcctctttcaaatgacctctgcttgaaaagaaagaggtgttcaatctctattgagcccagagaagggagaaggaacaggaggggtggacttcggcattccagagccctgagactcctagatgagttgtatctcgttttgacagcagcagtagagtaaatgacaagccctgtcaggtaacgcatttatcttcacgggcaaagcagccgttccaaaacaagaatctcagatgttgtcacatcagctaagacaagaagtcataaagcagaatggctatcattgcaggaagtgcagtgatatctagactgtaattaggaggggctgtgaatgggcactccagctccaagctcaccaggagcctggactttctgggtttagattctcagtcatgtaatcagtggagtcttcatcagccaactcggagctcaagccgctgagctgccctttattctgagagttttatggcaagagtagctcttctgattccccaaaatgttaagtaatgaagaaaaaaaataataaaacaagaaaaacaaagtgggtctctatccatctcttcatcagttctttcaatcaatagatatttatcccatgttccagaaactcagccagccaggtgtgggctgatcactgaggtagatccagtcgctggcctcagaagagtaggattctaaaagaacagatagatatacagcaggcagggtacgtggtcaaatggggtggcggggctgggggagcagtgaggaaggcggtgggcacaatctacggaggcctttctggaggtagcagcatctagactaaagcttacaagaagcttatgaactggttagatggaaagatggagagaaaagagacaataatttatacccagttataagaagataccaggcatatttgagaaatggacaaagtttgtatgactaaagaatttaggggaaggggattgggaatgtaagcaggatttgaggggcaggagacagaaatattaaccagatgattctgaggaatgacagaagtcagcaacactgatgatgtttacatgcatttgaaatctacttattggggatccccctggagctcagtggtaaagaatctgcctgcggattggattcctggttcaggaagatcccacatgctgaggagcaactaagcctgtgcaccacaaccattaagcctgtgctctagagcccgggaaccacaattactgagataaaaccaatgaagcctgctcattgcaactacagaatagcccccattcactgcaactagagacaagctcatgcagcaaggaagacccaagacagctgaaaattttttaaattcttttttaaaagatccatttatcttaaggtggttttccatgagtagacccctgatatatctcaagagattcctacagtgattttttaaaagctgaataatcattaagcagttattaaaattcaatactacacatcagtgaaatacatgaaaatcagagagaa

SEQ ID NO: 27549 - DNA, 1302 bp, Bovine  19866880840667
attttagccatttttaaatgagtaattgggcagcattacttacattcacaggtatacaaccatcatcactatttatttacaaaactttttcagttatatttcaataacacagggagggaaaaaaacccttagtcatcaactcaaataaaagttctgtaattattaagcaataacttcatactctctgcctccctcctcccatccctggtaacctctagtccactccccgtttctatgaagttgtctaaagaattcatataaatggcatcatataatattgctgcctttgtctctggcttctttcaagtaccacaatgctttcgaggttcctctacaaccgataattttttaaaatttgtattttcatatttgaattttgtactacagtggaactgttatatataggaaatcatcaggctttgcgttttaataatgaatgataaacaatgaagcagaagggaaaaaggaagccgccccaagaaggaagaatatagcaggaacggtatgaggacagatggtctacacattggtgtagggagaggagcttacgatcagaggttatgaatctgactggcacgctgacatcagcctaagagagagcaaatgcaacgcagagtgtcttgcagagctcttacctccgggttcaccccactgacaaaagcacagagcatcttacttacaactgaggctctaattttgcaggcaagcacattttgcatgacttggcagggtacaaatgaacacgagaagacagcacctgtcaggctccttaggaaaccaggcagaacgaaatataattccttacctgaaaaacataaacacataacacatattaaaattcaactggcataattttatgtctttcttagtcatttaagctacatgtttaatcaattatttcttcttctcacggaagactggcaaaggtaagggaatactgaagtcttaattcaaagtgcattgttcccaccaactcaagactgttttgatggaaatgtttccatctagaacgtatatttgataagcgctcctaacacaaatatatgaaaccattgcatcaaacttaactcagagttgacaggcaattatattattaatggggcaggttagtcatttccaggacacaataattacataatgaaataagtcctccactctcactcaaaatcccatctaatccctgaattcacctgttcactaggttgaatatccatccattcactcagtgaatcaaactatggactttgattaaataatatattgacattggttcatcgatgctaacaaaaatacacactaaca

SEQ ID NO: 27550 - DNA, 1510 bp, Bovine  19866880842927
ctagagaatctgaggcaatgaaaacaaatatcctgtgccacttaattattgagttggtttcctttgggattccgtagtgtgtaatttttacaacagagctatgaaccctttggaattttctctcttcctgtgaattcttcctctttgttcgttgttcagaattattctaatttgtaacttgttcagcagccacaagtaattcatattaaattgaaagtacaatgggatataaaaattctaatctttgtatctaattataaaaaatgtcattaaaattaatgacttaagtataattaaagcatagccagcctagtcatggagatctgaggcctgagaaaagcaaattagaacagttatattttccttctgaattgaccgtactctccagaaggcagtcttgtgcacttcttaatcatagaggaaattcaaaggtgattgtaacttagaattccaagtcctgtctaccagcaccacagcctgtgtaactttctaagccagtgtttgactttgtacattcagaatggtgttttcagacctggtgtcagaatattatgagttcatctgccagcaatccttactctaaccccatcctgttaggtcattagtcttcagaaggcgttgactcgtgttttaatgtgtcagtccttggtcattgtgattcagggtcagtgagaacatgagagttcgtgttttttctttaactttgcattttatggtggttaaagtagtaatagctaatattaatggagagccaccatatttgaagaagtctggttatatctcattttaatagccagttttttttaaattgcagtatgtaatatgataattgtgattttatattatacagttatgaaattttccttgtggtttatgacactatctcttctctgccacctgaaaacactgagaaccacatttaagatttatttttcccactttcacatattacctgtgctgatatttgcctaataatagggcgctagtggactgcaaggagatccaaccagtcagtcctacaggaaattaatcctgaatattcattggaagaactgatgctgaagctgaaactccaatactttgactacttgatgcgaagaactgactgttggagaagactgatactgggaaagtttgaaggcaggaggagaaggggacgacagaggatgagatggttggatggcatcaccgacttgatggacatgagtttgaacaagctctgggaattggtgaaggacagggaagcctcgtgtgctgcagtccatggggttgcagagagtcggacacggctgaacgactgaactgaactgaactgagtggttaagaacccacctgcaaatgcaggagacataaaagatgtggttcgatccctcgattgggaagatcccctggaggagggcatggcaactcactccagtattgcctggagaatcccatggacagagaagcctggtgggctatagtccctaggtcgcaaacagtcagacatgaccgaagcaacatctacttc

SEQ ID NO: 27551 - DNA, 1666 bp, Bovine  19866880848869
gcagagaacgcccccagactgtcaaaggagggagacagtccactgcctgccttcccctcacccaggtgtgacagagccctgtgtaagcagcctctgaaaattcctgagtcagttgggacaggaggagataagggggcaggagaaatatttcagggggacaagtgacaagaatataagaaaagggagggaggaagcaagggacatgtctattcctgggggttagggtggacaaggacaatgcagaacctatattcaacatggacagaagaccagatttcatgtgatggtaaagcaggatgatggagggaaaggtgagagggcagcagagacattcaaatcacagggtaacagagacttcacccttgaaggcagcgtcagttgcatttcgcaccagatgagaaaacaaaatgtgttccttcgatatttgctacccagtaaacagtctgtgtgcacatccatcttgctatctgctccctgactaaccgggatgtggacggacagcactgctaaagctccttgtccttctagtcattcatgatggtcaaaaccctcaactctggagtcacactcattgggttctccctattctctctagctttctgctgtggggcagagggtaacttacttgctaggtctgcatctgtttttctccacatgtaaaaggtactaaaactatctacttgttggataatatataccaagtgcctggcacagttcaccacacaaaaaaacggtgctcactaaatgtcacctatgattattattatgactttatctctatgtaaagagtcctcacaacatgaaaacctccatcctctacttctgtggacacctacaaactgggacagctccccaggcttagcaaaaggcacacagcagcaccctgatgtcacctggtcagaaatagataccctggaagaaaaagcagtttcatctgcttcattcttgtctcacatctactttgaggaagctggaaaggccttgagaggtgaatgaggagtattagattacatttttggtttgcaagaaacaataaaaacttaaggggatggtttctttatcaatcatgtacataaaacatgtgaacatttacatcatttcccctcttgatcatcatcaaaaaagaagaaacaaaaaggaaagaagattctacacaaaacttttaaaagcctttagctacaacccaatgctgaaaaatggaatttgtgtattattagttttccacaagaaaatgattgtgcagtacaaattaaattgctcttttgcaaggaatctgcttagagactgcactgatgggaacaaaaatacaaaagccattctccttatgaaagaaagaagggaacttttattcaataagtattcaaggatgtagctttccaatcttcaatagggggagaaaaatagccctcatttggtttggaaatgtccctaacaataacaaattattttcaatcagagctccaaaaaccaggtttctctatgtctaatgaagcacaaggaaaagattccatgaaaatctactttggtttttatcagagtacacacttgatctcaaaaactggctctctgagcttgtgtggtctccagcataagccaggagagatgcttcactgcatttcttctgagtttctttttggcacacacacacacaaatgaaaaccagtag

SEQ ID NO: 27552 - DNA, 1776 bp, Bovine  19866880897739
tttgtataaattattgtggatccaggaaggaaaatagtgggtgaacaaatttttactggcttcttggcatagaagtcactttactggtcatctgtctgagctgatcttcccctccatttttcctggaggattgatgatgaggaaaaagttgaaagttctgtggaggaacatcctctttgacctaacaagtctctctccaggtttaacacgaccgggtaggtgagtgctgctttcctggcctgtagagacagcaccgctgtcgcgttggggtttcaatttcaaatggaaatcctccaaaaggaagctggactaaagccttccatcaggttcagagaaggaatacatttatagttttcttttttctatctaaggtcattaagctcttccttcagtggtctgctttctactttccatttgaaaaatgaaaacttcattgttttcatgccattccttggttctttgatagtttctgacagagtcagctaatgatcattctctctgcagttgaaagcagcaagctcattcatttattcatttgttcaggaaaaagtatgacttaaactctctgattgagagtaagagacatacctggctacctgttttatgggcgctgcgtacaaccttgcacaggaccattagggttttcaaaatgacagagaagtcaaatatggatctgagttgggaagtctgtattcattttagaagatgttaattattttctttattttgattgtattattggagttggtcatatattcacacaacttaaaaatatattgcagtcaaaagaagtcttattctatctcctgactccacctacctaattttccaccttcagcctcctatatgtacccactcattaatttcttgtataaccttctggtgtttgtatttctccagatataagcaaatataaacatattcttattcgtcccctgtttacatagaaatgctatatatactactctacatccttcctctctcacttaatagtttccctgagatatttccacagggcgtggagaattgcatcatcctttgctcagccacgtgatactgtatggaagtaccatggattatttatccactcctctttagatggacacttgggtatttgcagccacttgctcacacatgctcacaatcttacaatcaataatgaggtttatctgtcactttacttcacgttggtttaagtagagctgttaaaaaaaaaaaaaaaaaaatcccaggagtgaaattgctgagttaaaaagtaaatgcattcataacttcaatagtgattgccaataagctccccaaagggttgtgggccatttttcactcttgccagcaatgtgtgaaaatgcccaattccactatttattacagaatgtactgggtaaaattttgaattgaatttttgccaacttgataggtgaaaaatgatatccttatgcagttttgacttgcagttttcctattataagtgaggtggtcaaacatcttttcaaatgtgtgagagccatttatatttatttttctgtgacctgtcagtgttccagtcatatttctattgctttgctgatatttttctccttcacagtttctaggtggatcttactcttattcgtgaacatttattttaaggatctaagtcctttttatacatgtactcaattaatcctcataacaagcttgggagttgggtattgccaccccattttaaaatgagaaaacagattcagaacagttaagacactaaccgcaggccacacagccaggaagaggcaaaac

SEQ ID NO: 27553 - DNA, 991 bp, Bovine  19866880955568
cgacatatagggtgtactctgtgctgagagtatggaaaagatggatcagtccctgtctatcaacagcttagagcttagagtcaaggtacagaaagtcagcaagggttatgggttattaacaaacaaggaaggaatgcatgtatctagagcatgaagctcatttcttacaatttttttcctcatggccatataggaggaaggataaggaaattgtatgtaaactaaggtggggacattttaggggagaagtgagagaatggatatgggtgaagagtaccaaaaacccactacccggcacagttctgctccacggcagtcttgtgtattaacatatgtgtatgggcactgagatccacaattctagcttgaaacctgggagattttcccctgtggtttcagcataaaagattgtaattagctcatgattaagcacattttcactgttttggagccactccataggacaggccttcttttttgttcggcaaccgcagggaccagtgacatcctagccttttagaattgtttgtacttactggtttgttggaaaccactctaaagactgcagtctgtccacccatcccccaactctcttctccagagatgtcaaaaccctcttgtggaatctgtgaaatgtgaactatgacttggttatatgaggttcagtgaaatagctggaggttttcccagcagaaggctaagcggaatcgtctagacatcgccttctccttatctcggcaagcctttctgggagcttttccacatggggaatctaggcagaaaggaaaatgaacttgactgtctaaaaacccctctgacttttagatctctcctgaaacttaccaggctgcagtttgttgttttgaatagaacaggaagatatttgcctttgttgttattacgagagagatttttcatttatccattaagactttatcgagcacccactgtgcacagatattttgccgtaagcaatcaaagaggacagaaa

SEQ ID NO: 27554 - DNA, 1010 bp, Bovine  19866881032476
ttttaacctcttaggtttatgctcaaatgactcttcagcgaggccttacctgatcaccgtatttaaattgccactccacttctaacatacacatgtatcttgctcactgtctttctcaccccatttaacagaggcaccacaagggcagaattttggtctgttgtgtttgtggctttacttgcaatgcttagcctggtggctggtacatagtagatgttcaataaatattaaacgaaaatgaaaagtgatttaatatttatgaatgaaatgaatgaatgaaaggtcattttaaaaagtctctattagtgtcctgtgtctctatgtcaattgacttataaaccccaagagatgaaaaaatatgattaattgacatctacacatgttaacatatacccgttaggacctgattatgaatggccttcaacggccctcatgctgtctcaaaaatgttgaccgtcaactaccaggcactgtttaaatactaggaacgtcgctttatagtagctaggaatggcttttggaaggcagaaacaccggaagcaacggcttaaactgagttggttttatttttctcgtataattagaagtctagacgaaggcagtccggggctcgtgcagtggctccaaggggccaccagggaccctgtctgcttctgccttctccatgcggtcccaagtttgctgcctcaactccgtcagtgtctggattcccggcaggaacaggggaaaggccaaaggaaaatgtgtgttccagaggactcctcagcctatgatcaatctcttcctgtaaagttctacccgcacaatctccacttacttcttcgtacccatctcttggccacctagcagcaatactaagaaacacagcattttttgtttacttcattttctttggtcagctgtgttatttcataaacaaaattggggaaaagagtacaattaaaggcatccttgagtaagcggctagcaatgccagctgccctagacttctaagaaccaactccctcaga

SEQ ID NO: 27555 - DNA, 820 bp, Bovine  19866881035163
ctttcactaaatcttctccagggaatcttcccaacccagggattgaacccacatctcctgcactgcaggcagattctttaccatttgagccaccagggacgcccctactccttgttagaggaaagccaattagaatgagtggaggtcagaatggtgacatattttaaaggaaacagtttcactatttccaagaaatagaaccaggttataaaattattccttcatcttccctcgagtacttgcttaataaagaattagaaatgatttgccattcagaaatcagctggacggccaatggtgcttctcaagtgtttgaaggtgattaaaagcagtttgcttttgtaaggtgtttaaatattccctctggaaatcttgttaaactcttcatttgcttcccttttctttaaaaagagggaaaacataaactctgttaagagttgagcctttctgtgccccaattaatgaagctttactcaattaagaaatattgactggctgcattagcctgcgtcttcctctggggtcaacagaggtacctttcaccaggcatttaaaccttagctgatgttagtgactattttaatgaccactccagttagcattttgcattctgccaaatagactaatggggtgaccgtggggataagggacaaagtctcatggcctcctttgcctggaaacagaccccagatcatggaactctgctgtgggtggaggtatttcctctggtggtgttgaataccttcacacaccagacttccacatacattgtctcctttaacccccgcaccagcagacattgattatatttcagctttcc

SEQ ID NO: 27556 - DNA, 1068 bp, Bovine  19866881099548
aaaatgatattaaatatgtataggaaatcccattttgtggggcaattaaagcccagagaggttcagtgatttagcctgggtcacacaacatgtacacactggaataaaatgcgaaccagttcattccccaaagcctgagttctatgcgctctgtgacatcctgctgcatgttcaatatatactacctccttgaaacatgaattgtcttagtagctttctcctgagcttggctaatttaaattttgcagccaacacaacagctgtttgaatgtaattcaaagagcttcagggtcctctcaagttgaagacctcagagggattatggagggggaacacatgcaacttgtctcctaaaaaagcggtaattcagtctaagcgaagccagtctgcaggctactttcccagccagagccagccaaggtcaaggttgacaggaaatcccaaatgagaaaatgaagtgctcagctgtacaccaagaaggctgccaagaaattgattcactaaagaaacaggctccagtgccatggaaagcacacagcttttgataagacagaaaggcaagcacacagacaaaggcctgggaacctccttgtaaataaggaaatggctcaatccattttgcaaccttggtggtgtccagctgggggctcccttaaacaactggctctccaggtcaaggtcatttccatggttcagatcagatcagatcagtcgctcagtcgtgtccgactctttgcgaccccatgaatcgcagcacgccaggcctctctgtccatcaccaactcccggagttcacccagactcacgtccatcgagtcagtgatgtcatccagccatctcatcctctgtcgtcccttctcctcctgcccccaatccctcccagcatcacagtcttttccaatgagtcaactctttccatggttagaatggctatttattcatcattagaaatgatgtgttggggggcagaagagactgggagaacataggcaggatggaagaaaatctagggaaatgggccaagcctaaaatgacaatgttcaatgttaaactacagaaatgccaagt

SEQ ID NO: 27557 - DNA, 1440 bp, Bovine  19866881099662
ggattgaaaccgggtctcccgcattgtaggcagacgctttactgtctgagccacagggaagtaaacctcagttaaatagaatcaggagaccagaagggggagccctcatgccctaggaagaaagacttttctttcctggcaaggactcagccaatgaacagtcatggagcctttgtttactctagccctcccaacttccttttcccctctataaaagcagtttccttccctggctgtgcaaggcttgctggagttgcagattcaaattgcaattctctacttatcccaaataaatgacccccaccttttttttttttttttttgctggagaaatatccagcggtctacttatttcaggtcaacaccctttacagaaaagtttaccaacctttgctctctgatgtggctacagttcaaagatcttcgtatttataccacaccagttccgttgtaacatcaagctgaagccttgggaccaaacactaaaaatctgtttccatggatttttccactgctgaacacatgcattcagggataatgctggacctctgtatcataatgaaaactttaattaaatgctcagcaatgcaaaacccattcagactcccactctttcatgtgtgtgaccagtctgtacaccaggagacacccccgaaccttgttaacacatgcccttgtgcacgccagctacctcgacaaaaaaacgtgacaataatcttaattaagtttaaatccactggattcatattctatcgagtcacaataaatgaatgtgaaagaaaatgaagaaagtcgccttagggaagatgacttttagaacacggttgggaaatagagggaaaatgggcatcctggctgtctttttgaactgacagaaaactgtactgattacattattcagcaagtaatgaaatgttcctacacacttattctcagaggggagaacctggggttttaatcagttggtaatgcacttccctcaaatcttgcagatttgtcaaatgctgtaaatgaaccacagttttctctcttttcgtctctggggcccagctctagtttttcagtcagcacaggcaactttaagcagacaggacagctgggaagggaaacaacccttccaaagaaggctgagctccacgtgctggccccagctgtgtgtgaagggctgctgaccccaccgatccctcaggtttttctgaagcctcctttaaggcggcagaggcagaaggagctgcaatatttaaaaattttctggtctcctaatgggaaagcactcttggtaggtaaagcctggtttctatgctcggttcacagcgaccacacaacgtgctttgatgcctgactcggcttgatccttttcctgtctaatttcagccacttgtcatttctgtttcctcttggcttcaaatgcatcgtggcaatcctttcctgagggcgggg

SEQ ID NO: 27558 - DNA, 1506 bp, Bovine  19866881145349
cttttggaaagcatgggtcatgttaacaaaggcaaggagatccaacttatgagtccgatagcactgcattattcaaagtgtctggcagtcagacccaaagagccatttactaacgggtcatgtttttccaacgggcaaaggacatatgatgagcagccccattcttctcccatggagatattaaatgtcttcaaaatcctcttgctgaaacaatatctgccctggtctaagtgattatgtgaactgcagagggaaaaaagctgttaccttgactttgtcaatttctaatgacagctgcttcatacggccatgggaagcagtagaagctcatgctttgttcaactattagattgcaggtttcagtgagtcaatactcattttgcgaattggatttgcttaaaggcagaatatgggaatcggtttcacccacacacaccccaacacacataatgccccactcaggatgaatctcaattagaaagaacttttataggtcaagtacatttaagatgcagggaaattcaaggactgcaagtccttttaatgaaatatttcagctgggaacaagatgtacaacagggcatttgccttcaagaagtacattgcatttatggcaaggaagagtaagtagcataaattcatattggaaatgacacagatgatccccagtaagcatttacactgaagaaggcactcaacacatttctcatggtggagatcaaatgccagaatccttttgctccctcccctatctgattttggcagttttttttttttcttagtaaataaagctctaatcaggtttagagttaatgcagagggagaacttaatgcaaacggacccactgaaaatggatttttttaaaaaagctatcattaagtttttgacacttttttatatacgtggaattagccacagatattttggcatgcctcatgcatcatgaatgtgtatagttcatccaatttttctctagcttttggatttaacattctctgagttaccttaataacttatacatgacgaaagaatttctgaaagagtctaaccaataaaggtagtattttgtaagggcaacacagggcagacagatgaatccacccctggccttgaacttctcactcactttctccctaaattaagagactgtggaagccctggttaagaccaaggaggttcccactgctcttcctgtggcttggattctagactccccactcatacattacttccaagaatcccacctcctttcctctgctctctctaacatcctgacagcctccttttctacagcagtgattcctgcatttcagattttaggaaccagcaatttttcactaaatggatttgagcaactgaccacaaagtgccaattccttattttgcaaactagaaacattaaaaagggggtggaaaggtaacaaccaactactattccataagtaaaaggatacttcaaaagaaaaaaaaaaaaagatagagggatataatctcccaaagagagt

SEQ ID NO: 27559 - DNA, 983 bp, Bovine  19866881221713
tggatctgtcttactgtctatgctctcgactccggaatggttggggatctctgagcagaaagttaaccaaaacgtccctgggcttggcttccttgtcttgaaaggcagaggaacatacaattgtcatacagatttcctttggttctttcattatcaacagagaacactccacagtggagtttgccaacagagcttatcacaacagacggctgctgaggcctgccaaagaacaggactccagacggtctcgtcttcttcaatgacaaacaagaactctcttcaccccacctttattactatgtccccccaaagcagacccttggcaactgcctttttgcagaccttctaagaagcagaacagtaccattattgaaggctgacagacatactcccttcctaattagcatgaagagatatgcaacacataactacaactggaaatgtcacattgggactgtacttccatgctgagggaaaagctttgcaagctcagagtgtataatcaatcagcctcttctacccagaggcatttgtaaaacaggcatgtttggaaccaccctcattgaacattccgcccttacaaactctctcccagagaagtcccaagggctggctgaggcagtgacctgtcgtattgagcaaaaatgtcaacaggagaaaaaaaaaaaaagcaaggaaaaaaggagatggtgcttctgatttatttcaagaatgccatccaataaatgagctcagtgtcgcaattaagctgggccaaggaggaaagacacgtttagtcttgtcttctgtgtcttgccttgatgttgactgcagccagtgacagaatgaggagttggctcaaactgcagagctgagaccaattatgaactctactcataactcgtatgcctttgtgaggggtaatacttaggtttcttaaacagtcacaaagggcatctactctgttggaggatacacataatatgccagcattacagctgatg

SEQ ID NO: 27560 - DNA, 751 bp, Bovine  19866881290499
ttggcagatacatgaactgtaaataattttgctttaaaaatggatcaatttgtcatttttaagccacatgaattcttttcatcatttaagcacctaagtgctgtctgtattagtttgctcttctgagcaaatattttcagctcactttataagtacctcgactttgaaatcattctgtgaaatactaatgagctgactttttcccccgttcccatttgtaaaatccattgcatctttccaatttccctggcctgtcagtaataaggaaatcatttgttttagggggattggatcagtgttattttcaaaggtctcatgacacaagttcaaggctagtgtgtggccaaggacttccaaggagttttcaaaattgaacccgtttctttcttcctagttggccctgatgtgatactcagaaataaaaagtcttgctccaaaagtgtccacctagtgataacagcttgtgttggagatattcagctcaatatgtggtactcctttccaatcgtttatttaagctggagacctaaaggtagatatccatgtctctaggatctccttttcctctgcctaaccattcctcctcccctctgctcctcctcctcgtcttctcctcctttcaagctttcagcaatgcctgtcaatctggcaccaaagcgtcttttgactttacctgtccctcccctttgtcgctgcttttcccctggggtaaaccaccctcggtccttcacccgttctgtacagtagcctc

SEQ ID NO: 27561 - DNA, 1037 bp, Bovine  19866881403333
cttctgtggatatgcacaaaccagttctttcctgggaacagacacaatgtacattctatagctaaaaaagaggaaaaagtctgagactgctatttttatcttcagagttttccatacagagcatacattgagctacagtagtatggtgagggagaacgcaactgaataatgatgttcttttttcatcaatttcctaagagccaactggggattttattcctaaggctccactgctaggaattctctcactcattctagccaaatccatgatattaaatgatcgatgctctcgattgtggtccagagttttaaataaatgaaatcaagaggtggtttttggagtggatcgtgacgttaacatctcagtgtctctcttgttgtcagagatgtttgacatgttaaaatctatgtgctgcccacctgggcttggctttatccgtgaagacttagtgtggcagtgtcatctgagtttcatactttgaaaataccgtactttacagggactgtacattaaccagaaagataagagtttttctctgaactactgtaaccttaaattggagactgattcttttgagcctactttccctagttccccacttcatgtaaatgtcttgatgagagatgatatgaatgagtattttgtatgattaaatcaaaccctttaggaactcccctcccacccatgagacagttgatgctggaaagaatgttgtggggaggacttaacaccctacttgtattttttaagtttcttttgtgaaagattttttaatgcatttttactgtaaaaatacatggaaatgtatgcattccataaccacgattgcttctggattgatatctttcttgtctctgtgttgtctcaaatatatcagggtcacgtaaccaagtaagagtgtctggctcctaatgcaatgaactatcataacattctgttgaaagggaagagatgatggtctttcagtagtatagttagtgccttgctactcaaaatccagtctgtagaccaactgccatctcgtcactggagagca

SEQ ID NO: 27562 - DNA, 1237 bp, Bovine  19866881570142
ttaaaggtctaagtccagcaaagttccttaataaaacttggggaactaggttctaagaatgagcttttccctatttctcccatctcttgcaaacctcaagagacgctgccactccactagtgagccagtaataacactttataataagaggcacagcacacatgactccaggcaggtggtatctcattagaccagcagagattgaatcctttcccctagtggtacaaagactgctatccttacaatcttgtttctgcagaacttaaaaaacagaaaagaaaaatacatggtgagtctgtgatgtgaaacagaggctgcaggatagatttctgtatgctgatgaagctccagaaattactatctacatttaactccccacatggacaagcatgaaacattttgctagcacttcaggatagctgctttattattattatcctgcctgttttttcggttctttttctcctggtcaatcttttgataaatttcatcccacagcgagaagaaacctgaattaagcatggaaaagaaaacaaggttcaaattccatcatctctatttttctcattatttccagccttttgtgcttcttatattcgttctagttaaacagggtagtagaataacacctgctcagaaaaatgaataaataaaaggtttactgagagcagaaaagacaatggtcccctgctggcaacactatatagctgatatgagcttctgcccaaccctaatcaataaacagctgcatgacctcatgtaaagttgaagtcaaatgtctctacaatcagaaccacgagtggaatctgatgatagtgtgtgtgcgtccttcaagaagacactaaattcttaaaaagacattaggatctaacagaactgtgctcaaccaacctgcaggactcaagtgctaacagtgaacactggatggacatggctctgaaggcaaatacaactgagatgccattggcattccatagtttgaacatccatagtaattaacacagctgttcccctaccgtcccaatctcactccaatttattctcagataagaatagataatgcaggtggtaaactatattctaatatggtctgatatcattcaagcaacagcagactaggactagagttccaggtcctctgacctacacaaggaaatatcatagaagcataaagttaaagtgaattcactcagtcgtgttccaactctttgggaccccacggactgtagcctaccag

SEQ ID NO: 27563 - DNA, 697 bp, Bovine  19866881707149
tgggatggagagtgtggctatattctagtgatagtaagaaaaacatcaggggaaggagagacttggggcccaaagataacttattggggaatggcacaagatgtcaaaaggagataaccgtgactttgacagcagagcatttacccagcagtagctgaggatggaaactcctgggacagttgaccaggttattcttacggtgcatcttccctaatgggaaaccagcaagcctttgggaaattacagctttgtgacagtttctctcttgtaaagacatacattagttacagcagattttatgacattacagactgaggagaaacctgtctcccctgtcccaggagctcccctgtaccaaatttttgtattttccagcattcagagtgaaggtactggagggaactgttctacttgccaaccagagggaaggtgttaaggaaaaaaagtctgttacttgccagtaggaaagtatgtgtggtccaacattttgtctttaagaaaattacttgtaatttgagatggctataatcaagatgagtttccagcatcgtaatgcatctatgagaggtgtttaatttgtcatgttaaaaaagcacaattttttgaagtgagctttattcacctttcagagtgtacttgcaataaagtttgctcttcttgctaaactattctctgagttttggtaaatgcatacaat

SEQ ID NO: 27564 - DNA, 1106 bp, Bovine  19866881780937
caaacagtagggaaaagtacatcacgccttgaagcccaggtgaggcagattggcaagtgctgcatggatctcctgaacttggagggtgccctgactccctaggcccctacctcagtgtttctgctccagattctacttgaaagtgttctatgaaggcaaataccttccattatcgttagcagggggatagccctggctctctgatgtctaaggaagaaagttcctcagtgccatatgtggagcttaagcttttaggagtggaaattttaaaagcgagctgcatatttatttatttacttggcaagcatgcattaaaagcctctgcgtttgagataccctattgtcaatacaaagtctctgcttttaaggaattcacattctagaagagagatacatagataaaataaatgaaataattataagtgattaatattctggtagaaaataattgagtaatcttcttagcttccccagtgggtcagcagtaaaaatgtccctctacagtgcaggagacagaggtttgatcctgggttgggaggatcccctggaagaggtcatggcaacccactccagtattcttgcctgggaaatcccatggacagaggagcctgcagtttggactggtaggttacagtccatgggattgcaaaagagttggacacaacttagtgacttagtgactaaacaacaagaaatgtttagcctagggatggcctcttcaaagagtggacatttaagccgagtcctgaaggacgcaaaggggatagatttaggacaatcaagggcagttaaatagttacaaaggccatgctggagaggctttggtaattctaggcagtgggaggtgtatgcatgtgtgagatgtctcccaggctggtgaccctatgacagacgacagcagtgactcagagagtagtggtggcattgagctttcctgggtttccatttgatttctcatttcaaaggcattgggttcaactgtgaaaaactttctgcctaatgagtccatcaaagaggtggtttgttgtgtgcgtgtgtggatttttaaagaagcagggtggcaagagtctgcctgtaactaggctgagacctttgaaattgacagt

SEQ ID NO: 27565 - DNA, 1250 bp, Bovine  19866881783544
cgattcaaactagcatcagccctgaagctgcagaggacaggggttaggtcttgtaggtagcaataataaatttggattgtatattaagagtgatgggaaataatggaagaattctgtacatactagactcaactgtctatgggagcagaggcagtaatttactcaagatgatttcatcacttgtgtaatattgaaataattcagggaaatgtataaataattgaagtgaagaccatttgtcaaaatgccattttggcattttaccagctgatgtgcatttaaaactaggatgaaaaatatagctttttttcattcttttaacttcaggaggatataaaccctttattaatcagatgtactttcatttgactccagtaagatcacaagccctatgcaaagctatcttccatttccacacagcaagttctcaccttcaagagatgctactaaaatgctcaaatgaagaagatcccttttcagtctgcagaaaagggatctattctctccatccaggagactgtcaagttggaaaattaaatctgtcactttaagatgtatgagtcctgcactttcagaacttaaagcatcaaagcaagcaagaaaatctttgggaaacaaatctatataacatggggattttaagagaagccatcatttcctccacagaaaccagaaggcctagaaacgtgaggtcagaaaaaggtcatccgacatccaaaattatctacatgtgaattagtgtgtttagagcggtagaccaagcttcccaccgctctcattacataaggtgagtcaaaaaaacttgtctctggtcagataacatttaagaaatcctacatcctccaatctagcattcagtttcctcacatatgaaatgagaataacagtcatgcttattacctcctagagccactctgaagatttacaaggtaatacacgtgaagtgctcagaaccacatttggcacatagtaagtgctaaataaaagttaactgttactgctgttttcatttttaaagcatcatgacgggtttccatgcataaaaccgtgtgaacaaacataagagcagataaatccattgagctttacatgtcccagtctttcccaaacttgtctggccagcagatccttttttctacctgttaaacactttctatcactaggggagctcaagtcctacagagctcaccatgggacacgcagctgctcattcaggaatccagaaggaaatttatttataacagaagtca

SEQ ID NO: 27566 - DNA, 1590 bp, Bovine  19866881791127
aggctgtgtctgcacttctgctgttctaaacataccatgatgaatatttttgtgtacataatgttgtatatttttctgaatatttacttgagacaggtattacatgcagaactgtttggtgatgggatttatacttttttaaggtttttgataaatatcatgttaatacaaatttccttgtatcctactgaacgctcgagttttatctttcacttaaatctgtgataatctgataataaatatagttaattgttttagtaattgggaaattgattctagttattaaaatttttttttctcctttgattttatccctcacttggaaatagtgtctctttgtattcgagggggttatttttattcatggtttgcttatgttgtgtgtttgtagatggtggtataattgagttctccctttattcttccactccatgtggtacaatttatcctttcttattggtaatgagtctgcacttggatacctcatgttctgtgctttctgtcaatagctccctgttgtatctaaggataggcagcaattggttggccatagggaatggagattggtaagctttgtgtgggcctgcaattctttttgttagattgtgagtttgggaatcacattagtggaccatcactttagatcgctttaatatatccatctgttggtgaactacctctatttatcttcctcttttcattcttgttcttttccataacttgtttttcaattagaatctctgtgtctttctttctttttttaacctactggagtatgattctgaaagaattcctgtcttctttctttttggtaaacttggggaattaagactgaaatgcttttttttttccctaatgaacaagaaatatagtagccctggtagtttatttgggagagtcacagtttattgaatgcctgtaggcaattcacatatacataaagctcaagataaaccattgtaatttttgcagtttcctctctctttctttctcagggtaagagacagggaaaataagaccctagagtaggttagaacagtggctgtcctgaaatacatcatttgtctaacaactggatattctgatgccagtgtttagagtaacaatttctgtcaaagaatatcttttgaaaactgtcaatattagtaattcagtaattcacacattccatcttaactgggtggtcttccagcagtagaatcttagtgcaaattgccattttcagtggaactccacaaatatgtctttactgtaattgttgcagagttatttatcttaacaagtatgaagttctttgctatgatccatcctgcttataaacaagatactgtttttcattcttgagaattacatttcagaattttttcgactattttttttaggcaagaagtttctagtgcaacttctgcatgcttatgcttttttaaattgacttttaattggaaaatgattgctttacaatgttgttgttgctttctgccatgcttctgctaagtcacttcagtcatgtccgactccatagacagcagcccaccaacaacataaatcagccataagtatacgtatgtcctctccctcttaacctccctc

SEQ ID NO: 27567 - DNA, 722 bp, Bovine  19866881803524
aatgctaaaagaatggaatctctggggtggtttatatacaattaaagtattcctttttttaaaaaataactttgcatttgttcactttttattttaacatctctgtactggaacatgtgttttgcattacctaataatggagaggtgtgtcattcttctgcctgaaaatatgctgctatcatgaaagcacatgttcacaacgatagcagttaaccataaagagaatggaggacttgaatcaggactaagagagtaaagggagactcatggtctaataaaaggattggagagattaaggtggctcaaagactgggggtgggacttgtagagggttaggattatgcaggcacacagaagcaaggaaggatttcagcccagtatgaagaacagccaagacaagcagctaattgcagcacaagagctgtgccatgcggggagaggaggtgtacagtgagtatacatcttttcctagagggaaacagcccccaggctcccagacctttcttgtcgtcagtatccatgaaagtcaatgccttcattaaactctcaagggaaagacaattaaaagtctaaatctaaaacaaagtccatggtcttcccaagaagttttaaaaagaaattaagaatgtacttctgcatctgagttgggtgagaaaaatgagatctccctattggatctagtgtgcatggtcagtcatgtcaaactctttgtgatcttatgg

SEQ ID NO: 27568 - DNA, 1020 bp, Bovine  19866881829894
aattggcccttttaaagaaaccttatttcagagatgtcaggtgagtgaaagagctgccttcaaaaacacatcattttcagtccacaggcttctccttacctcaagaaagcaaattatgcccgtgtccttaacacaaactagacctaatatgtgtccagataaaatcaggtcaaagatcaaatcaatgactattaaggacagcattttataaaccaattcattaaaaggcaatgacatcttagctctgacatatgaataatctatctttagaaaaaaatcgagtggtttcatttgtttctggtttatttcacacctagtaattaaatgtcatattgcacaatgcttcctggtcctcactcttgagtttctctcattcatcagccctattgacagcgcctgctgatcaagggcaaggagcagggagaggcaatctttatttccttgatctggcagcatgggtaccactgccattagcttcctgtcagcaggtgaagacctgaggacgtgatagatgatcccggagctcttacaaggagttttcaccagatacctgcctcttaacctatttacccagcacttacactttcattttctaggaaacccacatttttgcccggagggagcaaagaatcaacatcttcaataaatccaaaaagcataaaaactgagttttatccaaaagctaccaccatggccatccacagatttggtttcacacaacaaaataaataaacaaaaaagggtataggtatttgattgagtgagctgggaaatccagaaagcttattttactctcaacatgccatacacgttacatctgaaaagagtaataagagactacagcgattaatttttaaagttagggacttttcaccaatctgtacagaagatttttgttgtacatatgtaaaacaggaaatgagacatttaaaagggaagagtgctttcctaaacctttaaatgagcaactaaggtcagtgaatgacatttacaacaaaataaaagtgctataggacattc

SEQ ID NO: 27569 - DNA, 759 bp, Bovine  19866881841961
cttttttaattataaaaataatctttatgacatgaaattccaccaagtcaaactcttggaggctgagagataaggggctactcttctcctgccctcttggcctggcttgcaccccaattgtagttgatctttcccagccaggcaaatagagcagaggaaggccatgctcacagggaagagactcaattaaccacagctcaactttcttggaaaaatctctcctaaggctcaagagaggcagcatgataaatccaggcgcttagggaagggaatgcaaacaacccacataactatcctctgctttttcctccttgagaagtctcccagtttccctcgaaagaaatatttaccttaaggttcctatttttctttattatcactttttcatctctggaattgctacagttggttgtccttcaaatatcagcatgacaatgactgatctttcaaaatgccaccctcgctcacccgtgatggcaaggaaaggaaaaaaacaaccacacagggctgctcgtcacaatatttaccagggctggaatgttttgttagttttcggtggaggatgctgagacttgacaaaggaaaaacaaaaactcctctgtgtcaaaacacaagctgaagatgatttccttctctgctgccctggtgtcaactgcaaacaaattcagagctgccctgggctcaagggagtgtttatagtcccgcggagctataaacacgccatccttcaaaacaacacacagagccacccaacatcaa

SEQ ID NO: 27570 - DNA, 782 bp, Bovine  19866881887459
taaacttgctgtgcaaaggatctttgtagattcatttgcatctttttttcccccaacacattgtggaatttcctgctgaacttaaaggatatcaaacaggtataggggtccgcattcaccaagtcagttaagaattccccatgaccgtttatttttatggaagccgtgtcattagcaagcagcaaaccaattactcaggctacattcctaggggaaaagcctctcttaactgctttgcccacagtctgctggctcttaattaccacaagctaagagactggtgtgttgctgggttagaaaagagccagcccccagcctggggcttgtccttccctggtttctctgccaggacagggatggtggttttcacagcattgctggcaccctctggcagctgctgcacaaaactgggggggctatcagccaaggtctgctgttgccagttagagccttgctaacatctgtgatcagtaggagttctgtacaggtgggttgaaagctgttcccctttcccagtatgaattttgatgaagtcctgccagagagacagatgacgatgagatttttttgggtaggatgggaggaaatcccgtggggaagttgaatgtcctggttccagaacgccattcccatagtgacagacagacaggctgcagaatgaaatgtacactgtctgtgcctgggttatgatacgctgagagttactgttagttctgagatacactgtctgaactgagggatggtgtctgttctttattcatagaggctccctgatattgttg

SEQ ID NO: 27571 - DNA, 860 bp, Bovine  19866882113663
tattaattaaaaaagtttaatataccctattttttttaaacttccccctatcattttcttttttttaagagagaaataagtcagtaaagaaaagccagacaagagaccaaagagacctgctgggttgtgagttgacaccactggtgtgcatccctccacatggtctcttattaactccatgatgtagagcaaattctgtaatttctctaagcctctgtgctttcatctctgcatggagaaagtagtcctaccttttgttagaaaggttgtggcaaatgggacaaatgttaccaaataacatgtgagaattgcagttaccttaagtacttggtatatatacgttcattaattcttaccacaaccgtgtgggttgtgggctctaatctacagaggaggaaactgaggcagagagtgtctaaataacttgaccaagcatcactcaggtaagaagtagccgagctgggatttgcacaggagacagtttggttccagagtttatgtctttgttacaatattgccagttttccaccatccctccaaccagggtatccccatccttcactcttatctagagataggcatttcacaggttggcataactcctcctatgtaatttgaagcaagaaagcagatccaagaaaccgggtccgtgttgcttgttccctgacacactgtcataaacatttttccaggtcagtacctatagctctacctgggtcaaaatttaaccgccttggcgagagctggccattttagcccagccttggcggggggctggctggctttcagagaaacccagttctagctggcttgttgcctaggaactggctttctttcccacaagtagcttctgagaaaaa

SEQ ID NO: 27572 - DNA, 826 bp, Bovine  19866880551227
aaaaataaattgtctactggggtaaacattctatgtcttgtgaatcaagtaaatgtgacaatttacatttagaggcgacatcagctacacgtgcaaaaatatccctttctcttcaccagcaaattctctctcttgctctctcttttttttaacagtgcataaaaaatcatccttggagtagctttatggttccctaacaataggcctttacagttaaatatcttgatttaaggtgacagaatttgatttaattctactactatatctttcaacccagagatttaatttaatcacctattgtaattttctgtttaatatcaataaaatgtcttccccattgcccttacattgaaaatgagatcagattaatgctgtaggtcttcccagatttatagctggaagggaaagtgaagattgaaatgaatttatttaaatttacactgattgaagctgaatatcctacaagtcttaactaaaaacagcttctttgacagggaaatatgtacagtgcatattagagtttttatgaaagtttaattcccttttagtgctttttatgtcagggaaatatattgaagtagagaaaatttatcatctacttgtgaacatttaatgactaaaagaaataaaggtagatccaactcctactgtatgtattctgcatcatgatcagctccattgctgatcaagcaaggacgattgaaaattacattaacacagaaaattgctcagtaggtccacagtggactggaaaacccccagctctacatctatgggaagtgtcaggagcagattttattaacacatccagtgtcagagtgagtgt

SEQ ID NO: 27573 - DNA, 2081 bp, Bovine  19866880572258
aaaataatttttataattaattttatcacaaacacatgtacatgtgaaacatgtattaataattctataacaatacagcattgtgtggtggttttaaacactttaagatcttttattattctcatcaaaatggaaacacaaaattaagcagtactcataggaaactcacagaccttggaaaggtatctattggatttcagggtttttaaacctatggggcaagtgttaaacaagttacctcaggatgcatgggttctagtgtctttctgagttcaggactttgagaccgatggtgaacctgggaccgctcagttccttgggaggcctgaaccaaggatcaagctattttctccttcagcatcttaatgaaatcgtctgagtacaaagtcattcttctgtttgataggagagtttggtacagttaaaattttgctgattactaggactgacttggagaaggcaatggcaccccactccagtactcttgcctggaaaatcccatggacaaaggagcctggtaggttgcagtccatggggtcgctaagagttggacacgactgaacgacttcactttgacttttcacttccatgcattggagaaggaaatggcaacccactccagtattcttgcctggagaatcccagggacgggggagcctggtgggctgccgtctatggggtcgcacagagtcggacacgactgaagcgacttagcagcagcagcagtagcaggactgaagtccagggctcttggctcaatcataaaggtctcttccagtaactcaccttctaataaaagcagatgggtgggtcagtattttttcctttgtatttgatttttctcttctgggtgattcactgttagatataactgctatcgtgtgaacacaagaaagctgcatttccacagccaaaggaaaggatgcctttccttagcagtgataaagcagcattcaaaggattgatgtgtgacagtcatgtgatgcctttggcaaaactgataaatctcacggaacggaacactgagagtgaggtcaagtgttgctatcagttagtgcttaatacaggttcatgtctttgtatcagcaacagatggttttcaatttaattgtcccacatcttctataattctaaagatgaagctttcataagaaaggaggttataaacaacctgaaaaattaaggcccccattttttttatgaataactcattgtcatcattctatcccaccatttttatagtgatccttaggaagttacaggtacattttaaattatgaaaaaggatgaaaattatatatgaaaactgtagaaagctattaggcctctgtcataattaattttttaataaaacttgattttactttatctcagaagagacaaaaccatggaatgacatgtcgttaatacaaactccctacttgcttgaatttgcacttgctaaattttaactgaggtccagtacacacaaagaactaaaaagagaaatctttcactgcaccgatgtcaggccttcaatgaaagccaccctgctggttgtagctctaataataaactttcttttatacaaggcctttcaaagttacagggtcacaaagttccttgaaaataaatctcggaaagaacagcaaattctggaaccacatccaaattctttaggcctgtgactctaacagagttaataaattgtaggtgtaaatgactaatggcatgcagacccagcggtgagtatgttcaacagataaaaatgaacaagtgttgaggaccaaagaaaggatctatgagcagcggtgatttagggcagatacttccagagtttaactgaggctgcaggaagcatagctgaggccctcagatgagggagccttggagatacatgcagctggaaggccaccggcccctgtggggagtggaaaggggtgatgtcacattcatgagcttgttaaccaccattggctcaatccttgggaaaacaaaaacccatacactattgtgtgtgtgtgtgcgtgcgtattagtcacccagtcccacccaactctttgggatcccatggactgtaacccgccaggcttctctgttca

SEQ ID NO: 27574 - DNA, 2090 bp, Bovine  19866880811673
tattggaggctggtgatggggatgaagccagcagtgtgcaagtgcatagctagaggggctagcccaggtgtgcacacaatggcagggcagacagcaggggtctaagctgctgccatgaacttctgcacttgtgtgtgcccgcactggctgtgggtcccaggctctgaaaagagcagggcatacagagcgtgaaggaactcaggtggctggtggctgtgaatgtgaacatttgtgtggctaaaactggggatatctgcaggattctgcatagctgtggtgattttttcagtggtaaaactgctggggtcgtctgcagagcaggtgacagaaatatggtctcttccactgcatcctgagagtggcagctccgcttttcctcctgttcctactctctgaaggtctcaactttaccagtctgggtgtggtgaaaccaaagtggagctttcacatggtgccaccaaagactgggataactggcccttaccctgctctgcctttcctggtgaggggaacactttctaactgatcagtgcccacctgggactgggatgattctgagacaatgagcctgccttcctgatctttgtgtgcatgattttccttctactgtaaaatttcttaagaaccccagagctggttttgttcataggtagctgtctttttattgatctttgtaggagaatggagaccagggtctcctactctgccaccttggtgatgaaaccaaatcttaaaaccaattttgactccctttcccagtaaatatttactttgatgggaaagtagtcaaattttcctgatggacatttccccaacatgatttatgaaatggtttgcattttcaccactgatttaatttgctatttttcagttaccagtttttataggttctttttctgggatctacattctgagctatcagtctatttatcacttttttgcaaaatgatctcagttttataactactattatgatttaaatatattttattatcttgtaagtcatgttctctcatcacttttttatatcaaagttttcttaactatttttgtttatatatatgtatagatactacatatatatagatagagaagaaagacaaattttgagaacaggacaagaatttattggaatattaaagaagaagaagaaataatattctatggcatctgaactcttccaacaaccattttctgacctacttccaatcactgctgagccaagctggatcagttataattctgaggctgtcaagcatcagccttctgttctgatttgtagctgaggctcaaagttgtctttcatctctaccacttcactccgtgcatgcaaaagagaagattgctccagagaatcggcaactcacccaagggcaaataaaagctttgtgaagtttccagcctccatgcagatcttgcaattatagaattgaattcaagatagaagatgggtttttttccccttctaaatcttacttagagatctaggtaatactatgcaaattgcttaggataaaaggcaacttgaaagccagaggattggggaagggcatagccatagagactctgatattaaagaagaagattgattggggaaaggcctctgaagtgttctaaggactcaaaacaatcactttttcttttaatggtttcaaatatccaatcaacccagatcaaatacattttttttaatgtactttcaaatacttattatgtaagcctgtaatctattgaaaaggccactaagaaaaaaatagtcattttttttttcatatgtatgtgctttgttgctcactcatgtctgactctttgcgacccatggactgtagcccaccaggctcctctgtccatagggattctccaggcaagagtctggagtgggttgccatgctatcctccagggaatcttcccaacccagggatcgaacccagatctcccacactgcaggtgggagtacactctaagccaccagggaagtgcttttttttttttttttttccacatagttaatgtttataatgtccacaaataagaactatagttccatatgagacctatgatatagatgagtggttaaatgcagttgtga

SEQ ID NO: 27575 - DNA, 4233 bp, Bovine  19866881062921
tttatgttaattggaattattatacttaatggagctatggaaagggatagtacctctaaacccatctaggaaaacgatggcatttccaagatgaacaaactactggctgagatgttattctttgccagatctaggggatttaagaccaccctccggaatctctggggccttgacatcttcacctcctcgaattaactgtttcacaactagaccagtcacggagactcttaattctttctgggtcattttgaggctgtacaaataaagtgaaatagcagttgatcttgaaaactgaaaatgttacttgttttgtcctgttggactctttgcaaccccatggactgtagaccaccgggctcctctgtccgtgggattttctaggaaagaatactggagtaggtagccattcccttctccaggggatcttcctgacccagatctcctgcattgcaggtggatttttttgctgagttattgaggaagccccagtttatgttaaggagtttttattgggtggcctaaatattatcctagtcttagaagttcttaatatttcatcattgcaattaccactgttattattactatcccaacttttatgcatttatcaaaaaaaaagtatgtatgagtttaaaactgtgctctattgggttatttagaacacacacttattagctcacccccagagtcctatagaggttttcccacttctctgatgtttgaattgaggtacgattttgaccagttcagttacatgatgatattgaaagaaacaaatctatgttaatacttctaggatcacaagagttaaataaaatttaactcttgtaaaatgtttacaacattttaaaatcatgcatagttgaaagcacacatttcttcatcttggcccccagaggagccagtgcagccaggaattagacagaaagagtgtgaagcagctaaggtggtggggggaagctgttttctgctgggagggaaggaaaggatctggggctttcaggagatataaaagtgtgacaggctgcaaggtggagggggaagaggagtggtgaccgtgcctgaaataccgggggctgggatgcccctggggctggaggtgctctggtgataggcagtcagcatcctctggacctgatcagagggtgctcagtggttgcagataaataggacacccactcttcttctttctaaactgaaccaggagtgcagtctctggggaagagtcttcctttcttggcatactgaagtctccagcttgctcctctgtcccctgaagcttcctctcctcaggttttgcccccctcagctccatctttgtccttgcttggctcacctgtgtttgctcacctcagcatggaagtgtgtctgacccacgctggaccccacgttgatggcccttgctgctccctgagtctaagacctgagctcagggttctggccatcaattccgtaactcataggctcaaaaaacccagctttgtccaggggggctcctacctgttcattcccagcatccctgtgtcatggggggttgttcaggagcagggctgagtgtgggtgtgggcagggcaggaggcagcagggctccaggcccagaaacaggtgtcgggggggcccttggtgaatggggtgcccttacagagagctcctctcttccaggtggctggagacctcgtgagacgcctccacctagaagcccacgtggacaaacccgtggccacctacagtgggggcaccaagaggaagctgtccacagccctggccctgctggggaaacctgaccttctcttactggtgagtagtggatggagcagtgacatgccagtgtctccaaataaaatgctttgatctatcagaggtcctctggggaggatgttcaaaatttgcaatgtcacatttctgaactaataaatgttttgccctgaatcaacattttccaaacagaatctataataccattggaattttactgagacaaagcagactctttggagtcctttttatttatccaattgaagattccataaaatcttaacactaaagacaatatttttaaaagaataccagagcccacttgtaatctgaaatccaaagcacgcctgtcctctggcctgttgctttaagtcttctcctgcagatacgatggtcagagctatagggactctgtggtgaatctgagggtgggggtcttggggaaggaagaacctgcgggggaggggagggcgtccagcaggagagcagagcacagacagtggacctgagacagggccacctataatccacatgggcactgaaattaatccagtttggcggatagaagcatgagttagaggtggcccaggtgtcaataaacagagccaattgtttcgcatttcaaaaatagctaagagtagtatcatttaaataataaaaagaggtcattatttgtgggccatagactggattctaaccattagaagacctcccagggttttgcactgaaaggacatctgaggaacatggaacagtatgggagacaaaagacagcctttctttggctgttattgtttgttcagtggagacagcgtttcagtggggggacttaagggagattcagaagacctgcgttgaagaaagggccccatcgtggagtgtcttctggaatctgagctggattctcctcttacttgcactaagcttgctttttcccaaggtctggaatcaaagacgactgtgtaatccatcttctgaaaccgggtaaccaaagcttacgcttgcgtgattttgtagtttgcagaaggccttttccttacaagaggagagtctggcttgccttaaagcgttcccggcggggctgttccctgccttcagcaggatcctccactcagccttgccctgcatatcctgcattggctgggactttggtcctcgatcccactctcagctcgctaggtctcccgtgcttgggcggtgacctgggtggggactcacaagtcctgtgcatgtttcctcctcatctgaagtggtccttgacaacagtgtgtgtctttcggagtccttgaagtcacccttgaaatcctccacgtgaagtgttagtgacaggggtgactgtgagtgtgtgcatctggtggaggaggtgcgctgaaggacactcagcatcctccccagagacaggacaagtgtcctgctgccgacacttgtgtggaaatgtggagtgatgcctccagctctctcagggaacagtggccaatcacgccttccacttagttggtttgtaactattcaccgtgtcatgtgattttggggcagtggatgacctcagctcttaagaaaaatatgttcggtactccctgaccgcaagagcacagaaatgtgtaggcagcctacacatagctctctctaaaggggctcagagaagaagtgcttgggtgtttgttgaaggaggaagcttccggtttaaaagagatttcactgtccttgatgttgtgaaaccaatgaagcctgtttctgctcttgtatatcttctagggtagatgcttctgctgttataaagaggttggggtgcatcagggaaggcctgcctccccaggattccaaggggagcccagcagacttgaggggtgctgtgcctgctgagcatagcgcgtgggctggagctggggctggatttcccccagcctgcacccttgctccggggagtgtgttcccgagtgccttctccccctcccctcaccctctgttctctctccttcaggacgagcccagctcaggcatggacccctgctccaagcggcacctgtgggaggcactgaggaaggaggctgaggagggctgtgctgtggtcctgagctcccacaggtgagcccagtggctccccaaccgagtgcagtgccccacacagcactgccacacagatgccacgtgtcaccccctgacggaggtcgggacactgaccaggccgttcccccggtgcgtggccccactgggactctgcagccagtgggccctcactgaccatactctgtctgtcagtcatgtctgaagagccaggcatcctcctcaggcccttctgcgaccagtttcagcccctttattccagcaggagaattagctgaaatgaaaactcagcacgtttctaaatagggtctcgtattttcttcctcacagaattagtcttgtagtgagattttcacatggttggcttctttttggctttatgctgcactgttccaggccgcagagggacgcagt

SEQ ID NO: 27576 - DNA, 666 bp, Bovine  19866881511121
ctgtcccttgcttcctgtttcctcgtggccctgatatgacctttatcaaggcatcttttgactatacctatttacgatctgtgatgtctgctaaaatttgagtctggaaggacaaaagaatgctattctttctctatcttctgtggtcccttacacagaactcaatgaatagtagcttaatttgagaaatagggtaaaaacacccacagatccagagtggagaggaaggagtggccttgttaaccagagagaatcatccagaattgcataatgactcaacagagccagttggcatttgggaaagcgtgtgttaaactgttggcccagtaacgctttccttgttcatctctctcatcacctttctgggcaaaattttcataaaacagcttggaagctcagatgctctcaggctgtcatcctgtcgctatgataattactgtgctaatcaccaacaccttgcagattagtggagattaatggtgggctggaggagtgaggaggcaggctggctcaaaggctgcatttacagggcccccagaggactattgcatgcaggctggtggaggagaaacaaacaaatcttctggtgagttgctcaagaaggctttggtgagccctgtctcctgggagttagtttctggaggggtgataggcccaaacctcagt

SEQ ID NO: 27577 - DNA, 1118 bp, Bovine  19866881571677
ttacagctggcctaatctgattccctacagcctggccagaactctgcagtgatgaaagatactgaaatttacggcaaagctacatctcataagtaggcagtgtgacctctgtataaatagtcttcaagtttctgacaaatgagaaaacacttttagaaggaaagggacatattttccaaggaaatgtggctcgtaaaatgaaaacattatttgtggcatctgtggaaatactctgaattgcactcttttgacccattaatccaagaacaaatatgaaagtttgaaatttttttcctgaaaaaaatattgatccacgaagttgtttactagggataattactgaaagcaagtttcaaagttatggcttacttttaccacttttttgcttaggtctaaaggtcacttaaaaaaaaaaaactagctttacattatccatgttgccataaaattcaaatgcttgttctttgtgcatgcatgcgtgccaagtcggttcagtcgtgttcaactctttgcgaccctatgggctgtagcccaccagattcctctgaccatgggattctccaagcaagaatattggagtaggttgccatgcccttcttcaggggatcttccctacccagggatcaggcccgtggcctgttctttaactcctttttttggttatcttcaaactcttagctgtatttagagcactgctggaagcatgagaagcctgtccttactagactgcaggaattggaaatagtgctagattgggactcctgaggcatctcctacatgggcactgcttcctctccatgtcagcacatctcaaaacttcacgtgcagcagcatggcccaggggcttgtttgagctaatgtggattactacacatcatcccaaaggtctttgtgttgttaacaagagtccccaggtatagctcctggcaatcaaaccaaattaagaaatgtggggcttctgggaggaagcgacctgcactgtgactctccccaccctgcttgctgtccagtgccccgctgccccgagccagccctggataggacaggcatcggctccaggggatgctgggctccatgggcacttcctcaggcagagcatgtcagggctaggggcacag

SEQ ID NO: 27578 - DNA, 1379 bp, Bovine  19866880490617
atatctcccctgttttaaaagtgaggctctagctgttcgatctggttgcatttgtctcaaggctatcagaaggcagtacagcagatgagcagagccaaggccgctgggctgtatccagactgcgtttcctcatctattaaaaaaccaaacaaaaaatgaggacaatgaaaaatatctcatgaaagaagcttgtgaagatttaaataaaataatgcacctaaacgtgaataatacatacatgtggtggcagtgtagttactaagttgtgtctgactctttgagaccacatggactgtagcccaccaggctcctctgtccatgggattctccaggcaaaaatgctggagtgggtagccattcccttctccaggggatctcctgacccagggattgaacctgtgtctcctgcattgcaggcagattctttaccatctgagccagcagggaagccctgacacatacatgctgctgctgctaagtcgcttcagtcatgtctgactctgtgcgaccccatagaaggcagcccaacagacccctccgtccctgggattctccaggcaagaacactggagtgggttgccatttccttctctaatgcatgaaagtgaaaagtgaaagtgaagtcgctcagttgtgtccgactcttagcgaccccatggactgcagcccaccaggctcctccatccatgggattttccaggcaagagtgctggagtggggtgccattgccttctctgacacatacatagtgcaggcttaactcataatcgtgtgtgtgtttatcagtctttatggcagtcacaacaatctctaagacctttttaaaatagtataccctgcttcttttattgacagaaaagagagcaatgaatccgtggaagatattcaagtaaagaaaggtttagtaaagggacagtcttgtttgtatttggatgaaggattctaagctactgaaatgtgaacaataaccaactgtctcattcggaggaaggtgcttctgctttcctgccttgctttccagggactcactggattctggctcctcgtgtgtttatcctgaggccatggtgtctgtttgctttgcagcactgagttgctttgctgtggaactccctgctgggtctggccaccccgcactggtttctctcttgaaacctggtgccctgaaggcagtcaattactttctaacctaaatcttccatgaaaaattgctgacttcttctggaggtccacagggagatggattttcaaagccttccctgtgcttatctgccccacgtgggtacatgcattttggttgcaccggttctcacaagtactttgtcattaattagagattttgctgtgtttagggtcccaccgggcttctcagcaccatt

SEQ ID NO: 27579 - DNA, 994 bp, Bovine  19866880504244
taaaactgcactccattgctaaaaatgtttgctggtgcctgattttcatagatgataatgtcctaatgactgaccttggatttgaggcactgttacattttggtcttgatttacatttttaacttctccctaccccaccctcaggtcactttcctattcaacttgaccttggtattctcccgtggagggagctcctcttactcttctttgtagtacataatagatgccgggagagtggttgttcaataggaaagaaatgaagcccccataatctcatattcagtgcacagtgtcttttggaggcagcctggaagtccactgtccttggaatggcaagtggggacttaagaaatcagaggatccatcctgctgaccctgagctccccctaagttctagtatctggaagggaaacctatgccctcaggctggatttccccacattagtctgttggacattcttctacaaattcagaagctcttgctaatcttatcaaacagcctcaagcctcacagcaatgagagctcccagtttgggcaggtggtctctctgtgcgctggaatcccatcttaccatctctacctctcagctcaagaagatgccactaacatccttgtttttttgagctttatagtgctaacaccaccgtaagtcatatacctcataaaacaaaaacctttacctgtgataatgcattcatttaatttcgatgctaaatacagaatgagtaatgtgataaacagttctgactgattgaaatgaacccttcatttttcacaattgttccagaaggacactgagggaaagaaaatattaatggtttttataatgaggacttcacttggggtaagcagaaagtcactattttctcccgggatctcatttatcccagttcaatccaattaactcaattagagatcctggtgccattttaaaagccattcttccacccagttttagcactggacaatatctttatgctttcacgggattca

SEQ ID NO: 27580 - DNA, 1122 bp, Bovine  19866880504979
atttctcagcatggctatcgggatccccaacaacccaaccccaacctacagcattcctggctatccaagaagccagagtatcagtcaaaggaacttaagccaaactgcacagagggatggggaaaaagacacagttacctcccatctatggtaagtcctatcaaggtgtctcatttaattcacacagcaatctaatgcagaaagaattaacatcatgtgtacaaaggaagaaatagatcaaaagcaaaaaaagtagctaagatcacatgactaggaaatgatcaagccagtgtctggtggtctgggcatagccacctcatatccaggaagccactgacggccccccaggaactgcccctttctcctactcacaagtagttctcccaaagtctacgcaaaccgcccagggctgagaacagaacagacttgtttgtacacactggcatttgcacatgacaaaaatcaggctttgccacctactaattcccttggcgacagcaaaacagctatgttttccaagaatctgcaagaagctattttaagtacatttcataaacgtgtgctcctccaggacgcttgcttggcttgcagcagcccttcccaggatctctgtccagcaccggccgaccgccactgtgtccgaaggctggcccacagtcggctgctgggcgaccagattcgagagaccacggcaaagccacagcagccctcttccgttttcatctgaggtctatccaattaacaagagaaaaatgtaccgtatataaataagcataacttgaatgatttcctgaaagatattttttatcatgatataaaaaaattgaagcttcagaagattggaatttctaactttgccattaatattttcctaacaaatgttttacatatggccatagggcttccctggtggctcagacggtaaagtgtctgcctgcaacgtgggagacccgggttcaatcgctgggtcggaaagatcccctggaggaggaaatggcaacccactctagtactcttgcctggaaaattccatggacagaagagccttataggctacagtccatggggtcgcaaagagtggacagactaagcgacttcacttcacttcacctcataggcttc

SEQ ID NO: 27581 - DNA, 1742 bp, Bovine  19866880505680
aatgtggattcctttcctgaagcctgcacatcacaaggtgatgaggactgactacccgagcaggcagcgaaagggtggggataagaagagccgatcaggcggccttgcccctctatgggggtggggggtggtggcagtgaacaccattgctataactcagatacacaggagatcctcagacaggcccccagaatggtctgccctctgcagatcctgcttgttacccaggagccaaggctgtagtcatggaaagagtctggcagcaaatggaagaaagtcaggaaccccgtcactgggggcccctgggtccacaagcaaggtcctgaggatgcctgggagacaggcatgccccctgtctgtggcccctttatctttaggttggagaaaacgtgcttgctatggagcagcttcccctctgaagttcactgaaatattcaccagagatggtgggaggcagtgaggcagttggagggccccagagatcagccagctcaggactgtccccaaccacagggttagagggggtagccagggccagacagggagagactctctgggtcaaggaggccccaccagagtctgcatggactctgagccactggactcccaggcctgcacctgtcctgctaaactgggcagcccggacctctgcagggccttcccatcctgtctcacctcatcaagctgggtggaaacatacagtctgcgtcctaggtcatcaccttgacatttcacgtatgaaaaacaggtggaaaaggaaaagtggctcatgccagaccacagctggtacctgacctggcaggtttggggtccctttgcctagggctcacttcaccacatgcctgggtctccctaaggaaatgccccgagtctcagcccaagccaccccctcgtttccctcctggaagatgtgcagagcatccaaaggctaacccagaagacccctgcattgccatccctagccctggaggctgaatgtctttaccttcaaatgcccgggcagcatccacgaggtgggtccaatctaaccctgtggccgtgtctgggaggggcatcaggccaggatctgcgcacttggacttatccgataaggacccatcggagaaccagaactcatctagacaggaaaaaacccagagcgtcagtcagatagcagtgtgggtactggctgggccttcagaagggcccaggggggttcttgtcccaggtaagaaacacacatcccaccgctgtttgtgaaagagccacaactgccaggctcacttaggggtcgccaataggcaggggccggtgcaagatcagggctgaggttcccacaaaccagaaaagcagaggtgagctcctcctgggtgggctcctctgaaggacattacctggatctgaccaccctgaagatcacgtcctgttttcctcaggatgacttacccatgggaagagtgttgcaagcctctaccgtaaaaacggtttggtacaatctctcttgtacatttctctatgtataaaagtggtgattgaatttcgcttgtgactcaatgagatggtctgatcagtggctaaaccagaacccgctccccatcctgcactgagtatttgctagtcttctgtacaaagacaccctgtacacttctcctgaactctcatcacaggacgtgaagcacttacgtcaccagtaatactggctgttaagaagtcattatgcatctgcagacacgcttcctgaaggctagagctcctctaacacg

SEQ ID NO: 27582 - DNA, 1688 bp, Bovine  19866880572589
ctactctgccagttgcctgctggaggtctgacaatattggttttattgctacaatattggttttattgctacaatgcctggaatttcttgaggttagctcttgaaaagtgggttagcaaatccggtttttgctcccttgaccagggaagtaccaagaagataacatctggaaggagaccctgaattcatgtaaggaatctcttgtatggaatcacggggcttccgtcagctccacttctgtgctgctctgtgttcactgcctctgagcaagacactgccctactcacaccacactgcccacaccttagccgcaggcgccagctgccaacccatctggggttcctgctgccgaatgccagagggtcagaggcagggagggacctgcatcttctgcattcccttccattttaagtcggggcgagcctccatctgttgggttcttgggtgtggagctagtcttaaacattaatcattttacgagagtggtgaagagggcttccctggtggctcagatggtaaagaatctgcctgcaatgcaggagatgcaggtttgacccctgggtcaggaagatcccctggaggagggcatggcaacccactccagcattcttgcctggagaatcccatggacagaggagcctgacaggctacagtccctaaggtcacaaagagtcagacatgactgagtgactaacacacttggtaaggcagacatttgaggattgttcctttgctgtaggaagacaggatacagaggagcttgcctagagaatggcatctgatgggcagatgctttattagagatagcttgttaactgtgccgtatagatatagatttagatatatagatatagatatcccaccctgacagtatatatacacacccatacatgtaagtatagatgcaaaaatatatttctttttccatccaaatgctgaatgttctgttaaggcatctgatgaaatgctacctcggagggaaaatgaaagattgtctcttattacaggctgtttccatggtagcttaatacccttgggtagcaccctaatgatgagttattactttttagctaaaacatattgtagggaactgattaataatataacttgcatagccaaacaacaggttaatttttcttacgtttgttctcagaaaggaacacacactgatacatgtgataatttctctctacgtctgactcactcatcttagctctttcttcacagctaacaaaggaagggaaaaggaggatggatagacccttggggactccctcaggcaaagcatataggtggcatcttagaggttgtgcccgggaaggagggttttaatcaggagagtcccctcttaaaactgccagaccaagtgttccagcagctgtattctgtcagatgcaattgtagccctggcgcatcttcagcgctgtggcaggactaatataacaaaatgggctgactgtttacaagggcttctgggaggcagttgtgcctgacatcctgagaaacctcttccctggaggagtaactgaatctgtggttctcgtgtttgacctgccagctttagaggctgggggcagtgtcctccttgcggctgagatgcaaagacggcccagggcccttcgcaggatcgcctgtgggagacgggtgatgacaggggttaatacagaccagagaccaaacaaggaaac

SEQ ID NO: 27583 - DNA, 2352 bp, Bovine  19866880692927
cgatgtccgcgtggctatccgttctgacgatgggaaacctggctgcattcgggcctgaagagcgaccccagctaacttcaagattctagccagcaaggctggttattgttttcttgtgttagttttaaattcacagcatcaccaaaaaacactgcaaagcccatgcagagttatctagtgcagacccttatttttgccatcaggaggccaaggcccggtgtatttatggcgcatagccagggccatcaacttatcaaagacggtggttccctggcctgcttcctccccacacgccaggggacctgacacctcatgttcccctttcctgaaagtgggttcagaggcagtaatccaggtaaactgaatataaaattttttaatcagttaaatagatgatttaactggttgttcctgtgctccatgggccatgctatctagcctagacacttgaagcaaaacttttaattgtgtttcactagaaatctgttcaagcccattcttggtttcaaacatcttactcttttcctcatgtaatttcatacatacatatatgtatgtatgtattatatatgtgtgtatgtgtatatatatagtcacatatttcacaattattgatatatatggttgctttggggtcttccccagtgattcagcagcaagaatccacctgcaatgcaggagtggcgagatgccagttagagtcctgggtcaggaagatcccctggaggagggcatggcaactcactccagtattcctgcctggagaattccatggacagaggagcctggagggctacagtgcctagggtcgcaaagtcggacacaactgaagcaactgagcacgcacacgtgcacgcatggttgttttggttttatttttgcttttttgtctctttcaaaatacaaaaataaacctataatttctaaccaaaataataacaataatagattgactccccacagccgggccacatgaggacccacagtctgcgtggggcaggggcttcaaccagacgtcctaccctgagctcagcagaatccacctgagcaggaaggggaggaaaacgatgcacagccctgtagtagctaaaagaacacataagcaaattcagtattaaagccattaattaggacagattcctacacagatgtttgactgaatttgattttgaagcagcttctgcattacctaccacattttaatcagtaaccccaagaagcagaggggacaccccaaagaacagggaaatggggtgtttactgtactagactcccagacttgccaccatcttcctctcccttcaggtcacagattcattaaattccaatacactctgacacataaatatgcaatccagctaagagctcataaaggtcagcctccaaattgggtgacccatctcccaccccataactctagcagctaatgaactgttcaggctcccagagcttgaaaaacattggtaggaattcatgttctctgaagctgtcagcatgagcaccaagccaaaaacaaagctgtaagtgcaggggcctccagcacaagccctcacattctcagggcaattttaggatttgaatttcaacagtagggtggctgtttaatttgcatattttatcaagcagaccctgtgatgagaagccctttttagaatatgcacgtgaacatgtccagtgaagacagatgtattgagggttttcaggctttgaatcgagttccaaactggaggctcactgttgttgactgtgaaatgtatcagctgaagaaaagggaggaggaagagcacttcgctttggaaataatcatccataaaatagtctcatgattggcaaaaccaaccatacttaggaaacagagagcagacaagagttcggctttaaggatatgagtgacaccccagttttattcctctccccagtccctgccctccaatatgtgtggtgtgagttgtatgttgtaaatacaagaggaattattgctttatgaagagagggtaaaaaagtggaatttcaagatttggagggaagattggatgaaaatcaagcttaattgcattttatcactgtgggtgaggtgacaagatagaaaggcattatataaacacaagacattattatatgagtctttatattatagtataaaattaatgatgaaacctagaataaggtatcaggtttcagaagtgtcatttacaaattcaataatttgtggaggaaactgcattgacatcgaaaaccacaattacctccgttttaaaaacctactcaataaacctctttccttatctaaaagtttcctcagattcttatatcacctcctgccaagtatataataataaactacgtgggcca

SEQ ID NO: 27584 - DNA, 880 bp, Bovine  19866880763217
cttgagtgatcattaacttatgagggtctcccatacttttttctccccttataatcccccagtgggattaactatttaattacctactttgtcgttttactctgtctgtatcactcaggttaaccaagagcagaagatatggattctggtaactaactttttcataaagctggcttgaaacccaccatcctttaatataagcatgattaaggagaggttttgagaactgttagttttaatcaactaacttcctgacactgttgttgggtgggttgcctggtggcacattttacagctaatcgaggctgatagattcacgacagacatttcacagaaacatttttaaagattttcccagagccctggaagggactgatgagtaaaaatccattttgaacattttccaagacaatgtcatctgagccttgctcagcaccacagccctacagagacacaatcaaactcttgttcatttgctaaaacagactcaagactgcttcctgaagaaaactgtggccttacctgcagaaagaaagggtaaaggcatttgggggcagaaagccagaagctcagaatagatcataaatatcagggttgctaagaagtttagagcagttagagttttaagatacatttctcagaggaagaggttagtattctgtactaggtttaacacttagagagttagtcagtcacaggtggtaatgggattcttggtggtagatgagacagcctggagcaggacagattataaaatttgtgggatccagtgcaaaatgaaaaggcagaggcccttgttcaaaaattaggaattttaagatggcaaccccagagtgtctgtctaaggcaggactcttctgagtacaagtaactgcacagg

SEQ ID NO: 27585 - DNA, 2577 bp, Bovine  19866880848432
aaactagacgttagatctttgaggatccgatgacctggacaaccatggaaacaaaagcacttatatgcacaggacctgatgagaaatgcagcactgcccactttgctctccgtttcactcctgctttgatgagtatctgtgtttataaggaagttctgtctgcttctgttgcaggcagctgcttgcatttcctcctcctgagaaaggggctgtaaaaaaagataaatgacatggggctcaagcaaattttgcaagcctggcagatattgtttctacatggtggttttttgaaaattcctatataacgagcctgaatggtcttcttgtccacttcctcatctttaacttttccatgtagagagagagggacaaaggcattgtcaagattaccaaggacgaccccacagccctctggactgtttgtggcacacagaaagtcctgcccaatatcgagccagaacctctcccgctcttgtctgaactattaaaaaaaaaacagtcatccacagtggctgtgaaaaagcaattcattttcccctcctcctttattcctcttctacctttctcttttattccccaaaggtagaatttagacagatgcaaatcagaaagcaccacagactccactgtgagctggaaacaagaaaatgaaatcataaaatgcttagccctctctttgctggttggggtcctctaattaaacagctgattgaatatactcacccacatctcctatggtgcgtatcataaaatccaagcactaaacgtcgggactctattggaaagatttttcacacagtactaagacagaagcagcctttaccttaacaaagctctagctctttcctgatgctaatagttgggtttaaatatgaaaaatcatttttgtgtcctctgctctttaaggatgttcactaacctacgcaagtcccggtgaactcccagccaaattaggcttgagaaaatgaaagttactaagctagcatttccttttctgttggtctatcagcgtgaagacccgctctctccccgcagtgttaataactgaatatgaaatatttaaatggctgcaaattgcatcaattaaaattgtttccattccaagtaagctcagatggcatgcatgttttgatccaatgtctttttatgtttgatatactttcttaattataaagtacattatattaagcagaaaaaagcattggtaattgtagcagaaatgtttctttaagtgcaaaattaagaaaaaagtttaaaaagaaaggctgaggtaggtttcttttgtaagacacatactttataagatatatactatgtattcagttcagtcactcagttgtgtccgactctgcgaccccatgaactgcagcacaccaggcctccctgtccatcaccaactcccggagtccacccaaacccatgcccattgtgtcggtgatgccatccaaccatcttatcctctgtcgtcctcttctcctcctgccctcagtcttccccagcatcagggtcttttcaaatgagtcagctctccgcatcaggtggccaaagcattggagtttcagcttcaacatcagtcctatgtattactatttcattatcttggcaatgcaacaagccatggatagaagcagtgctttttaattctgaaggtgaccttggtttctgtctctaggacatgctgaccacttggtatggccaggacttaagaagcagagacaatgtgcaagggatctaagagaggatggcagtgagtcctgagcacgggtcacttccagcatttaatgagaggttttagaaaagtaaatcggatcagcctttctcttacttaataaccactccccccaaatgcttccatttagaacaaatccaggccattgatggaagaccccagggccctgtacgagcagacccacatttctctctttccctcacccacctccctctagccacgctgactttgtttccttgggaactgagattacccccacctcaaaacctttgccctttctgctccctctgctaagagggacatctctttagagagatcttctctttaaagagagaacagaacatcttcctgacatattttttgccttgctgactctctttttttaggctctgttcaaaacttcatttctttagagagattttctctggcctctcaatctccccctgtgcctcctccccctgtcacagtggtggcacatttgataaaggccaaatgaatactagtgatcagaaatacgggggcttcaaagaaagggagagaggactctgggctgggcagcttataaaagatcatcagagactatatctaaggctaaagccttgagacatggacacgcatctgtccctgttttggggacaattgattgggttggaacaaaatatccaaacttttgattctgaggtcactactcaacacttgtggttacttaacctactatgatggggttttccatgatggctcagtgttaacgaatctgcctacaatgcaggagacacaggagatgcgggttcaatccctgggtccagaagatcccttcccttggaggaggaaatggcaactccagtgtt

SEQ ID NO: 27586 - DNA, 948 bp, Bovine  19866880874719
atacaatgtccttgcatgttaaggagcttcagtcatgtccgactctttgtgatgctatagactgtagcctaccaggctcctctgtccatacggattttccaagcaaggatactggagtggattgccatgccctcctccagaggatcttcctgacccagggatcaaacctgcgatctcctgtgactcctgcgtctcaagcagaatttttcaccactgagccactagggaagcccccaccaagtttttctaattctctcttccctttgtggaatcatctccaaatgcagaatgaaaaactgaacacaggacatcccaaatccaagcaaaaagaaagttgtaggaacaacatacaagaattttaagatattcttcttaccacccgtactttttaaacacctcatgcatgcagtgccatcatgaaaaaaaattgtcatatcccttcctcaggtttaatgataatcccattgtgtacaaaacagaggcaactttgatgagtcatataaatggaagatcgagtctttgacatccatagaagacacatgagagcatgacatggggcaggagatgaatacttctaaaatttcttcctgctttcatctgaaaatttcccctcagaaatgaggatagtgaaaacttatgagcatcactgtataagcaggatgcgtcttgcatgttttatcttgttaatcttgcacagctaaagctatgtttaagctcagaagctcatatattgctagtggtctatactctacaaaaggatgtatgaaaaagatgttcattaaaaaacatctaccgtgtcagccattacagtcctttcatctgaagaggcactaaaacagaattcccctgtgcaagatttgcaaggagtacttttctctttaagggcacagtgatttcccccaagaaagggaagaactcaatatcctctttattctgagtttcctctca

SEQ ID NO: 27587 - DNA, 1349 bp, Bovine  19866880957587
ctgtcccttccttatagactcttacaaggtaagagccaggaggaatcttagagattattaattccccctgcattgttggcagcctcctggctcagtgctcaaacctcctggctcccagttcaatgagagaagtaatttcattgcctgcaaatgtggttataggcaaggttgactcagtggctgttattttcccttggaggcaaattggagactccaggtaggagagcctccgttttcaatgtttgggtagtaggacctgtcttacttgaatgatagaagctctgccatgaagaacaataatcgtgggagtgaaaatggtcacagatgaatcattggattgcaacaaagatgaaaaatattgtcatattctctacaatgtccaaacaattcctaagctggaagccagattgcagtctctttctttgatgtgctttattgtctttttaatgagccatatctattttcctccttataatgggataaactttaagagcaactacaaaaagaaaaagacatcatatcctaggtcttatttcctttagaaagaaccaaaaaagcttagttatccaagttgtatgttcttaaggatggtggaaaatcaggttgctattgttgttgagttgctaagttgtgtctaattctttgtgatcccatggatgtagcccaccaggcttctctgtcctccactatctctcagaatttgctcaaaagcatatccattgaattggtgatgctatctaaccatctcgtcctctgccgcccccttctccttttgcctgagatctttcctagcatcagggtcttttctagtgagttggctctttgcatcagatggccaaagtattaaagattcagcttcagaatcagtccctctaatgaatattcagggctgattttctttagaggtgactggtttgatccccttgcagtccaggggactctcaatcgtcttctccactgccacaatttgaaagcatcagttctttggcactcatgcttccttatggttcaactctcacgtctgtacacgactactgggaaaaaccatagctttgactatatggacccttattggcaaagtggtgtctctgctttttaacacgtctaggtttgtcgtagctttccttctaaggagcaagcaaactgtggaaaagcaggttaaatttctataaatacaaaacagtacaatctgcaaacagcagtagaaataaaatatagattctcttaaactaaaatagggcttccctataaagttcaataactctgttagtagaaaccctgactgaaaatttgaagaacaagaggttatgctaaggtttctaggtttatttttgtttgttgtttaaaaa

SEQ ID NO: 27588 - DNA, 1539 bp, Bovine  19866881002174
tgttcttgcctggagaatcccagggacaggggagcctggtgggctgtcgtctctggggtcgcacagagtcagacatgactgaagcgacttagcagcagcatgtgaccctaaagcaattgctttctgttatgagaatggagttagagagcacattttatcataattactcgcccacatacaccttcaacgctcgctcttcacatcctgctcctctcatttcctatgggaaacagtcaagtagataatggagagaaatgaccatgtttaaaacatagcaaaatcatgcaaaaagtggggttctggccctaagtactcaaaagacagaaagctcacttacagacataccttattttaccacggttcactttactgtgcttctcagatgctgtgtttttcacaaactgaaggttggcggcagctctgtgtcctgcacgcctgtcagcactattttcccagcagcacttgctcacttcgtggtttggtaattattgcaccattccaaacttgttcattattattctccttgttagagtgacctgtgatcagggatctctgatgctgttcagaagatggttagtgtttttagcaacaaagtattttttccttaaggtgtggaccttgttgttttagacataatgctattgcacacttaagagactctgtagagggtaaatgtaacttttacataaaataactgggaaatcaaaaaagtcatgtgacttgctttattgccctatttgctttattaccatggttgggaatgaaacctacagtgtctccaaggcgtgactgtacattttcaaggttttacaccctcagaggggcaaaaacatatgagtcctgcctccctctgtattgtattctcaaagcaataccatacgctcatcgcattcttcaaagctccctgaacagaggccaagttataagactgatttatctccatcacttatcaaatgcagttagagacacaagacatagattgtacgtgttacaataataaccaagagtttgagataatatctacaaaatccagtgacacacacactcaatttgggacgtgactgaagattccctagattgggttcaggtatgaaaagggccatgttcacagcgatcatttgtcttccttgggttttcactcccatctgctaatacagaataccacctctgctaaattaccggctgactcacatgtttctgagcatctttgaggttgagtcttaagtacatatgactgattctatcttgtatcttccaccaagtgtactgtggcttcccttaccgggtaaagccacacagccagacaccgccacctgaatgagtccttttcatcctcttcctcccggcccagcccttggtaccctgttgctgcttctgttacctcctgcagggcactgcttcagatgtgccactgctgtttgcctttttttgttttgttttgcttttggggttttttgcttgtttgtttttggtcgtgttgggtctttgttgcagcgtggaggcttctcttgctgtgctgcagggacttctctttgcagt

SEQ ID NO: 27589 - DNA, 3327 bp, Bovine  19866881074452
agagttggactcgactgagcgatttccttacttttttaaattgcaatgatatttgcctccctttgctgccttgctatcatatggaattggaagggtgaactcataacaagaagactctgcatgggaggtgggggtttccagtgacctctccacgccccattcatctgtctaaggtcactcggctgtttagaggctaagccacactgaggatgcatgtgttaaagagctctgcattttccagaagtccgtgtttcctcactgctccccagtcaggcttcaagttctctagtcttgggaaggtgtggacagaacttcaaggctccttgcttctggggggccctgtcaacttccagagcccctggtcaccttctggctataactcagagttgcaccaagatttccagccccccatgattctcagccaacttgtatccactgcttcgggacaacccagagctcccacgaagcccagtcattcccagtctttcccagttccgcctgccttgcccagtccccactcacagctctgcctcctgacagttgctacccacagtccaatctgatagcagtttccataaaggattgcctcagctcagattttttttttttttctgctttccgaaagaaacttctcaaggacaaaatgataagaggtgacaaattggcctggcacacaaggaaagcatattcaaaaggtaaagtactagcaaacacaggcacaaacactgctgaacttccaaccccttgtttgtaaagagactccaacaagccctccagtcgtctccacccctcgctctgcctcatgcctcctgggtgcactgccagctctctaagggctgtatttaagcaaagactcactttgctgcatttggctcacatgtgttagaaaactgctgtcttgcttcataaagagtcttcacctgctcacctgtagctgctgcttttctcggagaagccagtctcgcctggtgatggacactcgcaaactgtcctgagcagcggcttccaacgtctttggatccattctcagccgggcttgggggtcgtcaccgccagctcttaaaacacacacacacacacatatatatatatatatatatatatataggcacagatatgaatgacctgaaatcttcagacctacatgaatgttaatgcaaagaagcctcacaaagtggctcccagctgccctcatccttagaagggtcatggggaagaggtccctagtgtatgtgttggtttgaatgataatctgttggggctttagcagttgcctagagtactcttgcctggaaaatcccatggacggaggagcctggtgggctgcagtccatggggtcactaagagtcagacatgactgaatgacttccttttcacttttcactttcatgcattggagaaggaaatagcagcccactccagtgttcttgcctagagaaccccaaggatgggggagcctggtgggctgccgtctatggggtcacacagagtcagacacgactgaagcgacttagcagcagcagcagcagagtcaccttgctttattggactgggcgctatcccgctccacaactatgcatgtagctatctgtactgaaagcgtaaaatacacatcagattttaaagtcttagtatgaaaacaaagaatgccaaatgtctcattaatgatattttcacattcattacatgttgggatgacaacattattgatacactgggttaattaaatgtatttcttaaattaatttcacttgttttttttttttttcttacatttataaaatatggagagtagggacttccctggtggtaaagtggctaagaatctgcctgccaattcaggggacatgggttcgatccctgctccagaaagatcccacatgccaaggggcaactaagcccgagctctagagcctgtgagccacaagtactgaagcccacatacctagagcccgtgctttgcaacaagagaagtcacacaatgagaggctccgcacagcaaccagagagtagcctctgctcactacagctagagaaagtccagcaacaaagacccagcacagccaaaactaaattaaaaatcttattgtggctactatattatttaaaatcatgtatgtggtttgcattatacatcattggacagccctgcctggacccatccagagccaaattccagggcagatcttggctgtggacactacagagagggatggctgatttgaagatgtttgggtcagagcttctcagaaaatgtgtgctagaagactatcaaaaaaccacttaaaatctgtatggctctttctcctatgctcacaggagttggcatattgggttgaagcaacactggtgaagatgtggctcaggctgccaccttacatgagtgagttggccttgcagaaaccttgcagctgtttctcatcaaaggatgacaaatcaatttctaactgaatgcagtcggctgggaaaaaagtctaccctaagcaaaactatgtcaacaattcaaggaaacagtgtctatgaaagctccactgacgacagttaaaaggcaaacaacaagttggggaaaaggaaatattgctaatgtcaagagtgctagcaacagaagaagaaaaagatgagtacatctatcagaaactcaaaaaaaaagagaaattatgaaggtttatcatcaaaaatgttttcaaaagcaaattcaaacaacataaaatatcatttttcatgtaacaattgacaaaagcttttagaaaccacaattccttggtgagcacagggaataaaaattagatccaaaacatgcctttggatcctcttgtctgggctttaaaaattaattatatgtaaattgccttttcagactattcatggggttctgaccatccttatggcagaaagtgaagaagaactaaagagcctcttgatgaaagtgaaagaggagagtggaaaagttggcttaaaactcaacattcataaaatgaagatcatggcatccggtcctatcgctccatggaaaatagatggggaaacaatggaaacagtgacagactttattttcttgggctccaaagtcactgcagatggtgactgcagccatgaaattaaaagacccttgctccttggaagaaaacctatgaccaacctagacagcatactaaaagcagaatatcactttaccaacaaaggtctgtctagtcaaagctatggtttttccagtggtcgtgtatgggtgtgagagctggactctaaagaaagctgagagctgaagaattgatgcttttgaactgtggtgtggagaagactcttgagagtccccggacgcaagagat

SEQ ID NO: 27590 - DNA, 1821 bp, Bovine  19866881151799
gaagtccccccttccctttaatatgagctctagttttaaaactttaaatgtttgtatcttccaaatttcataggcaagggcatagtcttctttatggggaaatcactaagtaataaagtccttggagagcctgaccacggagcctgcgagtgtggttttcagcagtgtgtggggtgcaggcatctgctcaggctagcgactgaatgtatttttggatccaagtataaacctttctagataaatgtttttagaaagtcattttaatgagaaaatcctgcccaacaaaggaaatccttttttctgttttaaatcacgcttccccagtttagtgagtaggacagaaatttgacatcagccctaattcaacacagctggaaatttctgcccgaacactcaagtctacgggttttgatcatgaggtgagttacgcaaattctctttgaaatattgcctgaccaagttagggctaccgaatcagacatgtgtggaaggacaggagggaagatttagggctcttcttgaggctgataaaaggcaagtgtgtgtggaagagcggggacagacacacaagacccgctagttgccctagaggcaggagatcatcccaggcaagctgctcttggctgcatccagggaaggaccgagtctagggacatctcacaggtctctgcctggctcttcacacttggtgagaggcggccttggccaaggcaggctgagaaaccgcattgcttcctcaagacctggcaaagaagaagtctccattcgttgcttcaacaaatgtgtcctgagcatgttttgagaactaggcaagttgcactggaactccagggatggaaggaccccattctaaccccgtctagttggagagataggcaggtgcatacatgtgagagaagttctgtccatggtatgggaggaacaccccagcctggagttgcggcagtaagagattcagggattcaggagcatgtctggaggaagtgaggtttgcagggtttctcagaggagagggtgcgtcagccaggcagagaagggaaaagctcactaagaggctctattcctgctatagctttttttcattctggcctgtggtgaaaatagttactcctagggctaaatgatggaataaatgtgtacaaagaaaaaaataataatttgaatggctgaaaagactgcctgatgggacaaattactagagttttcaaagccactttgaaatgccaaacaacctgtactttgtctgttcagaattgcaaataccacagaactccatttcagtcaggaataccaatgatttttgttgtgggggatattttaattttcaagtatcagtcatgtagtcatgtaacatttttggggccacatttaatttaataactaagtgggagcaaatgttaccaatttcgcgctgagaggagcccagtgcatgaagaactactgaatatggttcagagaatgtccattgggaatctagcaagtagatgggaaagatgggcagttaaggctctcaaattccagaggggtagtggtaaagcatgcaggttccatccctagctcaggaagtcccttggagtaggaaatggaaacccactccagtattcatgcctggaaaattctatggacagaggagcctggccagagacagtccatggggtcgcaaagaatcgaacatgactgagcaactgaacacacagatacatgttcttattcagaaaggaaaacaggccatccttcccatgtgactcacccgctgtcctctgcctccagccttgggtttcatggacttggagaccaaaggtccctcactcaccactgcat

SEQ ID NO: 27591 - DNA, 965 bp, Bovine  19866881157498
cacagaataagcttaatctttaagtcaaaataatgatcccaaactagacaagtgcactaaccacatgcgttttcatttctactgaattcttttgtgaattcagctcttgtgtccatcttcttgtatgtgctgtctcaacttcattgtactaacttatgtgcttgttgctcattgtcaacagagagctatatgaactttattgtaactggtatgatgtaaagtagaatgagttagagagggaagaccttgcatgctcaaatgaatactcaaatctttggtatcctgtcaacttgttctgaacctactctgctatgtgtattgagagctgaattaatgctgttgccaagcaaggtatgaattagatctttttaagtgatagcttttaatcactttataaaacaagtctcctctaattgttcccttattaaatgccataatcaaattcaatatgctggaataaaattgacttggtagccaagatgctaagttcaaattgtgttatttatatactgcaagcattacatcaggagttgaaagtgattactcagaagatggtgatgaataaaagcatgcagcaaattgcctaatctcatcaccttgggttagaacgtctggtggtagataataataacagtaatgactgtgtattaatgtcttcctatgtgctaggccctgtgctatgtgatttactctatataatttcactttaaaaagaaacaactagaaaggctaaatattctacttttatgtggtacttttatctgaacccaggtcgatctgactgctaaactatcatcatttttctagagactttcacaccataatgtttctcttaaccccaagagaacacacaaaaaatcaagtgagattttcgctttggctaatttcaatttgatttaatgaaagattgttaggagcttaaagtgtgctttgtacaacggctagaattttttttttttattatc

SEQ ID NO: 27592 - DNA, 1503 bp, Bovine  19866881158907
actggagtgggttgccatttcctcctccagcggtatctttccgatgcaggaattgagcccgtgtctcttacatcgcctgaattggcaggcgggttctttaccactcctgccacctgggaagccccgatagtaaaggctagtatttgcgttgcacaccggggtcagcaggtggcgctcgcggctggaagtggctgcctgggatctccggggccccagagcccatctactaccagggggcgggggggatcaaggtccttcccaccggtcaaggaccaacggaagggaagctctgactcacatatttttaactccagtccttgcatttctaaaaaaaaatagctttatgggaaactttccagttcttgaggtatttgattatgagggtaggttcttagttaatgggattccaatttctgcagcttattttctttgaagaaaaaaatgtctcgcagtgattactgcttatgccttctcttaggagattgaatgtctttgaaaaaataataagagccatactctgaacagaagtggatctctgctcatctgtagcatgacagagtttgagcatcactttagtgactttagcaactgtgagtgagtctctcttgatgaacagtgtctaaggaaacattctcaaaatcaacacttggagactgatctttttcaactggttgtacagaactcatcaacattagcaggttttctcctaagtgatcatcatggtgttaaaaataattcgtgtgaggtatgggcttcccagttggtgtggtggtaaagaacctacctgccaatgcaggggatgcaagaggcagattcgatccctgggttgggaagatcccttggggaaggaaatggcaacccacgccagtattcttgcctggagaatcccatggacagaggagcctggcaggttacagtccatggggtcaccaagggtcggacacgactgactgatatgcacagtatgaggcatgctcctgtgtgatgatcataatgatgatcatcatataaatacatggactataacctctgagacttagaagaatgaaagctaagggggctgtattttcaataaaaagacagaagatacttaaaaaacatcaacctagagatgaagagtactgacctagaaacaagtgacctttctattatgtcgctgaggcgaccattggcggggggtggagccagggaccttgggttgtctattttgagtcgcatgtttctttctttctctctcatccttttgggtttccagccgagatgatccaacaaagattagaagccctggagaaggagagaagcagcctgcactttcagcttccttctcaacagcccgccctcagcgccctcctgggccacctgggggcccaggcccaggcttccctgcgctgggcagctcagaggtaagcgctctcccggggtcctcttcccttctccccactcctgagtggggaagaacacataggagcctagcctaggagaccctcccttctgttggttggg

SEQ ID NO: 27593 - DNA, 963 bp, Bovine  19866881165022
gtctaagtggggctagtggaggttgggtgtcagtattattttaggtaccctcagtttagctacactctgtgaggctgtgaaaaacaccaatggctcagcaggtagagaatcatcctgcaatgcaggaaatacaggagacatgggtttggtccctgggtcagaaagatcccttggaggaggaaaatggtaacgcactctagtattcttgcctgaaaaatcccatggacagaggagcctggcaggctacagttcaaaggtttacaaagagtcaaacacaactgagccactaagcaagcaagctgtgaggctgaatgatgcggctgtctacaatccctggtgaaacatagatgttcagatctgtggtttggttttttttttcctccaaataattttgcattctgagtttacatttaaacaaaacacaattagagaacaggcatgaatgactgatctgcatggatcagcttctttctcctgaacacatgtacatcaaaagtgacttaatagctgacttcaaatatatacagaaagtatggaaaatggaaattccgtggtatctcaatttatattcactgagggcaagatgaggataaaggaactcaaattgcagcagaaaggaattagacatcaggaaggaaacttcctaactttgggagatgtctgatggaaaaaaaatgaagccgctgtctcatgatggatcactgtcttagcccatgaatatttatgcagtgaatacatgctgcaaggcaggtgctgggcttggcactgtaagatccagtctgtagaacagacagatctgcaccctgaccacacagctttgaagtctagtgggggacacagatattaggctaagacacaagcaggtaattataagctgtgacagttgccatgaagggaagtctaagagtataaaatgggtacacggcctagggccaggaggcagaggaagacctctccaaggag

SEQ ID NO: 27594 - DNA, 909 bp, Bovine  19866881177819
ctttaattctactgtacgtttgtccctccacaagtctccgtaagaaagccccatcacctcctctctccttctccccatcctgtcatccaagttcatacatggagaattaaatataatattgttgccatactgttaagaaaggcagaaaatccacttttaagaaacaaactattgtcttgctgtcaaattcctctacccaaggtttgagaagcctcatcaccatcatgcttcaaggaaggaaaaaaaacctcatatactttagtcacagagagcacaaaaggggatttgctttagatgtttccatctctgtgtccacatatcatccaaggccaaacaacaggcatgtttagtgtttgtaattagatgaaaacagcaatacttttttataagaagcatcttatcttccccgtatgtatgtgcacacactgacagccatgagctgggtgatgtatctaacacagcctggcaagacaagatgacctttctaattgtcatgatgagaagcacaattgcaagtgactttgaaacatatggtaaacttcattatgctaaaatataatagcttcttctttggggctcatgatgaatattaatgtcagggctcctgaggaaaatgtgctctaaatattatattgtataaaaccctttcaataccaaagagagcatttatttatagtcttcaaccttcttcatagatgctgttaaatattccattaaacatggcaaaatggaatgaataatcatggaacattggaggtgggtggggacaatgatccctttccgagtatcaagccaagctccaggcagggccataagaaaaagtcaagagatagaaatacaaggtcaaggaggacacagagtatacagagaggtaagtcggtgggttctgctgcggagggcatcctcaca

SEQ ID NO: 27595 - DNA, 2212 bp, Bovine  19866881232421
ttctgttttttgttttgttttttggcccaaggcatttatgatcttaactccctgactagggactgaacttgcaccccctgcattggaaggtaaagtgttaacccctgggcaactagggaagccccaggatgttgtttctaaaacaacttttgtgttcccaacctactcagagtctccctctgattctggcaaaatgtcatccgcatggcagtaggattcaagccaccaatcctgaaaatgcaatgcttatttttacaaaaaccaaaatggttttaacttttctgtactgacccaaataagaagtcagtcagttatcacttagctctccttggtcttgggctcccggggctccacacacttgctctcctggggaccctgcctcccaagccacccattcagcaggtgttcccaagtgttgacagtttaaactgttgatggaaaatttggcctctctgtctctctcttttttaaaattctgtgatgttttgctttggggcctggaaaggagccttcactcactgactgctgcagatagacctcacctcaccgggggtggttttcttcactgagaaacttcacacccacgtgcacacaggcacacatgtacctgcgcggtgcacattcagactacctcttagggcttctgcctgagaaagcatggctgctgggggtgggtttggcccacgtgttaacacacatcatgcaggaaggatgtcggcagtgagttgtatggttttcgagatccgtccacgacagcttgacacagggcatcagacggtgcaaactggagctgcctgagaactaaaagcaagaattctgctctgaacagcttcagtttctggctgcagcactgttacccggagaggaggcctgatgagggctcaagggtgtgtgtttctgaagtcataaaagcgagcgcttgtttgagttcatcaggcaagtcctgctgtgtccctttacttattctctcctgtattaagggcttaaaagtggttcatttccctgaataaatttggctttattttccctgaaagcttagtaatgatttaatgacggaatttgaggagcttgtcatagaaacacatgtaaagggaaaaagatgaatgtttcccccagtgagtaaggcagctgactgtcagtccaaggagagcagcagaagaaagccctgttcctctgtccctggggagcgacctgcacccaagcccccagagcctttgggctaagctcactcagctgcacctaccagggatgctgtgtgtctgttcatgattggatcagggaaggaaggagcagtctcgtcaaaggaggcatactgagctccagggctacatatgggagaaaaatgctctcctggaaaatctactgaaatactttcagtgttcagcagagggtgtgtggggtgaatacattcacatggctgatatgaggataatgtggccatgtgaatgatgcagggaaaggggaggaggtgtgatcctgggaaccctgattctgcttaaagagatgctctgtattctcagccaagcataagggggacacaactggtctgttgagaaaatggaagggtatctgcaactcaaagaaaaaaaaaaatatgattctcttgctctgattattggctggcattagctcagaatttgtcagtcttatgaacaaggtgaggttgtggtggccttataaatgccaggtaattctggcaccttgaaaacgcgtctagagttgagaggagacttgagaactcgtctagagacttaccaccctcctcccctgtactcttgctgcaggagactgctctggcctcagtttcttcatctgaaagttggggataataggattagcaaccctatggtgaaggtgtgcacccaggacaatctttaggaagcccagagctgtctgaagtggccaagacttccatcagagctgagacttccctggtgctggactggtccagggacagctgattggctggtgtcagggatcatagcagagaatgttcacagccatggaggtggggacaggatgacttcagaggtttcctccaccagtgagataacacaaagtcccccttatgaatcctgtaataggggtgaattgtaatcccccgccccacgaaagacaggtccaagttctaacccctagtacctgtgaatgtgaacttactcagaaacaggatctttgaaaatataactaatttcagcatcttgagatggaa

SEQ ID NO: 27596 - DNA, 1023 bp, Bovine  19866881245039
tgcctggaaaatcccatggatggaggggccttgtaggctgcagtccatggggtcgctaggagttggacacgactgagtgacttcactttcacttttcactttcatgcattggagaaggaaatggtaacccaccccagtgttcttgactggagaatcccaggaacgggggagcctggtgggctgccgtctatggggtcacacagagtcagacacgactgaagtgacttagcagcagcagcagcagcaaggctctccaggggtttccaggtggctcagtggtaaagaatccccctgctaatgcaggagatacagattcgatccctgggttgggaagatcccctggagaaggacatggcaacccactctagtattcttgcctgagaaatcccatgaacagagaagcctggcgggctacagtccacggggtcacaaaagagtcagatacaacttagtgactaaacaacaaggctttccagcgcttccttctcataacagcaatgagctcagtgttggctgtattaaagccaaatgcccagtgagaacttggtcataatttgttgaatgaagaaaaaagtgaatgaaaacaaaagcaacaacattaacacaaaaacagactagagtctgcgtgtaatttggtcatacgaattataacatcaggtcacacaagacttactttttaagttctatttgataacgattcgaggcaaccatgatcagctgccaaagctcacacagtcgacgtaggagttgggtctgctacgcagaaatgtttcaaactcaaaatcagaaagcatatgcacactcataaagtgagaatgctccttggatgctctttgccttttccagtcgaagaaactaagaccctgagcaatgacttgatttgttcagaagcacacagtggaggcaaggtcatggaacttaggctcttgacttccctggcagcttttaacccataaagctgctctccacccccagcccatctgcgactctgggcatggcatctgtattcgacccagcttctca

SEQ ID NO: 27597 - DNA, 882 bp, Bovine  19866881255467
tcaatatcctgtaataagccataatggaaaagaatatctctatctatatataactgaattgctttgctctacagcagaactcaaccacaacattataaatcaactatgcttcaataaaataaactttaaaaacaagaaactgacattgcaatcaggttttttaaagatgatttcaagggaaaacatgtacagtgtgggtaattggatcctcgctgagctcaccatttacatgaagttcatactctgagcctccctttttcttatagtcttgtctgtgcctttcggttcaatgtcagtaatttcttggttactaaatattttattattaccgaaataagctctggaggaataaagcttctactggaaactgtcactaaattggccattttacaaagtagtttagtgtctgtacttaatcaagtagcattctagttgcatttcagcctcccaagctttttggattcaaagtgaaatcttctttgtgaaattacattgttggcaaaactctatttttggcttctagcctcctgactggtaggaccttgtttctccccaaggaatgtttgaatggctgccagtagtaagttctatttcttcaaatatgtggctattttatcaattcaggtaaaaatagaggaatcaagccaagatgttttcattgagatatttagacttgatgatcagaaccaactatattaagaaagatagaaactaactgaattatcactgggttgcataaaatgtggatgagtcaacaaaacttttaaaaagtgagaaaaataaattctttctttcattcactttgttcagtagttaaattcgctatgaaataaaaaatgtgtctgctgttttgttttttttttttaagtggtgattggtttc

SEQ ID NO: 27598 - DNA, 3431 bp, Bovine  19866881369271
aatatacttagtttccttttatctacaaaatggtgcaattccaattccaatcaataaggtcacaacagattggatcaggccaatgtataggttcttctgcactgtgctgtgctatgcttagtcactcagtcatgtctgattctttgtgaccccatggactgtagctcgccaggttcttctgtccatggggattctctaggaaagaatactggagtgggttgtcatgccttcttccagggtatcttcccaacccagggactgaacccaggtttcccgcattacaggcagattctttaccatctgaaccaccagggaagcccatgaacactggcgtaggtagcctattccttctccaggggatcttcccaacccaggatggaaccagggtctcctgcattgcaggtggattctttgccagctgagctaccagggaagcccacgtctgcactacttgtagacaatgttcacttatgttagttctcacttagaacaccagaggaaataggaatcggcacaggatagtaaaaccaaattcttaaacccgtgtgtccagcgtcaattttagctcttagataaaggcatgggacataaatgaggcagaacagcagggaagagtcatgcctgctagggataaatgacagtatggcatgatacaaggctcatggtatctcaacccaacagatacattctattttttaaagcctgtcttcaaacgtgctgactaatcatatgtgggcccagactttttccagaggggtctgacttcagtaaggcatcttaagctgccttgatgactctgtaatgattaaataggcacatgggagctttctggactatcttttcttcatgatgttgagtctagctcaggaatagctttgagaattggtacagaaagataaagtcacaagcagggcaactggtcatcctggtaaagacctttctttttaaagtgctgagggatgcctatgctcacatcagcactattcatgacaactgagatggaaaacaatctaaatatccatcaacagatgaatggataaagcagatagggtacatacatacaatggaacactactcagccataaaagagaaggaagtaatgccatgtgccgcaacgcagatgcacctagagactatcatactaagtaaagtaagtcagaatgggaaagacaaatatatggtatcacttatatgtggaacctaaaatatgacaaaaggaacttatctatgaaatagaaacagactcacagacatagagaacagactaggaattgccaaggtggggggaaggtcaggggagggctggactgggaggctggggtcagcagatgcaaactatattatatataggacggataaaacacaaagccctgctgtacagagcagagaagtataaaccacaatggagagaaggaatatgagacagcatgtgtgtatatgcatataaccgaaccactttgctatatagcagaaattaatacattctaaatcaactatgcttcaataaaactaattaatagaaaaaaagtggtcaaggggatggatcgcatctggtcaccaccgtgtccatttacatcacagtggagctgacgctgatactaaagaatctgattagccaaaggtctggagttgcagatttttgaatcttcctgaactgactattgtctcaagatggcatactgccctatggattggcactgaaaagtgactggaacttttaaacatgacctcaactccctccatattttctgtagaatgttgtttggaaagtttagaaagggcagggaaccaaagtccgctcccctagcaaagagaatctcatgttctatctgttcaacttaggcaccccctgccctgagtcactggctagctgggatgtccctgctttttcctcccttgtctgagagtgccgatgcccagctggcctcgaacatcagctcagaaacaccctgatgaaagaaatgtgagggtagggctaagaggagcttgccaggtctctggaaaggttttcatttcatagatgagcaggctgaagcccagcacaagtgtgtacctcagaggactggagatcaaccttcagcgttgcaataaagcacgtagctgacttgtccaaaggcccgcagcccatcagtagggctgcaattacaatcacagtccatggatggataatccagccactgctgtctgtgccactgtgctatctggacctcccacccacagaccagctccccggaaagtcccacttcatagcagtgattttattctgcagaggtagaagggaatcaagcaaagagacaaatgacggtggagaccgacatgaagtatatatatatggtcgtcgtggtttagtcgctaagctgtgtccatgtgtccaactcttgcaaccccatggactgtagcccgccaggctcctctgtccatggaattctccaggcaagaatactggagtgggttgccatttccttctccaggggatctttctgactcagaaatcgaatctgcatcttctgcactggcaggtgtattctttactgctgagccacaaggggttcccatatattcccacacacatactgctgtaaatcagaataatgaatacaaaatgcaaaaggatctcagaggttaaaatctatgccgtgagctgcagcagctcaaaggtgcagggagcttgtgcatcttatacctactggctgctctgtactagctctcctcatctggttaccttgctgtgcgcttgataaataaagataagataaatttaagaaacagttttcccttaagaaactcatcactcaataagaagtgacagagatatgaataatgcagaagggagtggtaggtactatgcaaatatttatgcggtgggggaacagagaagacagaatagaagttcttagattctcagtgggcagtgagacaagagcgtacagaggatatgctagagaaaatgcagctccctcctgtctaggctgctctggacagaggtgagacctgtcatgcctctggggctctgtcacaccaggctagtcttgggagcctgagaaatcactagagctttcatagcccactctaaccaacttctggttgaaagaaatgaaggctgcgttaccaagcagacaggagcattctcaagttttcacacggaacaactactttgtaaatccaaatgcaaactccattagtacttggcaggtccaaaacagttgtcctctccccatcaagggagcaggaacagcccatgtgttttgcaggaatttctttctaagtttccccctctcatctatcacagctaaatgtcccagagcccagactaactcactttctccttagaccccaccctaaaaggtgcttaggaccagaggcactgatcccagctgatgagtgaaactgactagcggggcagcttgttaagagaggcagtcagggcagca

SEQ ID NO: 27599 - DNA, 978 bp, Bovine  19866881457662
gaatctgctcggccaggccgggtgtcctgcaaggtcttggtgacctcctgcagctcgcccagggacaatcctcccacaaggtcgcagccctgccatgggagaagccgctcctgctcctctatctcccgtctcagctgctgatcttttgcttccagaacagacatcctggcttggagggtctcaatttctttctgcagagaatggagagagcaggtttttataaattaaccccattcatggtcgactacactgctcagaactctctctttacaggagagttcgccacctgcgtgagggccgtgaagctccccttcaaggcgggcagatttttggaggtttgctgaactggaaaaatcatgccagctttgtatttctgattagctggcataaggaaaaagcttccctcccaagcattaaataactgtgggtggtgagccaagaattagacgtggaagaatccagcaaatatgtaagccacttacttcatttcaggtgacagagccagaacacagtgcaacaaacttcagggacttgagataccagcaaagcagctaacatgaccgagaaaggaaaagcaaacaagccatggctgatctgaccccaaacatgcaaatgtagcatgcgtagaaagattagaagtcatagtttcttaagtctaaggattgaaagagatgccacagatagggttatgcagtctaaggttcataaaaatattaaataaatttaatttccactaatacggcaaaccaaatcccaagaattgagtatcttccaatcttgaggtcaatgaacaaaataagcagcaggtaattgaatgcctgttgtgcacacagtgttatggcagataatcatctcagtgcccatagcatcctgaatctccaatgagactcttgtaattaacatacacccatgttttctgcattggctgccagctataagagcacagctctatacggcgtctccccatctcacccacat

SEQ ID NO: 27600 - DNA, 1312 bp, Bovine  19866881473260
tattaaagtccagccttaaatatgttcctttgggctgttttccaaatacaagcttggcaaatacattccagaaatgctatatggttttcctttttctattgtccacataaagaatatttacctcaaactcctgtccaataccacaaaggatatctttcacaatctatttgaaatagattttgtaagtattcaggttttcacataaatgctgagttctgcagtcattatgtaatgccaacaagcagagaggcacatggtgacactaatggtacatcgttactactccataagatacatgtattcatccaaatattcagactatatggttacaccctgagtaagtgggtatttcttttaaaggcatccagatgttgttggtggtaaggaaagcatctgaaatgtttagatgtctttaggtcagaacaagtcaattatttgtcttcaagtatctgcacactgagtcgggggaatatcccctggagaagaaaatggcaactcactccagtattcttgcctggagaatcccagggacagaggagcctggtgggctataatccacaggatcacaaaagactcagacatgacttagtgactaaaacaacgaaatgacaaatctgcatgcttatttcaaagaagacactaagaaatgagttctaaatagaaccattaatagaacaaaagatatggctgaaagaagaaatggcctggtaattcatgtatgttcattggcctgtggtttctagttcacatgaaaggcaagctttagaaagccatatttcctagcccatgatcacgtgagagaatttggtctgcttcctttgacacaccaatgttgcctaaggccaaactgtactggaaactttggaggaaaaaaatctatctgtaaaggagattgatagaatcagtgaatacctaaacaatctgtttaacacaagacttcagattctggtgatagccacataaactctaaggtccttttgcatgagaaaatgaagacagaacacttctgggggggttgcctttcaggggatgtgtcctgcgtgtgtgtgtgtgtgcatgtgtgcttcagttcagtcactcagttgtgtccgactctctgcgatcccatgaatcgcagcacgccaggcctccctgtccatcaccaactcccggacttcactcagactcacgtccatagagttggtgatgccatccagccatctcatcctctgtcatccccatctcctcctgcccccaatccctcccagcatcagagtcttccaatgagtcaactcttcgcatgaggggccaaagtacggagtttcagcctcag

SEQ ID NO: 27601 - DNA, 1172 bp, Bovine  19866881799914
cttgtacagctggcccagcaccatctgtttcacagatgaagatgctaagactcaggaaggatgggagtcttgtctgaagtcacatggatgggaggggtcagggctaggatttgaatccctttatattgtgatttcaccttttatgtagatttatattctttatgaacctgattcctaacatgaggtctttccaccctcccttaccaccggcttactacccttattgccagccacctccatactgcactcaagagtcgagattatggaacaaaagtccactaacaacatctcttgatgatgttgagtgtcctgaaaagagagactgttttcatttttgaaatttctaagtacacattctgtatttcaggccccaaatgactatctactgtctgcaattttcctacactcagttcatcatggaacttgacagaaggttctctaggtttatcagccatgtaatattcacatattttgtattaaaacccaaattatttttggaggataactaatagggacttaccatactaccacaaatgagaaaaaagttgaattatagcaatttagttggatacaaatgtggtaacttcaaaccacttttggatattttattttcaaagaactatggctagttctgcttcctgttcaaaaatgcttaaatgtcagtgttttcctttgtagtcctataagatcaggcattgaaagtatattgatatcccagtcagagtttttgcgggagaaaccccctgtttgcctttaagaatttactaacatgccatccaattgattatgaggaattaagctgcaaaagggtggctcagatggtaaagaatctgcctgcaatgcagaagacccaggttcaatctgtaggctgggaatatcccttggagaagggaatggcaacccactccagtattcttgcctgggaaatcccatggacagaggagcccggtggctacaggccatggggttgcagagttggacacgactgagcaactaacgcttggagccaaaggtaaaccactttttcagtgacagttaccatgtgagaaattttaaaagtatcagcctttaacttttcaagtcagcgtttctcaaactggtgaaccttggaaattttagggactaataaaaaaaagtctaattagtcacatgaggcctgtagtctcaaattt

SEQ ID NO: 27602 - DNA, 962 bp, Bovine  19866881835826
cacattcctgttggatcaaaccctggtgttgtcagtggaaataattccctcctgtcatatcatattatatttttaagggtcaattgccattttagactatgggtataaagctaccagttacaattgatttattccatttgtcaaagctcagcagatactctatgcaactaatttattttcatatactattcagatgtggggaagttcttgacattgtaaaaaggtggaagctgggttggggagcatgtgatgggagggttcattgagtggctgcatgtagatgctggaacagagggtcttctttctgaaagatccacagccctggactctgccctgcagatgagcaggacccctctgtggtggtgatagccaaggctcatgccagcctctggggtcagtgcggatgttgcatgctattggctcttcctcatcagatgtatgatttgcaaatactttctctcattcctggattgccttttcccatcagtctgccggtagtgtcctttgatgcccaagcatttttggttttgataaagtccaactttcatagttttgctttcattgcctcttttgatgtcctatccaagaaatggctacatctagtgccgtgaaaatgttgacctgtgtttcctttaaaattctgtgaattttgtagctctgactcttaatgtttctgtctctcatccgtgctgagttaatccgggtgtatggtgtgaggtaaggatgtgcattcctttgcctgtgggtgtccagttgtcccagcaccatttgctgaggagactctgctttccctcttgaaagtcttcctcttgagaggtcgttggacccgtacatgcgggtttatttctgggctctgtatctgggtctgtggatctacatgtctttctaccagaaccacactctgttgattattgtagctttggtagtaagttttgaaattgtatcaatatgagagcccgcca

SEQ ID NO: 27603 - DNA, 940 bp, Bovine  19866882104550
aatcccaatgtaaactatggactctgggggacggtgatatgtcagtgtaggctcattcattgtaaccaatgttcccttctggtggggaatgtcgatattttggggaagtctgagtgtatatgttgtggagggtataaggaactctgtacttcctgcttatattttctgtgaacctgaagatgccctaaaaaaataaacctatgaaaacaatttcaatgacaagaactctggatgtcttcccaccatactagagataaatgcatcttcattatcattaccatgggggacagggccctgggcccttggacacactgcttcccttacttagaatgctttcctcactcctcccatttccacctctaattcctactcagctcagcatgcatatgcctaagaaagcttcctctgattccctggacctggccattgaggtcttgaagtgaaaggcttattgttcattgtccatctcattaagtgaagttttgaacctgtgtctctccttatttaaactactctgtgctatccatggtgccacggagctgcctttaaaaacgggccaaggtatactgaaggtatagaccatcagcgtaggataacttcttattcacgactgtgtgcctagaatgcaatgcagagtcactcagtacatatttgaggaatgcctgagcaaagctgcttaatatttacagagtgactgcattcatttcctatttaaactgctcaaacttggaagatcggcatatttacttcatttgataaataaagaaagctgagactcaaacaagttagatgacacttttaaaaagcagtagtttggattagaatgtgtatattgtaaattcaagtccaatattccctccactattccacagtgctgatctccaacatttaaaatgtattagtcatttaaatatattatacatatttgttctaactgaag

SEQ ID NO: 27604 - DNA, 1410 bp, Bovine  19866880501510
caaagcaaattttcagcttgggtagaattttgtcatcttaatgaattctgaaaactatttcaagttaactctgttgctttggattagtaattcactaaatggtgccttagtggcttgcaagggtaaatatgatttcccaaagtgctgaattcactcctacactgtaactgagaggatcaaacgtaatggaaagtaatgatagtcctaactcaaagagacaacaacaaggtaaacccttgctcttcttcttcctccttgattaacatttcctacacagaattttgcccaaaacagcagtacaataaatcaaagcatgttaagggagaaaggattactgttttagcaacagattcctccttcttgacttaaatagaacaacccacccatgttagacatgaggctatttgtgttcaggtgttctatttggtgtggagaatctacttgacagctttgcttccaactttgtttttcaagaaaaattttaaagcaggtctcaccaggttataaccaccaactccctgctaaggcaagtggatttagggatggtttatcagcatggcgtacatgatgcagtgtatatacttagtttgtagaggtgagtgagcaagaggaagcttgctttgtttacattttaagctagtaattattgacaagcatgcagtttggttcatcttagatggagctgggctattctgcactggttaaaaatcagaacgggcttatgaaaataagtagcccggtgtaagttacttttaaaattagtattttttctcttttctgcttaaaaaaaaaaaacagatgcaggaaagaggaaatctgggcatgcatgaactctttcttgctgtcccgcagagaagcctgttgtggaagccagaacccagggcttttcgatggaaggtgccctcaacctgagaactacagagggtgaggcttgtacacctggtggagcatttcatgtctaatagcatgtggtgaactgccgtgaaaagtgaaattggctcagtcacagtccgactctttgtgaccccatggactatacagtccatggaattctccaggccagaatactggagtgggtagcctttcccttctccaagggatcttcccaacccaggaattgaacccaggtctcctgcattgcaggtggattctttaccagctgagccaccagggaagcctatgaattgcatggggaggggaaagacagacagacacgcaggcaggagacgccagctcagaaggctcactcactctatctgttttcaatgacacccctcagtgactgctgagccccatgatagtgaaaaacagggctcacccaggaggccagacaagaagacactggatgtgagtggttatatcagttctcaaggccccaggttgacaatatggccaggtgcaccccaaaat

SEQ ID NO: 27605 - DNA, 1716 bp, Bovine  19866880573123
gcagagaggagagtggcttcagtaccacgggatccagcccctgagatgccccttcccaccagtggcttgccctttccctggcccaaaccctgaaggataagggggtgtgtggagaggttgtgcttggagaagtgctccttcacaaagggggtgggcgatggtagaaagcacacaggggacttctaagatctgctggtgcagctcctgtggtctggagacggccagaggcagcaggagaccctggctcccgaagggccttgacggtgacccagaggcatgacccttcatctgcctccctggatcgatgaccacaggaccccagatccaaccagcgcttgccctcggaaagtgaacagcacccccgggaaacagaacaggggcgaccacaaatcactgtgactggtggaatgagggcttgaataaaaattaaatccaggcatttgaaaagtctgtggtctgagacatattttaagtctatggttttaaaccgcaaatcagacctcacacagtaagtgcagtctggctccctgtgcacagtggcattggttgtcaacggttgcaaagagcaccaatgtcagcttcatgttaatgacctgaagacccagtctggtccggccccgcccccccccccgccctgaggaatgctgtcagtccccaggcaggcactgtcatggtgctccccctaattctggcctctgagtctcctgacaggttagtggggcccttgaccctttactgctctgtgacacctggccgactttgctacctgacctcctgcactctggactcagagttcctgggtccacgaggcctggtttcatcaacctgctgtggctgaacgtctttgaacttggtctttggacaatttgacttagagctctgccagtccaacttcaggctcatcccttaacccagaccagcccattcaagattctccagaggacacagagaagacccctctgaagtaagacagcaccccatcccctcaaagagctatttgtagagacaaggatggacctagagtgtgtcacacagagtgaagttggtgagaaagagaaaaacaaatattgtatattaacacatatatatgaagtgacgtgaaagtcgctcagtcgtgcccaactcttcacgactccatggactataaccccccaggctcctctgtccatgggattctccaggccagaatactggagtgggtagccattcccttctccaggggatcttcccaacctggggatcaaacccacgtctcctgcactgcaggcagattctttaccatctgagccaccagggaagtccctgtaaatactcccaataattttttttaatagcactgtcaagagtagcaggtaaaagggccattagaccctgaagaagagaaggtcaaactgcaggcctgaggtggaatttccacatttcacatcaagctagatgaacatgtcaagatcactaagatgctagctcacatatttattcagaactggccacagaaataattttgcatctcaaagcagccgaaagagttgagatgaataatacatttttatctatcccaatattttaaagcccaagcagccccgtgctatttgctcaaacctgtcggtgttttacacagcactctagcatgagtgttcgagtagaaatctcatttgagatgtgaaattgtttatggtgcgacacaaattcaaaacaatctaccatctatcgacgccc

SEQ ID NO: 27606 - DNA, 1974 bp, Bovine  19866880737536
aaataaaggaataaaaaaaaaaaaattaaaaaaaaaaataaataactgtctcaaaaatcaaaaaaaaaaaaaaaaaagaaagcagggcagtcaagttccctagagttctgtgggaagagtgaacaaacagactcctgcttaaggaacatggggcagaatttgtgctggggcaggtgagaggtgaaaacctgaatgaggagaggtccctgctggcgggtgtggtccgaaaggctccgggagccatcgggaggctcagccaatctctgtgggaggggcctcagggcagaggacacttggccctctgagaacagtgggcccctcgagccgactagagaaatggatgcctcttggaaggaaccttggggtcaagtcaacaaatgggaccagaacccaggagaccagagctgccataagactaaaacactgatcctagaaaatcgagttaacttctctggaccacctcttactcctggatgagagaagcaaccataatatcagggcttgcttcgcaagtttgagagtgagagaagacttaggcagaaaacacttttgaaaagttaggccgatcattgttaacatccccatgcaactggaatcctcgtgacaataatttttgcgtgtcgggcccagacgagggatccagaggaggcacagtccggtggcatctgtgcgctcctggagggagacagaagaccgctctgcatcatggcaggaagggagtttcctatttccaggagaaacaataaaaaagagctatctcttccctaagagcttgtctctgaaagacatgattctcatcaacattgtcattcaggcataagtgtatgtggtaccaaacagtagcctcagttcccctgctgggggaggacgtttccctgcccacagtaaacataaacccagataatttcacagccagtcggcgtgagtcagcaagcactctgagctgcccctgtgtgcttcccacacatgctgccattaccaagctccaaaccaatgctgagagcactggcacccgctcccaccccgggggcttttcatcaggcagatctcgtattagcggatggggctcccagcccctggtcctacagcgcttgcctttcccacctggatgcaggcaggagatgtggatctgcaggtggtgacaggtggggaaggggctggaacagacggccactgtagctccaggaatgatcagcctttaaatgacagatgaggttcaggagccatcatgttctacagacgtcagggtgatcagtgctgtcactttgttagttcggcgttcatttgaggaggtggggaagatcttagtacatgtcatgggctggtgccagacagttagctggctctgtgatcagtgttccctagaaatgatcctgtttaatctgcaccagcgccttccactgcagcccattttatggatgagaaaattcagcctcggggaaggtaaacacctttgaataaagccacagaactaatacgtgatacttttcaagatcacattaaagcttgcagcaatccaggcgttttactaatcttgtcagccctctgacatcctgggaatgaaattctctgccccccatcctcattccatgcctgtgcttggcaggtaccagcactcaataaatatttttggattgattgatcacaagtggagtgaagatggaagtgtggcatctgctgcccagcatgaggaggaaattagctggaccagctcctccgagatcctggggcttacacggcgagaggacacagggatggggaagcaaccaagaactaaggaggggagtaatgggggaaggtgacagaagtgaatcagaatgagtaaagaaagtagacagaaaaagcataggaagtaacagaaatgaagtgcttggagttagaaaacagtttgatctcgcctatatacggaatctaaaaaagtccagggcataaaaacagagtgaagatggagggccccaggggtagaggcagggt

SEQ ID NO: 27607 - DNA, 724 bp, Bovine  19866880911888
tcctctctccatggggttctcctggcaagaacactggagtgggctgccatgccctcctccaagaatgcaattatactccaattaaaaataaattgaaaaaaaaaactgccagctgccaatctggagtgactgcctctttcttccctatgtccttgccttctgggtacagggaccagttggcaaaccaacaaaacatttattcaacagtttttgagcatccacttctggtgaggttctgttcccctcccaaactggccactggcttaactggaaagagaaaagtctggtggaaaagcaattcttacactataggattgtaagtctgtaataaggatcataatcgatgtgcaaacagatttcttcaagttcttttctggtctcctgcagtgcacacatgcacacaggattcagatttttacccatctcccttctaatttgtctaatatagttcacatcaatatgtccacaagaaaatatcatgacacaccaatgtgttcctttgcaaatataattaggtattcttctggcaaacaaataaactcctagctaatgcaaaacttgttttcaaaatgtttttttttctctctctctttttctgcctggagcaggcttacaaataaatattgagtgtgccaggaagttgctcaattattcatgtactgaactttttaagcgtatctgggaaagacaatctccttgaatttacctacttgcccaaaagcta

SEQ ID NO: 27608 - DNA, 870 bp, Bovine  19866880964969
agtgagaacgagcctttcattcctcccaggacttgtcctctgctctctggagagaggactcctgagagcccggtggaggtcccctcctcacccggggagtctgtcctgcatggggaggacagtggcagaaatccagggcccctggtgggtgaggccagagtgttgatcaccgaggagcacttcctggacacagtctctcatggcccctttcccttctctccccatctcataaccctgtaactttcccctcacgtcactaccctggtgtctgcggtaaatcatcagagctgtgtgttgttgaaaaccaaccgtgtatcttatttcaagcagagaaagtgtagcaaaaacctccccttcatcccttcctctgggcatccatcccttggtggttcggtatctacttctggggaaggaaaggactaaacagtgctgatttaggagacaagggacctgggctgtgctctccgctgttcctggaactcgccgtgtgacctccagcaagtcagttaacttctctggctctcttatctacacagtgaagtttggggctatgattctttctaatctcccctccagcttttctctttgataattcatggcttgcaaaaccacagaaggcttcatcatttttgactgatctcattaatacaaatgaagggaaagaatctggcatttttttaagaacagcagcccagaactcagcgcgtcaccattctctggggatgggtttggtgatccccggaagggaaaagctccttactgcttaatccctatctctccaacaagccagacataaaatcctttaatcaaatctaataaactcagctaagcttcagaatggggctaagaaataactaatgtgttttctgt

SEQ ID NO: 27609 - DNA, 1004 bp, Bovine  19866881385321
cctaaaagcaagctattctggggccactctgtgatccccaagccccatgtagcctctccaagcagctgttcattcacagaataaaagaacgaaaagtgatagcaatagagcaaaactccaattaggtggaacttgcccctgatggcttcaaattcttgatcaaacattcagcaagaaacacagctttaaaagctcccaactgcacccaataactcagaccatgaacaatgtgttgccaagtggaaagctttggagcacctgctttaatagaaataattataattcgcaaagtgattagagtcagaatctgctgcttgagcatctcccagggaataatgattgttattaatttgctttgacttaaaaatcggccttttcagcctaccactgacacggggaggctttgagtgggcactgctatttcacccatccaggacccatttcccctttttctgataaacaaagagtcagcccccctggatatcatgttcccctcattctctgtcccttgtgtggtggagctgtgtccagcttctgctccaggggtggacatgggacccaggcctggccaaatagtactattacagccattatagcaggtgtgaggtagtagctcagtaaggttttgacttatgttcctctaatgatgaatgaagggctttccagatgccacagtggtaaagaaagaatcctcctgcaaatgtgggagatgtaggttccatccctgggttgggaagatcccctggagaagagaatggcaacccactcctatattcctgcttggagaattccatggacagtggagcccggcaggttacagttcacgggatgacaaagagccagacatgactgagcgactacacgacaatgatgaaggatgcagagcatctcttcatctgccgtcttctgaatgcaggcttttaaagaaggcattgtgttgtcatctaaccattttgggaagcacttttaggactttagaaactcaacaaagcccctataatgtg

SEQ ID NO: 27610 - DNA, 1014 bp, Bovine  19866881458442
aatgctctgacttcccgtagtcttggatgtgaaaggcagattgggtaggctccttgctttcatcctctttacagaaataacagctccagagaaacattttccaagttcacagcttcttaaaggagttacatatgaaaaatcagaaaggcgtttcaactttcctaaacaagtatttaactgagttccagaaatgtgacacaaagttagaaaactccattttatttggactgaaatgtgtatcttatttatttagttttaaaacaacttaatatagtttaactattattgttatcactctgaataatcttcaacaacccaggaacagaacagtctaaggttccagtttaagaactccattctgtgtagaaacgtggttatgttagattcccttagagtttaaaattttagaatcaaatcattttagcctattaaacactttttaaaacttgcataacatctgacaaaagactgttttatgatacacgtcaacgaaactcaacaccactttctccaatagtaaaaaagtgttttttacattggtactttttaaatgacgtgaaagtaaagagaactggttgccggctttggagtcattttgcttggagaagagtattctgtgcttcaccacccgctgccacgccttacagagatagggcctatagtccacatccacgtcactcaggcaattacgggcgcaggaaggcccttcctccgggtttgaggctttctgcattatactttgtgttgttgcaaagagaaccaaccgatactcatttacaagcttctccaagagctgagaacacttcctcagagtagactcctgcaggttaacactttctcctccattgacgcggtctatccaataaaaagctgacaggctatccaaaatcaaaaggcagacagagggatgcctacagagcatcgtttccagcgagcacagggtgaggagtaactgggtgctgctactgcagtacaccaaaaacaaccgcccaaggcagtgtttgaccatctcct

SEQ ID NO: 27611 - DNA, 1016 bp, Bovine  19866881459180
ctagagaataaatgcagaccgagatgaaggaaaaaccctaggaaaactctataggacgtgccaacatttacgaaggagccaacaaaggaaatggaggagcagaggccagagaaaccaaagggagcctgccagaagtcaagaaggaagtcagttccaaggaaggcgtgatcaccaggtcagaggctgctgagctgtcctgaaagatgaggaaaaacgccatctgccttggtgagactgaggttgctagcaaatttgacaagagcgggttctgtgtggtgatgggaatacaggctgccatggaaatggggatgaaatagactccagacgtcacccagctcaagccttctccacagacacggtgccgcggagaaatcggggcctctcttcagggctcagactgtaacttggggtgactgtgaatgctcagccttcgccactctttaggatgtgtgaaatttataccccaagaggccaaaagccagatacgccattcatcacagcacaccactcagcacacaatagccatgcgtgttctatcaggagtcactgatctggggcccactggatgtatgggtttaagagagaccatacgcaaaataatgtgcaaatacattctctagtgaaagggaccatagcctttctcagattctcaataggcccatgtcttcctctcaaaaaaaaaaaaaaaagagagagagagattttaagaactttgttctacaccaaagaaattgtacagccggctcaccaggccacaagagcccttctctgagatcacttccctgtgaaagcatcatctatcatcacccagggcaccaagcggcagctgcaccacagtcagaaaactccaaatggtccagcagcccaataaatcacccgcccatcagatcgaacactcccttttaaaggctttgattccaaggaaatgtcacttccaggcatggagcttcagaggctgataaatgctagatgatccatcaaatcatgtgaggacagagattcagggggccttagcg

SEQ ID NO: 27612 - DNA, 866 bp, Bovine  19866881553858
aatgcaggagacttgacttgtatatgttggagaggacccagaagtcagaaaattacagaagaatacactaaggccccatgcagtaaattgccccaaatagccttcagggaattctgacccatatgaaatgttaaagacatgaattctgtgactattcacaaatatttcttagtcttttaaaaagagatcctttaagaaacttcaaaatacatgaatggaataaaaaattactaactcctctgcgtgtcagatgcactcaacacgccaatgactgcaagtgttgctcagagtgggtggtcactctccctgttgtcagggctcaacttaacccaagagcactcttgtgatcctgggttctcttttttcctctgtcactctcaacaaacccactagtcaatgcaattcatatcattaaatcaatgttcttctgggcaaccacttttaagttgctttcttcacctgatttcctcaaaaaaaaaaaaaaatcagatttctcttctttcattagatgatgctattataggtggcactaatggtaaagagtccacctgccagtacaggagacgcaagagatacgattttgatccctaggtcaggaaggatcccctagagtaggaaatggcaccccattccagtattcttgtctggaaaattcaatgggcccaggagcctggcaggctacagtctatggggcagacctgactgagcaactgagcacatgctcttatatcatctgtggactgattacagtcagatttgtatttctgactctcacctttcctctgagccctagacttgtattcctgactccttataccagagctccacctgagtgtctaatagagatattaaatgatcaaatcaaa

SEQ ID NO: 27613 - DNA, 1122 bp, Bovine  19866880356133
gacatttaagaaataatattaaaggatgtgtcaccctggatctagaaaacaggtcatcatcagtttcctccagtagcaaaatcctccaggaggggattttggaatcaaaggggaaacattccctggttagcttacctgtcttgccttccactaacccaccttcccagagcactttcatcctgtccgtattcaaatgctaccctggaaacctcactgtaattcctcaacctaagatacacaaacatctagaactaaccaattctgtagcagacggataatgctactactaaaagtctctgctggaattgtagaatattagccagaataagagctgggtaaaggcttacaaatttaacccttcctttgtgttcacttgcacatgatgattttattaaaatgacacagtgttttcatttgccatgaaatctcccatctcacagttctaataggattcacctcactttatctgataggtgagattttaggaactttcatgacccatagtccaaactagaaacgataattccaaactataatgacactttgtgtctgattctgcaactccatggactatatagcctgccaggctcctctgtccatggaattctccaggccagaattctggagtgggttgccattcccttctccagggaaccttcataacccagggatcgaaccagggtctcctacattccaggcagattccttactatctgagccaccagagaagcccccaaatatgctagttgctcagtcgtgtccgactctttgcaaccccgtggactttagcccaccagactcctctgtccatggaattatccagggaaggatactggagtgggtagccattcccttttccaggggatcttcccgacccagggattgaactcaggtctcttacactgcaggcaaattctttaccatctcagccatgacattattccttactgtggcttaaaaatcatctttcaaatataacactggagtgcagatatgaaaataataacagcattaataaatgatggctgtcatgctatttttttcctccaaataacctccattttgttttcactctcattgctgtggcatgtgagggttttgctcaggttccatgggaaggtg

SEQ ID NO: 27614 - DNA, 1775 bp, Bovine  19866880407031
cattcctcaaacaagtttgtgaagaccttgaaacggtgggtcctttgtagtttttccaggaagtcttagcgtctcaggagtctactgattttggttctgaggggaaacccggtaaatatttctgttttattattaaaagaatataaaattcacctttgttctgagaatctggacaaaagagttatttctttgaattctagccagtaaatttgtggtacttaacaggaatcttttcataggtatatttcaaactatcatttatcatgccccaaaatattatttccatgattcaggcgtggagaagatggttgaggacaatttttattttgctttttcttttcaggggactctacatagctgttatattttattacaaagacaatatgttagtcaccaatgaagatcaaataccgattgttgaaatagacgactctcacaccagttccattacacaagattttctgtggttcacaaaggtatcctgagttctaattttattcttccccactttgcaccaacagtacctcacataaatctctaaaactttagttgagaagttgaggagtctccagtgagcaaaatattggagtgggagtaaatcatctcaatggtctctttctggcccaatatgccctttgtcattaaaatgctaaaatagtgtctacactacattttcaaagcaaagaagcctccatcctgtcagattgtgtctccactattctgagttatgggatcatttggcaaagactaaaatggggatctgattgtttcattaacattcagatctttttccaattggacagagatcaaaaagttgttttgcatgtatctgaaaatggactggagaacaaacatcgggtgtcgggtttccttccccctgctttgctttgatgccacaacctaaatcatgcactggcttggatgatgatgtgacctcgtgagttcttttgcagctgtcctgtatgtgggaagatataaggtggttgcggcaaagtgtacctatctccatgtcctcatccacagtattacaaactcggcagaagatgcttgcagcaacagcccagctacaggtgaggggctaggtttcaacacagacctccaaggaaattttggaaacacatgtcagttaagttaccggtcccacctggaaagggaaagggtgggctccttgctggtttagatccttagacgtatgaagtcttctcggatactctgagcggtacagctgtctttgtagtgaacctgtgcttttgacactctcctgggggaggaacagaggtttatcttgaagaatctagaagtaaacaaggagtaaagagacctgaattctggatctgatgttaatcggtcaactcatttctgctttctggatctgagtttcatcatttgcacgataagagtttgcctagctctcttgatgagttctggatgttttggtatcctgtggatctgtatgagtgtacagagatggaaaaagagaccctcagatattttaaagagcttcttcgcttggtgttatgggaaaacaaatctatctgcatacatttttaataattaaaaaacaaaccaaaaaaaaaaaaaaccaaaaaactcttaaagacttatctttcattctgaatttaacccttctgtactattaacccaatcagatcatatctccaagccctgcaagaatctttgtcggttacagagctcctcttagaaatgacattgaattctagccaggcatttctgggtttccctttcattgttctgttttgtttcaatattatctg

SEQ ID NO: 27615 - DNA, 1259 bp, Bovine  19866880418648
ctcccaggactcgggctctgctgaggttcagttgttcatgccacagacataattcatttcaaagagcaacaacggcaccttaactctggtgctggacacccgaaaggaaagaaggcgaccctctcctttctccttcactgttaatcccgtccctgtggttactgtggctcctttctctgggtgcagcaagaaggaaagaaaaagggtcacaggttgtttggaaacggttcttccaacctagtttgtgatctcatttgcacattttcattaatgtcaaactgtctccatggctgtctcaagatgatgggtctcccaaggattttgccagagtggtgtctgcttcacaggaattcagagagcagagcttcttttcaaatgttatgagaggagctgccttcccacctactgccctgaaaacttgcaggaaaatgtttgctgaagttctgaggtgaagagatgaacttgtgaatttttacctggctcgtcacacagtcactccctcccattcccttcatccccctaccccaccctcaaaaaacagagcagggaaataatggagtcaatttttctttaaagccctctaacgagccttgacgactcacacttaattgtcttgaaaataaaataggtgtttgggtttctgcggagggactggaaccactaaagcctcagcagaggtcctaaatggagccagcccgtcggctctgggctccagatgaggaataggatgctccagagagaagaggagacgctctgggccctgggaggtctgtgtcagggagggcggcctcagccgtcctcaactctctctgagaaggttctcagagcaagcatgtctttgcacttgcccagcatttaggaaagataccagggtactttcgagctcttccctacagaattccactggcgctgttctggacatctctctaccttgaaatgcctatcagaccctttcagttaatgattcactacctaggattttgatcctttggggacccatgcaggaagagacgtgcttctcagaggtattcccaatatgtcagaaacacccactagagttacagaaccaactgggttcagaccacagaggagaactgacgcctatttaattcaatttctatcaactcaggatgtttctgttggttctgtggcaacggcagttctttttattaataacaaaatgaggaaatgatttctcaataagtgtatctggtgtatatccatcaaactatggacttggagaggaaaggaaaaataat

SEQ ID NO: 27616 - DNA, 1826 bp, Bovine  19866880429771
agattgggctttggtgcattttagtccgttctgtttttcagcccagtggtgggtggttttgatgagggtatcactttattttgaaaacaatctgatttctctgtagatgccggagatggaagattaaagtgtcatgaaacagtacctatcacatacctacaggcatgcatacaaacactcccatctgcacacaaaaagctcctcaaactggctgctccctcacctcaccaccacacaggagcgctgaatcatttaactaaccctggaacaaagatcctcctggaataggagtcagccctgccctgcagcccagtgctgacttaaaaactcttttcaacatgaagaaccttaatgccatttccagctttacttgtgcctgatagtcactttggggcaagtcgttgcctctcaatgcactgattttaatctttcgctgacttttccttaaatgcaaaaatgttttatgattgcgctctctttttaagcagatttacatacaaatgacataaagtgaaaagctctctccccttctcacctcacccaattaccccactcttcagaggtaatcattacaattaatgagttatattttagagattttccccttcacataatcccttcatagagaataaaaacaaggattctagggctgaaccagtctagactttgatcagaataaagttttgtttttgttttcaatagaatctgtcttaaaatattgagggcctatgatcaccatagggcttccctggtggctcagctgtaaagaatctacctgcaatgcagcagctacaggagacctgggttcaatctctgggtcaggaagatcccctggagaagggcatggcaacccactccagtattcttgcctggagaatcccaaggacagaggagcctagtgggctacagtccatggggttgcaaagagtcagacacgactgaaaagacttagcaaaaaatgatcgccatattctttcaagtatttctaaactcaagtataagttcaaattggatttttaaactgcttgagacccttgatggcccatgataagcccccagtcttccagccattagtcctcaaaccccagcacttgccctggtcagcttgttacagaatttggaccatgttccctcctcacactgccccaagtgtcatccagcccatgccccctcctcactcagcctgaggagtggccctttggtcactggacattagatttcctaaaaggtttttttggatcctccacccgcactacaacatttctgtgcttcatcatggcacttgacatcctgacttgtaatctcgcatttatttttctttattttcccaacggtctttgaaagtatccgcaatcagggtacctgcctggtgactacatggagaaataagacctggatgatagcaggtagtcatagcaaatcattccaagtctgcatggatgcttggctggtgaggagacagaggtaagggctaggaaaaaattcagagatgtgagacttctgcgtttaggcagaaacagtggctggaacctgtgaatcaccctactcacatagcagtggttttcactgtatttttcactccattgagttcctgtctccttgttatcttgagtctttgaggggataagggaggctagaccatattatctcaataaacatctatcgaggcagcaggatgagaggatgtggggggagatgtgagcttaaactgagatgggtgcttgtgtgtctgatgggggagggctgtgtgtaaattcctcatggtaggtggctaagagggactgtctccaggaacccttacagcctggggagcaaaggagggccgg

SEQ ID NO: 27617 - DNA, 1404 bp, Bovine  19866880445160
ggtgtcagttattgtgttagtcattcctcaaactggaagctgaaagatgttccctgtagtgtggggaattattgaagaagtggaaattacatatttcatatattattagcctacctttatacagagcctgtatacatttatatcagcagctcagattaagtggaaaatcccatctaaacataaagaatttgaaatcagacagcatttatttagcatctgctgctgctgctactgctgctactaagtcacttcagtcgtgtccgactctgtgcgaccccatagacggcagcccatcaggctccaccatccctgggattctccaggcaagaacactggagagggttgccatttccttctccaatgcacgaaagtgaaaagtgaaagtgaagtcactcagtcatgtttgactcttagggacctcataggctgcagcctaccaggctcctctgtccatgggattttctaggcaagagtactggagtcgggtgccatcgccttctcctatttagcatctactgtgtccaaatccatatcaacataacagtatagggtgggagagacagagctagatggccttccccaggggcacttggcagaatcttggcagatacagctgacagttagaaaaaaggatcatgttcattgttgagcaccaaaccttaagaaaatgagaaaagtcattctgcgtcctcttaaccctagtgatgccacctcgggagaagctgcttgctcacactgccttgagccctttaacgctggtctcatttagtcctcacaccacacctctgagtacagtactagtaccctgcccatttcacaatgacagaaacaggctaggaagacttcctagaacctcctggcattcgtgatagcccttcaaggggcaaatgagcacctctaattccagttgccctttgccaccagtaacgtcttaatttttagaggctcggagaatcctcttatagctaaggaaataaaaccacctccacctcaagattccaggagttaagatctgtccgccatgtgtccccatctcctgtcctctcctggctttacagctttttttattggataattccttcttcacatttgaggcatcctaactgttcatttctaagcctgctttgctaagagactaccaagatgagagtctgagctatggaacgcactgcaatgggattttgtacttacctggctcccagactcatctaacagaggccaatcggcggctcccatctcttacaatagtttccagaagacaaaacatgagagctctgttccatttttttcctgggattctttatcttgcatgagcatcagtaatcaaagtggcatttactagcttagcaaatgaataaacctttgctttcccacaagttcagttgtaggcgtcaggctctctga

SEQ ID NO: 27618 - DNA, 3542 bp, Bovine  19866880517870
aatggactggttggatcttctgcagtccaagggactctcaagagtcttctccaacaccacagttcaaaagcatcaattcttcagtgctcagctttgtttatagtccaactctcacatccatacatgactactggaaaaaccatagctttgactagacggacctttattggcaaataatgtctctgctttttaatatgctgtctaggttggttatagcttttccttcaaggagcaagtgtcttttaatttcatgattgcagtcactatctgcagtgatttcgaggcccaataaaataaagtctgtcactgtttccattgtttccccatctatttgccatgaagtgatcggactggatgccatgatctttgtcttttgaatgttgagttttaagacaggtttttcactctcctctttcaccttcatcaagaggctctttggttcttcattttctgccataagagtggtgtcatctgtgtatctgaggttattggcatttctggaagttctcggttcatgtactattgcagcctagcttggaggactttgagcatgactgctagcgtgtgaaatgagtacaattgtgtggtagtttgagcattctttggcattgcctttctttggtaccggaatgaaaactgaccttttccagtcctgtggccactgctgagttttccaaatctgctgccatattgagtgcagcactttcacagcatcatctttcaggatttgaaatagctcaactggaattccatcacctccactagctttgttcgtagtgatgcttcctaaggcccacttgacttcaccttccaggatgtctggctctaaaggagtgatcacaccatcgtggttatctgggtcatgaagatctttttgggataggtcttctgtgtattcttgccacctcttcctaatatcttctgcttctgttaggtccataccatttctgtcccaaattctgccctttattctgccctttatgcaaacatatctttgcatgaaatgttcccttggtatctgtaattttcttgaagagatctatagtttttcccattctattgttttcctctatttctttgcactgttcacttaggaaggctttcttatctctccttgctattctctggaactctgcattcaaatgggtatctctttccttttctcctttgcctttcactttgcttattttctcagctctttgtaaggcctcctcaacaaccattttgcccttttgcgtttctttgtcttggggatggttttgatctccgcctcctatccatattaggaacctctgtccatagtttttcaggcactctgtctatcagttgtaatcctttgaatctatttgtcacttccactgcataattgtaagggatttgatttaggtcatacctgaacgatctagtggttttccctttcttcaatttcagtctgaattttgcaagaaggaattcatgttctgagtcacagtcagctcccagctttgtttttgctgactgtatagagcttctccatctttggatgcaaagaatataatcaatctgatttcggtattgaccatctgtgatgtccatgtgtacagtcttctcttgtgttgtcagaagagggtgtttgctatgaccagtgtgctctcttggcaaaactctgttagcctttgccctgcttcattttgtactccaaggccaaacttgcctgttactccaggtatctcttgacttcctacttttgcattcctgtcccctatgatgaaaaggacatctctttttgatgttagttctagaaggtcttgtaggtcttcatcgaagcattcaacttcaacttcttcagcgttactggttgggacatacacttggattactgtgatatggaattatttgccttggaaacaaacagagatcattgtgtcatttttgagactgcacccaagtactgcattttggactcttgttgactatgaatgctactccatttcttctaaggattcttgcccacagtagtagatataatggtcacctgaatcaccctcatgacctcatctaaacctagtcacttgccaaagtcctgtcttcttcaaacaccaacacattgagggtttgggttgcttttaaaggagactcaaggcccagaaaatgccatgaaatggataacctcaggcagaggaacttgcaagtgctttcaggtgatacatttctagaagtggaaatgctagctaaagagatgttttacattctgaaagctgtaaccaaagctccctttgagagtttggcaccaatttgtacggccatcagcagtgcagaaggatacaatggtagatacttcacattagaattatctgcaacatttcttaaaatagccagctttcttggtacttatgacttccagttagattcacgtgccattttcgagcagtcaccttactgactagatccagacacgctgcctggagcgtacgtgctggcttctgggccagccctttccctctctgctggggaactccatggggacatggttgctctagcttttcctacaaggcctgaggtgggtctggtctggaaatggggagccaggcactctgaaaggctttcccacgggtctgtatttcacgctggctctccaacccctccaaagatcagtgcggggtcatgccggtcctcaggggcatcaggaggtgacagtcgtaggggacaacttcttgaacacagaggagcttgtggaatctcgatctttgtattttggaaacaaataactcagccaccttggcaaagaggcagggtgcttggacgttaagaccctttgagattcttgaactcctcctcctccctgcagttctggatgtcaatctccatccatctacctttcaaatctgtagttggcaaacccagcctatgactcacgtgtggcctgcaacctcctgttgtaataaggtttgttggaacagaagcagtgctcatgttcagattgtctgtggctgcttttgcaagtgttgcagtcgttagatcgcatggctcacaatagcttaaatatttatatctggccttttacggacagagtgtgctgtcttctgctctaaatgtcttttgcgtttgtcctccttccttaacagttcagcccatcctgcctgggccactgcagtagtcagcaagctggtcaccatcggcgtgagccttctgagtgcagatggaagggtggcaggcctgcagatgtctccatttctactggtgcctgctgttggaagtggtttgctccctaagatcctctgagtctgcaggctgtgtgcagtcacctcgctgcatcatgtacgtgtatgttccatgaatactctacagtccgttaattcacctggaacatggagctaatggcatctccctagtgtttcggttgctgtcagctactgagctttctagacatgctgcttgctgtctcacccttggccctggacacgtgctggttcccttgccccaaggaccttccgggtgtccctggtaaactgccactttttcacatgccttttcaattctctcattagcaaaaacgccttcct

SEQ ID NO: 27619 - DNA, 1656 bp, Bovine  19866880533460
aaaatggcacacacatttgtcagggcccagtatttgactgcaagtctctcatctttggaacagtgatacttctaagctgttccttcagaatcatctcttcttggacttaagtcccatttcaacgctttccagcttcaaaaaattcattttatcaagatatggagtggagtaggttaacccaagtctgttcaaggtacaatcaaaggttaaaaggaaccagtaattttttaagcaaagtatgcatctttaagcctctaagagcagagtcatctttcaaacttggaccttaaggtggctatgttccaatgacacatcaaataatcaagtccccatacttctttggagactgccttcagagtctgctgtatatcccttttaaaccctacaatatcttcttttgacaacataattaattttgtaaaagaatagccacaggtcagtctggtagggaacaagatgatcagtcaagctgggtaatgtaatggctctttgggttagaagagaagaaatagctgagactttggggggatgtattgagatgtgcgagtgttttcttattatcttttagatctctgtcatctctagtgatgtcccattctgcattcacagtactcatgggcgcctttgctcagtttgtcttgaccaatatttttgtcagtttgtcttatcttgaagtcttttcaaaaatctaacttggaagtacgacccacaaaaggaaaagaaaatgcagccaatccccttgtatcattcattgactgagagggaaatttccagcagaagttgcaataaaaggttttgagcaagtgtagtagatctgttctgctaacactgagactccctgcaaaagtatgtccttctttcaatcaacaagactagcacgcaggtgagaattaatgagaagatccccgccttcaaggaggccatgagcaaagaactacctcccatgttgactacttttacagaaacaccactgatttgtctctaactcatacctttcattttctccatttgctaccgggacgttacagtctcactaaacagcagtgtgctctcccccatttcccagattcccttgcagttagattgtaaccacatgactagttctgaccaatgggacatgggaggaagaatgccatttccaaactcagtgatgtaagctcccagtgtggccctccagctttctccttccaggctgcagtggtcatacaatggcatgatacatcccccagataggaacatctgggaccctgaatcaccacccagaagagaagtacccgagagagtccctaaactcacactggaaagttcagggggtgagagtgagaaatcttggtaggatgaagccaccgagtatggggctttctttgttaccacaactgaggtttcttgtctaaaattctgaaataacaacagaggatggcaacatggtgtagtgggaagatcaggggcttcagagtagtcccaacctgggagaagttagtgacaggcttagaggctgctcatcagagtcatttgcagtctacaaatctccaataagaccaataattttcctctgacagagcagacttactgctcctggagacaggaaatgagaactgatggcctgccttggactctccccatggccaacttgaccacagaccacccgagtttttg

SEQ ID NO: 27620 - DNA, 805 bp, Bovine  19866880570194
cctgaggaggccgagcgactaggacctgcccccgaggggccacggggcctgcctctggcccatgctgccagcctcccggaggagcggaaaagcagcctccaggaccctaggcctgcggtgcaccgcatctacgtggaggcctaccctgcagccctggtggacaccaaaccctgggccgccttgagtcctgccatcgtaggccactcgggcctgcccagcgccgcgggcccagagttgagcccagaggaccctaccacctcccctgtgtcagagatactcagcagcatgctttagggaggtctacagttggctgtcctcttttcactgcgagtccctgcattttccatccccgtactccagtccgcctccacccatgttttcacccaatttaaactgctttccaggttaaaaatccaaaggttagaggttcaaggtcctctttttttagagttggagtggaggcaagagtggccagtcttatacccagttcagcctataaaggacgtaaaagagttttggtgtcaacatggagtcctggacacaagagtgcaagcataccatcctgatggcgcacctgtggcggaggtttgttgttcagtttctgaggcgtgtccagctttttgtgatgccatggactgcagcaggccatgctcctctgacctctaccttctcctggagtttgttcaaagtcatgtccattgagttggcaatcctatctaaccatctcatcctctgctgccgtcttctccttttgccttcaatctttgccagcaccaggggtcttttccagtgagtccacttttcg

SEQ ID NO: 27621 - DNA, 1988 bp, Bovine  19866880573333
tttaccagatgggtcttgtctctgctggggtcacacatacacttcttggtaggtctgcttaggtgactcctctgatcttggttaagcattcgtatgtttggagatgggtgtgctttaggctggtatcggaaggctgggctggaagactggactttaaaaacaatcccacagcaggttaacttaatcatcttgtgagactatcactgtttcatggtgatagcaaagaggaactagaaacattcaagtggtttttctttttttttccaccattcttctttcccattggccaaagcaaaccatatggccaagaccagaatcagagtagaaggagaccatgaagttacagggcaaaagatggacatggggaggccattaactgaccattaatgaaggcagtctaacaatatgctagattctctcttctaacaaacagctgctgaaatctggaaaaacagtaaggcagtcacttggtagaggtcactttgtagtcatgaaagaatgcagttattggcagaaacgcagtgctgaagcagggaggagcagcaaagaagtatcctacccactctctctctgtctgacctccagtgtcctactggtgcctctcaatggccaaatccagcctgaagacagccagtgaaagagtctggaaggcacaagccatagaagtcaggctccctgggcagagggtgaatctgggtgtgtgtgtcaagtaggtcattcttactttaattgtaccactgaaaaagaatggaaaaatttgattcatgattccaaggtcaagaacttttgagatgggctcgtttctaaacttggccatgctcaacaccctccctctctgttacttcctccctccctacattggttaggttctctgagatgtagatgctaaggggatggtgagggagaaaggggagggggccaaagcaggttgggagagccattagaccatgatccaagtctgacatctgtgaaggaaagaggaataaaacttggatatgtagaatcttacatggcattgtagttctaaaagagtttcagccaggtcagtggggagttcttgagccaaagtccacatcaaagggatcccacattccacaggaactgtggccttagttccctgaccatgcttactctttggctgaaagcagtgatggggtgcatggtcttggtgtccactcagaactcagcagctgcatctatcagctgctgattatgctcttggtagcaggagatctgagaggcacattttatggcttttgcccctttcccttctacccttcctttcttcctccctttctcctttccttccttctctttctcccttccttctctcttttttttctgttttttttttttttttttaagtgttgtttaagttccagccttagtgccaggtattggtgatatacaatgaatatggcaaatatgatatctgctcttatggaacttcattgttcattcttctgtaggactttggggtagagttctgttgaaataactgaaaacattcttgatttcaaggaggaagagagacttacctagctccatgccttccctccctactttattatcccacagagcctggtcagttgcctcatacatcattaagatgaccatatttactaagttcaaaaccagcccattcttattcatgacttttttttttttttggcagaaaaagtcgtaaacaagtatgaaagttaaattgtagttttttttatagttttaatgaatcccctttcaagaattagggcaaattcgtgaaattggactgatcccaggaaacccaagttatatgtcaaacatagcaagtaggctgacttaatcagacttgtttgggtgaaaaaaaacaaattcattcaaattattcaaaagttcgtcttaaggttacatgtgtgtgggaacttgggggaaagttattcagttggccttgggaagatcaagaactccagcagaatctgggccacacagagactgaaagtggaatt

SEQ ID NO: 27622 - DNA, 784 bp, Bovine  19866880661714
ggtgaggtcagagacaaaggggagggaaggtgggacgcccgggcagtgtgtgcgggcgcccgggcccagccaggttgtccctggggaggccgagctccctccgcagctaggaagagtgggtcctccgagcctcctccgcggcgggcccggtggcgctgcagtccgtgggcgcgtgggctgtctgctgttgccctgggggctggttagccggtttgctcaggagctgctggccgggttctcattgccaggtgagctggaggacgaggaggaggaggaggaggagaagctcaccacagccaggcccggggggtcagtggccgtgttctgtcctgtgaggctttttcggcagacggggcagctgtcgtgctgctccagccagggcacgatgcagccattgtggaagaagtggttgcagggcagctgccgcacatgctcacccagcccatagtcatccttgcacacggggcactccagccccgagccaacgtgctcctcagtcacgggcacggtggggagggcctggattttctctttgtctgcgggtgggggacccgagttttcaaactgattaaggagctgcgtgatgatggcgtccaggctgttggccccccaggtgtagtccatcgggtttgaatgcaggacgccccagggacccaggcccaggttggggatggtggccggggtgatgatgccgttgaccagctgctggatgatcccttccagcgtggggtcgccttcgtgccggccggtggcccgccgcgcggtgaggcgggcgcagggctgc

SEQ ID NO: 27623 - DNA, 2477 bp, Bovine  19866880751050
cctccgtcgcccctttctcctcctgccttcaattttcccagcatcagggtcttttccaatgagtcagctcttcacatcatgtggccagagtattggagcttcagcttcagcataagtcctttcagtgaatattcagggttgatctcctttaggatagactggtttgatctccttgcagtccaagggactctcaaggcacaacaatccaaaagcctcaattcttcagcactcagccttctttttagtccaactttcacatccgtacatggctactggaaaaaccatagctttgtaagtaagcctttaattatttaatgaataattagaataagtgcaaaagttgtctaataattgaatggagcagagttcaaaaccacctctataatagcttccttcttctgctgttggtcatcttgtcacttaacttgttccctcttagagaaaagattgaagactgatacttcagggaaccttactactatgtgccaagtattttgatttgatttctcaggcaaagctacacaacagttatcctaactatttgataagtggtacatgtatactgaaagaggttacataacttgcccacagtaagacagttagtaagtcgaggaatgggaatcgaaacacaagcctggctgactacagaaccaagaaagtgtaactacatcttgctgcttcttgggtgattatcaaagtacatcagcagcatcctttagcatcagcttctaaaatggagctgtgatttactaggtttcgttaggatttgaatttgactgtgataactccattggctacatagaggaatttttcacaatgagatcttagctgcaacgcataatactcagaggcagtttttttaaaagacactagccctattcgatttactccttgtgagatttctaaagaaggttgcctgagaaattagaatcactcgtatgtggaatataaaaaaaacaaatgaacaaaacccaaaataaatgaacaaaccaaaccaaatcagaacaaacatgtagatacagatagcagggtagtggtttccagaggggaaggggcagggggagtgtaaaatgagtaaaggaaaccgactctatgatgatagataaaaactaaaattttggtgctgggaggctgtagtgtatacagaggtagaaatataatgttgtacacatgaaacttatataatgttataaaccaatgttatctcagttaaaaaataatttttaaaaaaggaattagaaccacatacttattgattggttattgattttccttccagcatgtgagaaatggcaagaagggacccgtatcagttctgctcactgttgtaaacctggaacccagaactatatggtgtggaccaaacatgtaagttgctcagtcatgtctgactctttgtgactccatggactactgcccaccaggctcctctgtccatgggattctccagggaagaatattagactgaactatatggtggtactccatatttaacgaatgaaagtgagggtaatgaactccccatcgggtagacttctgcatctctggattaggattccaggcaggctgggatgatatgtgtgaaactgggactttggggaatccaaagcatggtcctgtgaaacagctggagaaaatgaattcagactatggagaattattctctcccactcagttatatttcacattcctcccacacaataggccccaaatcagatggcaaggagcatttactcaaacttcaggccctttttagttgcaggcaagcatcctctaacttcccaaacactccatatggtggctcctatcagcagcagactgtgaaagagactttatctaccctaaggcctgagtcttcagaggtttgggacccggagtcaacatcatttagctctcagaggtggagagaagcagaaagaacccaggctttctttggagcatggcctcttgagactgaaagaaacttaaatgtccttctcatttgtcacctgaaaaacatggacccaaagtcatccatttcattagtagggagagtccagactcaaactcgggtcttcggacagcctctaatctaaaattattttacccaccctcatccccactcagatagctgtgtagttagagagccagcacaacacagagagggagcagacagcagagtcactaacctcatgaactgtctggtcaccagaatccttagctaagtaaaggacaaagagaaggacagatatgccctctgaaccctgagggacctgtgtgtgagtgctgtctgagccaggcgaaatagagctctggaataacataaatagcaggatgttgaagaagcaatacaggcatggagtcaaaaacatgggtttgaattctgagccagctccctgctagttctacaacttctgccaagttcctgaaactctctgagtctcagttttgccatctgtaaaatgtagacccacctcacagggttatgtcatcaatta

SEQ ID NO: 27624 - DNA, 1751 bp, Bovine  19866880768234
acccatggacgacagcctgccaggctcctccgtccatggaattctccaagccacaatactggagtgggtagccatttccttctccaggggatcttcctggcccagggattgaacccaggtctcccggtactgtgggcaaatgctttactggctgagtcaccaggttctccaggtgggctgcccatccagagagctggcactctaaaacttaagctctttctgctcgtcatgtgcacctgactcagatgctgggctgaccttcccaacctggagaaggtcgtccctctggagacatttggaggaggaggagcagcagtggctggtctccgagacccagcctgtgcctggcagggaggagagtgcttatcttggaaacaccctgggcccctcagcaacacccccccacccacctcagacagctgtcaggcctctggagactctagaagggtctccttgacattgtgggtgaagaggtctaactactgactaactgcttcattcaggaacacagaaaaaagataattatgactagtattttaaaaagtgatttgtgtgatatatatacaatggaatattactcagccataaaaaggaatgaatttgagtcagttctattaaggtggatgatcctagaatctattatacagagtgaagtgagtcagaaagagaaagataaatattgtattctaacacatgtagatggaatctagaaaatggtactgaagaatttatttgcagggcagcaatggagaaacagacatagagaacggacttacagacatgcggagaggggaggaaagggcgagatgtatggaaagagtaacatggaaacttatattgccgtatgtaaatagatagccagcggaatttgctgtatggcccaggaaactcaaacaggggctctgtatcaacctagaggggtgggatagggagggagatggggggacaggttcaaaagggagggggtatatgtatacctatggctgattcatgctgaggtttgacgggaaacaacaaaattctgtaaagcaattatccttcaataaaaaataaattaattttgaaaagtgatttgaatactgggaggacggcaatctggcatgtcatgggtttcactaggttctagttccaggtccagtgttaatcaggtttgttactttgggcaagtctctgcacctctctggaccttggtctccccatctctaacgcgggaggcctggagcaatggcagtcacttggcctctctaatgtccccaccgcgctggtcttctgcgcctctgacctcagttgctcctggtataggcttctgttcctcactgttgaatcttctgtcaagtctgcttctcataagacagcagcatttacagaaaagcatccctatctggtgttcacaggcttttccaatgagatgccagtaatctctggggttatctctccccgttttccttctctgtctgggtggggacaggctgagtgctctttggagaagcacatattaataacagagacttgtgtttgctcagggttttagagcttatgaaggcattaatattatcagtcacacagctgggatggggtaaaaagcttagcgtcaacatcaaagtccctgcttttaacaacccacattacctatgtcttcaaaagatctccttaagttgaagttggaattaaccaatgttcattaaacaaacccccacattctgtttggatctgatttaaaaagaaaaagccagaaccccttctcatatcca

SEQ ID NO: 27625 - DNA, 2922 bp, Bovine  19866880838702
ccagacctgctatgatcatgggacatcaagtccatttcctaagggctctgagattggatcatgtcatcagctaaacagatggcagtggtatctctctcgtacagttgtggggagtgaatgagatgacccaaagagcatccagcacagtgcctagcatatacattctcgctatgattttattattcagaagttttcttaattcaagtcattttggcctcagaaatcattccatgcaaatataaactctggatgtgcctacctagaaaagcgggagtttaagtcatgatgtaacataacagttctgttgaaaagaagggactgggctcaaaactggagaagaactgaatgtcttatgagaacaagtccaccttccttcccagaaggcaggcttgaggcagagatgttgaggaaagtgcccttggtggggaagtcaagcacatctccacgtgacattcaaactcaggtaccagcctcatctgctgtcaccaaaggacagcgaggcaggtggcgagccaggaaggaaaaccccttcctgccttgttctctctcactgctcaagccatcacttcagttcagttcagttcagttcagttcagtcactcattcgtgtctgactctttgcaggcccatggactgcagcacaccaggcttccctgtccatcaccaactcccagagcttgcctgagtgccatcacgattaccaaggcaactacatagatagtctagaaatctaccacaaggactctgattcagcaggcgctactgtagattctgatttagtgtgctttggataaaacccacagatctgtattatgtatacaaacatataatatttaatttataatatttatagtacatattttacaattgaacttttattatcattcacaattcaaaatggacaagcgtaaagataataaacatcctctctcctgccccagctcccttccctggaaataaccaatgttatctttgtattcttccagaactgttttattcatatacaaagatacatttattttctcatattttacataaatgtggatcagcatcttacggttttcagagtacaagtcttttgcctccttagataggtttgttcctaggtatttcattctttttgatgcaatggtaaatgggattgtttctttaatttctcttgctgatgttttgatgttagtgtatacgaatgcaagagatttctgtgtattaattttgtatcctgcaactttaccaaattcattgatgagctctagtagtattctggtggcctcttcaagattttctgtgtatagtattatgtcatctgcaaacaatgacagttttacttcttttttctgatttgaattcctttcatttctttctcttctctgattgccatggctagggcttccaaaactatgtaaaatattagtggtgaaggtggacattctaccttgttcctgatcttagaagaaatgctttcaggtttttcctattgagagtgatatttgctctatgttgagtctgcacacccgcttagaactatagaatatactggaaggagcactgtgcctttgggtacagagagagtgggaataagtcctatttttttcaggcttcctgtttttaagtcacagcacagctccaaatgcctggaatgtaggctttagttctctctgccaacacagtccaccaagcacagacttttgtcccagaaaacgacagtcactactccctgtaagctcaggctgtgtggaaggggagagtccttgggagaaacacacttgtaaaaagaaaagtgcattttacatcctttcctccataccctcaaagaagtccaaattaattgtatgaatttaaaagtggctaatttttaatggaaatttaatctctctgtttccccagtgaaaaagtagcctgtttacaaagcaagaaggtcagtgtggtaagtgtaatccaatcatgctttgtaaatggtcatcttttccctggactattgtatataacacagcttttacacaagcttgttaaattttagatattcaagacaattgactctaaaacctttgattgccttggttatagtttctcatcactggttaagactccataatctaataacagcaatttatgtaagaacttccaatttactatggagaagaattagtagataatgactctgcctaaagaaagaatgtgtcatgagctaagtgagacctaacgagcgtggttgtttccattctgaatccctccattgtccggtagcgtaaactacccatgctagccttagtctgagaacagtctgctaggagttagaaaagattaatgagaacatttgcaaaaactcaagtcaagccgttttactggggagtagagaagggttgattttaatccattatccgtgagcttggaaggaaatcagtatttgcagactaccaaataagaaatatgtgatatttcccttagtctctcaaaatgtgggcattttccccttggaaatgggaagggcagacacagccttccctcctctagttctctcacctatgaaaggaagcccggattcatccggcttgctttttcattatttgaggctgagaacttggagtaaacagtaggggagggtcacgttctgaaagtttaagtatggtcagaggtaggagcacagaaaataaggccagcttcgcctgcctgccgacctatccagctttcttttctttagttttaggccacaagtaacaatcaattaatataaacatttaagatatttaaaattgatatgtagcaaatattagtgaccaactatgaaccagacagtttctctattatgctattaagatacgtgtgaaaactttaataacaagtttacagaatggttcattttatccctattttgcagatacaaaaccaagctcagagacataattacctgcctaaggctat

SEQ ID NO: 27626 - DNA, 778 bp, Bovine  19866880841147
ccccccgaccctgtctaatatgtatccatgggattttaatttatggaggtgactgagtgataacacagcagagtcagtgctactgaagagaggaatttattatttacatttcccaagagaaaggagaaggccacgccagggcaggactccagggtgccaacagctggctgtgcccgggaggcgggggcaggagtgagatgcttccatccgggcctccttggggttggagggcaggctggtttggataactagaggctgtgggctctagggctgttcctagctgtgtagcgcctgcaccagggatgatttagaccagagaaatgtggcctgctgtgggagttaagtttcaaatacatgttgacttatttaaaaattttttgttgaaataaaattcgcataaaactcaccatcttaactatttttaagaggttttagcacattcgtcatatttcacatgttggtttttgacttggacttttatttttgaaaggaaggaagaatattaagccataacccggagacccagcaagtagacatagaaattctttcatccttacctggtgagtcttctagaaagatatttgaaagcgtaggctcttcacctccgcactggtttctgaatagcttctatgcgcaggagccgctgtcttccttggccgccctggttatggtgccctctgctgcctccgtcagcgcagagggcctgggggtgggccgtgcggcgcttcggctagtggggtttcgtgtctgctgagagttgttgggtttgttccccaaa

SEQ ID NO: 27627 - DNA, 1146 bp, Bovine  19866880861983
caatttcatgtgtgactatcatggtatgtcatagagggttgttacttccagtgggcttcatgatatagaattaagtttagggccatttttaaagaattattttaatggaatattatataggaactcttcagaaagttatgggaagggggctcatttgttctagttttccagagacagtccctggtaagccagtgtcctaggctctgtccagttagcatccactcttactgtcaaaagtgttctgatttttatgacaaattatgttttcatcctagttatgggggagaggtcttccagaaacccagtaggagggaattttttgttattgttggctagcttttgttagacggagaaggcaatggcaccccactccagtactcttgcctggaaaatcccatggacggaggagcctggtaggctgcagtccatggggtcgctaggagtcggacacgactgagcgacttcactttcacttttcactttcctgcactggagaaggaaatggcaacccactccagtgttcttgcctggagaatctcagggacgggagagtctggtgggcttccgtctatggggtcgcacagagtcggacacgactgaagtgacttagcagcagcagcagcttttgttagatagatgccaggcattgatttttccacatttaatgcattttctcaattaaccctaaggatcattagaggtattagaggtaatccaagtcccagagagattaaataatttgtgcacattcaaaaagcaaccaagtggcagagtcaggattagaacccacgtccggcaaatcccaaaacctgtgcgcttagctgatgcatacttgttttcatcctctgtattagcaagtggtctgagatgttggacttcagtcccagctgcctgaaatcctcaacaatgccagcgaagcagatgaaacctcaagtggccagtggggcttccttctgggggaactctgttccctgggtagggaaaataaggtgtgtgtacttatctgagtatttctgataaccccaagggacaccctgtccattcctcattagtagagctgcctgtttacagccaggctgagattttttttttcccaaattaaagtataacgaattcgctaagacttcattccatgttgccctgcca

SEQ ID NO: 27628 - DNA, 1335 bp, Bovine  19866880864557
taaatttatttacagatgaagtcatgaaaaattagttgagtctttttcgttttttctttctttttaaagttgctgtttagaacactcaggactgtgttttgctgcagatttgtcatggttaatgcatgttgctgtagcagtcaatcatgtactctaaatactgtcacacttttttttaaagcctcagtcatgagccatgacagaaaaataaacaaacaaatatagagctaaaaaactctttcactgagaagctacactatgcagaaccccttgggaaggctaaaggaggccagaataaatgataatgtaagtgctgtgggtgtagggaagcaatgatgctgtatgaacacagaggttctggagaaaaaaaaaaatacacattcccacacgcaggcgcatactcctgtggaaaaattggcaatattagtagcctcaaggtgcaatttcctgaagcagtgagattgacaagtcagtactaaatgctgttaatttaactaacttcagattaatggtagagtcgctatgactgaagccctcaaacacagtctcattatagccttgctgggaaggtcctaaatataggcattgacagtttaaaacaaattcgtatacatttgtgtatttttagacataggttaggcgtcagagtttgtgtcacagttttcaggttgattaattgacccagtaactgcaccctttacccactccccccaccttcttccactccaaattatggacaaaatgggggaattgtccttgctaagtcattcagtgagctttttattgtgagcctgatgtttgaattgcatgcatgcgtcaacacttgggcgatagacacatgatttataaaaataaatttttctaatactatgaaatcccccctattaatttttatatccacaacagttattactggtgtgaattccaggtggtatttcagatggacagcttctcttgagctgtgcttggctccccctgaaatttttcctgcttttcctagcacaacacattttgtttctagacttttcctttattcctagactgaagacttgatgctgtttgagttgtaggggtaaaaggactctgaatctttaaaataaagcattcacctcttcatagaataacaagaaagatacagagaattttatggccgagtaagttttccaagatgggttagctacatgtgcttctcaaactgagacatctaacttacaacacagtatggtggtggtattgttggagttcagtgggtatctctgaagtctcagaataaatatgtctgtctttcaggaacattgaaatttctaggcagattttgatgaaagcaaattattt

SEQ ID NO: 27629 - DNA, 796 bp, Bovine  19866880928050
ggatggcagagtagaagggcagagaggtatccttgaagaggtcattgaactactcaagcagttcagtcctgaagtctctctgcctagcacttctccttttatgaggaaatctattttccttattgtttacgccagctgaaacctagattttctgctcgctgcagcccaaggcagttctgaccagctcagagctcaagggagatgaggagattagattagaaggggacaagaagcaggattcaaatgggtccaagtctctgacccaatgactcatatcccgaggtgtggaaagaactttccggtgggattgggagccactgtcagtatgttttaagtgattgtagagaatagaaggtggtgccaggatcaggaactgcacagagattattctgattttcataaagaagaaaaaagatagtttctggaaactccagacaaatgattttgaggtagatccttgacaacagaatggactaaggagcagatggtgggtgagcatttaggaaggaatgcaatggtcagtggagaataaaatgacttcactgagcacaagttattccaaactaacctcatttcctcttttgataaggttactatgtttgtgcatcaggtgtatgccctaaacattgcaggtcttgatttcagcttagggttaacagcttctctcatggtttccttgtggctaagatggtgaaatgtgggttggatgaaagtcgtggttttgtgtatttgcagctggctcaacagctgaatccaagtgttgactatttggatggatgtcacagcccatgtgctg

SEQ ID NO: 27630 - DNA, 1915 bp, Bovine  19866880935387
atgtggaggaacatgtgaagaaaacaagcagattcatttgttttaatgaggtcagaaaggaataccaaacatcttggatctccaaggtatctgcttccttccagctgtccacggttttcagctgggtcctgaaatggagttcaggacacccaagacaaataagtaattctaaagagcagtgccaggaaaatattagagttttaaaaaaataaagcagagattcatttattttttaaatatatacatatcttcctataacattcctgacatgaaagaactctagacaattctgcctccacctgatcaggctcaagcacctcagggcctgctgaacccaaccttacaagcatcaccccaacctcttttttttcctcttgacacgattttcttgtgtccactcccctgtggacacaagatgaattgtgggatgaattggttctcttccgaacacagtgggggcgttctgcagtgctgacgctgttgtggtaagtcaggcctccagaactattgggtctgaaatcctctccaaccctggcctttagaaggccagttccccagatggggcagctctggcctgctgtctcctgccttgagaatcagcccggggttcacagaaggagaccccagagagctgtagggttaaccaaccaaccataaacattacctcctccgctgatcttcaaaggctcaggaaaagaaaacaaaccacataaatctttatcagggctccttacgactgccccgggaggtggctcctggaagagctgggtggtgactctgtacagaggataaaaaataatttcagttagcggtgctgagtcagagatggattgcttttatttctcttttctcctcttttctttccctccctgactcctcctattaaaatgacttccttttgtcatttgccggccaggagttctgtagtgacaatcctcgatcttctaccagcttcctggttttccatagctattatgaagggggttacagagtaggaagtatgagatggctaccctgctgaaaatatttcaataacacaccttgccatccgggacaaactctccaaatccactcccagcttctatacatgcatacataacggcggggcttgtatttaaaagcacaggaaccaaatgctactcgtgatgctcagggaagtcattcatcttctgcaggcctcatctcctcactgtaagagtcacaagtttggtggcttatgagccacctagtaactccgacttagcacgtggctgagttcttgtctatcatcttaaacacagaattcccaccgcaactctttgagactttacacatcccactctacagatgaggaaactgagccttggagaggttaaggaactcactcaaggtcacacaaacactgggataagagcgcttacctcatagacggctgaggagcggatgagataatgtctgcaacgtgctgagcatgactcctggcaccttgtgggttctcattcagagagcacactctcatctagaaatcttccctgaccttctccctccctgaccccacatacatctctaccagatctccgctcccaggtccttgctggtctcccagccccgggatttctttggaggtgaaggaagatgtgtctcacctctgcagtgccgaccagtgcttggcacatagtagggacagagtgaaagtcaaaacaatgaatgaatgaatggtatgaacaaacgcccagttagtagacagttttaaaaaaaaaagtagtcaaaataaatactactagtaaaatgactttttctaaagatggttaaagatctgaaatttcctggaggagcttgtggtgctagtggaaaaatgtacaaaagggaacgaggaacgaagtcatcctctttttttaaataccagctctcactgtagtttaagggcttcacagac

SEQ ID NO: 27631 - DNA, 894 bp, Bovine  19866880994353
cttcactcacaaacatggatcaagcacctaggagagtgtaccagacctccgctccaggtgctaggactaccttaatatttgcttattaaataaaatcagtaaagagaactgtgatgtgagcaagccacacagccagagctttagtttcccaaactgtccgttggggtgactatggctccggtggggaaaatgggctccctccctgggctcctactagggaggagagagcagcgaggtcttcaaagagcacactggtcagagaggctgtgatgttaggtgcatgcaaggcccgtggaagcctcgggtccttgcaaagaaatcaagacggtgcagaaaaggagggtgaggagcctgcagcaagggggctgagagtgtcccctgcgggtgcagaagcaccagtaagggtccagcttcagggcatcagacatcgggggtcagagggcttgaggaggggcgtcaccatcagacagggattgggcttccaggcaggcagctctgaagtggcgaagtctccatccaaagtcttctttatctccagactcaaccctgagacaaaggaatagctaaacactgaagctggagtctgagtgtgggattttttttttttttttctgttcggtgcccagttatttgcctgttcgccagccctgggataagacagaatttatgtctcaccaaagaggcaccaagaagtgaaggagacagagacacacagagagagagagagatgattatgcagagcattttttttttgttttgcttcaaagtgtctcctcactagaatgctgccgcactgtctccggggagcggttcgccctccagaaaatatgacactttatttcctgcccttgtttgttaacacaccccattaccatccatctcagtttcatgtaa

SEQ ID NO: 27632 - DNA, 1438 bp, Bovine  19866881011500
aataaatgctggagagggtgtagagaaaaggggaaccttcttgcactgttggtaggaatgtaaactgatagagccactatggagaacagtatggaggttccttaaaaaattaaaaacagaactaccatatggtccagcaatcccactcctgggcatatactctgagaaaaccataatccaatgtatctttttaaaactatagacttgccatctctgtgctacctctgtattatttgctatttactaaccctgatgtgcaccctccagtctatttcctctacctggggagtcttttgtttctttctctgttgatctaaattgtatttacattttaaggaccgactcccatgtcacttgccctgaaatctttcccgcctgatccaccaggggagaagcaggcacacctgcagcctgttccataaccagctccccagagacaagcacctgttgccgtgtcccaccgcagtgccacaatggaagcactccaccatgtctgttgaaaccactagcaactgcagccccaaaaacataccttgggttttcttaagttgtagtatcctttatttgttacttgaactttccatctaaaaaataaaagtttaaaaaaatcagtaattactaacaaattaattgtcagttaattataattattaccaatcaactctggatgtctggtagataaggttcttctattaaaatagctttcgggaaatgaatacatttaaatgactatgtaaatcttgagaggagtactcagcctaacttgttacctaacctatgatttacataacaacacaatatacagcaacaaaataaaacaccagtgtccacacataagtacaactgacatagtcttttacatttaaactacatttaactttagaactacacaagtcttcatttataattcaaggaatattcccaaagctcaagaaatcacttttgagggtaagtataacttacctatctagtttaactccatctgcctccatcacgtttcttaagacttgtgcaactgggatttctcccgcataacctgtaccccaccccaaggtgttggagagatcattgcctgttcccagaggcaagaccgcaactcgtggaacgtatttctcttgtccctacaatacagaggattagttttagatttttctcttcagactatttggagggtaataatatttggtaaaattcaaagcccaaagcaataaagatacaaataataactactcaatcacaatattcaaggttggcaaggtcttctaatattcacctgcatgataaaaaatataaccacaaatactttgtaactttctttggaagtgccttctgtgagaggcaagggagatcttaaggatggataccttaattttcttttcgtcaagggcatccaggacccagccgacagtcccatcccctccacagacaagcactcgag

SEQ ID NO: 27633 - DNA, 1760 bp, Bovine  19866881120297
cattgctctttgccttgatccccacccgggtcaatagcatctactttgaggtggaccatgtgagggtggaggtaaagcagctctttctcaccagaatgaatcttggtcagtcaaggaccggcgtagaacctaacagctgggaaggaatctagggcccagccccaccagtgtggctggcataaggcgcggaactggtgggctgtccgcgcccaggctggtgctcagcgtgtacacttggtgctcagacacttgatgggagggttaagcatgtggagaaactcaacctgagtctccattgacaagctgtgtgcccagctccaggctgtatcagatcacaggaaaccacccacaggctggccaagcttggcggttatctctagggagcactttgctgtgaagatgccctagaggctagcacaggccctgtctttgccacagcaagccagcttgttggctgggccatgggatacaaagaaaaggtctaaaacaaacaaatggcaccctcccaagtttgagagcttggcaagaggcctggacgaagcacccaagccacatggacttgagttgcagagtccaaagcccaaagaatgtgttttgcgggggtggggagtcagttgcatctcaggtcgttcttatcatccctacatcacccctagctctgaactgaaatgcctgtggcttgggacaaacctgaccctgaccccacaccacccacttcccctgaagcctctggctaccttctcctttaaaaaaaaaaaccaccacaaaacgcaccccccaggaagcgttccacgtgctgctatcatgggggctccctgaatcactgccggcctccacatttcaaagcggagccggaggagtgcccggtgattcctgggtgccaacacagctcactcccgagctctgatctatggattgttttgatttccccctttgaactcttcccaccctgctccagcggcagacagagatactgaattaagcgacagacacgttggagacaatgagcgccaggggccccccggccctccccctgtgcccctcccctctcctcccccgaaatgtgcagacatctgctagctggagccgggcgctgcagtcataaagaagagctggcaggagagtgatgtacagcccggggccctccccagtgactggcgttaacctccaacggagaggcgctcaccccgtttccgaccgagccctttgtttcacaccagtctgcagaggtgcctcggccctggctgaagatttaaccaaattataatgaatgatgctcagcagctctgtgcccctaattagaacaagtcgcacagacatattgtctccctggtttcctctgtcccatttctcgccctctgttttctctgctcacgacacatgggccccattaaacattcttgtatttaatgtggttcccttaaattacttctcaagttttcgagttccatttagaattggattttgctctttggactgtggttttgatttggggttttgtacatctcgccaccgctccttttctccacctagtggagatggcgggcaccacccagcagagggtacatccagagcccccaccagtcaggagtgtgaaccaggacccttgactcacccgagacttcttttgctcttttcttggaagaaaaagaacttaacccaaacatacactgatgtccattttgtgaccttcgccccaatcgcttcatccccatcacaaggaaaggcggtgaagaccttctaggtataccataatttat

SEQ ID NO: 27634 - DNA, 1494 bp, Bovine  19866881133359
agggcttggcaccccttagtattcttgctggtagcatctcatggagaggagcctggcgggctacagtccatggggtcacaaagagtcagacacgactgaagtgacttagcacgcgtgcaccggctgactacaaaagtttggatcgaaagtctggatggtggtaacataactggtaagcactcagtcagtatgtggaatggacaaatgagtgataagacctggaaatgagaatgagcacacgctgggcagggccttgacctcttgacttctctgcacctcctcttccttctcttgtatgcagtgtggagaggactggatgcgtgagcccggcgcgagtgatcagcccagcacccggctcctgggaatccctcggtcaatattagctattatgattagtggtggaaactgctttttaaagtgagcccacactcgccgcctggaaggtgattgcatttctccgtctccactgagtggcgggaaactggttggtcaggagctgggaagtcttgctctgatttcaggatccctgtgactttctctcaaggcagaggaatgtgtttcgagaccccttgcagccgctcctggatcccagtccctcctccgcagttgaggatctttccgcccatcctttaccagctcgctgattcagggaagggctgccagatacagggatgaactttcccccggattccttgctgcctcccttcagaagcgaaatgccgcagtgctaacaaagtgtctttcaagcgaccagaggcccagaccgtgggctgctgcctgccagccagagagctgtttcccacccccaccccgttctgggggcaacggcaggcggtcccagccgcccctctctctcccctccgctccgtgttatctatggggattgggaaacgttatcaaaacaggccccatctgttcctgaagtcgtggaagaatactcgtgtgataaatttacagggcgctggaagaccctctaattttctgggaaacgacaaggcctctgtggccaccttgtgtaaaatttcctcttttatccccaagttacatgccctggactatttacttggagtctgagggtatatttaccattcaggcaacatcacaaggtgtcaaagaaatctactcagagtaggatgtgttgggtgtcttgcctttctaaaaatgacagtcagctattttttttttttttaatacatctttttaggtgttatgttcatagtgtaaacagttcaggaaggacgcgggtagggagtcaaagttcaagtcagggcagacgtcctgaacagaaacaagactcaatccagcagctctgccaagacagaagctggttagatattggattccctctgtgagttcttcctaagcctgttattgctctatcgatctgctgcgggagcacctcaaatatttgaagcctgagtgcgtcattcagaaccaaccctggacagccacactgaggagaggatttgccagtagctgaaggaatgctttggg

SEQ ID NO: 27635 - DNA, 2076 bp, Bovine  19866881250757
aagttgcttgaactgcttaataagtagttgagatggagattaattcctggctttaagattcccagcatcccaggctgttcacttgtctatactgcctctgaggacccccaaaattaaagtttatttcctattccctatcagcgcttctatgggaaccaaaacagcatttttactggccacactcacctggtgccttagctaatgaatggaatttggctagactgcccagcccagcaccagagcattatgaaatcttcccttgatccatctagttgtgccgtttctaacctttcaggccaaccatagcacaagaggaagagagagggagagaggaatatgcctagaaacctggagaaagatcaaatatagtcatttctagagatgagaagatctgtcttgctaaagcatgaacccactccacacttgtgagttttaaattgggaactgacgtgaaaactctgaatctgggaattctgtttaggtctggcaacatacgagattggagccgcttgcattttttattttaaattccctgggtagttcgaggagcaggggcatgcattactttcaaacaagaatctttattgtttgcatagcacacagtcttccagttaattagaaaaacatttttttcccaaattaaatttccctagaaaaacaatgatttaaattaagggcaaaaggcttttttttgggggggttgggggagacactagtaaatccttcctgcacctattgcttctagaagactaaaagtacagttggaattggaaggctatattcaattctttattgtgagattctgccatccataaaaataatatgcctctacttgtatagcttatgtactgtcttagtttcgcctgccatatgacagactacctatagatacagacatgatgagattctaaatgttcagggttttgacaagtgcgtaacactgcaaaagagtacatgtgtcagcaacaaaactcagctctacaatctgatctatttgcttctgtatctcctaacggctttcctcttatggctctcatctgaattcgtactttctctcaatcctctttgctttctaaataaaatatataatttttgtgagtcttactactactaagagttctttctctttttccaagcgtggcatgaagtgtttgttgaaggaacaccagtctttcagaggcccagctgccatcagtttaatgtcttcagtgagattcaaacagcttcacctcttgtacttttttggtctcttaaccagaggtgcctttaagcacctcttaaaatttcttcagtaatttctgcagtttggggatgagaaagtctaaatgatctctactactggagttactagaagtataagtaagccgccagtcccagatcatatagaaatcactttttttttcttttcatttataggatctctttccttagtagagtcatctactggattttcctaaaacattaaattaagagttaggaaggtctcagatttatcacaaactacaaagtacaaaatctccttatgtcatatctaagattaggtgatacgatagggtgttttagatagatagggtgttttaggtgttttaaattaaagttaaattttagatagagaggcagaaggagaaagtcagagcttggttccaaccatatttagatcagataattccagtgagtgctggagttgacccatatagcttccaagagctgattgttaaaatttcaggaatttttccagctagaagttaaacatagccatcattaaaaattaaattgtataaacttatagttaaataaattgtgttaaaaagacagtaaataatcaaaactcatggcttcctaatttactgcgttttattattagttatgctcttaagattattgatacatgttttatcagtatggtagaaataggatataatgatgtactactacacttatctccccagtctgtttactgacatcacattggtagcttcaaattggggtgtggtgggaatatgtgccagtatagaagtcagcaaatgctatgaaaccaaagcttgattttttattttgtggaatgtctaaaccagg

SEQ ID NO: 27636 - DNA, 1812 bp, Bovine  19866881354172
atagaatcctctgctaaaatgtttgtatcatatttattttaaaatgagagatatattttttttacttatttattttcttcactgtggtatacctgtgtttagtgtttacaatgtgttgctttatttaataagttaaattgatcataaattctgctactcacagatagaaatgtaacctaagtaataattaaaacccataattcttctgatagatatattatctggatattcttattcttcagaaatattccgagggtgctcttctgctgctccccagtctgctccctcaggttccacagcgaggctgccccagggggcccccagcctggtatttttaggacagatggcccatttgtggatttggtggtcttttatgccattaatctctgaagaactagaatgtatcttccaccaaacaccattagctccccttaaagatctgtggatgaatctgttgtctattatgagttgccagaagcttaaatttcagtcaccttcaggcccaggccatgttttgaaggaacaactaagaaatgtatacagtagtagtcagttacattagaatgcttttattttgcttaaattaatctcttcccagatctcaatgtgagcagctaaattctagtattgtaagattttgtgagaagatctgttttcaccttactcacacaccattcacagtagctacctgtggtggtggttgggagagtctgcagattttctttcatgggctgatcatgttttgagtataatgagcttcattgtttaatttgtgatcagaattgttaccgataccacattttacaaatatactgttagattcactttgctttaggctatattttatctataattcatagtagtaattatagaataatcaaagtaaatagttaatagggggtatcagaattaaaataatcaaaataactatatagtttttttttttacttttaaaactgtattctagctataatgttacattggatttagaacagagtcatataaaacaccctcatttacttaaaaacaaactggtctttcattttcataatccactgaagtttgaccttcacgaagtttatctgttaaccttattcactcattcagacttaatttttttaggaaagttacttcagaatatcatatcatataacatattttagaaaaattctctttttaggcacatttacccagcatttcaaataaatggataggcatgtaccttgttttaaataaatacaatttataagactcatgtttgcaagttatatattagggtagcaattgttgacattaccagagagtccatactttataaaaaatgatttgccatagaatttttctgttccatttcaaactattctgatttaaaaatagtaacttctaaattctcaggaagaaatatgtgaagtaaagcttgtattcatgtctgttttcagatttctccttttattctaatacaattcctagctccttgcaatcttagtaggttaaatactgaatccctggcagcttcttagggatcccataagtagatgatgagaattttcagtgcttttttttgtttaatggaaatcaaactgacttgtgttgtaacatacaagttgccaaatgataagattacatgatcttaaaggtgttctaggttttctgcaactattagctgtgaaccctattgtagctaacgtttatgaaattttatagtcaaaattatttatttttatttttttaggatgtgtcaaaaacgtgtagtatttgctttttgaaatgtttgcctacctagagctggaaaatatactgtgactcagaaat

SEQ ID NO: 27637 - DNA, 1079 bp, Bovine  19866881354338
attcttttccaggaagggagggagtggcagtggcctaaaatccctgggaaactctccctcggtgccctggctggcatcctggagattttcccagcttgttctgggaggggtatcccactctaagcaataggttccactaagtcctataataaataagacaaccccccaagaagtcaaatatttagattcccactagagcagggtttccaaaggtccatgaacttacaaaataatatttaccactttcatacttaagccctttttcatctctttcctgggttagcacagttataacttgctctttctcttgatttatctcctatctcccttgctcttgggagttatagtaaaaatttacataatttacaaattctttgctaaatctagcatgagaaatacagtactggactaatacaagacaccattcaagacattattgttctttattatcaatgcaattctcacagcaaaatcttgaagtttctttattactggtttgtattattaatgagtcacctcttaatacgttttctagctattctctatttaaaagtgaaaaagatttcaatattaacaccttctgtttgtaaggcacttaaactatgtttaacaaactaatttaatccttatagcacctatagaaaataggtaacatgattacctatatgctacagataaaggggctaagttgggaggggctaagtgatttgttcaacatcatatacacagtaaggagcaaggcaggacttcagcctaattttcagataattgttctttctactacaactgtgctgactcaagttaagagtcaccaaatatgaagcaaaatgaaaaacacaaaatgaagttaaatgatgtagatgattgttttcagactatttctgtggcagattaaattagatcttttcagactgctttcagtattgtttttaggaagcaatcaaatctcactctttaagctttcagatttcaatatttgtttcagtttcaattccatgcagcattctctactgagactcttgtacgtatcagatatagcacaagaggctaataatacaatatagaattcacactctact

SEQ ID NO: 27638 - DNA, 1511 bp, Bovine  19866881484628
ccacttatactccagtggttttcaatttcaggtttcccattcattcattcagaaagtacttattgttaaacccctacttatggagcaagcactgtcttggtgctaaatgtatgagacataattcataatatgaaaaatgtatagtctagttagtaattcatgctctagtctctcatctagtcatgcatccgtttactcattcctctgacacatatttgctggagactgtgtgcaaggcaccatatcaggcatggtgacaaacacgttcatcctctccttctctaccttctttttaactccttttatcacacatatgccatcatcaccactgctaagcacagaaggaaaaacaagcccagcaattttggggacttacatgcgcgtgtttgtgtgtgtgtggttattttagggggagaggtgagagggtttcaggtgggtgggcagtggtatctagttccatggggctccttcaaggagacacaggtcccattcagggtgggatctaagaaggcagataacggtttccgtaagcacaaagtaaacctttgagccatgactgctggggagcaatgggataagctgcctcatgacttggcgagcttctcaccccagtatgtggtcagaggtcaggcgatgagctgccaaggacagcacggaagagatgctgctgcccaggagacttctgatccctggtctagggtctctttctattctgagttctcattaccaaaacaatctccctggcaccttctaagtattcagaaaatacttgtgaaatgaatgattaaataatccttcaaccatgtattgaaccttgaggttcttgaaagtacaagctgggccttattcatgccttgtattcccagggctccagccctctccagggcaccagggaaagtctgaaagcctttgtattagaggatacccaagctcccttctaaaaattctagacagaaacatcttcttgtggtttagttacctggcagactctctcagcaagcctagcatcctttataggcatactcagtcatcttttccttaaactccaagctttgttttcttcccagttagcaaattgctgatccatctccccccactatgaagccttatgttcccagggaatttgttttgctatcagctagaaaggcaaaataagctatatagagaagctgaataacgccttcccaaagcaaacagtaagattggcttctgtgttagctctctttggagtcatctgtgctgtgcccctctctctggtggcacccgtcctcataaagaggatacatgattgccgctggagacctagtgagtgatctgtggcactgtgggccagacaccactgcctgaagagagcaggaggcaggagaagccagagtcgacttcaggattcttgggccccaggccacaccgtaattcaggtcatcgcactttgccaagggaagcttatcaaagaagagaacagactgacattttccggccctttttggtttgctctcggaatttgagcttgg

SEQ ID NO: 27639 - DNA, 1243 bp, Bovine  19866881494642
ttctttctttcaaagacctgctctactgctattcccatggctttctgtggaagcttcctgcgggctgggacctagttcatgtgatccacttggtgtgatgcccacacagttatgttaagcttttagtgagagaaatatgttaggtttgtatcagtttcctgtggctgctgtgacaaatgaccacacaccgtgtggctgaaaacaacagaaatgtattctctcatggctttggaagctgtgagggtctgaagccatggtagtcagctgggtggcactccctctggaggctctaggggaaaatataatgtcttgcctcttactggtaatggcaccccactccagtactcttgcctggaaaatcccatggatggaggagcctggaaggctgcagtccatgggatcgctaagagtcggacacgactaagcgacttcactttgacttttcactttcatgcattggagaaggaaatggcaacccactccagagttctcgcctggagaatcccagggacgggggagcctggtgggctgccatctatggggtcgcacagagtcagacatgactgaagcgacttagcagcagcagcagctgctggtggctgtgcataccttgggctgcatcactccagtctctgcctctgccttcacatggaccctcttctgtgttttttaaggacattcgtaattggatttagggcccacctggataattcaggatgatctcatctcaaggttctgaaatacctctgtgaagactctttttccaaataaggtcacaggttctgagagttaggacacaaacatgtcttttggttggccaccgtttaacccgctaggtgtctgatagtaaaaatgtctagaagcaagtgctaagggggttgtaccgctaaactctttccagcctgtagtcaggtcaaatgctctacaagaacagtttgcactttgacaccacagcatacagatagtgactagtgagtatatgaaggtatgctttaagggctgacattctgatattttgattgagaatcacattttaagactcagtcttaggaagagctggtgctgatgtccccaggttgagttagttgctcagttctcttggctcataaaacattttatttatatctctgttactgcatttatcaagatttattataaattattcttttatatttttatctctctcattaagtataaactccagagggcatgcaccgtgtcttattcagctcgcttagtaaat

SEQ ID NO: 27640 - DNA, 1325 bp, Bovine  19866881531022
cacaaaggaatgtatgtgtctatcacctaaggaactacagctagaagtataatggagtggttttgaataccaaaatcaaagtgacactttatgttcttcccatgtagtatgtgtgtaggcatataaacatatattgtgacacatatacataaatacgtgtgtcatatacatacatacatatgtacaagtatgtgtgacatgaagtgaaagtgctagtcgctccgtcgtgtctgaccctttgcatccccattgattgtagtccaccaggctcctctgtccgtgggcttctccaggcaagaatactagtgtgggttgcccttcccttcaccaagggatctttcccaactcagggatcgaacctgggtctcctgcattgcaagtagactctttgctgtctgaaccatcatgtaatcctgcatatgtggcatgcccgtatatacttgttggtcgattctgagaaagcaagccatgggaaaggggcaagcagtactggtctgagcactgtgggtttccggtgaccaggctgcagctttaagcggtgcctacaaattcgttcttggaagccagattgcctgggctacgatctactactgtgtcatgctgggcaagtcatttccctccctctccaagccttcctttcatcatctgaggaactgagatataataaaggtggcctcgtcaggttgttgcagacatgaaatatatacatgacaagttaaaaaaaaaaagtgctttctaaaagggtctggcacctaataggtgctcaataactcacatccattactattattctggaaattgctttctttttaaacttttggaaaaatcctcccatttccgagaccaggatgcaaaaacaatactaaatactgaaaagatgtaggaatggattctaaaactttccagataaaagagcatttgtgtaaaagggataaaaattctttgttatgttttgctttagacatgttatcaaccttttacagaatagcattatttttataataataacagaaagcatcactcattctctagactcaaatagccaaccagactctgggtaaaggcatatattatgtgagcaaagtggaatagcaactcttttgaaagctgctctttattgcgggcatttatatataacataggacaacctgttttgtagttaatgaacctggaagctaaagccagtggtatggctgaaaagagcagagttccttcttcgatgctacaaggtgaattagcatcaagtcctctgtcaagaaccttccaataaagaaccgattatataaggcattgagcctttctctaattacagctataaatataga

SEQ ID NO: 27641 - DNA, 859 bp, Bovine  19866881543496
tagggtttttactacaagtttttaagcactcgctgattttcaaaaacatattaaactggccatggccaatctcatcgattggttgcaagtccacatttcccgaacgacttaatagtctgcaacttgtgccggacggagaatgatttcaccattctctgtcctacaacctggaggttggacattggtttttaactctgtggcgggaggaagcagtttgttttgccatattgatctcctccctagaaccacctcctatgggttttataggttctactgtcctggagagcacattaagtccccagagaacctctttgtaggccgtttctagggtcaccagccttgccacggcctgttcttggaagatggagctcctaggaattttccccaaatttgatctttagggcagggggattggaagagctatggagagcctatcatggcaaaataactaaaattgacacttatgcttctgaatcttatcccttttctctttctccatatctttttcacagtttttttttaaacaatatttttatttattttcaagatattttaaaaatttatttttaactggaggatgactgcattacaatgttgtgtttctgccatacagaaaggagaattactgccccccgcccccacccctgcctccatcctacccttctaggtcttcacagagcactagctaagctccctgctctatatagcaacttcccactagttatctgttttacatatgatgatgcatatgtatcaagtgctacgctctcaccttccccttcccccactgtgtctccatctttttcaattgccaatgacaaatccagcaaacgtttacatacagcaaataaataaatgg

SEQ ID NO: 27642 - DNA, 706 bp, Bovine  19866881652953
ctcggctggggaaggggagcgcctctggagcccggtggttcattcatctcctgataaactgtttatctgagttttaacgagggcgcctctctcccagccctggagacagcagcctcctcgtgtttagcctgcactggcgtggggggcctggggcgggcgggggagacgccgcggcctcgtcccggctcgcgctgggtctgcctcggcctttggctttgcagggctggggtctgggcctctctggactcgaggcttttatctggacaggaaatcttgttttatcgtttctctcggttcactgtgttgtgtgctcacacacgcacacacgcacgcacacacacattccctctctaaatacacacacacatacacaaatacctttaaaaatcaaacaccacttggttctgaggtgtggacttctaccataggcgacccaaaatgtcaaaagggaaatgaatggaatgccacccctacagcaggggcagcacaggaaaggattctccaaagtgaaggagggaaatgctgttctgtgaaaaggcaactgtcacccataacagaaactaaaaccccagttgttctcgaacttgcttccctcttgccattattctcccttaagaatccacacgagtgcacactttagagacactgatacatctgctgaggcgtgcacctcccccatcacaacacacacagacagtgcacgcag

SEQ ID NO: 27643 - DNA, 1544 bp, Bovine  19866881654904
gcacagaaaaggtacaggaaagctaactgattgccagtgccacacagtaggggacctagtacccttgagtctccgtctgcaagtccgattcaggcttctcttaacaactttccctcctctggaaagtaacaattgctgttcatcagcttttgagcatgtaaactccttggagcaagggaaactgggtgacttcatccctttatcctggagataaattcaaatccagatgcccaggtctcaaaatgaaacatcaggcagttgccttgtctctttctaaatctggtagctggggagcaatccaaagagagactgccttcctttcacccacccattcactcccactcccacaaatcctacagtccatttgaactgacggaactcttgttaattgcctcttattggcctgttacaagatgaagcatggggaggagacaaagcctccctattcacattttcagtgggcagcaggggtctctgtaaaaatagagaacccggggcccaggctacccatttttgaaagtcaggatgagatcttctaccattgagaatcccacattataatcacaatattgcatcctgggagaccctgtcaatttctccaatggtctgttagaaatttagagtctatttaataagttagcactacttaaagttacagacctttttctgctttaaattgacacacgctttacattttaatttcaggtttttttttttcccagttggaggaaagagggggcaggaagagggggagagaggaaaaaaaaagaaagaaggggcagtgcttttcatgaaaacatcagttcttatatttatgctttaggaaagcaagggggaggcaagaactgcagcctgataactgaactttctgtttagaagtccctcctctccattgggccttagctaagtttcagtaattattgctcaggcacatagtcttggagctttgctttctctcagacttgtacacagttctaggaagggttgttgccaaagccatcatgtgatttattgaccctccactgggacaagggggaacagatataactttgtgattttattataaggaggctgggttaatatttctaggtgaaacaagctactataccaagttcaaacatctgaagagggaggttaagaaaccctgagtgtggggtgtaaggattattctgtcctggggctgtacagacgtcgtctgaggcagggagcaggagaagaaaggagacattgtgacccatttccaacacctcctgtgtgtagaggcggaagttccttgcctgcagagggacacgcgcggaggaaaaaataggagagttacaacatggcacttacataaacaacaccaaactggcataaaacatctaacaaaattacatgactttaagcttggaatttttatacaacataaatattagggttcagtccatttaataatgctatataaaatcaagatttaaggcagtaatgttccacataaactctgaaaacaacatttatgcttcttataaaagcagaaaatgattgcgttctggggcttttcaaaa

SEQ ID NO: 27644 - DNA, 1090 bp, Bovine  19866881668494
attttttttattaacatctattaagtgcccagctgaatgttccaaggaacacatttggaaaaaagtacttctctaggaacatctgaagccaggctttttttttttttttttttttcttcttcagtgtgccttccttagcttcactgagcagagcgctcactttttgtctggtgtttagtataggtctctcacacccctgcacaaagaaaaagcttcttgaaggcaaggactctacacagtcatctttccatcctcaaggcctggcacattataggtgcttagtaagtgttggttaaaggaaaagaatgtcatcataactgtctgggccaagtttgtggacaaggtgatctctaagtagccttccatcttcagtatcctggagctcagcagccacaccctccatcagtaagtcgtccatggggactgggagccagggtcacactccttgccatcctccctgcgtctactctcaatttctggcctcatttcctctatcaactcagctcccatttgctgtgctgttattcagtgttggctatggggatgttacaaagatgggcagatcacacactctcccctggagaagctcagagatgctgccagtcccactgatgctgaaatttgaggctcaaagttcaaaagacagagacacacagggagagtcagtcacccacgagttctaagcaggagatggcagggtcagcctcatacctgaggcctctgagagcactgtactgctctctcacccagagtccagatcatcaaccatcccaccttcaatgcaaatctaagaaagtccattcatgatagcactgagcttctgactaattaagcaagccccctgcctcccttccaggtaactctgaaggctcctcaaggaaatttggggatttcctagagggggccaggctcctgtcacttaagcaatatcctttcacaccctctagtggttagagggcattctgacatcccggaggagcgcggtaactcccctgcatgcgtgcctgtgtgctcagtcctgtccactctttgcgaactccccagggcctacctacaaagtagcctgtcctcgggaaatcgattggcaata

SEQ ID NO: 27645 - DNA, 2621 bp, Bovine  19866881692835
atgtcgggaggttaaatgagagagagatctcccccaaaaggtgacgctcatgcttcaggccaggatgcgtggacgatctgaactcagaaatatcctgtaaagtagggtgtgttttcacccatgactccccacctgttctttcctcgttaggtgctcaaggattaagagtagaaatgctgtgacgtcgcatggaaagagaaaaggcgattctttgctgagatgacaaaatgtgtttgccttgtgattgtccctgagaacaggaactgggtaaatggcttgcaactaaaggatgtttcgattatcaagaggatagccccttagccaaactaagaaagccctcagccccacttaggattagacgtgctctgcagactgcagtgagctctgtcctggagcgactggaggctgtgtctcagcttgggctcccctggtgactcagacagtaaagaatctgctgcctgcaatgcaagagacccaggcttgactcctgggtcaggaagagcccctggagaaacgaatggctacccgctccagtattcttacctggagaattccatggacaggggagcctggcagcccacagtccatggggtcacaaagagtcagacacaattgagtcactaatgcgtttacttcccttcaagcctcagcctacagggtccttcaaggagatcttcagaatccacatctctttccatctctctgcatcattgggatttttttttttttaataaagctagattctcttttcagtgagaactagctatgtatatctaatgattacattgggccagtatttcccaaggtggtagaaaaggctctgagaagtcctgtagtaaagaaacctatgtcactttacttaatccagagattctcatatgtatctgaccacagaactcttttagcatagcgcctattaatatcccatggaaacagtttggctataaacatataaactcttgaaactgcttagaaaggataacctcaacctattgggtttgggtagactattaaagcagaactatgggtcacatatttgggataaaatctgaagctgccttagtggtctgtctggattatttttagatctgtgtgtgtgtgtgtgtgtgtacacgtgtttatatatactatgtataaatatgcattttaacttcgaggttagaagaaaaaaagaagcaaggaatatttcttcttatacaaaagcaatcagtgtcctaagagcggggaaggggaaagtttgtaaattttaaggcattatcgccatctcctattgccggcaaccactgatcacagcttcctacaatggtggaaacatctggccagctctcagtgaatgacagacaatcaaagatgacaccccttctcattaacctgccagagcctgcccctctgcttctaatccagcacccaaaacacttctttccaagtcattgatgcctaccagctgtattcctgagtattcttttggatgatgaattaattcaaaaagacagtattttttttaatgttggagtttgattttgattttcagaacatgtctgaaggcttctaaagaaaattcttagaaactcgctctaaaaaaaatgtgcagttaaacgtattttttaattgttgtaaaggtatgggagttgtttcaaaattatttttaatgaaatataaagttgttttctgaaatagaacgttatgcatgtttttttttaattgtcatatatagggtgattttaaagtaaataagagcacaaggttcatattattttaaatgtatattgtatttgtcttctcagcgctgtggtttttagtctgaatagcatcatagtatggagccagcctattaagcagcctgcttgggtaaggaaactctgaggccggcacaatgttgcattgctcactctgtccttccaatatggttagaattccacaacctaaatgatcatttgttgaacaaattcatgcttttattagtcaaaatacagagaaaacagagcctccctgtttcgagatatttgctaatgcatggttaattatcacatatagctgactataattcattttacaggggcgacctcctgcaggtaacatactagcagtttatgaaccaaaataacctcactataggttagagctgttccagggcccgtcagacactcggtgcttccaggccttctcacttcacgttgctaattcgaacaaggctttatttttatatttgtcagcagcaagactgtaggatggttgttaaacttctcccaggcctaattagagctgcaatgcgcgcattcataatgaaactcgtgtcttgctcggagttagtgagcagggctgttacagtagcttcctggcaggccggggctggcagttttaaggtagctcatggctgcagtattaagtgactgttgaaattcattgactccaccacggctaatgtgtctagatgacaacaagtttacacggttcttttatagttacggcaaatgggtccatttaaatatttattaggtgattatggtgatgtgaaatggaaaaaaaaaaaaatgcaaagtgcaatctcccaagtatgactgtttttaaccgttgatgagaggcccagaatcaggtatcgctcaaaatcaccgcatctttcc

SEQ ID NO: 27646 - DNA, 1425 bp, Bovine  19866881816663
gggccggggctttgcataaatagaaaagcaaatgtatatttgtcggcattgctctcttctcctttgttttatcctctttccaaaataaagtgcattgttcccggggagtggaatttgaagtggcagctgtctgcctggctgactccttcccaaagagcagaacccaaggaggtaactagggttaacttgagtttgttctgtcctcgaccgacgacaccgggattcaagctgccaaaatagctgcatttgtggggtgtgtcagactgagcctcaaatgcccactgctcacacgcttgcaagtgacacacaagccttgagggtgccaatggccttgggtaccgcacacgtgttgctcattggagagcttgctcccaaatagtgccatttctacggccactgctcttatccttctctcacacgacagacaaatatgggctgaaaatcatctcactcagtccagatcaacaacaattcaaacgaggtttgcttttgactgcattgtctgtgagcctgttaatctgagggactagtcacattttggaaggtgaacatgtactgcctggctttaagaaaaacttataattcactagatgacagctctaaggtagtgtgcccaggagagggaacgttttgttcagaaaattcaggtacattatcaaagtttcctggaactgaattacattgatatgactcaatacaataaacatggattaaatcctttcgtgtagttattacaccaagatttctgtgtcaaataatttatcttctctgcaaatggctgttccagtattttatgttagtagggaaatgatggagggatagtacgtgtgtgatcccgggagcatcagtctttggtgtggggaaaaaagttcccaagaggtggtattagcacttgggagaaactttcccagccaccttttgccagcaggtgttaactcaatgtcctagatgtggttagtgtcagaataaccacccattccatttaaaaaattgaccttatagtagatgttatggttaggtgtttctctagtggctcagatggtaaagaatctgcccacaatgctggagacccaggtttgatccctggatcgggaagatcccctggagaagggaatggctacccactctggtattcttgcctggagaatcccatggagagagcagcctggtgggctacagtccatgggatcacaaagagtcaggtatgactgagtgattgaacacacgagttaggtgttagggtagatagcaataaatatgtttctaccttcaaaaagtattctttatggcaggaagctaagaggaactaaagaacctcttgatgaaagtgaaagaggtgagggaaaaagctggcttaaaactcaacatacaaaaaactaagatcatggcatcccgtcctgtcacttcatggcaaatagatggaga

SEQ ID NO: 27647 - DNA, 792 bp, Bovine  19866882093612
ataaagttgcaggcactagtggtaaagaacccgcatgccaatgcaggagacataagagacatgggttcgatccttgggtcagcatggcaacccactcaagtattcttgcctggagaatcccatgaacagaggagacttgcgggatacagtccacagggtcacgaagagtcagcaacaacagaagtgacttagcacacgtgcctgcaaagatccagggccatttgcaaggagacgggtgtagaatttcccttgaaagaagatttcccaattaaatgttagggtttgcaatttcccatctctgaattatttacagtggaaagaaccctggtttggggtgtggactctgagcttgagccatggagctctcctcatcagctgtgtgaccttgggcaagttactttctattgtgaggtctcatttttcccacttgtaaaatgagggagctgggccagttaaattcaaaggttccttttagtactatactggtctctgatttgtgaagtaccacgtttagaatttcagaacacttgtgaaattagtccaaaacccaccaacatcagaggcgactgatgtccagtctctcctgcaaaagcatgcccatattttgagaatgtccattgccaatacacatctgccctgcagttaattccatgtggtttgtttgtaagacataaatttaaattgatcactttttgatgatcattttctaacaatttttcactcttttttttttttccccagcaaagaattttttaagggggtaccttttcaccagagtctcaaaattaaatt

SEQ ID NO: 27648 - DNA, 1131 bp, Bovine  19866880369037
caggccacgccaagttcacgtttatcctgattcagcctccctttcttcaactcacactacaaatgacaacagtcacgggaattttaaggacattagaagagaagtataaggttctgcctgtttaggagcttttgaatctaataacaaccactaaacatgtttatgtaggttaaaaggtgcaggcaacagctaaaatgctaaagaagatatgccctggcagctgtgatgagtgaaaccaccaaaaccaatacagctcttaaaaattaatgggaatgaggaatactggcagctgataaaccaacaaatttagttatcagacacttccatttccactcaaaactctaaaatggaattcattcctttaacaaatcagctcaatgctgctgtgcatcagaaatcattctgggtacaatggatctagtggtggtgatggggggagccgataccagaatccgaacctctatggtctttaaattctggtggaatcatcatacgcacacatacacacacacatatacacactcactccttcattaacgtgggctgttctctatcaagaacaacactggatgtgtagaaaaggacagcaaaaccattgagaccaggagtgtatcagacttccagatcctaacagaattttattttctattgggattaaaaatcagtaaaagcaacataattctagataatacagccttaaactaatcacaggtgatacactttcactgtttactttcgtgctttttgtgactgaaactttatccatgaaaatcattgccaactagtgagagggaaaacaaaagcgacagattttctcacacattcaagaaaaaaaaaattttttttctgaggtaaacaggtttaacaagctacacccagagttacacctctgtaaaccacttggcttgccttccccaaacaaaatgtttccaacctcaaattccagcccgatgagaacaacagaactcaagtcctacccgacgttctgtgggttcacagaagcaccgttccacctcatctttacaaccaaagtgcctgctctgaggagcccaaggggaaaacaacgatcagcagggggagaggctcatcattagagacagcaagacagcgactgcagcactcaaaaaggaa

SEQ ID NO: 27649 - DNA, 2867 bp, Bovine  19866880482295
cggattgtactgtaatagactacataaacttccctcatgtgggctcacatgccacattgtaactaacctttaagaatctactgcttcagttttgaagtagtatcaaagaaaaccctgctgctgctgctgctaagtcgcttcagttgtgtctgactctgtgcagccccatagacggcagcccaccaggctcccccgtccctgggattctccaggcaagaacactggagtgggttgccatttccatctccagtgcatgaaagtgaaaagtcaaagtgaagttgctcagtcgtgtccgactcttagcgacctcatggactgcagcctaccaggttcctccatccatgggattttccaggcaagagtactggagtggggtgccattgccttctccaaagaaaaccctagtttcctagaaaaactatgaagtcctcctcccttttctagtcgcagcccagaagtctgtcacagacgcaaaatgtgaacagcaccacttgcctgaggttgtttatttggaatatatccttagttttcctaaaagtatgtcatttgttaacatgtcatgggttcagtgtttttaaataaaatgataagtatttaaataatggaaagtaaaagtgttagtcgatcagttgtgctgactttttgcaaccccatggactgtagcccggccagctactctgtccaggggattttccaagcaagaatactggagtgggttgccatgccctctaccagaggatcttcccgacccagggattgaacctgggtctccctcattgcaggcagattctttactgtctgagccaccagggaagctaagttttaacaagataaatactggtaaatacgacccacattaacagaagctctgtgggaatcctcagtactttttaagggtatcaggactccggaaacaggaactgctgacctagaaaatggacattggctgcaaaagtgggagaattgtggcttcttttcatgtttttgcagtaaaatgacggcagtgctgtggaggattataaggagacattgagggcatcagtggaagagagggtctttctttgagctcaaggttgtttctcattgtcaccacatttgcagaatgaagcgctgtccttagaagaaacacgggttcgagtagtgcaagtacttggccgtctcgggggacagatcaacaaaaacctgctaacaggtgacgtttcctgaaagtaactcaacccctgagacatgcgggcccctcagctgaatgcacaccggtcacggtgtcttctgagagtgaatgcttctgccatgccctgaagcctgtgggttcctatcttcagggtctggcatttgttcattttttaagcagagtctagctggataggcctttatgttaaacatcgtgtcaggaattcagagttacctttttgaatactaatattgttaatgtttggatatttttaggttgtttttgatcagaattagtgttttttgatgagtaaaaatttgtatttttagttttaaaatttcatcctaaatgtactggtgattttggcatttcagcggttagaatgtgtattagaaaaatatgtgttttaaagaggaactatttaatgaaagtattgttcatttatcattttttcacagaagaataacttaactaaaattgaaaattaaacgttccagactattagacttgtttaaaaataatctgactttcagtcagattagaaacagcgtgtggtggtttctgatgttgctgctgtgtgtgtgtgataaacagagcaggagagggtgggccagggccatccccggtgaggggaggaagggctgaccggcatctcccctacagcggcgtcccctgaggagcgggccaggggctgtgtggcttgggaccgagaaaggaggctcagctttcgcagtgccctttgtggacatgaagcccgtcattcacctggacctgttcctgccgcgtgtcacagagctggcactctctgcgggtgacagacacaccaaggtactcactcgtcactcgccgcggtcagctgcgtgctccttaggagacatgtgttgtgtttcatgggctttgtgttttctctagcttagtgatggggaaactgctcagttatcagaaatcggtacccttggaaaatggaaattaaccctaaagagtctgaatagatgataaaacattaacacactagaattcttcatcgtagagaacacagggcacagggtgttgggaagggattttttagtctgtgctcgattctgtattcaggttgggagattcaaaacagatgatctcaaggttttctatttgtacctttccacattttgttcattaaaaatagattttcaggaagtaacagttaaagcgtgctcacaactggagctgtgttctgtgatacggcaccgtgggactgtgtctcttatgaatgtgttcgtcccagtgcctggatcttttacgtctcagttctcagctcttggctccagagcagagtgaacagaagcattaatcttatacgacaggaagtgttgcttaatgttagttcgtatatgggtggggtggttacctgctgcacaggtttaccttttcaaagggctgcgttctgtagcgtttcaagctgctcttgacctttgttggacccctggtctgtttcaggttgcggcctgtgaacttctgcacagcgtggttatgtttatgctgggaaaagccactcagatgcctgacggtggccagggccccccacccctgtaccagctctataagcgcacgtttcctgtgctgcttcgactggcgtgtgacgtagaccaggtcagtgcgtgatcgtgaatctgaaacagttatagaattggaaaaatgtcgcatcgggtccaggatc

SEQ ID NO: 27650 - DNA, 1462 bp, Bovine  19866880553410
gggagcgaagtcatagaactcatttgaaactaatgagtagttgtagccaagtcctcattttagcttaagaaactgcgtacaaggtatcagaaatgtggcagcgttatcatggtgggagagctgtgctctctgtattccttaagggtgatgtgataggatggagacggtgcacagttctgtcaccatttgaaccacccctcctgcttcctgtgttgctggcaggtgtttctgcagtatctgctccaagccaggttggtcaccatttcacatagtctccgacagagcatgggtatcctaggaaaagcagtttttgtcagtagatggttcctgtcctgtggacaacctcaggagtttttcttatcaagatattagtaaagtagtacaggagtattactaaaatgtttttttttaatatgtgatattaggtatattttgaggttaagttccatagactgttttgagtgaagacagcataactggtctatgttttgggatggtagaatatttcactttgaaagaaataatagattatagtgcttttcagtcccttctgagtatgcatgtgtatgtgagtacatgtgtgtttacaagtgcacatgtatatacgtacatgcatgtgcatttgcatatagacatacagaacgtgtgtatatagcatatagatgtgtgtatacacacactgcttgtgtatattctcagtccctcagtcgtgtccagctctttgcaactcagtggactgtaacctaccaggctcctctgtccatgggattctctaggcaagaacactggagtgggttgccatgccctcctccaggggatcttcccaacccagggactgaaaccacatctctgacatcccccgcattggtaggtggattctttaccactgagccaccaaggaagcgtctctctctctctctctctctcacacatacactctcacacacacacacacacacacacacacacactcaataatggagtaaatacttagacgaggttggcctaaaccttctcactactgtttatgtgtattgcgtgactgtgtaagtcatgtcagactcaaatggtgtcgtcttaataattcgaaaggtgtctgtattttacggcttgaaaacttagaggtaagtctgctctagtttacacaagtgtttccataaaacctaattacacgtgtatgtcatgctgatttaatactcgtactgacactgttttgtgcagcattttaaaatttattttctttactttcaggattctctcttagcagatgaagcatttgtctttgtgaattcctcccttcaaagtctgaatcgtttgctatatgatgaatttgtaaaatcagttttgaagatcgttgaaaaactggatcttacactggaaaagcagagtgttggggaacaagaggttagaagatgttgtcagtagcaattttgcatcattttgtaccagctctatctgcatg

SEQ ID NO: 27651 - DNA, 2196 bp, Bovine  19866880573646
aaatgagcaaaatttcagtaagtgtagaatttctgtctaaaggctatccagtagcttcctgtatgtcatagattcctttcacaagtccggcattaactcttacttttctttgtttcatgtagatgtttctttctcagcaaaatagaggagaagctctgtctccttccagacagcgaaaggtgcgagtgaggacggggccgagatggactcacaggctcaggaagaagacgcacgggccctgatcacgagctgcagcttctccatgaggatgcagatggccgagagcgcgaggaagcaggtgggcaccagggccacagactcgagctggcggtctctaagcccagctcctcttaaaaagctgatgcttagaggtgatggagttgttcgtatttcttaagaaagtaagcttgaagaaaaattaaagttttccagaaagcctctaaagtttattattcacttgtcagtcatttcaaaatgattattttctgtaacttacaaagaaaataggcctaacatcaggttttctcttctttaacaaagtgagtgcttgccagtttgttacaaattgtattgtattgtatttaagtttcaaattgtattttgtgaaaaatatgtcctttgataataagatccttaatttatacaagtgtgctttgtttaaaagtggcatattaacattttaagtattaaaattttcatgtaatcatatttaaatgtactaggggaactttctgttttaatgaccctatgttgattgctgttataaagcaaagaatattatgccaataataattagtatttctgttttgtgggttttaatgctcttgtataatgtttttctttgaggtaagtattatatgaggaatttttatattttcaataagaaaaagcccagcctggaacagcctgagtgaacaaaggagctgtatcaacccctaaattgtgttttagaggagcacgatttcagatgctctcaaattcgccaccgaggaggatctgtctcctgtcccagtctcccctgccacacacagacgaatcttgttctttgtgactctggtagctccaggcttcccttggagttggaaatgctcttgatgttttgtgtattgctttcccactgcgtctttctgggattaggtagtctctccatgactatttcctgcagaaaagaaagaagattctctttttccagaaggtcctggccatttctccttctgtctccttagctctgggtgcagcagtagtggctgtggtccagggcatgcagctgaggtgatgcacgtggcttctcagcaggaagcggggcacagcgggtgctttccactgctgggggggcacagggttgtgggggagaaaggctccagggagaggaggcacctgggaatggtaggaaagaaaggtgctgagatacatttttagataatatcccaaagatgagaaactgggaactgaagagcctgctgtgaggggaaggctatcccgtgatgctggtttgaagtggaccgtgaggcttgtggccccaaattaggtactggagactccaggaggtcctggaaggtcttgaacatgctggtgggaacaaaaactgtgttcaagaagaccagagatgacaggagtgatgagggcgacctggacttctggtctgagtggttggaagggtcgtaacacactctaatgtcagtgtccttgaagctttggcagagaattagatttaagagatgtccataaaacaaccagataaaaagtagagaaattgtacattaaaagcttctgtacctcaagcaacacactaaagaaagtgaagagacaacccacacaatgggagacaatatttggaaactgtttatctgataagcgtcctcttatccagaatacataaataactctttacgactgaacaacagaaagtcaaacaatctagtgataaaacgggcaaaggatctgaatggatgcttctcccaggaagacactcaagtggctagtacacacatgaagaacacagcaccacgcgtcgtgggaggaggcgggtcagaccacagcaagggcccacccaccaccaccctcgggacggctggagtagaggtgcaccctgcggtcaccggtctggcagctcctgcaaatgccatgtgactgtagttccctcctcggaatatacccacaggaaagcagagcttaggtccacacggaaatttgtat

SEQ ID NO: 27652 - DNA, 629 bp, Bovine  19866880765812
ttgctatgctactcttgagcagcaggattactttgaggtctggtgacagcgtgggtcactgggccctgccctggaattggcctttgtaggtttacagggggctgagaatttgcctttctgccgagtttacagatgacactgatgaagctggtccagggagcacaacttgagaagctctgcttcggatccttgaccccttttgttttaaactgcacttaacagaaaacatgaaaatatgtggtgctgttcttttagaaatgctttttaatttttccctcaattaaaaaaaaaggcaatgagcatttaggatctatttcacctgtgacattttgattgtattccaatgataatacattaaaaataaatcaaataccttttaatgagttttccacatgtattaaggaagcaaaattaaatttatggtttatggttggctaaatgctgaatgttggggcaaatactgaatgcagtgtgttctccatacagaggcttcccacctatggcgtccttgtgcctgtcggacgtggtccagtggcttttcaccaactgcgggaggccccagacggaatgtcgacacaagtccatagaactcttctataagcttgttcctttgctgccaggtatggcga

SEQ ID NO: 27653 - DNA, 1182 bp, Bovine  19866881074949
tctccaggcactcacgataggtgtcaagttaggttatggggaatgaggggctgaggtgggtggtggagaaacaggggagaccaagtggaaagggatgtagacttaatttcaccttcccaagaaaattattctatgactagacccattctctcagaggcacttaagaaccaacaagacccaaagaaattctacaacagagatgcaaaaaaaagatttgcatctgagcagagatccaggtgagagcgagcccaacgaccacacacacacaacacacagacccttcgcggtgtgagtgtaaggtttcaagaaaacattcaaggacacaatgaggtgcatctgggcaagtctcagcagcattaggttttcagagtaagggcttcccttaaagctcagttggtaaagaatccgcctgtaatatgggagacctgggtttgatccctgggttgggaagatcacctggatgaagggaaagactacccactccagtattctggcctggagaattccacggactatagtctatcgggtcgcagagtccgccacgactgatcgactttcactttgcacttcttgcccctcatagcccagattcttcctctgctccccagagtggtgtgagggcagaacaccaaggtgctgctggtgatggctggaaacgggcaccttctcacaccaacgggagtcctcagcgtctcacccacaactctcattttcagttcaagttatatgtgcgccacaaactacatgcacttagacatatttttttaaattaccttaataagaagttctagggctggaattctacatttagcagctttatcttttgtgtaaacactggtacaaatattctaggatttaaaaagagatatcaaaatcatcaataagatcttacttcttataactaagacttaatagctaaatctacacctgggagaagaaataccaatacttgacatactacactttaatagttttctacaagggcctcagctcattaaattttttaaaaattagccacttaatttctaatacaatcaagcaaaaataagtaaactccccaacaagaaagagaaataaaattaagcttaaccatgttatgacgtaagttaccatgtaactttccatgtaagttaagagatgctgatatacaaagagggaagttttttcttcttaccttaatat

SEQ ID NO: 27654 - DNA, 1752 bp, Bovine  19866881148129
ctaggggtttacatcagtgaacagaatcccaagttgtcggtgggatgtcagccttgccgttcttttatactaattgataggatccctgagaacagggaatgttttcatgagttaagggtagagtgagtagtatcagttgagcttgcattgttttactttaaacaaaggtgttatttatagtgtctcttcatgggtgaatgcacactgaggagtatgagtaaaacatttctttaactagatgtgtgaactttgtgttcttaggactgcctctgaggggcctgggctgggtggagaacaggaactacaggcgttcaggtgttcgtaattacagccttcaatccacagtagaattgactttttaattataacaaaatctgaagcctaggcctacttctaggtgcagttttggtccatgtaaccttagttgtcagttgatgtcaagatatttagattagttttaacattcatctgagtaaatcatatttgattgaaaacagaagcttttatcagaaggtaaaccatatatatttccagttttttttcctttgacttcctatgctagtattatttataacttactttaaacataatttgaaataattatgaataaataattatgtcatagttttgaaagagtaaggtttaaagtatatgataattttaaaagaataaatgttcaagattttttaaccttttactatgttgaggaaaatcatttgactacgtgattctgtcagagttaaagatgtgataggcctgtttgctttgatcttaagacatagtttgtgttgttgtaagacgagagacctatgaaactatttagtaaaaattaaggctgaaaactaaagggtgaacaaacatctgtgatttcatcgtggccttctaccagcgtagactgccgagtgtttgtggtttgagtcttgtgtctgtgagtactgtaggactcctgtgggtttccctggatcaggagctggttgtgaactgctacagttcatgaggatgaactgtcgtaatgttacaccaaggatggcgtttttggagtaggagaaaaagcagatgacagaaactagaggaaaagagatgcatttttttctgaaagtatgtagactgcctgcagattgtgtgttccttgcctcctcatttgcatctcacccttgtggacgagttaacgtaacctgtgtgggaatgacataactttcctatctctcacttaattctgactgcatcgtgtgaggggactgcacggtggcccacatttttctccagggctttctgcggaagtgagtcaatacgttgtttctggctttacttgctggccctccctcccatgccagcgctgggtgcattggaattttccaggtatatcattagaggaggcagcacagaagggccggagcaagattcacagtgcctggggaagtcccagggattgttccaggaagtactgaaagtgagccagatggagtaggggtaaaaaaatgacctgaattaaaaatggacagaacacggaacagccttcatcatatttaacttttattatcatatttaaaaactgatttaaagtgtaagctgagatttctttttagcgtggatttcaacacctttttttctgcttgtgccaagaacacagtgttctggttaagtcattcagtgacgaagactgctggcttgctgccaaccagggtcaagttcattcagataagcttcagtgtagatagtaaactgagtgaggaacattcctctgtcttggca

SEQ ID NO: 27655 - DNA, 782 bp, Bovine  19866881272108
ctattacttggttagttgttgcttgtttttttatgttattaagatccctggttgctttatattattccagtatttatttggatttatataattagcagttttgtttttccatgtttgttaaatttttagcattagagatttagtaatttttcaaagtttacttttatgtaagtgaagtaccatatcactttagaagttttgagaattaaatgaattaataattaggcaataggagagtatctgactctagtatatagttcttgaatagtagttccttttacttactattctcttctttactcttttgttaggtaacagaaaggcttggcttttaatttaaaatccagtgatgatgaaattaatccagggtatcaaaagttaggatatttaattttaagcattgtaggctagtttagagtttgtttgtttgtttttaactgaaaaacttttataatttgcataggtcttaccatgactttcaaaaggtgtatcttgttacctgcacctgtgtcgagatacagaccgtttctatcaccctagagagtcccttgcccctcctccaccccagagctgacccggtcactacttctgacgccctagagtattttgcccgtcggagaacttggtgtaagtggaatcgtgtaacgtatgtaccgagaggtctgctccttttgactgggtgtgcctcaggttcacctacgttgtttcatccgtgcgctgcggtagtgggttgtttctttttattatgggggggatatgccacagtgtgcttgtcacttccc

SEQ ID NO: 27656 - DNA, 876 bp, Bovine  19866881490050
tatgtgcccacacggcccgcgtggaaatagaccgtggccgcattgccgagccctgcgtgtgcgagcgctgccataccagccacagcatggccctcatccacaaccgctctgtgttttccgacaagcagatggtacgtgccccctccacgtgccctgtccttgttctgcccttgccgggccctctgaagcccagtgtaacctgcccactcatgtaaccctaaaaccgcgcttcctgactgggttgacctggaagggagtaccgtccagaatgaattggaaaagcaggcagagggtgatgcaggctcacccaccgccaccctgatgtggccaccccacataggggagcattactcaacaatgctctcgtaatggaggtgagactgagttgctggagactagtgtgttgtggtgagcatagccatcttccagaacaacgtccctggggcagtggaggtgccaggtatctggatgtcctgagatgtccattccccatccttccagatcaagctccaggagtcccctgaagacatgcccgcggggcagacgccgcacacggtcgtcctctttgctcacaatgacctcgtggacaaggtccagcctggggacagagtgcacgtcacaggtgaggggctccaccttaaggcctctgacctggtcgggggcgcatgacctggggctgctgttttcagtgcctgcctctgacctccaatgtggtgccttcccagacagcagttgtcttcctgctgttgtccgaaataactagtgagcgactttaaatatattagccttttggatttcctttctttttaggcttttggaacacgattttagaatttttagtcaaattattaataagtgtacattcacttaaagaga

SEQ ID NO: 27657 - DNA, 2553 bp, Bovine  19866880423740
ggatcttcccacccggggatggagtctcctgcattgcgggcggattctttcccagctgagcccaagagaagccgaagaatgctagagtgggtggcctatcccttctccaggagatcttcccaacccagggatcgaaccggggtctcctgcattgcaggcggattccttaccagctgagctatcagggaagcccctggactccagtaccaaagccagagtcttctgactcccactgctgctctaattcttcccctcactctactgctaacacaaccaacaaacagatgtagatgtgacctcgggaaatcaaaaggttctagcgtgcaggtcattcaaaatcttattggatgaacttctgtccagtttatgtgaaggagtgcgggaaagagtgggttctgctttatttctatagctcattagtgaatcctaaccatactctcccttaggtcccttttccatctcagtctggttctcatctccttagaaagaaaaatgggatctttaaattcactcagttcatgttgggaagaggccaaaatcagggtcccattagtactccgctggaggagtctttcagcagcacagtctaggagaggcatttatgtctcctccttctcctcgtctttccctagcttggcatattctagctcgtgttttgctcttcctattaatatgagagaaaaataaaagacactattcatcttcctttgaaaagtttggcatttcagtggttttcttgaagtgtggggggggggggggggcctcatttgtaaccagctttgccatgaacggaaatcaatctgaatgtcctattgtgcatttttttttttcttttctcacagcctgaaatggcctttgccaagttttcaagctgaatctgaaagaccctctcattttccgctccctgcctccagcctcattgaacctttgcagagatttctcaggctgaagaagggctgcgctgcgaggactgagaggaacgcgacctactccgctaacccagtggcctgagccaatcacaaagaggattggaacctcccgagcctcccgcccctctcccttcccatcccctgccccttcaacaacctccgggaaagagggacgccggagggatgtgtttgggatgtgtttgcaattcaaatccttggctttctgccagcctcttttctaaataaaaggcaggagctgcggtgaggtgcaaaggggtctttggaattgcagtggccctgatatccggagatacccttatccgccgcttttatctgcttccgaagcaaacggggaaagagcaaggatggtggaggctttctgtgctacctggaagctgacggagagtcagaactttgatgagtacatgaaggcgcttggtaggtaaaactaagatgtgctgatctcttcttaaacttgcagcttcagatactcgcagattccttttttcacccatccgattagcaagagacaaaagcagatcccattgtcataatcacgtgctgtgctgattttaaaaaaccattttccacggaagggctttttaaatctggcatttgtccgctttcttgcctagggccaagtattctgtgaagaatgtgaagtttctgtgccttttcagcttttttttttccagcatcctattatttatgcttccaaattggcaatccacatatgacaaaggctcagtagtcgtctagcataactgatgggctaaacgtactttaatgagacttacactttacgacctggattccagaataggaaagtggattcctacttcatgagctattttggaagttgccaccaactgtattgcttctttttgctattttaggtgtgggctttgccactaggcaggtgggcaatgtgactaagccaacagtgatcatcagtcaggagggggacagagtggtgatcaggactcaaagcacattcaagaacacagagattagtttccatctgggagaagagtttgatgaaaccactgcagacgacagaaactgtaaggtaaggagccgctccttcctctggggtggggaggagaggagagaataactgttttttttttttccctagatgatgggaagtggaaaatgttctcagtatttcacttcagagagaaagacccagggttaattttgcattctagtgtcccatagcttatgttctgaataatgggcaactaccatagctcaaagctccaatctgtttctttaccacgtctttctctcattttgcatcaaatctgtatttcagaaagtatttcatcgtgttcatttaaaagaaagattgtactttgtttaatctctcttttgcctcaagttggcttcatcaatagtttacttcattctaagaccctgtttaaaggagtaggatgattcttcagaaagcactagtttaggatttttatttctgataatttatgtgcctgataatttttgcatctaaacgaacacatttcaatcgaattatgatttcttagagttttctcagagttttaacccggaagcaacagaggaaatggtactattgtataatgatcactattcattcaactatact

SEQ ID NO: 27658 - DNA, 2903 bp, Bovine  19866880483431
tatcagaaagcatttatatttctacataaacgactggaatctctatactaagataaaccagcaaatacatttatatacattcattttgtatttaaggaaaattgaaactaacgtaaaataattgagtcttcattgtgggtcgagtgggtagaggcttataaacataatctcatgtaatccttggagaaggcaatggcaccccactccagtactcttgcctggaaaatcccacggacagaggagcctggtggggtgcagtccacaggattgctaagagtcggacacgactaagcaacttcactttgacttttcactttcatgcagtggagaaggaaatggcaactcacttttcactttcatgcaatgtagaaggaaatggcaaccactccagtgttcttgcctggagaatcccagggacggcagattctggtgggctgctgtctatggggtcgcacagagttggacacgactgaagcgacttcgcagcagcagcatgtaatcctcacaatgactgtggggaaagtaaggaaggcatagtcattccttgtgaaaaagtgcactttgccaagcgtacacatttggctagtgggtggtgaagttaggatttgagcctgatttttgtctgatgcttatgcctgtgtccttgaccaccttggatagggagatttggcatgagctaaaaagtatcttgtgtccatcaggtatttatagttgatggttgaaaatatacatttttaaggaacactttatcccttattctatgaactctaaaaaagagatgaaacatttttctgattcatttagtgaggagcatttaacaaaaaaaatttttgaaaaataataaaagtgttacaaaaaagaatataacaaaaattcactgaaatactaaatatagtaatgtagaaatcaataaaatagaataatacaacaaaatgatgtttcttctagaaatgtacaagtgattaaatattgagaaatttattgtaatttcatagtcatagactaaaggataaaactacgattttttcacttcctgattccaaatgacacttgataaaatgtaactatatttcttttaagaacacacatttataaaatttagtaacataggaatagagagctgtttttaaattgtgaaaagcaggaaaaaacaaaaacattagatgcttacaacatgtcctgtttcatcacttatatttaattagcgtctatagattttaataaatacaataatttttttaaatagctaacattttaaaaattcttattgtatatgctagaagctgttctaaatgatttacaagtattaactcatttaattttcataacagttctagggaatattgactactgtaattctcattttacaaattaggaagctgagacccagagatgctaagtaacttggccaagatcacacagctaataagttgtgtagctaaataagcactcaagtggcttaactcatgagtctttaattttaaatcatatgatatactgcctctcaaaggtcatagttattagcagagagatgacatctttttttcttaaaagagtgtatatatactttttttttactaaaaatcccaagaaaattaattgaaaagctgttagaataagaaacttcaggtaagtggacatacagaggataaatatgtacaaatcaattgacttttctataatagctacaaatataaaatatgaaaaatgccattataataataataatgaaatatcatatatctatgagtaagctataatagaaatgtataagatttaaatgaagaaaatagcatttgattgagaaatgcaaaataagattagcagtaatgaagattgatattatattcctggatgagaataataaatattgtaatgaggctagtttccccaaaataatttataaaattaatgctattccatataggaccataaaaagagttttagggccaagttggcaaaatgattattaaaattcatctggaagaatgaatagactaggaaaagcaaatttttgaaacagaataataatgaaaaagaacttctaattccaagtattaaaacataaaaaattactgttactaagacagtatttcagtatgttactttttactaaaataaagacttaggagaagctaaatcatcttgaaaattctccagatttaagcatacaagggtaacatacaatgaagactgcatttcatgttggtagagaaagtattgattattacaagaacagaatcctaatagtgaattgttagcaaaaattgtaaccatgaatcttttgtttgtatgaaatgcaaataaatattagtttaactgaaaaagaagcataatgagatgtaactgaaaaatcggcaaacataatctggtctaatatgacatcaaaggcaaaaaccgtaattggagattgatagacttgactgtgggacatattaaaactttttacatacaaacagaaaggggactcaaacagcatgcctagcactggatctgaaaattcttttcaggatagaatgaataaatcagcaagtgctgaccaatatcccaagtgcactactcttttgaggcttcataaagcaaagcccatcctggaatagtgctcatttgttattgtgctgtaggcacggagcaaattccaaagatgaaattctagaaatcaaatcatgacatggaagttagggattgttccacctaaaaaggtcagctaaattagaattgtagcatacaagagaataaggaattgcagctagacagttctataattcatacatatgccagggcatttcatttcaatagaagtgatttacaacatcattgagtaatgtctggagttttacaatgtattaaaacactttatctctaataaaagtgaaacaattctagtttttctgtcttgaatt

SEQ ID NO: 27659 - DNA, 1021 bp, Bovine  19866880517811
aggttgcccatattagttcattagtaataatagcacttaatagctgctatttttttttaactgcctcttaagtgtacgatgttcatactgggtcttttgcctacatcctttgatttcatcctagctctaatgaggcagatcttattagcctcattttacagatgagctgaatcatagtgacgttaagaatagaaaagcttcacggctgtgccaatagctggcatgattcagactcaaagggagggaatgaactagattatcttcttggcttacttcagatactgtgaatccacagtgtatttctttctgtaggctacagtcagtagagttggaaagtcgtggctgtatattaccagaactccacaatattgaaatggacctgcattctagaacctggagaggtctttgcaacagaagaggtctttgtcctgcaaaacattcctgtaaaagtttgatattaactctttatctatacagctatatatatatagctatcaaagaaagtagctcttctttctttttgagtaaacatcttaaaatttccatatgaataaattcaaagcaaaataaaaatatggttaattgttcttttcttttgtaattccccaaatgcttttattgttcattgtacttttaatatattcagaataatttaatttaaactctggttacttaactctatttgcctgccaatttaatcattgtgcacctgccatatttgtctctctatagcctaaaataaagaataaaactgattataaaataaaatgcttaactctatcttgtattcattctgtcaccctattattgaaatactgaatagcgtctacatgtgacctgtataactatcagaatactgtattctaaattaaaattaaatgacagatactatcaatggttgatgtcctttcatcctattatgctctgtgtgtggctttccatgttgatgtcagatgaccattctgaaaagagtaggatgagatttcatatttgctagatttcttttctagcaaattgaaaa

SEQ ID NO: 27660 - DNA, 1351 bp, Bovine  19866880538473
acaaagactgctggggaggaggcctcttgacatcactcatacgctgatcttgcctctaaaataaattcaaaggaacttttatgtttcctacaactagagaatttctttgatgctaatcacactttagctgtttggaattgttctatctttcaggagtcttcatgttcttcataatttatctcagtcataatgagcataattagaagtttgtctttttgtgatcttttagcaatttaaaatatatcattaaatattgcaataaatatgaagggtgagctttctgcattaatagtgctcaataatatattttaattgcattatgaaaatgcatttcataatgcattttcagcattatgaaaatattttccaatgtcactttggggaatcaggagagttaggccctttgtcaatgaagtttgtagaactttgtttatatcagtgtggtaatacagtggagaggtaaaatgtcatttctcaagctgtaatacagaaacttgataggcatgaaactttatcattctgaaacatgtttttggttaatcagactgtaacttaagtgctgcactaatagaattttaaatcagtaagttattatcactcacaatagatatattgattagggaaaacataaagattttactcactagattcttatttcaaatcctttctgtcattgaattgtgagtttaagtgcattttgttttgtgtctttgtattccgtacagctctgtttcctttgaacacatagatattctagataagactgtcagactaaaagatagagtgactcttgggaggtattgggggaaaacctgcactgagaatctgaacagatgttagaaatatgctttaatccctcaaggctcttcagatgtcagttggcttatgtttctggacattatctgctggatcacattgagctatctcaattttatattcccagggattgatttcattaatgaagaacatgccaggacttgggattatctacaatgaaagatgatttcttcaggcctggtgagctgaaagatgactagatgaccactttgcgaatagaagaaattaaagctcagggctggtgtgaagacttttaacagcaagctgaaaaaacaactggacacacgtcagaactttctggcaagtgtttacaatcaactggaacaatttcagggcacattaggaagaggaggaggaagaggcctgaactgctgctgtgagaaactggtgcacggagttctcatcttacagcaattaaatgccaaacattcccccatctacagagagaatgatgttgggttgagtgaatgcttagagtaaaaaaatatgtgttacagaaacaaacaggaaatat

SEQ ID NO: 27661 - DNA, 1738 bp, Bovine  19866880573926
ggttgcaaagagtcggacaggactgagcagctaaccacagcgcagcacatgaactacacactgttggaagttgtagcagatgagaggacttgtacttaggggaaaatctggaccaaaaaagcaaataaatgatacatatttatcttttgtactctttctcctatcattttttttggaaagcacacattttgtgggctagatacatttatttgaatgatacctatctgtttacacattgtcttgtttcctgatattgtttcttgccaagtccttacagaaacgttgtagattcttatatatgccttgtttatgcttactgaatgaatgaataaatgaagaccagaaaaatgccatgtaggtctggaacattcctaagaaataaatcatctagccctatcccattgtaacactgtagttgaggaaattgaagtctggaaaggctgtataattataattagatgcagaggggagtcagtatccatttcctttgattctcaatatgttttccattgtaataatacaactgctgttaaattgatagactctttacaacttttgaccccaggattgaggaggttcttacttctatacctgaacctagactgaccataatataacttcctactatggaaatatctcttacagtaagacatatgccataacccagaaattctacttctcagtatgtatataagatacatatatatatgcatatatatactcagtacttatataagatacacgtatataagatatacaaaagcaaatgtttatttcatttatcttaataataataaaatcctgaaaagaagtcaaatgttttctatatggtgagtggttaaatgactcttgatatttttattttattaaatattatgcgacagttaaaaagaacaagccatacctatgtctggggccttccaggtgtttcaggggtaaagaatctacctgccaatgcaggagatgtgggttcgatccctgatctgagaagatcccctagagaaggaaatggtaatagactctagtattcttgcctgaaaaccctatggacagaggagcttggcaggctacagtcagtggggtcttaaagagtcagataagacttagagactgaatgacaacatattgatatctatgtttggttatagcaacagaattctaagacgttgtacaagaaaaaatgaaagctgaagaatatctacagtatataaaacacatagacacatgaaaaataatatgtatagctatactggatccatttgacatacagcattaacaaagggtgggaaataaatgttaaatttttgatagacacagttatctatggagaagatgagactaaaagtagaaggcagcttaatagttatcttgatttcatctccaagtttaaaatttgtgtgctaggttgcttcagtcatgtctgactctttgcaaccctatggaatatagcccactaggctcctctgtccataagattctctaggcaataatactgcagtaggttgccataccctcctccagggattgaaccctcgtctcttactttcgctgcattggcaaacaggttctataccactagtgccaccttggaagtccttaaaatctgtaaaacacaggatatattcatgagtttttttcatgtaatgtgaaaaaagatttttaatagcagtattatccaataaaaccttaatgtgcctctgttctgacattcctttacactaggggctaggaaagaata

SEQ ID NO: 27662 - DNA, 1336 bp, Bovine  19866880646053
cattgagttggtgatgccatccaaccattttcatcctctgtcgtcctcttctcctcctgcccccaatgcctcccagcatccagggtcttttcaaatgagtcagatctttgtatcatgtggcccaagtattggagtttcagcttcaacataagtccttccaatgaacattcaggactgatctcctttagaatggactggttggatctccttgcagtccaagggactctcaagagtcttctccaacaccacagttcaaaagcatcaattcttcggcattcagctttcttcacagtccaactctctcacatccatacatgaccactggaaaaaccatagccctgactagatggacctttgttggcaaaagtaatgtcactggagaagggaatggcaaaccgcttcagtattcctgccttgagaaccccatgaacagtatgaaaataatggattagagggcaacagaatggaggcaggataatgagtgaagagatccatcgaatctagacaggctggcacccttaactggggtagtgaacgaggcagagcagagccgttggcccatcagttcaagagctatttaggggatagactttgtatggcttgatgatcatggaaggtgagggacaagagtgtctgctgggtttctgacttgtacaactgggtgggttatggtgctgttcactgaaagagaaaactcaggaggaggaagaagcttcaaaaggaagatgaatatctctaacaggaggggatgagacccgctgatgtgtcctgggcttttcaacattaactggccttccatgctgacagtatcacacacagtgtcccacttaatcttctcaactgtgggaggtattattatgtgtactcaaaagatgtgggagccaaggctcagagagcttaacgcctcacataacgtccctgttaataaggaacagaggcaaaagttcagcccaggatgctcagctgggtgtgtttcatcctaaagcacacataccctctgttctgtcactctgttttccttttagctctgacacatttaattctgtgaaaataggtcactcgtgaaacccaaataacttcagactttctgggttgttaaattgaaggcataaactttactttctgatttattatttctcacttggaaacctgcacctgcctccaaactcacctctagaatccactcttcttttccaatctattccattttctgtaaccaaagtggtcttttttaaagttcatctttgattgccacactgttgcttaaaagacttcagtggctgcccagcacttctgaaagagtagaccgaatccttaacatgccgcaatgatgtag

SEQ ID NO: 27663 - DNA, 2458 bp, Bovine  19866880775697
gagaggctagtgaaggctttaactgtatattaaacaaaatgaagcaactgatggtttgagttgcattgcttttgaaggctttattagagttgtcaaggaaaaaaaaatctactgtgctctcattgcccttcaagcaaatctacttaaatatcttctgctcagtcactcagttgtgtccgactccccatggattgcagccctccaggctcctctgtccatgggattttccaggcaagaatactgaagtggggtgccatttccttctccaacttaaatatcttgaatgacccttatttttgttttaaattatgtaggaatattaagattgctttaactgaggtaactgcttatgatcaatacctctctttgctgtgattaactggtattgatgagaaaggatagtcctgttaatactttttaataaaattagaacattaagctcttcagaccccaaaatacttggaattattccagcacaattggagcttaaagaaacagataaatgttttgtggatctgagcctccatgggctgccttctgacagtcagataagttttggcatagctgtattatctaggttggtttctgacatcttttcttttttttgtcagtgggccagaatccaaataaatatttttggaagcaggacaccttgttcaaaagttgacaagcccaagtaaatattcatgtttaccaagacaaaaagagagatgagatgagccaaaaacacttacttataggcacttattttctttatgtaattgatcctaaagggaagatgaaagctaatgagccccagggacttgccccgtaattagttttacactgttatggatacaatgaacataaagcgatgcaaaatttatataaatgaatgcctttgcaattttgacctgtaagggcaagagaagcatctgctttctgttgatttagtgaagaagtttctttatataaccatctcttgggatatgattagtaccacagaatcattttatagtgagatgcttaatggaacaactttactctgtgacagaattgtcaccaaactattttttacattgtttaaaatcaaagagactatcatggtagtcagtttgtatcatttatagaaatgtttaatgaaccagaaaaagtatctatttctctatctttgtcagcattatgttccaataacacagctgaaataggattatgggtttcaaatgaattttttttaaagccatgaatcacgttttctaaaagccgtttctttttctttcttttgaaaaatttactgatgtatagttgacttacagtactgtattaatttcagatgtataatatactaattcaatacttttcaggttaatgtataaagttattataaaatattgactactttctctgtgctgtagactagatccttatgacttacttattttgtaattggcaacttttaccttttaacccccttcacctatttcacccttccctcaattccactctcttgaggtaatcactcctttgttctctgtacctgttagtctgtttctgttctgttctatttgcttgctttgtcttttagattccacataaaagggaaaacatacagtatttatctttctttgtatgatatttcactaggcataataatctcaaagtccatccatgttgtcacaactggcaaaatatcattcttttgatggctgaataatattccactgaatatatatatatatatatatatatatatatatatatatatataaactttctaacagaaaaatctcaagttaaatatattgggaagtccagtatctctaggatctttggttaggagattttcatgagtttgtactagtttgatggagctgaaggaacagctcttgggacttgggatagagatccttaagcctccagtttatatcttgctattcgggtaggtcagtgaccagttcaattccagagtgggtcctctcctttttactgtcaggttcctgcagttcattctacctagatactttaccaatttacggtccactggagattcgctctttcaggagaaagtgacttgaatactttgcaatgaaatgcaagtgaaaatgcagatgaaagctgacaaatgtatttttacataaagaataaacactgtccgcagaaccttttccccatcgacctccaggttatccttgtttctggggcatgtaaggatgtgaccatgttaaaatagagcaggtggaagagcagagatggaggaacactttgttctcatatatggaggaagccacgaggaaatgtaactcgacttttgttctgataattagggaagaactttcttatgaggaagagataggatctttagagaaggggaccctacttgccattttagactttattctaaccatccagaaattcataaagggatcctgtgttgagtgagggtagaccagatagccaaggccacaagccctgtcctcac

SEQ ID NO: 27664 - DNA, 3141 bp, Bovine  19866880801443
ttttgaccatatggaccttgttggcaaagtgatgtctcagctttttaatatgctgtctacgtttgtcatagcttttcttccaaggagcgagtgtcttttaattttgtggctgcagtcaccatcctcagtgattttggaatgccatttttataattaaattcagttacctgtgtaattttcaggctgatttttatttgttgactttgctcttaactataagctgtattttccatactggtatgcctgccactttcttactagctgttagatattgtaagttttaccttgatgggagctggatatgttgtatttgttaaaaaaacattcttgctgttcttagacatatgtgagttatttgaagagaaccttttcaaagtttgcttttaagctttgttgagattggaatggctttttttagccttatggccagcttccgcccactcccaccccccatgctgctgctgctaagtctcgtcagtcgtgtccgactctgtgcaacccaatagacagaagcccaccaggctgccccgtccctgggattctccaagcaagaacactggagtgggttgccatttccttctccaatgcatgaaagtgaaaagtgaaagtgaagtcgctcagtcgtgtctgactcttcgcgaccccacggactgcaggcctaccaggctgctctgtccatgggattttccaggcaagagctgtgtagtaaaaatcttataattttactcaaggatttttaacgttttttccattctgattggtaatacccacccccaccctgccccctagaggaatttaatcaaatacatatgctgatcagtgctctgctgaagacagaaatggaagcctctgcagatctccagagctcaatctcagtatagctttctccgttaattttttatgtcctgtgaactcttatgtgccttcacttccctaaactctcaactctgtcccaactgtgtctccagttcagtagactgctggcctgtgctggcctacattggagactcttcccagggagaaaaactaggccagtcatagacttcacattgtttcatctctcttagaaattaagtatcctaaattgcctattgttaactgtctgaaaaaccattgtttcactttatttttccccacggattaaggcagtagggtaggtctggtcactgttactgtgtcttggcctgagtttatggtacttaatccaaaatttatctatcagtatttttattttcagcagagacattactttgccaacaaagctctgtctggtcaaggctatggtttttccagtggtcatgtatgggtgtgagagttggactgcaaagaaagctgagcaccgaagaattgatgcttttgaactgtggtgttggagaagacttgttgcaagtcccttggactgcaaggagatccaaccagtccattctgaaggagatcagccctgggtgttcattggaaggactgatgttgaagctgaaactccaatactttggccacctgatgcaaagagctgactcattggaaaagaaccctgatgctgggaaagattgaaggcaggaggagaaggggacgatagaggatgagatggctggatggcaccaccgacccaatggacatgggtttgggtggactctggagttggtgatggacagggaggcctggcgtgctgcggttcgtcggacacggccgagcaactgaactgaactgatttttattttcagcatttttgttttgttccatttttgttttgttagttttttaagcaggcttttccccttctcatttctcctcagccctgcagtccttttcagcttgttctgttctcttctgtttgatctctcctttttgcttcaggtgaaccaattttagggaatttccttttcttactgagttatgttttatttcagattggatttttcaaatgcttttttttttttggtcggggcatgtttgtttattttttgctaagatgtgtttgtgttgttgccatgctatttatttccgaagttctgtataagtacttctgatcctaccttatattggttactgtagtgtgtctgacttctgcaatactcccttcctgtggtatctggtggatggtggtgctcaccctagagtaaggtcaattgttactagaatactttcgttttgccttcctgagatattgttaaattccactaccggcgtttgcctcacgtgctcagggagatagccttttcccctgggatctactactagtttagtgtggaattctgttagagaatgctagctcaccccactcgttcatttaatcctattttgcctaattctaataggaacttttacttggtggttatcaccaccactaagtcagaagagggaaaagatgagaataccagtttacttcttttccttctctgaagtatctgagaaacctcagacttttgtgaattcagcctgatttctgggggttaaaaggtaggagttggagatccacttacaattaatgaatatcccatttcttttctcagctaaactttgggtcttgttgctgttttttttcttcatttttaactgaacttactcattttgcttgatataaagggcactttttttttttttttgctttattttgcttcatttttacccagaagttaccaagttttatagtctatagataacttgtgaaccagatcactttttaatcaacttaacttcatccttttttgagtagatagaatgtagattttcactgtatcattttagactgtactgatttttaccgttctttttccagatcccgtgtttgtgtggcagtgccccgtgtttgctgtgccgatgctgtcctagtggaaataactccactgtaactaggttgatctatgcactttttttgcttgttggagtgtgtgtagcttgtgtaatgttgatacctggaatggaagaacagctgaataaggtaagtctttttttttttttttaattaactgaacctttagtgtgtgtgcctactaagtcacttcagttgtgtctgactctgtgaccctatggactgtaatctgtcaggccttctgcccctgggcttctccaggcaagaatactggagtgggtagcctgccctcctccaggggatcttgccgacctgcctctcttaggtctcct

SEQ ID NO: 27665 - DNA, 1115 bp, Bovine  19866880909421
aatcaaaagcaccttttgcttttctctctaaccacccactcccgcaaagctttcaggtgttactcaattacataggtacataaagatttgatgtgttaaatcacattattggcatatctttaagttggattcaaatggccgttttctccagttacactaaattggatttcttttttacatatatgttcattaaccccagttaaacttttcgtttgtttgttttacttgtttgatgctgtcttgtttgccttgagtgtaagtcactataactaatggtagaactcctaaagctttctctgttccagttgcttttattgagtattttcacatgacttctttataaaactgggaacataaagtgcctgtatcttgtaaaacttcatttgtctctcttggttcagagaagttcattcatgttcaaaaggaaggcaacatatacttgagtgcttgctgtctgatacagtttcagctgcatatattatagacagaaggggatgggatggtgtcaacccatccagctcactggactagttttaagtaaaagttttctggcttgttttgtgtttttttgaagcatactatttagtaaaataaatataatgaatgttgcgtatctagtgtctgttatgtgtcttctttggagtgacatccacatgtgacagtctttccttttcatatgaagtaggtagatgtaaactgtgaactttgtctgttgtccattattctaaacatgaatcataccaagctctttgtgcctcatctcagaggataggttgtattgcaacaaggaggaaaatataatgactccaaatttaatgtgttttaagttctttgtttaaaaattatactggcttactttctatgtttctaataaagaattgagaaaagaatgcttccagttgtccaaattaggtatgaacattatcactggatgcaaagtgcctttaattttcaccttgagagaaaagagaaccagttaaatcactttgaaacatttgctcagaaggattagagagacttaatgcaaggacagagaaccatcacctgaagaattctaccttcgagcagagaactggaagcagtgagctagtatctgaatgctttttaaaataggg

SEQ ID NO: 27666 - DNA, 1797 bp, Bovine  19866880918313
acacacacacacacacacacacaagcgcatagcttcaattatcttctcagctttattctagagccaaacatcttattttatgatcttaacacatatatgtatggttgtggaatattgtgactaaaacatttcatgtgccactgaatattgttttctggctacctatcttataatttaagttattggtatagaaaaagcctaggaaatatacatacatttcagttattggctattttaattaaattttaatgtaaaaaaagtcagatgtccaacaactggttgtttgaatttttaataattatttatggagtatctcgtatttgcatctgtttttgaaactgtcaaatattcttagttttacattattattttatttcactcagtatctaagtccaaagtgagggcaatatagtcaccttatttggctgggtcagccatcatcaaaagacttgaatagtgtggaccacaaacaataactttcttctgctagaacttggctgacaacacaggttgtgccttctgataaaaaagtaattcacaatgataagtatcacatttcagatagtcattttaaccccataatccaagttgttgcctctaagcaacctatttgagattactgttctaatacctatctcaatttaccaacaattaacatgcaaaatttattcctgtcaactgcaactgccaagacctaaacagtcactcaattaaaaattctgtcctgatcactcaaggtctctgaaacaacagaagatcttgatattactgcttgattgacctcctgatcagcttatggagcttatgccttatgccttaatttgactcaaaaaaaacctaagtactggagcatagcaattcattgagggtttaaagtagaacaaaccactagtaggatttttcattgaatgtatctttttaaactattgtctaaaatgacctatctgtttcagtaaatggtgtgtcatataaggaaatatcattaataactatcagaaatgaactcctgaacaatgagacagtggttctataccctagctgcactgtaagaggcaaacttttatattgaaaaatattttaagagctgtagtttttcctcatcccctttcctccacaagcatgatatgaagtaaaacttggtgaaggctgaaataggtatctcaggctttacattccatatccctgagtgtaccagattatcttctaacacccattttgtaatgttctgccttgactggtttttaaatattacaaagaaaatatgtttctactactcttcttggaagattaattctcctccaatctttaatgctatattcaatccttaaaacacccatgtaaattttttctcacagtgagaattttacttgttgaacttttttctgttacagtataataggactttatatcttgaaataaaaatatatatcctccacaacagggtagctacttaacctggtaatattttacatatgtgagtagtgagatgacttcagctattcaaaaagcaatagtaattcattaccacaccaagttgaaattatttcctcctttacaatagaaaagatgaagcaaaataatctttaaaagtaaaatcacaggttttaaaatggtagctgtttctggtgctgtgtgacatggaaggaaatgtgacctacttagaaatttcttaaaaaaacagattctcaattattttattagctatcatgttctgatacttttcaattttattttttcctttgttcttatttttcattcatcttccactatttggcaccagactcaacgaacacactt

SEQ ID NO: 27667 - DNA, 649 bp, Bovine  19866880937661
gaatgctgaggacccagaaactgacagcagcagaagtgttcatcccccactaggcttgaaagacaaaggaatgagatagactggtgttgtcagaactcagaggttaggttgacttgaacctaacctctggaaccacagtgggcttgaatggtgggagctgaagccaaagaggaaattcagcctttctcaaaagagctgacaaaagcaaaggatggagagatgaagagagaattactagagttgctctgttttccctaccctccagtatcttgcctctcaatgaccagaagtcagttgacattgagccagggaaacaccacctgcagaggccagctcagagcacaggaaaaatctgaagccaacagtgttttcatctttaggagatcacacggcataaggccacatcactgtgggtaggagtgggtgtggggtgtcccatggaggtcctgctgttgccactatcagcttttctggaattgattctgatttaggcagtgaggaactggaaaagaaaactaatggaacactaggcagcaataggaaatgagtttcaaatgcattatgctaactgagagatgctagacataaagaatatgtatactgagtgattccttttatataaaattctagaaaagacaatagtgatgga

SEQ ID NO: 27668 - DNA, 800 bp, Bovine  19866880994517
gggtgggatggagggtacctgcacgagccgtcttacctctaaataagtgagacagctaatgcagtttggtagattcctaaaagtctgttcctccagaatttctcccttactcaatggctatggtgaataaaacttttaacactggaagtattgacttttagagaatcctggtgaatggattatatctattttggggccatttagaaatctcaatgtgttagctggaaagtacaacacattgttatgttagtactcattcatcttaaacaatgacttgtttatagggttgagagtttgaaagaacatgattctgaggaaatgagagtaattattcaaacagggacaagagtcataaaacagctataggtaagagtgcaatgcaaaatttactcatgttgaaattttggatagaattgccaagactatttctctatgttattaattacatgctgttggaagttcttctttcaatttcctttcccttctctcctctccctttccttcctccttcctttcttctctctttcattttacatttatttaaagtagaatcttacatttgaatactccattaaggggtaaaattgaaatacctattggcatgatttaacattcattaatatcatagatcaaaatggtttgaagaactttggcagacctcactggagagagtgtaaaatgggatagttgcccagctcacctctggagaaaaggtttagcataaacatgatgtgagaggatgagcgagtcccacccagatcacagcaggcctggctgcagtcttattacaggccagccga

SEQ ID NO: 27669 - DNA, 4320 bp, Bovine  19866881019429
gggctgttgaaggtcaaaagcttcagcacacaggggttcagtctcccccagaggcagatggcagatatcactgctgttcagtcgccagcaaatgttcttggcaagtgccaatttgcagacagtatgcagacctgtgaactaatcctcttcattttctttttcattccgtgtctaattctaaactttgtatatctctcattcaattttttttcacaatcaacttttagtaggctcaatgtttggattgttttgcttggctctattagaaggaaatttatattttcatgttagatacctggaattaaacatttcccatacacccatcttaccaaatgtctctttgaaaggagtctatcaaaaaggatgcaagttggtacatagaagtctctagaagaggaaagtgatgataaggaggtaaatacagccaggcaatacgtgaaagcttggtgagagttagatgcatggagatgtgcataggtgagacaggcagacggataggtaggtaaagtaagtagataaatagatgcagtatccatgaggagaagtagttcagatcccagggccagagtaagtgagagctggtgcatttcttctagttccactcgtctctaatatcaccaaaaatgtgattgtaagtaacctgtacttagtcgctcagttgtgtccgactctttgtgacgctttggactataactcgccagactcctctgtgtatgggattttccaggcaagaatactggagtgggttgccatttcctcctccagggcatctttccaacccagggatctcctgtgtctcctgcactgcaggtggattctttatccactgaaccattggggaattaactatctctgctcaggaaaaacagaattaccatacttaaactatagtttagaggtcatctgatgacctttggtcagtgtcaaaattcttcgaagtgtttcttgcaaaagacacttgcactttcaagaaatgattctcttctcaatgtttacgttagaactaaatgacacgccaagtgtacacaattcacaaaatttctgcttatgaataattagtggagttctctggaagctttgcatgcaacaagcatcatcagtcctgggtgttactacacggcactgctttcccttcttattcttttctccctctcttctttgtttattctatatcctgacactgtccgctcactgctgatgttgaacttgaagctttcccaaatgtaaacttcagatagtattccatcagtcacgctccccctagagtccccacaatgcccaatggagaggggattaatgttggaagtggctcactccagcagcctgaaggtctctttttgtttcatgctttagggacgctttgtcagcctctgaatactgtctctttggttggctttgtggagacagcttgtgctcagaggtgatttagttgtaagctgattgctgctccacgtgtgaagagagcgtgagcagtttgcaggcagccagtcaggacgcccccagcccatgacatcagcatcgcatgatggggacctggggcagcaccaaacagtcgctccttgttgctatttttttttttttttggtctttaagaaaagagaataaagcctgggaaaagagcaaaagatgcctgctttttctggagaattactgaatgctcttcactgtaacacccaccaccaccaccaacaaaaatgtgactcatgttctataacagaaggtgggaagcacagggacacaagaccaaggggaaaaaatagtacagtttagtgagacttgggactagtctgtcagcttgatctgttttggtactttattgaaccctcccccatgactcccttcccatttttctagtggttatgttaatatttatctagaagcgtatgtgtactaacataaccgagacaaagaaaatcagatttctgtttgttttgattttgatcaaattaagtaggttgctttttcctgtttggcattgtatagtacattgcttactgtggactgcatgcttaaaataggaggtgagctagtgccagtccttcacctgcgtcatttctcatcaatcacatgctggtcagcagagtcacagcacgtggaaatctggtgacgcactggctaccgatcccgtcgtccggtaacagtcagggcaattcctccttctgggataaccgggccaagaatatgccctatgtccccctgaattgtagtcactgctgaggacccacgtccacagttggctttgtggtgatcggcagtgttttgaatctgactttcaacttgtgaccaagaggtttttaaaataaggaacttggttctgctgatgtccactaacatcttcatgacaagtggaccaaactcctgaaagtgcttcttgctctttgtctacaataaaatcgcagaattatctctatgatctcatgagactaacaatggtattcttgctgataacactcatcataaatgaaagaaagaagcatttgtgttaaaaatagttaagtataaggaattttccctagtggtccagtggttaagactccatgtttccactgtaggaggctcgggttccatccctggttggggaactaagatcccacatgtcacaccgcatggccaaaaaaaaatagtgaagtatgctttcttatatttcttggaagagagattactgcttctgagaaaacttgtttcagttatgaagaagaggcatccaagtacagactacaaatctttctgtcacttttaataaagttcatttataatattactttatgcctgtctcctttcccttggcaaagaaaactcctgactgtagcagctaaaatgttaatgagaatatcttttatgtattatttaataagttttgttaatttgattacataagtcaaataacatcctcattgcaaaaaattaaaaaatgtagaaaacatgatggaggaaaatcttccatcattccactccttaaaggaaacctgttaatatctgttgtaccgattggctgacttgccaggaggacctgggaagaccaaccatccacgttgattctggcacctttcctttgttgcacttgtcacagctgaaatgatcttgtccttggtgtaatttttattttttgactctctctgcttcactaatacatgtattagctccatgaagacaggtgttttttctcttttgttcatggttgtatccccagcaccaagaacgatgcctgacatttgaaggcacttactaaatatttgttaaatgatgctttcatgaatgaatgtgagtattgtcttattcccttgactagtccttgcttagttgaatttatcctatctgaataattttgtatcttgaaaatttaaattaacatgataaaaatagtatctctgcaagcttttatgtggcatctttatgtaacgttgcaaaattggatgctgactatcgaacaccatgccttctagtgagtaggacaggatttatctgtgttcattcttgggtgatggttatgacacttaaaccaagtagggccctttggggctcctaggcatggaagcctttcaaacagttgctaatcaggcaagagaggggatgcagagatcagggagaaggaattaaggaacaatagagcagccttgggcagggttctgatcctgcctccaggggtgcatgtaatagtatctttcagctctcctgcagaactaaaccaccaccaaaggaagtgctccagagagaaggtcacagtctgatgactttgaagctcatcaggaggtcacctgaggccagattaaaggaatgcaggccctacgtacaacctgagccttatcagcaaacttacccttgaaccattactataaagaaagaaaagcgtaaggaaagaaaagttgtcagtcgctcggtcaagtctaactccttgtgacccccatggactggaggccgccagactcctctgtccatggaattctccaggcaagaatactgggttgagtggccatgccctcctccaggggatcttcctcacccagggatcgaatctgggtctcctgcattgcaggtagattctttactgctgagccattaaaaaggctcctccttattccctcttgctataaaatgcctcatcaaatctccccaggttgggacacatcgattttgtagcgtgagcctgctgtgtctccctttacctgacaaagcaataaagccattcttttctattccacccaaaactgtctctgagatttggcttggcaccggagcacaaaggccaagttgttggcattgttactgcatttacttgtgtcattcgtttcaagctgcttttcttctgtctccagggcagag

SEQ ID NO: 27670 - DNA, 1206 bp, Bovine  19866881256630
attcacataaaagcataacattggccacctcctgctaataatacacatgtttcacaaggggcaagtagcatattatccaaacagattaaaaattatcatccagatagataattcctagaggagtggggagcactttggcttctcattgtgtgaattatctggattattgctccaattccgttttttgccctgggagtaagggtttagactcagaagcctctaagactacagcagctctacctttagacccagaaaccatggtaactgatagctacagcgaaggcaactttcttagcagctgtgtattttctagacctttacagctgagacatgaaacattgcttacaaccagccaatcccacagaatccacagtgagctcattgccctttattgatatgactggcaccattagcttctggatgaatgtgcacatcaggcaacattgtagaaagaagagattaattgtgtgctgttcttttttgctatcatcattatgtggcaaactatggtagctctctctattttattattttaattaaattcccaggagacagagaaaagtaaggagatgtaacgtcctgaacataaaaactgatgcttttattttttctaaatatgacatgtaaatatatttttctcataaaggaatatcccagagattatctgtctcatgggctataaataaaaaatagacaccaggatatgggggggggtgtgtgtgtgtgtggtgacgtgcatgctcaatcatgtccaactctttgcaaacccatggactgtagcccaccagattcctctgtccctggaattttccaggcaaggatcctgaagtgggttgccatttcctacggcagaggatccccctgccccagggaatcgaacgtgcatctctcgagtctcctgcatcggctgtgaacctgtgccacctagggagagtggtaaaaacctggaattttattaaatccaatgacactgaagggtagcagctttattattgtggggctccacagttttttaatgggtcattaaataatctctactaattagaatgtaaaacttccattcacagcatctaaaaaatattgaaagggagagtgcaatagtttatagaacaaattcaggagtcagactactccagtcagtcacctgccatatgctggctatgccaccttaagcaaactactatctctcttgtgcctcagtttcat

SEQ ID NO: 27671 - DNA, 1285 bp, Bovine  19866881394439
acactaacttcctgagtgctcagtaaattgaatggagcttgtccttgcagatggacttaattcatacaactgattttctgcttagattttcctgtctaggaaggatttctgccccaagcatagtctccttcactggaacccttacattttacctaatttttctaatctctttcacaaagatgctattcttttccttgccccgtatcatctctgccttatgtcttgtcctttcgctaatgggctgaggacatggaccctagaggctgaagacctacatttaaatccaatttagatatgaatatatgcaaacatgcaccaaacagattcatcacacctctttgggcttttgtcagactgtctagcaaacctcaggatctattatatttcgacttttcccttagttggggggtggtggtggtaattctgcatgacatttctatatgactgtgacagcttttctccaaggtatctcttaaaagatgtttatatagcaagcagtcttagaagatagagtgtttatataccctgtaaaggtagagggcaaatttgtttcctgaacaggatagtaaaatattatcttcctcctggtggctgagatggtaaagaatctgcatgcaatacaggagacccaggtttgatccctgggtcaggaagatcctctgcagaaggaaatggcagcccactccaatattcttgcctggagaatcccaaggacagaggagcctgataggctacagtccccacaggggcacaaaaagtcagatatgactgagtgaccaacactttcagttcagttcagttcagttcagtcactcagtcatgtcgaactcttcacgaccccatgaatcacagcacgccaggcctccctccatcaccaactcccggagctcactcaactcatgtccatcgagtcaacctctctcttaaatgaacaaaagatattataaacaaaatcctattttggtttattctaggatttgctttggagaaggagttggcaacccactccagtgttcttgcctggagaattccggggacgggggagcctggtgggctgctgtctatggggtcacacagagtcggacacaactgaagcgatgcagcagcagcagcagggtttgttttagagatatcatatactagttaaaataatctaaagttcaccaagctgatgtaaaccactgagtctagtctaagtttaactgaaatatgcaagatagacaataatgacttcttaatgtaaggtcgctggatcatgaaaaagcaagagagttccagaaaaaca

SEQ ID NO: 27672 - DNA, 2487 bp, Bovine  19866881580288
agtccgaaagtaggcaattacctatcttttggcagataaaattgagacattttcacataggcagggaccaccacaacctacctccgtgcacttcttaggatactctttctggcaatgtggctcagaacagtgtggtctcggtccaaaaaaaatagtatttcagtagccaatctttccatttttctgcttttggggtcgggaagggactggatagttgtctctctttctcccagatggtcttggaatggtaatcctagctcctaccttataggtaaattttgattatttaagccaaccatactaatttcattttctttgccaacattttgtttaggagtgagacaagggcagatacctgcataggcttctaggttaagtcttcctcaccttgaagtagagaaataaaaaagagatgatattttcatgcctatgtgtgatccttagaattgtgacttccatgtcgccatcctgacagcagcaagacagtcggacaaagaagataactctcaggctggcaaagcagaaaaattgaaagtaattacatccttgtttccattgagttattgaattaaacagccctagagtcactccatctcaggccttcttttgtgtgaggtgagtatttctgcaattacttaggtcatctcagtgtagttttgttccttgtagtctaaactattctagtgatacaaagaaaaagatgtgcgattcaggaaattggaggataaaatatgaaaaacaaagtctccagatgatagttatgtaaaaggtccagatggcaaacaaaaccagaaaaaattcctaagagagcctctagagaaaaagtcaagctaatagaatgcttgattggtagattaaaaaacaaaagtatgataaaccaaatagtacagggaaaagaaaaaacaagggaaatgaggaaaaataaaaaactgtacacaaaagaaaaaaactcatggcaaaccattgattctgtaaagagcaggattttactactcacagtaatgtaaacactgttttcgtttgaatttttagaatgaacttatggaaaattgaacagcttagcttgggttatagaacataaaatagagttgttagcattaacaattccaaagcttagatgacaaaactgtaaaagggaaaagatggaaaggagattttaaaacaatgaaatccttatcttatatactgcaaaaatgaagatatgctaatagaaatggagcaaaagcaatttcttaagtatgcaaatgtgtcaaaatttatgtaaaatgtaattactatcataatggaaaaattttcaattgtagggtctttgcttttgcttttttttactatcttggatgtacagcccagatttccgtaaaaggaatccctttatcccagtcctagctcaagatctctttccaagcaagacttccctgactctatgtaaagctgtatgtggttctacccacattttcccttaatattgccatgctttattgccttcatttcactccattaacatttgaattttctcattaattcatttacatatttatctctctcctcatataaccatatgctctttgaaagcgtggaccttatctacttcattaattgttgtatccccatgacctggcacattgtgactatatcttaaatgaataaatgaggaagggaatgagaaaagcacagtaagccagcataacatgaaatcaaaatataaggcataaaatcaataacataatacatttcaatgtgaggatattataaagagatataaagacaaccagagaagaaatagtaaaaagattttaaaatggttaagttaccttttggaaggcattgtcaagtatgaactttctatatattgtgtttcagactgtatttgtaatatcctatttttttgtgtgatgacatttaatatccttaattcatttttttaaccacttgcacatgtcttcctagtcctcccatgctgggactgaagatcataaattgaggaagatggtgcagcaacttcatttcttagacaaatgagtataatacttggataaatcattatcctgcaggcagtgctctcataaaatgctttatgcctgtaaagagtctgaaacagacttcatctactggaaccattgacctaccctttcacagccaactgacaggtttgatcttgactataaacttattacagaaaacaggaaatttaaagagaaaggcatttgtctataagtgtaccagtgtcccttacctatccatgtgctcagtcgctcaatcatgtctgactctttgcagccccacagattgtagcctgccaggctcctctgtccatggaattttcccagtaagaatactagagtaggttgccatgccctcctccaggggttcttcccaacccagggataatcccgcatctcttgcattagcaggtggattctttacttatagcaccacctgcaaagtcctactatctatagagaaataatttattttgtagatttcata

SEQ ID NO: 27673 - DNA, 1063 bp, Bovine  19866882004754
aagtgttttagatgactaataaaaaaaagtatatataattcatgaatcttatgtgtttattctacgaactttctttcttgcctttatttcagaaaaatcattaggttgttatcaagatttttacataatctgtgttctaacgataatggtgaaagaatttaaaaaagtaattgtattccaagcatgattgcatttaaaatccaaatttgaacatattttataaaatgtattcttaagtaaatgtaaaagatttaaaattaagattatgttaatgtttttaagttacaaaatattacgagttatgtaattgaattttaaatgcttctaccttttggctattgtgaataatgttgctatgaacattgctatagaaacatagttttatgcattttgcttttctcgcttgacaacacagggtggaaattcttttgtcatctggcatagttgtaatgtacttcttttaatgactccgtggtatctgtgatatgtgtgcagcacaatatattcagccattctgttactggtgcgcatctgctttgtttcaaggcttttatctatttattcactctggaagcttctgctgccgctgcaaaaaaaaaaaaagaaaaaaaccctaaacataagttattaaatacccgtgcttttatttctctggattagtgagttcagatatccatgtaaaatttgcatggcaaatctatacgtcctgttattgtactggcatagaaaaagaaagtcctgctgattaaaaagccccacatctaagctgacagaatgctattgtatacgtacgcaatgctatgacgctcctagcaaccagaaatatcaacaccacgtttctatggcaataagcaaatgtttaagcttgacagagaatactctaatatgtggtgttcaggggaagttttgactattagatagaaattaaaggagatacctttgttcttagatatttgcataatatattaatgcaaagccaggaaaatgtagatttattacatgtgattttgtgagcacgggtggctgaagatacattccatgttgctactggccctgtttaatt

SEQ ID NO: 27674 - DNA, 1578 bp, Bovine  19866882005485
gtatacctagagcctgtgactgatggaggatcctgggcatttggcagctgtaatacaaaatcagtgccatccacttgtggtaaccaagacaacaagaattgatgataatgtttgcttctccatcagttttgattcacatgttttctagagggactaaaaaagcagatttactacaggtggtgtcagacaagatatcgagcacaattctgtaaaagtaaataaaccttactattctaggtgtccattaatttttcattttggaggcttaccaaaacagatttgatcagaaaaaagaaagaaaatgttggtgtgccaggcactgagaagatcctggaccaaatggtagtgtctgctgcatatagtgtatgatgcatgcagacacgttacaggaaaattccagtctcaaattttgcagcaacatggaaagccgaatgctcagggaggcttatctaatggtgtgaagctgggctcaccttgcctgggcaagcgattcacttcgttaacaggctaatgaggaagataattaatttttcaagaagaagagaatgagggaaagtgttgtgtaggagaaatatatttctaattcacttactgagtaatataccaatggctgtgggcttaataattacctccatttaatagaagaggtgaaaacaaataacatcatttcatgccaaagtcactttccagaactcccagtttcccatcaaaatcaaacaagtttcaatttctaaagatttgttttctgtaatccacaatttaatatagaagaagtgtgtgtttctgtatttagactctgcttgaaccgtttcagcacctatagaagaattttcaaagaaaataattttagtgcttgaattgagctgcatttatacagaaccctctaatttcaaatagggaacaacagattttaaatctttaacatactgcgctggtaagactggtcaagtataaaatagttgttaaataatttcagtataaattcacttaaaaatttttgtacattaaaaattaatataataaatgtgttaatttcactgaccagaaacacttcaaacaccaatttttgataatttcataacaaggctaactgcatcttctgtctgtataccgtgtcttttctttgcacctgaactctctaaatgaggaacatctgctagtgtttaattcacatcatatgtttgatgtggttacttctgtgagaataatttagatttcatcacgttgaactatggagagactgccactttattttcaggaataatacttatcatttccaatctgatcttaatacatggggcccagagaaaatatcagaaaataactctttaatttgttggataatacttttcatcagataatagaataccttaaattttaaaatttgaatgaaagaatcataaaatacatcatattttgctttgttactaattattgattaatacttattcaattaaaatatttactgagggcttaatctgatgtgaagagtcttaaagatgagttgtacacaaatccttactctggaaaaggctataatctagtatagtaaatacaaacacttcacatattattcta

SEQ ID NO: 27675 - DNA, 1120 bp, Bovine  19866880489721
agaagactctacacatggacatcaccagatggtcaacaccggaatcagattgattatattctttgcagccaaagatggagaagctctatacagtgaacaaaaataagaccaggagctgactgtggctcaggttcagattaggaatgtaaaaacaatgctgttctgttttcaaaggtcccttttctttgcccagaaactaagaatgtacttaataaatgccattaaccaccttctcataatgccattcccctgggcagagttggttagactaattctcactcctccttcccactgggtagggaaactacataaactaatttatacagggtaatacactacgattttctaccacaaaggatattattctacacaaagacaaattacgaactcaatcagccacatttccttttggctaattcccctcctaagccttcccagtacatcccaccctgacaaacaacaatctgtcaaaatattataggcataggaaaggaagacatgaaaattcattaaatgcctgttctgttatgaaacagcctcaattaaggtcttagacactattttttctgctttatagttattgattttgttttgtttcattaacaacaagtgatcaaagggctttgggcagaggcttttggtcttttccaccccctcaaaaaagagtatgattaattagtttgtccttttacaagtaggtaatggctagtgggggttcagaagttcttgggtctgcccccaagaagaaaccagcaaataaaaaaccttgaccctggggaaaataacagcttcccttgtctgccttcataaatttcactttgaacactccatcaatttgaacaggcaacttaaaaaagaaaaaaaaaaatcacacacactatagtagttcaggctccagttaattaagcagctctgaacaggagttctcagggcaggtggaataaggccaaaagactggaaaccagtttggcagaatattgtaaagagtcacacagttctttgtgaaaggatgaagaattcttccaaatggttataaatctcctcgtaaaatatcctttttgaatgtctcatatgaattcttttcttcttcagaattaaatttagtaactacgaagggatg

SEQ ID NO: 27676 - DNA, 1680 bp, Bovine  19866880520291
atgctgcaagaggatgcaggaacaagaagttcttatatccccctcttgtggcctctttaattattgccattaaggacagatctattgtattttcagagctagacgttagaatggaaattttattcttggatttgtgttcctagccattctagtttggataattccttaaaacctaatgtgaaggattatgcctattatgtttattctttgatagtaaattgtcatttgtatttgagatagaaaagtaatatggtcagtaagattctgtatcaattgatgttgataccttagcatcaccagctattagggtgagtcatgtaaattggtttgctctgtccattgcctcttagtatgtctaagacaagttttattttatgcattaatcttctagttgaagttttactgataagtttctaactttttgtgtggaatttttttttcagagttattcttagtactactgtcagtacaatttagaaaaataattacctgctgttcagtatacctagttatccatgattgcatggtaaagccttccagccattccttgccttaagagaaataaaaagctgtgctactgaaaataaacataaaattcctagggtttgagatgctaccatttctgtcattagttctgtctcagaaatcttctcataaaaatgaaggcaaaaaagtgtctcttcacacacttgtcaggacagacatgaggaggttggtgtgtaaaacttcagatggtcttgatgtccgccatggtaagtaacttggttttatgtcattgttttcttcctaggagattaatgagaccagaaggaagcatgaaactcgcttggtagaggtggattctgggcgtcagattgagtacgagtacaagctggctcaagcccttcatgagatgagagagcaacatgatgcccaagtcaagctgtacaaagaagagctggagcagacgtaccacgccaaagtgagcaggctgcccgggacggcgggaaacactgaatgcgtttgtttcggagtgtccctgagtaacatagccttgatgtttggcttgttctaatattattaaatgaattcctgcggtctccaagaacattcatttttttctttaagaaagcaattttttataaagtaaacgttaactatgaaattattcagagaaagtaggattattccatttttaccaaaggtatggtctttaacctctttgtccaagtgatcatttgtgtcaaagttatattagttaaactccagccacctaaaagtaacttttcattcaatgacaagtactaaccttgttggactgtgtctaattctgaatgcatgtcatcattgtagatggattgtgaccaccacactttgggctgttttgaacaaaggccaaatggacagtctctgatatttcttccttggccactaattattcatttaaaaaagactatagaaacttctctcttatatcaggagaccatgcaaaaatttattaaatcaccgagtacaggctttcatagtaaataattttaccccaatatgttaaatgttacatgatttgattaaaaagttagtggaagacttagaaaataagtcatagaggtgttgaaaatgatttccattgcatggcctcaaattggtcgtattgcttttaatccactttatgaagtagtagttggctgatgagagggtgat

SEQ ID NO: 27677 - DNA, 1967 bp, Bovine  19866880561525
attctagataggctgtctgctgcagagattgctagagaagttagtcatctccctcagttcctgctgtaggcagctagagaatcccactggagcagggcagaaggctctacatggaaggatggctcataagacccgtagaataatagagtgctggcagtgagagcttatattcattgagtcagccacctcctctttatcagttcagttgctcagtcgtgtgtgattctttgcgaccccatgaaccgcaagcagaccaggcttccctgtccatcaccaactcccggagtctacccaaacccatatccattgagtcggtgatgccatccaaccatctcatcatctgtcgtccccttctcctcctgccctcaatctttcccagcatcagggtcttttcaaatgagtcagctctttgcatcaggtggcccaagtattggggtttcagcttcagctcctctttctgggtcatcattttccttcacagtagtcccatgtagtaacaggaccatttctgtcccattggagggtaaaagtaaggtagcttgatcaaggtgagctgacacgttaggagagctaggatatgaatctagtccttgtagcagcatttttacttattagatggggaagctgaggtctggatgagctctgtggctcttggaagcataactggttaatatagcaaggctgaagctaggccatagtcctggaaattctagaatcactcctcttacaagatgttaaaaagtctcatcattatgttattggcacgtgggagagcagggctgtgcatagactgatttgatttcctttctctttcccagatctgggctgcgaatgccggtgtcacagccagtcctcccaccgacctcatctggaagaaccagaactcttggggcactggcgaagatgtgaaggttatattgaaaaattctcagggagaagtatgtatcggttttaccaaagtgtcattttttttttaattgaagtatagttgatttatagtgttgtgttaattactgctgtacaacaaagtgattcagttatacacatatgtgtatttgtaaaaaaatattattttccgttatggtttatcataggatattgaatgtattgtttctctgtgctgttataaagtagggccttatttatccattcaatctgtaaaagcgtacttctgctaaccccaacctcccattccatccctcccccaaacccctcccccttggcaaccaaaagtctgttatctatgtccccaccacggtgtcaatttcatttgagagttcatcgtgcaaatgtgatttcttttcaaggatgaaatcaaatgtgaagtaactgattgcttaaatcagaccaaggctgctgagtcagtcaaagtaaagctaagtgcaggttttagattttaggaatgaaatatgagtttgtcgtagttttagattttaggttttagattttaggaatgaaatacgagtttgtcgtagttttgattgttagcacagattccagaattcagtctgttttcagtttctgtctccactgcccagtgaccttgtgactttaggtgagttccttcagctctcttagttttatcattttaaagtgaagatggtaataacaaagtacgataaatgagatgataatataataagagtaatataaatgcaacagtccttgggaagtgctcagaatggtatctggcctctggtaaatgcttatattattaaccttgttactagctttccacatgcctgtgaaactgagtttaaagattgaggagtgtacctttgcttgatgagtatgtttaacatatcagtcatagaattcttgtcaaagaacctaacctacccctgttgtcacataaagacgcctctaagttcccccagccacacacacatactaagagatcagagtgtctgcaaaggaaggcatggttacaggtcaggagttcttctctgctcccatagtgccaggtt

SEQ ID NO: 27678 - DNA, 1046 bp, Bovine  19866880565411
aatcaaacaaatgaccctgctttaaacctactgttcccattcaaacttggcacatcacaagataatatcagtaatacacggtattgatctgatcacaatttcccataatagtagagtcagtagacttctacttaggaagtgaagattaaaacacttgctattttaaggattacagaatctgatttgggtaagaagtgtcaaatttccctacattttttttaaccaccttcacttcctcctctgatgtctatattgaccattatttcagtttctggttaatatagacaatttccaactgaaatacaaagtttgatgggagaagagtggtgagaagttaatactacaggaattcgtgcaaaactcagggcccctgctcctccagggggcatttgcccaccagaactctatgtggaaaatgctttctggaggatatttctctgagatgccttgcatagagtgctccagagtatgctgaacatagagaatcatgcctctaacagttgtacagtttggtggcaatgtgagaaatgtagcaataagccaaacctaccatcaattataaatgccaaccacttcaatatgaatggatcaaattagaacttggtctctgagtagaataagcatttctgtagagaaagacagaagctgattaatgcacttcctggagtcccgtcttctgaagacggaataatgtctgacctcagaccctctagctcatttgacctgtgtgcctctacatttccatgtaacatgatttccaaataactagtgagattattctagatattggttcagtaattgcataagcatttaatcctaaatttaggaaaaaattagatgaatataaaaagttaattaaaagatacttgcttcttggaagaaaagctatgacaaatccagacaatgtattaaaaagcagagacattactttgcctacaaaggtccatattgtcaaagtaatggtttttacagtagtcacgtatggatgtgagaggcgaacaataaagaaggctgagcgccgaagaactgatgcttttgaactgtga

SEQ ID NO: 27679 - DNA, 1938 bp, Bovine  19866880776630
ctaaattcttccttaggcacttacttgccaacctcagcctcagttttctcatctgtacaatggagatgacactctatgacatgtgaaaagaaaccagcacaattcctggcacagagtatctaattaatggcaatcagtatttataaggaaatggaaattcctgaaaaaaattaactaggttgtgtaaagtcatgaagagctgggatttgcagccaagtttgtctgatactgtactataagcccatcccaacacacatgatgaaatggaaacttttttctggtgtaaaataagcccacagtggacagtccagactgctgtgatggctccatggttttcaatggcccagcctcctttcacttttctccccttcctccttggcaccacctccaggtatcctcagagtcacagaatggtcactgtaccatcaccatgttcagaaaaaacagaacgaggaaggagcaaaagggaagaataaaagatgcctactagatgttttcttaataatctgggttcaaatacactgcctggatttgtgcattgtgcccagtgctgacccttctagtccccaaagcaaaaatgtagtaaggaagcttcccctatgcagggctatttgctctggtgtgcagtactaggtgtagtggaaaaagaagatgagggttaagaaccagatttcttagatcacattgtctcactgagtaggacagctttgtctctcatatgtcagtttctctacctgtgaaatgaggaagctgagtgggatgatcatttaaagatggggctttgctgctgaccaggtggccacctggggcacggagcaaaatgttagtgttaatcacacacctggtcctcggctctcactgtacactgcaggtccacaccttgctgagtcatgttgtcagggatccggagtgttccctggagccctgccatactgcctttccttccttctacgctttgaaatgcccccacattttattgcatgcaaccagcggcgtgcaggctctaagggccccatgctccagatatttgggtgctcttacatataaaaatcctttttcctatttctcgcttgttggtctctgccctcgctctatgacaggggaggcaaaatgtcattttaatatatccttacaccttcccagctaatcctcatatgaggtgtgtggcagcattcctactttatggatgagaaaactaaggcgtgggccttccctggtgttccagtggttaagaattgccttgcaatgcaggggatgtgcgtttgatccctgatcagggaactaagatctcacatgccttggggcaactaagcccacacatcacaacaactgagcccacacgtttcaactagagagtacgtgggccacaacgaggatctcacttgagatcctaagacttgatgcagccaaacaaataaatataaaaaaaaaaaaacaagaaagaaaggaaattgaggcttagagagggtaagtaaggtcacaaagcttaggtttggtgtcaggatacaaatatagatccatgtgatttctagttcatgaaatatttgcaatttaatttcaggaaatactgtatttcattaagccttcccaatggtagacaaatggtagaatttctagttccctctcaagtttgaagtatgaaacattttgtgtacaagggcattttcctgtgccccaaggtcattctttgcctgctccctgctctactgtgaaattgagcagcaatggattagcctcacttattctgcagagtgacactgaggttggaagctctgtggtctctgttctctctctttctccctgctggcatggatcagggaatgcccaggacatctttgccagctggcatggaggcctcattgtcacttttgaattctaaacaggacatctgctcttacagcccaggtacggatgcctctagctggctccaggaaaatg

SEQ ID NO: 27680 - DNA, 1245 bp, Bovine  19866880930412
tattcgttggaaggactgatgctgaactgaagctccagtactttggccacctgatgtgaagagctgactcattgggaaagaccctgatgctaagaaagatttaaggcaggaggagaagtggtcgacagagaatgagacggttggatggcatcaccaactcaatggacatgagttgagcaagctccaggagatggtgaaggacatggaagcctggagtgctacaaagaggtcgaaaagagttgggcgcgcctgagtgactgaacaacactgattaaaatatggtatgaatgcagggaggtgtgtgctgtgtgaggtagttctatatggtgataactagggtgtcatttgttatgcatttgggggatttttatcttgggattgctttagctcagtgagttcatcttgtagaaagtagaatatccaaattctccctagactgagctgatgataacaattcagaagctaatccagagtcagtgtttgcctttctcttaaaatattcctgcagtaagctgtgcaaagattagcagcttacacttgaaaataactcacgaagtctcagaatttctgtgctctgcagatttactgcacactctggtgctgtctcagacacaagataaatgctgggttagaaatcctgtctggtgaagcagataaaatggtaacttttccacacagatttgtcttcagaacgggaatggcagtgctgtgtgtggcccaacttggttgtgaaaagttgccacaagatggggttctcgtcatcaggatccaacctaggtactttactgctggataaattaggttatagaaatcactttaataggcattaagaagggtagttttaatacagaggagtattatatatgctcgtgaaatttagactgaaaatccaggactcagttaatacgtagttgggtgccactgaatatgtggcaggagactttggggtctatttaaaatgacagactttataccaaagagaagtttcctgaacgtgagctgcacctacggctgttcccacagagcgtcatggggacagagactcaggggctgcctctctctgcagtagatgcgacttagcctcagtggcggttagggctgcattattgaactgtttcataacgaggtggaattttccccttttatcttgtcttcagtggtctggtttcactactgtgtttagatacagatttattttcttctcacctcagagtttttgaccaagaaaattctggatgctcatat

SEQ ID NO: 27681 - DNA, 2049 bp, Bovine  19866881159352
tatctataaagttcactaaagcaaagcacagtaaaatgaggtatggtaataaaaggcattaaatttatcaaataaaaaaaaaaataaagtgctgaaaaattaaagctgtcaaaaaaaaaaaaaataaggggccatggtagatgaaataggtttttatgagccatggaatctagtcccatcttttttgtgtgtgaaaacatgttccaacttagaaatgatcttataggaagataattcgggatgcaggaggtttaaaagcccacaaaataggttcaaggacaagtgaacaaagtagataccatgacatggggtatgtctagaggtagtgttactgatgacgtatcaatatagctgactgaagcttaggtttcccttcataatccaaaccactgaatattagattgttgagtttgtttgcctgttcttttaacaaacttccgtcttctgcttgctagactctgtaaagtgacttctgtcagaaatgagcaaagtagtatgaatacggttcttatttctgtgattgtcagacaagtacttttggcatttatatatttcattctgtaaggccatgttcattagtaggttccagactgtatttatcataattcataattaccacctgtaaagaccattttttctataacattgtaggtaactgacttactaagtcaacttaatttttcaatgcatgttttcttgctgaggcattggagatatcaggaaacccaattaaactggctttaaagtaatggggatatgtgagctcacaatgcaacaatccagggagagtggacttgatccactggctcacccagcgtccccagggatctttctgcggtctgtttcctgggatctgtccgcggtctgtttcctgggatctttccgcggtctgtttcctgggatctgtccgcggtctgtttcctgggatctgtccgcggtctgtttcctgggatctgtccgcggtctgtttcctgggatctttccgcggtctgtttcctgggatctgtctgcagtctgtttcctgagtgtctccctcatggatgcaagacagctgctggctggaggtgccgtcattccagattgacttcttgtgggcaggagcatggtcccggtcaggtcctcgcctgggcttcactcttgttttaccagcctggatcatatgcccatctcttagctagttcctggagttgggaggacagaatttgagcttgagccctcctccacctccacggctagatcacactccgctccttgtgacacacacgtcacatctccatgtgagagagggtacccaggtaaaactgcattcttaatgagaaatgagtggggtggaatgctggtgggtaaaagcagtaagtgtcaccacagaaaacatggattattattattttttttttaatgaggaaaataataaagcggtctctctgtacctctaaaatacaggcgtccctgaaacttttgtacatgtagatactacttgtgtgtcctgagaccccatagtttaacagccagcctctttatcaataaaaaccaccttgatttgtggtaattgctggtttctgtggtgtgaatactcagactggtgattccaggctacccacatggcatgactgagtgcggagttggagagacagcatgggagctagccctgctgcactgctgggtagatggtgtacctgtacgtacccaggctttatctggacagacccgtgacgtgttgatagagaagcaaaccatctgtgtgtgcctttcagatcactgatacggttcagtgtccttctaagaggaatttttttggtaaagacatttatctttagtaccttttggggcctaaacctcccaacaagttttgattctgaattttattatttttttatttaaatctgtagacatttagctcacttatattccatacaggctttctgcattagattaattggtttttaaatgttgtcaaatgaaaagtgcttaacagcaggcttaaattaaaggcagttgtgctgaagtaattcataattaatgaagttgggcaaattgctattttctaag

SEQ ID NO: 27682 - DNA, 731 bp, Bovine  19866881281656
taagtgcttaaatgactggcacctcttgtaaaatgtaatcttcgtatgtcaaccgctattattgtcattttgtggatgaaaaaactacatcttaacgtaaatatctcactaaggttaattcggccttaactggtttacttggttgaacctttgcactctgaggaaagcacccttattttcttctgttttctgactaattgaaaatcaattctttctacaaaagtcttacagaatatttattttatatctccttcacagtccataagaaaaatgagttgtagtttgttaaattccattccagtttttcttagtatagttcagattacttccttggggcatgttgatcaatagcatagtagagtaaagatgtttttaaagccataaagcttagcacagcattatttataccagcagccacagaaacatacatacaaaattatcttagagtgtttaaagcacttaatgtatttctaaaatctaaattatccaaatagcatcattaaagaagaaaacacataaaatgtataaaattaaagtggatttttggaatgacactatggattttgtgacaagctgtgggctatgtcaggaaaaggtcattcgttggtccttttataaatgatgctgtttgggaattcttcccagggtagttagagatggatgcagagcttcagttctcagtctgcatttctttgccaactctgtgatcagtgggttacatttgctgcctg

SEQ ID NO: 27683 - DNA, 2421 bp, Bovine  19866881286854
cttgatgtactcctttcccatttggaaccagtctattgtccatgtccagttctaactgttgcttcttgacctcatacagatttcttaggaggcaggtcaggtggtctgacctattcccatctctttaagaattttccacagttttttgtgatccacacagtcaaaggctttggcatagtcaataaagcagatgtttttctggaactgtcttgctttttcgatgatccaatggatgtgggcaattaacctagggaaaaatgcaaggtctttctttgctttccaggttaaaggttttgaaagctttgaagaacgagaagatccatgtgacagagtatgtcatgttcagggtaaaatagaattactaacattcatataaggtcagatgtttgtgttcagtagagataaaaacaggtagcacttagtaaaatgaaacccaatcacatgaaatcagtatgcaagatatcaatcttttattcaacaaatatatatattgagtatttagtttactttgtggaaggctctgtcctagatgctgggagatgttttcctctacttaagcttatgttatggtgctcatatcataatgtaattaaagacaactcttgatgattaaagcatgacatgggatccacgtcagcttttccccagagagagagccaaagcctccctcttgattcaaggagtcctgcagggggatatgtaaacaaacaaggatgtcttcaggagaatcagataagggagcattggcaggtcatgaccctgccctctgaataaggatttgggagatggggaaaagtggttggtgaattacatttaactttttattgagcattatcctgaagtgcttttcatgtgtcttgaatactctgaatttgctctttttttttccctcttggtcttctaaaaatgagctttgtagataaggtcaactgaagttcactgcttctttttctcaggtctgtgtgcctctaagatatgcagatcctctctccataccagtggattgtgtggcctatcctttcttttcaaacttctgagaggatttgcctaatataaaatataagatagctaacattttacttatgactcgctatgagctaggacagatatgaaacatttttaaagattcagtgtttggctggttttcttcttatgcccattgcatggatgaggaagactgagggttagcagatttaggtagtttgtccaagtaagtgactgaggtggggtcatacccagatccaacttcaatgcccttgaccttaaacaattatggtgctcaccactcaacacaaaagtatggcgtgcctgctgtgtgctagttcctctggacactggggatatggagggcaggagaacagacagaggtcttgcctgtagatatttcttcagctatgtggggggaaccatgaacaatgaaacaaacatgaaatgtactatgagggagtgagagttgtatgggcaattcgatcctgtatggatagttacatgtggatatgtgttgattacaaacgtgactgaaaaaaagactagaaagacacatactgtaagggtgattacctctgggtggtcagatttttattttcttcttctcatgtttttgaacattttcaaatattccgcaagcagctgtatacttccaatataatcagatgagatccataaagattattaaaaacagaatttaatcttagaaaatcctggcaaactgcatagagtttaggcacacccctcttaccctcttttgtttcagtcctggaagcaaagtgtgtatttctcccctctgtgccagtgtctgacatatttatccctgcccccagggatcatgttggctccctctgtcccaagcttctctaagtttgtgcacatcagtccttcccaaggctggccccacacgtgaatctcctgggcagtgtttcaaatactgatgccagagcttcaacccccagacctgctgaagctctgtgtgtgtgtgtctcccaggtgactgtcacatatccagggttaagaagccttggatggtgagccccttccccctgttcctcagtgctctcacttctgggggaacagccagagcacctccttcctctctgtctcacctggtctgggatgctcaggaaagagaaggaggagggaaagacccgagcaggtgggcagatcctagccctcccagcaccaggctgcagcccccaccaccttcctgacctacttactcagggcctgcagtgcaagcaagtgactcaagcctggcagccagcagggattgttaacaaaagccgagtactgtacagatgggagcagagggcacactccagccacactagaattctcaccgttccggaacacagcgctggctgtcacagcttcgggcctttgcctgtgctgccctttcagactgaaatgtcctttgatgccatctcc

SEQ ID NO: 27684 - DNA, 1116 bp, Bovine  19866881622918
tataaaagttgctgaaaactgtgtgtgtttgtatgaatagtgcactaaataaatgaaggagcaatattttctcttctcaaaaagaaatatccaggcaactgaaagagattactcgcttttctttgttgtgttttaaaccatgtggacagtgatgaacaaagattctatctacttactttaggatgagaggggcttttcataggtgggttaatggaaacttgagtaatgttgtgtctggctaagccagaagctacattttgacaaccaaaaatctacctgattttcatgggtcacagaaactatgctaatcaattctacactgtatttaattttcctaaggtgagaagcaagttttactggcataaacccttttttcctacttgcccttatcactccattttttcaagtagctctttcatttagcgtcttctctcctttgaaccaccaagtattcaaatattcattcctcctactaggataaattttatgcaacaatgaagagatcttcctgtcgcaatgagttgtgagaataatcattttctcctacatgtctctaatttataaaacatagatatcatcaatttctaatggaatggatagttacacttaattattttttacataatttcccactaatgtgtttaggagaagtgattattggagatgtgattgaagcactagaaatgccatttggtagacagatggttcatctcaacctaaagttctatccgtcaataggaaaacggagtcatgccccacgtgggagagtgggtgtttgaagctccatgtctgtgtgtgcgtgcacgtgcagacatgtgcttatataggctgttaaaactttctgtgtgtgtacaggaccagtatgaagagtttcaagactcattaaaatacctacattgtgaagtgacaagctccatagatttctgagtgaataatgttccttttagtgactttatacatttcaagatgtaatgatcattcagaactcattaccatctgaaagaatatggggagttggtagaaacttggcaattgtctttcaccaatgttaattcctgccattgggagcagaaatagaacttgtaggaggagaaataaatgctcacactcacccct

SEQ ID NO: 27685 - DNA, 1420 bp, Bovine  19866880488828
cgtgacaggcagaaggcttctggtcctcccatattcagcctgcgtgaagagtcagcagttccttctttcgctttgggcccgaggaccaaagcgaagcttctttctctaacgaatctagggaagtgactccaagtgaggtttcccttcttgataatacatctactcaaagcaagtggctgaaatatcaaaatacacgccagtgcaacttgactactccagacagagttgatgagaaagtaacagacggcttctttgctgaggctgtttctgggatgcattttagtaacacaggtgaaagagagaatgatgctgtgaatggaagttctttagactctgtgtatttacaaatgatgaaacacatgcttcaacagcagcagcaggattttagcagtcaagattcggtttgcagaaagaaggcattttctttgaatataaacgaggcttctaagactgaggaagttcagaatatgttaggagagtatgcctgctacaactgcagtgtaacaggagatttacaggtgaggaaatgtcccagtgttttcttggtgcatcttttccagtacttatctgaatttcagcaaaagaattaccaaagtcatacaggtgaaatgattttagtcttgaagccagtggctttgggatttttcttttttttttttttaagagttttccagaacttttgctacagtcacatttttttaaaaaattctttttatttatttactgaatttatttggctgcaccaggtcttagatgtggcctatgggatcttagttccccaatcaggaatcacacccagggtccctgcattgggagcatggagtcttagccactggaccaccaggaaagtcccagtcacatctttgacttaagacctttctagaggttgtaaacactaaattacgtatttgaaagtgtctggtgcagtatctggacataaaaggtacttaaattatagttctgtttccaccatcacttccactactactactactattgttttcatttttacaatcagctcagttttgattattttcatttcactatgagctcagttttgctgaccagatcattattagggtaaaggtacatcctacttacattggttatgaacaattcttactgtaattgtgaccagaagtagagatacataatgattcactcacatcagttaaatttttcctacaaaaaatttaaaaacatattaaggggccgacaagaaaagttagtcttatttatcattaaaagtgccatgtcatagcctttcctgctatactcaatttcccgtttaaaattagaaaatgatttcatgcattctggaaatcaaaagaaaaatttaatattatctatataatttgcttattagtaaacagtatttttctggaattattgtaataacttgaattattgcatttcagga

SEQ ID NO: 27686 - DNA, 5306 bp, Bovine  19866880574754
tacagtcttccttacagcgatgatgatttgggtaatacggagaataataaaatcaaccattgttcggtcatgaacctataacaaggagccatgtgaaggcatctggagttttgagtcaatttgttggtagttgatctgaaccaccccacacgctttcatcagaagctgtgtgcacaaatctagttttcctggtttactcaaattatgactctgtctttggctaccagattcgacttttcttcatttgtttctatatccctgaaacttgccacccacttatcagattatcgtcctccattaacacactggccagtgtagtatgagaaaaatactgggtggtgtattaacaaccttagattgccctagctttattatatgttattgagtaagtctctttagctctctagcccttattcatttctaagaccctctagatttcacggccccaaatcaactttcttacgatgtttgtcaagaaaagccagaaaggattccgggaagtttttttgatttatttgatttattttaattcaaatttatttattcaaataaaattaaaattcacagtgaaaccccttgtgatcggtattccaggggctcttttctgtttctttttttaatttttctaggaaggggaagtggactgaggagtggagggaagacggcatattgctggaaatctcctaccgcttttgcagtatgcaattttagatattcctcagtgaacaaaaacagtgaaccgaatatttcaaagctatatatagactttagattttttaaccctttgcctcctgagagacaggcctagatcatcaggctgtgtggtcttcagcaagtcatttaacctctctgatctccatttcctcaagtgtaaaaggaagtcagactggacctgtctactccacagtgtgatttcaaggactaagttaaatgatacatttaaaattgcttggtaatctgtgacatactaatatagggtattagttactcttttgaaattgtattctttatcactattttattattaaaatagagcaaaatattttcaaccatgacgaatgatctcggcatctatctgcatcacacaggaaaatggcagagtacaatgcatgtcaattttattttaatatttaaaaaggcataatgtgcacgtacagagcattttgtctaatagatgtgctgcaatagtttatatatgtgtgtaccttatacatatacaagaatagaaacaaggttactcttgctaaattcctgattatcttcctgatttctcctttttttgatttgcaataaaatatataggaaaaggagcatatatagaaagatttctccaaattaatttagacatgtgtttattttctgcaagatgaaaattggtattttttaatttaaaaaaatgtgctgtgatcaaatatgtttagtctatactgtggactctatgcttatcttacagattaaaaatacagcaacttatgaaaggttccaagaaatcttgcaacagaggaatctgttcaacttcatttaacacggtttcccaaatttatttaaccatgacactcattttttttttaactaaccgcctattaatagcttatgaacctccagtattctgcataataaaatgtaggaaatgctgaaacctgttccaaatatgaaacagtcattataaaataaaagacacccagtgtcgactctacactaggcttgctgagctcttttctcctcactaacatttcaacctaaaagtcatcctggaaaaccccgacaaatgcaaacgaaacatgccaccacgtgactgagatcgaacgaaaggcagagggacacttctggcaaatggtacaaagtattacagttgttaaacaccatcagtcattttggacacgaaaccgcttctgaattataccctcagggcctagggggtgaggggaaaattgcacctaatatgaggcaggcgtaattgacttctgcttgaaacagtcagtctgcccttggcaaaacagccaaatgtaccttgaaaatggcaattatttattaccattggattttctgagatttgtgaaaaactcaaagtctgccagactctataaaaatattagtctcaactaatagaccttttaaaatttcttttaactttcaagaataaaatatgaggaattaagaccatcatgtttagtcaaaaaaaaaaaaaaaagaccatcatgtttaggaggaccacatgctcaaaagatgaccttgatgtatgttacaattttccacatgctatataattcaacaaagttttgtgaaaactgatgctacaattagaaaataatggccaaaatatttgtgtacatgcatactgtgagaataaaacaaaatgctacactctccaacaacaagggttctgttgagtgtttttagtgtttgagtagaaatgagttcccaagggtgaaaaatccaagagtcacgtgtggatgcgagagttggactgtcaagaaagctgagcactgaaaaactgatgcttttgaactgtggtgttggagaagactcttgagagtcccttggactgcaaggagatccaaccagtccattccgaaggagatcagccctgggatttctttggaaggaatgatgctaaagctgaaattccagtacttcggccacctcatgcgaagagctgactcattggaaaagaccctgatgctgggagggattgggggcaggaggaaaaggggatgacagaggatgagatggttggatggcatcaccgactcgatggatgtgagtttgagtgaacgctgggagttggtgatggacagggaggcctggcgtgctgcaattcatggggtcacaaagagtcggacacaactcagtgactgaactgaactgaactgaactgtgatggagaaatcacctcagcctctgaagggtttcaagatgaagacctggttgacactgttgaagcttgttgtattagcagtggtttcctggggaaaggaggaggggcgaaatggagaggggcctaggggagacaagctcctagatttgattctgccagattccacaaagtgtgatacatgttcgattggaaaatttttactactcttactaccggaaaacaaactccatcatattcctgtcacctacaaatgcgcttttcaaggacgtttgccgtctgcttctatggagactggaccctgtgctactgcagctactgaccttcagggcgccctgaagggagttcagggtggagactgaggcactctgtgcgccagggacactgatgggacaggtctttagatggttagatattctcaggaactgacttcatgatcccaatccttgcatctcctcatatctagaaaagcattaaatcccttcatggtgacatcagctccttgtgaccagcagaaaagctcttgtaaagtaagtaactgattgcatggaactccccttcaccaaaatcttatatgttgaccttcccccactccctctttggaggagttgctcagagctctctctgaggtgctgtctcccgggctgcagtcctcattttgtcccaaataaaacttaactcacaactctcacattgtgcatctttttagttgatgctcttgactagtgaagatatgcttagcacaaaagcactaggagaaaaacctaaaatttatgtaggttgaaatgaatgaaatattatgatacaaattaagtggacagtgcaataaaagaaaatgatcctattgcattctatgagcccagtccatgtttgatgtgtaaaatgaatatatatgctttccctttttaatatagttttattgaggtaaaatttatgtaaaataacctgcatgtatttaaagtatacaatcagaagctttaatttatgtatatacatataacatatgttaagcaatcaccacagttaagataatgaacatatccatctctcccccaaatttcctgatgtctctttataataaaatctgaccctctctatacccaaccttgtccccagaaactcacaaatctgctttctgtcactatggattagttggcgttttctagagttttatcagagaaggcaatggcaccccactccagtattcttgcctggaaaatcccatggatggaggagcctggtaggctgcagtttatggggtcacgaagaatcggacacgacttcactttcactttcatttttcactttcatgcattggagaaggaaatggcaacccactccagtgttcttgcctggagaatcctatggacgggagagcctggtgggcagccatctatggggtcacacagagtcggacacaactgaagcgacttagcagcagcagcagcagagttttatataaatggaataatacagtatgtgtttgttttatgtctgttttttttttaacttagaaaattattttgagataatctatgttgttgtagatattaatagtttgttccttttgtttacccatttgccagttgatggatatttggcttgtttcaagtttgtggctattacaaataaagctgttgtaaatatttgcatatgaatctttgtatggattcatgctttcacttatcttgggtaaatatttcggagtgaaatggctgggtatggtaggtgtgtgtttaactttttaagagacaatcatatttttctccagagtgactgtaccattttacattcccaccagcattgtatgaaagttggaaaggacgtggaatcctcaccaatatcccatgaaaatagaccatactatcaaaaatccaacatatagatcacaaagaatttttttaaactaatgaagaacttactcataaaatcttgcagtctgagtcctgccaaactttattattaatagcagaggaaacccaaagtaatcttcgctaattctcttatgaattattggccctagaatgtaaatttcaaattctgtaaacaatcacatcatttttctttttgctattaattgtaatgaatctaccagtgaaagggattttatctatctacttgtttattgcaatatgtgacaaaaacatggaagaagaaattcctttcctcagtgtcaaatagaacctgtaaagatgtctctgagataaagtcaaaaccatcactagaaaattggttactatctgtttttattattgcattcactgatccactcaggtccaagcatcagcatgcagatctagcaatgaattagatgttccaataagatgagagtccatcagacagaaatatgtttgtaaggaatgcaactgccactagaacgtaagctccatgtacctggggactgtttctcttatccctgttttcctagtac

SEQ ID NO: 27687 - DNA, 2470 bp, Bovine  19866880626198
atggattcctgagatctatgcctcttataatcctcataacaaccaacagctgaagtttattgctaatgctacctctttctcaccagaccctcaacatggaaaataggccccctgtgatcgaagcccatcttttttataatcttacctcctacagttagtaccaacagcaggagtagcactcacggcagcgttggtgggggggcataggatgcattatatctaaagtcatgaagcaacatcaaaaacaggagaatgagaaataacattagaagcaggagcatcaaaagcttatagaactggatgttaaatgttatgcaaagtgagtttatatccaagagagctatcaataaagagatttttaggagttcttttttacatgttgtttgatgctgtgcagaaagatggtagctgaaagcagttgtatgactcctggaccctctactcaaaccctgtgcacaggccctgaggactcgttcttctgaatcccttgctattctggaactggcattttcttcatactcctgtgcctttgcaaacacttttcctttcctctgaaatatccattgtccctcactcaaggcgtccctcttctctgctcccacagcatttatggaattggaattcaagttgttcgtgtatatttcctttatgattgtaagttccttaaaagcagagccctgtttaagtcatcttaattccactaaagtgctgtaacattactctgtattaatatatagtaaggaaatatgtaatttgatcattgaattattcattaaaatacactgagtggaaatcctgatgcaatataatggttgtagatattctcacacatattcatttattcacttatctgacaaatgcgtattgagattttagttttttacctttttaatgtgtcagaccaggtgctaggaatgggagacatgaaagtgacacaatcctgaccattacagtactctctgtaccgtaagactatacggagagtacggtcttagcagcaagttgatacttatactctcattaccaaattcctacaaaatatacatagactacatatatttcattgaaatacttgtatacttaatagattaaaggtagaaattttaatttatgcgttggttattcatcaagtctttatatatcaatttcctctgctttataactatagttttgagtagaattataatgtgcatcaaagatgatttccataagtgacctcacttttcaaggtttccattactgaggttccgagtcctgctcagtggtaaaaatgcaatagtacatttagtgcattaaccttcagtaacaaagtcaaaggcagatctttattacctatgtccataaactactagatcttaatattagcccatttccccatcaaatcacattggaacacaaaaattccacagattcgtgtgtttggtttattaattcaggaattgtaacgtttagaatccacaaaccaaaagtgtcatttgatctctaaaacatatattggatagttgaacaacttttttattttgatgaaagtcatatatcagtttttctcaatgcaaagctaaatattaattaaaaacactaaaaggtgtacatgaaaggaaaaaatttccatatgctaattttgatggcctgggtacaaaattctgtgctaatagccaaatgtttgggcttccctggtggctcagacagtaaagaatccacctgcaatgcaggagacctgggttcaatccctcagttgggaagatcccctggaatgccaacccattccagtattcttgcctggagaatccacatggacagagaagcctctccaggttacagtccatggagtctcaaagagttggacgactgagcaactaaggatatacacaggcaaatgttacgttaagttacactaagtacatttagacttagtaattatactaagcaaagtcatgtgcccagaagcaaaactgcaaaagcctacatcatgaaagcaagtgcaataccaaaacctaacacaaactgaaaaataatttatactatattgctatcagtttttaaaattcaaaattattattcaagatgaactccatcctatattctgctttgacaattttaacttattcttttaagcaaaatctgtttggagtctaattttcctgtcaaatctgttcttggcaaagatttctttaaatctagtttgccatttgccgtttgtttaccccaatatgattaccaagctccatcatgagctccaaggcactgagaatcctgagcttaagaaaatggacaagactcctgctctgaaagagctttctctagaaaacaaaccaggaaatggaaagagcaataataactagagaagaaatcaaaatctaatttttgtggctcaattcaattcactaaaagtcatagacttattatcttgggaaaagacactaaatttcgtcacaccctttagtctagatgaatttctttaactattcag

SEQ ID NO: 27688 - DNA, 2170 bp, Bovine  19866880772420
ttggtcttcaactctctctctctttttaaaaatcttttaaaatttatttttaattggaggatgattgctttacgatcttgtgttggtttctgctgtacaccaatgttcagttcagttcagttcagtcgctcagtcgtgtctgactttttgcgaccccatgaattgcagcacgccaggcctccctgtccgtcaccgactcctggagttcactgagactcacgtccatcgagttggtgatgccatccagccatctcatcttctgtcatccccttctcctcctgcccccagtccctcccagcatcagagttttttccaatgagtcaactcttcgcatgaggtggccaaagtactggagtttcagctttagcatcattccttccaaagatcagctataagatacatatatcccctccctcttgagcctccttcccaccccaccccccattccatccctctaggtttcaactctgttttaactcacccttacttctggttcccaaagcttataaatttgaatcgcttaacagtctctctctctgtctctttctttgcaaatgatgaagttatggtctacattcatagctgtttaatggaagaatttacctacaacacacacaagacaaatacatacacatcatttaagatatttcacctaatcgtgccctaagccatacagatatctactatttagctcagtaggagcctgaagttatccatcccaagacggttggttcagtggttcaataacgtgatcagtgattgaagcttctctaggccctctgttttgcagtcctcaagtgttaagtcatctctcttggtcacaattccaagcatcatgtctttgtataatagctaaagccaaaagcaagggtagggggaaggtggtggccaggtcttcctctggttgtgcctccttcttataagggagggaaatctttcctaggagccatcctgcaaaagcctcctttcatttcattgttagaactggatcatgtgtctgcctaccctttgaaaaatccctaaaaatgaacaggatggcatttggttgggtacattgtcatccaaccaaaatggttgggagaaattagagaaatgtgtttggtagtcaaccaacaaatctgatacatctacataaatagaattccactgaattttaaatctcataaatctgcagttaattaactggatgtttaccatccttagatttaaaggtgttatcttatatcaatatatctatctatctcatagatatgtatgtctgtatatctatatctatccatctatgtcatatatatatatatgtatatatctacctcaatggaaggaaagttgtttttaaattctttttctgtttagctattgctataaggacttttgtggttggtgtttccatggtgatcaaaaacattgtcatctaaaagcatttctttagaacttaacaataaaagacacagtttagatgatggtcacaggaacaattaatgtggttctcgacaattgctgagaatgtgttttgaaagaatttattcttcagttggatatgatgtatgaattacattactgaagttatatctactttaaaattttaaactgtcatcaacagtaataagagtctcaattttatattcaaacttctgagagaatctgttagagatggtctatctaataattcttatattaaatattctcttatcttttcaacttcaaagttacactgagataaatgaaattttttaggtgggctctcgttagttcattcaacaaattttttggatgcctaatgtgtatcaggcagtattataggctttgggaatacaacactgacagaaatgaagtccttgctctcacagagtttatattctaataggtaaaaaaggtagcaataaagacataaaaataaatacatatgatctcactggcattaggatgagtactatcaaaaagcagaaaatagtgttggtgaggatgtgcagaaatccgaaccctgtgcactgctgatgggaatgtgaaatggtgcacctgccatatgaaacagtatggcagttcctcaaaaagttaaaaatagaattatcatatgatccagcaatcccacttctaggtgtgtaaccaaaagaattgaatgcagaaacttgaacagatatctgcccacttggattcaaagtcgtgttat

SEQ ID NO: 27689 - DNA, 1194 bp, Bovine  19866880777103
cagaactatgtgacgcagttgcttacgaattaaaagtgttcctttgggttcttatcatttgtctgaaaactacagaagtgccagcatctacaagctctggcgctctatgagcataaaacggtgacctcgcttgagcatttaaaaaatctatttaattcccctgaagaacagacaatgataactttctgttactctggggagaagcagatggctttcttcaccttaacggtcataaaattggtggggaaagtaatgctgatcttcactaatgaaggaaaattccttttgcaaatcctgctttgaatgattttttttttctgttaaactgaaaagaggcttacttcctcaaatctgtgaaagagaagattcacaggctctacggtgagtgtatcaaattctccctaagtactgtactgatgtcatgcactacggcattaggctaattaggaattacgcctgttttcagtcccatctgtattttcactcagacaaatggaatatgatagcaatgaaactaagtggttcaatgcttatcacaataaaaatttccattaggaaaatatgtttaagagtactcaggatacctgaattacccttaggtcacttaccagaacattgatgcttcatttctaagaggctccattggaagtggcctcatcaaactgctgcacaaaatatgtctaatgtaccagatcgtgatgtcaccggtggcataaatggtacattaaccctgccaagcatttagtgaattcttgaaattttatcacttgttagtcatgaaaactgagggggaaaaaaaatattatatacccaacttggccttcatcccatgcagcctcatcatatctttgagctttagctgttctaaagcatgtttcattaatgtgactcaaagaaaccacagctaaatcataagcatcacagactcccccttgtttccatccctgtgaattcacagtggaatggccaagggatggtggaaacattggggcagctactgaatccaagagaacatcatgcttccagtgagaaatgacagggagctgtgagtaattgcattttcctgtgttctctacatctatctcttaggcaattgtggaacattctatagcacaccctgagaatataagtagccccccaaattttatgtcagtcaataacagttatctccttgagaagaaaagaccagcagaa

SEQ ID NO: 27690 - DNA, 2215 bp, Bovine  19866880780962
aaactgttctttgcttgctgaagtgtcagtgagatctcttataatcaagactgcaaagttctacacagacaactaatctgtttgccctcttttctattgccctttttaaaaccttactgtttatcctatatctttgttttgctcactggtacattcccatttcctggtatacagtaattcaaaaatctgttggatggtgtcatcttagttgatacactaaacttacacacacactaaaaatgagttagcaaaggcctaacaggaggcctggggtgatactaagacaaatgggaagtttcatctgtcttctctggtgcactggggtgggagacgctattagttggtatgcaggccttgaggctgaccagcatgacaatagattggtgggctaaagcttttgggtatcaagatgaccaaaacaccatactagtcttagataagggtaggggaaagcagtggatttgggttaattgctgtatttggggaagactgggactacatctccagaagagatgaagattctgcccctacgcttatcttctgtcttatatcctttaaagctcagtaaacagttattagattaaagcctatttgtgtctcctgagtctgtcagctataatctgaaagtgcagcagtgatgctgcagatagaaacagattttgtttcaaagtgacatccaggaggagggtacgaagccattaatgcatttcacttcaaaccgccaactcaatgtgcattctcatcaaaggaagagtattttggcatttttaaaacaggcttctgttggtcgggtaagcactaatttctaaaacataagtaatttatttagatgatgctagcctaactcataaaatggaagtacatgccaaaattaaccattagaaaaacaatcaggtgctgcataaccatttatttctcacctcactctcacttcaacccatcctgtcaggctttcctttccatcattctaatgaaactgaatactagggtctccactgtctaccagacctctcaggagcatttgcagttgctaacgccctcgctgaaaacattttcttcatttggcttccaggagttgtcttctccatttccttctccggaccctccgactctgtctgctctacctttccatgatgctcaggaactgcatttagtcctgggctccctgatctacacagatgccctttcagagggtctctggctttaagctccatggctctatatgttgatgtttaacaaacctatctgccccactcccgacttatcccattatctccccattccaacaggcaaatacccacctgacctcttcacttatttatctgaagcatatctcaagcttaaattgaactctcaaattttagtaaaccatgttttttgcctagtttttcccatctcagaaaataccagtaaaaattgctgagagggcaaaaacactgaaatccttcttaattcctccctcacaccccacagccaatttatcagcatttctgttggctctagcttttcaaaattcatatgaattctcatttcttccatcacaaccacctgttccaagctatcacgggtgtcttgcctgcagttcaaacacatcctcacatttacttgcttctactcctcttccattatcaattctccagacagcagccagaatgatcatttaaatatataagtaaaatgtcaatttcttgaacaaaatcctccaaaggtttcttatcccaatcagaataaaatgaaaaatccttattgtggcctataggtcctattagatctggcctagggatttcactctaacttcatcacttgcaacttctttcagggtgctcattacaacctcaacacaccatggttccattccttgaacagtctaatgcattcccacttcacggctttttgtcctgctgttccccagctttcctgtcacacctgcagggattacttccttgttcacccaggcctctgcaaatgtcactttttcaaagaggctttctctttcaccaaatctaaaatatcccttccctgccaaccataaccctactctctccctcactcaccactttctatacttatatcctcttattcctacctggaattataattttattgcctacctgcttcattataatataaacactacgaaggcagagacttcagcttgatcacaaccttggcatttattgaatagttaagtaatataactaacagtatctaataa

SEQ ID NO: 27691 - DNA, 998 bp, Bovine  19866880789062
gcgaggcagcctgctttacacatggtacttaagttcctgctgtgtaaaatgtctctacatagaattcctgcattactcaatgaatgcctttgatttttccccctcagtctttccactcacacagaacaccaaagctgctaacctcacttcaccaacataacaggtaaaaattacttttgtaattgcataaaccaagaagcagcctcttggcttaaacagattttttttcataatcatttacagaagacaattaaccatgcttgcagcatttaaagtccaccggaaaaacatcgatcaaaatggctcattttacaccaatatggatgtttgaaattttataagttatccacagtttttcattatctaccagcatttcaggaagaacaaacattttgcttcatttataattcattttgggtttccgtggcggttcagaaagtaaagaatctgcctgcaatgcaggagaccagggctggatccctgggtcgggaagatcccctgtagtagggaatggcaacccactcctgtattcttgcctggagaattccatggacagaggagcatggccggctacagtccacggggtcgcagagtcagactgagtaaataacactttttacataatttgtttttatttgtactattttgaaaatgtttcactcagctttataatagatattcaagaatggttttcaacacaatacatactgtctttgaaaccatattacagattttgaaagaaattgttctctactgagatgaacacagcaaatacaccataggttttaaagccagttatgattaaaaaaaatcaagacattgttatagactattatcggagaaggcaatggcaccccactccagtactcttgcctggagggtcccatggacggaggagcctggtaggctgcagtccatggggttgctgggagtcgaacatgactgagcgacttcactttcacttttcactttcatggcatggagaaggaaaggcaacc

SEQ ID NO: 27692 - DNA, 1710 bp, Bovine  19866880817243
taattttaataattatctttcctgcactaaatactgcaactggtgattgataagtacctattaagtaaatgaataaattaataaatgcctgtattgctgcaacaacaaaaaaaaattcttaaggaaacaagggtgacatccatacaaacttccctaactagagacacagatccttcatttcccctcatccctcaaatcctgctattcaaagattagtccataaatattggcaattacatatttgatgttttatatgcccagcatattactgcatataatatgcttgtttttagtaaataacactcatgacattacaaactggacttccattgtatcaggctatatgcgtgcatgtagtaaattggtaattccttatgtaatccagtatacgttaacctcattttcatttaaaaaggtttttacaataagatgtttttggggtttaaaagattttagactaagaattaaaagactaagttttagccttttttgctacaatgctgtcacatctacatatcaaatggaaatttagaatatgtgtctctaaggttctggccctttcactattaaaacttcttaccttcagtataatcttaaatgattatagggatgaaagatggtttgtacaaatcattaggcctaggttaatcagatgcctagttctgaatgaagaatgcagcttcttatttttcatgatctttattataaaaataatatgatctttttaattaaaaaaaaagaaaatgttaggccacaaccactattaacacatcattttcttccatagaaagtttaaatttttgcctatttttagtgaactttatataatttgtatcaaagaaaatgattactactttttttacttacattgccataaattttcattttgttgccttgcttgtgttaatataattgtaatatgagcatagttaatgtgacttcatatttcctgccagagatctacatttttcacaattataaacatatttagccatgtagagtttttttaaatatatttagggttatttcctcagaaccaattcctagacgttgacttcttgcttgtgtacactttcatgtttttaatacatatttcaaaattattttccaaacatattacccatcttatgctcatgccaggaggcaaaccctatttataatacttaatctacacagaatttatacctacaaacaaaaagcagagattacacttcaattctctgaacttttccatttctaaaactagcgcctttctagtttatcaagatccttcttagagactatacttatatactgctattctttttgtttagaaataaatgccagctaatgctcaaataaaattaaatctattaagaaatcaatggaggttaaaaaccaggcattactggtctaggtagctagtacaattttctactgaatgaagcccaaaaaccaccacctgtttaacaatttagagttcttactagtgtgcttatatttgacttgtgtgttagatatgagccatcagggctcctggtgcaccatcccttccatttaaatactttatcacattattctcatggacaataaatggcataactggagttcaaataatattctgcctcagttcaggaaataagttaatgagaagtgctttttgccattctaactctgtagagggaactatgcctttttaggggcggatgtattactgaattgatttatgga

SEQ ID NO: 27693 - DNA, 935 bp, Bovine  19866880932890
cacctccctccccacctttttgcttcatctcttgcctggggtggcgtctttctaattccagaagcaccatcttcctttgcactacagtcctgacagacttccttttcactgcgagctgcaaacactggccctgcacgttatttttattgataaattcttagtttctctttccgtttcactgtgggctgacagaatttcaatgctacactattatgaaattatccaggtcagagtaaaagccaaagagaatagggagtctcccttaaagtcctcactcctggaaacatcaggcacacacttcaaagtattaatacaaagtatgcttctctgattcggaaatcctccttatcttagtttcatggtttcactctgaaataaatgccttgcaatgcaggtcaaattcctgcatctgacagatcaaagatacactttatcctccagcaaaaatgaaaatcaaaatatttcagaaagatttctggccctctcccccaccaaaaaaattcacaataagcctttgttaccagtttagggaacctaccacaactgaattattaaagcatgtaagtcaacttaaataagtgatggctcaacttctctaggactctgaacaaaatattattatcataatcaaaacaatatttaaagggcttttcactgacgtcaattaaatattagaagaaaaaatgcctttacaggctgaaactgagatttgaagttagcatgtgcttttcaaaaataatctgtgatcctaatgaaaaatcaactatcaatatataaacaggcaaaatatattaaccggttgaatgtaagtgaatctgtgcaatactgctgcaagtcactccataataaaatatatattcagttttgtaaattttaaattaaagagatgggcatccttgtatactcccaaatggtcagttcatcgctaaagtcaa

SEQ ID NO: 27694 - DNA, 2767 bp, Bovine  19866881046461
cttttttcacagtccaattttcacatcccatacatgaccactggaaaaaccatagccttgactagacagacctttgttggcaaagtaatgtctctgcttttgaatatgctatctaggttggtcataactttccttccaaggagtaggaatcaaattaaattgctcacaaattaatctagctgaaggcaatggcaccccactccagtactcttgcctggaaaatcccatgggtggaggagcctggtaggctgcagtccatggggtcactaagagtcagacacgactgagtgacttcactttcactttcactttcagctcaatcttggtaaatctttcctttgatgggtttttgtctttaacaagctgtttcatgattctgcatgtgagtggcaaataacatgagcgtgaatttgatacccatgaagctgaatgtacctagtgaggctgaaaccagggactttaataaattcagaaaatattataaaagcagtaggcagctcatgtctgtgcatatgaacaaggattagctctgaggctttctggtctaccctcatccccattgcttgttcgatgtgtaaacttgggcaccattacctcacttctttctgggcttctagcagtgccgtgtgtattaacaaaatgttctcagcttctcattgaagacacaatggaaattgaagttactgctgtgcttttcatttcagtgaaaagaaaggaaagattgtcatttatagtactctacaaggctatttttagcctgtagaacataataattagaacagtgaatttaaaggttctgtcacaattccaccctccaaccacatgtgaaaaacagccccagcgaggaatttaagagagagtaattgctcacagaactttaagaatgctatataaattaaggataaagtgctttttatactctgaactcttacatcttttgctcagttatgcatatgggaccacataaaccacgcacaccctagcatcgtgagatcttaagatggagttagattgagaccagttcatccaaaactctcagtgacacctggtgaatttgaagccaggaatatagacatctcagtccagtcccacagctacttagtttatggaagtctatttgtgatccacaacacttcatcttacatgttgctgaagacatctgatcatacccactgctccccgataggcatataattcattccactgtttgagtcgtatatgtaagtgtattcataaacacattcattgacatatgtggacacacagcaccaagaagtgtcctctgatagaagcttaacccccagtgccagtgccctaaaggtttatactagatcttggtggcaatagcagaaatttgcattttggatgaaaaaaatatatatggatgctgaatagttataaaacaatctgacttcaaccactggcgccaaatttgacattttactcaaaaggaacaaatgaaagtttgcttgcagatacaaaataattcaggtagactcaaaggaaaggggagataagagaacacaagagaaggaaggagacaagatgtccaaaggtaagccagaagtgttttgattgaagtcagccattttaaaaaccaaggtgatcttaacagatgtgtagagatgtcagaaggaagaattaagcttagggaattaagaagcattagcttagggcagcccatgggcagaaccctcagcttcttgacactaggaatcggtaaggaaaatactgggtaaagcttcaaaaactgatacatccaatgctggtataaagttggtccctatggcctcatggttatagattcaaatcctgaaacctttgatttttggccctgttgtataataactgagttatttttttttatttggagcactgcttaaattctctgagatccagtttccttacttgctatataataatagtacctggtccataagacatgtttaccacatatttgtggaatgaagaattgtatttacaagcagagagggagcaaatcacagtatgatcactttgcagtaaagatgcaggaaaataatcataccaatataacagtacatggagatgaagcagtgccctaatcaaaacaggcatgagtgtatggttagttcttaagagaatcatatgaaaacatcatttcatttatttgaaatatttcttaaagtttaaaaaaaaaatactccttgttccagaatacgttttagaaatttcatgagtcatttaaataggagagctgtgtctaaaagaaagaagtgcagagatggctgtagttggtagtagcccaggacagaggcgtcaacagtaagtatcactttcatgtcttaggtcctctcataccaaaggtagtggctgcctttagcaggaaagaaagaacgtaacattctcttgtctgctttcctccaggacgacaatgagtaaagctagaacccagaagagggctgtggtgaaggaccagcagggaaaacgcatttacttggagcacctggaggatgtcccagaagcgctagaccaggacgacctccagcacgacctccagcaactccttcggcatttctgcaaggaggactcgaagcaagaggcccagtgaggggctgcccaattctcacaccagaaaccacaccttcactcaatatgcaacgtcccgtttcattagaggagtgacctcactggcctgattaatgggataccctgacatttcactttcagcaaacatgcggcatttggtttgagttttcccccatcctctttaactgtaagctaattt

SEQ ID NO: 27695 - DNA, 1254 bp, Bovine  19866881100702
ctaaatttgagtgttagaggaaagtgtctgtacattctgtattatagatcttttttgccttatgccatattcccatctagcatgattttaaagatactgttgaatgaaagaaagttgttagagttgatgttaaattggtactcaactttgtccaagtctatttctaagagcatttgtttttttgtttttgtttgaggtctttttttaggtggtggtttggtttttggtttggggtctgttttgggcatcttattagcttatgggatcttagctcccagaccagaagttgaacctgtacccttggaagtgcgagtgaagagtcctaaccactagactgccaaggaattctccatttgtatatatcttggaagctaactgaaatgaaatagttactcctcatttgaaatgatacatggctcaattttacaataggtcctatactggaataattttagaattataatcaaatgtttttattatttattttaagcccttctaaattctaatgcaggatactttggcagcaatctcagaagttgtttatgttgatttgctggaaggagatacagaatgccatgctagatttaaaactcctgaggatgctcaagcagtagtaactgcacattcggaaattaaaaagaaacactgctggcaactagagattctttctggtaaaactttatagaaccttctcttttttttttttaacaatgcttattttggggtgattgttttataatttccgagtttggcagatgaaaaactagggggaggtttctctacactaatatacgtaaaaggcattaaataactcggacaactgttccggttctactgaaaatacaaagctgtggatgtgtttcttcatctgtatccttatgttcagtgataagcatgtttatgtgtgtttgttttcttaaaggtgatcatgaacagaggtattggcagaagattttggtagataggcaggccaaacttaaccaacctcgtgaaaagaaaagaggcactgagaaggtaatcagttcatactttgtaatttcagtttctggctgttttctttcataacttggtggtaaatgattatttaaagattgtcttaatggtaaaaagcacagtgtgtatttagagtgtagtttttaaagatatgagtctccacagataagattcagaaactatgcatattattcccaatagtgatggtaagctttattcctttttctctagaatagctgacaagggaaataaacaagctta

SEQ ID NO: 27696 - DNA, 954 bp, Bovine  19866881126985
atccttttttgcctatctggtcattttgatcaacagatcttttattatttttttgaatgtcagaatctaataataagccatcatttactacaatgttacgattaattggtaagctactgttttcacagaatgaaggaatttctagttttccttcttgatcccaggattgatcattatcatctattgacttatcttcattatacctttttcccttttcagcacatgtttccaagaactggatcctgttttgcatcgaaaggtctttcaagtttaaatgaccttcttgggtcttgggtttcttttctatatcttttccatctactgtagaagaatgtacaggtgaactccgtgaggataaatacacggcccagcggcttttatttctcatggtattttctgattgatgctggttgtgtacactttctgtgctcttcacttcagcatactcttcctgttcaggtaagcaatttggttcagcaggaatttctaaacttccttgtggttgtatctgagggaaatggcctataatctcagaatttaactccttagacgtacttgtggatgtggacttcagaagagctaatatctgggctttgcttctaatgttttgtgaaactcctaaactgtgagataccaaactgtctcttttcatggactcatcagtcagtaaagaatctgaatgcttatttacagaactgacaggagaacaaacataattttcttcacatagcacttctgggttaatcttgaaggatggagtagagataactgaagaaaaaggtatgccatttcgttctctgttcttgtaagtgacaatgttctcagagtctgttggcatattacttgcatctttcttgccaattgtaggaaacaaaggaggtgtgctgtacaatggagaaagaaaggcaggaccaggtttctcagactcaagtgaagcagctgggtcactatttt

SEQ ID NO: 27697 - DNA, 1929 bp, Bovine  19866881171304
acaatggtgtgaagagagctttagcctccccttctgggttcatggaaagatggtccttagcataggttggcagtgcaatctttgtcagataagactttcattgtactttctttgtttctttcttatgacaccagtcactttttaatcatgcattattagttgtgtattatagtttatctgtaccaagtaaagttcctgagggtatatatctgtcatgtacctgtttcaatgcttttcccttagcatggactggaccagtgtttgtcaaatgaatgactcaatgaatgaatgaatgcattaatttagaatggaaatcctagcaatatcagctgtgtatgtcaattatccatcagttgatccatgcatttatatccttccctacttaaaatttgaggaaactcccaaagatacatatatagagagattaaggaaaaagctaaattaaaattaggtaagataattagggcaaggaaaagtgttggaaagtaaaatgaataggactgaaccttgttctgaaaaatatataccataaaatcttatgcatttgcaaggggagaacattgagttggtgttaaacttactagaagtgtatgaaggaagcagttgattttctatatctagaaaattatgttgccagttgctcacatgaaacagttattgcaactatgaccagagagaaattcttctcatggtatatcagaaggagtttattgtgtagtataaagaataatgtattcagcttatctttaagcacagcaaggcatttcaaagagtattatattacctttggtttatactgatagcatcttcaccataacttatataaagagtacagctgtggaaagggataaacagtggttcatgaaatcctgtgataaaaacagaattgcaaaatatctgttaaacattttttggaaaatctatgtttagcaattaatgtggatataaagtttcaatagcaggtaaaagaaaaaaatgtggaagactataaaatgtattatataattattagaataaattataatcaattaatagaaacagttgtctggagatggggctcaaatattgatgagcattatttactgttttttgttttttttttttacttttctatgtataactatagaatgcagcaaacagaactagttgttaaagagcagggaagattcagttaaatagagaatctatttctttttaggttgtaatttaagctccttttcagtagaaggaaatggactccagtgaaaattcatagataccaattatcccagaaaatgattacttaaagaaaggtgagagtagaaaccaattaaagaagagcatgcacctggagccctctctggggatgggaaagttggatagaagtgttgtaactgcagggatgtgatagcaatagtatgtctttggggaaattagctgtcagtttcttatgtacttgtgtggattttatattgccatcttgtaacagaggcaccaccaacgtcagtttggagatatttgtccacatgcagaaatttactgagggcttaccaggtggctcattggtaaagaatctgcctgccaagtaggagccacaggagatatgggtttgatccctgagtggggatgatcccctggaggaagaaatggcaacccgcttcagtattcttgactggggaatcccatggacagaagagcctggcaggctgcagttcatggggtcacaaagagtcagacatgactgaggtgactgagcacacacaaaaatttaccgaagagttttttaaaatgtgacatccccagagttaaatcttggggaattttttggctttgttgtcttaatattagaaattctgaggttgggataaaaccttactctgacctccgtccttacttctgacttgtggtgttggtgctggcaagggtaagcagacagatctaggatggtaa

SEQ ID NO: 27698 - DNA, 1583 bp, Bovine  19866881268447
attcttgctcggagaatcccatggacagaggagcctggcaggctgcagtccatagggtcgcaaagagtgggacatgactgcagcgacttagcatgcagcatgctacatgtatatatatgtttatgtatggagccatctcttggtatccatagggtatcagtttcagaaccccctcagatatcaaaatccgaggatgctctgtcctttgtgtaaaatggtgcagtgtttgcatataatgtgcacatccttccgtattctttatatcatctctagaatactggtaacacccaatatagtgtaaatgctatgtatttaaatagttgcctgccatgtgtcaaattcacagtttggtttttagaacgttctggaaaatttttttgaattttgcaatctgtggttgagcgaatcatggatgtagaaccttggacatggagggccaactgtacataaaatggaatattgttcagccttagcagaaaggactctgacgtgctgcaacatggatgatccttgaagacactgttaagtgaaatgagccatccacaagaggacaggtatcctctgattctgcttacatggggtgtcgtcagagtcacagagacagaaagtagaatggtgtttgccagggtctctggggaggggaagtgggaatcttgttcattggatataaagtttcagtttgggaagatgaaaagaattttggagattggtcgcacaacaatgtaaatagtagttaagatggtatattttatgtgtagtttaccacagttaaaaaaaaataaagtatcaggtggtgataagggctattgaaaagacaaaacgagatgattgtgggagcacgagggaggttggggaggtgtgagctgttattggacatttggtggtcagagaagaccaccctaatgatgactatcaggcagaggtgtggaatatccgaaggaggggacacgcatctgggagaagagcattttaggcggatgttaaatgggaatggtcaaaggtagggctggtttgtgtttcggaaacagggagcttggcagtgtaactcaagcaaagtaggtgaggagagtggtagaatgaaatctcagaggggtgggggtgaacagatcatgtttcaggttatgacactgagtatgtataaatgcatccttgtatgaataaaatatgggtattatatttctctgtgattgcaggcatagcgttggtttttttgaaagcagatgattgtattgattgaaatcgtatatgtttcccccctctacacctctgcggttaacacataaacatttcgtattggctcacacagtccctggaccaaattcgtatgattctttctcaccccttcaaccccccatgccagaatttcttcagagtcacaaattaagcttatcttaagaattctattattgtgaatgtaaattaaaaataatgaaaatcaaagtatcagccttactgatttcagtattatgagtcattcaatgggcactatatactaaggtgggttttctcagtgtttataaatatctagctagagcttactatggattttatatagaaagtaaataatacagacaggctcagga

SEQ ID NO: 27699 - DNA, 1180 bp, Bovine  19866881328823
gggaaggaaggaatggaaaattatttttttatggaaacagtttcagtctgtgaaggtgaaaacattctgaagatgcatggtggtgatgattgtacaacaatgtgtatgtacttaatgctagtaaactatacatgtaaaaatggttgaaatgttttatgtacaatttaacacaatttaaaaaaaaatgaaattctggtatatattgcaatgtgactgaatcttgataatattatgcaacctgaaataacagatacaaatgaacaaagattgtatacctctgtctatataaggtacctagaacaagcaaatttatagggacagaaagttaagtagaggctattaggtgctggagggagaggagaatggggagttattgcttaatggtgtaatgtttctgtttgggatgatgggaaattttgcacagtagtgataatcacataactttgcgaatgagcttcatgccactgagttgtatgcataacaatgctaagaatataagtgaaaatggtcagttttatgttatgtatactttaccacaatttttaaaaagttgaatgatttttttaatcattctaaatgataataggaaagggcaaaaggaacacttccaaagcaagtgaattttacttttctctggttcttttgagtgtcatctcactaaagtaaacagtatgtgtcacacgtgagtgaagcatgtatgtctttcttgttcaaggtacgtgatacgactcaggaaccttgcggacgactatcatttatgaaagagccaaaatctacaagaggcctggtgcaccaagctatttgcaacttaaacatcaccctgccaatttatacgaaggtattataatctgctgtagtgcaattcaggctgtagaggatttgatttccaaatcctttagaatagatacaggcaaagacactgaatgcaaccacgtataatagtcatttttgataccctgtccaatttgtgatgttccatttaagtaaggaaaaaagtagctctaccttattttgcattaaattcactttgatggaaaagtttctataaatatgtattggctatggaagagagaaaatttcaatgtaaggtgtaacccttttggactgattttgaacatgaaattattcactttgcctcccttatgggtttttgtgcgccctcctggcaccatgctagtgg

SEQ ID NO: 27700 - DNA, 934 bp, Bovine  19866881421052
ctgaccagtgagtcataccagccctttgcggtgaaagcacagagtgcaagccactggactgccagggaattccctacatgtgtgtttcccttggtgattacatggtctcaacacttaaacacctctctctggtccagagtttgtggggaaagattgtagttgatacttattctgttcatcagggttgaatatttgtcgtttttcattttaggtgctataaatagttgaatgactactgattattttctggacctgactgtaatatcagaagaaataatggaaagccaagaatttattgtaagtcttacttgtgttcactgtttcctttttccttccttctttgcatgtttcacaaatgttttgccagatttagctaaaaaacctaaaacaaattttttaaaaaccccaaacctgggactttcctggtgatccagtggctaagactccttgctcccaaggcaaggagtccaggttcgatccctagtcagggaaacagatcccacgtgttgcagttaagagttcacatgccacagttagggattctgcatgccatggtgaggatagaagatcccacgtgctgcaactaagacctagtgcaaccaaagaaaaacaaaaaacccaaacctaaaataggacactctgttaaatttgaacttcagataaacagtgaataattttttagtataagtattcatctcttaaatattgccctgtattctggctggcaaccctgtattttgcctagagttcacattggttatgcaaaattctttggaacaaattctttggaagcttggaaccaggaaataatttctttctctcgaaagactggcacgtctattctatctagattaatggttcttaacctgtttggtgtcaggacccttttatactctcacctctcctttctcccctccatgtcttaacgaccagg

SEQ ID NO: 27701 - DNA, 940 bp, Bovine  19866881435898
ttgatgaggatggaaattggaaccccctggtacattgctagtgagaatagaaaatggtggggccactatgggaaccagtatgacggttcctcaaaaaattgattaaataactaaaagccgggtctcaaaaagttatctgtgtaaccatgtttacaacagaattattcacaatagccaagaggtggaagcaacccaagtgtccatcaacagatgaatggagaaataaagtgtgatatgaacattcaagatgagaaaagaaccttttggaaactaatccaggatgtttaagaaaaaacttttcgccaaaaagttaaactatgttcatgattctgagttttttccaaaactgggccccacacaacttaaacatggatgtacttgctttcaaactaaaaaaggaagcgcttccaagtttcggggatggatctggccctacctcaatagcctttgccacttgttcttttgtttcaaattccacaatggtaaattccctttggatcagacttacaatgtggtatacttatataaacaacatcaccacctttcccaaataacttatttgtttttgagaagaagatctttaatttaaaaagcttctctattggaatggataaagaagatgtggtacatatatacaatggaatattactcagccattaaaaagaatgaaataatttgcagcaacatggatgtacctagacagtgtcatactgagtgaagcaagtcagacagagaaagaaaaacatcgtatgacatcccttatatgtggaatctaaacaacaccatcaatcggctatatcccaatacaaaataaaaagtttaaaaaaaaagtttttcttattttatttctaattacatgcattattacttttggaaattacaatgcagctagtagcagagacttattcaacccattaagtcaaactggggacctcataaa

SEQ ID NO: 27702 - DNA, 959 bp, Bovine  19866881684149
attctggaaatttccaggaaaggagattctttccaaaaggaaaaagtatgcaaaagaaacataagcttgtgtacatattcaaatgacagaaatcaatctctaatctatgtggctataaagataccatggagtttatgtaactttttaaagtaaggaatttgttggctatatgcagtgagtggtttgtgttagattactgtgcaaaagtacaagtttgtttttttttttaatcaccccctatattatcttccagcttccctggtggctcagtagtttaaaaaaaatccgcctgaaatgcaggagacctgggttcaatccctggggccgcaagatcccctggcaaaggaaatggcagctcactccagtattcttgcctgagaaatcccatggacagaggagtctgatgggctacagtccacggggctgcaaagagttagaaacgactgaatgactaaacaataacattatcttggaattttaagaattttggttctgtttttgcttagtagccttcaagaaaagcatcactgttcataatatttcgggaaatatttcctactatgaagagtgttgttttttaaaagagaagaacatcaagaactattaacacactagtgcaattcagaagccagccattcacactcatctgcaatattttatttgttccacattttgcttggttttgctgaaagaaagcaatttcgatttgtactcagatttgcaaagacgaagccagtgccagatatccttagctggatgcttgtagcactcttttaacttaaataaattcaagaggcacttgtgtggtctaaaagattgtccagatgaaacgaggctgaaatgttatgcgaagggggaggggagcgcgtgaatagcgtcagtgaatttggtgaccgagggccgctcctgtccattgcgtgaactgtcctaaagggtcaaactgttcatcttcagcccct

SEQ ID NO: 27703 - DNA, 1350 bp, Bovine  19866881968234
cagtgcattgaaaagcggctgtgaaaagacaccatagagatacagagttaactgagaaagtcctaattgtttcattccttagctgttcacttccagggcaacagagatgcaagtgagtaagctctctgtaggtttcagcctccagcttttgagatgctcagttgatacagagcagagtagacattagctgaccccccactgaggcttgcccagattgaagatttgagcaaagaattaatgttttaactcaagtgtggtgtggctctttagatagccacagtaatcaggacagatgttttcatgaagctggtctttgggagtctccgcagatcgattcctgtgtcctttgacacagtgccagtgctcttcagtagtttccctcttttctggcataagagaatgtcctgagtttaccttgtgcattctctgcctagatctgaaatcagcctcttctcctacaaacccgtaaaaactttttactaggtaatagtatttaggtttcaaaatctgggcattaggaatgcttttcatgaaacaagttgtaatagaagaattacaaacttgatgacaataaaacatttcagcatatttcccaaaagcagaattgaaagacaaactatgaagcttagcagaatggacgagaatactaaaattccaataaaaataaaaaatgacatgaataagcaattcccaaaagatggaatgctaatgagcagtaaatcatctttaacttgctaataataagagagaacatatactgttattgtcctttatcaattcactagaatttctttgaaagaaataagcttcaatgttgataaaagtatggtaaaactataatcttgtacacattggtggaaatgtcgcttgatttttggctttctgctaagtaccttggaaatatgaattaagttgcagtattaaaaattgcagccacttgtattagttaggatagagcttcagatgctgtgacaaagaggtgccaaataaagtatcttaaaaaaatttatttttctcccacttaatagtccatagtaagtgctctaggttggaagaaaagctctgctttctctggtcatttgggggccctgtttccttcccttctcttgctctgccatttccaaagtgttaaagctgtgtggttgatgccaggtcacaggtaagtatgtgttgcagttcatatgaagggaaaagaaagaagtctagaataagccattttaaacaggagatgtagaattctgcttacaaggcctcatctagcaagggaggttgggagctatagtctgctcaattaactatgtatctagcttaaacattattactttggaagaaggccatatccttcaatta

SEQ ID NO: 27704 - DNA, 1055 bp, Bovine  19866882021765
ttctctcctggcgcttgcacagtaaagcctgcctacaggctacacagtaagcctgcctacaccacaacatgaggttgtggtgaaggaaataataccatgttattgcaggtgcaaagcaagaagtctgggtttttgagcattagctgcccagaccccttgtttagcaccagtgactcagtggtaaagaatccatctgccaatgcaggagacgtgggtttgatccctgggttgggaaggtcccctggggagggaaatgacccactccagtattcttgcctgggaaattccatggacagaggagccaggcaggctacagtccatggggttacaaaagagttggacatgatttagtgactaaacaatgacaacagagtgttctggtatattaccatggtgatgcattggagtgcacagtatatttgcctagtcttatttttgttgcattcaggaaaatgaaattctttaatagtaaatatcttagattaataaagaaatacggcccatctctatctttcatgcaaacttttctaaaatatgaaatagaatagatgctgtttccagagaaggcaatggcaccccactccagtactcttgcctggaaaatcccatggatggaggagcctggtgggctgaagtccatggagtcactaagagtcagacacaactgagtgacttcactttcacttttcactttcatgcataggagaaggaaatggcaacccactccagtgttcttgcctggagaatcccagggacgggagaacctggtgggctgctgtctatggggtcgcagagttggacacgactgaagcgacttagcagcagcagatactgtttcataacaaaatgaatagatactggataatatatccatgattttcaaaaatgcctaatctgaacatttagatatttaagacactgataaaaagtgctaaacttttctccaggaaaacttacatatacccataactactacgttataggacaatataattttttctttcatcaacttatttttcagttggaggaaagtagctttacagtgttgcatgttt

SEQ ID NO: 27705 - DNA, 918 bp, Bovine  19866880574974
aaggataggagcaagatggcagtgtgtgcaaagtgatccagaataaggaatcatattaattttaaatatgttgcctttaaaagcaaaacatatttttaaactaaccatcttcacaaactgagctttgtcagcatctaagggaaaaggcaaaatatttaactaaaggtatagaaaaggttcaaatccatgcagaggaaaagtaaatgcatattttgagtttatccaaatgctaaggcctctttctgattctcacaagtgaccatcagacttgaactgttcaaaaatttccaaaggagcccatctcctcaccaaaatatttctatgttaaaaccttcaagaaggcaactggcccagtttttatgatcccaaattaccttggtttcaatgtaatctttgtaaactgggattcccttaggaagatttcaatcttaaaaataaagggatattaagaaacaaaaccctatcccctgctccattttcagagcccatatgccaaaattgtagcttattcatcccaagacattaaaaaaatatattattttgtgacattaacttagaaatttgtacttttgtgtggaatattctaatgtaaaactagtacattatgataaatgtccctttcttggaacctcctctgagtgaatcatcctaggaagcttttctttcattttaatttgtctattatgtcagtgtatagaaccaccttaacaagatggagttaagagaaaaaaatttaagacttagttgtagcccctatagtaactgtatttttctggtaatttaagtttttattagctgaaaatactggttaatgaccacagtgacgcaatggtctagagaccacctctaatcatatgaaagtactttcaaatttcttagtggggaaattatccccaccctaaaaacattcctgtcctt

SEQ ID NO: 27706 - DNA, 3647 bp, Bovine  19866880558434
tcatctgctcatttgagattgttgatatttcttctggcaatcctgattcccacttgtgattcatccagcctgacattctacatataagttaaataagcaaggtgacaatatacagccttgttatattcctttcccaatttgaaactagtcagttgttccatatgagactgtaactacttctccttgacccacatagacatttctcaggaaaaaagtaacgtagtctggtattcccatctttataagaattttcacagtttgttgccagagcacatctgggtaatgagctctacctatttgccaatttgagtttgacatttgctttatttgtctgtgctatatgttcatgataaacccttagcatgcatgagtcaaggtattatttttcaaggaaattaaatgaagctaatcatagatattttcaataagaacactaggaaataaaaaagcaatcaatactgacaaatctcattgggcttcctaggtggtgctagtggtaaagaatctgcctgccaattcaggagatgtaagagatgcaagaaatgtgggtagaatctcttgcatgtgtgttgggaagattccctggagtatggaatggcaatccactccagtattcctgcatgggaaattccagggacaaaggtgcctgccagactaccgtccatgggccacaaagagttggacatgactgagagttggactgtgaagaaggctgagagccaaagaattgatgcttttgaactgtggtgttgtagaagactcttgagagtcccttggactgcaaggaggtccaaccagtccattctgaaggagatcagccctgggatttctttggaaagaatggtgctaaagctgaaactccagtactttggccacctcatgagaagagttgactcattggaaaagactctgatgctgggagggattgggggcaggaagagaaggggacaacagagaatgagatggctgggtggcatcactgacttgatggacgtgaatctgagtgaactccaggagttggtgatggacagggaagcccggcatgctgcgattcacggggtctctactagtcggacatgactgagtaacagaactgaactgaactgagcacatagaacataaatctcattaaatatataatgcaaagtgaattttagaaatgacaagtattctgtgaacatttagaacaaattcatagtctcctctatccacaatattaggagattaaaaattagactacattttatcattatcattgtaaactgtgctatttggcttgttgcatatacttaggttgctgtaaaatgttcttattcaatttatgttttacaactgctaacatgtaggaaaatggagaaatacaatataatttccacataataaaatgaaagaatgaacagtgatggaaagttagggtgttattaacttcaaatttgccttcacatgaggacgtgtgaaaaagtcagcatgcattttagcaggtagacagtaatgggactggaatatgagatatattgttggataatttatcttaccttggcctacctctcctttcctctactgctatcagagttcaggccattattacctattacctgagatattttaatagcttttcaactcatcccatcagtttcagtcacttcctgacttagttcatttcttacatactgctctattcaatatcctgaaaaatatatttgtgttcattgctcatcttagttcaaaatctgaaggggtttcattgtcctaaacctagaatagaaattctcaggctaaatcaagtgtttcaatatcctgacaaaaatctactcttcatcaatactactcaatattccaaggaccttacctttcaggtaaatctaatcatcatgaagtaatcactcatatactcattactggaatggctttctctacatcaaggtgtgcaaatcctacttgtcacttagagtttgtttaaagtgacaaatcccctgttacatgttcctagaatccttgcctcttctggaaacaaactttctctcctgtaggtagagctagaactctgctgccagtatttgataaaagtgttttctcccttaaaatccacttagttgggacttccctggtgatacagtggttaagaatccacctgccaacacaggtgatgctggttcagtccctggtcaggaaagattccacgtggagtggagaaactaagcccatgagctgcaactgagcctgacctctagagcctgcaccttgcgaagacagaagccctgaaatgagaagtccgcacaccacaacgaagagtacccttgctaactgcaactagagaaaaccctcacacagcaatgatgacccagtgcagccataaataaaataaataaataaaatttaaaattagaaaaaaaatcatttagtcacagatatttatcaagtaacaagtatgagtgtttacttggaccattttgtttacatgtaaactaaaacagaaaacaaaacatttatgtaaaatacttgacaggatactttctattttattaggtaggtagtcaagcagtattttcctttccatgactggtttattactataaatttccatagcatctaatctattttcttgtacataacaaatgctcaacaaatctttgttgaactagcagatggtctttttagctctttcttcatttctttaaaaactgttacattaatgaaattaagtatcatgttattacaattcatttatgaaaaatgtccatttgcatggacacatacctgtatatactgtaatgtacaactgataatacttttactttccaagctcaaagaacaattttaaaaattcataattaattaattatttctagtaatgagaataaataatttcttcttttttttgaagaaaaaattaaatgtactatttacctttcaaaagagaaactaacaaagctgaaagtatcttaagtacctgataatagatactgtcttttattatacttaacgaggcagcagaattttccatgtttctattctatagccttgtgttgtataaaccaattagatcttcatacaactacaaataaattccaatcattaattcagcatataaaattattactttcaaagatatttgttatcaagtgaagttaatgatcaactctttcctacacagaaaacatacaacaaatcaatattgaatcatgactaatgatgtcaatatataacaagcatactgttataaagaaatgaatttattacccctttgacactcagttatagctaaaactgtgtgatgttttaatgaacagcttccaaataattgcattagaatcaactacatatttaaactgtgttaaaaggcaacatagagagggtaaaattgccttccccaaaactcaacaaaagcatacttgtgtttatcatcccctaaactattttcaaagcattttatgaaacatatgatgtgttcagtagtattttgggtgttctaaaggatatacaaaatgtatttgcagatatcaccttcaaggatgttataacttagtacacacatgaagcagatagcattttacactatttggttaaacagtgaggtaggttgcatggattttatagctacttagttttaagaaagttcccaaaacaactggaatagttctttgcaa

SEQ ID NO: 27707 - DNA, 1704 bp, Bovine  19866880582674
tttttagtattgttaggaaagttttacttgtgttttagaacaggaacagatttctaacacattatttgcacagccaactataaccaccccttctgtgcttgctcagtgttttccatcagtgctcccagaactcatttttaaaagtacatattatttttcccagtaaatcaagcaagctctatgggagcatagtacaacctttcatgaagaaacagtacagggaaacaatattttaaacttactaggtttagctgataaactctcatcactgctgtagatttataattatcaagtaatgattattttctgaactatgttttctgttgtccaaatgccattgattgtttcaaacagacttttcattactaaggtcttttttctatacacttttgcttgctctgctgttgctaagtctaacaaagtcaaaaaaccaaaaagcttaaaagtgatagatcgtctcaagatacaaatagtgatgaaaatgtcatatggaaaaataacagtctttaaaatgttcaagttatcttaaagttattcattttttttttttctttcaaatttaagactatttgaaaacaagtctcttgcttggatgcagctagtataatgtacatagtaaatccactgggagattgttgatttatcccagaatgaccaaactagccaagagatccaaggttgtttccatggtttagtaatgaaccaaacccctctccactgagaggtagtgatgggacatgctctgtggttcaaattcagaccagctcaattttaggctttggttttacactggctactaaaaggaaggacttccctggcagttcagtggtaagaatcttcttgttaatgcaggagaggcaggtacaatccccggctcaggaagatcccctagagaaggaaatgacaacctacttcactattcaccatgagaaaaccccatggacagaggaaactggtgggctacagtccatgtggtcacaaaagagtctacaacttaggctaagactaagacttaggctaagttgtgtctacaacttagcaactaaatcacagtaataactagaaggaaagtgattattactacatggaggagaaggtttgtaatgaattgctaggtgaaaacagacacctcattaggatttaaacagttgatttggttatcttggagttttggtatctaccattataatcactaaacttattgtttaggagatattaataaataatatatatcttacctatttgggtggaaatccagcattagagacaagtcaacatctctttctgaataggaactacatagctgtttgatgatagattgatgttagaccttgaagcccatcagtaaaaacttcaggataattattttttctatgaagatttctgatgaggccattttatcttacttagaaattttattttgccataagaagatgattataaggataaacttttgaattttcaaatgattaacatgaatgtgaagtactgggagcttgattcagtgtcctgatattattccttacttccaaagtacaaccaaattcctttgtgtttacatgaggaaagatttccattaaaaaatatagaaaattattatgtcctaatgttcttatttatctgttgcatttatgtaaatattttcataaatatttcataaatattttcataaatatctcataaatattttgtcagcagtccaat

SEQ ID NO: 27708 - DNA, 1481 bp, Bovine  19866881298849
ttaagtactgacagaacattaatatcagttttagaggaaggaagggagtatagagagcggaagaagtataaagagaaagtttgtggtaacagttaaaacaggggtaaatatatcctaacaaatagcatttggaggtcagtgattcctctagaggggagaatttatgttacacagcaggggggaaattgaaaaataggttggggccagatttcaaaaagcctttaaaaggccagattattgaatttggactatattttgtagatattaattggtactatacttctagaatatttttaggatgctaaaagcagtattttaagataagtaatttgatagtaatgttcagaattattaaatgagtaaaattttatattactgatatcagttaggaaaacattgattagtcagcagtaattcataatgtcaaatgcagtgggaaagcaatggatacttttgaaaaatattataaattcacaattcaccaattatggcaaatgattaaagatcaatggttagaaagaatgtgaggttaaaaaaatgactgaaatttctgagccttctttgaataaaaggatgtcgattccatatgactttgttagtgaggagaggtattagcaatatataatagttttatgtgtttaatagtgtttaaagaaagtttctgttaagcttatttaaaattagcagatgcaagtacatatgttggaaagaagagtatgagttgtataaaaaatgataaatgtttatttagagggtatgaaatggagaaggcaatggcaccccactccagtgctcttgcctgaagaatcccatggatggaggagcctagaagttcttgcctggagaatcccagggataggggagcctggtgggccgccgtctctggggtcacacagagtcggacatgactgaagtgacttagcagcagcagagggtatgaaaacataacacaaaataaaatagattttttaaaaaaattctataacacctctgaaaaacacaatagagcaaaatttagtgtgaggtagaccatcctggaaaacatgtcactttagtctctaaattattatgcttaacacagcagcttggtcatcataagcacgtttttgcctttatgaattatttttcttaaagcatctccaatggcataaatcccaagaatttctataaagcacaggatacaatcaaactttacttattttcaccttgatttacatatatgataatttatgtgatggatatcttacataggcatctataggaatgtttctttttttctgttcttacagatgtatttctatttgaaggaggaataattggtttttttttctttttaataattcaattaatggtttgttgagtgccttctattggagaatcactaggttagctgctggagatgcagaggtagagaagtgttacagctcagagttcagcatgaaagtaaaatgaatgaacaattataatggagttcggaaaag

SEQ ID NO: 27709 - DNA, 1194 bp, Bovine  19866880514321
ctttctttgactcttcttcttcctctctccttaaacactaatgcttcctggaatttcatatctctctcttctgaatttcaactgtctttagtctcacctacttttctggcttcactgatttgcttattgattaccaagtctgtatttccagccccagattttctgtgcagctcctgatctgtacttctaattgtctgtcggtttacttagatgctctgtaggcattgtgtcagtcaaaataggcgaggctgtgctgtggtgacaaaagactccaaagtctcagtggcttacaaagatttatttcttgctcacattacacattcattgtggccctcctgcagctgtgacctcgctgtgctccctttggaacctaggatgttggagaagcatctgtctggaacttggccagtcattgtagcagaggagaaaaaagatacatgtcaagccatattctggctcttaaagcttctgcctagaagtggcacatctcagaccacattttatcagtcaaaggaagttacgtggccacttgtgagttaattgggtagggatgtataatgtacccccaccccctagcccccccctccccccgccagagggtctctagaatatttggccccagtgatccaatctaccacaggcgtttcaagcaaaacacatataaaccctttcctgattgttttaggataatccaaaacaataggattctcctcatccaaaaggtattcctcccctgattctctgttcttctgttgcttggtatcactgtgttagttagccaagctagacaattcttaagagttgtctttaaattcttctcctctattcccctccccccttcctgtgttcagttggtcaaacagtcttctgtgctctgtcctgaaatctcttgtctcagctcttctcttgtgtgtcccatctgccctaggcagaacttgttaggattgcagaagactcatagaggtctccttttttccattcctctttcacagatgcatcctccacctgctgtcagggctaggtttttaaaatacagatcttatcctgccactccactgctcaaaagtctttgtgttttcccccattgcctatgcttgagggtacgaaatgctttcttatggtgttcagtgtcttcccgaggtagccaaagcataatatttcagtttgctttttcaacatgtactcatacacctt

SEQ ID NO: 27710 - DNA, 1373 bp, Bovine  19866880528054
taggtacccaagggtcacatatgaatttgatggaatgagacttttcctatactcatgtattttattatatgaatagcatatgatactcaactgaagtgaacgatagttaaaatggagtcaaataaattcccatcaaatttgtgccaacatgctaaatatacttcctatatggaatctttctgtacagcagaagtggttggaaattgaccaaatagcaagatttttcttatttctgcttttctggaagtttgattttagagtttgattatagaagaacttgagaatttttaaaatgtaagcaatcatcacctaattttgtggatggttagattgagacccaaagatactatgcttggttcaatgcatgtagttgcaaggaagggcttagaactgaaactttggttttcctaattctcatttcagtacactcctcctgataatgcatgtgccagtgaattcttttattgatcctgtacaagtattagttttgttgaacctggtgaaccagttcgaagattccttcatcttaactttaactggaagttgacttttttttttttaactccaaataaagaataaaactgattttttttccctcaggtaacttgtccatcttaaatgtctttttttcccctctgtgaacataccagtgtgtcatctaaaaaattgatgacaataatgcagcccaaagccacaggtagaataattcagtctggattcccttagtgaaaccatggagtatatttgtttgtgaaaatatttaaggatgaaatagttgggccaagggaaatttacagaaaattcaacatcttgaattaaactgattttcaagagttcacttaagagcagtttacttacttgttactaatggcctgaacccaacttagctctttgatgactaattataccctttttttttggtaggtagggaaaagtggcaatgtaccagcaggcactactgtggatagcaccatcacacatccatccgagtttgacttttacctctgtagtcatgcgggaattcaggtaatttggaagctggtccagatacttgtcttgatagggaggtgtttgaaaattcaggaactagcttaagtagacttgtcattaaacactgtacataactttgttaatacttgtgtcctaaaactgttacctcttggtctgagtatctccttgtaggtgtgctaggcaggactatttctgaatttaggtaggtttccattctcctctcaggtagtacacccatgtcagagacagtaatcatacaattctttctccagggaaccagccgtccttcacattaccaggtcttgtgggatgacaactgcttcaccgcagatgagctccagttgttgacttaccagctttgt

SEQ ID NO: 27711 - DNA, 2214 bp, Bovine  19866880583478
ctcttcctaatctcactgggtttgcagccatgatgggaaagggggccctacacccagctccaggaaccgcttcatttctccctaatcctcccaatagcagagacagcccagggtggggcaggatggaccagcatctcagggttctttctcccacctgtgtacatcagctcagctacccagggacaagcaggcccagagacaaatgggaaacacagagagatacatgggagacattgtcatacacacagctgcccagggcacatagacacacacacagatgaaacgcactgaggaccaagaacagacgtgaacaccaatagagacagacacacagtctcagatgtccaggacacagaaacacatgtccacaccaagccaggagcccagggacatttgtgcagacacccatggactcatacaagccactctgggatgctcagacaccaggaataaggggatattcccacacctgcacaaatgcagctcctacccaagggtgcgtgctcagtcactcagtcgtgtccgactttgcgacccccatgcactgtagcccaccaggctcctctgtccatggaattttccaggcaagaatacttggagtgggctgccatttcctactccagggagtcttcctgacccagggactgaaccctcctgctttgcagggggactctttaccactgtaccacctgggaagccccacccaagggtaagcatatactcacaccacccacagagtagaacatactctgaccaacacatcccactgaaagtaacaggaaactcacactcatggaaacatatactcttgtccactccctacaccacatacacatacaagcacacatgcaagcatgcacacaaacactatcgtcaaatacatcaaaagtcatagtcctgaagcagaaatacctacccaggcacaaggacatacgcagagacaggcccaattatgaagacaaactatggaccccatgctccctgctcagaacacacacaccagagaggcctgtacctgacacagggaatgggccttaagtcctgggggtcctttttctgggtggggtgggggctgtcccttcccctaacccagcctttccatcatgcccaatgtggctgagtcctgcatcccttcttggtacccaggctcttctctactcccgaccctccagcctgcagacccatgggagctgccaaggacataggcctgtccagagagcatacataatcctcctgggagactgaggtagagatgaccctgtgtgtcctggggtggggccgtcccctctccaaacccctgaggaagtctgaaaggaccacaggttttagccttgaccctgggcagggagctgtgggctggccttcctacctgcgaaggacaccacccaggagagaggcattgaggcactcgggaggtgagagtcgccgctggacctcccccaccgtcaccttgtacttggacgtcgagctgagcagagagagccggccgggcacggagcagaagacctcactggggttcgtgatgccgccaaccaagctgtctttggccagtgagagggccgaaaggctgctggctttggaggggatggggactgtggagcagaagcgagagcaagggagagaaacactgagcactggccagctgggatgcgagcgcgctgctgaggtgccagctgcgagtcagcaccgcgctcacacgctgtgcacacacagctgcttctgcacgtcccagcaccttccagaaggaggttctactaaccctgctttaaaagagaagagactgaagcatgatgaggttaacgtgactcactcatgttcactcagccaatgggtggtggaaatgaaactcaaaacttctctggctctggaaccccgattcccttcattgagtcaggctggttccctgttaaaaatcaaacagcctcagcagtcttgggagtttgggcatgcatgatcacagagggtgttggaaatagggaaacggaatgtgagctggcgactggattcctgggtcactgccagatcacaaggagtccccgattccctgctcccactcacctgtgatccccatgtctcccccaccatctcaggtcagtgaaaggcctgggggctttggactcccgcattccagagacagggaggttatgaccccattaggcccccaaccctggccctcttccagctaagtcactctgggatgtcaagggagtccag

SEQ ID NO: 27712 - DNA, 1866 bp, Bovine  19866880670449
aagggaagagaatatgtagggtttttttagctgatggaaactttcttttttttatagaatatcttgtaaaccatccaatagaataatttggaatgactgctctatctagaccagggtttctcagcctcagtactattcgatactttggactgaatacttctatattttggggggctgtcgtgtgcattgccagtatcatcccccaattcgtgacaaccaagaaggtctccatatatttggcaaatgtttactgggggacaaaagctcccccaagttgagaactgctggtctagactgtcagttccttgaaggcagaggttctatctttttcttgaatctacagtacagcttagacatggaataaatgaataaatgtttgttgaagaaataaactaaatcttatggtcaggaaatatcagattgtccagattttttaaatatcaggttataaggaagaaagtagcctcattggtattgtttcactatccaaattagcaattaaattgataaagatagctgctgtttaatctctgacagtctgtacaaaactataacaatcaagctaatttgtggaggattaatggatcatctccagcatgaactgatgatggcctccagagtttagagatgattttattttaaaatgcatacaattttgtaagcctagctgtagatctactgatactgataaaaggttttagacagtagagtgcatctgagagttcatcatattgtatctactattgacatccccccttattcaaaataatagcagcatggaaaaaatatttagaaatctagagaatcttaggccaaaaagcttttgacataactttttatatcggagtatgttcagtgaagtataagatcacagtaattgtagctgtttttgttttgttttggctgggctgcacagcttgtgggaacttagttccctgaccagggactgaacctgggtcctgggcattgtcagtgcagagtcctaactgctggactgccaggggattcccaactgtagctatcatcatcatcatgatgaagggaatattatccttcacaaacaatagtacatcaaataatctttcaatctcttcaggacctccagccagcctgtttcagccacctcgtcgtcctggccttggaactgtcggaaaacccattcgactgttagccaaccatttccaggttcagattcccaaaatagatgtgtatcactatgatgtggatattaaaccagaaaaacggcctcgtagagtcaacaggtaaggattaaaaagaatagacttctatatgtatttaaatacacatagtttatttattatgaatcatcttgttctctaaactcttttaacatgtaagctttgtttttctctaagacagtgagtttcttgatagcagatatgctatctcatacttggttctccttcatagatgctagcagagtactggacatatcatccttcagtcagtaaataatgaatgaagaattgtccctctttcactgtccaaaggtagcagaaatttataagaagtagatgaaaccattgatatccatggaaaatagaactatctggaaattcaaattttattattaagtgttggcattggacatgagaaaaatgtaagtgtaaagacagaagaatcatcttggggtattgaagaaattaaactcagagagaagctctgtttaattctagcattatccaagaggggtctagataggatgatttaagtattgtggtctgtataacaggaatttaccaagggtgaagatatagccctataacagatcttattctagtgtgctgagatcactcattttccttgtctctgtttcttcactgatactcagacagtcattaatat

SEQ ID NO: 27713 - DNA, 1736 bp, Bovine  19866880726161
tcccataaagttcttacagagtttatttgactaaatatgctcagagaaaactgaaagaatttagggcattaacctaaggtgttaaacaaaagggatctacatgttaatgtgatttgaacagaatgaaatctacaattcatgaaattatttacaactgtttaaagttctcaatctgtggaagagtagttagtccctggcattgacctaagactcaagtttaattttacctgcattgttttgtgaaggtgggtcacacatactttgctgattacagaacatcaaaatacaaagcaggttacagaaatgtttcatttctccccgccatttcaaggactcactgagcttaccctgtcgcttacaaccatcacattttgccatctgaaaaaagaaacagaagacagtaaagaagtaagaaataaattatctatggactgattaaataaaaggtcccaggtaacgagtgaggaaatctgcttagaatttagatcactaaaaggaaggttaactatcctggagggaggggcaatatacagtaggggactaagaggtacaaactactatgcagaaaataagctataaagatattgtacaccacagggaatataggcaatattttataattataagtgaagtataacctttccaaattgttaatcactgtattgcacacctaatactttactataatactataattcagctttttttaagaaaaaatgaaggttaatgattctgaaattggaaattatgtcaacaatcttatacaacattaaaaaaagtcacattatagatgccaaaaatagcaatttttagaaagtgaaatggaaatagattgatcctccttaaacacgtcagaagactattttaaagtgaataattataattttaaatattttaatgttttaagacatatgtcttctacaaggaaattaaaaaacaaaagcaatgtaatttcagtaacattaaagtctttttaaatcctacattaatacttaacactgaaaatcattaattgccctttatactatttgaaagaaaaaaagaagggaaaaatgtgccctaacttgaaaaaccaggaatgtgaatcatatttacctgacagagcaaaactgtatatttggacatgcattcttcacaacaaaactcttctactttcccccctaaattattctgtaccaatttgggagatgtctgtaaacaataactgcacattttacagtgatttccccagcgttttgccaagtcatgtttataaagcaatttgcaacctaaaaaaatcagagaaggtaaaattaacattagagagaatagtaagtatttacatctttaatttaaatgccctatgataaagtttgcacagttgggttctcaccaattagtagatcaagaaatcaatttagaggattgatactaccattttctttttttaaacaaaataagacagcagagcaaatattacagtccatcatatataataaaagtcagttttgttttataaaacttgttttctttgggtatgtgatcatacactgggtcacaatgtaaaatgtatgttttctgcatgtggtcaagaggtttgaaagccactagactaggaggttacttctgcatggttttagagtaaaacaaaacattctaaacttacagtcatctaaataaggaagacatgctgatttgcatattcagaaatataatggatgttaaaaaaaaaaagtataatcttaggatgctacgaa

SEQ ID NO: 27714 - DNA, 1472 bp, Bovine  19866880727536
ggaacttttgtttttctgtgataaaaatataaaatattgatttagaaaagcctattccagcaatttgaaatgcttatttttagctcattcaaataagttatatattaaatgtttgttcttttttgccttattatttctctttctctgtagaaccggactgtagcaacaccaagccacggagtatgggacatgcgagggaaacagttccacacaggagttgaaatcaaaatgtgggctatagcttgttttgccacacagaggcagtgtagagaagaaatattgaagtaaggcttgtcattagtttcactttgggaccattttgtgtttcaattttaaattattcagctaatgttctaaccaacattgcctcaatatgaagtatatttaatcaatgaacctttaaaaatgtttcttctcagtactttgatgaagattctgaattttttggtcatatccaagtcactgattgattcttataggcattctaatagactagcttatatggtatagcaggagtaccattgacttttgatggcaaatagtttagatttaattcccaggtttgccacttcctaactttattaccatgaacaatttatttgatcttattatgcttcagtttttaccttttaaaaatagagataatagtacttatttactgaatgaaagttaaataacatccttatttctcaattgagttccttgaaagagtcatttaacttctcattttcactttccaaaatttggcctccatctccactacttttcgtcttctccacattctttccctcaacaatcttctgtttaaaacaaatcttcattttaccttgacactctctcaggattccaggcttccattcagtctccttccttgaagttttagtgctctaccaaaattgattcctggaatcaatttcaaccacaaaagtatctttgtgattatcagttctaatggtctattctcaatagctgagaaaagaagagaaactaaaggcaaagaagaaaaggaaagatatacccattttaatgcagagttccaaagaatagcaaggagagataagaaagccttcctcagtgatcagtgtgaagaaatagaggaaaacaatagaatgggaaagactagagatctcttcaagaaaattagagataccaagggaaaatgcaaagatgggcacaataaaggacagaaatagtatggacctaatagaagcagaagatagtaagaagaggtgataagaatacacagaagaactatacaaaaaagaacttcatgacccagataaccatgatggtatgatcactcacctagagccatacatcctggaatgtgaagtcaagtgggctttaggaagcattactacgaacaaagctagtggaggtgatggaattccagttgagctatttcaaatcctaaaagatgatgctttgaaagtgctgcactcaatatgcctgcaaatttggaaaactcagca

SEQ ID NO: 27715 - DNA, 1294 bp, Bovine  19866880747021
ataatgttacatttcaaagtattataatttcaaaagaaatgctataatggaatcacatggaagacacagaatataaatattcaattaaatatgtaagaaatacaaaattcctaaaatatcaacagcaataaaggaataccttgataactacatattaactctgaatgtatctaattaccagttctattaaccaagaaaaataccatttgtattaatgaaatattgttgatcagtaacaatgatggttgagcttaaaatcagaactgttttttcttgactgggttaaatcttagaagaaccagtttcaaggtaactagaaataataatatcactcatgatcctataagtaacttgagaaaagatgatatgataattgtcccagaaactaggaaagactttagaaatgccactgttctagtcctaagtttttctcattattgattttgtccttaagagacaaaaatatttagctttaaaaaaaaaaaagaatgcttatttatagcataatcttcactgaatgggaaacaagctactttctacaaatacttcatctacaatctgactacattacaaaatgccccaaatccttgtatgcctaaatgctataagatttaattctatacaattaaaacaaaaattttcagtaactatataaagcattcaaaaaaactgaagtccataaaagacctagttaaataaccaggaaatcctgttcctgaacaagattaaatgaactcatgaaatttattttatataataaataaaaaatgaataagggcaaatcagcttagacatattcattctgcataagatggaaaagacagtagcaataacaataaaaataataaaacttacatccccaatgatttttgctgttactgttggaactgcacctgatataaataaaaatataaaatttaggatcttattatttaaacactagcattaacagctgattttcagaaaacaaacacaaagttttataataaaaatatgtattatcttttattttattcaggggaagagtagcatctaaagtattatacaagaaaaatagatttggaaactacaaaaacactgtttaatgccaaagcagcacatagggaaccaccattcctaatatgaatgtgacaaacacatgaaaatgattacagacagaaaaaaggtagaggaccactgtcgtcaacctcaaaaaggctaaataactgctgtcaaatcaagccataccttgtaagacactgttagaattcactgtgggctgagcagcaggagcacttgctaatgataccacatt

SEQ ID NO: 27716 - DNA, 1652 bp, Bovine  19866880795543
cccctgatcattattaactgagtctaggcagtggaattctactctagaaagagcctcataaattccccataggttggagcttactgaaaaaaaacaattgtgagaccatgtactataattatagggatactaactaataggattatttctttaatctacagtattaataaaagtcatgtctctgtcctttcttcccactaaaagggaacactttgatcaaaatctctgtctccccatcctatctccaaggagagaagcaaagggctcacctgggagtggtgtggaggtgctctggaaagaggcctggggggtaggggtggcataactgtaggagggagccactggcagagggtgagcaatctggactttctcagggctttttacttgctgaatgctaggagtagcaccgggatcctctgatgcttcacgctgaactgatacatctgaccgaccaggaatcttcacactcaggtctgtggttaagggattaaaaattgtgtctgtgctgtggacctagagaaatgcaaaattttatttgaataggcaaaagttatacagtcagtttttaagataatgtctcatgaaataactgcaagttaaatgattttttgaaaaattcaaaaccgccaaagatactaaagaaattaatcttaccacgcaaattggtattaaaaaatgttgatataaatgttcctagtatttttctctctatgcaaaaagttttgcttaaaacaaagcagtaataatcgttccatgtgtacttttatctccttctcacttaacatttatattcaatctttcaacaaatacatattaagcacgtatttataaagcaggcctgtggatccaaaacataaataaaatataatcactgtgctcaacaagtacacaatctagtgggggagaaaggactagaaacacaagccaaaatggtcactatacctttaacagctatgactgaaccaaagaatcaccattagagtacttctctttcttggagaggaagcatgtgaagaaggatagtttaataaataaatgaagactttctggaggcagagagtcctgagatgagttccaaagggtaaactagacaagaggctgaagggtgagatgtgaatagccaaaagaaatgagattaacatggctagtgttgggaaacaagggtcataagcaaagtgagaggcagggtgttgaaacagaaggtaagctggaaagacagtcaagggccacactataggagactgagggtgtgcttaatcactcagtcgctgccaccccatggaccacagccccccagactcctctgtccagggggattctccagataagaatactagagtgggttgccatgccttcctccagggaatcttccaaaaccagggattaaacccaggtctccctgaaactaacataatattgtatgtcaatcaaatttttttaaaaaagctggttcatgccctttgcagtgaagtcctgcctccatctctaggctcggacaaccacagatttgtttctgtcaccattaactagtttaggcttttttggaatttcatataaaaggaatcacatacaaactatttttgtttctggctgcttcccttcaacataacatttttaagattcatatcatgttatattcactctttttatta

SEQ ID NO: 27717 - DNA, 1783 bp, Bovine  19866880833958
tcatcactaacgcgggtgatatctgccttagttttataggataaagttggggaggttcatgcttggaaaatgaacaaaaaaaactccaccttgctgggtgagatagctgagaacattggatatttcaggaatacttttaaacagtttttgctataatgtgtagctttaatatttgtcttcagttatagacccatgaaagtattactgtatcttgtgaataaagatcattcttgtggactatatggatgcattcataggctgtgggaagcagtggcgtgtgtgtccgtgtgtgtgtaaatattctatgtttataacactgtgtattacataagtttatatagaaaaaatgtgtttctttaatgttttgggggactaaaattgtaatataaccattccagtgtaatctgaccactcactctggagaacatttatactacacacagatacacacccctaaagcgtggctaactgctcccactttagataattgctgctttttttaaaacccaaaataatggaggaggaaatagcgctctttttaaaggggcttttctgaaaagtaaaatgtaaatataggacatgtgggaagggtggggccttctgcagatgtcctgcaggtggacaaatagccttttaaattttactttttaaccatcttaaccgtgtgtgcctatttgtactgcagatgtgaaatatttgggggggttaatatcagtatgttttgaaactgaattattacataaaatcagagtaacctctttctccatcctccttttccacactgactattcttgccaaatatttctactgaaaccaattttcagcatggtaaaactatggacactcaaacctccttcttcatcttccctatcctgtcttacacccggtctggccttatatttttttgttggcttttcataagtaagaacaatttactgtagtttagagactgcagaatttcaaaatgtttatctataagccttcctttgttaatgttcggttacacagtcatattagttaaaacagtggagtcagtggagtgagtctgagttcttaatatgctgtaagataaaatcttgactgatactaaacttgacggctgcatactattaagaggaaattggattacatggtgggtgggagctaatctatgatatatgtgtactcactgtatactgagaaacaccaaatgcggagtcctatcactgtgtacttgggggccaggctgtggagatggttttcattttaattccttgaagactgtatgtcattaagacgagcagaaggcaaataaagtttttaaacaaaaatgctttggggggtatttaaattatgttcccccaaaaatctttactacaaaaaacctagggttgagattgagacgcttcaagccgctttttaagcagttcagtcacttacaatattttatgttaaagaaattgtcataattctttctgagccaagctgtcactaaagtgtcctgtgacagaaccactccttttttctgccattctgtgtattggaagagttctatgttgtatttgtttttaatccttgattttaaaatattaatggttttagtgttgcttagcatcagtttgaagtgtaactttcactaataactgcaataaaaagaaaagctttgctccaaactttctgttggtgtgtgttcatcattactgcacttcagacttaagtaaagggagttagtgtgaaagagtagaaagaatttaggctttaagaatcgtaaagtcctggattctagacaagttcccttgatgtt

SEQ ID NO: 27718 - DNA, 943 bp, Bovine  19866880877871
cttcagggttagcatccccaaaacgatcgtagcaggggtggaatttagacattaggggaagaacttcccctttcataactttctgacgatgatatggccaaagaacactagaggggggacttcccccgtggtccagtggttaagactcggcgctccccattccgggtgcctgggtttgattcctgttcagggaactagatcccacatgtccaaaccaaaagcatgccacaactaaggacccagtgcagccaaataaataaatattaaaaaaaaaaaaaaaaagaatccaccttgcaaggcaggggatgtgggtttcatctatgatcatggaactaaaatctcatactctgtggagcagctgagcccatgtgccaaaattacagagtccatgtgctgcaacgaaagatcctgcatgacgcaacgaagaccctgcgtgcctcaactaagacccaacgcagccaaataaataaatattaaaaaaaataaataaaggacactaggagttgaggcttgtctgtccattaaatgtccggggagggaactagttctgtagctgcaaccaggaatttttaaagcttttttctgttacaagcaacagtatagggcagcattatcaggaaggagctgaagtaggaggctctggaggcatgactctaggctacaacagaggaaatgttctgtctgaaagcatagagtcctctctctgcatgcacacgtgcacacacacaacagccaagatcctttctggcctgaagaatctttggcagcagcaagagcacttgtcccattgtgagggtcatttttcaaagcgccactggactgtgaaagccacttaataacttgatctgtataatctgagttaatactagctccgcagttgtgaggattaaaatttgagaaatttgtaaagcgtctgcctccaagcccagcacctaggaaacct

SEQ ID NO: 27719 - DNA, 1757 bp, Bovine  19866880912890
ggtctgcaaaggaaagacactgaagtgacggtcaaggcagtaacaccaacatctctcatggaaacaggaacattccaactgctgataaataacagcagcagctgagtaaatgatgatgaaagaaaagattcagagaaatctaaaggacccagagtgtggtcagaggtaaagggaggtcagcttgttttctctgaacagaagaccatttggaccactttgaggtatttgaaaaagttgcgtcttaaagctcatggaccaaaatctgttataaaagcatttcaaaggcaaagcatgggtgttcttgtgttgttcctaacagctgaaaccaaaacacactattctgagagtgtcaggccacaggctaaagaaagctatagcaccaaccacgtcatccaaaataaaaaggctcagtatgggcatctggaccacaatctcaaatagtgaactgtatgtctcactattaagaaactacgtcttgggctacatttaataaatcctggacagggtgtgaaggaaaggccgacgttgctggaatgtaaactggtgcagccactatagaaaacattatgggaattcctttaaaaactaaaaacagagctaccatacgatccttctattctactcctgggtatatgtccaagaaaaaacaaaaactctaaatacatgcaccccaatgttcatagcagcactatttacaacagccaagacatacaaacaacccaagtgcccatcaacagacgactggcttaagaagctgtggtacatatatacaagggaatatcactcagccatagaaagaatgacttattgccatttgcagcaacatggatggacctagacactattacacgtagtgaagtaagtcagagaaaagcaacattatgtgatatcacttatatgtgaaatccagaaataatacaagtgaatctacacacaaaacagcaactaactcaaagacatagcccatgggattaacagcgacaaactactatacataaaatagataagtaacaggatttactatatagcatagggaaccatattccaaatcttataataacttatgatggaaaataatctgaaaaaagtatatatataaaactgaatcattctgctgtatatctggaattaatacaatactgtgtatcaactataaaaaaagaataaaaaagagaaagaagtcttggggtagggaagcgtagaaggtctcaaatatttgaatcaaatcactgaacttctttattgccgcgccacacagcttgcaggatcttagctccctgatcagggactgagccctacaccctaagcagtgaaagggccaagtcctaaccactggacaaccaggggaatccccaagtcattacacttttaatgcagacagtaataatgcaagttcacaagttcaaagaaatgtggtaactctagaagaactgtagatttaggtgaaatgctaattatttttctaatataacaaggctgtgctaagataactaagaggtaatttttaccgagacaaaagtaattataataacctattttataggtatcctttttttgtattacctgcaagtgtaacgagcaagtttctacagagaaccctgccttgttcttcatctctaaatggatgattatttttctacaccaggtgggccatttaccatgttagattcagactgtctgtgtccccaggcaccagtggtgtgacttccatgaaaaatgacttcctttttctctgcacagtacgttttccctcttgc

SEQ ID NO: 27720 - DNA, 1378 bp, Bovine  19866880940633
gccatgcaggagacgtgagacaccagtctcgatccctgggttgggaaggagggcatggcaacccactccagaattcttgcctgaagaatccccatggacaaaagaacctggcagctacggtccatggggtcgcaaagagctggacatcactgaagcgactgagcatgcacgcatgcaaagggactcagccaaacatatacatgtatccattctcccccaaacccccttcccatctaggctgccacataacattgagcagaactccatgtgctgtacaataagtccttatttccaccctcctttgtctacttttagcttaaatctaactccttcagagatgcttccactaccacctctttcttaattaggttacctgtttcctgttttgttttttttttcttttgggtcttttatcacagtttaccactttaatgtttgtttagatctgctttctgcattagactaaattctgtgaaagcagagatcatatatattgtgttttttaaaaaatgtatgtttcaggtagcaccatgcctggcacatagcattattaataaaaatgtattgagcaatgaattatctgaaggctggaagagctcatggtgaagagccaggagctgaatggccctcaagggtgttttctaatgtgggatagaacagatacaggtggttgctatgtgagatcttaagctcttcctctgcatcttacatgtggcatgaccctggaataagtcattctgaaattttcctctgctggaaaatgaagctaaagtgaactggcctggtttagctcccagggttatggttgggatcataggtacaattaatgtgagatgagggagcacgtttaagaggctgtgctcacgctgactgacccactgctgaggaggaggtggggctcattacggtctagctgagtggaaaagagaagccaagtcttgccaaagctccgtagctgccagcccatgggcccagcctaggcccagtggtgcctcgctctgtgctgggcctcctgagaggggttgggctggaggtctgcttgtgtgcctggagtctcagtgagctgggaaacaggcacggctttgtgtacagccggtgtcacctcagggtctgccttttgagacccagatgccagatctctgtccctcgtggttgtatcatcttggtctgtactgcccacgtccttcccatcccctcattctctccgctcttctctcacctgaaaggtttttcattttcagtttattgatctggttcttccctggggtgggatacataatgggaaaagggggtttgaagtagcttcagcctaagggtgattggaggaagagggctggacactggggttctttcccttcactctagaaggaaccacgat

SEQ ID NO: 27721 - DNA, 1815 bp, Bovine  19866881013519
cacaccaggcccagagaggcctcccctgggagagaggcactctaaaagcaaaatgctcaacattagacaggttttgacctaagaatgagcatttagtctggacaccaaatcgtgccctccaggcactggatttattgaaaaactacatacatattaaaacatctttatatacattttctctgttataagattacaaatatacaaatgcaaattccatcaaagtcagcatcttgtacattagaaacaactgcagaaaacctatatcctaattccatcagttaaattgggattcctcaaccagttaaaaaaaactggcacagctcacccagcttcccaagtgcagctcatgacagtgaaaccacagtgtttacatgggacgtttttccaaggaagcagtgatgtttggttccgaggggggaaaaatatgtttaaaattctgagagcctcatggtggttcggagaaaactgggactggtggcaatcctcttgacaacattttgatgaaactccttgatggtcttctctcaaaataagtaatgaagttattacttcattgtcctctgactggtcagggcaacgtactcaacccagctgaatgcaataaataatgattatatataattcttcggtcagaatgaaaaggaaggtccttgagcaacagtgtttcaaatcaaaaactgaagtcctagaagagaggtctctggtccacagactatctaatgtggatggccactggctgtaaccttctatcttcatccttatactccagaaaatttgctctttctgacttgggtaccagtttgagtgcttattataaaggaagcaaaagtgaaccggaaatttgagactgccttgggaagggccagaaaggaaaacggaaggggcatgacttctaaaatagcccatctgttgattcctaggtcctctaagaagcccctctcactgagtcctggtaaccatcctgcatgtcgtaggggtgtgaagacatcatcgcagtttcagtattcactgctttctgcaattttctgtcctgtcacactttttcttcctccaactacccctttcaccaaaaggaatcaatccagttagttgctagggtaaaatgtcaaatatttaatggaggacactcaggtatcccataagttgctgttgtaaacactccagaattattagtggccaacccaggaagtaatactaggaaagagatgtccagagccacatggtggaaagaaccggaatatctgtcctcagtcttaatgcattgactgtgaaggaggtggggatcatccacgtgagcatcaattccagccttcagtgccagatacttatcaatggagcccccacagaggtgctggcgccctcatagcgctagctttccaagtaacggaagatgctttgcttcgattctgaagtactatcatctattttgaggcgcttaggtgaagtggatgtcattaaagacggaccccttctccgtacctacagagcagagaaagagacaagaatcaactcaagacctttgtacaggctgtggttcactcatacttagcttcaatcggctcttaagcagctcatagttaaatcatggataattaggaaaaaaagaaattgaaaatttccaggcaagtctcacagctgattatacttactggggttagcaatccccttgtaccttattgggaatgcaagattaacactatggcataaatctttaagccagaaatacatatatattttcaattcaattcaattcactcattcattcattctgctttggagagtcgccaaatcagttctcaaattccctacccgagg

SEQ ID NO: 27722 - DNA, 828 bp, Bovine  19866881014144
aatgcagggggcaaccaacttcagaaaactattaatacttccttttctcttaggctgctctctcccttccatgaactctcttggttttctgggctagagactacttgcaacaacccctggagctagagtagtaggacacggaagtccagatgggttgatgggagctggcacccataccagactgcttgtgattttattctgatgaattcctagtggtctcgagagtgatgaaaaaattaacgttttgtttttggttgttgttacaataaataagcttctacggaaggaactagagcctggtatctggagttggctgtagcctgatggggcaggctttacctcatcaaagggtgtaattgaaattcattctggaagctgtgagtagagggatcccataagtgcctccttcctaggctaggactattttcttggaggttggaggacatagtacacaaagcagtgtattgtttctggcttcactgggctcaaggccagatgtgccgtctgtgcttaggtgtgtttcaagcacatatactggactaggagctcctagagggtggagttggtgtctgatttatctgtggaaccaactaatgtctaggccttgacacaagtacatctttattttttgaattgagtcacattccattgtgaacataaatggttaagtacattgtatggctatctaataatttgtgtgtacttagtgtgtggataaattctttttgaagagtttgtcctcttcctcttcgcttactggacagctaacccagccttgagtttgtcttttgaatgggtagtctagcttattggtagctatgtgggcct

SEQ ID NO: 27723 - DNA, 928 bp, Bovine  19866881021971
cagtgatagagaattaactactatatatctcagcagactagtgagtagattaaattattaagcaaaacgctttgggcaaaagtcatatggatgttaaatattctgatttacaagcactcattatcctagcactcctgtggggttaggaagttatcaggatttcatagatgagtaaacaggcatggggtaaagtcacatggcagagctctatttacttagtccctgtgggaagggaataatacacacctttagcaatcataaactttcttgccacatcctacacaatctttaacacattcaatcctcttttccccctttcttttttcattgaatctttaagatgttgcatcttttcacatgctgtcaatggaacaaagacagttctaaggtaacagcaaggctagaccaagtgaagaggaatattctgtgtgcactggcaaggagtcacagaaagacgcggctactctcgaaataaaatgtgtatgtaatagtgttttaagggttcatctccaccaccacataatccaaccacaggaattaagaaacatggtttgctgtgaaaacactgaaaattaaaaggccattgccagaccttcctgttggtgtaccccctccaaattctctgcaactgttacgttcaccctctgggctttaattagcaactatgctgaaagaaaaaacaaatcccacaagactgaagaataacaagtagcaataggaagggctcagaacggccatttggtataacaggaatagacaagaagcatagatttctctgttcctaaggctgcttgctgtattgcttacccgactccgaagatagtcagccaggtttcggcgagtgaaattagctgctgccgtgggagacagttcataacctggtacaagagatacatacttgttgtcaacagttgaaaagtgaaagtga

SEQ ID NO: 27724 - DNA, 1509 bp, Bovine  19866881025183
ttggctaaatctcaatcacttaaagaagttatgagttcatattcttccgcttcatgtttttgtctccacattaaaaaaaaaagtttcttgcttccttgtttaacatctctaggatcctttttaattcatgagaattctgaatggatagacatgatatttaagtctgacgagagaaagcagccaactgaagaagatgacaagtagacacataccagtcacggacattatcttcctccttataatgttcatacgagaggtggcagctgtacttaacagcaccattcccagggtaatgcacatataaaacagagaaatgatgtacatttctgctacatactgaaagaaatacgtgtcttgaatataatgtgtctgtcctgtgtgagttttgctttcagcaaacggggctcctcgtatatgaatccacattcgaccagatgacatcaagattacaaaacacagagctaaaaccgcccaaaaatttttgctaaaaataaacgtcctcttccatttcaatacatacacaagtccaccgatgagagccacagatatccctaacttgaagggatagtgaaaatgtataggctgtctggttgtgaaattgcccatccatctcccagttctgtcgtctacccatgtgaacatatgctgcgcagagatatcccttacttggaaattataaatgtcatctgctgtgaattcacttttagcaggaagatggaggacaactggacctccccttcacctggagtgttttaaagacctcagggctttcatcaaaatccagcatagcaaaaaataccttgttgctgaatgcactggagaattgccaggaacctgccaagacctgaaattcttcaacagcaagtttgcacggtgcacatgatctaaacctctggagagcagtaaacattgcaataacggaatagtttctgggcttttctaatacaaaatggttgaacgcggcagtattcattctcatcactctgtctctcttagtccagtccatcagctgtctgaccttttcttctaacaccttctgtccctggtcaggatgtgccgaagcctcaggagtcatgaacatcaaggccaccacagtcagagatacgtgccgaagccaccagcattcttccatatttgtttacttcttctggttacgtttccaaatatctatgccaaaatccgatcattttttctaacaatttgtccagggatttatatttttctgtcttcgttaatcctagcataaagagctatatcacaaatttccatgcatgtctggcttgtgagccatgtattagagtttagaaaatattctgtggaaaaaaaattttgtgattaaagaagtcttggagatgtttccaaccctcagtctctctgcagagttccagactcacatttctgtcggctagactgcagtaccggatccacgacaatcacctcaaactactcagaaaccaaccctcatcatccccttgcctaccaagtcctaggttctctaacctctcttct

SEQ ID NO: 27725 - DNA, 2347 bp, Bovine  19866881030060
gtgggttaagtaacttccatatgtgtgatagaacagagatggaacccgggactactgaatccaaaaaaccctacacatttgatttcttaggttgtttgttccctcctccccgctctcaagaggtctttccccaaacccagaactaaccagtgttgggagggtggaggttttaggagctgatcctgcctctttgattatcaggtggtaggcagcatggatgcccaccccagccgttactgtgctactgtgcgggtacagcgaccacggcaggagatcattgaagacttatcctacatggtacgtgagctgctcatccagttctacaagtccacgcgcttcaagcctacccgcatcatcttctaccgagatggggttcctgaaggccagcttccccaggtagggcccacaataggtcaagaaaaccttcacattgaggccatagggcctgatggtagcagagagaactgctccctttcttaagctgttggcactgggaggtgcttctacttacggaggtttgctaaacggaacaggcttggaagcagagatcccaactgagagatggtgtgtacagtcattgatagacctttcttcttgtaataaaagactctcagtgcctgtttactagttagttcatgttgaagactgattctttagaccagtggttctccagctttgggcttccctggtggctcagctagtaaagaatccacctgcaatgcgggagatctgggtttgatccctgggttgggaagatcccctgaagaagggaatggctactcactccagtattcttgcctggagaattccgtggacagaggagcctggtggactatagtccatggggtcttaaagagtcagacagactgagtgactgagcacaggacagcatacctgtatctattctcccccaaattcccctcccatccaggctgccactgatcctgcattataaacggtaggttcactcacacttttcctttcaaggccagggaggccccctttccctagacctggcttttccatgagaatctcgaagagacaagctgggaatgtttgttcttagcttttaaaccagtgagagacttccccatgccagagggagcaggactttcccagaaatccctcttgtacaagagcccccactttttgtccctccctctgcacctcagtgcagggttccttaccttctccagcaccccttcaccccttcatcaccagcagggcagcctgccagtccacacctcccgccttcttagcaagcagctgctccttccacacagattaggtccaggggcaggccaataaatgcaggtctcgggggaggggaagctggagacgctcttctgagaggctgtgagagccggcagggtggccccattgaacccctttcccctcccactgcggggcggtggtgcgggggtggcggggaacctcagcactgctagttgaaacaggattcccccctcccctctcagcagccaggctttaaataggattaatgagagagaacattctaaacactgctctgcgaggttccagaaccagcagccggctacttcctctcaagctgccattttggactcattccccgggctgccctcctgacttccagctacttctttcccactgggcgttacagctctctgctcagaacctcgctaggagctcaaggacagatgagtgtcgtccacccactgccaggaagtgccctctgctgtattcactgagactgattatcttctgtgataaaattcagaccttagggcagtgggtgggcacgaagtggaacagaaaaggagcagtcctaatctgtggaggacgaatcatattcactctggtgtgaagggctctttcatatcatgggggacttccctggtggtccagtggttgagaatccaccttgcaatgcaggggataggggtttcatccctggttggggagctaagatcccacatgaagcagaagtgagcctgcaggctctggagctcagatttggcaactagaaaggccatgtgccacaaggaaagattctacatgacatggggaagatcttgtgtgctgtgtgctcagtcacttcagtcttgtccaagtctttatgacccacatggactgtagcccgccagtctcctctgtccatgggattctccaggcaggaatactggagtgtgttgctatgctctcctccagaggatcttcctgacacagggaccaaaccctcccctcttacattttctgcattggcagatgggttctttaccactagtgccaagctgggaagccccttgtgtgctgcaactaagaccaaaaaaataaaaattaaaaaaaaaataacaatcacagtacc

SEQ ID NO: 27726 - DNA, 837 bp, Bovine  19866881062350
tgagattgtgggataaaaacccacagatgtctggctctttctgtggctggtggtgagatttaaacaaacgacatgtcttttatatgcttttcctctttctgtcagcaaaatggaaggagcccaaacctccttgcttgcttatgctcacattttgaggtggcaagagaagctttaggctgttcagctggaaggcatcatttaggtaaaagcctgctcttataaatgaacattttttttttctcttgcaaattctctttcacactggcacaaactgtgggactgttgcgtaggagattcatttccatctcaggctcctgtcttactggagccagccttcccggtccatcctagaggctgtctgcccaggaagtccattctcgcgctgtgtacacagccaaaacaggattatgggaggagagcctgctgtagtcagagcttgctttatttagtgtagcatctttgaacctcaaagggataggggctggaaattactgcttcttaagacttggtctgggctttggagtcagagcactgggcttgtaccttgactcactatttagctctgggcaggtttcttaacctcttaaagacttgtataattgtgaaattgatgatacctctttctgtatggttgttgggagggccagatcagacaatgctcgtaaaggtcccagccacagatacatgtaggcagcagagtgaaacagtgtagagatatattgtctagatttagatcctgactccactactgtcaagctttcaagcttgggcaagcttcacctctttctgccttggtctcctcatgtgtataggggtaaataaggacagtactttata

SEQ ID NO: 27727 - DNA, 798 bp, Bovine  19866881104479
agcggtggcctgctgccctactgtatcagtcactgtgagttggtaagtatagtctccttcttgcatggcggagagctgcagggtcggtgttctaaccccctgaatgaacacatacagagaagtggactctcaaaatcatatcatacagtaagtccttctctggtctacatcatctacccagttttaaacctaggttggtactgggccaccacctcccaattagtgaatactcaaccagacactatggaacatcttgttaaaaaggcttgacccttcaagggaataaacctctgacacagcaacagtttcaaataaagttagagtgctcacgagggaagggagtacaggaaaatgtgcagagataaccaagatccatttctatgactcaagccaaaaagaagaccatgaacatataacaaaacaacacaatttaaaaaacaatgttctaacaaagtgtgatgcttaacaaagctgcatcaataaaacatggcagcaacaactctgttgtaatgctgtgctgtccccttataggtctgaacagattctgtgacagcagagaaacctcatataatacttaaactaaagccggatgaaatgtgagctttaagtcatgcctcaaatacgaaaacataagactcctgagtgtcagaagggatattacagataacttagagccaactgccaacgcaggaacttctaaaacagtaggcgaaacctagcagcctctgggctgaatccagcttgcaagcattttatttggtctttgggtcttaaaagtggaaaatttcttataaaagt

SEQ ID NO: 27728 - DNA, 737 bp, Bovine  19866881153314
ttttttttcttaagccattcttattgtttgggggccagaaactctaggttctgagagggtgtgtaagtggaaagacctgagttttggcccacatagtagaggtgcttgggtgtgaattagctatgaattgagatgcagggattaaactggagacagaaggagccagtagctttctgggaaggtacatcaggaattactggaagaagtttgtctgcataaaaaaaacaagatgctgtctggaattcctttatactctactactttgcctagccaagagtgaaatccttgataatgaagacactctgcaaaaagaccctcaggccagagccaggcttgacttcactagccactttggaggtggatcagaatagtgaccagtgcctttccacaaagttaaggtgcctttcacggagtgaggcttggcatttagaacaggagattcaaactcttcttaagaatgctgagcttccagcttagttacaccaaggcaaagactttggtgtttctgaggatgttttgatgccttgattcagatctttctggatttagtaatcattctgggcactgcttgtgtgaagcactaaagggagactgaaatgcatcttgacatagtccctgtttttaaagaatttagaatgtagtacaagaagcagacagtaattatgggagcagccagtactttgcctgcattcttctaggtaatgtcctaagcttttatatgtattaataatagtcca

SEQ ID NO: 27729 - DNA, 1626 bp, Bovine  19866881182216
ttgagctcaagtctgaacttgagcaaattatctgccctttctaagccagtttctgagtgtgtaaaatgaagatactgtcacttacccctgcctaactcataggtggggaaaactgtacacgtacaacattatcatactcagtgtgagacaatgtagttcagattatacatgctacaggaattcagggggaaaaaagagcaatctgtgtgagctgaggtactgtgagaaatttaaaagcaattctatacaggccagaagataagagaaataaaatgtggcatataaccaaactgaaaccttgtgccactttaacaagcaagcaatctctgggaaacaccttctctatagtatcaaaatatcttacagcaacaaaccaaaaaactgattggaagcgatactttcattttataccagaagaataatgaatcgcaaaaggttaattcattttcagcctaccctacacattttcttcacgaaatgaaaaggaagaaaaaactccttacacaattccaaagcttctatcataaacatttttatatctgaaaacaccatagggaaaattagagctaaatacaattattttcaaccatttttaaagaactaactcaaatttatcttccttcctataccacagtgatttctctgaataccataaggatttacttttgaaaccattaatttaaaagctaacctaatactcactggtgatacttctttttatcatacaaaatcatcttgtaatatttatttcctggttttcttaatgtcttagacccctgaatggattataccaaatatactgcataccctgtaacacctagaagcactgtgtatgtaagtgggcttaaaacacattctattttttgaagtggcttcgtatatattattgtgaagaaacagaacacctataaatgtactgaatttgttactgctaaactacttcatgctaaactcacttgcatgtcaaaggccttagtattcaaaataatggatagatttacccttaaaaaacaaattgactcctttggaaaacatggtttaccagtaaaacttttacaaactaatcatggaatttcataaagtaatttgacttaaggaacatgatccataccataaatgtttaacagtttgacaattttcctttccttaagccaagaatgaactgttacctgccctcaaagccgtccctagtctctacaactagagatctagctgtagatcccttcttcctctggagtagataaaagcaatctctgctttctctgcactacctgagaagtttggatgtacttttcatacgcagcatcattttctagcttgtgttataattatttgtacatatatctgaatcccttattaaactgtaacttcttttttttttttttttaaactgtaactgctaagataagggccacatcttatttttctttgcatcccttcagcacctagcactgtaacagacatataggtgccccaaacctatttgtcaaatgaacattaaatcatctgggccaacagataatactttttcaaaagtaggatatctatgaatcgtgaaaatgcactcttaagattccacagacaagcaaccaaaatctttcaaaaatatgcagtcaaaccgcacag

SEQ ID NO: 27730 - DNA, 1202 bp, Bovine  19866881182850
cataatcccatgatagattggctgccccaagctcctcaggctctgtgttcctgcatgggcagagagctggaagaaacactcagaagggagtagggacttcacatttttgcagaagtcagagaattgcatagttgtgtttagagatacaattgcaaccagttttccatttctgaataagctagtatgattagtatgaagactcaattatgaaaccattcaaatatcagaaactaatcatggaatatattaactttccccagaatggctgaaacatgtaaagggatggctgtactttttcctattaacttacgagtaatacctgagcactgtgaaacatttaaataatatagatgtgtataaaataaaaagtgaaagtgctccctttaaatcactgttatcagagggagcaactacatataatttgaggttggaagaacataaacatcttttattatttgtcttcatgtttagatctttaattcagtcatattttacaattatgaagcctgtaaaaagggcctctttcaaatttcaagtttatttttctctaatctagcttgcaggaaaggggtttcaggagctattttaccgagaaccgaagggaaattgccagctaaagacgcacaccttttggcagacgcatgtgctcggcactttgtatacagcgcgtgatatcctcctcaagcaagtttcaaactcccaattataaagaaagaaactaggagttacgtaagattacgtaaggcaagtaccccgtactgcctggatctcaagagaccggaacaggccagaagccgagagcagcgtttaatccaccaaacaccaccctcacttgccaaactctcgcgacagttgtgcgtcatccgggagcgccggtggccgggactgtcgcggggcatgcgacgcgcggagctctgctcggaggtgctgtctcacccgtgaggcggagaagcaggccagccccgcgctcgattgaacctgcattccccggcctcctgccaccatggagtacctcatcggcatccagggtcccgactatgtccttgtcgcctccgaccgggtggctgctagcaatattgtccagatgaaggatggtgagaggaagcaggggaggccaggccgggcctgggtatagggacagccgggaggagttcgtgggaggttgggtgagtaccggggagagtcttgggcatggaaccccg

SEQ ID NO: 27731 - DNA, 930 bp, Bovine  19866881240833
tgttagtatgttgggagttacctttggccaataagtagacttaggtgctttccattatattgcttgtgtacttttgcacaatagttcatggcaaatccaaattctaaatgttagatactactgattattctacatccaagtgagagtaatcaaatggcaagttgtcattcataaagctggtatttgccataagtgtgaatcagacttgtttgtagcttgtagctttaggcatgttttagcaatgtttaggactttgacctacatttggtgtgactttatccatgaaaagggaattgtttagtcttcggactcgtcgtttccctcctgttgggcctgtctttaggtgtactttctaaaataaatggacatctcttttgctacagaatagcaaaagtcacttattttttagcatactagttgtgtgcatttgatctgaaccttcttgatggtgtcatattttagctgtacagatagcgtgtcaggatcctttagaacaaccaagagaattggtctgagtggtgataccgggattttacaatccttagaagaactgaatattggctgtagaggtgggtttggagaaaagtgctttgtcacaaccgaattgaatctaattagttcatctacagtcttttggcaaaggagagaagctgcagtatatagctcactagattcattttacaaataataaggatttagaatggggcttcatctgcttaaggctttgaagattagaatcataaatagttggagggttaaatgtagcgctgttagcttcaaaatgaattttaaaaataatgtgagttatatttttggtttatatgcttcctaatagtcagatgtaggttatatatcaaatttgtaactaattttgacacgatgttcccacaattcagattctatagtccttgggacgtgtagcttctggat

SEQ ID NO: 27732 - DNA, 1106 bp, Bovine  19866881282293
actttatatatatttacaaaagcttatttcaagaaaatgtcattaaaattcagaaagttaaaaccaaaatgttgatcttcatgtaaatttgagataagataaacctgcctgatactcacagcagcaatagaaggcttcttcccatcaccagctggcggatgagtgacatctgctcccaaaaagatcactggttgctggaacacagaaggtcttaaacacatttttaacaagagttagataaattttttcattatgcttttatctgtctcacactagggcagcacaattgcaagttgttggtatagcacagagaagatccttttcagacagcttctgccttaagcagctgtgctgatggttgtaaagggcagttgcggctagcattcttcataataggcataaaatgataaaatttcctcatattaacccatcaatttatatcaacctttctttaatctacttacattttaagccagtataatcttgaaaggagataaagaatcattaaaccacactggaagggattaagggagtctaccactccctgaacaaaagtgtaaaatttgagtaacatatatttaatagtcataaagtagctagtggttcattttattttaaaattgtattcttgaaagtcaaatgactatttctcttagttcttgggcttgataaaattctatattcatctcatttatgaatctcatttatatttaatagggatgggaaatagaggcagtatggaaaaacagggaaaaaaaagagcttttgtgtcaacaagacatttaagattttagagccctagttgcttcaactattaaaaggaaacctattgtttaattctccaaataacattatgcctcttccccagcaccctatttctaggtcatcatgtctcataggtcctaagagctcttagacatgatggcaatgtaacagtaacatctgttgtccaattgaccccagcaattgatatgacttatttaactgatttacttaattgacatgccccctctggtggctcagacggtaaagcgtctgtctacaatgtgggagacctgggtttgatccctgggtcaggaagttccttggacaaggaaatggtaacc

SEQ ID NO: 27733 - DNA, 1242 bp, Bovine  19866881329028
tgggtgcatccataaatagacaaagaaaatattttttattttatatctcaaataagaaaaaagggaatggaaactgaattttagtatgagctcatctaatctgaccctaggaaaataatgaaaatgatcagaatgacccctcattcttgctggaactgcaacccaaaccaagtgcttaagtactcagagactctgttgttaagattgcacacatccatgccatcactggctccaactacagggaagcaataccaactttggggcccaggattattcagatggttgaagaatcccagttgaaacagaaggctaaaatcagtgacgatatcatcaagatgtgatctctgtcttaaatataataataaataaatactatgggaaaatgttgattggtttatgagactcggtatcttaaaattttcatctaatgagttaaagaaagcaaaatgcgatcatagtcctaagataagaggcagcataggctagtggttaaacatctgagctctggagtttgaatgcctagattcaatttcttcaccttagcctcttatttaacctctgtgtgctttagtttctttagtggtaaactggagataacggtagtacccacctcattgggttgttgagaatcatgtagttaatatataatggttttttataagttaataaatcagcacttaacaagcgtatagaaatttcccagttatcactagtactaacttcagcagattcagaaacacaaggatgtgtggataatgatataaaatttatggaccaaattacccccacccattccatttaataccctcagcctgaagtttccaaaaattttccccatataacttagagattccctttcattacttactatcattttccagacttagtagagttgcacatatgtactcctcctgtgtggatatcatggacatagaagaatggacaaaggggaggagtcaaccctgagttggctccttggcaagtagtatatgcctccatggtcagttaactggaaaacagatgaattgaccaggcaaaaatacttctggcccaattctagcctctgggaaaaaggaaacaatagatactctggaagagcagaggcactaaggattcaaggaacgtggcttctccagggaagaactcataaattctgggaccagatcctagaaaattgctgtacatttgatgacctcaaaatactgttgttgataaggaaaattggtggtttgaacacatgta

SEQ ID NO: 27734 - DNA, 1008 bp, Bovine  19866881371343
tgctatcttagtacctaattgacctttaatgtaatgttttagaacatgtaacttgagaggtctaccagtggatcttaccagtttcattctcaactctttcctaaacaaatctgacttatttctgggaatcatgcacttaaaagttgtctttctttagatgaagatgattcatgctcattactgaccaaggagagcagccacaatagcagctttgagctgataggctccacacttccgtcctatcagccctgtaacagacaaacaggccgtgggaccagtcttttccctacagcaggaggattcagatctccttccccagggctgtttcgagccagtttggtcagttcagcctcgaaggtgagatgctaatggttttctaatctcctcccccttttgcttcccgcattgctaaataaagtgtgtccaagccaaaaactcccaccacattatgtatgttcagttttaaaaatccaccccctttgtgtattaaaaacaagcctcatccagggttctttctttcttgaggatgttttttttaagcttcccttggctatgcattgtcctccccaactgcaattgcctgagagtagattaaattttacaaatagcagcttctgttgtcatgacagtgaatgacatttgtaaaatgttttgtttttgtttggttttgttttggtgccagagttcaggaaagctgtctgagccttcacttcccatagaggattcccaagatctgtataacgcctccccagaacctaagacacttttcctaggagcaggagacttccagttctgcttagaagatgacactcagagccaactgttggatgcagatgggtaggtagttttatgtttctgtgggtgggacggtgctgggtactgcttaattttgtttaaaaataaagcgagcttctgtcactccatctgtgctttctcttctgagaaagagaggtgtgcagaccattagtatattctacaagttgaacaaagtctatctagaaaataaaa

SEQ ID NO: 27735 - DNA, 2592 bp, Bovine  19866881406779
tcaaaagaatcagacatattgacctgttactgagctactattgagtagctaaacaagttctctccattaatttttcttttcaaatgaccatctgtgaagtatagcagtttctgggctcttccccaagtctgaattcagctgctaaatagtagacattccactgcgagtctatttctgtacggttgaaagtactctattatggaaaatgcccagctgtggctttgtacctttcattctgtaatatacgtattcattcaacacagttattaggtattcactgtgtctccagcactgtgctaggtactaaaatcagtaagttgaggaagacatgtctcctgggattttatgtttcagtatggtagacaatacaggcaaacataaaacctgacgattagctcaaagcagtagagatgaaagtgcaattgaacatcagaggaagtctgttagagattttgtagctggatgggtaagatttggctctataaagaagagaaaagaattttccaggcagagggaataacagacacaaagaagacaagacaagtgacgtgtttggacagtagcaagttttctttgactggagcatttgaatagagaatagcaggcatgaagctggaaaagtatgttagagcaagattatctttgttcaaagtaaaaggctagtcatgggattaaatagatattatttaacagtcagttggatgtgcgtgacagagaagaggatgaagtaaaagatgaccaagattttgagcctagatgatagggggtaataataatttaagtagagaactcaggagggatgataatttcccatttactaagccctttgtatcacatggtgctcttaagaggtatgttcagaagttattgttatcctaaaagatcaagttcagaggggttgttacttgtccaaggtcctatagctagtaaggggaagacaagaaaggctggtggcacagtatcatttgctgagtatctgttatgttccagcagtgtgctcagcacattcactgattcatcaaatggttattgagacactgttatatgccaggcactaaggatttcgtggtaaaacacaaatttactagtttcttggagattctatcctggtagaggaataaataattatccaaataatgatcttttaagtgaaataaaagtagaggatttcatgaaagtatagttcatgtggctctgacctgaacttcagagtcagggaagatttctttgggggaaatgacatttaactgaaaactaaagaacaagtgggcattaaccagacataaaagacagggaagtccctgcttaggcactgataaagatctgggtctttgcagacactatgctatttaattattgcaacagtctaaataagttgtatttttcaattgagcaaactgatgtttagagagacattacagattacttaaggagtcacagtttgagctcaagatctcaaatccagtactattcatgctatttgaaacctgaagtttgaagtggtcttttgttacactatttttttttttttttttttgctttcttttttttacagtgcggaaggcagtcatgtgtcaggacagagcaatggccgagatcctcaggccttggctaaagctgtgcaaatccaccatgatacccagcacaccatgtattttgcctgagaatctcagaaaaagaactcaaccagtttgttatcccacgcagcctcaaaatgtttcaaatgcctactgcctctagagagagccaagttgacttcaggtgggcttctaccagcaactcggaatagttgcactgaatctatacttcacagcactgtctgatgcatcaacaaaattgagccattttttaaaagtaatagatactcatagattatcttttctgatgcactggactgaatttttacctcatcatgcaaaggctgatcagcctgaactttctaaaggactttatgagaaaggtttctatggactattttgctagctgtggtgttcaccgcatccctctagtcttaccagagaagattttttttccttttttctgtattcattgagtggggtgtgtgcataaatgggagagaaaaaccaaacaatctactttagttcagtgtaactatttaattgtgtgggtccataggctttttaatggagatttctgacttcgccactgtaaatgccttgaatgagcattaatttttttgtaagttttacagaattttatgagtttttactacttttctctgttgatctctacagactggtgctggtgcaagtacaggctgccaggcaattgcactatatttggctgcagattcagacaggcaattctcttatttggttgacttttgtgaatgtgtaacacagacagatgtgatgcatgccatgatgacagataacactgccatggcaaaagtactcatctttccccctctttggaaaaaaaaaaattagcttttagtatttttcagagttctcaaaagtgcccattttatgctgctgtgtggtttgttagatccaaatgatttttaaacttttctcatagaaacttatctttggcaataaacattttttaaagtccctcctcttcctcccc

SEQ ID NO: 27736 - DNA, 1586 bp, Bovine  19866881416195
ttttctttgagctaactttttaacattgtgtttaagttatcaaattaactggtataaaactgttcccaacattcccttatcaacctcagttttgaaagatctttaatgataaacccttcttaaatttttgacactagtaatctgtttggttttttgtttttttttgattagccttcctaggaatttaaaatttttattaacttttttaaaagaatcaacttttggtttcattcattttctatactgttttctatttaattaacttttgctcagagttttatttcttactttctatttgagcttaattttttcttctagttgaagatagaaacttcatacggtagtctgcctccaacatggtccctaataagtcttgcctcatgggactctgcacctttgtgttaagtctctcctacactgaatataactggtttatgtaactaataagacattacaaaactggcagaatatagctttcaatactaggccttaatgtcattatagcgtctgccttgctctctcatggattgcttgctccaaagaagccagccacaacatcatgagaacacttaaccaaccctgcctgttgagaggtccaggtggcaagaaactaggtctctagcacaaacttaccaattgagttttacagataataaaacaagacttactcatccatttaaacattcaagtatctactacatcagggactcctttgtgggttggaatttaaagataaaccagacaaagcctctccattttaagaatagattctggtcaagcaactcagttcattccttccccaaactccactaaaactctggtaaggaattaaggagaaaaaaaaaagaaagcataaatctagagggaagggacgatcgaaaatagaaaatgtaccattttagaagatgaaaaacaagtagccaagctgtaactgacagagcagatggaattctcaaaaggtgtgagaaatggcagtatcaggtacctctgaaactggtgataaaagaatggaggtgttgcagaaaaataaagacaaaagctgtttgagaagcaggtagagtcctagattcctgtctagctccattcacattgtggaaccactgcctcatctttatcctggcataatctgtaagcatattctctggcaaaagtaaaagactttttggagggatgatgtcaggcacagctgagggcacaagactgtacccaaaacaaagaattaagtgacaataaatattaattcctgaatgcagacactccccaagccaaaatccccaacttggcttccagaatgcaggtaacaagactattacccttcaggcaggagtctggaagtctcatctctgggtaattgaccagctaagaagaaagacctaactaaggtcactaacattataggttccctaggatcagcccaattaaaccactctatgacaaagcccaaagtcaactagtcccactaatgaattcaaagcatcgagtcaatgttttagattcccactgcatcatgaataaataatcaaggacaccatatacttgaaggaagcttccgaaatggaggacagtgatcaaaacaaacaaacaaa

SEQ ID NO: 27737 - DNA, 2103 bp, Bovine  19866881543908
aaattgaacagttgaagagtttactgtttcaaaatttagcatttcttctaagtataacataaattctttgtaaaaggccccccgcccgatatgaagcttttttcctcattatgacaataaacatagtaagtagtgttttcttacaaagatgatgcctatgaagtataaacattataggaaatattcataagcataatgaaagaaataaaaattgcccatacttctgcaactgcagggactcagatgctagcggcgtctaatactcttttggttctttttctttgcatagatgatttatctatatgtgaattttttctttcataaacagtctttaaatctcctgtagcctttaacaaataaaagtgtttcagtctaggagtttcaaggcagcttgatagtatctacaggcgcattttatgtgcatttcccccctaaagtctaggaaaccttattactggtatctccagtcctcaaatacttgtgaagtatttgactatagcatttgttttttaaatcctgttaaagagattttgatgtttcaaaagctttcaaacaggaagcatgtctcccagcgaagattattcagcactatttgaaaaatgaaaagtgaaagtgagagtaagatagggagatttagcttttttctgaagctatggactgaatatggagttttcttccttgggcactaatttctatctgaatatttatttatctgtttaatctgaatgtgtctggttcagctagataagattagaatattgggatttttgaggtattttttaaatagcttagtgcaatatttgttaggatttttgctttggcactcattgtaactttctctttgctttgtaaatggagttggtttacttttttaggtgatttatattcttagttgactttttgttcttccttgagatggtttcttaactgcagcattgattcttttcatatatgcttttgtttatataataatttgcattcatatttgtagagacatttcaggattttggaatcttgagcctaaagataatggccactggcttgattccttcagtttctttggttgttgttcattgcatttcaagtgccttaatgtttttatgtgtattttcagttatcaacttttacatatattctccacctgaaattgaagttaataaaatatgcaaatgaatttaacctggagagtgaaagaaagtaattgatagagttgcccatcaaagtcttcataaaacagttcttcataaaattcaatatggtaattgataagcctgtttgtagttgttgtgtaataagaataattttctgctaagataaaatttctaacactgtgtgtttttcctttgagcagatcatgacaagatgttcaagatgagtgaaaaaatcttactcctgtgtgttggagaggctggagacactgtacagtttgcagaatatattcagaaaaacgtgcagctctataagatgcgaaatggtgggtaatacttagaatgtggctctggtggttttgtctttaaagtgtactgaaagagaatattctatactggcagttctatacatgtgctcttatttttatttgagtcttactatttttaaagctttagttagatcctccttctggtcctaaggattttctacaaaaatcccagagcagaaaagagaactattataacacagatacctggggaataaaaataaccccaccttgaaaaatgagcatgatgatatgagatttttaagtgttagagaatgtgacttgagctacagtatgtacgaaatctcagaactaaaagacctaagttaaacttggttatactgtttttttatgtgacaaatcacttatcctctctggacctttactttccttatcactaaaatggcattattgggaattccctgggcagtcccatggttgggattctgtacttcattgtagagggggattgggttcagtcccttgttggggaactaagatcccacaagctgtgcagcgtagtcaaaaaataaataaatgggtattgttataataatattaatgaatagtatgtatgaaaatgctttgtaaactttagactctgtgtaattataggagacttactatgt

SEQ ID NO: 27738 - DNA, 1331 bp, Bovine  19866881717570
taaatttccttttattttaagtaggttgagtatcacttttgattttacttttttatacagtagcattttaaccagaggttgcctatgttggagtcgttggaaaactacacagtggaatattcatagagaggcagaatgacccaataatcctgggaaagaaacactctggagagatagtctgtagtgtcatcaagttttcctagtaattgccctggtttgtgtaagctggataagtgctgagacccagtgctctcatgttgtaactgatatttctttatgaccaagaaagcactgatgatgataaaatcgtccagtaccactgggaagaacttaagggacctctgagagaaaagaagatttctgaagatactgccatattaaaattaagtaagctcgttcctgggaactacactttcaggtaaatttggatccttcaggcttaccataggccatttttcccccccttgtgagttttacattattaaaagagtaactctgacagatatcaaaattccctgtagagttgattgataatatatatagtctttggttccattggttctttaagccatgtggtaattgtggtcaaaacagtgataactttttagggcaaaggtccttgcataatagatcaggatccacacagctaatccttctcagagtcatacttggcatatatccaaacctttttatggaatttctgtcaaaaactagaagggtctatcttcctttgccttttctctggaaaattctgtaaggaatctactgtcatctcttccctttgggaaatgcttcctcagcttctgatatctcaaaatccttacttttgactaattatttatttgaatataatttgtagggtctttctctattggagactttacagagaatatgattcaaagtcagttcttttgggaagtagcactgacatactagattgtgattagtgagtctgaggctgattctagagtaatcttccttgtatctgcattattccttgtattctgcaaagcacttgtacttgagtgtcacacaaataccatatgtacactatactgtccttattgtacagctgagaaaaatgaggctaactactaacttttctgaggtcacacagctagagctaaatgcagattttctaacccccaaggtcagggctcattctcctctgctccttgacttgacctatttatgttttgtctctgcttccttgaatgctcttctcagtctttcaggggttctgcctctctttaaggacctcctccgttttcagcgaggctcttggagattgcttcagaggggagcagtctctttattccccgttacactca

SEQ ID NO: 27739 - DNA, 1317 bp, Bovine  19866881744734
ctgtggtgtatcagttcccaaccagggactgaacctggcttgtggtagtgaaagcccaggatcctaaccactaggcccccagggaactcccacccatgggttatctttgaatgttgagcatgtgtcctgattcatctccttgaattaataagtaaatcgctggggaaaaaactacttagggctacatataattgtatgttttcagatgcccatagcaactagaaaatcctggggaaaagactatttagaagcccctgtactagaacacagcactccccaacagcagcccaggcccaacacaatggacatgaaagctcctcacgggtcttcctgcttccttctgtgctgtgtgctgtgctcagtcatgtctaactctagcttgccaggctcctctgtccgtgggatttttcaggcaagaatacttgcctgagtattacaaccctgagtgggttgctatttcatcctccaggtcttcccaacccagggatcaaacccacgtctcctgtgtctcctgcactgcaggtggatcctctaccactgagccactgctgccgtctactttccccaaatgatctaccaaagagtggccaatggtctaatcaaacctcatctgatcatgctatctccctcttagccaacaagcttccagagaggcccattgcttttagcacaagagctttttttttatcagtcttcatgacatggactaactttctagtttcaatcttttactattcccctaaaaccctgagccatatttaacaaactactttagattacagattttgtatatatcgtgtttagagtaaaaactatatgaagttatgtatttctatttgtttttccatcagaagagccctaattcgtatccagtacctgttgggggccagagtgaggtactccgcccatggcaaaggtcatgaggaaggaggctcgacatacgcaaaggcaggatcgagcctcaggagtccccctggaaatcctcgagcgtctacccccataaccagagcctgcctactttactactttgtgctctcacctacacctctgactttacagggggctgtcccccaccacctctttcggagaaggagttaacctagagctccagtcaataaaaactcttgggcatgacaagagtgttttaacctacaaactcctctgaaggttctctagcctgcctgacaggctcgtccggccacatgtgattgctcacagcctcccaaccgtgagaggcacgagatgctttaaaccctctaaaaacaggttctttaaagaagttagaaaactataagtataagtatagtgggctgattt

SEQ ID NO: 27740 - DNA, 1744 bp, Bovine  19866880279580
tagcagaaagtgaagaggaaactaaagagcctcttgatgaaagaggagcatgaaaaagttggcttaaagctcaacattcagaaagctaagatcatggcatccggttgcatcacttcatggcaaatagacagggaaacagtggaaagtgtcagactttattttggggggctccaaaatcactgcagatggtgattgcagccatgaaattaaaagacacttactccttggatgggaagttatgaccaacctagacagcatgttaaaaagcagagacattactttgtcaacaaaggtccatctagtcaaggctatggttttttgagtagtcatgtatggatgtgagagttggactataaagaaagctgagcacagaagaattgatgcttttgaactgtggtgttggacaagactcttgagagtcccttggactgcaaggagatccaaccagtccaccctaaaggagatcagtcctgggtgttcattggaaggactgatgttgaagctgaaactccaatactttggccacctgatgtgaagagctgagtcatttgaaaagaccctgatgctgggaaagattgagggcaggagaaagggatgacagaggatgagatggttggatggcatcactgactcaatggacatgagtttggatggactccgggaattggtgatggacagggaggcctggtgtgctgcagttcatggggtcgcaaagagttggacacgactgaactgcactgcactgatgagactctaggcatgtgctcatttaccaagtgccacatcatgtctggtgttcacttctattggtgttggcagccactgatgttcaacacctacatctggtgaccagtgcactggaggttgcaatatggatatattctaagctattattttgttttcatttattagagggagtaattttataaggagatgctaccctctcatctatttgatttctgaatagagtttgtataggaaaggtaggataaatatttaattctttccttttatttactcaacttttaagataatgaactggactggttccctgttatcctcagaaggtggctatttaaaacaattgttaggaacttagaaattaaaacctacctgatgggtttcatttcatgacaattattgtctttattgtctcatcttggctgttgggagtcccttcaagttggttcctgagttgtttgccatgactcttgtggttgctctctggcatttgctaagttcctcttgtatgttttctatcctaaacttggaatcagctatttctctaagaagccctgggtttcacgtgtgctttgcccctacgtataaaggcagtcctgccgcaccctgctgttcaggctcagttatctccaccaagataatgactccttgtctatgggtcttcagacacatggaatgcaaagtgccctggtggcagctgggacctgtagttccatggacttggacctgtagaatgtagttctgtgtcccctggaaagcatgtgctccctttggagaacagtgcttccaaccacacagaacccagaaccacagaaacaggaagcacagtggccctcggtggactcttggaagtgagaagtgtggccacttcttatgcccttttgttcctggaaccaggtattcttccatagggacagagcagcacttgaacttctctgatttaatgcattttctggatcctgaaggatgacataccattcttgcagattgttgcctcagatgc

SEQ ID NO: 27741 - DNA, 2634 bp, Bovine  19866880401333
caataccagactaatcagctgaacttagatttttttacctagacattttgatgttatatagacttacccatagggcttccctggtaactcagagggtaaagaatctgcctacaatgcaggagaccgaggttcaatccctgggtagggaagatcccctagagaagggaatggcaacccattccagtattctggcctggagagttccatggtcagaggagtctggtgggctacagtctatggggtcacagagtcggacatgactgagcgactaacatacacgtacacacaggcttatgcttagtgttggatcccgtagactttggacaacttctttcattctttcagtttctctattaattttctaagaacagaactgtaagggggtctttggattccagggacttgccctatctagtgttcttttgcacaagcatgctgtattattcttttaaaactgaatattctcccacccctaaattttggtatattgtaaaaagtattaatgaagaggtctgagacatgtcagttcaaggagcagggcatcagaagttttgctatttattcaacattataatttttctgtgtgacttagtgaatttgtgagattttattactaaaatatgtaagagtcttcaattttttaaactgtttataacaccaaaacttcatcatttaatattagggcaatacagtttcttcagcgagaccaaccaatgtgttagaaatgatgaaagaatggaaaaataacccagaaagtgatgaggaaagcacaacagaccaaagagacagcaggtctggacaagaggagtcgaaagtttaccaacccagccgaaatgtccctgatgtcagtaactcttcagatgaagaggaaggaaaacaggtaggaagaaccaacaaaacatgtaggaaaaacaattgtttcatttctccaaactgtgaaataccttcacaacacttggaacatttttgcaactctttttttgttgttggattgtaatggtttgtaacaaaagagacctgcatgataaagaaagtaaagcttgaaactagcatgatttagtgatgtggcctagatgcttattttaagatccgtgattatataggggaggggtctgcaaacttttcctataacaaatagtgaatattttaggctttgtaggccataatagtctctgtcacaacttctcaacgctgatgttgtagcatgaacacaggcatagacagcaaatgagtgttccagcgaaactttacagagacaggtggtgtgccagagttggctaatgggtcacaatggattatgtatgtattttaccaggctatacaatttggaatgggtttatgtattacttcaaaaattactattacattagttagtcatttccaattttatgatacctaaaattgttttataggcttattattttactttattagatatagttttattctttttggtgaataaaatctagtaacatttggttaattctagattgcattctaccaactcaatatcctgacaatttacccacatcctcttttctcttgtttctgtgtttgaggaaaattttctgtgtgtttgttctcattctcgtcttgaagtctaatcagcatgtttgagctcttctttaatgatggaacatcttgccactgggggccagatttacgaccgggcaccccacttcttatgaggagttgctgcttttcagttctctgagacctagagacgggcagagaggggagagggcctggagggtaaatcctgacccacagtcaggaaggtacagcatggctgcctgtacctgtcctgccacgaattctgtcagaaacttgaggaaagaggcccagtagagtgatctggttgatttttatttactcattgggaatttcttcatctagttgatagcaaatgtctagataataggcttaacatttaattatttagacattttgaaatagccatatttttatgtaatgtaaacataaggttactgaatccctttcaccctctcccgtctgtcaacaactcctgcagtgcttagcagctgtgtgtatttggtattcttgttaaaaataatatcctaaaaacccatgtttgcatttcctcattgaacataatttgaaaaatttcttgttagctgacttggaattttatacatacatacatgtgcacacacatacataaacatactcacacatatatacatacacacgtacactcacacactctcatatgcatacattacgtattacacatgtgcatcaacaatatactcacacatggtagtgatgttttagttgctaagtcatgtctgactcttgtgaccccatggaaccaccaagctccgttgtccatgggataccccaaccaagattactggagtgggttgccttttccttctccagaggatcttcctgacccagggatcaaacccaggtctcttgcagacagtctcctgtattgcagatggattctttaccaactgagccaccagggaagcttgtatatgtgtatatatctacatatatgcatgtatacaagtggggggtatatatatatatatatatatggatatacacacacactcacatatatacaaacacaaatccatacatacacatgcatacacacattat

SEQ ID NO: 27742 - DNA, 1300 bp, Bovine  19866880421857
acttcactttcacttttcactttcacacaatggagaaggcaatggcaacccactccagtgttcttgcctggagaatcccagggacagcagagcctggtgggctgctgtctatggggttgcacagagttggacatgactgaagcgacttagcagcagcagcaagtcaagagaactttgtcacctggggccttcttttaggcaaggcatcaactgactctgaacccaggtcctgggcatggccagtaggggctcatccaaaagaaatgtgaagccatggtgtggctttctctctgtgtcatcttctattatagggtcttgtgaacccagctcagggttgtcctgggtatttgtggtaccctgcttccttctcccttcaggcagtcgtgattggcctacgggagaccaacctcagggccctgatagcccaacaagtgctgcttctataattgacagctacaaagacataaccacctagcaaggatcactttccagagaacacacaaggattgaaatagatttaaaaactgaaaccactctaattcacaggcaggatgctctagtggaataaaacccatctgccataaacaatgatcataactcagcattacttgattttcagagtatctcattaggggcatgtgcctacagaccttagtttctaataattctttgttatgtatttgctcattcatttgtttatatatgtttactgagggcttagaaagcattaggtattgagaagctggtgatactgtagtgggaaagatgctcttgtgaagtttagattctagttgggggagaatatgcatatagtaaagtcaagggtgataacttgcagagaaaatttaaaagagtgaacatatagagagtgaggaggtggtgggagggagttgctactttagataggatgagctcatcattggaatcgtgaatccagttccctcccagggcgctggcttcttaaaccaagcctggcagcactggccctggcaagttcctcgacctacccagcaggagcttgacagttggtctcaggccaggctgaccacagcgccaagtagtgaacgaggtgttttgcaattcctagaacaggcgccacctagtgattataaatgggatccacctgcgtttcagtcatcccactgccttgaagcttaaatgacatgggggcttaaatgctcaaaattcaagacaaaatgttaccaatgggatgctgggggctagggctgtggtttgataacagattgattgcatgttgaatgtatctgtttagatcatttccttctctctgcctgtccca

SEQ ID NO: 27743 - DNA, 1367 bp, Bovine  19866880437584
tgggagaaggaaagaacaggacataggggtcagggggcgtgcaggaggggagaggaaagtcagaggggaagggcctgggcagtcccagactccttcagcacactgaccttggaaaagtcgtttccctcccctggatttcagttctgtctttccatcacactccatgggaagcatgcaaggtcagacctcaccaagaactgggtgcctggtgtggccgccaaaggtcagggcattgcaaggccagcctggctcccaatcctgagctcccagctccacctcggggtggccgtacgtctgccactgggatcgatgggaagccattatcatcgccacattttaatgacaccaattaattccccatctgtgggtcccctgccgccttcagcgctgaaggttaaagggaggggcactggctcagtgtggctgttccccgggatgacaggtacaggctggtctgtgtgatgtgtgtgtacgactgtgtgtgttcatcatccttgtgctcctgtatataaaggcagtgctcactgttactggtttatgtgtgtacccgtgtgtactctgtatgtgtcatgtgtatacacaatgtgtgtacaagtctacatctatgtatgtgtaaagtacgtgtgtccttacatgcgtacaaagtgtgtacataaaaattatgcctctatatcatgtttgtacacaatgtaggcttatccgtgtacactgcatgtgtgagaaggttctgtgtgtgagtcctatgccaaggaacagtgaggacacagaatttgcatctctgtgggagtacgttctgtgtctgcctgcctcattgtatacacacctgtggatgtgtgctcacctgtgcattcgtgtgctgaccgtgtggagccctgaccagcagatcctgcttgctgcagtggtgtggggtgggcaggggtagaggctcctcttggcttccctggggctgggttttgcccttgagcgcagggttctgaggctaagtcttcttgccctctgacatggacctgaggctgcctgaccttcgtgtgtgtctcaaaggataaataggagttcaccaagcaaatggagtggtagagagggaagggggttcctaaatgttctaagtgtgaatcatacattcatatatctttacagaaaccccgtggagtaggcatcatcattagtcccattttacagatgaggaaaatgaagcacagaggtgtcgtccaaagacacatagcttgaaagtggtaaatcaggatttgaacagacacccacactggctcatacacacaatgcacttgtagacaaggcaatggacacacactcatgatcacacaggcatgctgggcacacacttgtgcacccacacacgtatacacaca

SEQ ID NO: 27744 - DNA, 2031 bp, Bovine  19866880489009
tacaaatttgaggaccactgccatagagtgagtatcccttcccactgtggctgagcctgatagatcggcccctatatctcagcagctgagaaagacaggctcaccagtcttaaagaggctccaacaagttaagaaagattctgagtgcagttgttatgtatttcccctctggcagagaagagaaaagggcagatgcccaacagacagaagggtatcctgaccccgggtccctggaggacacaacttgcctcccctaaatcccagcttcacagaaagacccaacagcagacttagggtgaagcctgagatctggcactacaaccactgctgctgcctagagagcacgacaagcccagaacttagcgaggtagcaaggaaggtgggccaagagtgggtagtctacctcagatatgaagggcagtgccaaggcaacctgggcatggggccgggatgggagagaattcccaaagaggtctcagaaaactagcactgggtcagcccggcccaacaggcacgtgcacataagcctgagctcagtgctaagcaacactctgagggttaaaaaagcccatcattctaaagctcttggccagggctccctgaaactttgcagctgggacccacgctctgactccaacagagcagtggcatcgtctggagaagactgatgctctactgccagctctcacctgtagaaccaaagttgcacaaacctagcttccagacctagctttttccactgttcacctaatcaattccctcaccataaagatggtgacacagaggcccagagagagggagggacacagctaaaaaacaccacaggtccctgtaaaccatagacggtaccctgaaccattgagcggtccctgattacatctgcagccacaagtaagacattctacctctctatacctctaccacatgttatacaaggaagaaaaaactctccagttgtatcctctggcaggctggccctcctcactaaccattcctgctctcccaaccaaggcagccccagggtactgggcatcagctaaggcccccaccacatgagccccccaaagccttcctctagcccaaagctcagaacagcagcatcacctttaagaaacatgttgcacccactccccagatgccccctccctgctagaaagacagatttcgatcctaaggtgattcttctcctgcccctggctgccagcaggcttacctgtggcgcctgctgccctgtgactacagcaacacctggggggagaagtcagaagagcgacaggtgagcccaccacaggtcccaaaggatggtgcttaccaagtgcccaggaacacccaaccctgcacgctgcagccagctgggctacagggcctaagcctcggggagctgggtactgggtggggaaaagggagcagcctgagtcctttcctcctttccctgatgcatcctcagccagggctgcgtttctccagctcacctgagacgcttctgcaagaaagggcttggttgactcctcctgttcctgtttatctcgaaggctctgcagtatttttcccaaactgaacagcgagagggagaccctcagagaggcgactctcttcctagctgcatctccttcctaatcctctgggtgccttggaacagaagctcagaaggaagaaaacgagattttcaactttcaggaactagctctgtcgccctctgcatagctcaggaggccatcactcccagccttttaggactcgatccaaaaatccttcagccctccatgttccccaaaatgacagtgctcatgtgtggctggaacctgccccgatccggcagctcatttaaatagagctcatcacaacaacagtgttggtggagaagtgagtagctgcagggccctggggaccccctgtttatacgtaggaagaatgatgcaatctgggtatcaaaatagcaatccagaatggaataacaggctcacgcagcagcggtgccggcacagccagagctcaagttacacactctgtcagccccacactactgcagca

SEQ ID NO: 27745 - DNA, 1252 bp, Bovine  19866880493388
catatctttctaatgggattaggcttcacacaggtcagggaacaatttattattctgctggctagagccaagtttccctttgaaaaatggttactcccggagtcggcaattacttcaaaaataaatttaccaaagacaaaattgtgcctcttgggtcagtaaacgacttgcctgtttggggctgaggagacaaggtgtttattaaggaccgccttcgtttcctgtgcaggtttttcagtttgaataattgtccaattaaatataatttggaagtcagtgctaacccagtgcctgtatcgcaggaggaagaatcactcggaggcgtgcattaataaatccctgggagccccaccactccccaaacccctcctttggtttaattttgagaaatttttttgtcttcccatggcctgtatgcctctcgtttggaaatgagcttcttccccctatagaattcttcggcctccctcccttccatctgtctgtctgctcctctccagcaagcagatgcgtgatgcctctcggtgggatggttccttcatgggtctgtggacttgtggttcttttttcattcatccagcctttcattccacaaacgcctactgagaacttactctgggacttgccctaagctggagaaaaagcagatgttgttcaggccctcaaagatgactcaaccatcaagacagagggacccaaaatggacctgagcagtgccatgtggttactctaagtctcctacatacaaaccttcaaggtgtgagctttcaaagatacaaatgtgtgtttcatcatcaggcatgagtgaaattgcagcttgccatccatctcctattgctgatgatccttcagctctaccatctcccacctcgtctccgtcctccagtcagtaaatcttcttgccttttcactcgatgccagcccctgtatgccagtggttattccgtactactgtacttttcaaggtgctgtactgtgagattaaaaatgtttatttttgtgtttgttttttatgttttatttgtgtgaaaagtattagaaacttattacagtacagtactatatagccagttgtgttagttgggtacctgggctaactttgttggagttacaaacaaattggacttaagaatgtgctctcagaacataacttgtttatgcgtaggggacttcccgtatctatgctctcagcaatgtgctttgtagttctattcatcaagaggtagagtccagttttggtttcctcagggta

SEQ ID NO: 27746 - DNA, 1466 bp, Bovine  19866880496754
actgagtgactttactttctttcttttacctgagtcgttgaagatgagggctgattatcagtatatgtagatgtagggttgtgggctagcattgtcttcttagtgagtagtaggtcctgatagtctctcctgatgtggttctgatatactttgccctgtccaaccagtccatcctaaaggagatcagtcctgggtgttcattggaaggactgatgctgaagctgaaactccaatactttggccacctcatgtgaagagttgactcattggaaaagaccctgatgctgggagggattgggggccggaggagaaggggacgacagaggatgagatggctggatggcatcaccggctctatggacatgagttcgggtgaactccgggaattggtgatggacagagaggcctggcgtgctgcgattcatggggtcgcaaagaatcggacacgactgagctactgaactgaactgatcctctcctttcctttcattcattatttcctcattgatagccagctctgtttattcatcctaccagctctttccatttgaatcactttctctccagctctcttctgtactgtttaccttgtatccactgtatttctcactttagattgcactggagtgaagaatggagtgggcttctctttaagggagaatctaagtcctcaaactttataactgatcatttcatcaacttgaaaacaatttctgtgcttgaggaaaaataaaaggcaacattaccatggtgtttttttcttgggtctgtggtattatatttacaaaatgaaatagtaggttatatgtattctttatttttctataggaaattacacatcatttccccctaaagtttaataaagtaacattaaatcttaataaggggagatccagagtccttccagaaatccctaggattaactaaatgggaattcctttgtttctttggtgtcagatagggttaggcttaggtttcagggttatatagtcagttgcttgcaactctaggaattcataatcttgcacatagatattgatgctgagacttttcaggacaacaagatagtaaaataaaattatatagtcagtatatgaattggacaatatattactgcattaaatatagataaaccatttgtggtgggaagtaggaataggcttgagatgaattattaggagaaattgtgacatctgtccatgtctagtctcgacaggaatttattcctcgaagtcactatttctcttgataactataaagttatttctcctctacgattcatcctctatgggtggagcacagtagtgggcagtttcctatcactcttgagatggtaatgtttaaagggtaaagatacttagaagcagggatgacagtaggtaaaattttaactaggtaaaatttgccttacgatcaatctctttccaagtccttcaggaactattgtgtctcttctaactttgggg

SEQ ID NO: 27747 - DNA, 2255 bp, Bovine  19866880527038
ttatagaatctgacaatatcacaatagaaactctactaaattcaataaggagagaacaaagattgaaaaaaaatgaatagagaatcagtaagctttggaaaatatcaaacaatctcatgtgtacttgaaagcccttcaaggcaaaaaaaaataatggccaaaatgttcctaaattttatgaaaaccataaactcacagatccaagaagctccatgaaccccaagccaagaaacatgaacacagctacactaaggcacaacacaatcaaactagttaaaaccagtgataaagggcaaaactattctaagaagatgtgaggataaaataagtcacaactctaagactaaaaaaccagagaaggcttttggcatcattgccatttatgacctcctgtaaaggtaactgtcatctctaatagttatcaagcactcctaatgaatcaagcacaatgcataacccaaattgactactgctgccttagaaactggcaaaggaaacaaagaacaatagctaacattcaatgagacatatgctttatactcattttcccacttaatccctccacaactaaatgtggttgatactattaaccctgaatattcattggaaggactgatgctgaagctgaagctccattactttggccaccttatgtgaagagccaactcactgaaaaaggccctgatcctgggaaagactgaaggcaggaggagaagggggcaacacaggatgagacagttgaatggcaccaccaactcaatggacgtgactttgagcaaactccaggaaatagtgaaggagaggcaagcctggcatgcctgcagtccatggggtttcaaagagttggacatgacttaactgaaaaacaactatcgttaaacctatcttacagatgaggaaactcaattagagaggttgagtaatttgtccatggtctcacaactaaaaagtggtagatccaggattaaattgtacaggcactctgacctaacacacctaaccgctatatcataccacctcctagcagagaaacacccaagctcatgggcaataaacaacttttgcagaatggcaaacaaccataccaactctactatgaacttaaccttgcagaattatgacactattccaagggactctaatacagagccaagggccatagcaaaaaggaaagccacttctaaggaagctctgatcactctgggttatatctgaagttgtttcattttttccccaacatgccaccagaaatatcactgaagatgtcaatctaatcatcagacacctaactatacaatcaacaataaaacgtcctccagaatgcttttcatcaatctccactagcagagtggtgtaacagagtcatgccaaagacatgagccactgtgtcccaaagagactacttctcaaggagacgatattaattttgtaaaaataacaactttcagaatgcagcacctgataaagctttgcctttaactatagtctgccaggctcctctgttcatggaattctccaggtaagaatattgcaatgggttgccatttgcttctccaggagatcttcccaacccagggattgaacccgggtctcccacattccagacagattctttaccctctgagccaccaaggaagcccagctttaccttaggtgtctcaaacacttgttccaaatgtatgatgtgttcatgtttcacactttttaggatgtccacttcccgttcaagtaacttcacagcagagcttccagccttagatgatgaggaaatacagatttcatgtaagaatttcattaccgcaaaagttagagttattttatatttttataaatatattttatttataaatataaaaatatttatattttttcctatattttttcagaaagttccttttccaaaagataatatgcaacctatctgcatgataagattaatgtataccctttctttcctttgcccaattttaagagataattcagcctcaaatcatatctgtttcttggacggtttctataaattagctaacaacatggtctctgtcatatcacaaaattattgcagctcttaatatgctttttggtatttccttcaaaattatgttgatcttttgatggtagcataataaaaacaaaatctactttctagggatgtcaattagaaaatggatataaggcatctgtctcattaaatgtcagttattgataaaatgcttttatcttgctttgtctccattacatttatatacatatca

SEQ ID NO: 27748 - DNA, 905 bp, Bovine  19866880563098
aatgcatgcttactttcttctacgtattgtgttttactaggcattttcacttgcatcattttagcaaattgtcacgacgactgtgagtgaatttgttgatgctctggtgtctccagttgaggaacgtagactggcgaacttgcttaaaatccagatctaagtctgtaccattccaaaggatgtgctctttctatgccctcttatctaaaacagttaatgagcattttccccctgaattgttctgtgttgtttcccatcctgttctcctttctatccactggaaattaggataagattttggatatttgtgggtttcatctttttctgaaaggtgtatctggttgaatgttgagaataccagtccatatcaaaaattgggcagggtaagggtgtgtggcaagacttggaaacagatagtctgaatcacctctctttatctggttaggaggagtgatcatctttctcattaaactcattaactacttgtggagacaagtagttaattaaatgttatattatgattccctgtcattttacggtaagaagatggaatttgtttttggaagatttaagtaatatgtcagtaaattagcatttgtaagtaaattctgattttttagtccacaggtctcttttggagtcttcaagtttgttggcaatgtttgaggaaagaaatttattaggccataactttcactccctggaaatggaacattggctagtttctgttgatagatacttcttttttgtgggactgatcctgtttggattctgtaagtcaggggtgagggttctgaaatgaaaatgtacagggtgttgataaacttccagtccttggtgttcatgagatctgtgttcagccttggtccgccggctagatggaatggtctgtgaagggcagagaa

SEQ ID NO: 27749 - DNA, 2541 bp, Bovine  19866880583521
ggatttaagttttggtggtgacgtctgtctgggaggggtttggacttagtccaccgctgttgccgttagttaggtcttaattatttttcccccagagagtagttttcagtttctttttagtaatggaaaaacattttttttttcaaaacagtatttatacccatctccaaatgatataaaacataggatggctttttaaagcaaatgtgtattttcagtaagcatagtgagctgcacagtggaggtgagagaaagcatttttgggcttgaatggagctgacccgagagaaccttctcctctgtgggtgctgggccgttcccgaatcctgcacggtctggcagtgactgcggtggtggagtgcctgtgagtgggctctctgggaatgggaaagactgtaaaaccctggagtgcgtccccagaagactgaccttacgagagaagttctgggaaacaaaccgcagggagactttacaggaattttttgttgagcccacaagcaaggcacatgaggaaaagagatgtaattatagtttgtaagtctatgaaaagatgcaatgagtgacatgaaatagccattctaagtttcttcttcctgttggacagggaggaatgggggttttatgcattcattcagcagatttttactgcgtgccagctgtaagctgggccctatactaaatgcagagaataggtggctagcaaaacagtcaaggttcctgctcctaaggaacctggggggaagcacatgatggcacaagggagcaattacagattatggtgagtgccatggagggtaagtcctcattcagactgaagggtcgcagacttctcttaggaagtgagaggcaagttgagccaagtaagattcagccaggcaaagactatggcgtaggggggcatccaaggcaaaggggaacagcctggagaaactctgacactttggggaactaaaaggaggcccacggagctggcacccagagggggagggtaggagaggaggctggagaagagtcatacagggccttatagggacatgggaagattttagattttaccctgaatgttggggagccattgaagtgtgttaagcaggaaatgacatgatctagtgtaaaagggtgattcagacacctccgtggagaatggagctgtgagggcaagagtgaaagctggggtggtcaggaggtttttgtcacagttaaggggagagattagggtggcgatgaggtgcagaaaaatgaacagatgaaagatatatctaggaagtagcattgtctggagtcggtaagtggattggctgcgggccagaaagaggtagggatgcacaaaggtatctccttgtcagtacaagcctgcacggggactcccagcagaccacacaggttacaggttcctgtctttcgggaaaggtcaggtaggattgatctgaatccagccttgcagaggcagcaggattcagctgacctcttgctctgcccagttcaaggaacttacacacaatagcagcacccagcagagattccagttctcccagtagtagggcacttactgtgtccctatctgggcccctcccccgactcagggcaaggctctaaggaaccagtataaccccagtgtgccactagggggcgcatggcctgcattctgtgtcaggtctggtctggagggctttttgaagtttgcattagagagagactgaattgtatcagctttagtagtccacctgccctgacccttcatgctccttagaagaatgcctggtatatggtatttgttgtttagtcgctaagttgcgtctgactctttgccacctcatggactgtagcccgccaggctcctctgtccataggatttcccaggcaagaatactggagtgggttgccatttccttctccacgggatcttcctgacccagagatcaaacccaagtctgctgcattgcaggtggattctttactgctgagccaccaaggaagcccactcaataaacatgagttggtattataactgtgattagtgtcttattgtagaaatgaatgggtattgcctcttgtttctcagtatggagactgggcaggtggaatgtgcattttagggatcaggagaagaacagaaaactgcctgttgggaacgggacaagagaggaggtgagtgatttgatggtgttgcccttgctctttcatcctgtcctccacggacggggaacactagggacactaggaattcctttgaggaattcctgagttggtacttgggtcggggtgttggattgggtatttttagtggctggttgagtgtgccctctttgacactccggttgctccactgaagcagcagtgtcccccccttagggttggtgccaccctgttatttcctgctggattttgtgatgctcctcctaccttatctcctgcatatatataccttttaaactagagtgaattaaaatcttgttttaagaaatttgctataatactgaaggttagtcaaaaacacaaagattctgcatggggtctcgcattaaagattccatcaggatc

SEQ ID NO: 27750 - DNA, 1132 bp, Bovine  19866880593994
cagagacattactttgctgacaaagatccatctagtcaaagctatgatttttccagtagtcatgtatggatgtaagagttggaccataaagaaggctgagctctgaagaactgatgcttttgaactgatgcttgagtctcctagactgcaagcagatcaaaccagtcaatcctgaaggaaatcaatcctgaatattcattggaaggactaatgttgaagctgaagctccaatactttggcctcctgatgggaagagctgactcactgggaaagaccctgaggagggtcttgaggagacatgggaagaagggcatgaggagaaggggacgacagaggatgagatggttggatggcatcactgactcaatggatataagtttgaacaagctccaggagatggtgaagaacagggaagcttagtgtgctgcagtccatggatttgcaaagaatcagacatgactgatctactgaacaacaacaaaatctcagaagttttctcagataatggttcaatttcacatgtacagaatatttcaaatgaaatttgtttgcccttggtaatcagaaagaacctgagctttactgttagaccaaggttcaaattcctcaccagtgacttaacctatgtggtctcaacttccttatatgcaaaatatatagatggtgtctatatacctacatggcagaattgttacaagaataggattaatgtatgtaaagtcctgacatattgtaagcttttaataagttgaagtttttattattatgaaattctgccaaaactcaatagatggtagcatcagaaaattattttatcagtcataatttctcaatctaatgctccaaatattgttctacacagtttccaatatacaaatggtcatctaattagctcatagctagtttagaatataaccttatgggagtttgctctagatgtgttcagctttattgtagaggaaatggcttgctgaactagcccacaagcagcttgttaaatgttaaattctgaatgctacaggcactcaaatattgcatttataagaatttttttaatattataatgttggacatcaagaacattttagcctagccacgaccacagtctctcaaagtattactgctctgttat

SEQ ID NO: 27751 - DNA, 1081 bp, Bovine  19866880672003
attcctactattgtggtgttaggatcattcccttgagcccactgaagtccctacttcccttgctggctgtctgccagggctgctctcagcttctggaggctgcccacattccttgtcacatggcctccctggtccttaatatagcaaggttgcagcaaattcatcttgtactttgaaactttctgactttgctttctgctgctggccagagaaattgctctgcttttaaggggcttatttgactgggtcgggcccacctggataatctctgattgtaagatcagctgacctgggactttaattacgtctgcagagtcccttcacagcagcacctagattcgaattttattgaataacttggggtcgggaaacttggaggttggagggcatctttagaattctgcttaatgggtgggaaaccatgtaccttcccagagagggaagtgaaatgttcccaaaccattattatatctctcacgtgttcctgaaaaaccttctctaaatccactcctgtgaccacagacagtcttcagcagtacctgggcagaacctaagagaaaaggagggccccagacctgttcccaaggagctccatcactgtcctcttcctaggatggccctggacctaggatctgagctccacccaggccccagggaccctcctgaaccccctgcctttggttccttatcctgtcccactctgggtggtggtccagccttcacttctctcgctctttgtcacgggctctgggacccccacccacaatggttgagtgtctgggctgcctctgtttccctaggggtgacatgctttggaagagttgtctctacctcctgggactcaggaccccgactcagtttaaacagagagggtgagctggctccctgggctctggctctgagcgttctctagccggcagccttgggcctggccgagcagctgaggggctttgagaacaaggtcacgacttggcaactgaaagccagtcgagctccttccatcaagtttttaactagaaaaatagtgtgcccatttctctgtaatacactctgggctttttttattagacttcatttcccc

SEQ ID NO: 27752 - DNA, 824 bp, Bovine  19866880757283
ttagtttctttcagccttaccttcccccatggtaaattgacaatgttcaagtcctttccagcccttttagtctgtttcttcagtttccactgagagatgaacaccaggaaattgctataaactgtagcatagaggacctacatgagatttttcggtcccattcattaaaatgggtgaacaaaggttttaaagatactcttctcaaaagcatacactaaggtcatctctaagtactttaagggaaagttgaaggtggaccagccaacattgaagaaaatcacctgcgtggaaggtactctgtgtcttctaggacttaaaacagactctgtggtcttgtccagcctaacattttatgattcttatgtgggtgtaagggtgctggtctctatggcagaaggaagaaaatgccttatttctgtcctgcttttcaatttcataatgaatattaaaattaaaaaaaaaccctctgtttctacatcttttataaaatccttatgactccaagaataggattccaaccaacaagatacggttcagagagtatttttatgttcttattctgtgaaatggttttacaaaactccctaactttggctctacaataaagtgatgaagttaaacactttggttcatggttcagtaaaaggaataatatttgcctttggtttgaggtttagcaaattggtattcttcactttggttttcagttcatgcttcagttcaagtctccattaaagaatggagcctcagaactccttggctctctagagatagaatcaagaacagggttcgagttcattttcagaactttaagcagcccctaa

SEQ ID NO: 27753 - DNA, 2976 bp, Bovine  19866880761058
gagacgcagacagattctaagacaagagaaatacacacagctcactggactctgctatgttgtcaaaatgtaaggaaaacagggtaaccctaggcacaggtccccgaaggaaggaatatgctatctctaactgaggcacatctttgagcctggaacaaggttattctctcttattcaatataaggccctggactagaaggtagggaggctcacctctttttcaggcttatggaagtgcttcacgatgccattgactgcctcaccgatggactcttggatctgcccagtgttcagctctgattaaaaattaagcagatatccaatctcagagcttaatagtgcttgtttaatagagcaaaagactcaggacatgggggaagtcccacaggagaggtggggcagcctggaccctgggaagagttgtgttgctcttggcttacccaactttgtggagctagctcttcttaaaatcttaggacaaaaagtaacagctaatacctttggagtctagtctctaatagatgctagtaaaatttattctttgccctggaattctggcaaccaaaagagtgccaagccttgacagtgaagccaggaacttgatagtgaaaacagggaaggccagaaagcagacccctctcctccatagggtcacatacaaatagcacagatgatcgggcctggctccaggagctctcccctctcctcccagtcctctaacgggagtgccaaatccctgcactgcttcatgagaggagggtggcaacacctgatgctgctttgcagaggtggttcctgaggcagctgtgtaggcgcggatctgggctccctcatcagggctccccgaaatctgcccactctccaggctgggcagcgtgagggcccagccccaccttccacttactgggtctgttgttgggtgagatggtaacaagcctccggatgacgctgggagactgctgcaggggcggagtccggcacggcctctcatccacctcaggctgggatgtgagcagctccccgaccagaacccgctccaggctcccgtcatccatgcccttccccaaccagcggccacatggaaacctgaggttcaggcaatagcctgtcagagctgtcagctccttcagtgtctttccctttgtcgatctacaaaggccatcaacaaagccaatccctggggacaggctctgaaactggcccgggaccccttgtggcccagctcctcatcccactgtgtcgcatcaaggaagccacccgagtgatgggtggcctggacagtggtagcagacacttccacttggaaaaccctcctttttttctcttccaacaagaagcctcagcctatcacacctaaaaggtctccctgagaagtccacatacccaggcatcaaacacagcctctggtagtacaccaggccccactgtctcaggacaaagctgaagaacacttacttgtaggtatgtccggtgatctcattcctaaccatcacatattccaccaaccatttggcgtagagtccagagttatcatggcctatctgcacagtagtgagtttccccaagttttggcactgtaagagaacagagaaacagggatgacaggaaggtcaagaaataggagaaaagtgccacactgctcagaggcacagatctgactggctgcctgcaagctgccccactatctgcaggggcagagctcagagctccacctgccaccaaagctggcagtacagtactatctcatgaggaatgatgctgagaaagaaagatactacaacctagaagaagaactagggccagggaacagaaagctctgaaagtggcagagcagtctgaggtctctgtgaatccttgggttcagcagctgaaagaattcttgagaattcctcaacacaccatggcagggaggtttgcaagtcccgatgggtaccttccagccagagaccatttacacagggcaggctccctctcctcaggtcaacctttgactctggcctctggtcatcctgggacaggtcagctgtgctgaaacataatactgtatagagcaaggcctccataaaatcctggaggaaggtgccaaagtagtcctgccagctgaaactcagacccccagagccttgggatatggtccctgggtaacacatacctcgaaggtcatctctaacaggttcctgggaatctgcaggatctgtgtctcacccagttctcctgagatgcagatccatgggttggcggtgaacatagagccccccagcttcttgcttggtacaatcaggatgtggtaaggaatcactgtttaggagaaggcataaggcattgcaggagatcaggaatccctcccgtacctgaccctgacctgccccaggtgtgctggcatgtctgtggcgcctggagcagcagggcctgaggccagtttagaatactagccaatcttctcaatctcactcctcccaaggttatcacccaaacatccaacacacaagcccatctgtgagctcagagctaagaaaaactgtcccttaaacatgatcgccaactcaacaatgtactaaatggcttttcagagcacttttctatctgtcatcccaaggactctggtaataatctccagagagggcaggcaggtatcacaatcctctcctgaggcaccaagagggaaacagtttccctcaggcctcctactttccagtccagtgctgcttccaccaaagcctatgaccctcttccctggggaggagaatgagtgtcatatgaaaacaagagtccacaatgctgagtcactagccgaacaactgctgctgctgctgctgctgctgctaagtcacttcagtcaggtccgactctgtgtgaccccatagacggcagcccaccaggctcccccgtccctgggattctccaggcaagtacactagagtgggttgccatttccttctccaatgcagaaagtaaaagtgaaagtgaagtcgctca

SEQ ID NO: 27754 - DNA, 1394 bp, Bovine  19866880787996
tataggagatgtcacttgtattaataagacagggatgtgtatataatttgtggagcatttagaaaagggcacgggtaaccttcagagctgtcatgtggaaagtgttcttcctggcgccagaggacaaacatttccagtaggtggaggttgtagagaggcatttcctgatacagttgcagggaagcatctactttaaaccagagactaccaactcctgcaaagaaactagtattgttcacagttttgcagaaggaaaagcttagctgtacagagacataactatttagcacaattaaatgaactgcctgtaaattctttttcactggaagtgaaaggtggggtgatcatttcctagcaatattagaaagagacttatgttaaattaggagacttccaaagtcatttctaatggctaatggcagaattttctttgattctaggacatctttgttaaatggcattgtgaatcaaatgtagcttctttttgactcattgccatcactacaaacgtagactcattaatttggactgaaattattagctttttagccagttttgaagagttgcaggctactactgttctcaagaaatcagaaaacagagccatactactctgtgtgttatactagtctggtctgtgtgctattagcttggactcctctgttagcttctacttctttccattatcactgtatcctgagctaagctagtgtcttattttatccttacttgtctggtcagtgacctactggcagctatttttaaaaagatgtcaagcacgtgggcattgtgacaactgttttctcagagacctttttactcaagagttgtggtatgtttcagaagactggggctgccagatgcctgaccagaatggagaaaaatctgggtctttacctgcttttaggtagacttgtctaaaggttctagtagcctggtaactgttctttctttccagcaaatactagccaccaaaatcagagaggggaattcaatcctagcattgtttttgctagaggcaaagtagcctccccatttgtggttgatatgaaaacataacttttcaggaaacctacatactccagtgctgacatactcaacccctccagttgccctgaacaggagaaataggttgggaagagggagtatggctggtctagtagacctgtttcctggaggagagactttgaggacaaagggaatggagatataaaatcttctgcactgtgagcctggatgacaggaatttaactttgctttcatcatttggcaaactaatatgggatatattgggattctgttatgaaatgctgaactccttggatacattggatgaccttgtacttggtggggatgctacagcggttttcgtcttatttgaaaatgggtaaaga

SEQ ID NO: 27755 - DNA, 984 bp, Bovine  19866880790168
agtggagaaacctggagaagactctgcagggcctggatgggaggtaggaaacctggcagatctgaagaccttcacccactctcttgcccacacagctccctcaagggtgctccaggctgccctgggagacagagaagaggtggggcctccatccccaaggcctggcccggagcagccccatctcatcaagcccagctgcagaagccagaggtctcaccctttcccagctttgctgatgacacaaaggacaggggcatcgccaagaatttctgctttgcacttttttttatatggggcttggtcagagcccaaacctatcacggggatcctcttgaaggaagaatccagtcccactgagccctgcccccccatgcctccccacgtctcctgtggccattaaccacggatgccaaacaccccagcccccaacacacacacaagtggaagaaccagttagagaagggatgcgtgtctgtgtcaacaactgagaatttctccaaatcttaagcttcccagaccacacccatggtgagggccctgggtctgcagcttccctccccaaccctctctcatgtccagccagctgtttctctggttctcggcctcttcccctcccttgcactgaggagacagggccagatgaagggcccagcgccccggcaatgcacagcacagatgaggagctctcaggggccagccattccccaccctccaaagctggacaccatttcccaattgcccgggcactgttccttggatgacacctctgggcagcagcctccatgctactaggtgcctctaatcctcactgtcccccagccttgcgatgcaagacagaagaagacagaaagagcagacgctcgaaaagctttacagtaaggctgactggctctgtccccagctcccaccccactcaagttcctggaaacgctccctcagccccagcgagctgagggaggggaatctctgcaggaatgcagcctg

SEQ ID NO: 27756 - DNA, 1300 bp, Bovine  19866880802653
atgcaaagaactgactcattagaaaagaccctgatctgggaaagattgaaggcaggagaaggggaccacagaagatgagatggctggatagcatcaccgactcaatggacatgagtttgaataaactccgggagatggtgatgaacagggaggcctgcgtgctgcagtccatggggttacaaagggccagacacgactgagcgactgaactgaactgaaacatttaatacatgttaattctcacatgtatgaaatgatattatgtacaaagctattcatcacagcattgtttgtagcagcaaaagattaaaaacaactaaatggccaaaaatcccaggcagaaatataaattatatgacatatataaaatagaacattaacatagctataaaaagaaaggaggaaaatctatctgtttgcatatgaaaagatctccaagatattcttttaaatgaaaaaaaaacaaaaacaaactacagaacaatgtacatatatttttaccttttgtgggggaaaacagaaagacaagaatctgtatttgtttattcttgtatatacataaagaatttatagaaagatatataagaaattaggaagatggctgggtaggtggaggtaaaggatggaagggaagtttcagtgattgtctttatactttttagttgttgaaccatttaactattaatatattgcaatagaaggaggaggaggaagaggaggactggagcagaagtagtttttattgtcatgaccacaaaagtaacttaaaattgaatgaaatctagaccccagccatttttgaagatcataggacttttcaatgggagtcttctttgtagttcatttttaagccacagagtatacatgcattttttatgctgcctgcgaaatgtggacccctgattatagtgagttatcatcctggaccaatttagggtagacaggcaacagataacatcttctaaattcttgtggccacacttttaactattgccttaagcctgtgggacgagaatgggcaaccaaaacacacacacacacacacacacactagtgagtcgttaaaatcgtcatgtaagattactgatatgagagatgctataatccttttaaattagctcatagagcctattaataagataataagttaagatgtgacctgtgattcctttcaattatctattttgcaattttactgcagataaatatctcagccctttcattaattaagaggtcaacacaagccagtttgtcaattatttctcatttctgaaatatttttcatgccattcaatttttt

SEQ ID NO: 27757 - DNA, 1169 bp, Bovine  19866880816323
aaatagggtaatcattttgttgggcttttttttttttagtgcagtgtgaagcatgtcattttcctggtttgttagtagtgcagatattaaaaaagaaaaataatggccagttaaagaagagcagagaaatatttagagagatttaagaggttaaaagagaccagtaaggaaaaatttttagggagaaagggaacgttaatatgggggagaaaaagagatgaagggagaatgagagtctgaccttggtgctttgcattatcattttcttgttgccttcccaaattccttctttcctgacccttgggataactagtgccttttcttctattgctgtttctctgcctgtaatgagtttctctccactttcattgagttgctggttcctgcaagtggaacaccctcatttatctcttcttcatgtcagaattcctttctttttttcccccccattttttctcttttgaatgactcttgtggggaaaaaaggatgagttgcctttctttgggataaaaagaaaaacttgggtgttctcaactgttttattttgttttgtttttgtagttggaagtgcgtgaagaccccagtagcaataaggatctcaaagttcagtgtgatgaagaagaactcaggatttaccagctaaacattcagatccgggaagtttttgcaaatcgtttcactcagatgtttgcagattatgaggtgtttgtcattcagcccagccaggataaggagtcctggtttaccaacagagagcagatgcaaaattttgataaagtaagtattaatatagtcctgctggggaggtggtaagaaatgagaacatttaaagatgtgactgaagatgagtttttcttccataaaatgtgctggaaacaagttctcggtccttctgatgttggtaaagtgttgggttgctttagagcagggtgcgggttagtgctatcaggtgatttaccttcagtcggagctctctcaggcacagatgcacatgcaggttgaacaccaggattctgggaacgttgattgccacagtaggttacctgagtaagtttaggccggtgtgtcaaagtttcaggatatttgaaatacataaattttttaaaatgatgagggtttgcgctttgctttttgtaaagaccctaggaagcttcagagaacaattagc

SEQ ID NO: 27758 - DNA, 2179 bp, Bovine  19866880824316
ttccccctctacaggggtccccctttgatcagaggactcccaggggccaatgggacctgaccaggcagagctggtggtgggctggaacaggggcctgtggagggttggactgaggaagctcctgagaagttcagttgtgggattgtggatgagcttgacttagcagtcgggccagaggaatgtggcccatccgagacccagggatgtggttcttgctctagacccttcagtaatgagcccaagattccctatgtgcgcctggagcggctcaagatctgtgctgcctcctcgggcgagatgccagtgttcaagctgaagccacagaagaatgatcaggatgggagcttcctgctgatcatcgaatgtggtgctgagtcctccagcatgtccattaaggtaccgcttttctctgctttctccttgaaacttgccccagtccaggagcctctctttcctctctgctcctggcagaatcctagctccagccttgttccaagtctcagagtggggctgctgctcagccacaccttgtcccatgctgcctggggtctgtgaggggcaccctaggactgagctgtcctggtgttcctagggctggctggtttggggtcctgaaataagttggtgccaagggcttgttatctttcttctccctccctcaacaacgtggtacctcgctctaaccactcagactcacttcttccccaaggtcagccaggaccacctgcctgatgccatccaggccccaaatctggggggaagaaaggtcactgtcacatctctggctgggcagcagcccccagaggtggagagtgcatctcctgaagaacacaggctcattcctcgaacccctggagccaagaaggggcccccagtgcccatagagaatgaggatttctgtgctgtctgcctcaacgggggggagctgctgtgctgtgaccgctgccccaaagtgtaccacctttcctgccacttgccagccctgctcagcttcccagggtgagtcatgcaacctgggccctgacctggatggcacagtgatcttccaagggaggttattccaggccagcccacagggctctctctgggggacttcctcccctctctggcctgcataaactgcaggtctgtgactcagtggctctctctgtgctccttctgcacacagacaggcagatgcttcccttcctcctctgttcccagcttcctcctctgttcccagcttcctcttgtgcagatatatcccttgacatctctcccagccccttgctaactcctgtttttctggattcactaatcctgagttaactgagtttctttcaagcccgttgctaagaagccattctctgtagggctggggacttagtttctcatgccacccccactccaatcctgtctcagggtagagggacaagggagggggctgtggacatgtgctgaggcctcacgtggcctcacttgcctctgcaggggagactgggtgtgtactttgtgccgcagcctgacccagcccgaggtggagtacgattgtgaaaatgcccgcttcagccagcctggagtgcgggcccctcctggcctgagcatatatgaccagaaggtagggaggggtctctgggaacaaggttcccacctggggtagcctgcctgtgcctatggaggctgagacttttctgaggggatgagaagcctctctggtacctctcttttgggctatgcctggacattggcccctggggtttcgctattatttttcttctgccagctgtcttcctttggcctgggagtctgaactgtgccctggtatggctggcggctcgtaccctgtgggccaaagccatcgggatcaccatggttaattcctactgaggtggggccagagcagactgacacggctgcccattttggtttctgcagaagtgtgagaagctggtgctgtccttgtgctgcaacagcctcagcctgcccttccatgaacctgtcagcccgctggtaaggaagccctcgctggttctgcagaaggcctgggcctcgagcggattgcggtggggcccggggtgggctcggagcgtggccggtggaagttggggtaattgtgcatgatcttgggacctgggggcctggccaccacagcgctgcacagctgctgttgcgtcagaccttcatgacatggaaaccactc

SEQ ID NO: 27759 - DNA, 936 bp, Bovine  19866880858472
ttgtttggttgaggggatactactgtcctctgtgtagtgaatggaggccagggttgttactgaacatccttacaaatgcacagtccagtccaccacaacaagaattatccagccccaactggagcaactctgatctaaagcagttgagacagggtcgtcctgtaggctgggggaagatgataaggactctggctggtcatccaagcccaaagcagtttagatttgatgagcctggaatacatgttctccctgcccccatctgctctgtcctgtgtcacaggataaggaagattgtatcctgactcaacaatctttggtcccctagcctcaccgctacaggacctatgttggcgagggaccaggaaatacagagtctatcctgattcctccctgagtgcccgcgatggggtgggctatagaaaacatgcaagggatgtcaggtttcatatttggcttcttgaggcagggcttctgggtcagctctgcttagtcagggctctggaatggagaaaagtcattttcatggcatgactgtgttacaggaaagtctgtgcagttgctggggactctgcctggtgttgagaattacttaatccagtcccaaatccttccttgccccgtctttgactcattcgtttacagagatctgtacggctcccatggcagtctaattagccgtgactgaaatcccccttcacagcccctctgcccccacacctcggcaaagacatttcctaaattcatggtggtttctcatgatagtgataaaaatgagatctggtagagatcttggttttggcaattgaaaactctgacggcatagaggatttggtagctctcctgtgtccactctcaggggccttgtgttgagtctgttgctttttctgtctgctccctgagagggggcagctgaactcctctatggtgggaggcaca

SEQ ID NO: 27760 - DNA, 799 bp, Bovine  19866880872992
tgctcgaggcattagtgtaatgggggaaagcaatatgcaaatgaataatgactcaagatttcaagccaggcaacagccactgttagaagaccttggcttttctgagtccctgtagattctctgcatccaaagagctgaaagagaagtagacagttccagggctttacatcactaaactatacagactgcgtcaacagtccacatctttaacaaaggaaacttctcagctctattctactggacttgatacaatagaaaagttcatttaaacctctataaacacatataaacaactgtggtagtaattttaacagtttgaaaatacccatttcagaaatgtgtcagcactcaataacttttttaacttgtcagaagatgaaactaaatgactgttttaagactatatatagactataaggccagatgaaaagaaataagcaatggtagcgtgccaacattttttaaaaaaggcagtagtattgaaacttactgttaaccactggttatctagtagttccttagctgtgattctgtgagcagggtctactttcataagttgtttcaaaacacttttagctgcaaataaaggaaaaaatcctatcttatatatcttaactataattaatatcacatattttccaattttaggattaagtctgtatgacacgaaggaaacatatcagttatagaataaatatcatcagtacatatggctaatactaaacaaagtttaaggctgaaagtgagggttttattgcctggataaccctggtttatagtcttcagtaaaaattagcta

SEQ ID NO: 27761 - DNA, 2058 bp, Bovine  19866880906693
ggaatttatttctgaagcgtagttgcagaggaggagggttgagaaatctgtgtgtgtgtgtgtgtgtgttagtcacactcagttgtgtctgactctttgtgcttctatggattgtagcccatcaggctactctgtctatgagattctccaggcaagaatactggagtgggttgccattctcttctccagagggatcgtcccgatccagggatcgaacccaggtctcctgcattgaaggcagattctttactgtctgatctaccagggaaacctggtaatccatacttccctgctagtcccatatctctcacttaaggatgtagaaagtgtgattcagagaaaaggggtcactgatttcaggttgcacagttagtgacagtcttgaacctggaacctacatctcccaattcacagcctttcctagggccgacacctctgctctgaatcagacctgattcctttattttcctgggctggttttttccaccacccagaaaacttccagatggcttttttctactttcattggctgcgagtgcaaggaatacacatggaatactcaaactggaaagaaacataattgttgaatatgctaaaaatcatgcaatattttttagtgtcaattgtggattatttttgtatgtagacatatgaacagatagttaaaatgcaatgtgatatatgttatattagaaggatgttcagggtactgtgggaaccctgaagagggaataattaattcttcctaagggaaatcaaccttgcttctcaaagctagaacattcaaaccagtttggaaggatgaataggaaggagtttatctgaaaaagagtggggtagcaaggaagagtattttagggagaggaaacaaacactttcacaaacacaagagttatgcaaagatttggtgcatttaggggatagcagaggtatttggcatggcaaggatgtaggatgtgtggcaggtgaagctagagatgagactagaaagagttgaagccagtgtggaaagggccttgagccacaagctaaggattttggcctttggggccatgggaggtacaggatgtgatgaggccttgtctgatctattcagttatttctctttttctcatcatgctaatgagactgtgttactatgactaatgtttgagcatctgctaccagggagttggaagccttatggaaattattttcaacaattagaacagcatttctgacctggggggaaatgaggagggtcttccctgaccagccaagtggaagggagggacagttgcatgatgcccctggatgatgctccctgtgcaaaacatccttttcacgtctgttgacgggcagaaaagtatccaggagattgcagatccagctctgtcattaagtccgtggctctgcggaggctaggggaaggatttttttttttttttttggcagggaggagtggtaggtgaggagaagagcagtagtaaactattgctttgcatgattttgtagatttgatttttccgggatatatcagttaccttttgctgcatcgaaagccactccaaatcttagtggttaaaacaataaccaagctttatttatgattctgcaggctgagagtttgggctggcatactctgggtggttctgctgggctgcgctgggcctgctaatctctgctgtgcacagttggtgggtgtgttggggctccctggcttgttttggcttcaggtggcttacctgagacaactaaggcctcgctgcccatagtttcttatctcccagctatctaacctgttgttgttcgtgtggcagtattcgcgttctgagacggagagcagaatcatataaagccacttgaggtctaggcttcgaacttattcagtatcctttttgctgcattctgatggccaaaacaggtcatgagggcagcctagcttcaaaagagagagaatagactacagttttttttgaagactccacttttaatggataggattgcaagggcatggacacaaggaggggaagaatttgtggccactttttcagtctctcagactatctactttcatca

SEQ ID NO: 27762 - DNA, 1685 bp, Bovine  19866880908707
tttaatctttttttttttcaagtgagtcagctggaatgagagttacaactatttgagaacagccccctggtagacagttaccacctgattttacacatgatttccagtatgttttggcaaagcaacagaatagggatgtggagctattgctgacaacttttctgaacaagtgcctctggacttagctttgcttcttttgaaacactgatttattactccttagctcaagcttcatttctcaggccttgctcctctaatgacactttagaaaggacatcactttactctggaggggtctgcttattgaaattcacctttctttgggaccagagcacagggtttggagtaggaccatccatgtgaccttgagcaagaacacttacccctctgaactccagtttgctcttctgtaaaatgcagataataacactgcctggtcagatgactataaggattgaatgaagtaatgcagataaagtgcttagtgttatgactgtcacaggtaaagcctcaaatcattacattactataaagtgagaccctacttttccccccatctaagactccttcagtagagtctcccataattgcccagaacaatctctcacaacaaacacacctcaagactgaccaccttggaacctcctgcccagattcctcttgcctagaacttcatcagaaacttgggccatagttcagggatcttataaagcagctgaggatctctagcctctcccctccacaaaattatggacaagagtttgttaactgccatcatgggtcaaaccatagggagatgataggggaactgttgagagtggaatgtcgagaaggctcagtgatgccttatatttgcagtcttgccccagctgggggaaccacagtgctttgaagaccacgggtccttcagacccttaaaggacaaccctctctcttctcatcagccctgcctcttccatcccatccctcaactgacatttactaagtgccaggcactactccttgtgttcaggggctcctgatccaggaggcaagggcaataccaagtgtagatctcaaatgagggtggggatcccaggtgttctctggaaggagcctggggagaaaggatgggccagacttgcttatggctgcctttagtgcttttggagctcaagagagttctattagtaaaaatgtcccggctagcaggccactcaccacactggtttcctccatggtcctgggccattgcacaggactctatctggcgttcagatgttcggggagactttttagccacttcaaggttcacgcctgagagctggaggtgcagctgctccctgtgggcagcctttcggagagtgcggatggccttccggagccgcttctctgttcgctttacaatgcaactgagatcacaagacactgcagaaaccagagagtgcggtggagggggagttcaggctgctgtacatatctgctggactatgtctagaccgactgcagggcctaccaacactcacagccccctgcagacagcatggggagagacatggagctgggcacctagcaggctgggcagcatttgattcaaacagaaatttgttggccaaaatggtagctttgagttttgatgaggcagataaaatcatcaggttccaaacaaattcagtgtagtttggggggtaaacaaacaaacaaaa

SEQ ID NO: 27763 - DNA, 898 bp, Bovine  19866880927170
ggagatttctttacggtgtgcagagcgggcagtgaacttcaccatccccaccccattccatcttaggcccccagagctgtgagcaaaaccacagtgataacacaatggccaaaagtatgagcatcctagttcaaaacaagaagaaacttcagagaaaaaacaacctccaaggagggctagtaaagacctctctccccacagaagaaaagacaagtgatcatcttctttatttaaaaaggggatagtaagttagcctcggacaggttcacgaagactggcaatgggaaggctagtggggagcacagggccactcacggatagtcgtgaagacattggtgaagcagaagtaatcgacggcattgaaagagaggaggtgatagaggaactgctccttctcgtcgtcacagcgcaggaaggcgtagcgcttgtagagttttctgtcggagaggaggtaacacatcagtctctcagcccaaagcaggggaaagaggctagaagtattcagttctggagggagatggctaaggaaagaacatgagggcaagcctcaaagttctgtagccacctaaaaaaggaacaaagccagcaactccatctgagggctagagcgaaagtggcttaacctacagaggaacaacacaagccaagctctactcgtgtccgagagctgacgttattataaagtgtcagaggttgtgggacctcgttcctaacctgaaggcttctacagggcatcatcccagtgtgtagtgtgcaagtagcaatggcaggaggtcgtggtcagcattcttactagggctagtctcagaccctcagcaggcctgagaccccagaggtcagaacactgctctgaacatgtcagaggcaaggaatgggaatgatccaggtcacagataag

SEQ ID NO: 27764 - DNA, 1170 bp, Bovine  19866880929817
agagattctttaaaatgtgacatttagaggagatcttggaaattcttttttaaagaatgaagtttcacaaattttggtatcttgtgttttcctttttattcagctcaaaatactttatttccttttttgatttccttttcgaccgctggttttatttagaaatgtgttatttagtgttaaggtattaatgattattgttggtcacaggacttaactgtctgattcaagttatttcagatttattgagacttgttatatggcccagaatttgatatattttttaaagtactgcactttctttttcattcttatccagagaaagcaattgagctgcgattggcaaaaattgatcatactgcggttcatccccatttacttgacatgaagattggacaagggaagtatgaaccaggcttcttccctaagctacagtctgatgtgctttccactgggccagccagcaacaagtgagtcaaccccagagattccctggtgcagctcccaggtcacagtgataatatagtatctggacctagactgtcatttccagaagaccttgacttttataaagcaaatgtggagaagatacaaactgtccaggttgttcacttgtttaaacaaggaaacaggtgacagagcatcatcagctcccgtctccactgtgcaaattgggatagctccatgtatcaggacctgtaaaaggccagactgcagatgggttgaaatcatctgcaaatctcataactggacagcacctagctagcactgtaagtggtggagtagagtaagtagtggttgaaataattggagtctgacctgaaactcagtaacttggcagaattgtttttcctttgttaacttttggagatgagtttatcgaaggccaggcagagatgagtgaaaatagttttggatctgcaagtgaagtttctgtagatgtttcaagagagagaacgtcttggttccctggaaaaatatctctttattgcccagtcactgatctttaacctgcccttatatcaaggtttctgagctacctctgatgacttcttggtagcttaccattggtccctagatgtttaagttttctcctataagttgaccttactttcttagcagaatattcttaattgtctgcttgattctgtcaggggacaaaaagaaatgctc

SEQ ID NO: 27765 - DNA, 1059 bp, Bovine  19866880949878
tgggctccgttgaggaatttacagccacaaaaacagggtaaatagccgtctttgtctcttacctgaagggactaatcatggcaaggacaaagtaaggaaaaaatcctgtctgataagggagatactacacatgcacagaaaggctccttggaatcaaaagtcagaggataatttcaggccataatcagtcttgctcctcccagaagccatcactttcagatccatcttggctatggtatgcgtgcacaccccaagtgagggtcctgagacaaattaaccgggggtgggggtgggccaacaaagcaaggtggctggccgagggaagaagacccggaaaactgcccctttacaaaggatttaaatttcccaaaagctcgactctctgagcttgcccatgagcctttccgcatgtacttttcttttcaataaactttttactttactctttaccttctgcctccttgcctgctttcgttcttgactagacaggtatgactagggaccctagccctaactgttggctcctgttgtccagtggttaggactccccatctgtgaaactaagatctggcttccagccactgctgctgccgcttactgccatgagcgtcagaaaccaaggggatgagaagggccaagaaatggagcagagaagaaggccacaacttcacctctcctatagtttggatcctcccttacccactaaattatcaagaaaagagaaggcaaaaaaggggctaggagatcctggagggagtgaggtgaggatatgaggccggtgagagactctgtaggtccttccttttgagaaagaaggctgccaggagaggcaagttcctacagtgggaagggaatctgttcagggatgagttgagaggagttagttcctaagaggtaagacacctgtgagctgggggcttcctatacgggcttggggaatttcagagggtggtccgtgaggctggtgaagggggacagtagactgtcagagcttaagtgtaaagctcaagttaaaagctcctcagtagtggaaaggctgtaaagtggaggtgggtcctg

SEQ ID NO: 27766 - DNA, 1078 bp, Bovine  19866880956707
cctttgatggaattggagaaggaaatggcaacccattccatatccttgcctgggaaatcccacagacagaggaggctgggcactacagcccatgaggtcgcaaagagttggacacaacttatcaactaagcagcaacattttattgaatattacacagctattaattatgggttttcttgatggaatattatgcagctgttaattatgggttttcaaagaatgtttaatgacattagaaaatgttataataaagatgaaaaaaagagtcacattttgtatatctaatataacctaaactgtgtaaaaaaaaaaaaaaagcataagtagaagaaaaacaaagaaaactcaccatgtccttattagtgggttaaatctaggtggaaggatgttgagtgattttaatttttttgctgaattttccaaattccccaatagtgagcatttatacttttaatcagagggtgaaagcattatttaaagatagatttggtctttagtttatttaatgatattatactaatgttaatttcttagttttgataaagatacatgtaaatataagatgttaatattagagaacactggatgaagagtatgtgagaactctgaataccctctcagaaactttcctatacatctaagcttacttcaaaataaaaaaaattttttaaatagatatgagaaaatagaaagtgaaagaggttcaaaatgaacatctatccagtttgagatttgaagtgagccttttgagagctaagatggatctttagggaaaaattaattgccttctccttcctttgaccctgatgccctgctgatttgaacatccttataatgttaagagaagaatatgatacagataattcatcagttcagttgagattagttcattgtatggatagtatgtggatctgctctttggttctggttaacaatcattagtcaaaagattcactggaagtcatggaatgaggagtgagggtcagaaacgagcatgtccaaagccttacataacaccttcactcccgtcctgtgtgccttcatgactgtttggatctgttgatctttgtgccattt

SEQ ID NO: 27767 - DNA, 1806 bp, Bovine  19866881014759
cgtctggtgcccacaaaaatcggctttgtggccaacaagtgatatggacccaaagggacgtacttaaaaactacattatcagggacttggaaaagagattaaaatctaatggagggattttgcttcaatttttgctttgaaaacagactaagttccaatttagagtgattctacagattaaaaaatttttagtttagttcaaagttttaaaaactccttatgtttggtcttactttggaattcagcaaataagcaccgacctccccatctaaaaatagtgagggcagaacttttctgccttgttcattgctgtaatctcctaacagctaaagctgctgctgctgcgtcacttcagtcgtgtccgactctgtgcgaccccatagacggcagcccaccaggctcccccgtccctgggattctccaggcaagaacactggagtgagttgccatttccttctccaatgcatgaaagtgaaaagtaaaagtttagtcgctcagtcgtgtctgactcttagcgaccccatggactgcagcctaccaggatcctccatccatgggattttccaggcaagagtactggagtggggtgccattgccttctccgacagctaaagctaggcggtctgtatttgttgaatgaactgtaacctggatttatcacctgttgtaaacccttggctaattacaacctgcccacgaaggcaggaccgggtgagcagatagtgtgcagattcttcctaaattccacaaaaatccactttgtgatccatcagcaggcagatcaggagcatgctttggcttacaccaacttaccccacactgacttgaagtatagttcatgtattcagccattgttctgaaggaagcactgagggtcgggtgtctgtcttctctctatttgaataaacggcaaatcacaggtgagatctgtattccctactggagaaggaagtcattttggaaataccttcctttttactttttgaaaggcctctgcaagtttaaattagtaaaatgatcttattgagaaagaattccatctctaaaaggaatacacagacatgcaatttttccaggacaaacgtttgttggctttcctcgagtatcagatgatagcctctaagaattgcgttaaaaagtaaccaatcagggccgagcacgagcggtacctagcggtgtcctaaagctacccagtaagaatctgtcaaatgtcaagttttcaagactttccggttcactgtccggatacacagcagcttccgccaagcacaggatccctcgggtcccggtgtgtggcgtgccctggttctcagcaagccgctgctgagggaatgaatgggctggtccacagcagaggccctcctcacctttcctggcagaaggcgctgggggctggctgccggccctctttctccatagtgccgcacccgggaaacgatccccacgctgcctttgggaagctccaccgaaggccagtccaccgccctcctcttggcccgctccagcacttcctgacccagcctagccgaacgctgcagggaacgtcggtccaccccgttcagcgccgcggccaccaaacagttctccatgtctccctgagagggaacatacacacaaacacgggcgagtcagcggagcgccggaccccgctccatttcggtcggacccagagcctcaacctccctgccgaccactgcccccggctagcccaacgcgctctccagccggcgcccagtcagggcctaaggcgtgcgctctcagcccctccatttccgtggccccctcccctcgctagagagccctcac

SEQ ID NO: 27768 - DNA, 1939 bp, Bovine  19866881070281
cctcccagtacctggaggacaattctccatggtattctacatttccaacctgagcaagagaaattaatcattcttttcaaagatgtttatagagcaaacagccttgggggatagagtctccctctaggacagaggcagatctgtttcctgaccagaataataaggattatgtctgcttacggggcaaaggttgaacaggtttgccagcagccccttgaaaagcttggggtttcctaagcttgaggttcctcggctggacataatagacccacgatgtgtacagcctctacctggacctcctccacactgccccatggggctgcggagcaaggggaacctatgtgaacagcaagctcatgtggcccgttgtgcatgagtagtaaagtcctctgtgatccaagctcctctgtcttctgccagtatctgtggacccgagcaggctagtgctaacttgcaaacagagtgaaatctcagacacttcacacttactttaagggaagagtaggagagatacatattaaggaccaggtatcatgctagatactttgatatatattttatctcatttaatcctaacagtaatcttgcatattactactattattgttgttaccataaaactatcatcaccatttctgtcaaacatcaacatgaatcagccataggcatacctatgtcccctccctcgtgacctccctcccccctccccaagtatttcggccagtgtcaattgtatgtttccatcatttgctagttagtgactcttcttttttaaatataaacttaataggtattaaaaattttttaaatcatcatttcataagagaaaaggtcgcaaaaaagttaaaagtgatttgcctgaggatacacagctacgaaagggcacctattggactccagagactttcaaaaataaagggacagtgtggttccccctttttgtggtcccaggagccctttgggttccaattcattcaaagcccggctttaatctctcagctgcccagtctttggtaagcctctttctctgatgccctttccttgagaagttccagaagttgggccacaactgcccagagagaatgaagtggagcgccggagcgccggtcctgcagcaccacagatgagccagcccaccgctcggcccctgctcacccacgatgtcttcataggcattctcttctaaagtgcttttggatccaaacttgggttggctctcagtaccgttctcagtgggagaagaggggtacagggactggagactggatgcatcctcaaactcaaaggattttctgtggatgacaaagagtatgagtcattctggctgaaccacacccttgctgccctggaagggaatggccaagggcaacagccaagactggaggtcctcctcgctaaaccagccactgagcaaagcatcaagatggatccaaacttaccatccaaatgaagagataaatggtccaaaaggccccagcctgggtgcctgcaactaataccagtaggaagtcatgtgtcagacgctgtgtctgatgctctacacatgttcgcccattcgtcttcagcttgctgctgctaggtatcgtgccactttaagatggactagcccatggaggagcctggaaggctgcagtccatggggtcgctgagggtcggacatgactgagcgatttcactttcacgcattggagaaggaaatggcaactgactccagtgttcttgcctggagaatcccagggatggggcatcctggtgggctgccgtctatggggtcgcacagagtcagacacgactgaagtgactcagcagcagcctgaggctcaaggagataaagtgacagaggtaagactcgcacaggctgtcagacggcagggtctgaggttttgacctgggcctccaagccctggagaatataatttttgagaagcaactgccatga

SEQ ID NO: 27769 - DNA, 1070 bp, Bovine  19866881074968
tgctcttaggttaaaagaccctttaataaaacaaggaaaaaagtcctaccagcttctccagctacccctggggcaccaagcacctgtctctcttcagcctttcagtcagtgccctccatcaaatcagtgcaccttagctggactttctgatttgaatacacacaatgggcttcccaggtggctctaacggtaaagaaccctcctgcagaggcaggagccatagagacactggttccatccctgggttgggaagattccctggaataggaaatggaaaccacttcagtgagaatcccatggacagaggagcctggcaggctatagtctatagggtagcaaagagtcggacacaactgaagtgacttagcacagcacagcacatataaatataaacaccacaaagaaatgaaaaaaaaaaagaaagttaaaaaaaatcaactgagatttcaccactgagaaataactgttaacattctgggagctttaaaacatccatctcttgaggctttttcctttctcttgctctcaacaaatatgattttatgtaaatgtcataaatgcattttagtaacctacggctttgccaaaacagtgtataacggacattttccatggcagtaactacagatttatgtccctgtgtcactgcccagcagaactgtttgcaccataagaagccctccctcccccgtggaccccaggtggttgtgactttggctgtgaccatcagcactgtgaaggtgctcatttgtgtgatcagctcctttccatcaattcccagatatggaatggaaggtggaagggcatgtatatttcatgtctcgatcagactgcccgacatcttggggtggctggggccctcccttggggcctaaaatgaatgggaagctgctgttaaacagggaatcaagacctaggctccttgagggcaggggccagtctcccatccaaggggaggctgggcttcggaactgggaggggttaattaaagagggctttgagaaatctataaacaccagaaatgactggacaggtgctaatttctttttttagtattcacaatcgctttt

SEQ ID NO: 27770 - DNA, 1069 bp, Bovine  19866881112872
cctgaggctctattcattttttttttctattttctttctctctgttgtacagattaggtgatttctactattgtaattttcaactttttgatttttcttctgtccttttctttctgctgttgaaccatctactgagttttttttttttattgatgttatatattggttatagaatttcaatttgttttttcttcatatcttctgtttcttttctatgactttctatttttcatttggttcaaacatgtccatatgctcactgaagcattttttaagatggctgctttaaaatccatgtcagataattccaacatttgtgtcatattggttgattttcttttctcatttgatttgagatcttttctgttcttggtatcaaatgattttcagttgaaacttggacttgtgatgttataagactttatcttatttaaatagcttattttagaagaattttttttgtttgttttgttaataatatggagactagaggctcttagcaggcaaaaacaaaagctgttagtcctcttagagtctaaagccattatttgtacaatgtcactccgccacgttttgttggcaaacaagctgtgatgtcaggttcaaggggagggaaaatcaaactccatctctagatgagaggggtggcaaaatcacattccaaaagtgcatgcaggagggaggagtggttgtggccatctctgaaaatgatttgccacattcatagctattttgccttatgaaattatgatttactcttgtttcatcaattatttttttctgtgtgtatttccttgttttctgtattagaacaatgctccctttacagttgatccttgaacaacacacatctgtacccacgtgtgggtacacttacatgcaaatttttatactacacagtctgccattggtttaatccctggatgtggaactatggatatagagggctgaatatagttattcatggatttttgactgcttgagggggtgggtttggtatccctaacctctgtgttgttcaagggtcaactgtagtaaaaagaaacacatatcaaaaaccaccaaaaaa

SEQ ID NO: 27771 - DNA, 1554 bp, Bovine  19866881115178
gaggaggagggggttgacggtgagttgtcctgccccagagcacctgcacacacgcactcaagagatgtcctttacctgccccagctcagggccaagtgaagagcttggtggatggctctgtgtgttaaacagaaagaagggaaaggagaggcagccctggaagctttcccaggccagttctcggggtcctcagggaactcagtgcaataaggaatcaactcaggaagcataagctttcaactgtgcccatggtaacgacggtcacaataaccatcagaacccatcataacagcactggaagtgctctaccagcttcagggcaggccctcagggggaggacagaaggtttgtgggaagaacagaaactacaatacattaaaagaacatgattaaaaatatattctttccttccctgaatttctgatctaagaagggtggacccactgctctgaaaagctataacaggagaaccaagagccaactagaaaaaaggtaaaatgtagataactgtggtatttgctggagccaaaaagaaaaattctatgaagatgcaaccaagaaaggagtggatcacaactgccaccaggcccgtggcagtgccccttggtcacatacctgcagaagcacagctgctgttcccagcagtggcccaggaggtgaggcattgtgggcaggtaccgctgagagaaaacccggagagcccactcagtcagaggtgcctgctcacggtgctcccgccacctgctctctccagccaagtctctcagactcagggaataatccagcggcttgagaagctgaggaccaggctaaccctttacatgtgaaacatagacttgaacagtctgcgtggctggcttcctggggccttctcccaaggccctgagagccaccccagactcccatcgacgctctctgcctgactcttttggctggtctggctacaaggagaggagacactcccaagcaaacgaaacgcccactgggaataagagcagagaagccagggggatgagaggctgtctcactaaaattcagccaaaaactacgtttggaaaatgaaattgttcaggtaggatcaaccaccaatcacgaattgctcaaaaacccagctctgacaagttatagacaactatctgaagagttacaacccaaagacaggaatacaacaaggcaccactagaacctttctacaatctctgccctgagacagaaatcacagttctgggatctcaaggtgtagtgggaagaacacctgacttggagtctagctaatgctagtcaagggtcattgcacacctcagttttgaagactcaactttctcaccataagagcaataataataacatgacctactcatataattgtaattcagacaaactgaagcttgataaatcactttttcttccagatcatgcttctctgggtacttggaagtcgctttctccattcccaagctagattcatcatttttcagactccccgatactgccattcatcccagtgactctacgccaggcactgtgcgaggtactaggatataaaaatggggg

SEQ ID NO: 27772 - DNA, 1289 bp, Bovine  19866881214971
ttttgattatagccatctctgtaggtgtgaggtgatacctcattatactttgggtttgcatttcccttatgactaatgatgttggacatcattggctatttgtatatcttctttggagaagtagctatttaactcctttgtttatttttaaattttgaattgtttttttttttattcttgagttgtaatagttctttatatattctgaatattagacccttatcagatgtatgatttacaaacttttcctcccattctgtatgttgtctttttcttgttgcctggtagcgtcttttgaggaacaaaaggttttaattttatgaaattcaatatatatgtttttactttgattgcttggctttagtggagaagggaatggcaactcactccagtattcttgcctggagaatcccatggacagaggagcctggtgggctacagtccatggatcacaaagagtcggacacaactgagtgactaacacttgcttggctttagatgtcatgtgtaaaaaattgttgcctgattcatggtcgtgacgatttacttgtatttttttttcctaagagttttgtggttttagctcttgtatttaggcctttgatccattttgagttaatttttatatatgtgtagagtaagtgtccagattcatccttttgcatgaggatagcctgttgtcccaagaccatctgttgtaggcctcacattatttgtttaagtcaacttgtaagtcctgttgttttgatgaaacatttggctgataccttgtcacttcaattagatgccaccatcctacacagaagacattccagacaaaggaacatctgtattgctaattagtactttggttaccatctctatgtaggcttacaacctggtgagtaggtttgcaggggatgcaagaagcttcagggctgcttccccttctaatttaaggcctttcatgtgacccgtggtgttgcctccttgccgtctttcctctgaattataacttgattgccccttgacctagagaacaggaaaagtaaaagaggcattgcttttctctaagctggagagaccctaaaatcatccttccagactcatgggaggaacgtgggaagagttgtgaacctttcaacaaagaaaaggggatgttttcaagggaaggcagagctctttcgtttcttcatgcttcccattgaaagctccaccttctggaatcataacccagatgagccttggcttgtttcagaactctttttcctggagggaggatagggaagggagactggttcctcccaggg

SEQ ID NO: 27773 - DNA, 1375 bp, Bovine  19866881253067
atgggtgattcatgtgtatgtcataaaccagcacaatattgtaaagcaattatccccaattaaaaatgagtcaatttttaattagttagaaaataggaactggattaaactattgggttggacaaaaagttcattgggtttttaggaaaaactcaaataatttgtccagttacttgagaaatgtgtgaatttttcaatgagcatattatttaaaaactgaccccaatttattaatgaaagaataagaagcttttcatctctccttttccatggcgggtttttccctagtttccagtttcttgactcacttgttcagttgctcagttgtgtccaactctttgtgatcccatggacttccgccttgactcagtagtataatatgacttacatttcctttatcttgctgaagcaaggtaactcagtagctattgtccaagtagattttcatttcacccagacctatagttttatacaaagtaaatttcctaacttcagagaacttcacaactattctcaataagaaactctttaggcaatcccaggaataaaccccatgaaagaaattctgctctattactaaatagccttattcacaaatttcagcactgtagatatgctccatgcatatctttctatcattgtatattttgaaatatatatatataatgaaaaatcttaatgaaatatatttttcaagggtaataattagattttttggcattatctttggattctggcactattcatttatctagtatcttactgtattgttcttcatcctgtttgtgacgccagttgtcttgcttttcacactgttcacaatatttggtgaacccagggtaggcaaggcgtgagctaagaggctggaagaagacaggaggagtcataggaactgcagacacatttattcttttctggctggcacagcagccacagaagcagatatagcacaatacaacataatggcacacaacctctctcctggctgacacagcagccataacagtagagctgtgttctctcctctcgtggctgacccaatggacacagccatgaggcagcagtaatgccaccactttttatgtggcactcacatatccctgcagcacaaagtagctcgtgagcaggggagtacctcatgacacacaggggcagtactgtaagtgatctcagctgttacataaaccttgtgatgtgcatgagctgtgctataaatgatctcagctgttacatggttattatttacaaaacttggggtaagagagcctgaacacgccatcttggctaatttgctctctccccatgcttgctcttatttttaaactatgttttgtcctctgtaacagtgtaggattcccttagaggcctccaatta

SEQ ID NO: 27774 - DNA, 2398 bp, Bovine  19866881337811
tgtgggtttttctttagtgctccccagtacactttgagatttctgtgtatgatgggagacagtcttttttaacttgatgaggctgttcagaacccaaatgtctcaaatttatggaaggacgaggcagaaagaaaaaatgttttaattttacccacaggtgtaaattactaaattgttttaaatcatcagtaacttgagaagagcttctttatatctgaaaacaaagattagaagccagtaatatgtcagacaaaaagtcatgaaaattctaaccatattaagcagtctaatctcatgcaaccaatccctttgttttgccagccctgcctgacaaccgaggatgccagtgaaagcaatagtctctaagaagctcgtgaagctctttgccaatgtctgtatgacctgtccagcaaagtgggtgccccaatcactggagatctcagaaaacacattttaaccatgttttctccattgtgagatattaaccctacagccaggaaaggctttatcctattaaataaaagtgaagtctgtcagggagccaggaaaagccaagcggctatcttggatttcccatagccccaactatttggtttatagccactgtttatccatttaaaattccctgatggtttaattttgtagaagcagagtgagctttgtctatgtgtgccacagtctattatcaaaagccatgtttcaagaaggaaatggcaacccactccagtgttcttgcctggagaatcccagggacgggggagcctggtgggctgccgtctctggggtcgggcacgactgaagcgacttagcagcagcagcagcagcagtgtgtccctggtagctcagctggtaaagaatccacctgcaatgcaggagaccctggttcaattcctgggtcaggaaaatccctggagaagggtatggcaacccactccagtattcttgcctggagaatcctcatggacagaggagcctggtggcctatagtccactgggtcacaaagagtcaggcacaactgagctaccgagcaaagtgcttctatacctttccccagcctagcaccaggccagaccaactgtccttctacatacgatgcattctattagttctcctctgcccagatcttcattttgaagggaacttagctcattcctcttaaggggaattttcaaattatttttgtcatttatttttatgtaacacacttgggccagaccatgtctgtgttttgttttccaactgcttacctctttaatatctggggatctgtggcctcggtttctccatctgctttcatagctgtgaaaatagtcactcttctgtttcggaggcattttcagtggtgataggcctattccaagacattgataatcactctgacacctcctgtgcaccacagcatggacgcgtgggcttcattacaacccacagggacatactctgcccaggacagtgcagagcaggtgtgatttccaaggaatgcaaatgccaatcagcactctgacttgaatgacagacaagtcaagacatgagaaatatgataaaaaataaatgcaggctgggggcctggggaggagttcggcggaggagaacaagatgatgtcagagagggacttagaaaagaaaggaaaatgggttgggatcaggggagcaaaaaagagaacaaagtgcaattaataaagaatactgactagataacaacacgtggatctgccagacccagaagcaggagtcagaggatggaagtgctcgtagggtcgttaacgtggtccttgttctaggccggtctgcagtaggaccagcccctctcgtggcctgaacaccagcacactaagatgaggacacagactgaagaaacaaagaccttggggagactgaagctgagagaggctctggttgtaagaggtggccgcagaatggtccttacattttgaataggagtgctctgtggtgttggggggtggggaggagaaaaaatacaaaacattttgtgcttatcactgaaatgctttgtttaaataattctatttgactccaaaatgtaagttccaggttagaaagatcaaaagcagtcagtcttgaaaatgaagctttttaaattccagtgctgctgttggaatagagaataaaaggctttgttcaaacatgcattcccagcagtgagcagagctttgaaattggtcagggaagttgtgttccgtaatggctgcgcttgcctggagaccaaagagctgtggactctgggaaatgactctgggctggatattttccatctgccccttcagaaccactctgccctccccacccaaaagaggtgatctttcaggattgcattaataggttctcttggcatctgggttcattgggattctgtcagtggggaataccagcaaccac

SEQ ID NO: 27775 - DNA, 1076 bp, Bovine  19866881354267
tactgggtgtggctcggatctgtgttctgcctcgctccatctagactgacatccttcgccacagggcaccttactcagtggaatcactgcttgctaaaaagggagcagctctgcacacctggcatgccttccacctgccacctgcatctggcatcgccgctcatcactcttcagcaagtcctccttcctttccctcccccaacttcctcttcctacccaatcggtcggaaaacacacattcagtggacgtttatttgaacagagcacattagaaaggtaaaccttttataaaaacaatcaagtcactccaaggccagaagaaataatttttatattctctggccagtgttctaaaatctctaggagaatcagcattgctttggtaggttcaagataggatctccatcctccagcctcctgtccatcgtggacaaagccagaacaagctacagcctcagagctcctttgcctcttcacctttctccccattctgcctccatcagtccattgctcagagattcatccactcagccatttatccaatgggagcacttccaggtcctggagatatctatgtggctctccaaatccagttactgggcctatccctggcccctaaatgccagggctaagatcagttctgcagaattttaagacaccaacccaggccctgtcttcctgcttccaggaaggggaggagaaatcttgattagacaggagactacaggagctcctaccttagtttcacagcttagagctccagcagtaaagggaagaaggtgggactgggtggcccctaagagcacgtctcgactgtccacaaaggatgtcaacatggcagaggtccctgaacacagagctcctccctgacgtcacctctgccaagcactagtgagggaaaaagcctgagcagaagctggccctggcctcaagctgaccctacaggcgcgcttcagggctgccattacctgagtgggtggggtttgttgtacttcctgtcctgaggactccacatcctgtgcaaagagtccaaggagttctcagacagctgctggggttttcgtcctgctcttcgg

SEQ ID NO: 27776 - DNA, 1332 bp, Bovine  19866881383856
cctggtgcacataccctgagtttaatataaatttcagtttgtacagcaagataatattgctggggataaagtagcacagatagagtagtgtttcacagaaatcaattttccagatatctgaaacatacctctttcaataacaaaatgcaattgactttaaaatattattttgaaggatagtacttctaaaatgctttgcacactaccctgtcttactaaacagagtacctgaggccaaatgagaccatttcttagtgatgtaaaagaattctgatgaacctctattgctggggtattctgtagttcatcggtgctttagggaacttctaagaatgtagtagggtttagctagtcctttccgtgaatgacatcacatcatggcacttttccaggtggtttcttgtcttctctcctgttgttagctgccattatagaagtcctaattccctgcttctactctgcttactgctatatatagaaaaactaaaaatttccaaagaaaaccatataactaagcttgctagatcaagttgactaaattgggcttatagtctcatacagagtataatgtgtgaggtttgtgacaactattcttgctgctgttttgaagctttgcttgcttacttctggtttcaggttttgatcctaggagttaaatttgtcaaagactgaccaccacgtacaggtacagtaggagaagagaccaacgacttgtgagttgtcttttggaaacacattgaaggccttcaccttggctgaaggaaataggtaaggagacaaggatgcatgtaaatagatttgtgaactaaatctttggaatatttgagtgtttcaacagcttcagattaagtagactgctttaacagcggtagatcttgacacaactgaatcagatagctgagtggggaactaacttttcctgccagtggtttcacaagttgatttttaataggaaagttgctcttgctgatagtaagtgtcctgccagcttaatgaaaaattcttttatgaagtaaggttgttgctacagatgtaactttgttgatatccgctaaccaatgggtgtcaaatgggaaaacaattatggatggtgaagagagaagaactgaagagtacccagtgccctgatgatccaagaagatggaaaaaaacaaataaacaaaacaaagaggatcagggtctgaggctgaaggaagagcaaaggaaaaagcggagtccagtgaatcagaagtgaaggctagaatgagtggaacctttaaaacccaaattttggagatgggaagaactaggccagaggtatttttcttgggcgggttaaggaaatttaaaggt

SEQ ID NO: 27777 - DNA, 1237 bp, Bovine  19866881400508
aaatacttctgcatcatttgctgacaatatatcccagactccaatgaagccgtaagctgtaacttggtggcctcaaagtcctctgaagatctggggccccactatgagcagaacagaggcccctcttgcaggtgaactggggttcagctagagctctctgtgatacctacagccttgattccatgagggctgacaaaaggagtgtgtgtctttttcagcagtcgactagttcagaagtatgaaatgaagccactgaaatgtcttccagtttcccttggtatttaaagggttctgttataaagttgtctttcttcatcaccttttttcaaagtggctgaaccaagattagaaatcttagacaacagcagctgacagacaaatgtccaagttcacacaaaaacattctgctggcggcacggaaggtggtgggataaaatgctccagagactgcagaacccattctagaactttcacatctcatgtgcagcagcaatctgttttcaccatcagctcatttaggaccatctcccaggtacgtgtgcacagctgctcggctgtaacaaaagtcctccttgtagtgacacgaagcggctccgagcaggagtgggtctctgtggaacacacagagctgtgcccgctgccaccgtttcctctcgtctgtgcactcagatggacttcagacttcccctggcgcttgccagccagtacagaccgagaagtgggctgggggctaagtgccgttaccaaataaagattagtcaagacccaactaggatgggtcctaagacttctccccagcaaggcctcaggctacttcagggagtatgaagataggaaaatccagcagcgagtactgctcccactgcagtgcacagagaggcaatttaacctagtcattgaacccagggctgaggcaggaactgtgctctgggcctaaccctgccaatagttagctgtttaacttttaggcggtcacttaatctctctgtgtctcagtttccacatctttcaaaggggaataagaaagtggcttcctcatagtattgctaggataaacaaagaaataaaatagaaaaatacatataaaaatctatggaaaaaaaagtataaaatgctatacaaagtattataaatcaatgataagatgcttagaatgttgttgggtaaacttgaccttcatatcccacaccgtgcccagtcccagattcaagacaatgaattccctcaaaaagaaagc

SEQ ID NO: 27778 - DNA, 1625 bp, Bovine  19866881410553
gcaaaaaatcttattacagtgaataaaaaaattctatcaaacaagctgctgtttccctaataaaagggttgcctacaggcaaccaatattgttttatttcagtaacaaactaactccacacacaatcagctctctacaccaaagtaccaaaaaaatgatcaacaaatgtttctgaagaaaacgaagattatttcattgttgaattcactttttacctctgtgatttttttatatataagcaatattgacttttttaaagcccttcatcaaagttttttaatttacttgaatggtcctaaatacccttctaagtctctcatgaaaaacgtgaacatcttcatttttaaaggtatcattaatacaagtccttgtaatttataatgccggaacttggcctacatttctgagtctgactataacatgaaaattcagatgtaacataacatgagttagtgacctgaccgatggggtgagctgaactgcaccattctgtccaagcatgttagtaactatatgctcaggactgtctggttctgtactgctgatttcataagaaggcagctgatggcagtacctgggggttggagggatgctgcataaacctggtctctgtgaaacatcctccaggagccggaccatgcacaagccactgaggccctcgtgaaacttcctgtctgtacccatcaaccattctgagagactctgtggtcccgttggaaggctggtgggcaggggctactgatactatctgctaaatcaataaatagttaactaatatcacctctttgccgtagggttgcacagtgacaagacagacaaggtcttgtcattttagagcttactattttagagggaggagacagagaatgaacaaatcaacaggaaaagtatcagctaggagtaagtgctgttgaaaattaaaataggttaatataacggatgatggtgtggctgttttaggtttgggaatcgtgaggatccttctgggtaaatgatttttcaactgaaaaaaaaaatggcaagaaagaatcagccttgggccaatcagggggaggaacattccagagagaggaaagtcaggtgcaaaggctatccaggcaggaaaaagcatgtgtgtggatcacagactagtgagaagtcgagtggtatgagatgaggccaagaaaccagatagggccagagcacactgggctttggaatccagaatgaggggtgtgggcttaattctaaatatgctgtgaaacttttggaaggggtttaaacagaaaagcggggtgatctgatttatgtttttaaaagagagctctggttactatatgaagaataggttttagaaagtaggcacggaggcagagagcagttaacaaattattgccaccaaccaagcagccatccagcgagaggtaaggctctctgggctaagacagtcgtagtggagaggacagaacagaatgattgtggacatgttttgggagagagtccccagaacttcctgatgattggatggaagttaaagggaaagacagcaactagttgcccaaataactggtagatgaagattgcagaaggagcaggtttgggacatgtgacaattcaaaaacctgtctacaaattctctgatgctt

SEQ ID NO: 27779 - DNA, 901 bp, Bovine  19866881485305
ttggaggaaagggccccattattgggatcttattagacctgaatcctactctgcagaaaacctggaaaagttattatcagaactttacctggcaagaaaccaaaaatcatgtcatcatcctcagacttctttcagcccctcagacttggcctgattgaatttgttggtcttggaggcccaagggacacgactgcttcggagcttagataggttggtttccatgaggcgcctctgcagaatgttatgaggttgcttggggaacagaaagcagaggcttcttagtgacaggccatgttccccctcccctattgtctcccaggtgccatggaaataatgaaggagcctcacataactgagctccacctttgcctcttatttattcttccctcaagtacggatttcatgagtattatcagagcaggaactatcagaacagtagttcctcaaatgaaaaagcaatatgggattctgggaaatgtgaacaaggccagtattccatggctaaagaaaagtaagagactcttgtgatttgtactacctgggcttgctgccttcccttcccttacaaggacatttcaggagaaaagtggctttagtctatgtgggataaatgtatctttccagagaacttataagtaagggcagctaattctcacaggccaaagaaaccttcttagcactggttttcaggagttctgtatacttctatttcaagtctcacttcctcacagtctttatcttttggactcaaatgcatatgccttagtgacttggctctctcctgttggttgagtcatccaatggggtggatgaggtgggaagacaagttatacctgctgaataaccctcttaggagatacacattagaaccggcagaagccatagaatcatccttaccatt

SEQ ID NO: 27780 - DNA, 924 bp, Bovine  19866881542933
tgataagaataaggaaaatactctgagaatagagtaagtacatatacataatggagtaaataggctgctcctgagtccatatgcttacttttatttttaaaagtctgataaaaatttactcaattacattttatacagtaatatttagtaagctttgtccaaaaaggctatgttttaagtttgcttgtaaaaataacgaaagctttatcagtctctggtcaataagaaaggaagaaaaccttgctagaaataacaataaataatttcacacaaaaggccaggtgacataagaatagtatattaatgaatatattttcttcgtatttacaataagtccatttgttaatactgtaatagaaaaaataatcagtccacattatacagtagaaacaggctttgaggctgatcatacctgtcacaataaaaacatacaaggatttcttccacagctaaagtacttttcaacatgacagtcttgggtgaaggcaaaactgaccgagtatttcacgtcttagaatcgaggaatcgagggtgttaccattaagcaagcagcaaaaagctgtttgggttttccaggactatttaaatatagtagttaccatatgagaatttaattttactttgagatataaaaagtaaaaaccctcaatagggaaactgcattaatcaaaagcagccccaaacaataaagccatcaatagagaaatgaaacaaggcattcttatgtatcatgcataaaaaggataattacatcatacatactttaatgaccagattaataaataaatgtgataaatgttacagtcattggaacaaataaactatgttcaactacttaagtgttatgctgccactgcttctgtttcaaaatattaagtaatataactaatctaacatctaaaaactgcatactttggaatgttt

SEQ ID NO: 27781 - DNA, 973 bp, Bovine  19866881628577
gccctgcctgaaatggattgtgcctgtagaagctgaccttctctacagttgtaattaagtcggttctaattaagcttactcaattataaccttctactagcctagggaagaaacgcttccttttgatcaatatgaatcataagcaaatctggagttgctcaggaggcatggagggggagaactgcctttactcccccaggtgagctgcatggagaggcacaggctacctttacaggtctttccatccatctggagcgtgaagccgacgggacaactgcaatgaacccctgttgaagtatccttgcaggtgcggtcacagcctccattgttgacagcacacgtttctgccaaggaggtaagaaagaggcagttagcttcgtagagaagtgctgacacagctgggaggaaagggacatccgtgcagtggtaatacttgacaaaaattcatgaacatcagggagtgtgtggggtactcacagccataccccaagtctctgccacccacaggtgagttagaggaagagcaagtgcagctcttccccatcccctctctgcataagtgacatcgggacttccctagtggtccagtggctaagactctgcactcccaatgcaggggacccaggttcagtccctggttggggaactagatccccgcatgcttcagctaaagatcacacgtgctgcaactaaaagacctcacatgccacagccgagatccagagcagccaaataaataagtgacatctccccaggaaacctgacaggatgccagggagacagacgcccttgccaacctgctttcctctctactggcagatgtgaaaacactaaaagttcctggcaggtgtgaagacactaaagatgtgaagacactaaagaaccaaatgttctttagtgaagacactaaagaggctgagtatgacaacctcttccagcaggctagatgtgaatgcagaacagagccaagggg

SEQ ID NO: 27782 - DNA, 632 bp, Bovine  19866881641069
gacccatgcgtctatgcttgactggaatgattgttttaatacaaacagatgtcatttctattccaaaagagagggcaacagctaatacatctcacattctcttaaaaccttcttgttttttatctgacagttatgagctgtttgagctccagcactcaatctgctggaggtggttgggatccattcatccgtgccaaggcctgctgtcaattaacacagaaagaagcttgcactgggtcaggggggagctctctcttggcttgggccggtgatttctgaagacattattttctcccagtactaagatggcacaggaggtgggagatgcctccaggaagcatcctgtcctccaaagaaggcccacccagcatgacagttgttcttggatcagcagggcatttacactaacaggctccaggagcatctagtggtaaatgtaaagtgcccaagaaaaggcagcagtagaaacatcattttccttccctccgggagactatcctcaatatctcatgccggctgcttcccaatgtttctgatgctgggccgcacaagatggttcccagggtcgggagtagggggaaagtacccccaaagcacattcccatacaaatcagctgcttcttcctcttttt

SEQ ID NO: 27783 - DNA, 1552 bp, Bovine  19866880584041
ggaggcataatttactgggcagacacaaacagcagaatccattctacctatttttttttctcctgaaaatctagcaattgagcctcataaagttgttggaataattaaaataagtgactgcaaattatctcactcagtaggtagcacagagtaggtgttcaaaaagtccattctctttcctttctttaaaaatgaaatgcaaaaaaaaaaaaaaaagaaaaagaaatgcattgtttcatgctttcctgtctctttaaacaggaagcagaaggcttttgatgaggtgccaactcatgtttatagctttgtcaagatcaatcagtcctgtggcttacactgaatgataggtgtgtatttttaaaggaaaagtgtttatgcaagcacagattgaaatttctagagaagtctagagagatttcttggagaagatcactcatgctgctatagctgacttaactggtcctcttcatcaccacatcatggcccaagaaggattcaccttgaactctaactgagagggagcttaagttcccatgataggaatgatactacgattggaaagaaaatattcaggagtcatatctgacccaaacaaaagtcatgcaagacacaggggcttccctgaggccttgacaaacaaaagttgtgatgaaggatcacatagtcatttgttctttcaacaagccaagaaggaatttgtcctggaaacacatcttgcttcatctacataaacatcaccagtcaagtagaacagtctgtgactaagataaaagaaaaagcatctgactgtctagaacagccctagctggactttaagacattttcttaagacctgggcttggtaatcaaagcttctggctttaggatctcctgcaagaactaacaacccattctgcttctggtcctcccctgtgttatgattggccaatgcctcttttacagagactttataggaacccactaattcccctcccttggacaataatattatacccagaaagatagatcaggaggggaaccctatggcttgagggattctcagagagcctgactaattaggaggcagtaaatagaggaaagctgaggatataagttaaagcagctcaataatccagactctgcacactcaatctagtttccacctgccgacccccatctttggacactgaaaatcacgacccaaatgccctccgtctcactgagaatgaacatgtctctgcaaacatttttgtcagttcctctctgtgctaatcttcctgcctgtcacgcctaggtagcaagtcattgcaaagttatgatctgtaagtccagaaatgtataatgcagtttgagcaaagaaaatactgaaaactatttgctacttactgggcaggattatggtgtgcagaaggaatttgaaatatttagatgtctcagaattacaggtggagattcatcaaggtcacggtggcttttcttttcccagaattaagcaaagcaagccatagaatttcaccgggcggcagcttctttgacaggatattaaaatcactagctctgtagtctccactgc

SEQ ID NO: 27784 - DNA, 2441 bp, Bovine  19866881168135
tttactggataggatcagtccatgtgccctcatcacattgacggaaagctgaaagtggttgcccttacactcaagcacagaagactgatgcagtgtgtgatgaacatacgggcatcgtccttgccacatcgttccaacatttttctagacttatggtgcctcctggtttctttgaacatgcccagggcttactgtgctttttatccacttggcatgttccctgagaactcccacaagatacttttggtgggttaatctgcttcttgaaatgcttagtcatcctgtaagacccctgctccagcactacccaccctgaaaccttccctcaccctcttggaaaaattgttcattctaatttttgacacaatctgttagaccatgtaacctatggtgtttgtattatttctatcttgtcgtacatgtccttcttatcagtttagctgttttggggtgagtaagcagagataattttttgtcctatccttatttatttctccaatttttaaagttctgcacttgcagaatctctcaaaataataatgcttaatcattgttgagtgagctgaatgtttaccagaaattttaaaaaatgagaatatatttcatttttaaacaatctattcattcccttctttaggaatagttcaactggatcctaattcccatcatccatacatattggaagtgcctaattctctatagaacaagaaaacattatggtcattttcccacttgagcaatatctcacactaacagttattaatggagtgagatagggaaactcaattaggataagaaggagatgatatctccagctagagagaaacatcaagaatagctaaattgggttaaacttttattctcatgtctctgagctataaagagctccactcgatatattttttctattcttagcttgagaaattacacttaatttcaatacctaatttagtttcatttcaaattttcattaaaatgctgcagattctcttcctctgttaatgcaaatagtaagtctggacccagaattatccccaccagcacctacttcctgccagacattcttttcaactatttaaatagacattttataacaaatcatttagtagaaatatatgatttatgtaggcagaacacagtgtttcgttaaaataaattagaaaagtttagaacttgggttcaaaccagagtaattactttgtcattaccttgcctatagttctttcatttccagttgtacattgattggttaattctctgttccattttctttgaagaatttacaatggtccgtaaaatagtctttgtctatcttctgcatgtatattctgtatccttcagttgaataccataccagaaccattttgaaaatgtaaaggggcacgtttaaaaattatcccaggataagaggcatacacagaaatgttcctagcatggtcagacatgcgagaccctaagaataacctcctacccacggctttgtgttttttgtttttatttctgtttttttttttttacacctttaaggcaagcatctggatcaagtaatttgctgcttattcatttcttgctctgtgtgtgtgtgtgtgagggaattttttttacctggtcaagtcaagttaaaagaaaaaaaaaaaaacctgtataaaaggtattcttcagaaagcatcaataggagggcaattgcagggttcagaaaaacaattaatgtaagaaggtgctacagattcaggcttgtgaagtcaggttatcttttaaagaattgtggcataaaaataaaataaacccttgggctggatggtagagaatcctgagaaattaagaactttaccaatagctgaaagttaaaaccctccacctctatcacccaaccctttaacactcaagataatctgaactaccatttgcagatctcactacagctcgagtcccagatagtgccacgtggactcgccactggacatgcagacggacagagggcacaggctcaaaacacaactccgccactttctctcaagctgtgactgggacacttacttcatttcttgtccttttccctaaataggagtcataatatcacctctggctcagagctgtggggtgggaatttatagtaacagcaacaacttgtaaaataaaactaatgattgttctcattccttgagggattactgtatgcgtgctctgtgctaagtacttggcatatattaacacatttagtccttacaacaaccttgtgaaataggtcatatttctttttagatttatgggtaatgaagatcattctcaaaaggttatgctaagttttccaaatccacctagacatgaactggtagaagcagaaatcatatccagtgtttttacactctgaagtccatgttctagctgtggatgagaaataatttaaaatcaaaagacagcattgcctgggttattatcaa

SEQ ID NO: 27785 - DNA, 1243 bp, Bovine  19866881179336
tttccagtagtcatgtatggatgtgagagttggactatgaagaaagttaagcaccaaagaattgatgcttttgaactatggtgttggagaaaactcttgagagtcccttggcctgcaaggagatccaaccagtccatcctaaaggaagtcagtcctgaatattcattgaaagaattgatgctgaagctgaaactccaatatttgggccacctgattcaaagaaccaactgatttgaaaagatcctgatgctgagaaagagtgaatgcaggaggggaaggggaagacaggatgacatggttggatggcatcacaaactcaatggacatgagtttaagtaaactccgggagttggtgatagacagggaggcctggcatggtgcattccatggagtcacaaaggacaggactgagtaactgaactgaactgaactgaaacaaaagtatttatttataacactagttacataggacatatctaataaatatcatgatttaagttggtcatgacaaagcagaccctcagcactcacgtggacaaatcccagggttgtgagcccctggaaaataggaatggtgagctctttctctctgttacccccaaagcccccaaagactgtttttccttaattggattattatcaaatatatttcctatttctgttgtctttaaaataagtggccctaaatatatgccacatcttttctttacaactttgatgatgttgtacctaagccaaattcatatgtgaatcttctcatttcatccacataacaggcatgattcatgtgttgttacaactctcacttttttcattttgtatttattgctgttataagattctggagtatttatgcattttctaaaccaaaaactcagtataatatttgaacacagcttataaaagatgaaggaaaaattgatatttgaatggagaaaatgatcaaacagatgaaatcaacagctgcacaaccaagatggcaaatgcatttatcaaagtgtgctattactttaaactctgtcaccgcaagccccaaagaaatatgcaaaacataatacacgctagttctctacagatggatcgtaaaagctttcaggtgacactacctggctgtctaagaatgacttgcctaatcaaaagagacatcttctattagaattaatgactcagcacgtggattagagattctatttaaattctctcccctcttcttatccattcaagagacatctttaattttagg

SEQ ID NO: 27786 - DNA, 788 bp, Bovine  19866881279401
ttaaaaaaaaaagtccaatttttaatactcattctgtgcaaacaaagactcaggcaaaagattaagcgtgttcaagaagatgttaacaacacaaagaggaactgtattttaaacaagttggtgcccatccttcttgcctgctttgaccagatgatctggctggtaattagacacttattaggagccaagagtcattttagtgtattttccttcaaaacacagtgagaaaatgcatctttggtaactttattatcaaggccctgtagtcatgtatcaggagccaatggctgcatcttgaatccaattatgaccttgtgtttagatttaaatgagaccaggcttcagtcttccaagtttatccctaggaatatctcacactattagttcttcctttcaatctgcttattaactgcagttaagatcagggagttataatgattacacttcacaattctggtccagattgtcactctgtgcaggttatttaatctttgagagctacattgtcccacctgaaatgtggaaataatagttcaatttactttctaatgctggtgggagaacggaatcaaatatgtgtagaaaagatctagcgctgaacctgcacacatatgcataggagctcctcagtaagggctcgacctgcctggagtggacagccttttccttctccaggggatcttcccgacccagggactgaactccggcctcctgctttgcaggcagattcttttccagctgagccacaagggaagcccaaggatgttgataatatgctaataatagaa

SEQ ID NO: 27787 - DNA, 953 bp, Bovine  19866881289077
tgatcttattcttagcatctccctgtgagatatacaggaaccaattttatcccttcttatcccattttacagataaggaaactgtgacccaaaacatttatgtgactatttaaatttggagtctggtgtggaatcctacagacctcgcatgaagcccagtgcacttttaaaagtacgttcttgatgacttatccaggtttacctggtggcgctagtggtgaagaatcacctgccaattataggagatgagggttcaatccctgagtcagaaagaccccctggagaaggcaatggcaacacattccagtattcttgcctagagaatcccacagacagaggaacctggcaggctacaatccatgggatcacaaagaatcagacacgacttagcaacaaaacaacaacatttatggaatcccaaagttgtgccagaaatatctgaaaatcctgtaagatgtgttctactgttacaactattttccatatttggaaactgagcacctgagtgtgctataatacgtcccaggtaaaaaaaaaaaaactagtaactggtaaatgacaagattcatataccaggaatatatgaaccagctttatcattttaaggaaggcctaccttctatgactttaacaatgaaattaaaaaaaaaaaaatccacatagagcaatagggaaacagaagggttaaagaatcacctttgtcctaaatgaaaaattttcctagcacatccaccaaaggcattcagggtgagatcttgttcttgagttatttcgatcatcaatctggagaattcttttgtgtctgtctgctcgatcagtggcagttccttgtgagaaatttacagtgatgtcagcttgtttaaattgatgatgggaaaaaggagatggatctcaagtttccagacagtatctgatgacctaaattaactgtccctgattctgcattatggatg

SEQ ID NO: 27788 - DNA, 1152 bp, Bovine  19866881318345
cagtcctgtggccactgctgagttttccaaatttgctggcatagtgagtgcagcactttcacagcatcatttttcaggatttgaaatagttcaactggaattccatcacctccactagctttgttcgtagtgatgctttctaaggcccacttgacttcacattccaggatgtctggctagtgaccacaccatcgtgattatctgggtcgtgaagatctttttttacagttcttctgtgtattcttgccatctcttcttaatatcttctgcttctgttaggtccataccatttctgtcctttatcgagctcatctttgcatgaaatgttcttttggtatctatgattttcttgaagagatccctagtctttcccattctgttgttttcctctatttctttgcattgatcgctgaggaagactttttttttatctcttcttgctattctttggaactctgcattcagatgtttagcatttttcaaaagcagaccttcgccaaggacacgttgccagaattatctttcaggttgcatccttaaggactgtcactccagcagccctgtgacctacccccaaacactgaccctcatgtctgtccttatttgtctccttcttctacttgaatcccagggctcatcattcaagtcattctaacatgagctacttcaacacatttgcccttttcttccttcttcacaaaatcccaattctagataaaataaacctctgtgtgcttgttccaggatggctgaacatccctggggaaaaatcacacagcctagaagagtggttttgttttcattttgtgatttcgctattaacaggctctctgagttgcccagaatacatatcaccctactctcatcattctggtctcttgttcttcaagatggatgcttcataccttctcttttctcttcaactgccccattgcaattcccttcactctcagcagctgatagaactctatgctttgaaaaccaaagcgaagcacctcatttttggtacagctgggagaatgtctttaaggctaagttgcagtgttgcaatcatcctaaatagtttacgggatttgcccatcccctctcttattttacctggcctctgacagtatggctgtgtagagttctgccaaggacaattttgtctat

SEQ ID NO: 27789 - DNA, 877 bp, Bovine  19866881436091
gactgtagcctgcctggttccctagtcctgggattctccagccaagaatactggagtgggtatctgtgttatatttagtcctgtcaatatacgtgggtgtcaaagtgtgtgtgtgtggtcaactctcaaatactgtcaaggtaaaatatttattaaagttatttttcataaaatgtatcttggcaagttaggagatctggtgatactgggcatagatttctccatggaaaatctcatcttgggtgtaactgtttccttttgacttggcttgcacttcccaggttaccacatcccctgtccaacattcccactcatttatggtaactgctagcccctatggcttctgaatctctagcagctgacataatctgtaggatccttttcgacttttaagatgctgtgagtctaaagcatcaggcgtgacctttattctccagaatgtattttcaatcaagaaaattattgggaaaataaagaaaccaaggactccttaatgttgtcttcatgattatctgccaagttattttgttgttcttctgtgtattttgtgataaagaatgcctgcatcatgtccccttgacatgattctattattcatgtcaatgtgacaggtatgaaaactgccactacaaaatcattacaagggattcctttatcacagccaaagctaagacgtctgctaattgttaatgctaataaaaggagctgctattacttggcttttaaaatataattacatgacaggaattctctgcttcattttctcacacagcccactgtaatcaccatataacaaaattagaaatggatgagacttaaaggaaagcaaatttagccacttaggagatgggaagtcccccagattaaaaaaaaaaga

SEQ ID NO: 27790 - DNA, 1519 bp, Bovine  19866881531224
ggaactcacagacaggttgggcaactggtctaaagttagagtacagcacgatgcaatctccctgaggccagcagatcatggactaagagcccgtgttggtcaagggagagccctggagtcagatatgtttgagttccagctccaacagtcactacctgttcaagctttggaaagacgctgtgcctcctgtttaagcctgcttcctccagcgtttagagaaaacaaaacatatcagaccaaaacacgttctttttgtgctccgtgatttgaagtaagtcacgcaaaccccctttaacttaacatcttccagtgacatgttgatgtaaagacttaatgaaataatgtattgcaaaatgaaataatacattgcagaagagcttagactaaagttgatgacaagtcggtgcaggttattactgttgtgactgtaggtgcaggcctgtcttttcatcacgcagcctgacagtggttaaccagttcagttcagtggtcagaatgctttatggggcagtaggtcctagttggttttagcatgctattccatgaccctctgcacttagcatagtttttgacacattgaaggcactgaataaataattatcaataagcaagtgataatatattttcttcattaccttgcaactgcataatttaaataaattgctttaaaactcccaatgataccctgaagacaatgtaccatttattctggttttcaagaccttgagtggtttcatattagcactgacaaatactcattacatttgtctgtcaaattatgagacatgaacaccatttcttggagggaaatgaaaacttctgaaaatatgaatatgcccaacttccaggttttctgaatgacagcaagaattttatgtcaggttctgcttattcatctgggacttttatgacatttttttgttcctaggggaaaggggcctgaaaaataccagattctctcaataccatacctccctatatttcttatgagtcctgcaagaaactaactgaagaaatacatcttattggaaaacaacttaatatataactttaatgctactccatggaaaggaaatatgtaaaagcactgctcatttgattttcttccaagaaatgtgggtcgagagataagatcaaatacaaactgatatgatgatgataatgatgataatgtatgaacagaaggactaatagggacttgtccatcttatgtgaaaagggtgatatgaagagtaaaagctgcagcaatagacagagaggaggactcagaaactgaaatcctaacttgaagacttgactctgttgttctaactcgctgagcccatagtaagtaaccttcagagtacttaatatgatgatagacaattatataattttatatatgtgaggatgttttgtgaattaaaacaatttgtgttatcacagtgctagtgggtgggagtggattcccccatgcttggtgaggtggttacttatttttgcagaattcactgcattattatattacacccctccagat

SEQ ID NO: 27791 - DNA, 785 bp, Bovine  19866881947072
ttgaattacaagtttcttaggaagattaaaagagatggcacacagggtctgtgtgcttacagaaagcacttagaatgtggagactattattaatcttatgcttgtgaccaacacctagtctgatataaagaaaacattcattttgaattaattaattgattaagtaacagattaatgctgaacaggtcggtccatagattaaacctctttccatgaagtagcaaactctctgtcagtactaggagaaagagtgggcacccatttgataagcatgtaacaaaatagtcatataccagaagatagtttgtgaaagtatagattcaattctgcccaaactttagtgtctatgattccataaactgcaaattaaattcagcatcatttgagattctttagaaaggtgattccatttgtctctgaagtaataaaacagtataatattgatataatttacacatcagcaagagggttatttataaacaatggcatatgcatgtagaaattgatgttctcatgtttgctgtttaaaaggattacgttaggagctatttctcaactgcttattttgctaagaaggtggttgcaaaactaatattctctgcttaattattgatggtgccctgatttgttttttcatagtccaagtgacaaaaattgatttagaaatataactggcaaagttgcatataaaacttatggtttaactcaagaggaaaaaaaaatgtagccaaatcttgttaaatctttcaaatttatttcctttctttaaaagggaggatataaga

SEQ ID NO: 27792 - DNA, 2943 bp, Bovine  19866880426032
atgcttccttgacatctcctagtcacctaattctaagtaggactgttccttttttcacagttaatcatttgggaaatgggtgtgccttctaaagttgctgaagtgcttgagattctgctgccccaattggaataaagaataataatatgcctgttgcagaattcttgggacagcaacacggctagttgtctcccctactttttgtgtaccattcttagtcataggatctctaactttcagatagacacatgtctactagaataatgactatattttccagcctctcctgcagctatgtgtgatcatgtgtttaaattctgactgatccaatgcaggtagaagattatatgcaatgtctaggacatgtacatagagggagaaggaggctatattcctgttgcttagaatacagccatgatgattgaagcttgagcagccattctgcatcagaaggcagaaaccatgtcctatcctaggacatagaccagaaaatgcttttcttttagagtcagataataagtactttcggctttgtgggcgatatattctctgtggcagctactcaactctgttgtagtacaaaagcaggccaaaacaatatgtaaatcaatatgcaaatgaatgagcatggctgtgttccaataaaactttatgtacaagaacaggcagtgggctgcaggtcacagtttgctaagatggaagagcagtgagttaaagggatcagggtccctaatgacatcatggcaccctttacctggctggtcatgaaccgccttctcctagacttatgcaagaaaaaagacaattgtgaagtgattgctttagaatttctgtcattataagccaaatctaattctaactaaaatagttgtttaagaaatgagtaaatgatacatgtaaaatagcccacataacattaaagacaaatgaatattgaataaagtgagtatttcataataataagcagggagctgtattttaaaaaaaaattttaacctctctccaaactgaggacctagtggccagcagatatcaagtccacctggaagacagggaaagagtctgcgccacagagagagtatatggattgaccctctgccctctgcgtgcacttcttattctgcacagggtcagggaatccactctcctctgttttatcaggctggtattcctttccagcctgctgagatgctgccaccaggatgacaataaaccactcagaggagaaaaagtgcaagactttattaaacgtcataaaaaagatgtgactgctgaggtccatgtaagctcactcgggtttgagcgcccaggcttggccgtaagtcaccctctggcaaccgaaaccacatgaagcatggtgttgaaaacttgctaaatcatttgtcactcaaaggcttttaaaataaaatactttaaaaaataatcatttgatttcagactctaaactgcgggctgcactgagagggatgtaaatactctgttcacaggcacattcaatagcagctgaaatcagggccagtcaaaagactttggctgtcaagcttcaaatcccaagctacacttctctcaaattccaaacttcttcctctttatgtgcctcaaatgaaattgttacatctgggcagaggcggagatctctaaacctgggggaaaatttcctggctactgagttttctgactctggattgaagtagacttaacattcattctatgttattccttttctgaacttcctaatgtttgtcaaggacatctgctctactctgactgtgtggattcaaatgctggcttcaccacttaccaaatgtgggccttcgggcaaacatgtaatttctcatctgcaaaacgggttacatgaagaattcattcattgatacatcatgaaaaaattatttctgagcacctactgggcaccaggtattgttcagtgtgcagggaataaagtggacaagtaccatgcatgtatcatacccagtgcaaaataattactcaaagattgttgatattatgcttttcatacacacacacacacacacacacacacacacaagactacattataggtgctggaaatccagaggaaaacgaaataaggcattcttcccatagcacttgcatatgagtggagaaggcaggcaaatatatatataatatatatataagatcctttcatatagctataaatgccatgaaaacaactagctggagttatatgataaagcgtaatcagtgataataggggtcatggtggtcaggggaacattgcctgaactcccatgggcagatctgggagagagcactccaggcagtgggatggactggtgcaaaggccttgaggccagaaagtccttgatgtgtttgaggaacagacagaagatccatgaagcaaagggaagagtggcgtaaagtatggttggagaggtgggaaagtcagtctctcattatacagaacttagaagctctggtaagtcttttggatattatccaaatgcaatgagatctcagtggaaggttttaaggattttcagtttaaaacccgatcctgatgaatgtatagacactagggtggaagcaggatgagcagcttggaggctgctgtggtccagctgggagatgatggactgagtgttcagaaatggacagtgggagggcaaacgtattaggtggaggaggtgagaaagaaggaagaggtgatgatgatttcaaggtccttcaggagaaggaccagatctggaaagacagtgagaagacactgggaagatgatttcccagtggggatagaaacaggggtctgataccctgcttcaggcttcagagtcatcaaccatggatagaagatgaagccaggggatagatgaggtcactctggtgattaggggagcaagagacagcagcctggaaactctccttcctgccttttccctcacaactgttttatcgcta

SEQ ID NO: 27793 - DNA, 1823 bp, Bovine  19866880538694
aaattatttcagcagagcttaatcaatggggattttaccaaagcctgactaatctgggggcgggggagggaaatactcagctccaggtcaatggaagactgacaccctaatcatgggatggaggaggcgtcccttcaaaggattttgtacaacaggggattcaactgaaagaactgaaagccttaactcctgtttaagaagtctctaggaaaagccagccactcagggacaaaaagaaggtcactggatactacaccacagatactgcacacagtaacacagcctaattcctagccagataaacaaaaaaatctcacactaaaaccctatttcctcagttcctgttacccagtacatcatgtccacctctcaacaaaaaattatggaatatgtcaaaaaagcaaaaaataccatcttaaaagaaaaagcaagcatcagaaccagactcagatatgagagagatgttggagttatcagactggctatttaaaataattacaattgatgtgctaaggacttgaatagaaaaagtaaacaacatgcaagaacatagggatgttataagcagagagatgggaagtctaagaaagaatgagaagaaacagacggaagtcagaaacactgtaacagatgaagaatgcctttgattggctcatcactagactggacatggctaaggaaagaatcactgaactttaagacatattgatggcagtctccccgaactgaaatgtgaaaagattgcaacagagtatctgggaactgtgggacaattataaatggtgtaagttgtgtgtaatggggataccaaaaggagaaggaaggagaaaaaggagggaaggcgggaaagagcaaaagagggtaggcaggagagaagaaggaacaaacagtagaaatatgtgaagaaataatgactgaaagagatgtttctaaaattaaagacagacacccaaccactggatctaggaagttcagagagcaagcactaagcaggataaatagcaaaaaatctattgttgagcgtatcatattcacctggaaaaaagtcaaagacaaaacgaaaatcttgaaagcaaccaaagagtgaggggaaaaaaaaaaccttaccctgtagagaagtgaggataagaatcacaccaggtatacggggtttcctcttaagaaacacatcagcaagaagaaagtggagtaaactatcataaatgttgaaagaaaaatccacagacttgaattctgtactcatgtaaaatatcatgtatgaaacgagacgccagtccaggttcgatgcacgatactggatgcttggggctagggcgctgggacgacccagagggatggtatggggatggaggagggaggagggttcaggatggggaacacatgtatacctgtggcggattcattttgatattggcaaaactaatacaattatgtaaagtttaaaaataaaataaaaaaaaagtgaaggggaaataaagactttcttagacaaacaaaaattgaagaaatttgtcaccggtagatctgcctggcaagaaatgacagaaatgctttacggagaaggaaaatggcacaggttggaaactcagatctacacaaagaaagaatattagagaatgaataaatgaaggtaaaataaaaccttcaacttttattattcctaattgatctaatagacaacaactgacttgcaataataatagcaaaaataaaattggtgattatagcttatggaggtatgaaatgaatgacagtgatgtcataagggacaaggaggagtaagtgggaatattagcacagcaccatgaaatagtacagtgtta

SEQ ID NO: 27794 - DNA, 3046 bp, Bovine  19866880584110
tcttttagcatagtattgggtgtgtgtgtcaactgtatttcaataaaaaaggaaacggtgaattcttctgcagttatgtcagaataaattaacttgccagattataaaatttccctttctgctgacaaataattcattagaaaaaagttttcgcctgacatatatttgacaaacaaaatcgtaagtttatattgatttgatacatttatattgcaatatgattgccattttcatattagctaacacttctattgtgtcatgtaattataatttcttttagtttcagtaacaattaaaatctagttacttagaaagtttaatgtttataatatagttttattatctatttgaaaaataaagaagcagcccctgctcctaaggaggttttaatctacttaaaagcacactggtcctatggctgtggcttagctcagccactgctactctggattgctagcactggcagcagaaaacctgtgtgactcttggaatcactggatatatttattaccacaatatgtgattaggtaaaacaatttagaggcaaatcaacttatttctcctgtaaatatgtcaacacattttggtggtgggtttgtttgtgcagaggtttttgtggcccatttcctacctggtttcactgagctcactccttcgccaatactctccacaagtccagctccttcatggcctgggatgaagggatacttcagtgggattattccttttatagcatgatcgtcagaaccacagatccctgtagatatcatccgggtaagaattaaggggcaaggataaattagtttggaatttttcttctgtctgagacttattatgaataatttttttacatgaatgacctcatttgatccctataataatattcagagaaacacagggcaggtctgctgctaagtcgcttcagtcgtgtccgactctgtgcgaccccagagacggcagcccaccaggttcccccgtccctgggattctccaggcaagaacattggagtgggttgccgtttccttctccaatgcatgaaagtgaaaagtggaagtgaactcgttcagtcatgtctgactcctagcgaccccatggactgcagcccaccaggctcctctgtccattggatttgccaggcaagagtacctggagtgggttgccattgccttctaattacccctaatttaaagatgtggagaggaagactcaaagacttaaaatgactcacccactctcatgggggcatgttcagatctggaaataaactaggctttttgaaatctactctgtacaccttatgtcatcaactagttttgcaatacgagagtctgttctatccaatgaaggatttttgaccacgtatccatagcaccaccattgagaaacccaaaattttaaaccctgtattgtggaatgttttcccagtcctctgggaaaatagattttaaactagcatattgaaaacattaagttaataatataaaatgtgtttaactgttgcaaaatttaattggcattgagaagttttaaaccttctcagttaatagcctaagttttcttgtctgtggatagactcaatccacttacattgatcatagaagtgaaacatttcctgtaccatagcctctgtattactcctctgccaggaattcatccagaaagcatacaggcagggatactgactagttgtttcagtatcagtagtgggagtgcgggaacactgggaacagctttgatacatgaaataagatttccttacacttgccttcacaagttcaaagatttaaatttaccttaatacgaacttccccagcctttggtggctcaacctgcacttcctcaagtgaaagagaagagtttgttttccaggcaatggctgccaggcatgtgattgtctgttgatacaaggacaataagatgacatcatttagcgataacatttaacttctgatcatacaaatgacacttacttgctataatttgtaacaataagaaaatcacacacaaaaagaaaagagatcattgcaatttcagacataagctggtaaaattttagcatatttcttttgagtctcttaaaatatttttatacagtagagatcatgtcatataagcagttttgcattttagggttttttgtttgttttgttttagccagtgaaagccaccatatattgaacatttactgtttgcttcttctaaaatgttttctcgtgatttcaaaatgctttataattttaaatagctgttttatatttcatcatttgaatatatccaaatattcttaatcagcaactaaatcatttccattgttttgactattataatatatattgtttataattttgacttgcctggttcccttaagcaagaattactaggggaaggatagagacatggttagagtgaaactgatttctaagtaattctacagaaaatttgaatgattttgcacaactcctagaactgtaaaacagtatctgtcatcatttttcccactcattagcattgactgtactcattaaaaacaaagtgactgtcagaaaaagctatttctttttattagtattttttaattttaagaatgttgaaactttttatgtttatgtgagttatacatattttcttctttttgtggaatgtttggtcctatattttatgtaagtatccactggcatcttggtatttttttactatcatttgacctattggtgcattaaatgagtgactggttgtccactatcttgtcatacatgatttttccttcttgattttcgacctttaattttttatgaagctatatgtgcatatacacgactgagcaactgaactgaactgaacacacattaacattttgattcataaaagtatgttttcctttattatttagtccatttccatggtttgagaattctctccattgttgatgttgttcagtcactcagtcgtgtctggctctttgcgaccatgtgaacggcagtgcaccaggcttccctgtccttcactttctctccatataaagaccaaataaatatttgttaccct

SEQ ID NO: 27795 - DNA, 1563 bp, Bovine  19866880585027
atgctaactatatcctttttataaactggttactttagaaattggggtgctactcacaatatgtgtgggtgagaaaagtgtattgtgtaaattcagcaacactgctaaaaaaaagaaaacaatttaaaacagttttagtagccaactgaaaaagtgagctaacaatatgtacagtcccaatttaattaacataattactattgcataattatgtaactgcataattactatattgaaggttcaacattccatatctctaaataggggtagaatatatgcatttttatacatacttgcggagttctcgttgttcttcccattgtttctgtttcattagcttcttcatttgccgtttagatattggttgaaacctttcacttgatccgggcttctgattttgctctccatcttcacttaagtttttctgtctttcaacattacaagtctcactaaatgctggcaacatttcagatgacattatttgatgcctctgaaaaattgaaaagcaactctgacatgaacagatgatttacaaccaaaaaaaaaaagtaaaaaaaaaagaccaaaggatgcaattaaaatgaaaccatattagtaatgaaaaaagtgcaaatttaggcaatcaatcgtcatttagtggcaaagatcatttgatgaaatgggctattttcatacactattggcagcacagaacaattttcccagaagactactcagacctgtacgtttgaagagatttaaaatgttgatactctttcttacaataatttatttccttagaattcctgtaaattaattagaaatataaacaaaattaatagaaaagaatacatgtattactgctatttttaacaattaaaaattagaatatcaccaaatggggactaaatataaattacagttcacctataacactggattggaatactaagcagccaagaaaaatgtttctcaatattatttagtgataaagggaaataattatgttaaataagaaaatcaaaacaaaaaatgttcaattttctttatatatatatatgtgtatatatatatacacacacacacacacacacacacacacatatacacacatgttttaattctgacccacccatggctttctgcattttccaaattttatataatgaaaatatagttttataaaagaaaaacatattattttttttaaagatatggaaggcacatttttgtacttgtttttaatactgtcatacaggaaaagtgctaatttcactatctgggtggacactcaacaattgatttttgacacaaggtgtgctatacatttctaaattttggacagtacagaaaacaaattgagttgccccccaacatatttcattataaatatgtaattataaatttttcacttaagtcacagctgaaaaacaaaatatgtaaactgactctgtaatcagtttacataatatgtaaactgactctgtaactcagggccatctaaaacatcttatttagatttaaccacccactctggtagctcagttggcaaagaatctacctgcagtgtaggagacccaggtt

SEQ ID NO: 27796 - DNA, 921 bp, Bovine  19866880664356
aatctgtctacagcaatgcaatgtcttaatctgattaaaccgtcctcttttgactggcggaagtctcatatcttggacacagtaacctggtctatggtgatactttcaagaatcccagagacctcagctttgtctgtggttaagcttcatttagtcaaccttccctcattcagagccctttctcttgagttagttgatctaaagcgcagggcagaaactgatcaaatgtcaatttttaaaataaaaagagaatttacttagcattttaattgataaaaaagggcccaacaagatctagatatgtacatgcatgcataaaattttgatggaggtagatatattctccagcaagcacactgcacattcacagtgctgtttactgaagtctgctatatttagaaaaggcctgtctgatggagctgggctttgagaaaactgcttgatcctccctttcatcactacgtggtggagtggaccttggcaagccctgggtggggagaaatcaccacgagggctttcactgcacgaacctccactcttgtgaccaaacatagccctgttgcttcaggaaggtttgcataaaagggattgattttcatttgattctgcaaatggattcactgagtgagcctggcagaaaggaagagaataagaaggaaaaacaaaatcttaggcagttctggccagcttccaaatgcttcaagctgacagcacaactggtttaatctgcttctttgtagctgaagacatgcttcacctttcagaccagaaacttgggacttaatgagcgatcacctgaaattcttatctttttttcctggcaaaataacaaaaccaaaacacaaactattatgcttaaactattatacattaaattttttttaaattgtagtccctctcattcgattaaaaaattatttt

SEQ ID NO: 27797 - DNA, 1093 bp, Bovine  19866880669084
taggacatttggttgatttcaattagaacccacacgtcttctctacctcccacattctctcttcatctcagagcctcttctctctaccctcaagtgtggtttcagtatgactggggaatagacactaaaaatatttttggaatgacgtgacccactcttaccccatccaggaaagggacaaggctccacaagaaacagcacatgctttcctttcatttctggaagtcccggagtcgacctacagatgctgcttcttccctggtcgatggcattcagactcctagctgccgacagcgtcaggccaacaactggacagaacagcttggctgctggaagctggccacagtctcggccacagcagcagccccctggccacagaccacctctgccacccaacccaggagccttcctacctccctcaggttggcctgggccccgccacaggggctgaagaactgggaggtggtggcggcagtggcaagggtgcctgcagccttggggccagtccaggcacgtgggaccctgcttcaggctactctgcagcccctccagggccagggagggaccgaggacagtcccgtcgctcaccactgtctcctcctgtcgctgacacctaggcaagggctcagaatggaaggcacccctcctgaactgaatctgcaggccagatccaaggaggtgggggacggggcgagcggagctcaagatagccaggagctaaagcagcagctgcagccgcttcccaagccatcagcctcctccctgcgagaagcaaaatatgtggagatgtgcgcttcagctggagtccccagggacagtccccggaccatgagactcactcaggagcagcgccagggggatcagaggggcttgaagagtccccaggagaaagcccaagacgaagtcagcagtcaagagcgcgaagctctggcccccctgaagaattctgtcccctcggaactctccagatcccagctctccggtaccgatgagggcagcaaccccttctcttcctcctcttcctcctccccggtggacggagcagaagaaagtggcctgtccaagatggagggcaccaccacatccacagggg

SEQ ID NO: 27798 - DNA, 1248 bp, Bovine  19866880766832
ttatatgtaaattagcattgggcagacctctcaaaacctagggagttttataaactgatactccaaatgtagcaaaaacaattcatataaaaacagtgtcagtcaagtctccactaccattcacagccagcatcacagtttgtccattctctgtagcctttaacacttgggctcatgcttccttgtttaatacatagattcttaaaggtatctgattattaaagaaaccaagttcatcactattaaaaatatcatcgaggggagtctaactcatcaatttattttttaattacagagggaaccgtcttggcagcttctttctctgcacccgcagtttcccaaaatagctgaacacagtggtccctaaagccacttttgaaacttaacatcaaggacagtacttctgcagaattttgagccttttttcttaaggtcttcgcatattactatcctcttcacatattacatattctctttatctgtaatagtggactaaaaggagtaagaaaacaatcccacttgaatcaattattagttccacatttcactgacactcttcatttaccagtcacatattaaagctctgcattaaagaacttgtaacaaacacattatactagaagtgtcttgaaagcagttaactgaaaaccacaaaataggtttccagagattttaaatttaagttttaaatatgaaaaaaataagttaaagacaagtgaagaagatgcaagtcactatcagactcccaaaatcttgtttcttagttcacagcaacaaaagccacacatttcttaccattaacaatatcaccttcttgcaaaggccgtctgtctggaattccatggcaaatcacttcattcactgaagtacaacaagacttcgggaaattataataattcaggggtgaaggatagcaatttcttgcaatgcatgcctataataaattaaaaataaagtaatttggaatgtgcaaaagaaaaagctagtatgcatgcaattaatcagattttaaaatctgaaaaatgtggaaaaacctattgtacagatgttcctaatgaaaaacctatttaatattttactttagaaataatagtagatactacttttagtatcaaacagtagggtttctaacagtcagcaaaccagtttaccaataattgcaaaagaaaagcaaattcacgcattacaaatatttacaaacatatacaaatgtcactatatgaagatttattttagaattaccaactc

SEQ ID NO: 27799 - DNA, 1734 bp, Bovine  19866880769189
ccctagtacttttggtatctagcctgaaagctatttattgataaagtgaatgaattgaacattttattttatgtaagtccagtgttgtttttttttttgctttaaatctactcaacaaactactatttgttttctttttttccctactctataacattcacagagaaatggttcttctctctcttctctctctctcacatgtagaggcatgtatgttctgattgactctttttttttttaaagacaactcactgaacacattttatttacagttttgtacactgtcttaatatgagtgggattgcttttctacttgaggcaatttttaaagcaaaataacctaagtaatacaaagtgttaaagtacagcgtaaagatacaaaaacagacatactaattctaattaggaatgtaattatgatactatattttttataatacacaattaagtttaggaaatcacacaaacatagatcagtgatttgaatgaaaagcataaatttgtagcaaagcattgtagttacaaaaaaaattaccaaagaatgcacaaaactaatgtttattctacctttatgtcatattcctagattcttcaccaatgttacatgagaaagaaaaactaaaccaaaacacatgaaaaactgaaatcggaatcactaatgttatcaagtagggaagcaaataaaatctagcagccatcagcaagagtacaggacagataatgctgtaaaaagaaacaaagaaaattgccagaaaactatgcattatactctttcaaaccagcaaaatacgctccttcatataaaggaatgtaagcaaaatcattctcctgtaaggtatagaaatgcaagttctttttttaatattgtagatgggtcaaatgtttttgtaatggttaattctattaagctattacaaagtgggccaggaacacatgtatggattctggggatgatatgatgtgtactgtaattctttgattgggataatggacactctagctaaaaaaaaaaaagaaaatatgaatacagaagtacaagacaaaggctaatgaaacttccttttatcttagcaacatttagatggaactcaaatttaaatgcagtccattctgcttttgaagaggcattccttcagctcccaaatcttgattgcttgaggcagttgcctatgagaatactcagaaggtgtcttcttaaacaacaaacctatttttagtggtggagctgcttagtagctgtgtctgcatgggactgataaccagttactatttttggaggaagtcctaacttttccttgtataccctccctatatgtctaacagtttctctgttttcacattcagtagtccatattgctattttatcacctttcagttcagttcagtcatttagtcggtccgactcttttcaacaccatgaactgcagcacgccaggcctccctgatcatcactaccttgcagagtttactcaaactcgtgtccatgtcttatcaccgttagctctaatattaacaacaactccacatacatcatcactgtagtcatcaaaagattctccaataaggcacagcagtgtctctagccaaaaaacattcgaggtcacttcgtctctgctgtttgttcagtgtaattagccattgtcctcgtttgtttttctcatcttcccacataggctcaataccatccttaaaaagtgagtagtcacagccagtcattaaattactagataactg

SEQ ID NO: 27800 - DNA, 2428 bp, Bovine  19866880802820
agttttggagatggatggtcgcaccacaatgtgaatgcacttaataccactgaactctaccactgaaaaatggttaagatgaggaatttctcggtttcctggtccagtggttaggactctgcttttgctgccgaggatgcaggtttgatccctagttggggatatctgaagttttcattatattctcaacatttaattttctagggatcataccttcccttcttcatgtgaattttttcttttaaaaaaatgtttctaagcatttcaatcagaagtactaatataccactgatagtcccttaatgctaatttttaaggtaaaggcattttaccaaacttaaaaaataggttgcaacctcattattgaaaagtatgatacaaaagaaaatagaacaaataggatggagcaatcctttatttttagacactctcacaaaggggtttttagtacgtagagtttccagcggagaagagagaacgtgagaatcagcctccagccactggcagctgctccgctcaggaccgaggttcctcctggcctgagtggtgaggtgggggtgtgtacttcccttccttgattagcttttcccgctgtctcctgatggcatgcagacgtttcatctgtcagaggaggaaaatatttaaactcggagggagatatgcaccagaaagtgagcactggagaagctgaatacaaaactggtttcatttttaaactatggaagcttttcatcctggagggcctctgagataaatcccatctttaaagaatcaatttctgctgtatgtatagtaatacctccttgaaaacggataactagtatgttcctattatatagaggaatataagcatttacaaaaataatagagatacagcagctttaagaggtatacttgtgcatactaaaatctttaaaaatatgaaaagctgtcatcacctcacagcatatgctggtgactgctcactaggtcagagaaggcaatggcgccccatgctagtactcttgcctggaaaaatcccatggacagaggagcctggtgggctgcagtccatggggtcgctaagagtcagacacgactgagcgacttcactttcacttctcactttcacgcattggagaaggaaatggcaacccactccagtgttcttgcctggagaatcccagggacgggggagcctggtgggctgccgtctatggggtggcacagagtcggacacgactgaagcgacttagcagcagcagctcactaggtatgaatgaagcagaaataggccaatgaggtctctgggccacactgaaaggcctgctatgtgctcagctcagccagtagtcgctcagacaggcagggccttgactgctgccttttcccctcagcaggacgttccctacggatgaaaatcaaggctatccaacactgtgcgagagccgcaattaacggattctgtgacatggaaaacagacttaccaatcctgaatgcactgttccttggctcaaaacccagtggctttcatcttagaggaaaagctgaatccttccctagaaggaaattacaagacccttctctctgacgttatgtctttttccttcctccagctctctctgctccagctcagagatccttccattcgctgcttcctcctccctcaaatgcacgtggttcactatctccaagtctctgctctcatgttttctatccttgagctctttcaggagcactccactgaagcacagagcaaccataccagtgcttcgcatccttctgtttattttccccactgcacgtaccaacacccgacacgctatttcttaccttgttcgtacattttctgtatcccacccccaacccttgccccaccagtgagttccattagggcagggacttttcgctgttttgcttactgctatattcccagtacctggaatagttcctgacataataggtgatctaaaaaatactttttgagtgaatgactaggttttcacaaaggcatgaagtggcagtatattcaattaaacatcccattaactttaaagaatgaggatgcaacttcagtagaaaaaaactttaggtattcccaatactaaacattaaccatttaaaaaactgtattcttaacatttctctagtaaagcatttcccaacataaaactagttatggttgaggcatcatacagcccgtatgtcaaatctctctcccagctagaaccaatcatgacttgggtgttctgaatacaagcacagggtctagaatcagcactgccaggttcaaatgctatttccacctcttactgggctatgtgaccttaggtaatggatttagtatttccttgcttcaatgttttaatcctacagtggggaaaataattctaaagtatctcataggagattattgcaagaaatatatgtactattacattctaagaa

SEQ ID NO: 27801 - DNA, 1593 bp, Bovine  19866880876375
aagggaaaccaagaaagtgtgatgtcctaaaaggcaagtaaaaaaagtgtttcaagaagtatggaaagaatcaactgtgcaaatgctgctgccagtgtgagtaagaggagaacttagaactggtcactgatacggtaatatagaggtcactggtcatattgtctctcacagtttcagtgatagagacctggcagtgagaaagaaatgctaaggagagatgggtgtttcttttgttttcgaggctgtggggaagaaatgaaagctaaattctcatcttccctgatgggaagtgaatagatgatatataactccattattttgattagatcaatattcagagtttaatttattatgactatgtaaactcttggagaaggaaatggtaacccactccagtattcttgcctggagaatcccatggatgggagaagcctggtaggctacagtctacggggtcgcgaagagtcggacacgactgagcgacttcacttcagttcacttcatgtaaactttatatgtagatgaaacaggtggtaaactatgattattttttctttgctgtgcaagtttttgcagaatgcaaaaggaattggtatctagtctacaagtggagaatttgaccctagaattagttttctaatgtacgttctactactgaaactctaaactctccaccactgtctaaatctcttttcaaaactttcataagggttagatagtcccacacattaacaaaattggttcatccattgaaataaaaaagaaggcagagtgcatgcctctatgtgaagttaagttggtagatttgttggaaggatcttgagaaagttattttctgattgcagctgttttctcagtggaataagaagcaagttcatcagtgagagtgagaaaggtcaaggggtgagaaatttaagaagagagaggaaagtgtgaaacagttgtggaggaaaccgggagagtaaatagacaagggaaatgaaatttggtttcccaggtatgctgggggccctcttgaggcttgtgatcaccagtttaaagtgatgcctctcagcatgccatgtgatttctttctaggcatgttcaagtgctcaaattttggaacagagtaggcagagcattagatcaggattgtattaataactttgccagacaagcacagcaaaaggcagaagggatgggagtggaggtgttatgcaagagaatggtgatcatgatgatgatgaaccatggatctaagctggataaggaaggaaatgcggatgtcaaggggtgactggaccatcaccatgtagtagagtggagggcatggacattctgggaaaggcaaagaattgttggagtgatgttgttaagggaatgaaatgacataaaatatttgaagataatttgaagttgttgggaatgacagtgtctagatataaccatgaatgaggtcggggggaaaagtggtgggatcctgcagtcgcttgatctgtagagcaaacaacagtgatgacatgtaaagaacactatactggtggtactaactccacctactttaatgaagaattttgttaggcttatcttaggagaagcaaggaacatagcaca

SEQ ID NO: 27802 - DNA, 1374 bp, Bovine  19866880886295
accagacaagcagggacagccccagttgcccagagcccactattgggctaagccatttaaaccagtcaattctaggctgcataccctccttgcccattccttcccacagaaaccatgacaaaggctcttgtccactttcctccctggccccctcagcctctgaccctcatgcttccccatgtgccccatcctcttggaatctgtgagtgtaaggaacgatcttttcaatggcaattgtctcctgacccgtcagctcctccatacctggaaaataaaatccacagtttaaaaagtgaaagtgttagttgctcagtcttgtccgactctttgtgaccccatggactgtaggcttccaggctcctctgtccatgggattctccaggcaagaatactggagtgggttgccattcccctctccaggggatcttcacaacccaggggctgaacccaggtctcctgtattgcaggcagattctttaccacctgagtcaccagggaagctgcgtaagattgagggtaggaggataaggggatgacagaggatgagatggttggatgacatcaccaactcaatggaaataagtttgagcaattccaggagattgggaaggacaaagaaacctggcccactgcagtccatggggttgcaaagagtcatgacttagccactaaacagcaacagttttaaaagacatcatatggcgtacactcacagcctcaggggctttcttcagttcatcaagcatgctgaggcccttcctaccttgccattcctcctaccagagatgaccctgttgcttcagaaagaccttcccccagacctagccaacttctgcacatctaaatctcatctcaacgggatcttcctcagagaccttccgtgagccccagcctgggtcaagtccctttgccattattctcagggctctctgctttttcttcacggcactccacatagcatgtgttggattccctggtgattatacaattaaggtttggtttcctgcaaaagattgaaaacaccaacagagctgcagttatgcctgttttcctcactattgcatccttagggcattgcctggtacatgctatgtgttcagtatttgttgagtgaatgaatagatgaatcccttgaggcctcctagaaatgagacacggagtctttgaagagagcctaaagcccagcaaaagaaagttggaagagaggcagagaaacatattttattactgttaacatggcttcattttccccaggcaacatacagttggcagcataaggtgtcaaataaactgtggaatatcatacaaccattagaaatcatctttgtaatccaagtgtttcatacatatgtcatagtatattaaaaaaaaaaa

SEQ ID NO: 27803 - DNA, 1027 bp, Bovine  19866881022546
tgacttgatctatatatatatcaaaaagattacataggaaagtcaggcattataaacaatgaaacgtcacccgatgtcttacaaaacagtatatgaaaaacagctcaaagaatgaatggagagtaagacttatggttgtaaggtagaaaaggcgtaaacattctagatttaattacctcttactgggagcttgattcacttttaaaatctaattttccacttgagttgtgtaaaattatgtgatactgaaaacctcctgtattataaatacaaataatttaggcaagagatgctttcttctcatctcaaacgtggaagaattataagccctttattagtgttggtcatttttaagagtaggaatgtcttaacatccctcgccatgcccacgaggataaatgaataaatgccggcaggtgtacgcctgccttgaattggaaaaacaggtattattactcaaacacctcccattccagaaacgctaaccccagaccccgccccacacaaaccccgcccctttctcccactgcgggtccggagttggcgcagtgggctgacgtaagacgtaacctccgtagccttctacgtgtagctaccggctctgcctctgggagttgaagtttccgaaagaggaccttctcgagtggtaaagaccactacaaaaagccttctgagaggttatcagatttcccgacaactcctctgttcggtaagtgtcttggcgcggaggcttgcgctcatctaccttttgatataatccgggagcaaaaggagcgcgtgccgatcccgccttccactagcaatagggcttccgggcaagaggtaagtgggataatggaaaatggtagcaaagacccagctccggaaggaagtgtcgtcagagagagcgcgccccttcggctcgccaaacagctttctgattcgtcggctgcaaattaaccccgcctctggaatgcgtccacgcatttgagacatggaggcgagagtcgggctcggctctggtcactagtataggacctcttgctgt

SEQ ID NO: 27804 - DNA, 786 bp, Bovine  19866881082397
tctagagttctcttggacccagggtttaaaaacagaaagtgcacttattcacttatgatttaggggaataattcataatctttttggaaaataggcttgtttgaaaatccgatagcattagtgaagtccctcgttacccacacgtacaattttacagaccattttttcgattcactgatgcagtgaatataatccataaacctctcaggaattcacagatctatgttaaaaatacctagaaagactttaccaactcttccattcaaagctagatagtgaatttatgtgtccccaaagcaaaattcagagtttgaaatctagaaatatggaaacagtttctttaggctttggctactttgtttcttactgaaaaatattccatgaaaatgtttaaatgttttggttatctgttttatccctgtttggctaatagagtaagttcaaaggttcttttggaagcaatgacatcagagaatctgttatgatcatcatcggggcccttgtcaggaagttgtgtcagaaccaaggctgcaaactgaaagtaagtgcaaatccagtctaagtcactgtatatatagctccaaaccatcctgtttaacactcacatgctgtccacaactggtgttcctatttcccctcaccctactctattttcaccacctgcaacccactccagttttcttgcctggagaatcccagagacaggggagcctggtgggctgccgtctctggggtcgcacagagtggacacgactgaagcgacttagcagcagcagcagcagcagg

SEQ ID NO: 27805 - DNA, 779 bp, Bovine  19866881120698
ttttttcccatatatctagtggatttgagtaataattttcaaacaagtgtttcatggaggtgattcagaaattgtgcaaagattaagtttttttttccagtaaacaagtatcattgaaatatctatatactattattgccaatgagattttactggaaaagagttcactgctattcaatctgaaaataatgcaatagaaaactctcaatgacaagatgactttttaagacctaaaggaatgattttataatgcaggaatttcaggatgcatgagaactgaacaggatccatgaaaggtcccctgctgaatggaccccacagttatgccacttaaggtacttctgtccatgcagaggtcagacttcccaggatacccagctctgtgggcaccattctgcaggaggaagatttcataagcaaacagcctcttgtggcagaggtcactggctaaatcacatgctcaccaccccctgaggggagtatatctgtccatgcctttcccagaacatcagatgacacatatctactgaagaacatcttacaagaaaagaaataattctgcattaaatgttacatgtcagcagtgagctgcatcccaattccagaaaattaaaatgtgagagatgagtcatagaaattgaaaattgacagcagctttctttgctggagtccctgctgtgctatgagagaccagggaccatcttctgtggcatcttttctctgtactcaatcataaacccgagcctgggtcaggagctcacagccgctcataagtttca

SEQ ID NO: 27806 - DNA, 2189 bp, Bovine  19866881187751
aatctgaagagaagcaaaaaaatgggcacttgacatcactactaaacgattcctcactctgcaaggatctatttattgtattagcgctatctgacaggaagactgacaaagttcatttgtcttttctcttaagcacttcctccatttgccctcggccctgaagagtgttagttcctagagctgaaccagctctctgccacatcctgagtgctactctggctcttctcatccctggccagtgacttttcagtatcttctaacttgcaatttaggtctattctggagttccccctttctcaggatggtgctgctgctgctgctaagttgcttcagtcatgtccaactctgtgcgaccccatagacggcagcccacgaggctcccccgtccctgggattctccaggcaagaacactgaagtgagttgccatttccttctccaatgtggctatcctaaactcccaggggttatataaaatactgagtgggatccttaggggaggaaagtaggtcctctctgggatctttctatagcagccccacactaggtaacctgagttactttagttcttagtacactacccatgggtctcacttctgaaaatgctaaaagcccatctacatatgtgtttgcatcctgctgcccctcagcacgtggggctggtgatgcctccaagactgcagcagtgactgcctcccttcacgggcagcagcctcccacccccttctgctgcctggtccttcacttggactggagcagacctgctccttctctttcttctgaattaacttccttacctgaaaaatcttctggatccccttccatccccacaccagatggggtctctagtctcctcccgcttagctcttccatgtcactgtcctgctggctttcctccccacacacctcaaaacggggcaggagttgtctctagtcttggatccctcaaacatcaggaaacatttggtcacatcaccctccgcacagggctcatttcagcatataggggcacagttcaaggactttaggggcttccttgatggctcagtggagaagaatctacctgtatcgcaggagccacaggcgacatggattcagtccctaggttgagaagatgccctgaaggagggcacggcaactcactccagtatccttgcctggagaaatccatggacagaggagcctggtgggttacagtccctggggtcgcaaagagcccaacatgactgagcaagttggcactcacacgcgaggactttatgctacattttacacttctcctcaactgcgaactctcctccctctcttaggctcagagctgtttatcagggttagtggcagggctgatgaggtacctgctttacttataccctcttggtaaacctctccaggcttacaccagagtcctcggggtttgccctaaatgggtaaagttgcttttctctttgcctctctactctgtttcttgcaagtctccagaggagcaagtacaagccccacgtttctgagttagataggacagtagtccaggaacgaatattgatttctcattattattctgccacctataccttactcactagattttgctagtcagtaagtagcactgttaaatgttcaaataattactttttactcatgaacatagatcaacaaaggatcttttttcaaaaggaaaaggatccttagtagttcagggtgcagtcattgaggtcattttaactattctgacatcgtggcaggcataggatcgaggtccccaggccacaccaaagtaggacgcatgtgcacagtgcttggctgtggcccccctggtggagctgtagggcttgttgctttaataagccccgccaccactaagtcgttcagccatccaacccgatctggtctccctccaagtcttcttatcctcctcaccttgcaattgctctctgccaagctcagctacttccccaagcctttttcaaaggccctcttacatgtgcacccccctagtttttcacactgaggactacttcaaaggctggcagtcctgggaagggaggtctgacaataaaagaaatcccaactggagaaaggtttgctttggcagctgcctgattgttctgtaggtggggaggcgcctgctccaacctctgcagctcacttgccctcacagctcattacagatgttttcttttggtctggttcc

SEQ ID NO: 27807 - DNA, 1053 bp, Bovine  19866881370604
tactgtaagttccctgaacatttcctggggttgtctataataaagtgtttctgggttgctgtttattaagcaggtaagatcccttttgaatcagctgcctcaccttcaaaccagttgttttgctatttcacatttgcattgaacagttatacctcagtgcagtaactcaatggttaattggccagaaagcaagttttcagcagtgactcagagtgaatattttattttgaacattttgttcttcatgagtgtaaatcaggtctagattggtacacagatagggggatggtgggactgtgatgtgataccacagtgcaggcgctgccacactctggtgaaattgtgttcccagagctattaattgacactcagaaagagttcagaattgattataaaaacaaacagacaaacaaaaacagttatgttttttctattaaaaatgagctttcattaaagatacagtgatgattgtcatagaagccttgttttgaagagaaaattgagaactgagattaacagcaaaaagaatccagagaaaagaaatatgtacatcatttgagtattcattggaagagtgccttattttacatccacaataaagagagttgacaattctcaaacttactttgtaaataccaatacaaatacactttctaaatagaagtgttttggtctgtaaaacaaaatttatctgcaactacaaattcaactgttttacactaattatcctaattgatggtatagaacatggctcaattagtttgacaaacagtggaaactagccattaaaatagtcaaaagtataaaatggccaagttacaccccttcccccacacatacaacacacacagcaacagtggtcactgagttcaaaggacttgattactcaagaataagagaatatagcttttttctggagaagattgtttattcttgattgtactgttattgacttgacttaggtcattaaaaaattgatatgaattccatatgactaactacaagttagttggatactctcttcaaaaataaacatttaaactgagttaaata

SEQ ID NO: 27808 - DNA, 1894 bp, Bovine  19866881490373
aaaagagagccaggtttgaaaggttcatttagatttatgacaagcccagacagcaattaaaaagcagacatcattttgccaacaaaggtctgtctagttaaagctatggttttaagtcccttgtactgcaaggagatcaaaccagtcaatcctaaaggaaatcaaccctgaattttcattggaaggactgatgctgaaattgaagctccaatactctttccacctgatgcaaagagccaacttactggaaaagagtctgatgctgggaaagattgagggcaggaggaaaaagggacaacagaggatgaaacagttggatgtcatcactgactcaatgggcatgaatttgagcaaagtccaggagatagtgaggagcagggaagcctggtgtgctgcagcacttggggccacaaagagtcagacacagcttagtcactgaacaacaatctttcatagataagtgtggtcctttcctccaggtataggaaaggtacctctcacgtgagagtcttacgatctactttggggaaaaatcagaaaatccttcctgcaccagccatttctcaaattccttagcttttttgggaatattgaaactcatcgataagaatgtggactcaagagccaggctggctggatttgaatccagtttcatctctttcattagttacattcttttgggaaagtgatgacctctttgtgcctcactttttctcatctgtaaagtaggattaataccgcttatcatatacagggttgtgtgaggatcaaatgagttaacatatgaatatgtgttattattgttaccagatgacttttgagatggacattcaggtatgagtaagattctgtggtgggggaggcatgtgagtggtggaagcagtatttaaaaaggatgtagatgggaaagtggctggtgcttagaaagctaaaagttttccagtttggtggggcggagggtacatgacagggataagagacacagaagctagaatatttggagactatcatataagatgcccagctgatgaatgtcttcctaaggagaatacagaatttctgaaggtttttgagcagggatataataagactagtgttctatttggggggaaaagtcatcttggcagtcactggtataaattgtcactgagaaaccttcttgctgaaaatttttttcttaaggagattctcatactggtaagcaagtacactgaccagctgacaaaatatgcctgtttatttagcagtcatatttctcagggtaaattaatataatctatggttcataaatcagttcactcaatgtattcatctattgacctgcttattactttaaaatgcatttccttcaagatggatctaagaccacttataaacatgtgcaatacagcagtaaataaatcagaaatgaacatcaaaaactatataggggaaacagaaaggcaattatctacgatcaggatctagaataaaatggtaaattcaactgatcattacattagctctagcttcctaaaagcccaggcataaagggaatctgaattgtgccgttcttaaggcctattaaaagaaattttattaggtttttaggtaagtcgagccttttcttcctggagtctaatagaaaattcacatatcttttgagtgaagagcaggttttaaatgatgaaaaagcagacttcatatagtcattctaatgacttcttggcatgaacaatccctcacacgccttataattcctctgaattgctggagaatattttctgaatttatacactcaaagacttgacaagaagcatcatgggtgtttgtcatacacagaaagatgctgaaggtagagtagcaatgggaaggatatgttttatatttcacaaaagatgaagtccagaaagtg

SEQ ID NO: 27809 - DNA, 2337 bp, Bovine  19866881660511
tgtactctcaataaaatgcggagtacagccagaaagtataactgagatgtgccgtcttgggggaaattaaaactgggacatgaagtgaggctgcgcactatcaagccgccgggttaggatctcacagccagtgtccgtgaccagcagagtgtgctcgaactgggcagaccgcttcccgtctcttgtcaccgccgtccagccatccggccaggtttcatcctgccatccgccttaaacgaacaaacaccatctcttaattctaccactcagtcctttttctaagtacactctagggaagtgtacttgcccgtgcccctctatccttgggtagctcagaaaactaatcttacaattcattattaagattcctgtgtacacatcatctgtttaagctaaagccttcccaacttcattttggtctttagttcaatgaagcaataatatgtttaaattttacaacttcacgttttgtatacttctcaactactgaatgaagatgctgtttccaacaataaaggcactcagcttcctttttgtaaatgtactgattaccactcatcccaggattgcattaaagaatttagctctctcctgatataactttggcatctgactaaaccatagccagtgtatattgtgaaggaaataagataactttttatacttttatgataacatttaattcctgtgtaacttttaaatggcaggaacataaatggtgagaacagattatactgtgaaatttttgtaggccacacccctgtaaccagaaagagggcaaagagaaagaaacaggagtttaacaagagaatttaaaaattatgatgaggcagaatgggttagaaaggaaataacagtgaaagaagctgggagacgaaggaaaatgagaggagaaaatgggcgtgagatgtaaggcagggaagacagcagcagaattacaaggttctacaattccagacactactaaaaaagcatacagagatgttcctgtctccaaattagatgttaaaaaataatagtaatattctttattttgaatactctttaccaaacattagatcttactgcctcagacaaatcccagagtataaagtagtgagataacctacttctgcaacattaaatcccggtctaagaagaaaatatgaggcagcataaagaaagttaactcatgctttgtcaaccatctaacgatgagtgaatagatagttttcaatgtaatgaatgatcttttcacaaatggatttaagacattaatacttctttaattttactgttatctactaaaacagattctttactaaatgtcaagtcaaatatatctgactaccgttctgagaaaattcctcttcgaattaagacactttccactatggagctgagacttagcccagcttagttacactgaagtatatctggtataatttgatgattacctgaaccagctcaacacaatgttatttgcttactccaggaaacaccacttggaagtgaagaagtgaagtcgctcagtcatgtctgactgtttgcaacccccatggactgtaccctaccaggttcctccgtccatgggattttccaggcaagaatactggagtggattgccatttccttctccaggagactttcctgacccaggaactgaacctgggtctcccaaactgtaggcagacgattccaaaatacactttcctctccttgtccttgcctttctctgccatcatacttacttatcttgcaactgcttatgcggggtcatcattcttctggggagtgacaaaaacagtatcttacacttgtacagccctttaaaggtactctgcgttcatacaaaccatctcacttaattcttaccacagccccgggcattcagataaaagataaaggttgtaacttgcatcttacagaaaagggaactaaggatcaggttaagaaggcagcctctaaaacaacctccaatgcttcccttcagtgtggactgggtttagtgactcacttctaaggaagaaaacctggtagaagtgatggggtatctatcactctcaagattaggttataaaagactggaaggatcctgaggggactccattaacacaggggacaggacgcaagagccctacgactgccgcatccctctgcatcccctaatctcaacagacaactggtgaaggaggccccggttattactccgacagcctcagtgagagcgcgaatcgtgacacagatcacggctgtcatgcgcctgtcacagcgaccaacgactgcagggacataaaactgccagtgcaaagcatgtctgggctgggctttctccacagcagttgtctgatggcagca

SEQ ID NO: 27810 - DNA, 1204 bp, Bovine  19866881865325
tgtttcccctatcttacaattttaagaaagtacacattcattaggcataatggaaaatatagaaaagtatatatatattaaaaaaaaacccatttgtcactgttctaccatcctaaggtaagtattgttcatatttggataagttacttccatacagaaacatacttttatatgcttctgttttgagttgtgtttgtttcttaaaaatttttaaaaattgtgtccttttcagttaacataatgtaatagcatttatctatgttaatacatatcttgacaaacaattttaaagggctgtacaattttctattagatgtaggctctaaaatttatttatctattatcaaatcattaggtatttaggttaatgtgaactttatcattaagtatgctactgtgaatatccttctgaatagaaaccattcttttaaaaaaaaaattatttatttggctgaaccaggtatatgtgctctttagttgcagcatgtgggatctagttccccgaccagggactgaatcccaggccccctgcatttggagtgtggagtcttaggcactggactaccagggaagtccctagaaaatattctaaattttgaattttagattatttatttaggctttcttctcagaagagaaatcagatttaaagatcttttataaaaaggccaccaccatcagaaatctatgagaatgctgtttcatgacacttttaccaacactgaatagtactgtacatatgacttcctgttaagcatggcagaataatcatttatttttccttctactcaaggcttccttaaaggggcagtaaaagaataaaatatatattaaaacccacaaggtcaaagaaaatgggaatgcaaacatgagatttggacaaaaggaagttgtgagtccaggagctgactgggagaataaagtgaaaatatgcacactcattcctggggttgaggcagtcagataaacacacctctttggcaggagacaggagaactattttcttgaatgatttaagatcaggaggaaaaaaccaccaaaataattacatttggagttcccagcattcagacagaaagttggagaagagaatgaatagaaaatatttttttaaatattaaaaattcttaatgaaaatattaagaatcatatgggacactgataagaaacaatatacatgtaactaaatttacttttaacatat

SEQ ID NO: 27811 - DNA, 1188 bp, Bovine  19866880557474
ttgctggtgctggagcagttcctggacgttctgcccagtcatatccagaactgggtgcagaagtatcatccacagaacgtcaaaagaggctgtggccctggtagaccgctttcacagagaatgtggtggaataagcaatgaggtgagcagaaagattccttatatgtacactgtgaaagagggtgaaagaggggtcaataactggagaatgagatggattaagtcactcttctgttgttcctttagaataactaagtgcaatctgaaatcacaggcttgcactgacagcttctcaggttggggagttcctgagagtcttttcctggccttagaaaaagaaatgcactttgccctctttagggccagggtgaattgaaggtggtgggcctggcctagcatggccaaggagacaggacttagcagccaagaaataaaaggcaagaaaatgctaggaagggaggaaaaaacctccaaatgcagggttttaaaggtcaaaggcaggagagtgtagcagccaaagtataaatcaaacctttctggggagactgcaaagaaagagaagaaatggaaagagaaaaggggaaaaaggatcagaaacaagatataagctcacagtaaaatggagaaaatcagaatgctgaggcgtggtgctctctgggctgggaacacacatcgcagggccaggataaaagcgtctccgtggcctgccttcatgctttgccttggctttgctggtgagtaggtaaccaggtctgccctggggagatggcagcctacttctccttgagagccccgccttgaggagcacaagtgtcttatacacctgaagtgtatggcggaaagttgaatccagctcttcccccattttttcctccgctgcatcccctttctccatgaaattgttccctggacgtgggaggattggaaaatccacctgacagaaaaccctcttttattcattttcttattctttagaggaaactagaaaatcaaagtccactaaagcaaggatccaagtctagaaagcaagagattggaggcagtgagagaacaggcagcctacccctaccctgctcttggcctgagctgtggctgtccaaggaggtgtggaggcaagcaagtcatagcttctctcattttaatctgattttcccagatcatgtgtacagttccttgtgagaaaatcat

SEQ ID NO: 27812 - DNA, 1824 bp, Bovine  19866880602904
tcgcagctcctgctagccagcggggtggcgggcacgagccatgaggtgtctgtggtgctgtcgtcagtgctggcccccagccgcccctccacttcctgcggcagccgggcccggcttcctggtgggctttggggaggctcctgctccgcgtcgaggtcgatgatggaaaacggttcagaggacttggcactgacttccagaactttcttgtcttctaagggactgttcagaaatgactttgctttggtttgctccagctccagctcttcatctgaatccagtaacaggatcacctcgtcttctctgttcacactgcaggaagaggtctcaggcctggagctccggcggccaggtcctgaccgggttagatccatgggtggagatttttctgagaagatcaggacccctttacctctgcgttccagtgtggaactacattccttgtctttctggcctgggtcctcacacgataagggaaggcgcctggctctctttggcttcggtgatgagttctgggaggccatgctggaagctgtgccctgtaactggggtatcggtggggacaggtcactggggcaacgagggtggagacgtgtctggcgaggactccggccttgatggggctgcggtgggaagaagcgtgagcgtgaggggggtgcctgctggtagacagggggatggaagccctctacctccctttcttggatggtcctgtttccttcttcccaattgctcgtcacccgggagagttcagggtatccagcttgaggtgacgaaaaaggctgttgaatgttatcatcatcagctgagcacagaggggcgctttcctgcctctctgcccggccctgggtggggctggaggagcagggacgagccagtgctccctctggggcctctgctttctctcccccgttcaaagcccggttgctggggggcaggagtgtggactgtctcgtgtttccccatttggccggggtctcatctcttccttgcccggatgattccacctgctctgcattttctggctgttctttatcctgttcacttgtgaggatttcccccaaaactggaccgtcctccccgagcaggtcggcttctccctctggctctggagctttctccccctggagcagctttcgctgagtagccgcgaattcataaatttcttccatctcctcctcgttgaccttttctctgtcttcttcgtggccctcaggcatcagcaggtcctttgctccctccccctcacccagccacacaaagtgcaggagctctcggaaagtctccactctgctgtcagcgttgtcttcctgctcctttccctgtccaccttctgcatccatcacaaagggcacttgttcgcacaggtcaacaagctcactcaccccaaacctgcaacaggaaagccatgcgtcaccaccccctgcgcagaggcagcgccctggctcaggaggcttggggcaggagtcctcccaggcgggacggccatgactctccccggcccttccccactcccctgcagagacagtgcccacgtccatgcccatcaatgccccaggccactcagctctagaaacagcgtttggggagggcccgctagccccgctgtgcagcctgagcgtgggctgagaggggaccgcggggctgggtggttctatgaccggacccaaagcaccgggacacacacacggggacgcccaggccagtttgggttagcccggacacgtgcgccggcctgcctggtgctctgccatctcatcggcacctcggagacgccgggggccaagcccgcccttcccaggttccagcccaaaggtggaagca

SEQ ID NO: 27813 - DNA, 2466 bp, Bovine  19866880619442
atgttctcttacccttccttagtttcctttaaaacatttatcacttcctgacatttgtttgtctgttgatgttagagtgtctgactctgcatgagatgataagctctgtggtagccggggatttggcttattctccactatgtccctggtacatagagggtgcctggtgcaccataaccactcagtacgtatttatggaatgactgagtaatgaatactttccatacttggcagtacaatttggagtaagttcactaagtaattcttgcctgtttctgccacctggatgtgaaccagtgagctatgggagtggtagaaatcttttctagtccagtgtttggtgcttgagaactaaataaaaagttagtataatgatggcatgtatcatttgtgcatgatacatgcccatggaccttcacatcgactcacctaaacctggtcttatccagtataagtcttcctgaagacgtaatagcaccagtctatgtttcctgcaggctctggagtttggttactccttagttgaatatggagaagtggtgtcagaagatgtggaatttgcactggattcctgtcgatctagcttaggttcctttctcagtctttgcttttcatgcccagtcacaaatgcagtatagtgtaaacttaatattggatatgagagtatccatttaaccattcaggataacaaacggttaaagtatcttttgcttttcctgaagtagtctaaaattagtgaaccatttattagttctagtcgttgacctcagttttttatttcacagcattatttgtgctccccaaacctaaagtgatctatttagagcaaggggaagagccatatattcaaggatctccaatgttcaaagacaatcctggagagctgctttcaggtaaataataccatgggaagaggagaaatgtgcctagattaggaacctttccaagggcttaacattttaagattctacttccctatatatatattttaaaatcagtgaatgttgtgctttttttctattcccatagttatcttgctctgacatacagtagactgattcttatgtttattccaacagagataaaactgaaaaatgacatggaaaatcatcaactcatgtgtctttctgacttagaaatacaagcaccaggagacatagtatcaaaaaaagccagtgtgaatgttcatcagaaaacaacaggcaaagaaaatcatggtgatgtgcataggctggggaaatggcaccaagattttccagtgaaggaaagaaataaactttccaactggtgggaggaagagctgctgaaacttatggagcttcataagaaagaacgtgcaacagagaagccttttaaatgtcaggaatgtgggaaaagcttcagagttagttctgaccttattaagcaccaaagaattcacactgaggagaaaccgtataaatgtcagcagtgtgataagaggtttagatggaggtcagatcttaataagcacttaaccacacaccaaggagtaaaaccgtataaatgctcctggtgtgggaaaagcttcagtcaaaattcacatctccacacacatcaaagaattcacacaggagagaagccctttacatgtcatgaatgtggaaaaaaattcagtcaaaattcccaccttattaaacaccggagaacccatctataacacatgcaagcatcagtgaatgctcaagactttgacaccaggattgacaccaatgaagaaaagcttatccagtgttcttagtctaaaaaatttaccaaccagagtttaaccctaaagtttatgaaaaatttcaaaattaagaagcatgaagaattttttaccagtggaaaatttggtgatataaacatcatgtttcacagaaagaagttagggttgactgtgagaggaaacagtagtagttagttgtactacttactgtttttacttagaactatcactgaattccttaggaaaataggtgttctctaagaacccgagtaagggaaaaagcttttgggattgtagctgacagaatagcaataccagcttcaaatagcagatgcagtcatgatcaccagtcttctgtggtcacagaggtaaatattgtttttcattgatcttccagccactgttaagcacatatgatggaaacatttgtagcatagttttccaaaataaaaagcagtaatatacgtgtttgattacatacattgtctttcaggtagccgacttagcagtttcaatagtcttttgggacggaaatgaattttaacatgaagttttccagaaaccaagttgagttttcttactcttgtcattggacagtgtttgcaaaattgacatggttttgacttcctttatgaatctttatttctatacctctggaatcctttcagcacaatttttactgtgagaaataatttactttagtggggagaatctgccagggaactatgcaccatcttacc

SEQ ID NO: 27814 - DNA, 1828 bp, Bovine  19866880653179
tggtcttgtgctgcaccccacagcccctttggtcttacactgaagttacttatgaagacgtccacacttggggggtgtctcagttgtcctctaccccagccaacatccactctgctgtctccacagaagtcaaggaatttgccattgttgccctgcactcggccccatcggacgcagtggctgagattaattctctctacgatgtctacctggatgtccagcagaagtggcacttgaacgtgagccctccccgctgcccccgccttgggctctgggggcctccatcgtgcatcgtgccctgggccaacccatggctgtctcctggcaggatgtcatgttgatgggcgatttcaatgctgactgcagctacgtgacctcctcgcagtggtcatccatccgcctgcgtacgagctccaccttccagtggctgattcctgacagtgccgacaccacggctacgtccacgaactgcgcctatgacaggtgagcggggtgcctctgcgactagcttcagaagtgcttcccaagaccggacactcaccctcctgacttaggaaaggcatttcttagttttgggttggagcacatttagggagaatacgacactggcagataatggaggttggtcagcggtgtgcagtttggggcaacattgagccggggcccaaccaactccacagtggcatttaagcgtggttggtgttgtgtgacaagtgcagattgtcacaccctgggctcttgtgtctgctactgtaggatcgtggtcgcagggtctctgctccagagttctgtggttcctggctcggccgctccctttgacttccaagctgcatacagactgagcaatgagatggtaagtatctttcctggacacactgctttttttgttgacttgagaaaaccaatggctctgggccagtcctgacccacctcaggcgcacgaccatagacgactaggtgtctggggtccctgcgctcactgctgtcttcccacaggccctggccatcagtgaccattacccggtggaggtgacgctgacataagtcccttctggggtccggaacctctgccccacgctgggagctgaagacaacaactgacccgtcacagttaagagcggagggcggagcttaaggaacccagtgccgttcgtccccgtgtgccctcaaccaccccacagcagctggaatttgaggagagggatggaaggtaggcttttcctcacctggcccacttccattgtaagtgtggcggtcgtgtcaccagagcaccccactttctcagtctggaaagaaagtctaaaactaagaaatgccttttaatttaaataaagctcaaaagggggtgttgtcattcacgcacccagtcgttcccgtgtgtgtccctactccctagtgactggctgcaggccgccttgccccacggttgcgtctgtccccttgtctgcggccatcagtgtcgctccagggccttgacaagcagctggttcaggcgtccaaccatgggtcgagggtcgtcgatgagtcccgctgtgatcatggcgttctcgtagatctgaaaggcagggcagcaccttgtcagtgggagggggagcaaggcctgggtccaacccagggacctcaaatgcaaagagaagaagggaagagagttgttctgtttaaaacagggttttagaggaaacctcaaagcctcagcctgctcttcacccgctccagcagcctcacctgatccaccagcagctgggccaggtcaggctcgctgtctctcagctgactgagcttctgatcagaacgtgtctgcaacacggaaaccacacgtagctcagag

SEQ ID NO: 27815 - DNA, 573 bp, Bovine  19866880713469
gggctgtggggtgcagcacaagaccagcgtgtccggggtgggcgcactcactggtggagggggatgagaacttgaccacagcgggctcccggctgaagctgtcgttcccgcaggactcgcagccgtcgtcgtactggtaggtgtccagcacggacaccttgttgggtctgcagaaggccaggccggagggtggtcagcctgggctcaggcaccacgcagacccactggcacagagctcccaccaaggcctcctgcctctgcatgggctgaggcctcaaggggcacagcccagctcagacccctgctctgggggccccagttcttgccctcaaacctgaggggagggcccacgggctctaggcgacattgcagcctcccgtgtgctcgtgaggcggaagcctgcaatgttacctgaacagaaagaggtagcgctccttgtagctgttgcggcccagcggctcactgaccacatagtggtaggtgtttgggtcatccctggattgaggagacaaaggttccagtcagaagttggtggtatggcaagtcccagggacctacccaacacctgtgtcc

SEQ ID NO: 27816 - DNA, 1128 bp, Bovine  19866880722200
tgaaggcaaccgtggcttcagttggcacacagaccccactaggaagccaccagccctcacccccgagagagaaaggatataagatagtccaaggggggtggccgccgttgatgtagaggacgtaggtaaagccatctttgaggaccccgcggatagagtagtagtaagggagatagtggtgctgcttgaagtctctgttctcgtagaagcttatggctgtgttgttggtggtaaggacgtgcaggtagatggctttgcagtggtcctgggcagtggttgatatgtgatcctttagactctcaagtaacagggaccctgaggggtgacaggaaaggggcggtggggggaagggagcgtgaggcaaaggctgatcttgcaaaaccacccattgccggagtccctaacgtccgaacccttggtggggcttgtcagctgaggctcgaacgtcccggacgaggatgtaagccagccacagtccctcccaagggctggacctacagtgaaactcactgcccttttagcccaggaaaacatggagtggaagggactggttacgagggaagatcccgacgctcgctggccgcgtgggacaggagtttggagctgtgtgggcggcagggcccccaagggtggcaggcatccgataaaccatggttgggactgttccttcaattacgcacgagaggcacggtcagaagggccgttctctgatgaggatgcccagcaggggttattcatctgatctcaccagatctgggaaggaggccacagcagaaagacccagcgaaacgtggaaagaagacaggctgaaggctgagagtgggtggggccggcagacttgtcgggggcagggaacgaaggaagggtgcgagtctggccccaacagagggccgaaggatacagcaagacagagaccgagcaggtcttctgagatagtcggcagggagcaggggcgagctggggggacttacaggccccccttacctatcccgtgcttcctgaactccttcaccactcccaggctgaggatgtacgcgacctgtgtgtccacggagaagctggaggccagaatatctccgtcctagagagaaagtcagagaccgccgggtcagcagtggaggccccggt

SEQ ID NO: 27817 - DNA, 675 bp, Bovine  19866880832988
atctttctcctcacccccattccttgtttggccagtttcctttttcaagtgttctaccaggaccacagcctcctcgatgctctgtggatgttgcttctttatgagagtctgggtgtccccgggcagaatggtcaggaactgctctagcaccacaagttccaagatctgctcttttgaatgaatctctggcctcagccactgacggcataattcttgaagctggtcaactacctcccggggtccagctgcttcatgatagaggaagttccggaagtgctggtgagacctctcaggactgagactgtccgtctgtggggcatgtttcttatgctgactggcgttctctgccacaggtcctttggtctcccaaagagctctgatctgagggttcgagaactcagccaccttcagatctactgtcatcattcttctccaggaacaattctgctcctgtattagacaccccaccagcggctacctctgacaactgaagcccgatctggttttgaataaaaccaataaaaggatcttcttcctaaggcactgagagcagaaacaagctcacgtcagtaagatattgtcacatgaactttattacttgctacttattatgagaaaaatgacctttaaaaatcaactgccaggcctgtgttttgctccttttctattaaccaa

SEQ ID NO: 27818 - DNA, 776 bp, Bovine  19866880837455
atcccccatccatgggcctaccattgccacggggcttcagcgggcattctggcgtcctgttggggggctgcggggcctgggggccctgaccgcctttcccggccagcaggtccaccagggctttcacctgctcggctggggagctggcggtgtggccctggccagtctccccacccgggcgcaattcctgcttcctcatggagtcggggactgcggccaggggctgtggagagaggcctgggcctgctgcctctgtcgtcccgcccagtggcctgggacaggtgaccgagcctcagggcccaggtgggatgaaggcccactctctccctccccggatggcgggcggctggccctcggtctggcctccaggacgggtttgggggggcgtggtttgttcctgggtggccacagtgggccctgctgccaggagcatcgccaggggcagggagccccgggctggaatctgagctttgccgcttaccgtctgtgcgacactggacgggccgcctgagctctctgtgccgtggtgtcctcatttgtaacctggaaacggggctaattaggaacaggtccaccggcgagaagggaagggtggaagaggcccacggagagaggctgcgtgcagtacagttccagccccatggccttctggaaacggcagagccacggagatagtgagcggacagtggccggcagggctctggggaggatgaactggtggagcgcagaggattgccgaggcacggaagcgactctgtgatactgcaatggtgtgt

SEQ ID NO: 27819 - DNA, 1202 bp, Bovine  19866880837787
aagatttaatgaaggaggtccttccaaaaaactcccccccattaataaagaaatatttagacttccctaatggtccattggttaagattctgagctcccactgcagggggtgtgggttcaacccctggtcaggggactaagatcccaaatgctatacagcacaacccaaaaaagaaagaaatattgactgttaccatctcacctggggaagcttgtgctgttgccatcaagtgtgcttcacctttgaggaactggccagggctcctctttattataaggtttggaaaggcttggaaggataggtaggtcctgagcaggtgaggagcagagtgttcatgacctcagctttctttgcaggaaggatgttttttggaggggggggcagggttggccagaaatggttacttacagtagcctccatggccattgggatcagattccctgagagccttattagagacaagcagaaaataattgtcccacctgtttcctggtccctatgagcccaacaatgaaaacaaagtatatgatctaacttcaggatcagaacttggagataaagcagtctgggtggagaggagttccagagaaaatcctttgaaatctccaatttcatcaccttgctaaactgggcttgtgcttatgtatttgacaattcagctattaaaaggtctttttcttagctcagaaagtggggttattgcagtgttatctgaatgagcctcttctttgtagagctagtgatgtatttgcggatagggaagctggagtgggggagagttgtgcttcttcctgtaaagcatctgatgtaaaggatcagcctggagggagagatgtagcagacagcacagcatctcccgattgagaaactccaggctcccagagcagacttctgtggggatgtcttcccagcacacagtgggtcacccttttctggggatggtcatcaatccatactcacaggagtgtgggctccagcagcccaatttagaacccaccatctcctcccagtgaggatttgtgatggatttggaactttgcactgatgctgaggacctgtgggttattcccagtatgacttggtctggatggggaaatccagaagcttgcaactctctcttgtctgcctcatagatggagaaggaacaatctatgcagaaaagcaaaaaaaaaaaaaaaaaaaaaaagcacagaaacaacaa

SEQ ID NO: 27820 - DNA, 981 bp, Bovine  19866880852301
atcgatgagaagacagacacggaggagacagccgtgtgacctcagaggcagagcctgggtctgcaagccaaggactgccggcagacaccgcaggctgggaaggccaggaatgacccaaggactgtccctacaggtttcccagggagcacggccctgctgacgacgtcctcttagactccagtctccacaaccgggagagaagaggtttctgtcgtttgaagccgcctgggttgtggtccttggtgacagcagccccaggacgggacacagaggggcatgggggcgggaggagcccgcccggtcctcactgtaccctcctcctgcacaccctgcccctgcccctagcgcccacctcaagctccggcagtagagcagctggggcagcaggctctggaggacgccggggctgaggcacaggggcaggggcgcctcccaggcgcagacgtcggacacctgcaggaggtaggccagggcggcgcggtgtggggggctggtcagcctggccaggcccccgctggccacggcctcctccacgctgcgggccagcttcggtgtgctgcagctcgcgcaggcagtgaaggacattgatggcccgggcgcagactgccacgtcggggcgcagacagccctgcaggagctcggccacctgggcctggtagccctggtgctcgccctgggtcagcagggagcccggccagcagtgcgttgacccttcggggacaagaggcctgagaggaatcgcaggaagacgtcgagcccgcccgtcctcagcctgcatggcccgctgggccgcactccggaagtgtgtgaggaagcccagccggggccaggacacgccaccctcggtgaaaaggtcgaagatggccctcttggaggcgctgcagtagtacgcggccgccaggaactcctgcagggacaggtgagtgaaagcagtaggcggccgcggaggccatcgtctcctcccgctgcaggaagcggccg

SEQ ID NO: 27821 - DNA, 862 bp, Bovine  19866880887937
tagaaaagatattgtctgatgtctgagtagaaattttaatgaaatgcaaagcattaacgattgtactggatggttgtattcaagataaatgctgtcttaatctttgagaagtaatgaatgctgcaggtattgtccttccggtcagaagactagaaatctgcagggtggctctgattgctctgcaccgtcagatcttctcagtgggttggaattggtcaggccttggcgatctttttattaggttgaatcctatagaactgccaacgtttggtcatctggcttagagaaacaatagtttcatatggttcaacctaatataataacggcttttcctgcacttgtatgtattgtagtgtgataaattgccgatgaattaaaagaacctcaccagctgcattctcactgcggcctaaactatcactcagcttcacccttagtttgaaaaaatagttaatgaacatgaattggaactctgaaagcttattaaaatgtttgtgttaatttgttttattttagcctcagatgcaaacatcagtgggaattgtacccacccaggcgattgcaacgggccccaccgcagatcccgaaaaacgcaaactgatacagcagcagctggtcctactgcttcacgctcataaatgccagaggcgagaacaagccaatggagaggtccgggcctgcgcactcccacattgtcggaccatgaaaaacgtcttgaatcacatgacgcattgtcaggctgggaaggcttgtcaaggtaagtgccgtttgctcaggtcctggtggcagagccaggggtggacttgtctggtattctctggcacctctcctgttgagaaggttcccacttcccacgtcccca

SEQ ID NO: 27822 - DNA, 1203 bp, Bovine  19866880925569
actgtcccgtactgacatgataggtgcagatgcccccgtgacggttagtggccagtgccggggcagggccgcgtggactcttctcactgggcacagttgtcagtgataagcagcttagagggccgtgagcataaggaagacagtgcaggctggcggaggactcagacaggaagttcagttgcacttggtttggggtctctgaatggaatgcaggtaaagaagcagatttggagagaaaagattctgagtggtgagttcagcttcccatggtgttggggtcctgggggcccatagctgaagagtggggccttgagctctggagagaggtcagattggcagagagtcatagacgatacttgtaggaggtgacggcaggagtgttgctgcataggagaccacgtcataatgaaactttgagaactagtccataagccatatctagagctgggaattggttttgagaattcctcttctaaaaaaaatttttttttcgtttcattgtttcttataggaactgagaacagaagcagttgccagacctctggaaataaatgagactgaaaaagtgatgagaattgcaataaaagatattctggtaagattacttgtatttaaagtttttgtgcctagaactggaaaatagtgagttcctggttttacaggacagaacaagctgggcctcataacaaagattgaacgtgttagtggggaagtgaaaaatttagagcatgttctggaatagctaggtgatttactgttatcttccccttgttattgttttcgtgttactaaaattttgtcagttttattaatttaataattctcttaaaattttcagtaaatactgttttatggactcttcacaacttatttaaccatttcctcactgttgggcatctagattatttctaggttatcttaattctaaacactgaataaatagaatgatcatcatcctttactaatcatccatggttagttattataagctcattgcatctgaatcattcatttggaaggcagatagtgacagaaactcagactacttgggcttgaaccctgccctgtgtgacgtcaggcaggtttcttaacctttctgtgccttactttcctcatccataaaacagtccctgccatgtggggtcctcatgggcattcattatgacagtctgtcatacagagactcggtacatagtaggtatt

SEQ ID NO: 27823 - DNA, 1501 bp, Bovine  19866880946405
agaagctttccccgggctgcgtgctcagtcgtcctcaccatcctcacggcagagccttgtggcggcggctctgctgtgagcgctttgggccagtgagctcctctgaagcctcggtggcctgtggagtgccccctgaacatgttcagggtgaacacagggcctcagggctgcacaggactgtgtcctcaggctgcccctcctctgctcaccccgccgctgccagagcccctcattgtgggaggcgtgccagccttacacccccacacacctcctcttgcagagtgcatttgacttgacattggggttttcagagagacccagggggcctggaattgatataatttgtgcttagatcagtgtctcctaaactggtgtcttgggagctctcgtctatggggtgtaagtatgtctcggggaaaacacgttctatagttagataagtattctgactggaggaggcaatgataggaacagattggttctttctgcatgctgaaaacctgttaatgaagtttctgtttttgatatcttccttctagattgcagatttaaaagcagcaaggcagcttgcttctgaaatcacttccaaaggagcgtctctgtatgacttgctgggcaaggaggtggagctgagggtgagtggtgttcagatacctccgttacctccctaattacctcctcagctgagcagacttccagggtttcttttccaattagcttttttcctgttctcttggtttcattaaacagtacctgataaaatgagatacattgcaggaaagtacaatccatgagctgcagttcctcctcctggtgggctcgcgtctgtttctgatgcctttggcatctggttcaggaatggcaaacgtgtgccgtgttgcctcagctctccctcttgttcctgtagcagactttattgatcacaatgctttcgccccggtgccctcagcctcggcgtgcttcccaacaaaacgctcctccagcctgtggctcccgaatctcgttgcccagtggaatcacctggggatctttacaaactgctggtttctggcttccatgctgatgtcactggtacggaatgtgacttgggcatcaggagttttaagtctcctgggtggttctaacacttaatcagtttgggagccagttactaatctaggcagtcagttgaagttgatgttacgattgaaatttatttgcagtctttattttagcccctgtcagtcaaggtggatgctctgtcctctgtgtttaaggagctgttgaagagtgggttcctaaaacgcccttgaagctcctatagagcttttaaatcacccgacatccaggtcgtcccctggaccagtggattgaaatgtctgcaagtgagagccagatttttgaagctctgcaggtgatcccagtgtgcagcagagtttgggagctagctactggttgaagaagaaatgggagtgttggttcttacctgtgaggatttatggcattgcagcctatgggcgca

SEQ ID NO: 27824 - DNA, 1693 bp, Bovine  19866881020280
caaagccatgaccggaccaccatatacagtctcatttaaaagtttttaaaaataaattcatttattttaattggaggctaattaatttatgaaagtgaagtcgctcagtcatgtctgactctttgcgaccccgtggactgtagcctaccaggctcctctgtccgtgggattctccaggcaagaatactggagtgttctagtgttaataattagcctccaattaaaataaattaaaaaaataaaattattttttaaattcattacaaaaaataaataaaaataaattcatgcatacatatcatgggaagttcagcacatcctgactcacatattctccatgaaagtcatgataagatgactgaaccagtagaagactgcttaacatttttaccaaaacctgtgcctacaatagctctataatcataccacagctcactggagtatttctaagctttcagtccttttgttctataaagtcaccatttactttcactgtgatcttttttaaaaaggccaaattaggatttacttaacaaaaaatgtccttatttgctaccaaggatcagatgacatgacattaaaaagaaatgacatgaaaaagagaaaagcatcagacaaatgtacaggattatttctcttgctactaaatgttagaaattttcaattatcattccaaaataggaaaggcgggtcactcattcccaataaccaatttggctccattcctcccttagtgacaacatgctgctaatccatcccttcagcacgacagttctcggagtgcagtccctgaccagcaccaactacggtcacctgggagctggccccaccccaaacctactgtagaaggaactctggggagccccagcacgctgggttagcaagcccgcagtgactgtgctggacgccaagtgtgagaatcatcgctttatcctatctaaccaaaatgctggctgactgaccaggggatctagatctaaatcaaaaccttcacctataagacagctctagggaaagccaggcccctttttcctgactactttctaaaacaaaactaatattccaaaagccttatcaaaaacaagtcctaatctaaccctttgtgaagagggcttaccatacaaactatcttggtccctgatttcttttttttttaattacaaaactccctgacttcttatatattacttataagaaaggactgaacaagatttccgaggctgcaaaagcacttaacagccttggaactggaccccttgcccagatactctgcaataccttcctcttcctatcagtctgcttcctctgccacctctctacacggcaacaacacctccaggcaagagaacttgcgtatagcttccagtccccactttaaatatattttttgctgtcctcctaaaagacaagttttgattctctacagaaaagtagagcatgctaccaaaaaggtaacatacgaggtttcctactgttgaaacggagacacacagagtggagggaggagaggggcgctgaggaactccccatgatcacccagcacagccaggataggatcccacgaagcctggctgatagtgatagtgaaagtcactcagtcgtgtccaactctgtgtgaccccaatggactatacagtccatggaattctccaggccagaatacggaggggagcctttcccttctccagggaaa

SEQ ID NO: 27825 - DNA, 1068 bp, Bovine  19866881084854
caggctgaccagcctcctgatggtggagggcctgacggacctgcagctgagggagcacgacttcacgcaggtggaggctacgcgcgggcgctggtgctcagccaagaccatcgccctggacaggctcttcctgcccctgtcgcgtgtgtccatccccccccgcatctccatcaccatcggggtggccggagtgggcaagaccacccttgtgaggaacttcgtccacctctgggcccgagggcaggtgggcaaggacttctctctggtactgcccctgaccttccgggatctcaacacccatgagaagctgtctgcagacagactcctccgctctgtcttcccgcacgctggggaggcgggcctggcgtcagcagtgctgagcaaagccctcctggtcctggatggcctagacgagtgtaagacgcccctggacttctccaacactgtggcctgcatggaccccaagaaggagatccaggtggaccacctgatcaccaacattatccggggcaacctcttcccggaagtgtctgtctggatcacctcccgtcccggagctgctggccagattccggggggcctggtggaccggatgaccgagatccggggcttcagcgaggaggagatcaagacctgtctggagcagatgttccccgaggaccctgtcctcatgggctgggtcctgagccaggtgcaggctgaccggaccctgtatctcatgtgcaccgtcccggccttctgccggctagtgggggcagcgctgggccacctgcaccgcaagaggccagggcccccggacgccgagctgtggcccccgaggaccttgtgtgagctctactcgtggtacttcaggatggcccttggcggagaggggcaggagaaggccaaggcgagcccccgcatcgagcagctggcccacggctgccgcaagctggtgggcacgctgggccggctggccttccacgggctggtcaggaagaagtatgtgttctacgagcccgacctgaaggtgctgggcgtggacctcgtgttgctacagacggccctgtgcggccgcttcctgcagcg

SEQ ID NO: 27826 - DNA, 928 bp, Bovine  19866881105692
tatttataggagagatttcatgagcatatagatctgctctgcagttagtatataaactgtcattaattagaatagtaaagatgcgatgtttaaattgttttaattaatatgaatttttaaatttaaacgtttggattttttttttaaagatgtaatcctgaataccatctgagggcaaactctgagagggatgtagagtgaatcgggcctggcagtacatccacgcatacagtattgagaaaacatatctacggtagcatctgactcttgccatatcctttctctcttcttacaagtgaggtacctgggcctctggaactttctggaatggatggaaacaagcagtctgcaccttgagccacacgccctgaagatacctctcttggaaagcatcgcaggccacttgagcagagaggaggatgtgaaaagagccccggaccctgagagacaggcgagcaccctgtgtggggtctcctgggtctgtgttacctgatcctctgaatgcgacagtctttcccactcagcacgctgcccagcagctccatcacggggtcctggaactggttggtgtccagcctggtcaggaggaacagcggtagtgagtggtcctactgctgcccatgggcaggtgggatgaggtccctggcactggagtggccgctaagctcagacacctaggctgagaccctctgccgccccctcctctccatcccagcgaagcccctgccgagcgactcagagatctgtgccaggacacctgcgtgctcagaattctcccaccaggcgacttgggaggttcagtggcataaaccatgggcttctgaccctcagggctgtcttccctgcagcccccacagtgtgtgtgtcagtcggacaccagctgccctcctttaaggattgtagaatggccctggtcctccagccttcc

SEQ ID NO: 27827 - DNA, 1326 bp, Bovine  19866881135979
taagctgaacgctgtgagagttccaaggaagtgaaagttgatttggggatagggaaaagttacagaagtccttgagggatctgccctgcagcagagagtggggccatattccaggcagggggaaaggtaagagcagtcttgaaagcttcagagatgagcatgtaagaaaatctttagttcttttttttttttaactcaatgtaattagggtatatttagagtaaaagttagaaaatgagttcttgtacttctactatggagcctggaatggaagtgaagagatggcatttaataaaataaagtaatcaagagtatcatttgagggtttttgacagagattcttccagggcagctcatctggagctaagtttaaggtgggaacgaaaataagagaccattaccaggtcattatgctatttttgcttttaggtagactggtgttacactccaaggcgtagatcttgattctttttgagagaaaaggattaaacagaggtgataatagtatctgctgggaatttcctggcggtccagtggttagggctccttgcgtccactgttgagggcatgggtacagtccctggttggggaactaagatcccacaaaccatgcagcatggcccccccccccaaaaaagtatctgcctaagtcacttgaatatgtttcaaagcaggttcatttccttagaatttcaggttgtgacttagtctcttcaaagtagttgctgtttccagtctctcagaaccagtgggcaataagtctgccacatgtaattcagagcattgagatcctcatcatctggaccaagctgaacataaaattggaatttgttaaactgaataaatggagctctgccagctgtgcccctgagtgtctctggcaggcctgattcataacatgggtagggagctggttactgaacacagggagaagaaagtgggaaaagagaccctctgaaaggaagaagaggaaagaagtcacaaaatgctgaattgtgaatgagggcccctgatgactgttgtttgaatgttaaggataagggccacagttccttattcttgctgaggaagccactaaagtcccctgaaaatctttccttttgatttcacctttctctgcctgggcacagtttgagaaatgatgaatgtacagctggaaaacaatgaaagcatgcagtttattctgagacatcatacaactgccatagcaggctgaatgtttttgctgggtgactggctgggtttaatggtgcctgctgttggctaacaaacactctttccttttttggtttataatagtaatcgccttagttagagctgcctttt

SEQ ID NO: 27828 - DNA, 847 bp, Bovine  19866881173516
aattagatctgataaagtgcatgaagaattatggacagaggttcgtgacattatacaggaagcagtaatcaagaccatccccaagaaaaaagaaatgcaaaaaggcaaaaatggttgtctgaagaggtcttacaaatagctgagacaagaaaagaagctaaaggcaaaggagaaaaggaaagatatactcatccgaatacagagttccaaagaataccaaggagagataagaaagccttccttagcaatcaatgcaaagaaataggggtcaaactcatatagtccataattgtcaaagcaaaccccaattatctgatgtatttctatagttcctgaatgttatcatgaagtctgttgataaatccaccaaaatccacgttattcaaatatggcccaagcctcactctacaggctgttataaaaaatagtagcttatttttcttgtgatttcactgggtattctaactacaaaattaaaacatgtccaggtgatacagttttgatttttaaaaaattcaaaatatttggggggcagtgcaaaaggaagctgttgaactatataaagattttacttcacaacagaattgtacaacccctttaaacagctccaactattaagaaacacctactacataaactaaggcacaggtgtattagaaagactggcaaattaagagactgtcaaacagcagcagacgggacatctagaaataggaaagtcagatttaaccaagtgaaaatttcttcagcattagattttactattcttagcgatagttcaactaaacattcttttgattaatggaaatgaaacacgggggaaaatgacacatgggatgatatccaa

SEQ ID NO: 27829 - DNA, 804 bp, Bovine  19866881320701
catgatgctgaaacttgataatatccccaaatatggaagaatttgttataaataccacttgaaaatacccaaaatgtacacaaggaagaatatctgagagtggaaaagtgccaataacatacattatttgtaaacttaacagattaccttggtaaacataagaaacactcaagttaaagcttagtatttgggaatgctgtattgaatgcagtaaaagttggatttcattcatatggacaaaaactttcttctttgcctaaagatagtatactactgttcctgaattccaactctccagacatctcactgtcaggatggctttaagtctttatccaggtggacggactgctgcccagtgaccactacaggcagagcaatatgattactgctttcctttctggcagtgaggaaaatcagcttgtttcaggagaggagaagccacactgcatctgttacacaatattattctgtccttgcctttcggaggcactactttttattgagatttatcttatttatcttaagtctgttcttgtgagcagaccttttttctcaccttttttcttccttttgtgtcttttcctatattcagttagggagagtatgcaggtattcctgttattcctgactggtgctactgtaaagagagaggaggagaacaagcagcattcagaagcagggttctgaagattgatcacccatgtcttgcagtagcaacagctagacaggaccttgtcagtggtaactctgagttcagacctttacctctagaccagcactacatgagcctttatcccttttagg

SEQ ID NO: 27830 - DNA, 967 bp, Bovine  19866881337847
ctaaaacgaattgatgctccttttctctggtaatgttttgccaagcaactttctcatatcaacccagctttcctccctgggaaaagaacacatgggctgtggtggcaggagtggatttccttggcaattctagtgatgtgaagaatcacaaactggcattctgattccagtacctgagttctttgctgagttatggtgtgcaggactgattactgaattccagaaacttaaggggtgaaggactatgatcatgagacagaggagatgctttacagatggacagtctttcctgggctcttaaacttgcttaaggaatcgcagagcattccataaccactgaccacactagcatatccaaatgctggtagcaaacctgatggctgggactttggtgaagaaatgatttatttttatttctttatttttggccacagaggatgcaggatcttagttctctgaccagggattgaacccctgttccctacagtggaagcacatagtcttaaccactggacacagggaaggcccagtgagaaaatgatttaaatgaaactatttaattgaaagaaaaatagtcttgggaattccctggtggtccagtggttaggactccatgcttccactcccagagggcatgggttccatccctggtaggggaattaagtttctacaagtctcagggcctagccaaaaaaagaaaaatggtcttccttcaggattggatgaggcaaaagggaaagtgggatgtagacataaaggagagggtaaacaatgacagaggcatgtgggtagggagtgagggcagacagactgaaatattaagaagagacaaagagatggaaaaagatgatggatggatcaggtgcaaaggtgaagttcttgggttctggcctgattttatggaactatataagatactgcaagtggagaattaggaaaagtacagaatttagaaatgtacaaaatt

SEQ ID NO: 27831 - DNA, 835 bp, Bovine  19866881366440
aaaaaaaaaaaaacctcaaaaacattatattagcaaaaaaaaaaaaaagtgtctcgtgagaaaaagcaataaaaatcttattttaaccacagcttctgctttaacgtccaccagcatccagcgccacacgctggctgcgcctccctggactccaggcgcgccagcccctgaaggcacttgttctccaagcttctgacggtcacaccgagtgggggaaggggaaggaggtggatgaaagtgaaccctgaatgactgtgatccacacagaggttagggctgcagtgaccacacgacacgccgtccggggacggggacggtggcgcctggacggacagagcaccgcgggcgggctgggccgcgtcacgccctctctgagacgttgagcttcgtgagttcgttggcttcctccatccccacttcttcacagtcgcttttctctatggctttgccgaaccgacacctttcctcggctctgactggctccttccagggtctcttagcagacgggtgagcgtccctggtctgggcgttgttctcggaacctggggacacctggtccgggttctgaacggaaggcaccaggctggctatctcgtctgtgggggagcgtccgatgctgccatccacctggacccggatgtcgggtgagatggacagctggtgctgtggcaccaacccactgtctgtgcacttggggtacaggtaggtcttcatttggcctttgcccttgacgttcaccgtccctcggtagtcgaactcgtagcccatcttgctcaggacgcggtagctctcctcgctgacctggatgcggcactccacccccgtggtgtccatc

SEQ ID NO: 27832 - DNA, 890 bp, Bovine  19866881599560
acacatgtctatctatacacactggcttaagccaaactcttgtcttgcagatgtagaaattgttgctttgtttctctgataaaactggttttagacaaaaaatagggatgatcactctcttagaccatgttaatgttaatagagaagaagcattcttttctttcttctatgtaaaacttgaaatgaggaaaagccattctcatgtaaatcatgcaagcgctataattactataaataagaaaattcaagaaaatccaatcactgtatagaatggtaaagcaccaactcatttcttatatcatattgttaaataaactgtgtgcaacagacaaaaaaaaaagaaaaaagaattatctcagtgcctctgatggatagattatctcctgcctcccagttcctttcccttgtgtaccctttagatgagcccactaagcttactaacagcccaccatcaccctgttctcagtgtctatgactctgtttctgttttcttatattcgttcatctgttttgatttttagatccatcaacatataagtgaaatcatacagtacttgactttctctatcttatttaacttgctattattcccttcagctccatccatgttggctacaaatgtcaaaacttcatttcttctcatggctgagtaatattcccatgtctgtatgtatacatgtgtgtaccacatcttgttataaaatttttttgatgtctaaatttgttagtttcagatatgcataatattaagtatttttttcaaattatatttcattataggctattttaatacatttaatatacttccctgtactctatgggcttccttggggctcagaggtaaagaattggcctgccaaagcaggagacacaggagacggattcgattc

SEQ ID NO: 27833 - DNA, 857 bp, Bovine  19866882224422
agtcagacatgactgagcgactccgctgaactgagacattgttgatacttttaggcattattgatatatgtagatttagatttatttttagatattgttgatacattttagatatttttagacattgttgaattatcatcataacaactaccatttttggagttcctactttataccattaactgtatataatgtacgtacatttattttttcctaatcattgaaacgtacttggaatgcgaggattttgtattggtcaggacaggttcaactaagctgtggtaacaaatcgcccctaaaatttcagtgctttagcaaaacaaacatttatcatccagtcatgtaaagttcaatgctggtcaggaaggattcttaatcctataagaccatcatcttgatttctgcctggctcttaatttataaagatgactgagtgacaacataggagatcaatggcattgaaagaaaagtttgtcattattccctgttcccctagaaatagcaccttgacttaccatgcagggatactgggggaagcaccaaagttagttaagaggcagaagcaggaataagggaaaacacataggtccagaatctttattgtgttttctgtgggaaaggcaaagcagggcagggaaactgcttaggactggtttgaattatgttggtaggctctggggcaatagggttggtctctagttctctggtacctggccctgagtgatttagggcaggagaaatgctggcctggtatatgagagttagataaagaaggcagctgaatataaggacttgggatttggttggagggtttgtaatgtaatttttgtgcactcaagaaagcgggtcacagggga

SEQ ID NO: 27834 - DNA, 1609 bp, Bovine  19866880600999
caagcaactgacttgtatcaaattggagatttctattagaatacacaggcatatatctttcatttataataaatttaaactacaattataaaatagacatcaattggggtcagtatgagttaaaatgacaaatgctgctgaagaaacaaagagaacactaatgtaagtgcttttctttctttaatctttatttgatctgtatgcattggatttctaaacaggtggctaacatcatagaaacttgtgatgataataatagatttaacagagaataatactagagagcttccagaagcttaaaaaatcttaaattagaatcctaaatctagttaattcaacacagggtgtttcaaccttctcaagaagctgtttccttcataggtatggtcagtaatcacccactagaatgtaagcgttcatccttaactaacctctctcttaaattacacctactcttcgaatatatgccagtattcattgtattagattgtgtgaataaaaagcagtaatgtatattttcttcccttataagaaatattctggtggaaataactataaacaataaaacacaagtattcttacatccttataaagataagtacattgtattgtgggattttcttcagtaaaggttagtgattaatggattggtgtcagcttgcccagacaaatgttactaagctgctggacttacattatgactgtattatcaagtgggtgaaagcactgaaaagaaatcagataaaaatgagactgacttaggaggaaatgattggttagttgacagaaatcttaaaatattaaatggatctagagttctcattgcaattctaaggcaaatagtttgaaaaaacattcttgtacatattctcaatcaactaattgacataaaaaaggaaatgtttattgttattttcttaatatgtattcaaataatatagaaatatagatacactaattttagaataattttaattttaatgtgattatatttagttatcacaaatacatttatttaatagagtaagcctctttgattattataggctctgaatatttctaggcttcttcaagtataaaatattttaaaatcactttaatattcagatccataattcattagtgggcaggccctctgtcatcattttatcccatacccagtagcactcattaataaataataatcaaacttagaaatgaaagggaaaagtgatttcatgtcctttcaatatcataccagaacactgcctaacaaaatcacctaaggattatttatttagaggatctaatttgtttaacttgaagttgctattgattagaaagcaaatgctacattaggggttaatttgtagagaactaatgtgaaaatgattatttgtttggtagagaaggtatttctaaaagtgcccatttaggacactgacaacttttggatctcatgaagcaatctttgatttttaaatatttattttattgaagtatagttgatgtacaatattgtgtcaatttctgttgtatagcaaagcgattcagctatatatatgacatattatttttcatattccttttcattacagtttaccaaactcccaatccattcctcccctat

SEQ ID NO: 27835 - DNA, 1236 bp, Bovine  19866880603297
ccttatatttaaaattacaacctgttattccctcctggcatttctaaattatttttccattctatttttccgtagcacttatcttccctttacatgttgaaaaatttatgtacaaattttgttcattgcttagtctgcctcactcactagaatatagctccttgaaaatagggttcgttttaaacaaatatttcatgaactgtgaataaagtacatagaacatagtagatgttcaaataaatgtcaaatgaataactggattgaacaaataaccaaataaaaagagcaaagcttaaatcgaataatataaacatgattatatcttaggttttcttatcctaggggcttgatattatatgaactgcctacttccatcaggctattcataaactaaaggtaaataaatattcagactgagattattcactcattttcctgcacattcatttccagtagcttcatgattaatcaaacatgtactcttagagaatactttgaggagcaaggcttccatttcattgtggtttgacctataagttgaagagctggagaaactatacaagagtgtctcaagtactttaatcatggatttacaagcattaaattctttcttatgaatgtgttggtgctttcacatttttctaactgaaaacattccacagtacattagagatccccaatcctggttcaatgctgtttctagttaatgactgtgtatgattcacatagagtgagttgcaaggtgatatgtaagtaatttttgatatggatgtgaaaaataactttgagatatgagaaaataggtaggccaattgaaagagagtttttgaaaaggtctgaagaattaaaagagcatgttgtgtttaggaaatggtgaatactccagaagaattagttctcagagtgtttgctaggagcagtggaagattaatcaggaagagtaaagtatgaggagaattttatgccaagctatacttgtactggattaacaagtgctcttaagcacaagaaggtgaggactaattgggtagaacttgaaacaactgatttattttttgacaagcatgtttttatcacaccacatttattttgtataagagttttacttgtacattgttgtttcatgtttatgttggatataaaggtgtaaattagaaaaaagatataaggtacatttaaagacaaagtttgaaaatacaataaatttgagattcataaatgcagaaataaattagt

SEQ ID NO: 27836 - DNA, 1265 bp, Bovine  19866880723681
atttctccaacaagatagtccaatacccaacaggcatacgtaaaaatgctcaacataactaatacaaataaaggggaatgcaaatgaaaatcacaatgagtcatctcctcatacctgttagaagggccattatttttttaaaaaaggaaaaaaaggaaaagaaaacaagttttggtgagtatgtggataaattggacccctcatatactattggtagaaatgtaaaattgtgcagttgccctggagaacagtaaggaggttcctcgaaattaaaaatagaactatcatgtatgatctagcaatcctactctgggtatatatccaaaagaactgtaatcatgatcttgaaatggtatctgcgcttctctgttcactaccatccaaccatctcctcctctgtcgatggcatcaccgactcgaaggacatgagactgagcaagcttcaggagtaggtgatggacagggacccctggcgtgctgcagtccatggggtcgcaaagagtcagacacaactgagcagctgaactgatgttcactacagcaatattcatgaataccaagaaatgtaaacaaatatctgtcaatagataaataaatataatgtcttagccatttaagaagtaaatcctatctctattttctacattctttttgtcttgcctaggcatgctttgaaagaatatgaatatagctatttcactgattgattataatattccttgatagattgactcttaatggcttataaataatccctatccaatccccctgattctcaagtgtaggataactgataaagacctgaattatttcagatcagagaaatagctggataattcctactgctggagcttcaggatctactgatttctatctttaattagattctgatcttatacactattactgacttgattccattctttggacatgtttttaaaatcagttttccttttgaggtcctcttttgcagttcatcctgtaatttcaaacatacagcaaattttcttgcttcctagacacaacctgttgtatacactttgctaacagttgtccccattaacttcttcctcctgaattgtgcctcttgcttccatccctactaatttttttaaaattttatttaatttttaaactttacataattgtattagttttgccaaatccctactaatttgtcttaaagtcaccatgtctgaaactggcagaggacaatcaaaggacttatctctaagcactgtttttagaggcagcgacatgagatt

SEQ ID NO: 27837 - DNA, 678 bp, Bovine  19866881065582
tttatagcagtagtgtatgttctgtatcttcctaacatatttaaaataaactttgaactgttagaataaaaattatcacacactcctggaaaacaatcaaaagacaggaagaagaacctgaactgtactcattctagaaatgaaggaaataagttatgatcataaaatatctttggtaacagtcacatgtgaggatcttagtccattgattttttttttcacttttcaaaattctgtcaaatgttcgacaaatacatatcaaatcttagatatcctgtagtttactttaatgcgactttttactggggtttcaataatcattataagatttttgtatctattccaacctaacatgtggcaggctgagttattcaaaaacaaacagcaagtcattcttctcttcctagatagagtacttctcatttttcaaaatcatattccagcacacagtaatgcaatcatcatgctgagactgtcagtaataaccttcactacttaagtggcttctttgaacagctgctctgaaacaatttaaaatcccatattcctcaaaaataaaacaaataatgactatgactatcgaaacattggaaatcttaatgagatattggataaatacatttacatgatatcatcagtgcgtcagcaaagagtgcccatttctgtacatcacacatt

SEQ ID NO: 27838 - DNA, 1542 bp, Bovine  19866881180860
ttttaggatatatagcattaatccaccagaagaaggcagaagcttacagcagagtaaggagcaagtggacatgatgagctgtccttggattctagatacatcttagaactagtcagggtattatggtggtggcaattgcacagaccttcatcattatcgactggtcacttaagggtagataatttaaaaagataaactttcatcatgactagtgagttgcctttgttgtaaaaaattaaaatgtgtagtttattatcatctgtgtgagctaggtttgtcacattgacaaatttaattttggaattttacaatcattttgaagtttaactttcaatattttgaggtgttaacaatatcagcttgacttttagctcattaaaagtctttgtgtttctgttattacatgccatgagatggtctttttcaccaggagtgtcactagcaccataattaacataactactcctaacctgagatcattaagatgcattttgcttcacattggaaatctatgtattgttcatcttaaaagtcaacatatgtttttttttgttaatgaactgaagtggtatgggatttctaatttacttaaaacgaatacctattttctttcaagtgtctgactctaagagaaatctacttcagggcacatttcaaggtacattaaacaccatcaactttatccacacaatgcttttattattggaacattaaatgatcccctcctcaatctgagcacagcatctagtctctgtagaaatgagcagttaacagaaatctttcctataaatggaatagatgaactgtatcctaggttaaataataattatttcatacataaaaggttagttcaaccttcagagcacctttgtgtttaggtagtaacttgctcccaatactagagaaaatctggatcctgtaaaaataattgataatgtgatttgaaagaatcacttttgagcatctttacctgtcaacattcttatatgatgaattataatatttggccataattctcttgatgataccttggtggcatattgcaattatatatcacatgagagccactactatgctgtgctttaagataaatttcaccttataaaactaacctaagtaccaaaatttaaatatttctttcctgagaactgtatttggagtgagatatagcaccttaattttagaaatcaccacaaaggttgtgtgcatgaaattactatatatgtaaggaattttagatgtcatatcaaaacttttacataagggatgtggtaactaacaccaaatgatatgatgtggcttccctaaggtcatgcacacagtaacatcattagaagtaaatccatctatcctgagcccatattctgtgctccttgagtgatgcacagtgtaccttctggatttcagtatcatttctaaatttgtctatgacattataaaacaattttctattttgtagttcaacatcaaaaatattattcaacattgatgcaaataatttcaataaaatataataaactattataaataaaataaaatatg

SEQ ID NO: 27839 - DNA, 3406 bp, Bovine  19866880429725
caaacatgtagctttaacttttggatgtttgcttattgattatgcacaagtgctcctgtcaatgcatgtattaatcattagtaaggcttctttctctgttagaggaaaagataggtaacagtagcgtgaggagcatttctttcccgcattcctcttggcagtgcatgtaccctgtttcagagatgccttcaacaaagtgtactgttagtgaatgtccagcacctgttctgccctactcctgtggtgacccctgagacccagcccagaccctctgaatgagaacctctgtggttgttctcagataacgtgcatggttaacaaagactaggtgattcttctatattctcctgtttgaggatctctatcctagctctgggccagagagtgttaattccctgagaagacctaggagctttcctataagctttccctcttatctttcaaccaaatgaattctgtttgcccacgaagaggaagacacacacccttttcctaatgtggttatccataccttgaccccctctgcagcctcatcccatccttacttgttttcttcctctgtgttatcaaaagtcagaattctcttgttgttattgttattagaagtttaatccagtaacttggcatataccgttggactctcaacaccgattttattattttatagcctctttttccatcttgtgtgtctattatttttactttatgagctccatggagtgccacccatgggcccatggtggtcttgtaattcttttcttccttacttgagattttttttttttttttttgaccatcctattgagcttgcattttaggggaatctagaactgctctgtccactctagtcctactaactgcagtctcctaagtcagcgcaaccacatttcaagggctcaatagccacagcgagttagtggttacaatattagacagtgctgcacatattacaaaatatttccatcactgcagaaagttattttggagagggtttttctagaaccttctatccatcaatctttgccctaaaaaaatgtttgaatctgctcgtctacagccaaactaaagaaacatgaatttatctgctctctttttcagttatttgggctcctgaagcttattccacttcctctgtctggctagcacctccttatgataataacctgagccagggaggtagctgccctctatactcttactaacttttgagagtgaaaattttcagtttgaagacatgcagtgttagacattaacacttacttatgcactgcatttcttagaaagttacttgaggatgtgtttccacaaaatgaaaggatataatagtcatgcacgaggtgaattaatctgtgttctctgatgcgtctgactctgcggatgcattgactgtagactcagtagatatgtaagaacttgagctcttgagtcacattatttcgacttcagtcttaactctttcctttcatagctgtgtgacattggacaaataactatacttctctgtgccttagtttcattttttataacatagggaaaagtatttttaataataccttcatgtatgttatgatgattaaaagaattaattcatttaaaggggtctgtatggtgtctggaatgttatgagcactcagtaaatgcaagctgcctgcatcctcttccttctccttctcctcctcccctcctcccctccctcctctgtctccttcttatcaccctcatgtacaaagcatgggattttgaagataactaagaatcgtttgttcactctcctcacagaatttagaacctagcataggaaaaagagaagtaagcaagcagatacaaaagggcgatgccctgggttgctgatgagtgtcaccccctttgtcatgggttttcctatcatccttatgcttcaggttcagggccacgtgactttctttgacattcggtgaaaactgacgcactgtgtctttagcagcctcctatcaagcacttgtgacacctgtaagacctgcctgtccccttctggatataatctcaaatttcctgaatctcccaggccttgtgaattatattcccgacattcctgcagacatacacagctaaaagtatgtagaatttcacagtcaagggcgagccaaggtgtggcccctgtgggaagaaacgataagtgctcgttgggtctctccttacatctcattttaggatgaatgtagtcttggttgttttccaagccagaaggcactcgctttgcttttgcttcaaatctatgcactttaaaaaataccatgacattttgcttctgagacaaaagtcaaatgccaaaaaaagaaattcacctctacaaatgtgagtattaaaaacttaatttataaatgcaaacaagatcagctgccaagatgccaacacagttacttagtttgcagacttggagattgtgggcaatattcctcgtgcctgctctacacctgtgtatttgctgccttattggggattgagagagttgttggggttgacattggcatccttccctgtctgaatacttaaatacagttggtgggctggagattacagtcctggaatttatttagagggaaaataggaagtgaggtaatgaatcgggcatctggtgttctattcgctgtactcacctgtgtcattggcagaccgccctgcctttccatgatgcctcagtagggctgtcagtcacaatgttcacttccccccacggccctacagggatgagtctctcgttcacattgttctaggcgtggactctcttgcccccgggaatagcacagcacataagtagatgcttcccaagaggaagggatttgtttcatgcttcaaaggtcagaagagctcactaagtacttatggaatggataagagtctcaaatattagttaagaaaccatttgtaaatttgtaaaaggatgttgggagatggaaaagttcctgattgccagaggaggggctgagctagggaaggtaaagttgtgggtgttgggatccatcttcccccctgggaaagacaatctgaggatacatggaggaagacagggtgagatgggagggagaccaagccctcctccatcacctgcgtcttggtcctgcctagagatggcaccataccttcctttcctatttgcatgacccagtgcatttctttttcaccagtttgatttagttttctgttacttgtttttttaaaaaggcttatatcagaccttccccatgatgtaagagaatggaacagagccaaaaagtgcatctacaagttgagaaggcaaccaattaagtacagacatttttccagaatgctggggtaagctcagatttccaaatgtggcctaccactctgcctcatggccattcttggccagtcctctggagtggacactaactcaatttatacatgc

SEQ ID NO: 27840 - DNA, 1737 bp, Bovine  19866880441589
tctatgtcctaaagtttgtaagaggtctgacctagactcacaagcaatgggaagtcattccccaaaccacaaacctaaaaaattctagtcaactctccacttgattccaaatccgccctccatatccacctacatgcctttcattttcacagaaatagttgatggtttggaactgacattaggccactgattctatctcatgcctggtttaatcttatttaaactgaaaaatctggggttttttattcgtgttttttgttttcccttcactgcttccactgacagaggaagcatttgagctattcgaactaataatttgggaatcaaaaatttctataaccaccatttcttgacaaagcaatttttgatgagaccaaagtaatcattaaaagaaagttaatttatgggagtttgcttgacatcgtagtaattagtatttttttttcccttgaaaatgagcattaagtgtcaacagttaattgtaaaagaaaaaggctcaaataccattttgcagtcattttatggagctgatttccctccactaacagggcactggcattagaagacagagtaaagatttatggacttcatctccattgctgtaattaactctgttgaacaacgctacacttctatgaggcattagaaggacgcttgctaagaaggttgaatctctggccaagttctgagatgtttcatctacctgaagagttcagagcatgatcattctactattctctataaagtcctcacttagtgtcagggtctatgccagacactgggagctcattacctccatatttaaagggtgtgaactatctgcaaggaacttctatgacattaggcattagggatggagagggagggactgtcctaaagaacttgaccagctcttgtcccaagtttccaagaggggacctctaaatcctttgatttttccaagtgagaggagtgtcttcgtaacttgtgggcagtcccttggaccacccctgactttaggctagcgagatgacatgtggtggctcctgtgtttaagctaacatagtgatttagcaatcgaaaccctctcagatctcatcctatgtctcttcttttagctcctcccaatttctatccttttactattaaaaaaaaaaaaaaactgtaatagggagtatggcactttcctgaattctatgaatcattcatagaattttcaaacctgaggatatagaatgagctcccaaattttgtagccagcaggtcagaagtgagagtgccctggggaccccagacttgcagctgatgtctaaagcagcagggaggagcacagtttgaggggactgtacccttaacttgtgaggtctggcctaactcagggcaggtgagtcactgaagaggtgaacaagaaaaagcccttatctccatgggacttgtatcctcctggacaaagaaggcaagcacaggtacaccgagcagaaatcaggatttcatccagggagacccgccctaaaggttagtgaggcaaatgcaaggggagagacaggctagaggaaggaggaaagagtgtcagggcaggccttcctcacctcagagtggagattcaaagaagaagaaggaaaaattcttgaggatggagacctgaccttgcccttctttgattatcatcaagcaggacaatccagggaaaaaaaatcaagtcaaaatcagctaccgacagattctgcttccccaaagagactctgtgtaaaatatcga

SEQ ID NO: 27841 - DNA, 1884 bp, Bovine  19866880509629
ctcatgatgtactctgcatataagttaaataagcagggtgacaatatacagccttgacgtactcccttttcctatttggaaccagtctgttgttccatgtcccgttctaactgttgcctcctgatctgcatttaggtttctcaagaggcaggtcaggtggtctggtatttccatctctttcagaattttccacagtttataatgatccacacagtcaaaggatttgacataatcaataaagcagaaatagatgtttttctggaactctcttgctttttcaactattaaacatcagtagataacaaatacaacagtgttcctacgtgtgcacatctgcagagcttaggaaatacacatggagaagaaaaaaaaaaaagcacaactgtgaaggttatgaagaaaggctttccaccaagattaggataggtagtcaaaattaaatttttgcaggaacccacttttgaaacatgaaagttatacacttttttgctagatggtgcatctggctgaaggtcttgccacaaacaagatttttcatcattctaggaaaactgttgtaagtaattagaggcagaagtagactttcacatttacttatgacttaggagtgtcctatagattcaatcataaagcttttatccacaataaagcatgagcatggattactgaaattcttaatgaagtggtgtttccataatggtatgatttcttacctgttgatacaatgcatctttgtctctaatttcttttcatgggatatttggacagataacacttcataaccaaagaattatagagaggacaacaataggtaaatggctttactaaatgctttcaagcttttccaaagatcttagcctgcatggaagatgagtcagggttggttcctaaaccacagcttactttacaacactggtttttattccaagttaatgaatcgagggagatgcacaaagccataatcacttactatcctccacaaatcctaatgattatgtctgagcattttattaccctgttttcctgtattcgctttcatcttctaagagggctttctaacttatagacaaggtcttgctaggaaagtgagtggtaagaaattcactgtgaacaacgcgagagctgaactgtacatgacagcagtttatatcagaaaggcaaggatctgaatcattgaatatataacttgcatcaggacagagaaggtgagaggggctgggacttcgaattcggtagcacaactccaaggcagcaagcgagacccagtatttcaggtgagcacatgtttatactctattctagaagagactgggacaggtgttgagatggctcagcctctcagtggtctgcccactacacaagtagacccatgaggactacttaatcttgtcgttagttttgaagggtctgttcccctctatgggtttgcagaaatcacacattataatcacatcagaacatttctacagaaactctacgtctatcaccagagatgaaattgtactatgaggtatcagctatctgtgatgctcatggctcagcatctgagtccttccccaccagggagactaggaaagggaattctgaggttgatgtgttgatgagaccatatacacagctacagctcttagccctgttgagatccagctgctttttgggggattcattttgagtttctgcacaactgcaaggctgtccctcaaaatgatgcatggccattaatccatggataagtccaagtacaggggttcggctgggagaaagttatgaaggaagctgggtgaaaattcattgagctaaaaatatagatggacttgaagacaagccaaattaaaaacatagctgactgtcagtgtccaaattgttactgtgcacctcctgttg

SEQ ID NO: 27842 - DNA, 2594 bp, Bovine  19866880512683
tcaaccccagggatcgaaccccaggtctcccatgctgcaagccaattctttaccatctgagccattagggaagcccaggataactgagtaagacttcccttgaaatagctgtcctgtcagtttatttttcttgggctgagcctatcagccatcaagcggatggccaagggaaaatatgtcaaattccactgaaaacagatatatcatattattcttttcaccgttgagcaggcacagtgctgtggtggggagtagccttcgattgtgttgactgtctctggcatctgaccctcctgtgactgcatttatgtggcccagaaccttggtacagagaattttccattgtgcagcttatctaagtggctggggctcctagattctgggtctcttcacattccaccctgccccctcctctgtagcttctctggtccacccagtgttagctaggtagagccaggaagcagcatttggggaagcatagccttgctgctgtgatggcgaagacacaggaagaggagagagtaggaagtttggagcagccacacccaggaaactccagccatttatagtaatctgtcctatagggcaacgagtaccagtttctccctgttgaagctgtataagaactgtgatcatttccgcttagacccacccaaccccctttgtctgactcactcactcttttttccctatcaagtttattggagtccgtatgccttcttcactgaatatagttcttgtcttgacttaatatagttcaaaaatcaactctggctttacttaaactcaaacagaacccacaggtgggctgcccacccccccacccccaatccatgaagtatttttaaattaaaggaccactgggagacccgggcccttcgtcaggacctagggcatgtccctcatgtctcttccatccacatgctgatttctcctcacattcagaaggcagctctggagggagcctgtcagcttggggaaggaaaccaagcagataatcaggaaatcaagtattcaccgggaatgggtatttggagtgcagcaagttcaatttggcagataatttgcttcccacactcagctttacctacagcacaatgaaacacatttcaatctaaaattgcctcctaactccaatcagcattaatttaataatacatattcaacagatataaacacttccaatgactggaaaaatagtacagatccacatgtgtttatgctgatattggagtctaaatacgatttctttcagagacagcaatggaagtgtttctctgcttcccacccccgcctcccaaaggtgaaaatgcaatttgcaaattgctgagggatttactattggcagggttgagagccctgcgatacttagtttttctgtttgttcactagcactttttctgctgggcctcactgtggtcccgtgactttcttctctagttagaaagcagttctgcctcttttagttggttccaagaggctcagcttgatcatcagtggtgattttattttcttctttgttgaagaaggtgggaaactgagaaagtattagcatattcttgccaccttaggcaagggtgctatgcaaaagcctttagaaccaagagaacatccagaaatggggagacttcacggagtcctgcctagaagttacactgccccccaggcctcaggacatccccaagtagagcttccactcagggaaaaatgtgaaagagttaatactccccagcaactcagatggctttttgttgttgttaaaagaaagagtttaacagttgaaaaactaattaaaaaaaaaaatgaggctttactacaaaagcaaatggtaatgattgcagcagcaggagtcttatacccttaactcttgtcatagtcttattttcacaggttaaacatgtgaccttgatacacatataacatgaacatgtgacaatttaacttaactcattcctaaggacacagatgagatgttcaagctgattataagaacagttgagaaattggacatctatatgaacttagaaatgttagcctgagtttgccaggtttgatacaaaggctgattaatgtatatagaataataaaaaccttaatgtatggggatatcttttgtactgggcataaattaacaagttaacacgtaactttacagtgtcttgagctccaatcagatagtaaacagttgtgtcaaacacaagtacagtcttccagagagctaaataattcctcgcaagcttgttaagagtgccttggtatgtcagtaatgcaaaatgccactgttccctatgcctcccctcattgccaactgttaggtaatgatcaaagcagattctcaagcgctggctcatagtcacaatagaaccttgtaatcactgtccagatttctctggctatgtctcatgccaagagctcccctcccccacatcactgcatgtccccaggtctctggacttgaaggctgtgtggacttttctcctgccacttctctcagattcttttccttcttccaacttggtggttccttccatttccaatgtcagtctcactagatcttcaggcctttatattttttttctatcacagacatcaaa

SEQ ID NO: 27843 - DNA, 854 bp, Bovine  19866880603368
aatgggataaggtgaagggtgtctacacttctcagaagtgggtaccagaaggcatttccaaaggtagtgtcagcatgggcagtccagaacatttttccatctgttggtttttatcagaaatatctgaagtcatattgcataattaagattgctgtgacaaacaatttttaatgctttcatgtgcagtggtattttccccaaaagtcatttctgttgtcttaagtggcaaaactaggaagatccattggaaaatataaatgattcaccaactctctatggagaattgagataaatatttatgttggtcatttatcattcatttaatactcaggggcttattatatctatacttactatgttatctctttgaaatattcctatgtgagtgatttttcatagcagccttagagaggggtcctaagagatgagacatttctgcatcttaataccacatttgctgagcaactaccttctatgtttcaagaatatgtatactctattgatttacgcacagtggacttctgtgttgttgtgctgattgatatgcctgctagacccagaatcttatataaaacagcttgaccttaaaaatggtactttatgaaagtgagaaattaataaactaagaatcataggcaatagctttggagtaaggacttccatcattttgccttgattgaatcaacagcgtcatcttttgcaccaaaccctaagtcagtgctttgtttatgattctctatacccattccatgtctgagctccaaatccctgctcacctcatctccctggcctggaatgccctgtttacttcactttctaatcggctaaatcctcttcagatgctttaagactta

SEQ ID NO: 27844 - DNA, 1644 bp, Bovine  19866880655974
atgaattaaaagaaaaaaaaatctacgagcaaataaaggaagaaaggaaggaaaataatttgagcatgagaaagatctcatgaaagtattgaagtattagctggtaccttgttggttaagcaacttgagcctcagtttagatgagatgatgcacagatttgcccagttcagtcaggcatgaactccacatgcatgcccatcaccaccatcatcatcaatgctctcactgttgcattatgatggttatcagtccctactgatgctcttaacaagctgcaagtacacttgcggatactcataaacatatctgcctcatggagcatattaaaaacctgctcactcatttcacaggcaaaggaagaggggccagcaaaactcacattgagctgaagttcatctgtccactgtccaatcagtcggtagccggggttggtggtgttcgtggtctgatactggaagatgtcgtaacgcccaggggcatccccattcttgttaaacatgactggggtgcccgcactacctggggaagacaagacagtgacaaattttatagttaaacaagattccgtcaatctcttgtgccctggggaatagtctgaagacctagtgatgagcaaggtagcctagaggtagccctgttgtttaacaggttccccaacatgctccctgaaactcctggacaagtcatcactatgctctgtgaatcagtagataaggtgggaagacaatttgtttcctccttggaacatctcaattctttaatgtcttaaagcattttattctactttgtcttctcttgtaaggaataaaaattaaatgcattatttttcagagaaaatcttaagctttattgttgttgttactattattattttagtttctaccaaacactaaattgtgcataaagaatcaagacataataaatatatttttaaaatgaaatacaagagaagtgaaaaacaagctcaaaagttcacttaaatacatagttgaatactgattgcatttaaaagtatttttggctgattatttctaattggctttaaacgataagcagctgaaatgcttagcagtttgcctggtgaatgcttaacaaacaatggattctttctcaattttctatttgggtcttatttgaaatgtctatcttaagactgtaaacaattagatagtgaagccaatttcaaaagactaatgcattgttttgaaaaaatatataacttaaaagttggatatgagtgaaaagttccttaatattaaccatagggaacaagaggcaaatcacatacaaagtataaaagatgtgaattttagttaccttaccaacagttaaagaagaatcaccagaagtttataactgagcattatttcactcatgatctctgagaaataggaaaaataatactggcttcagggtatgtgacttcagggtatgtctgctctgcctataagttaatacatgatctatatttccaacagaaaacagtgctctatttcctgctgtttacaaggaagttcatagatcaattacaggctgaaacagaatcactgagaacattttgctatttttagggggggggggcaagtaaatcttagataaagagatgaaacactttcgataattctcattaaaaattttaagat

SEQ ID NO: 27845 - DNA, 1355 bp, Bovine  19866880673464
taccaataccagtgatgagagagaagagctactggttccaccccttcttgccagactcctgttattataatctggcactcttgattgaatcctgtaaactgtcatttatagtcaaggttatctatacttttaatagaaaaaaaattaactatcaggaaatatacacacaaatcatgcaactgactatttaccaacttcgggtgcgagctagcttcttgttggagcataaatgatttcagggcaatttcaaagaaccacttacctttcccatgcatatccatcactgtgttaaagctcgcttccacggtgtgatttcaaatggaagacatcatgttccctgctaagataaagaccttcgtgtcccattcagttactgtgaaggctctgttatactaatgccacatgataaatcaagaatgcctttgttatttatgagaagttttgccttcttggtattttctcactgcatcttttctgtctttcttgctctctgcttgttatttcttcctcactgtcatagctaaaaggactgttcagtagggaaatgaaaacaccccctacatcgatgagtggatgaatgtttgtcaggaggttgtaaggaatgaacacttattgaccaaagagcttgtctgaatagcgggtgagatgactccgagacgtgagacaaagggtgtggtgagacaactacttctcctaggctccccttacccccattttccaaggacagagatttctgtcttggaaatctctttgggctccagaatcaatcaaatgagagagggtaaattctggggtcagaagttcactgaagccacttttattcttaacaatgggaaactggctgtgcagctgtgtaaagaccagccagatcctgtttccaggcatggaaaacacactcatgaatttgtccaattgaaggatgggtgggggtggggtggggggatgctgctcatttagattttaggggattgtttactactctcaactgaagaatcttttggagaagttgtctgtagacaggatcctatcaaattcacgacatttaaagatggcatgagcaaaacatccctaggaatggcagggctcaccagagaaaactgggggtgggggtcttccaggtacagtaaccagaaaaatgaattctcttagacgaaggcccctacttaggacagacaatgtaacataaacaggaaggccgtaatagcatcgattacggggctggcttgcttaagtagctggagtagtttaggatgacatgtgctcagtggttgtgctattttggttctgaagggtaggggacagtagaaaagggagagaagcttcacttttcattaggcccaagacatggaacaaga

SEQ ID NO: 27846 - DNA, 1318 bp, Bovine  19866880795093
agttgccccataaaagagaactgagaaaatgtagcaggttttgaaaagtggacagcaggattctggtgggcagaatttgccattctaaatacccttatcctttctccctgcttctgaaaaagctcatgcctggaaatggaatctcatttctgtccagcaccgaggcttctcccttgctggtggtaatgagccattgtatctggtgagctacaggttgccagcagatgtccagaagcaaggacatatcagttttcaataggacacgtgtttgatttgtctcaggcctttgtatttgaatccaagtttctagcttgttataatttctgcatttggataatttacctgttgcctctctgaagaccagttcagaaaggtcatggactgaaactctatgatacgaaaaaacctttggctgaacggctgactgtttttggtctctcccggggcggggtggggggacaataaatataccagcagttgctatacattctatcactggctgtaaattttccaatcaacctgatctttccaaatctgcagtcagcaagaaggctgtgctttgcatttatctactaggaaagacattagtcttatttcaattatatttttaagatcaaagttttggaagtattttctatacatttttctgatgatttcaaaatgaaaactcaaattggcccacttctaattcatccatttttagatagggaagaagaaaacagtcttcaatcagcattttgagaagagtgatagaaaagaacgatccattttcaagaaattaagaaaattccaggaagataaccaatgttctgaatttctacactttcagtctttctacagttagcaccagcagtctgaaaaatgaacccaaagccctttcagaactcccatctgagcagaaaaagattaaatcatgctcaacatgcttcaccaaataaacagagtgaaatgatatgtttttgaaaataagaatttcaatggtaagggatgaaacaaagagaggttaccaggtaaccccatcaaaccagaaaattcaataagccttgcgcatcccttcccttgcccactacttaatcagagtgttgctggaatcagtttgaaggaatctacttacttttaaactggctgttttgatgtcctgtaaatacagcccaaatatccatttctgcaacagaactgaccataaaaaatgaaaccattcaacccatgggattagggtatccacattaactatattatgtattcagcttggacgggggctgtttatttcattgcatctcagtgtcctcggcagcactgcatgagcacactggctcta

SEQ ID NO: 27847 - DNA, 3025 bp, Bovine  19866880877535
tcaaagaattgtggttcatggtctacaacgatagtgacccctagcaattccctagcaaaaatggagagggagaacagagagggagaactcttttgtagaggggaaacagatttgggagagtcacagtaaacaaagagtggatgccttttcatcggctgaactgtgacagtctctcactggctgagctcttgccaggaaagaaaggaaagtccttctctttcatgttggactctgctctccttgtaggccatgagaagtcagtctggcctcctgactctgttttaattaaggtttctgtttatttttacaatagtagaaagtagccaggagttgagccacttgttgctttatcttggctccagtacggatgcagcgatgttgttattgttttctgaacctcacaatattttaaatacgagaaaattccacatgaaacacctgaaagtccttcttatgtttgaaacttggaagagcctgtgacctggaccccacactcctacgaggcagaagtccactggcgctgggtagctgctgccctctttacatgcagcatcctcatggtccccacgggtcctccccggtctagcgtctgcctcacctctgtaggcaagtgtgcttgtgactacagcggactctttaggttgctcaaatcttttcatttctatcttcttctttacttcaagaatagactgtgtttgccaggtaagcagttgctgcattaagtgcttagaactttttagaatttttccatatgtattgtattaattttcataattatggccgtgaacttttaagttcagttaggttttgtgtttacccttttatatctgaaattatttcccaaatcttaaaattgatgtgccattttacaaagattggcttgctgtaactttgaaagaagtccaggtttcctttattctcttaaattatcaagggaatcagagataacttaaagaaaatgagggaaaaaagtcctggcactcactgttatttgctattgtgctatctaccacctctgcatttttagggagtccaggaaattgtaactgatggggaaaaaggcgtcaggtaggagagaaacttaacataagagaaataatataaaaagaactgattaataatggggtattattattgcatataataatgtagagagacttttagaaactgctatgaagtaggtatactcccaccatactctcaatgttaatttcaagattcccaaatttaagcagcatgccatagtttatttttttccttagaaattatttaactgttttaggattcacatagaaagagtttaatatctgccaaacctcctatgagacaacacagttttcctcatctcaatatatgactgcccgaatctgattttcttagggagtctgtagagcctgtgggaaaataatcatcagatcggatgtcaggtagaacctagcccaagtctttgctctggtactggataggatcacacacacagaagtcagttcctgacatgctcagaggttgtctctcttcctctgtgaaaagagacagtaacaggacttactcatgaagaccaaataaaatagtcttcctgtatcacatagcatagtgcttggcataaactaacacaccataaacattttgtgttttgtttatggcacaggaaacaattagtaggatgtgaatattccttcactccggataactcttgagaagtcatcatttcttactgaaatgttttgacaattgtccgtttttaaagagtagcctatgatatctaataaaaatgggttgatgctgtttttccccatccctgggacatagtcagaatttaggagcaaatgtgtattacatttatccttgcatctgaactatagtctatcatgcaacagtcccacctattctagagtgaaatatttagcagacattcagtgctcgtattcgcttattttctgtttacaaggtgaggtgttgactccccctgatcccacaccacccctagagtattgtgggacgtgtgaggtgtttgttttgttgaggatgatggtgagggttccgtggtactgaaagttcttacaaacttgtctcatatcatcatataggcaaaagagttgcttgggtcttccacctttcatgtggttgttttgaggtctgataattttaccccaatcttctgggttgctatgagacttgaacacctggtaaatcactatgctataagttattatgtaagctcttaacattctaaacccagagagtcagatgtcctttaagaaatgaaaatcaagcatgttgttccctttgagactcagagcccaacactttggagaaaaggatacagagaaaggaaaccccccaactctggagagaaatagaccaaagcctatgaaatctacttgagtgcaaatcaacacttttaacttgggccttttaagttgctgcttagtatcttactcagcttgattcctaacttacttaaggaaggagggaagaaagtgattgaaacatccaaaaaggcaaaatcaaaccattccctcttggcttggattcaaaggaaggctgcatatttaaataatttctgtttttgtagaagtattgaagagatttctttttactttctttgcttcttcctttactgtttaaaacttttccttccccttttgtgttgctggtatttattataggcatcacataggtaggtatttgtctttaataaaaggatgcagccatttaactctattgtgatatgttgtcttatttcttccatattttttgtttattatctattagtcttttttcatattttctttatttaccttgtgttttcacttataagatgaatactttttgttttgtgctaatttaagatttcatctgtgtatttttactttactattcagttcagttcagtcgctgtcatgtccaactctctgtggccccatgaatcgcagcacaccaggcctccctgtccatcaccaactcccggagttcacccagactcaccatgtgtcgagtcggtgatgccatccagccatctcat

SEQ ID NO: 27848 - DNA, 929 bp, Bovine  19866880987248
cctttgataaaggtctcagtaaagaaatatcagatataaagaaccaaacagaaactttaggaccgaaaactataataactaaaattaaaaactcattgggtgggctcaacagctgaatagagacaacagaggaaagaaccagtgaacttgaagacggaacaatataaacagcccactctgaacaacagagagagaaaaaacaaaacagaatgaacagcgccttggagacctctgggctatacagctgctgctgctatacagatatccccttaaaacgaacagagcctccgggactaagaggaacagtaacagaagatctagcacccgtggggtcggaattatacaagaaaggagaaagagaagggctgaaaaaagtactcaaagcattaatggctgataatttaccaaatttggccaaagacataaacctacagatccaagaaactgagcaaaaccctaataggataaacccaaagaaatctccactaagacataccatagtcacactcctacaaacaaaagaaaaaaagtgagcaaaaaagaccttgaaagtagagagacaaaccactcctcatctaccaagaagcaataattcaagtgccagcagaattctcatcagaagctatggaagccaaaaggaagcagcctatttattttcaagggatgaaagaaaagatctgtcaacctggaattctatattcagagaaatcatccttcaggagtaaaggggaaatcgagacattttcagatgaaggaaggctaagaggatttatgctggctgacctactttagaaagtggctaaaggaagttcctgaaacagaaggaagtgaaaaaagaaggaatcttagaagatcagaaaggaagaaagaataagggatagagtaaacatatgggtaaatacaacagaatttccttttcctcttgagtt

SEQ ID NO: 27849 - DNA, 1816 bp, Bovine  19866881010619
tggtgaatcctttccgattgagcttcagttactttgcctagagcctcagaggaatctctgttgcagctatagccttgcaacatgcatttctttaataataagatttgaaacttaaaattactccttgattcatgggctacaaaatggaccttgtgttagcagatgaaaacaacactaatttcattgaatatctccgtcaaagctcttgggtgaccaggtgcactgtcaggaagcagtaatattttgaaagggatgttttcttctgagcagtaggtctcaatagttgatataaaatactcagtaaaccatgttgtaaacagacgtgctatcctctaggctttgttgctccatttatagtgcacaggagagtagatttaatataattcttaagggccctaggattttcagaatggttagtgaacactggcttcaactttaagtcatcagctgcattagcccctaataagagtgtcagcctctcctttgaagctttgaaaccaggcattggcttctcctgtctggctataaaagtcctagatggcacctccttccactataagactgtttcatccacattgaaaatatattgtttggtggagccaccttcagtgattatcttagtttcacctcctggataatttgctgcagcttccacaccggcactttctgtttcatcttgcacttttctgttatggagatgactttgttccttaaagtccatgaaacaacctcttctagccccagtcttttcttctgcagctcccttccctctctctgtcttcataggattgaagagagttagcacctttgctctggattgggctttgacttaagggaacattgtagttggtttgctcctccgtccagaccactgaaactttccccatatcagcaataagagtgttttcctttttttatcattcaggtattccctggaatagtacttttaatttccttcaagaacttatgatttgcattcacaacttgactaacttttggcacaagaggcctaatttttggcccatcttggcttttgacatgccttctgcaataagcttaatcatttctaacttttgacttaaagagagaaaggtgtggcccctcctttcatgtgagcatttaggggcaatcgtagggttagtaaatggtctaatttcatcatagctgtgtttcatggaatagggaggcctgaggagagtgagagagaccaggggatgcatggtcagtggatgagtcagagcaaaaacagcatttatccattcagtttactgtcttacacagctgtagttcacagtgtcccaaaataattgtaataatatcacagatcaccagaacaaatatagaaataatgaaaatgtttgaaatattgtgagaattaccacagagacatcaaagtgagaaaaacgtccatagacgtgctgggtgcagggtttccacagatattcaatttgaaaaaaatgcaataaagtgagacatgcctctatatccttcctttgcatctgtagagactgtgttgtttggcacattctcacttggttctaatctgatgatgcacagaccccctggcagtgatgaggcaatgctctgtgtctagaacgcaggctggtggcaaaagaagcacttggcatgtggcttcactgagacttgtaaacaataattaaatggacttatgcatcctcattctgctgtttcatttccttctttcaagatgcaagaaggaatttgagttctggataataaacaacaagaatcacagcactctgcatttaaaccaaatgagctcaatgagggtgtacaattcttggaattacaattt

SEQ ID NO: 27850 - DNA, 635 bp, Bovine  19866881024653
ttttttaacttttaaggtcttttaaaatcttattccaatatagttattaattttctagtaaaaaaatttcatatttcaactttaaagatgtgtccaattacaggcacccaccaaagaaactgcatgctgaaagagaacgagaagataaatatgtgcatgtaaaatattaaatttatactttcctacaagtgagaaagccccattgaaattctgaagtccaagccatcatgttaattaacggttgaatgatgtaatctagcttctctttcgatgagtctctcttctttctttgagcctcttttttttttttttttttccacatcatatatgttaaacctactttagcaagtctgggaataacttgggttgttgatcttccaaagcccattacttgggagttggccttttagacccactgcagaatatgtaatgtctacttgggagctgtggaaagccccatccaccacttgaaatgaaaatccaggtgttaatcaagtgtaaagaagacaaagctataaaagagaaataagaataaatatcccttggacatcctaccacatcttgaccatgccaggtgataatgaccctgcatccttgctcctatttagggcagggcccctgcttgcttcttttga

SEQ ID NO: 27851 - DNA, 1652 bp, Bovine  19866881078114
atgtcccatcacagcttattcctttgtccatatctttatacatccagctttgactcacacatgcatcctattctctttagagcatgtttttctgcttttcaagtcctctgaggcatcatcatttttcctgctatgagccctgtgccatgctcttcctctctcagaaactctccagcctgttcttctccattcctaaccagccagtgtctactcatcttttgagaaagcttctacctttaagatgagtaaaattccttgattatatgcccatacactctcagaatatttattacagtatataattatgtattcatagaaaggtcactggaataatgtagatttcccccctactttctctagcagcatgaaagcatggtttacttacttggtttactccccattggatcaggaggacctggcacagtgatgagtagaaaggagtcactcaatacgtatttatgaatgaatccatgaataaatatgtgattctgctttctgattatggactacacataaataaatggtaaacacttgtgcttcttatttagaatacttatataagattatatatgaggcttagtatcttaaagcatattttaaatagcaggtaactcaatttggacattatgaaaatccactgaaatcctcattactctgaccccaacatacactttgtttccttcatcaaagatgttattttagcatttttagtcatgtctctgctgaccattcattctgatgctaatatggaattggtaagagatttaaacctctgtgaaaatgactttatactcctggctacaacatgaactaatatttatcagcaaaagcattcaaggcaacatgaccccttttgaattcaaagaatcaatgaaaatgtcaattatcactagatggacaggccgaaaagaatacattcttgtctgtagtgtttttgtcctgcaagactcatgctcctgttccattttctgaataatctagtaagattcaatttactttttcaatttgtctccagccaagcttccttctgtcagctctacagaaatttcaatgctggccacgtagagtaacaggagaaggacaacgagaatgagattacctgtgcatttgcgatctgtgtcttctttctttgacccactaatcgtcagcttgcagttgaagttttcctcccagtattcggcaaaccacacatttcttcgattgttttcaagagtgcgggatgtaaaataggcatcgaaccctaaacagagttaaatgaaaaggtcattgcttgcggggcactgctggaacatttggaaataaaaataccaataatagtttttctttgttttagtggactggatgcttgctcttttgtgtcaatcaaaaaaaaaaaaaaaaagaataagaaaaaggtaaaaaattctaatgccaacacacatggctaaatctttacttcattctgtcaggcagatgcgtggcggacaaatgacatttcacagtgaaatctgagttacagatcttagcgataatatgatgacaacagcatcccttgtgcctcttgggaactagaccagggacaaagcatctttatcatcactgagataataagtgatcattcccgtacttactatgggccagactctggcttgacgtcggttctttctttcatt

SEQ ID NO: 27852 - DNA, 1209 bp, Bovine  19866881081974
cttctgaatgaggcatgtaggtgctagggaggatgatgttatatggtaaatggcctagagcattgtaggcctccaataaatgttcatttatttaaagtgtctctttgccaacgctgaatttcatcatctgtagaatgaggatacggcccgagaaagcaagcatgtcctctgacaaccttcgtctgcaatggccactgtctgtcctactttttcactaatcagactctacccaagaccctattaagacagtgtcatggataccctctcagttactcacagttgctccttagaaagtattattttatcctttgatagacaagtatatgctgccctccggagaaggcagtggcaccccactccagtactcttgcctggaaaatcccatggatgcaggggcctggaaggctgcagtccatggggtcgctgagggtcggacacgactgagcgacttcactttcacttttcactttcatgcattagagaaggaaatggcaacccactccagtgttcttgcctggagaatcccagggacgggggagcctggtggactaccgtccatggggtcacacagagtcggacacgactgaagcaacttagcagcatatgctgtcttcaaagatctcaagtttgggactctatggtctcatacctttaagaaaaaataatccagattcctcttacagtgttgtcaatctaacaaaaggagaatgattttaacatcggcaactgcaccaaagcacccaccatggactgagctgggtgtttaattactgaggtattaattatcacatcattcttcactgtggtgtttatagcatcttcatatatttagcctgtagaaagcactttaattttttgaatgacaggaagagcagaagtatctattaaaattctctctataatttgtgagtcataacaagttatattttcatctagacttttgaggcaatcaaactagaaattttgatgtaagaaagtggtaccaatagaagatcaagaattgggtagcaatggggcaggggagagaatattagtaaataaaagcagacctcacatagtcttcgaaacaagaccaactgtatacaaatcactgtgttaggattttggggaatttgactaggagtagaacattctgaaggaacccactgtttagatgggggagatgcctggtatctaacaactcttttgtgacccccatgggactgtagc

SEQ ID NO: 27853 - DNA, 872 bp, Bovine  19866881088466
tttttttcctgtctctccaatcagcataactaaagcccttccttcaaaatgttttttttttttttttcctttttctttcacttaatgtttagtcagtggctaaatctatgactaggaagaaaatggaatatcattttgaataaaattccttctgcattgttatagatgtttgattatataagtttaggtgtggagctcaccgaaaacttctggctgctgagacatttttagatcagagtacaaaatgaagatggtaaccaggcaacgtggttcttgtacggttattaaaaataaaatgtgaagcttccacgatgcagaataattttctgacaactttgcctggtttttgctttgtcattggctggaaaaataggtagaaattccatttgtcgaactctgcattgctttatctgggttaaattcattatttaaggtcatgattgttggaaaatcatatatatgtacatgaatgtaagcatggtaatttagtatgactcagaaaattcttaaacatttctgtactatatatgtagtgcaaaaaattaataatttaaattatatatataattatatatacatatatgcttgacaaatgttcacaaaatttactatggaaacaaacatgatcttgcattcattagaatgttttgaagcttgattaaacatatgtatattccttatatatcaaggtattgttgattaaaatcttggaaacctttcatataatggatacttttcaaagactggcactgagatgcagtcaattatggcaacatgcttcaatatttatttgatgtttctgtagacatttgagcgtgtagtcttgatacatatagcaaaaatggatacactcgaagtaccttgtcttctgt

SEQ ID NO: 27854 - DNA, 1974 bp, Bovine  19866881189948
ttcgactctttggactgtatggaccgtggctggccagattcctctgtctgtgggattctccaggcaagaatactggagtgggataccgtatcctccttcaggggatcttgccaacgcaggaatcgaacggacgtctcttgtgtcttctgcattggcaggcagattctttaccattagtgccacctgggaagcactccagttctttactggccccaattcccttttttcatagtctcccccaccaatgccaacctgccagagggctgcaccgcctttaaaggccttctctgtctgaggcaggaaggaggcttgatctcagtgtcatcctataagtgtcatttctttgaaagatcacaggctctattaatttctgattcttttcgtgtgtagacgattccaaacaagagttgcttacattatagattagatgagtagatggcttaaaaggggaaccaggtctgggcattcttgccaaaggggagagaaaatcagtatcttctttaagattgccaccacacatcagctctcagtggtgactctgtgtgttacacattgcccgccccccatcatggctttgcatgatcctcttccctccctcctttctcctacttctgccttctttctccccttgcttccttcctttctcctccactccttccttccacaaatgtttgttgggttcctactatgtgccagcctactgtgcagtgtaacgctgtaacaacagtgagcaaaataagcatagacctcttgtcacgagcttgtttcggaggaagggtggcagagatagatatgaaacacataaagtcacaagtaagtagtcacaggtcagggtaagtgctatgaaggaaagatacaggggcatgggggcctttggcaaggggacttgatctagtccatgctgtgagggaaggagaaactggccttagaactgagagcagaaggaagagaagagtttattaggtaaaaagaatggatagaacattccagaaaagttaaatgtgccaaagccctgatgtgggagggagctgtcctacatacagaacaggaaggacaccagagaaagggggtggggagagatggggacagtggagatgggtggacaggtgggaaagttagagctacgacctgtagacttggattccccaagaccacttggctgatgcgtggagagcaggtggttgctgctacaggcagccaggtgagaaacgatgactttggcctgggtggtgatggagacaaatacttggaatccagagaatctgaggaaggaaaatcagctcaacaatttaactagctttgtgaccttggcacggaagttggttaactgccttgacctctgtttcctccagagcacagtggtgcctgatgttactggccctcctttgtccccagagagtcttctcatgtcttctggatatgattcacctgctgtgcatgggcacaggaaggcaacagtaagtgggccgtgtccctaagggactcacagtctatggaagaccaagttagtgtcataaagtgtgccaggcgcatgatccaggtgaacaggcagaagatgaagaaggtcagagaagcagacaggactgtgtctgtgagagcagggaaggcttccaggaggaggtgatgtctcagtcagccatgaaatggatgagtaggagcttgccaggtgatggcaagtagagaggctggagaaaatgacatgtggaagtgattcttaccaggggcagctttgtccccaaacatctggagacatttttggttgtcacagccagagtggtgctacagatggatagtggtcagaggccggtcatgctaaacatcctccagttcacaggacagtcccccaaatatacaaagaatgtcaactctgctgaggtaaaggaactctgctttttaaggtagttgctggagtaatacatgtgaaaagccttagtaagttagacaattctatatacataagtctcttaaaatttt

SEQ ID NO: 27855 - DNA, 1435 bp, Bovine  19866881396614
ctttgtgattgtttctccttccaccccctccctgttgttcatgctgatagaatacatgaggaatgtatagaaaacacttagcacagaacctggcacatggcaaatgaccaaacaactttactaccatgagttatttcctaaagacaagcaaaaagacatcatttctctccactctttaggtttagccttggataaagtgagcacacacctggatgatatcagtctcttcccccacatcatggccttgactgagttacagcagaaattcacacccttagctttgcttttgttgaaggtcaaagagaaaaaatgttagcatttgctgaatctcagacagcatggcacttaacagtttacaagggacttaactgtatacaaggtcttttccaacgcatttgcctcactctgccctcctagagcccctgagagtagggtagagattatcaactctatttaacatttgtaatcagtggagtttttcagtctcagcaacctacccaaggtcacagagcccacagaagagatgagaaaaacacaatagaagacaacatgaaattctgccaactcttcctcccacagcactccaaagtggcattttcttcttccagacaattctcaggttgctaatatttacctaaaccaaagcaggagcaagaggcagttaccaacgctgcttgatgtcctattgtcaaagcaaccttgccaagaacaaccacatgaggcttttccaatggagcatgaaaaggatgcttagacttataaatataaccagagaggagaagccacaggaacatatgtgtatataatctgcctcaaaggtatgccacagaaatgaataatcaggagtgaacgtgtcccctggcctaaccagtaagtccccagagaggaataattaaggattcaatggtcctccaagcacccacctccttcaccccagctcaactgcagaaaaattcgaaaagataatttgtacactggtaacaatgggaaccaagctattttcatatttcccttccaccaagacttaagtttccacagcgattttgtgtaaggcagttttcccccctttcccaaagactccatactcccttctaccatacgtgctggctttaaagagaagaggagaaaacatcctgaagctattttggtaaaagctgcatgtatgtgggttgtgggttgggggagggaaaggaatgatgcttgtagggttatgagatcagatgatatttaaaaaacaattgataatctctcacctctggctgaaccatcaatattataacacatttgtcacttgggggggttttattgttggtttcaggtaaatccagctattctccttcagcaatcatcaggtttggctcctgaattctttccctaagcaagggtgcaaggtttagatctcatctctaatgaaagcaactcagcaggtaaaata

SEQ ID NO: 27856 - DNA, 1506 bp, Bovine  19866881523221
ttcttgtcagactgcagcaatgttctccaggaacgttccagaagcattaacactcaggacgaaccgttaatttaaattctaccagctccctttccctaccagtcagcaggaagacgactaaaaggcagacaacagagagtgagcacgaaggtggaaaaactgaaagtcaagcccaaggaagagggattaagggaaccagggtgaaagggggtacttggtgtcaaaagagaaggttcactgtggatgagaaagccggcttcagttagaaagacagacaaaacccttaagtgacagcaaatttgttccatattgtccccaaagggaaaaatgaacattataagaagaagtacttgggttcagctcaaggaaaagtgctactttggggaaataatagatttctgaaaatgctgcagctgttataggcacacctcatccataaaagtgtacaagaaaagatggaccaaacacctgagatggtgccaggatacaataagctgctgggccagattcctgatccaggccttccttctagccctgagattctacaaattatagttaggtgctttgtttaatcaggcttctattttatgattctcatcttgaatgaatgtgatcaaaaggtattctttgagctctctttcaaccttgaaagaacccgagaaagttttcttcctatgctggcaatgctgtaaaggacatttctaccatttattgataaatttcttctccaagtacaggggttatacttgacacttgttaaaggattatatgtgactggctgttaacaatagtaccctagctgtaactaatacaaacttctcattgctccccaaagaaatatgttactttacattttagttcaagggaaagctggggaacatcagtcaccatacatgagataaagggtaatttgtccgattaaatccctgaactaaaagttaaacactgagaacaccatgcatattttatgattctcagtcctgaaatgaatggtcaggcacacaatgagataccaaaacaggggtcatacacaggtgatgacaggaagggacacagcttgaaaaagaggagcttgatgggaggtggtaaggatatcaaaccgaatttttcaaaggaaactagaagagaggaggatttttagaaagcagagtggccttcataaggtcctgaggaaatacagagtacatcccatcccttctctgccaaaggcacttcacttgggaggaaaggaatgcagaggtgagggcatgaggcttctcacatcatgtcaagcagaagctcaggagacacgatgatgatgaagaaagtcccaccctgatgtgggccctccctcccccacctctagtctcaaaatccttgttcattctacccagccactatgggctctcttctctctctttctctcttgaactttcttaggcatgcccctgcctcagcacagctgtatctgctgtcccctctgactggaatgcttcctccacccccacataatgccctggcttacca

SEQ ID NO: 27857 - DNA, 1115 bp, Bovine  19866881854583
cacatcattccccatgaacatgtccatggttatcaacttactggcatacactgcatttcactactccaactggcatggcactattcctctggcccaaggatagataaagtaatgaaatgatattcaattgatttcacagtacacatgtgttatgaatttgaaacacatttctgacacatactatgctccttgagcatatattttagaagaacttactctaaggacttccttttatgactcaaaccataatctggaaccatcacagtccttggttttagaatactatgtggtttcattttcattttaaagacagccccaacttctagctgctgaatcaaaccatttaggggaaagacatattttcagttggaaaactagccaaagtccactaatcccttctatgattatacagagaacagaagtaacaatgtaagcagtcagattcaactaatttgagaagcaaggatatgtaaatttgtagccatttcgacttcagtccttgttttccccatttagggcactatgtccttcaatgtttaacagacttctccaaagtagcatggaatcaggctccacatttgatgtgctgacctctcatcaagctacacttgcactctctctctagagcatccagtgagggcttagtcccagttctggtttcagccgtaccagccaatcagagccaacttcagtgaggaacggacaagacagctcattaagatcaacctgttaggactgcccaatttgcatatacccacaaccatatacgggtaagcacagaactcagatatatataaatcacgttcagaatcaacactgtagcactgcatgatttgcccacattcacatctccagatagacacacactgattgcattaagattcaacatattacaactgctaaacttaccgactcgtataaaacatgtaactatatgatgggagcatgtatactgaacataccttggaccaacatagtaaagcccaatcattttgaaaactttgaacttttgtgactgaatatagctaatccagctacattaactccatcatttgaaacaattaatatacatccagctgttaggagcctaaagtagaatcaacatcaaagttctc

SEQ ID NO: 27858 - DNA, 1201 bp, Bovine  19866880378993
tgggaaagaagaaaaaagatctatacttcgttggcacttcgttgctttggtgttttattttaggtaattgcctcaaggccacacttttacacccctccttcagtgtttgttgagcagccaatgaaacggaaaaccccaaaacacctctaacacttccttcctccctaatagaccgaaagaattcatcgagtgtgtctcccacatccggctcttgtcctggctgcttctgggtgccctcacccataatgcggtgtgtcccaatgcctcctctccctgcctgcccatacctctggatgcaggttcccatattgcagaccatcttattgttatcctgattggatttccagagcaatcaaaggtaagtgatttctgcaagattaaagccatacgcatcaagattgctaatggaaacccttatcggccaattacatttcttctgagaaggaaatgcaccttatcacttgccctcctgtggatgctaggaaggcaactttgtgctaatgccttatttaaagttgtttaaattcccagactatcttctcttccccctaagttgtttttcggtttacttttatgaagacaaattatagaggcaagcaaaagttagcttcctaggcattgctgtctcaaaataatgaagagaaataaaaggctcgaaatataataaaacttccgtgatcagtttttataaacaaatatgaagtggagggaaatttattctctaatttttcatgcactgtcttttcaactcaaatctctagagatatatgaagatacaaagtgaaaataaggccagttgggaactcactaaattatatatgggaatcacttacacagaaggaacttataaattgtagagacgggtggtgtgcttaagggaataaagtaaatccaaggcttagcatcaatcatgagcctgtacaagcaaaccagacacattagtactgctcagctgtgaggagtctaagtcccctcacagagcctaggccagttctaggagctcatagtggttttgggaacagctgggatttaggctagctagggcaagcttcaccagcaatagattttttttttaaattctgcaataaaatagagcacccatccaaattacctgaatgatgtttacaaaaggaagtaggcagtcggttcctaatatttcaacccaatctgtgttgattcctaatgatggtactttgtaatt

SEQ ID NO: 27859 - DNA, 998 bp, Bovine  19866880379117
aaggtaatctggccaaagtcggggaggagagcagggtccccatactccttggcctgccagttcccagtgtggccccccaggcgcctgcagagatatctagttcctgcccagccatactcgtgccctctttcgtaacagactctgattttcctctgtggacccaccctcacccattctcagaccgggattccatgcacccaaccttgccaatcagccagtgccacactctgtctgcagtgattggcttgggaaagacacgtgacctgggttggtccagggtctagcgctggaactcttcctaggagcatcaaatcagaagtctgctctttgttctggggttgcttggctggttgagcggaaggcagaatctgtgggcatccacaggcgagagccttcctaatatagccaagtcagaggacggcaggctcaggagatggagaaaaagtaaacaacggctaatgacgtcgtttggactctgggatctggctctacctgcacaaatgcaatccttcacttcacagttacctgagcttatagatttcccactttgcttaagcctgtttgagctcggcttgctctcacttataacggaaggaatcctgactgctatattagggttcacggaatacagttgaagaaccactgttctatatcatccttcaaatcaggtagaatgcattggatgttttaaaatttctgccaacctgttttcatggataataataataccaataataactcagttcttcagtggttttcaggtttcatcacacttacagaagaacactgtgaaaaaaacccaaccatttctacctgtagatcaggaaattggagctcagtgaggttaagagaattgcacagacacctgagggattaatcacataaatgcctttgcaaggtttttttttttaggatttatgacaaataagtgagaaaagtattaatacttcagttacagaaagagctcacacaaattggcaaacaaaacacttccagca

SEQ ID NO: 27860 - DNA, 2024 bp, Bovine  19866880392640
tgtctgtccacagggggacaggctcttgctgctcaaccagggacccagctatctcctgcctcaatagtaagagttgtgtttgtctttgtcccactttttactcagactacgtttctagcagatggaatgagttgctgtttgttcaacacagggctaaagctttttaccgatatttgtaggcgagagttttgtagggtagacttcacctggttacctatctttactttgccttaatatgtaaccagtagaggttgcagttcagtctcagatggttatagtggactgagaagttacttgttaaagtctgggctgtgctgaggaaaagagcactggggggcttattaaaaggggatatattaattgattcacatcaggaggagaaataaatttcttatattttatgacaggaagcagtagtacaagtgaaagcaagagagccctcaggctgacagccagccttatttccttggatgtttgcattttaaagagttggctcttgagtcctggggaagacagttctgggtggtagaagatttacatctcaaagagggagaggaagaaagcaacctttttaaataactgctctaagagggtttttcagggctatatttgcctattgccagattttggctgggacaaagagtaaatttacctggtaacattgagctctgcaagcaggcattttaagggggctactggtgaacagaattatttgtgtggagagtctctagtttctaattggcccaggttgaggcctaattgagaagaggttcagaggagcctaaatgaggaggctgaggcctagaataatgactatcgtgtttcttttccttaagttcatgtcagttttccccccagtgtcctgacattttaaagtattagcaagtatctcgagatgaatagaggaggctttggaattggcaaaaaagatggtagactttgcgctagttctagagccatagatctgattttgtaaagattaagaaggtgaagacagatatttttaattcttcaaagaattgagtggcagcctcaatagtaccatagatggttggctggcatcaccgactcaaggaacatgagtctgagtaaactctgggaactggtgatggatagggaggcctggcgtgctgcagcctatggagttgcaaagagtcggacccgactgagcgactgaactgaactgaactcaatactaccaagggggtggcctacccatccaactatattattttgaacttatttcttacttatatcagagagagttccagttaaggcagaaaccaagattcttaaggttctagggtgcctggatttagagttctatgtctttgaaatgtttttttataaatcactcaacaaaggttttatgatgtatttctttcctctgggtaccattccacttcagcccaattaaccttcggggaaaggcttctataataattcctattgggccctgaacaccagcttccaagtgggccatttgtaccagggaggtggtggaggggagtttatggtggttgcagatttaatttttgttctaaatctgatttctttcctttaattttgttagtggagactttaagctatctgtgatcttttttatgtccttttttcatattggtaaaaggatatttgtttagggtcagagttttctcaaaactcttacaagtataaactcttttccaaatcaaaggacttgttgactggccattgatatttaggatccccaaaggtatatctattgtaaaatgtgactcaaaaccaactagcctttttatgacttatccctggacacggaggcatccccctaaaagggtacagaaaatgaagcaccatagtttaaggtcactcccaacagtagccaaagagaaagaaagtcaagcatctcatttgctgagggacttcccaggtggcactagtggtaaggaatcacctgccagtgcaggagacataagagatgagagtgcagtccctgggtcaggaagatcccctggaggcgggcacaacaacctactccattc

SEQ ID NO: 27861 - DNA, 1641 bp, Bovine  19866880441696
ttacctttgttgctgtataggtaatatgttttccccctcctctggcttcttttaagaaattttcatcttcaattttttttgtaatttgaaaatgatatgcctaagtgtagggtttttttttttttccccatttattctatttgttgtttttggaaattcctgatctgtagcttggtatttgaccttaacttgggggaaattactagtcattattttttcaaacattttttctattctcttctttctccatctcgtatactcattaaatgtatgtcacacctttttaattgcccccacagtcattggatactaagtgctgtgattttcagtcctttcttctctttgcttttctgttttggaggtttctactgaagtaccttcaagttgagtctttccccagcttatcttgtttactagtaaacccaacccttgtagctcaactggtaaagaatctgcctgcaatgtgggttcgatccctgagttgggaggatcccctggagaagggaatggttactcactccagtattctggcctggagaatttcatggcctatatagtccatgaggttgcaaagagttggacatgactgaataactttcacttcagttcactttaataaacccaacaaaggcattcttcacttctgttacagtgttgttgttgtttttttcccaatcgctagcattttcttttggtctttcttaggatttccatttctcagctcatgttgtccatctgttcttgcatgttgtctattttacctactagagtcctttgcatattaatcataattgttttaaattcctagtctgaaaattccaatatccttaccatgtctgattttgatgcttgctcaatattttcaaatgtgtgttttgctttttggtatgtgttgtaatttttttaatagtcaaacatgatgtattagggaaaaggaactgctgtaaacaggcttttagtaatgtggctgtgaggtggggtcatgggggtctcaatctttcagggagcctatgccactggactgtgaacttcacaggtgtttttcatttttctagaatgatacccttctaagtgaaagaggctggctagagtgggctggagttgaataatacctttctcccaggtgtgttaaggctctgataaccaccatcaggttagtctctggttaatttgtttcctctgaggtcagtccttataaagagcagaatgctctggtatgtttcaaaatggttcctttcctttcccttcagaagcatgagggaattttctctaatatactgtggaaacttggttgagctcctggatgtaaatctctccaaacagtacatgctcacccatgactggatccccctagagtttttatctcccagagtcgtccaaactgtgctttcatcaatttgtcaattacagatctggttttcctaccctggttctggttcctgtggtcgttttagctcataaatctctgctccacagagttattttctatattcacttgtgtgtctttctgatcatgtgaattcacaatttgccctgtattctcaccactcttatgggtcctagaaggattgttgatttttcagtatattcagctttttacttactctttggatagagtggtagcttacaagatccttacat

SEQ ID NO: 27862 - DNA, 1561 bp, Bovine  19866880531762
aacatatcattggcttgtgttatatagaatgcagccttgggaaagacacttgtggataaggaagcacccaaccaaggagatgcctacaacttcgtctactttgaccttttttgctaatttttagacattttttaaaatttaaatttatttattttaattggaggctaattactttacaatattgtgttggttttgccatacatcaacatgaatcctccacgggtgtacacgtgctccccatccggttttctttatagtccaactctcacatccatcagatcagatcagatcagtccctcagtcgtgtccgactctttgcgaccccatgaatcgcagcacgccaggcctccctgtccatcaccaactcccggagttcactgagacccacgtccatcgagtcggtgatgccatccagccatctcatcctctgtcgtccccttctcctcctgccctcaatccctcccagcatcagagtcttttccaatgagtcaactcttcatatgaggtggccaaagtactggagtttcagctttagcatcattccttccaaagaaatcccagggctgatctccttcagaatggactggttggatctccatacaaggtgcaaataatgaatgttaagataaataaaattaagtcagtttaaccccaaaagtacaaatcatttcctggacctatgggaaatgcgctgggcgtttcttgggcagcctgccttggaggggggtgcctcccagtgtggttggagctggggacaccagtgtctgctctcacccatccagagagtgttcagctcggggtctggggagctgggtggagaggcggtgggtctgcagagcagggccccctccagagaagttgctgagggcagaggaggtcctggaggagaagtgaaaatgccccctttccttttacccccctctgtgtggatggcagtagggcagcccgtccagtgatactgaggccacacaccagcctgcgcactgccgaccttttgctgtggtggtgtccctgcgaccacaggagctgtgtgcaagaagatgccatagctgtcgatggggttgggcacagatcagtggtagcccagggaacttactgcagagcttggggaacatcttttggggctcagttcagagaagagttgagcaagaaataggtcacagttaccaggcatagttgccgaacttcttattttctggcaggaccaagaaatgaggctttccactaattccatttcttaggtagtagcttggagctttgtcttccctttgtcttccaaaaagtggttttacaggtttaaccatatattccacccctcttttccttttaaaaagagaatgtgtgggatgcagtttaattctttttcttatgtttgttgttttgtgttgtttagtcactgagtcctgtctgactctttgctaccctgtggactgtggactgccaggctcctctgttcatggaattttccatggagggggtggctatttccttctccaggggatcttcccgacccagggatcattattgtacaattagaaacaaccagatgttcagtataggg

SEQ ID NO: 27863 - DNA, 927 bp, Bovine  19866880582891
tgtataaagtgctcaacaatagatattaaatgcatagagctctgatccagtctgctacttataatctcaatcttgaactaatcacttggacctgcttatgtgatttggctctactaattactctatgggtttccctggtggctcaatggtaaaaaatctgcctgccaatgaaggaggtgcaggtttgatccctggatgggaaagatcccctggagaaggaaatagcaacccactccagtattgttgcctgggaaatcccatggacagagcagcctggtgggctacagtccatgcggtcactaaaacgtatgacacaacttagagaccaaaacaaacaaacaaattatacattattctatttctacccacatttcaagtttatgagcaattttatgtgccctttcaaatttatgtgcaatattatcacccaggttccagctttggatcttcccaataatgttgctgctcctctatcctggaagccttacctcaagttgcctttacttataacccttctagttacattcagtcttgtgcccagaacaacatcccatctgactggcctatcctgatcctgtagatagagtcaaatcacaagattcttgtggcaaaaaaaaaaaattatatcttatggttctatatacctacattatgtaaaacaaagaagctaagctcctaacagttactgagatagcaatgaaaagggagagtaaggactgctgaaaattcttctccataaaagcaagagaaaactggcaaaaattaccaggatcaactttttctaaactctggactttaactaaaggcttgcagccacccaagcaacattaactgaaaaaaaaaaacaaaaccctcattaagatcagagagctttgtagcattttaatttgccctggtcccatcccctattctcgggctctgaagcag

SEQ ID NO: 27864 - DNA, 4128 bp, Bovine  19866880604191
tggatatatatgctgccccgagaagttctctcacattgaagaaggtctccctcccacattgcaggtggattctttaccatctgagccaccagggaagcccatgaatactggagtgggtagcctatcccttctccaggggaacttcccaggaattgaactggggtctcctgcattgcaggtggattctttatcagctgagctgcccgggatgcccaagaattatacttaactaaaactagagaaaactcaaatgtctttgaacaacactaaaaatcctaaaacatagggaatccactgcacaataccgtcaataaaaaccagatttataactcaataagtgatcataaagtgtgtagcaatgtttgaactgtgagaattgttaaagtagattaacttggtgagtactagtaagaatacaataattggatgataataaattacaaaaaaggaatgtcacatttttcttccaaggaatttcatgaatcaggagacttcctcatagctttctgagcttggcagcccagatcttctcaagactcaggagggactaaataggcttatttaccctcctagacctacctggagtcatcagcattgtccacattcctgacctgacctttgacctggctgccgtgaatggcccagttctagtcattcctctttgcaaatcccaaggggccatgatgatcaacgtctctcaggtctcctcttccacagagctctcaacagtgtccactgtcctttcaatctttaaggctacccaaggggccttttagatggtatggctcactgtcagcagttaacagaagacatatcaagtgctggagaagcaaggccttgcggttcccaacagcccatggaaacaagctcctggatgcattctaactgaaatgctggcttcagcaacttgaagaaagtcaaatgcttttgataggcatgggacgtagaatcacagaatgatgaaatagaactagaaggatcttagagatcttttcccataaccacgtaatgttaaaggtggggaaaacaaggcacattggtagtcagcagctgagctagactagaacttacagaccctgactcccatccaaggctctttccactatgacatactcttgaacaccatctggagtgaagtcgatatgtagattgtgcatgttcattgcatgacatcaaagcaatcttcagctgcagttggattaatcattcatcctaaatctcatataccatttatcagatttgcctcttcttccttctcctatctgcactatttccataatatggctaacattttcccacaaaattgtctacattgcaaatagcaccttgagtttatataacacatcacctctgaaaaaagcaacaagtttatatccattgtctcaattaaccccaataagtatttggttgtaagttttttttttcctgagatacagtaaaaatagatgatagtggaagggtttcaattacataatttacaaaaatccattttcttctcagtctttttgatcatcatcttttcatcatctttttttaaaaaaattacaggggaacccctacattaatacatagttctgagtttcaagaatcagacatttgctaggccagcagatgctttctccacacccaccatcacagtaacgctttgctactctgacttatcaagtcttaacattcagcaggtttctgtcgagtatttcaggaatatcattaatcattctatcgccttaaaaaggtgttgatagtgcaggtttgggacaataagctaaatgaggagaaaagttatagatctcccaactcaaagcttgcttgttattcaggaactacaaaactttcactacacaatgacagccagcattcaaaaatgtgaaatgaatgcatatgctttttacagttcctttcattaaaatgcagcaatgactcttttcaatgggtaaccaaacatgcaaaggaatgcatagacagagtcactcctttccctgagatcttttaacattttataagcattccattgtattgcttttgtttacttacctgtttctttttctatatcaggttgtaaatttcttgacggtaaaaattttaccttactcatgtctctatcccaagcctaacacagtgcttggctcttaacagacactcaatatatttgcaggttaaatgaacaaacgaattattactttaataacagcactatcacttgaggttctattgcgtatatacctgtctcccacactagattatggactccttttacccctaatgccagacaactagtaggtattcaataaattgatgagtgaagacggggaaaaataggaagaaagaagggggagagaaagaacaaaaataatgatgactaatcattaaagacaattttttttaacagaaccagttggcaaaatgttcaagctaatttgctcattggtgaatgcaacaaaaccctagcaattatagattatttaactttcatgttttctactatttgagaacagccagaaaggtccctgacatacagcaatttgtaattgtgctcagaatgtaagtgaaactcatttacgttcaaactgtgcacacaaaagatggccgtttggctgaaataacagtagccacgtggcagctcagatttcatgtactttattccacctgtgtgcctgaatattcggagaaggcaatggcacccaactccagtactcttgcctggaaatatcccatggatggaggagcctggtaggctgcagtccatggggtcactaagagtcggatacgactgagcgacttcactttgacttttcactttcatgcattggagaaggaaatggcaacccactccagtgttcttgcctggaaaatcccagggctggggagcctgatgggctgccatctatggggtcgcacagagtcggacacaactgaagtgacttagcagctgcagcctgaattttgctgcagaatcttagataattgggttgttggatgtaaacaaatcatctctagtctcacctgaccctggggttacacttctctagaaagctccccctttcaccctcttcaatctctatttcagtcctccccacacttttcaaaattagcccccaggcccactcttttccttacactttaagaaaacagaacccatctgctttggatggaattttgtctcccagaattcacatgttgaagtcctaatctcaaaatgtcactgtacttggaaataaggcctttaaagaggtaattaaattaaaatgaggctcttaatgtgggctctcatccaagccgactggtgtctttataagaagaagagatgagagcccaggagagacaccagatatgtgtgtgcacagagaaagggccatatgaggacacaatgaaaagacagccatttgcaagccaaggagacagtcctcaggagaaaccaaacctgttaacaccttggtcttggacttctggcctccaggaggcaagaaaattaatttctgtcatgcacaccatcctgtctgtgatgcttcgttatgacagccctggcaagttgactaaaataccatgttagaggaagtcctctaagagcagtggtccccaacctttttagcaccagggactggttttatggaagacaatttttccatggaccaggggtgggggggacagttccgggataattcaagtgagttacatttattgtgcactttagttctgtaacgataacatcagctccacctcagatcatcaggcattagatcctggaggttgtggacctctagagcagaggcaaatgctaagagtctgagttctgaaatcaaacagttctggactaagaatttggttctctctctactcaatcccagtttcctcatctgtaaaatgggaataatcataccaatgactcttaaaagcatatctccatcccagataggtcattcttctgagtaatagatcttatctattcaatttctcttacggatactgcacagtaaaacatgcaacgctgaacccttatcccttccctcaccaccatccatgtaatccaccaagtcactccagcaaagcgtaatcaacagctcctattccctgtcccctactcctaatcaatctgccaccaagtcctatcaatggactactaaaatacac

SEQ ID NO: 27865 - DNA, 1565 bp, Bovine  19866880612593
ttgcagtgtgtcttcttacctcttgtccctttcttcttgtattaaaacaattcttctactgtagtttggtagcgtttcagatgtgcctgatttagatgtttgtgttcgcttttgtagtcttttttgttttgttttgttttgaatgcaccacaaggcatgtgggattttatttcctccactagcgagtgaacctcatcccagcaccagaaatgcagtgcttaaccactggaccatcaaggaagtccttcgcctttgtaatcttaacctagaagctttctcccacgttttcgtgtctactgtcttctcattctttatgtcttaaatataatctcttctgagaggtcttccgaaaccactaggggggcattccttacccttttcttttttctctgttttagctcccatctctttatagacctttgaagatattttttatactttccgttcatctttcactctttaccataagcagcatcaagggctgtagctttaatttttattttttagctttttcatacactgtcacatattcagtatttggcacatagttcaggaagagaaggggacaacagaggatgagatggttggttggcatcaccgactcaatggacatgggtctgggtagactccggcagttggtgatggacaggggggcctggtgtgctgcagttcatgggggtcacaaaaagtcgggcacaactgagcgactgaactgaactgaaatatctgctgagtgagtgaaaggacaaggtacacataggcatgaattttgaagcttgatagcaatgctctcaggttttacatatgtaggaaaagagcggggaaatgaaatagctcctagctcattggattgttgtgaggcttaccaatatgaagaggagaaagtgcttagaacagtgccttgcacataggaaatactacagaaatgttgtatttttaagagtcttaaaaaaaagagtctctaaagagttatcagtttatatttaaatattgttttatgatggaatgaattatttttttctttaaggtattttttaaaatgtattttaattggagggcaattgctttaccatgtggtgtgggtttctgccatacaacagtgtgaatcagtcataaataatacatgtgttccctccctattgacgaattattcttgagtattgtgtagtatgttctgagtcatagcatatctgaattttaactccaggttgatcatgaatctcaatttggactgtaacactatcatggaagagaatgtactttaccatgaaggtaggagcccaggtattttcaagtttgtccatatagccagacacttaaatttcaggacactgctgtctatacttcaggttcttgtttaggcagttccaaaatatctgcaccttctaaaggagtgtaatacatttttggtacaatcacttttaaaaaaatagagccacattgattggataggtggttgataattcagtttgatttaaaaacttaaagaatgattcattgtcatcaactgcagcatatctctgaaattatttaatttctacccaataactccttagttcctgaaa

SEQ ID NO: 27866 - DNA, 2884 bp, Bovine  19866880660586
aaaaatggaaaactagattttaggaatttttttttcttttttttctgggtgagatcaagatatatttttatagttatgtcatcaataccagagaaatgttgtacactgatttttaataagaatcgtaacattttttggtgcttctcttgggctctaagagctttaacgtcaatcaactcttgtagtcctccaacagccctatgagataacagttattatcatccagattttacaggtaaggacagtgagctgaagttctgtaacttgctgaaggtcacatagccaagaagcaaagccaaagcctaacccggcatctgatgcctttattcctaatccctgagctgtagggcttctcacagatgacagatgtttcagcactgggtactgtctgcctaaccatgctaataaatggaaaagaactgaagaaaggtttttctcaatttgtatgagctactgaaaaccaaagtcttcaagcagctttaagtcaggtttgaccagaatggaaggctgggcattccataggaagcttttactttaaagattaagcaggtgtccttggcacaatcagattcttctccagtagtctcatttctctcctttactacttccaaaggtctagttactgaaatgtttttttgctacaggacactgatacactgagtcttcaaattaagtaacagtttgaaatacatgtttttgcaagggacaggtaaccaaatcacttgcatcttttgagtgcttactagaagtatgcatggctgcaggcagattcctgagacatacagattctgctgcatgagagttctatgatgcaagtatgtgttgggactagtaccaccttacagaagaggaaaatgaggaagcctgaggcacacagaattaataacttgctgttggtcacaccgctagtggaagagccaggatttgaacccaggatatctggcttcagatctccagctatatcattctactatactgcttatcaaaaaaaggacataatttaagaaaagtcattgcacagtttcttgttttatttatttgatttgtcctgaggcagtgctagtttggaaatcgtttaagaacattatttccatcactttttgttttacaaatgatgtaatgaaaggtttgtgagtttgctatttgtcttgtaaagtagtaattccgtattttattgagggagactttcttagacttaaaattctagtaaactctcccacatactgcaactagagagtagcccgtttgctgcaactagaaaaaagtccatgcagcagctgaagaccctgcacagccaaaaataaagaaataaagtcattaaaaaaaaacaccaccactacagttttaaagggaaaaatgtgattcccttagaatttgattctacttcaaacaaagctttcataattaaaaagcttttctttggggaagtggaatcatcagataaagtgctctgaagtgacagcacccagagaataatcaaacctgcatgtttgtttaccatgagttgtgttatagtctttgttaaaattatctactgttgatttccttcttgatggatttaatgttctcaatctctgtaaaacactggcagaaaaggttaccacaataccacatgtctcgtttttgcatcaaataagtgccatactttataagttctccaatatgtttataatgttctacataattctagaccatggttgggaatcatcatgcattgatatttttgttttgatctaaggcagtgagtgggtcttgaactctgtctgaatattataatcacttaaggaaataaaaaaactgcaaaactcatataaacaatgccagggtcccttcccagctatcaatccctgggagaggggccaaggcaatcatgttttgagagctcttcaagcaagtctgttagggttgagagtcactgggctggagtgttgttattttctttctttcttttgggccaggggtttttatgcaccatgaagcctcaactgttaagtcactgagagctctctctggaacagcgtttgtaacaaacatttcatggtaggctcacgccagctgtttgaattctgcaaatctttaaaaaggtgtctatatattctttttcaacatattttttcccaaggtttaaatacacttgttacaaggggccctactgagcagtcttatgaactaatatgtgtggtcctgggatatcagccatggagagaggtcatgaaggtcagatgcagaaggtcactgtaactgaaggccaagttctaggggaggtcagccagtaatgcagcagacatgatcagttcaggctgggggtggtcaggtcacagataaaggagaggactcctgcttcttgtagttctccaggtgtggccaaggcccagcgccaggcaggaggaaacaggaagcaggaggtgagcccagtggtaacatccacggtcctgagctgctcctgtagtggtttggaatggatctgggcgtggggcactgggagctgcaggccgggcatgtcaggaccctcagtggcagggacgtcagtgtagacaggaccacaccaggtagactgcagacagctgccagccccagctcacggtggggaacgaggtgtctgtatttcctgattcctgttgtccaatttatcctgaatatacttgtcaggtttttgtctctgactctatcaaagtcgctctcttgtcaacaggttgccagtcatttacatataactaaacccagtggtcaagtctgtcttcaaattacgttttttggccatgccattccttgggggaatcttggttccctaaccagagactgaacccacacccttggcattgaaagcatggaatcctaaccacggaccaccagggaactccccctcaaattactttggacacag

SEQ ID NO: 27867 - DNA, 1393 bp, Bovine  19866880753874
taacccctacctctagccggctctgtcaggtggacgaggctcatcgccactagccggctcaccctgccttcctccaggaagccttcctgatttacaaaagtgtgggaaggaccctcctccatgcctgtgcctacagtctgtgcccacgatccctaccctctttggctctgaatgccaacggtaggcttcagagagctgaagggatgtggcctgggcccatgcgagtccccagcacccacagcctgtgacccagcagggaaaggtttgctgaatcctgttgcgaggggcgggggagaggggcagtcttcccaaccggcatttgccggctatgagggaccctcacgctcactggggcttcccctgtggctcagcaggtaaagaattcgcctgtaatgcaggagacctgggttcaatccctgggctgggaagatccccgggagaagggaaagactacccactccagtattctggcctggagaaatccatggactgtacagtctgaggggtcgcaaagagccagacacgactgaacgactttcacttcacttcacgctcattggttcagtgaggccacctgtcaacacctgaaatggaggagtcaacggggtctgtgtatccagcgccctcgttacaacagtgcaggggggaaactgaggcaaacagggacctgcgaccatcaccatcacgacaggcaccccctgaggacacggggggtggccggcctcttgtcctactctcccacctgtgctctagctgagtcccagcactgatcacagggcaggactcccaagtcctcccagccctgctggactgggctcacctggggcttctcaggcttcctgagcaggtaacggcaggcgttcattattatcaagcatctcttggcctaatagacccagttaggggaggccagttagcctgcagacaagcccactgccaaggcctttctgagtctcagcggaggcccggaccccagagtccgagtggcccccctcggagcagggcctctgatggcctgagagccgggctgctgacccccctctctggggctgtatacgcctcagggcctggttctgggaagcaaacggggtaacactctaaagcatgggccttcaatccaaaccccccaaaataaatgtttaaaactctgtatctatttgtacattttcaagctgacatctaaatttctcatcgtaagtttaaatacttgtagaggatgtaatttccaacatattgtaaatattaacatttcaaaataaaactgttactgtgtctctttcaaatggacccagtggaattctaaataccatagcaattcaagatccaccgtcatccatcttaaaattacagaattggacgcttcttaaacactggaaagatagcaaggctcctt

SEQ ID NO: 27868 - DNA, 857 bp, Bovine  19866880784501
ctcagagacaaatttgcagacaccactatccattgctctgtcttgaaccaaccccaccaacatacagtcagatcaaagcagagtacactaatctgagactaccacagagaacaggcttctgctttacagagaaggatgcaatctccctttcatctaagaatttgctcctgataatttgaccactgacaatacaatattgccccagtctagtaaaacagtaccttcacagctggtttgttaattgcattgtggcattcgatgtgctggcagtggatggggttccaagctgtaaggcaaagcacagctgatgagtatttctcactgaaagtgtttgtgccctgtaaaaatgagttaaaaaattttttttcactacttttccttttcctaagtagaaccatcaccaggttttctaaaataattatttttttttaatctatgaagtattttctaatttagtaaaaacatcacagctccatccattttcccatggggaagataagctagtgggtgccatacccaaaaaccataatattatttcatgatgatatgcctagtaaatttttagaagtttttacatttatggcttcacttgatcctccaaataactctgtgggatagataaagcagattattaacctcactttatgtgtaagttaaaatcttaaaggttaggttcctatggtcacagagttagtaagtgacaagctgcaactagaacatatatctcttggttctcaaaaccctgttcttttccctatagcatactaggccaaacagcctagatttttggcaccaagaagttttcagattcataataactgctataagtggttatgtcaccattccatttcccaccc

SEQ ID NO: 27869 - DNA, 2126 bp, Bovine  19866880818725
tgctaaaactcatatccactctcatatgtcaacatcattgcagatattcaatgattgcaagtatttttcaggctgtttagaaaatcccccacagaagtttatgaaatgtcctgagtaatactgcatcatttcagtaagtgtgaagatgcccaacacaaagaaagaatcactatacagagcttcccctcattcttcacctctgaactaaaggaagttcatgcttcagctacctgcttcaggagaagatcaaacatgaggatgaaacaatttagattcatttcatcatcttcacaatcaaagtcaatagtccttcctccttggtgtccaaaattcttgaaaggactacgaaatggactacgcacaggactccgaaatggactctgaaaaggactatgaaatggactcagcatattgtgctgaactcgtcgaccaggatcagaggcaacactcacctagaaaaaagaaaatcagcacatataagtgagctcacagaagctcaaatggctgtacaaaatacttgaggatgctgtggaaggtgtttccagctgtcacacggatttccttccttagccaatggaattactacctccaaatcccatgcatcttctcaaaacataaaaataagaaataaaatcatccaaactttctatttgtcaggtaaatgacacattatcaccctgaagaatgaaggcagcctctttgccattatatttttcatcccaccaacatgtccaactacattgtctgcatctatctaaaaccataaactgaacaatgacaacttccagagtaaagcattgcaaatcaattttagaaccattagcacagaatctcagattgactggtaaaagaagaatggtctctgacaataataattattacactatcatgagacaacagtacatcaagcctattgtactagttatttttcatttgcgaaccaactcttcccccacaaaaggccctcactgcccttttctgccctgttctatgcccaaggatgccaagaactgagcctcttctggccctcttgctggatggcttccagatgattcagtcaatgagaggtaccagcagaagacctgaagttggcagagagagaggcaggagtatttctctcccccgcctggctcctctgatgctacatttctgcagtatctccatcctctccagttcctctagccagcctttccctataacttcagctgccaaaaggcccaggaacacttgttccttcagccataggtatataaaggcttcctagtgaactactgctggcctctgggtgtctcactgaccctattgcccccttaacctttcccataactctataggccaagaatccataaaagactctttgttaaacatctgggataaattctgtagcaggaccctgactgacatacctgtacatcagtctcaagtcatattttctctctttaaaatctctctagtaatcagaaagctccttgaaccccatatttaaagtaaaaaaaaaagtaaaaaaaaaaaaaagagtatcccattaagaatcagaatacctggatcatgatagtgttatctatggcaaatcgcttcagttcacagaacctcaggttaagtagttgtaaaatgaggataatgagttctttccaactgcctcacacaggcctcacacatcttcacatgtgatgtcattacatgtgaatactctacacagtataaagtgttaatcatgtactgtaatattaaaggtaaccaaagaaagaaataaaatataaatattgggcagctggttcctatgaggtacatgagcaaataatgatttttttaaagcattttaaaagcatgaatcctatgagtatgacggtattataaaatatcattgattcttgactggagaatcccatggacagaggagcctgacaggctacagtccaatagggtcactaagagtgagatacaactgaagcaacttgggtagacacgcacataaatgtcacatatagatgtaaattctctgaatggctcttgtgagcatcatgactttccttggtcattgactattagagactaaaacaactttttagaaataaaagtaaatttaaatttttaaaaacttgtaaaaatttttaaaaagcactaaa

SEQ ID NO: 27870 - DNA, 2071 bp, Bovine  19866880834093
aactgcgtttttgttgtggttagctgcttactctcacgtgatcttgggcaaacacttccattttcaggcctcagcctcctcatatgaaaattactccggggggcttcaggctcctttccgtgccagtgttctgtacctagactaaaatgcagctgaggtgtctattgtgcacagctgcaatcatttcttagtaaaacacttgtgacttttctgtttcatcggtttgagcccaaggtcgactgaccctcacctcccagtgtgcactgtgtctctctgctgtcagtcaagggggcaaattaattctaatgatgatcagaaataacatcaaaatagcactaagaagctcagtctgctaccagacaaacaaatctaataatttcttttataaaggatacgaaaatgatccaagttttcattgtcaagacttggctgatgacgtgagatgcagaaatctgaaaatatatactcatatactcagtgtgatgtggtttggtctacttgcgttctaaagctaaatagttatgatttttgaatgtcttctatttttactccttgtgcaggtaataataatagtaacaatattcatatctgatacttgtggagcacacattgtgtgctatgctaggtactttacgttttgttcatttaaacctcctaacaatcctaatgaagtgaggtaggtattgttcctatcacttacaaacgttgatagaaacagtactaccaggggacacgtccttctgtgatatttgtaactaaatgcacagggtcgggcagtatcagtttacagcttcctttcgttgatgtatgctgaatctgccactgtgctggaagatgccaattacctcattgcctgagacttcagatgtaggaagattgttcagttgatggagcagaaatagcctggttttatttccagccttgcccttgagttttctgaaacttcccatgagaaaataatttaacatctttgtgccacagttatcttgtataaaatgtaatggaggtaagaatgctggagggatttcaggattcattatcatgtgaaagtgcttttgatttataaaatcagggagtaatatgactgaagatggataaagtgttgaggaaaagctcatgtcatagatacgggtgacctttgaataactcaaggagttagaggcactaaccaccttccctcgccctcgccccgcaaacagtaaaaaatcaggaatttctgctgctgtctctgcctcaaaaacaatggatttgataaatgactcacccaagggcagggagctgaaacgctttggatagaatcaagactcaaatcctagttctttgggttccatttgttgtgatctctaattgaccacaaacttcctcctacacttagtttaaagatctgtaaaatgaagatgaaaaaatagtcaaaagtgttagctgctcagttgtgtctgactctttgtgaccccatggaattgtaggcctccaggctcctctgttcatggaattctttaggcgagaatactggagttggtatccattccctcctccaggggatcttcccgacccagagtttaaacccaagtctcctacattgcaggtggattctttaccatctgagctacagataatataattattgaaaaaaatccatgtacaaaaatggacctaatacagttcaaacccgtgttgttcacaagtcaactgtatttatattttttaattctatcatttatcaaatactgtgcaggtgctatacagaactcttaaagaagggagtgatagttgcttgcaatttaaaccatttcataaaagcttaaaatgtaaagttagcttttttgttaaatgcaggatattcaatgactgatgacttgattttgttttgcagaccttggacagtcaatcttttatacaactacatgtttgctcccctttctcagtgatgatattctgagtactttgccctacacgatgatatcaaccttagctacctttcctccgtttctgcacaaggatattattgaatatcttagcacatcttttctaccaatggctatacgtaaggttcagtcttacctaatactag

SEQ ID NO: 27871 - DNA, 1949 bp, Bovine  19866880964389
acaatggtgaaaaggatgaaatgtaacctactcagccaggcacacaaggcccttcactgtccaccccttgacattccttcaaaccctcggaggggcttgggcctcccgagacgacttgcagagtcatacctctaagactttgctcctgccgttcctcctgcccagatgccctttccccataacctcctcatggacctggaacaattccacttactatgaagacccaagtcagtgtcactgtttcctgtggttggagtttggtccaactactccaggattttcagtggacctagagagcaatttctgtgccccctcaggtgactttgtgtgggttccttgaggccaagagatcccagaaaccagaatggcctttcaggtctgtgtctggcactagaggctcagttagcacaagatgaactgaacagactctaattgggggatgtggatccatcaggtaccaacatgcctggaggcagcgcagacctggaatctgaatagtggagggagaaggaattctaaggcagggaagggagtgaggggcaggggcctgaggccgagccccacagctttccttcaggagagaggagaaaggtgagcatcttgggatagtgggatcctgcatggtaccgcagcagagggcctggtaggctgaggctcttgactctaacgtgcatctgaatcccctcagaacttgtcaggatgccaactccgcagccccaccccaaaggctctgactcggtgggttacagtgagcctataaagctccactttaaaacgaatgcttcaggtgatgttgagggccactctctgaaaagcactgagccacaagtgtcagggaagactggacacaggtagggaccctagggcttccctggcggctcagaatctgcctctaattcgagagacatgggttcgatccctggggaagggaatggcaacccactctaggattcttgcctggagaattccatggacagaggagcctggtgggctgtagtccatgggtcacaaagagttggatacaactgagatacaagcactttcacttttttgggggtggggagaacctatagacaaaatgcagaaatatgcatgaactgccaaaggtcccccagcacactgcatcccggcctggacactgagagcctggaaacagggcttaccagagaacaaacctcgtcaaggttatttcaaatatgccccaaataactcaacagagatatgtttaatgaggtggatccacgcaggagctcacgcattctacaggccgcaacttgggtgatccaatcaaaatacagaatctcttgttagagaccttatcaactggcaattgtagacatggaacttaacccctgccggtcaggactgaggctctttctggctaaagaagccctcctttgtttacaatcaaattgttcagagaggaaatccaggcaaacaagtgggggttgcggtggaggggggaggttagcagaatagactgcaaatagctgggaggtatctgtgtaactttgttcccagagcctccacttgggttctatactaattgctgtcttacacgtgaatgaaaatcagaaaacgcaaccgtgctcacaggagggggatttcaggccagcgtccgtggctgccccctcttcaaggtctggccttcggaacaatccaggcagagtcactcatcaaatggagattgacttttatctgattacccgatggagaaacatccttctccatctcacaggagcacgctgtgggaaaggcgttttgcagactgcagggaaaagttgggccttggcttccctcctgctcggccagtggaaaattacaaagaaagcagggctgtcctctgctctcctcaggggttcttcctgggccccggaaaacagagagagaaaccggaaacacggagcgagcctgtgcttacctggggcggagaggagtctgggaggtgg

SEQ ID NO: 27872 - DNA, 638 bp, Bovine  19866881038539
ggggagaggaatgatgacatgcagtctggccccaacaccttcattctgcctgggctttgccatccacctccaaggccaacctcactctctcctccccgccccccgccccacattcaggtctcagtttcaccctctgtaaaatgggaggctggacacattgatgtccaggccccacacagcatgacacactgactctcagcttggccatgtcctacagaagtgtacaacaattagatgatttcactgttattaagatgatgcttctgggacctaggctgcctccagtcacgtttccacatttctgccactttgccttggttcgacaggggaccactgtgacctgccagatctcagcccatctggccagcggccctgggcagtccccctcgctgtttttcccgtggttgggcacgttacggctgttacagagcatttgtcagcgatggctgcggtccagggtgaggccccggccctgcctttgaccagcacctctacagagcaaggtcaggcctcctgagcctgcacaaatagaaattaggaggcaattagcccccctgggtgtgtgaatttccttttgaggttcaagaggcagattttaagcaaacacagcgtcactaaccaaaataatactttccacc

SEQ ID NO: 27873 - DNA, 1491 bp, Bovine  19866881059733
aacctaatgccgtgcggttgggggtattgaggagcactggggtgaggacagtcaggatggaagcggcctcttcctcccccactgggtcagttgctaattcctgagccgcaggagggacccagtccagactgcagcatccagacgaggtcccagcagatgctgctgccaggcggctgagagctggccctcttccgctgggtccctggtacccagcccggactcagaggaagttggctgagtgcctccctttgagaggacaatccgcattgcctggccttccaggctagtatttgcctgcattgaggagcatcctccgggcaaagaaacagagtcctgatggggcaattgtgtgggaagcatcgggaagccaggttccagtccggtctgcccctttcctcactctgtgactccctgaactgactcccgagcctcaatttccccaagtctggcctgagctggtggaactggctggttccagctcaggcttttttttttttttaaagtgcttctgggtcaaggcctttttgcctcttccaggcccctcagggattcatttgcattcttggaataaaattgtgactgtgcttcatgctcagccgcacatctaaatgcttatgcggggtttattttggagaagtaactctccggattgccaccagctgggctggcgccgccgccttccctgggtgaggcaatcagccccccaccgaggctggagcccacgaggggcaaagtctccggacctgggggaggcgccttccaatgagagcttcaccccaggggctgtcgcgaggctgttgggaaatgtctcatttttatatgtaaataaatcatttccagagattgctctgatcacagcggggctgctgctaaaatgtttgaagtgggtccgctgccaccgtaaactttgttaagcattattatcgagttcgcttgttttcctccaccgatgtcacagaaatctgcccactccctgtgtttttgcctcttctgcctttgtccaccctggttgcatccctctggggctggggagctcatctccaagccaccccttccgtggtaggactctgagtaatgggaaagtgcgctgggatggaaattctctttgggtagctgtaatgtctgccccctgagccacacctgggtcttgttgtttagtagctaagttgtgtccgactcttgtgacccggtggactgtagcccaccaggctctgctagccatgagatttcccaggcaagagtactggagtgggttgccatttccttctccaggagatcctccccaacccaggggtcaaacccgagattcctgaattgacaggcagattctttaccactgagccaccagggaagccccacactgctctggcctctcagaaccagcttgctcccttggtcacctccatctatgggaccagggctcctacctccttccaaagcctgtaacatcctctgtcacttggctctggctccttttgcaccctcaccagt

SEQ ID NO: 27874 - DNA, 1793 bp, Bovine  19866881136557
ttttatttagttgcaagcttgtctcccctcctaatttttcagtccttggggacagaggttctgttttgtttatctttgagtgcaggcacctggcagccaccaacatccaacaggagctccataaatatttaaaagtgactgtaaatccatgccactggacctctgtagaagggtccccttcactctccaacctcctttttcactgttgcctagtacccctccgtcatcctccttgctatttatacactcaagcccaagcctgcttcaaggtcttggcctggctgtttcctctgcctggaacacacttcccccatttcagcagggcccgattctttaagtcttccaggtctttgcttgtctgtcgttctttgaaccacacccattctgaccatcctatttaaattgacagcccatgctcactggctctcctcattctcctgagttttttgatttttctcagtaatacatgttcttttgtaatacaaactttaaaagcttgtttcctgtggttagtatgtttctcctctcactaagatgtgtcagggagttgcatggccctgagcagacacttcctgcatcctgcactgcacgccttcaatccacttctggtttcagcacagtcgtgatggacagctcctctgcacactgggattctcctgtccccaactccctactaagctgctcacctctacttttctgcctgagagtcaaggaaagcaggcagaaacccgaagtgcagggggtaaagactccataaggacttgaacaatgtagtcactggagttttggacacataccctggcctgcctttctttctttctttattcattcatttatttatggctgtgctggatcttcattgctgtgtgcaggctttctctagttgtggggagtggggtcaactgtctagttgaggagcttgggcttctcattgtggtggcttgtctcgtttcaaacatgggctctagacatacaggcttcagtcactgtggcacatgggcttagttgcttctaagaagagaagactcctctgaggctcattcttacaattccttgggggaccccagtggatcgaggcccttttgactgtggggggtaacagtcttgattaatatagccttaactggatcctcccttttccttccaggctcacctcccaaacacatcacccacttgaatactggtctcatctctgcttttgggagaacccaagaagaccactacactccaagcctacagcatacttgacctatgagggtctggtacacgtttgttgaagaatgaacagaaagagagacaatttacagaattttacattttgcatgttggtttatgatgaaatatttgggtgacttttttttttttaatcacaaagagaatttgctgaatcttgtttcttcttgtttgcactaggattttcacagaatgaaacttctgcctggaaacctggctttgaactttgtagatttttttcagggaatgagttttttttcactatttactttagtcagaaatgtcagaagcatccaggagcttgaagatctcctgctaacacctgccttgaccagcccagcactcagctgtttgttatagctgtccaaagagcatgcctatcttggagtatgatgagaaggattactttggcgagtttctccctgaaataattgagctaatccctgcctatttaggcactcaatcagcatttatagaacgcagattgtgtgtcagacttgggcaatggggatcagaaatgcctgagacagcgtccctgatagccctccaggagctcctgg

SEQ ID NO: 27875 - DNA, 1464 bp, Bovine  19866881137747
caagttttcatcaggttcattctaatttcaaaaaccagaaaactctggaatgagagaacccccaaatggcagtttaagatcttatttccaaaatcaggcttcaggataatccctcagctctattcatttgtgtgctggagaggggatcgcttttggctgaggtcagtctagaaaactgtattcaaattgtgtggaagggaagcaaacatttcgcaacaaatcaaatcaagcaatggccctctcagacaatcatgacgttaatgatgtatctgtcaattcacgtatatatataagtgtgtatatatatatactggttatgcatacatatatataaaatcaacagtattaaaatgtgtagtaacataataaaattaagatttcaccccaaacaaatggtagagtacaacatttctgcataaaattactaagaggaaaaaattcatacttctctgaacattcatctcaaccggctgatatttcaccattttgctgccgcctatccttttcaatcttgcaaaaaaagtttgagactctttattgcagggtccagtaggtgtatcatgaatatcagattcatcaaaaacactatcttcttctaattggggagagaaagtcaaaattacacttaagaggttattctctcttaggctgtgtctacacaagcatttcaacgaaagcatcatggaacacagtctggggtggttcctacaccagcccaagtctagcccagctgggcatttaattcaggtgtcaaattattcagaagttgagcagaacaaactgttataagtttgcccctcaatttccatgtcacaaagggcagcattttcaaaagaggcatctcaatattccgatagagccttcatggggagctttttcaatgcacttaacaaccagataaccaatacatgtcaggaatctgggacactcctgaaacgtgcctgctttgggtgaattttcaggctaatttggcaaaagaaaattaaacacaatgagtagatcttgccccttccacaaatacatgccttcctgggatctgagaactggcatagacacagcctaacagtacatgcaccttatactttgtgaatgcaaaatactgtactctacacttgaaaatgaaacacatgacacacagaaaaagcttagaaaagccgctggtcatctcaaaagctccacaaatgattatggactgaaagagtaaacaaaggaaaaagaaaacagaaaataacatctccccactaaagtaagactcttctcgagtttgccgtgggcgcttttatgaatcccagaaagaatctttgactgttacggtcctgaggctccataaacaaactggtcacttagaatcctagcaagcttgtatctgtgtccttttctacccccttttggccacttttaaatcaaagagaaaccccaaaacacattaatgaggaaaatgttgttatattgcaacccacaaaa

SEQ ID NO: 27876 - DNA, 1150 bp, Bovine  19866881196457
cctgagaggtgcagctgccgccctgcctccgctggctgtggtggaggtgctggaagggtacttactccctgctggagtaacctgtgttttctttgattttctccacaggaagcgaggcatagaagtcgtgcaggtgagtacagaccatgccctcaccgctgtgcaggtggaagggcctgcagcacttacctttcctgctctcggaggagtctgggtgcttggcctctctccacttgctcttgttttaacttctctttctgtggaattgacatgcttgctgcccagggtggacaggagttggggctggctgtctggtgggggttgaggaattgctgtgctttgtcggtgggggagctgtgggaccctgggtcagggtggggagcgtgagggggcatagccccacgtcccggtcctgggtgctgttgtgacccgtctgtgccatcctcaggggaactccagcccctgggtatctgcctcagctgttagccctctggggatgagccttcttctacctggaccattcttgtatcatgacccaagtggtgtcatctccatagacctttcttctccccgccccagggtgcgtcccctcccccttgtcagtccttctctgctctcagtggccgcatctgatcttcgagatgttcccctggcccctggggcatgaactgagtcagcagagactcctgaccccctgtgttgcctcactttgggttggacttggatcacgaggtcactggggcttccctgatggctctgcagtaaagaacctgcctgcaatgcaggattcgcaggaaatgcttgttcgattcttgggtcaggaagatcttcaggaggaggaaatggcaacccactccagtattcttgcctggagaaccccatggacagaggagcctggcgggctacaatccctggcattgtaaagagttggacatgacggagcacacacacatacacacacgcgagatgagctcattagctggagaaggaaggatagttggagagagaagctcacctggggtgtggagcttgccctgtgggccccaaatggatgacaagctcggacagcagcagtgatgccaggaggctgggtctgtctgagagtggggaggggtggagacatgccaggggtgcctgctggccagctccg

SEQ ID NO: 27877 - DNA, 1037 bp, Bovine  19866881211870
acgctgatggcagggggaaagtgagacagacgagcagcagattcatcagcctcagctctgagcctctggggtcctggggctgtctccccagtctccctctcactgggtccgcaggttcagagccctgtggggtgactccagtattcagggcccattggagggggggcggcgtacccaggggttaatcacaagctcagcctggctggcaggtcctggaggatagagtctgtgaccaccaagcccggcttggctggagcctctgagtctcaaggggacatacctggaagaggtgtgtgtctggtggggggctgtcccttcctggggcccgtgggcctgccttccacccccaaccccagtctggaggagagtgagcttggatggtctgggggccacggcggggggcacttacgccagctgggaggacttgctgcggttgtatttctgcatcacctcctggaacaggcccttgggggctgaggtcggggcgctctcaggagacacagaggacctggagggtgcagggcaggagtgaaagagggaaaagtattccgtgtatgagaagcgggtcatggccggaggcaggaacgaggatggagggagagcgcgggggagactgacagacaggcacagggctctgaaccaaagcagatggccgggtcctccctgtgtctggacgcagctgctgtgtctccagattatttttggcccttggaggaagccctgggagatttaaatgaccatataagacaacaatgaggttaacctcaccccacgccccaggtccccctccccagccaaccacgcgggaggcagatatgaagcaaggtgacattcttcacccagaagatgtgagaagtagtcagtggcaggtcccaggatgaaaagcgctcagtcttcgggcgggctgggctgggtcccaacaagagatggacaagaaattcaccggggtgggggacaaggagagcaaagctggggcgccaagccaggtcagtgacccacccccacctcgccggctcctcattagagggtcctgccat

SEQ ID NO: 27878 - DNA, 1146 bp, Bovine  19866881217288
ttgtctcctacccttcttttcctcttcgagtggtcccaccaatacctgtcagcgactcagtgagaaaagaagggtatatctgacaggccttatctacatgatcccaaacaactagatatttgagaatttggggttatttactttcttataaggacaatttcagaaactgaatctctaacatgtatatggtctagaagaggatggtagaaaccaagaagtctgtatggcccttagaaagccttacatgttatatacaggtttcccagtcatgggaccaagacagcaacttggtgtgatgtgaactcaattataacatttttaatgtaattagcatgctgcttcattaatggtggttatggcatgtttagctacaaaataatcagctgataaactgagcaaaagagaggtgtgatgggaattctcatgtcttggactccatgttaactgaattcatggaagtgactacgcaaagtaatatgaaaaatctgattcttgtggttggtaaattttacagcaccatgattcacttgaaactgcagcttcgggtaaaattcaaaggcagcagtctttcagaaaatttaacaaatttcatgtaaaattcaaaagtggaaatctttgagaagatttaccaaatttaaaaattagcatctatcagacaaaatcaaagaacgattaaaaacctctagtgatagaacaatttctccaattatcagttgtttttaaagacagaagaattccctgagagtaaaaattcttaatgttcagcacagtgtgtaaagcacctggcattgtcctctaagaacacaccatcaaaagctggtgtgtatccaacatgcgcttttaatggagaggaggacaaaggtggaaatctaatgatgcattatgctaaatcccaaagggctagattcaatcatgattttgggtcatgacttatttgacacatttattttgtgatacatttagctagcactgaagtcaaactcagttagtcatcccggctcaatcgtactcaacttggaattctaactatgtaattcactatccctttttagatgactctcgcaaattaggaagagaagatacatgttcatgattttagtatgtggacttaaaaatgggcatgttatgatgctttaaaacagattt

SEQ ID NO: 27879 - DNA, 1219 bp, Bovine  19866881223695
ttaaaaattttaaaggaaacaaaaaaaaatttttaaaggaaacagaagattgggaaaaaggccagccaaaatataaatattttctacggtaaaaatagccaatcacacaaccaggaaaaaagaattcttgaatttctaataaaaacatgattttcaaaaactgtttcaatttaactgtttctataaaaagaatttttaagggaaaatgcaaaaattaaaggtttatccagtctacctagaagcgtgtgtgtgtgtgtgtgtgtgtgtgcatacatatatatataaacttcatgtaactgctccagaaatgtagtttcacttagaaaagtagcaaggatacttaagtaatggctttaatgtctttacctctaaattactcatcagccaaaatttttgaaaataagcctgtcatttggctcactttgataaagaagagaatcctatttcctatgttaactatgaagaactgtaacctttattctcaataaagtattaatgaaggaacagtttctgaaaagagccccatttaatgactgagtcctgggttaatttaagaaacatttactgaatcctattatatgcagtagattccactcctcattctctggatgatcaaagactttctctgctatcccatatgtagatatccaaccacaggctgctatgctacttattatctacctgttttcaaaaatatcagccattctacctctttacccttgatgaagctgattctaatgaatcaaatttgccgaaggtctagagggccattctaatattttgttgtctttaagaagataacataaaacacataaactacaattattttctcccatgttaaggccatttatattgttaaaaaaaatatgcacatacagaaaagtatgtaaatcataaatgtgcagcttaatgaattgttatataagcaaacacttgtataatcatcatctaggtcaagaaacaggacattgccagcattataaaagcctcacacttgaccttctcatttctaaatgagggctgcccttctcagccccagtggttgcaataactacctacctttggggtgattaccttcttacttcttatacaacatgattttgaaagaatagaaaactatcaaaaatttacttagtatatatatgtaagaatctaaagtcaaaatcaacttttaaaggaattgtcacaatattttttataactttcctaatcttaaaaa

SEQ ID NO: 27880 - DNA, 1435 bp, Bovine  19866881239570
acttaactgtagtaccgcggaggaatactgtgaattgcggcggtgtcaatggtgtgggaaaaattggaatttaaatctgttgtttggggcaccatgacgctgaggctcttaggagactggtgtagggggatggatgtgaactcgcggaaagcgccgttggttgccggcatcgcccagacctgtgatgtggcagaaatctgtgagctggtgtagcccccttgggggagtacagactcctcgggagaatgtcccggagggacgagatcaggaatgtagccttaataggacttactgaggagacaagtcatgttctgatccctaaggagatacccggaggcaggggtgcctgtagagtgatctttaagtcccctgacccagatagttaatttttaagcagattaaatgaactcttagagggggagggcgtgacattgggtaagtttaccagagctcttacgtatggaaacgaccctttgatctagactaggatgtgattctaggaatgcggacccctttgttggcacaggcagtccataaggctcttcagcctgctctgtaacacctgaaatacaaaaaactgaaagttttctcaggcagtgatcctccagagccagaagaagagtttgaatcctggctgtttcatactactcaaaagatgaggatatgaaagttgtaagatgtcgaaaaaacaaggcgattgctagagagcttcagagactcagcatccggtatctttcgtgtcctccagataaacaatcctttaatcacaactcctgaatgcctgcaggctctgggagttgcaggtcaaatacctgaccacttgccagaaggagggagaaaattgcttaggaactaaggctggagcctttactacagaaactggtagagagaggagacttggagtgagcctggagcaggtccttgctggagcagtccacagaacaccggcgcaggcaggcttcttagagttactgacactaataaaggatgaagaggcagctgaagaggaggaagagggcgccctcctccaggcaggacttgagagacatttcatctgaatcttgggaaatcaggaagggctatctgcagcaagcagaacacggaggctgaacagtctgtatgctcagtgatagacattaacctatcttgtgctgccaagttactcatgtttgtgcagttcttagtataatcctttgtcatttctgtgcccatgtaatgtctcctaaatgtctctctagtcattgactagaaggatgtagttcagcactggtatttatatatttatattcacccatgaatttgttttttaatcactcagagtcgtacagaagtttcatcactacacacatacatgtgatactctgagaggagtgtccagacatggctcaggtgcacatgctgatcagatttcgttcaaatgtcggcttgtgtgata

SEQ ID NO: 27881 - DNA, 996 bp, Bovine  19866881239965
tgtcagttccgtgtttgtcttggagattccgtcctcctctccaggtggatggtagctctctcggcttgatgtgcagccattgggctatcgttgtcttcagcagctttccaagcctcgcctctgggaacttgccacactcggctctctccctccccatctcccactccagttcttcctttctttagcttaactccatcatagaagatttttccaaggtctttcctgaatcatagactcaatagcaaatcagtcagtgaagttagttttctttttaggatttacattatttggggagctttggggtgccccagcagagggttagctcttactgagtgtgtggcaagttgagaagccatggttcctcgggcagctgggagactgtagaggagggcaagagagatccctgtgttgtctgagccagaatacgcctctgtggtcataggaggaagctgtagctcaggtcacagaggtttccagccttcctctcacattctttgaggactcagggagctgccctcctggcttccagctgagtccttactgctcactcaagacccagctcaaacacacctcagtcatggggccctgggctggggttgacctttctttcttgccaagttctttgagttgtaactctcccttgatttgcatttctgctttctgctcttaggtaagttaaaaacagttggtgtttgcatgtttgtgtgcttgtgcacaagtgtgtgagtgactgtgtgtgcacagacacacacattagagggggaagctgtcgtccggtctcacccatgttgtctgtcccccacagcgcctggcatgtgcctggcaggtagtaactcttccgtgactttctgtgtcatgaatggaagcttgttgtgtagatttgagaaattccacctttaaaactgactcatggtaaagaatccacctgcaatgcaggagatccaggttctatccctgggtctggaaaattcccggagaaggaaaggcaagccactc

SEQ ID NO: 27882 - DNA, 1514 bp, Bovine  19866881329717
ccatagataataggaaagaggaaggtcacaaaatagctgtgcatataagagtaaaaatataaatcatcttccctgaaattgtcacaatttacacatgaattgccgttagatgggctgtaagataccaaacagaatgcttttatctcagtcaacgatccctaacaagaggtccaccccagggtcagaaaggcagtcacaaaggaaaagcacaggcacgtccatcaccgcagtcagctccaggaacattatattcagagagacatcacctctaagttctcagctggggtaggatcacaacaaaagtgactaggcttaaaacagcagcaaaattgtacaataaacaaactcacaagtttctatatttttgtatattcactgtaatatagaatcgcaaatataaaaaattaataatcattatatcatcatttttctaaaagcaggctttaaatgtttgtttaagaacacatcttactaaataaaccattgagaattctcttaggaaagttagccataactaaaagacaaaataacccccaccaccaccaacccatttcccaaatttcaactttttgtgcagtgaaactttggttatcatacctccatggaccaaattatcaatgcttttaaagttaagacaactgacgtattaaaagctcatttgctgcaaaaagaaatccttttttctcccacacagtaagtcccctacatacaaactctcacattacgaattttcaaatatgcgaacgtgcccctgtatgccagctgtggtactgaactactgtacttttcaaggtactgtttaataagatttaaaatgctctctttatatctgtgtttgctttttatgtattatctatgtgaaaagtattataaacctattacagtacagcactatatagctatgactgtgttagttgggtacccaggttaactctgttggacttatgaacacactggactcacaaatgtgctctcagaacataacccattcatatgtagaggacttactatatttaatacttaagcagtagatactactgagctcctttttatgggttggaagaatctggtaagcatgcaagctaatgaaattgacgaaagactgcagaaaggggaagagttaagcaaagaagcatgctcttgggcttctgtcataaagcatcattaatacatgtataatatacaccatacacagcatgcatatactatacacagcatacagcaccactatacactgtaccatgtggtcaacattttctaaaaaccactgatagttaaatttggaaaagttcctagagatttcttcatatctagcctcctgggttaggagacaggaaaaatgagtcccagggagattctgtgatttgctccccaaaattacagaattagttagtagacttgacgtgtccttcaagctccacctcttacatttttctgggggtggactagtttttaaaacaacccccaaaccataatttcaaccagtctccctgataagcaggtcagggtgaata

SEQ ID NO: 27883 - DNA, 1432 bp, Bovine  19866881345902
tcataccagtaactatattgaaagactagtgtataaaattcccaaaaataaatgactagatggaagagcttcagatgaaggaccaggtgtttaatcactgactttacacaatgaccttagaatacactgcataaacagctctgaaaacgtgagaacagtgagaatgtattatttattgatttgtaattcttttagtaaataccgactctttaggggaactatagattttctcatgaactttaacaacccacaggccagtagagcttctgtttccttttcataaatactgttgagttagcaccagcatctgcatgcgtattccagtcaggggtgtcttacagttgtgtgctctaaaatacagatttgttttttttatattgatcaaaaatgtatttttcagtctttggaatatgaagtttatttatagctttagttccaaaatagcttctgaaatgcattgcccctgtttttagttgtaatgcatgtgattatactttattgaattaaaactcttaacagagaaacaactgaaagcaatgacctaattttttctcttagcaacttggtcagattccaggagtatgtgacttgatacaaatacagaataacaaaaactggccccactctaatccattcctccctctttccatcctctccattgtccccatgttaacacgctcccttctgtctccatttggttgctctggtagttcattttgcttctccctctaattgtttcctcttcggcagcttagtctggatatacttgctagagaacagtggagctaagttaaataccatcatcaacagatcaaagtagtaaatacaggtttcagttaaacatgggatatggttgaagaattcctgtttcaggaatggcagttcaaatgactcaagttatacatctttaatcataatgaaatttagcacttaactcaaaattgtgaataaggttccaatgtgtaatatttaaaatatttaattccacattttattttataactcaaacttgttcatgctgctgctactgctgctgctgctgctgctgctaagtcacttcagtcgtgtccaactctgtgcaaccccatagaaggcagcctaccaggctcccccgtccctgggattctccaggcaagaacactgggttgccatttccttctccaaaaacttgttcatataaactcttcacctctgaccctctgcgcacactgttctttggttttatagtatctttgactttgttcactaaatgtctaaattctacccttgcctttacgaccaaactcatattctacttcccgtgttttgtcttaggcattgcagattaagtgttcctgcttcttgcaaacctctaaaacacttcttttatcattcttttaggtttttacatcttctgacttgttttgaaattaacctgtgtaactttcctcta

SEQ ID NO: 27884 - DNA, 861 bp, Bovine  19866881349416
atctaggtgagcataggcagggctgctgatcccaaaattgtgatcaaacaaatgtttgctgttataagttaatacactttaggatagtttattacatggcaatagaaaactgaaacagccctccaaaggtatccactcataatcaactcctaaaacgtttaaatgacatgtacatggtctcatagctagatgggaagacagctgaccagaatccaagtatctcaatcaaccagtccagagttctttgtatgacatcatactaccttctcttgtatttctcaaacaactagaacaagaaaagaagatggaaatagttcagggaaagtgtcatgaacagtggctatttgaaggaagaatctttaagtagagatatcattcacctcacatataaatatgtattttccatatatatttggtctggttatgtttttgacacacaagtgttggatcacttgcactccacttgcaaacaataaagattttttagcaaacaagatcatcatttaccaaaattaagttgcattgtcactcacttttgtattcaggtttctaccccagagttacacatatgcttttatttcatattatttttcagaaacactatgcatatgatgggtaagcaaaagcagaaatggaaatagaggccatcgagacatagcaatcttgcatgctgaataatttcctttcccccttcacaaatacagtgacatgtacatactgggaaaccatggtgcagaaatgagacagatgtcaatgaatgaatttacatacaaacacagcaaatcatgccgcaccacacagatggtttgctcttaccttcttctgacatatagcagatatttcagctgtaaggggaaggta

SEQ ID NO: 27885 - DNA, 778 bp, Bovine  19866881458438
gtgggtttttttagatgctggcgtggaaagcatccgcctgccttcgtgctggtccccagccgccacttcctccccccaagtcatcgcccaaatgaacagcagacccatcaagaaagatttcacaactcttcttctgcctggtacattctaaaacaatggctccagtttcccattccacccagagactaaatggattaaaggtcttggtcttcccggcaagccatgcaaagcaaacacactgacccctgagttggccctcacaccctgaagctccaggggctccctccgcctgcccccctcctgtccgttcccatgggagaggtggcatcgcactgggttatagtctgggatctggtatgaacagggatcaggtactggggacagagcttacttcttcaccttttaagcagcgactgtttgtgagcacatgaattcattgcctctaaaaacggctcctgagagaaatttccgcatggaccctgatggaggctgtagttagcctccaggaagtacctggcccttcacagtgacctccagctatagcttcagctacgggtctaggctttggtggtgagtacagcagcatctacaaaggatcagggggcttccaaggaaaccatcaaagatgactaagagatgaaattaagccaaagtgtcctggagcaggagacaccaggctccagaaggacatgaatacagctgcacctgctctgcccgctgctggaccccgggcaggcattaccaatccacccctgtcctcagccattcacagacttta

SEQ ID NO: 27886 - DNA, 748 bp, Bovine  19866881534178
ctactatgtgcttggctcttcacatatattactacatttgagccttttgacaatcctacaatgtaactgctattattcctagtagatacaaggggaaacactctaacagatgttaacctgcccaaggttacacatgtaaagagttgagaagaagggatctgaatccctgtgtgtccaataatggagaaaaaagaactgagtaggaacagatctagagatgaccccagtgttggaattacaggcaagaacgctaaagaagctgctataaatattttcaaggacttaaaggaaaagatgatctaattgagtaaacagatgaggaatctcagcagagaaatggcaacaaaagagccatataaacgttttagaactgaaaaacaatatgaaatgaaaaaatattcactggatgggtttagcatcatattggagagttcgtgaacttgaagacaattcacagaagttaccctgtttaaagaacagatacaaaaaaaaattgttatgatcagtatcccagtgacccttgagccaatattaagcagcataacagacatgtatttaaagtcccagaagacatggagagagaaaatagggtagaaaaatatttgaataaataatggttgaaatttcctaaatttgatgaaaatttaggaattaatgacccaagaagctcaacaaatcttcgaaaaacacacctagaaacgtcatagtcgggcttttgagaaccaaaggtaaagacaaaggtctgaaa

SEQ ID NO: 27887 - DNA, 1072 bp, Bovine  19866880174669
actgcactgtgtcctcccagatgccctgtggacagtggacaggtgtcttctctcattcatgggcatccggagctctcagctctccttgccctggcctgtcacagaagcgtctgttgactgtgtcctggcttcccacgtggcatctggagagaggtataggccatgtgaaggcagcccaggccatgctttggcctgcaaaactgtcagcaatgacaccttctcttaccatcacctgatgagcttatagcgataggaacagccttttaactagatgtgtgttttctgtatggacaaaattagtgcttcttcgtgtggagaaggaaatggcagcccactccagtgttcttgtctggagaatcccagggacgggggagcctggtgggctgttgtctctggggccgcacagagtcggacacgactgaagcgacttagcagcagcagcagcaacaagctaggtttgataaaagaccagtttcttttctttccagtcagtagtcatgaagggacgtgagaattggaccataaaaaaggctgagtactgaagaattgatgcttttgaactgtggtgctggagaagactcttttaagagtcctttggacaacaaggagtcagactagtcaatcctaaaggaaatcaaatctgaatattcagtggaagaactgatgctgaagctgaagctccagtactttggccaccttatgcgaagagccaactcattggaaaagaccctgaatctgggaaagattgagggcaggaggagaaagggacgacagaggatgagatagttggatggaatcactgaatcgatgaacataggtttgagcaaactctgggagagagtgaaggacagggaagcctagtgtgctgcaatccatggggtcgcagaattggacatgacttagcgactaagagtgaacaacagcaaaggactaacactttaaaaatatatataacaaaaatgtcatggggatcgctataaaagtttccaaatgcttgctctcaaattctgtagttctctcattctgggctggtggaataaacagtttgtgatccaacactggtctgtggggg

SEQ ID NO: 27888 - DNA, 2156 bp, Bovine  19866880455222
tatggatgtgagagttggactataaagaaagctgagcaccgaagaattgatgcttttgaactgtggtgttggagaagactcttgagagttccttgaactgcaaggagatccaaccagtccatcctaaaggaaatcagtcctgagtgttcactggaaggactgatgctgaagctgaaactccagtactttggccacctgatgtgaagagctgactcactggaaaagaccctgatgctgggaaagactgaaggcgggaggagagggggatgacaggatgagatggttggatggcatcactgactcaatggacataagtttgagtaaactccgggagttggtgatggacaggaggcctggcgtgttgcagtccatgaggtcgcaaagagtcggacacgactgagcgactgaactgaactgacctgaccgtggtttctaaaaccccagaaggaaaaggaaaacggctcataaagcaggggtgccacaccacagtcggccactaggtgtcaccactcagcaacgcacccggtaacccctcccagctcccggggcctcaaggggtggctcaccattgttgcagtgtcggacacagtcctgcaggacggcctgccacttgtcctgctcggcttccgtcatcatgcagaagtagtagtgacgcgctgaaggatgccagaggatgagcgggaactgcgtggggcacttgagaatgggggcagagcccgatttcggtgtggtccctgtggagacagcacccactaagcggctgccctctgtggcttccctcggccagagaacggccagcagctgacccctcgccctgcccctccgggtccagagagggctggcctgtcccagaatgaccagagtccatggggaggccgcttctctcagtctccacagcttggctaagagaaggcctgccccccctgccccaccggcagcaattcttagcattggtaatgcgtccacctccctggggtcaagttctaaactctacgcaggaggcacaaataacacagggctggagccctcagggtcaagggccaagcattactatcttgggtttcccttcaaatttcagctgcagaagccaaagggtggcttaaatgtccaaagtaggagggaggcgtgggggcaggggatacagaataaataaaagggggtttttttctctctgttttgtccgcatggatattcgagatccacagagataagtggtcctgggctgtgacctggtcactcctgttaataacaggacaatggcagttcttctttgggtcctggctctgggtccctgtgctaggctcaccacacacacagcacctcgtggggtctccacaacaccccaaggtcagccctcccagtgcaggggctggaatccaggaaaaccagactctagctgagtcctcgatcaccaagtcccacacaggggcatctcactaccccttggtctccttgggatcagctaagaggtggacgtgatcccacaaagcttctgggtgtctctgatggggtggggtcacctaggatggctccccacaaatgcagcattgacttggcagcttacaaagtggggcacctggatcatcttctccgggaacctctcagggacccaggaagggacagggtacagagtaagccccctgcacagctgtgatcaccaggctcaggaagtgggggctgggtgggactcacactggcgtggccccaattccctgggtgacttcaggcaaatccctctcaggccccccccccttggaggttcaggttgtgctgggcacttgccacagctctagcccagctgctgttcctgcaaacatggagttccagaaccagggatgccccccacactctacggccaaatccctgggcacttggcctgggatgggtggtccctttacctggtaaagagttgccaacgagttccaggtactggtccaaggaggtgaggattttgtagcccgcactgttgatgacagctcggggtgggatctgccgctcataagcctgaggagggggcaagagagatggtggaggcagctacaggtatggccaagcccaaaccccatgtctctacccggccccagggccccactcagtgttccctgcccaagacagggaggaggaggaggaggaggaggagaggaagagaagagaga

SEQ ID NO: 27889 - DNA, 1011 bp, Bovine  19866880464603
ggcccgctcagccgtagctgccgcgaccgcctcagcctgcgcctcccgcctccggaaacgcttaccggtcccgccccctaaaactgccagtgtttccgggggtgcgtctgagagaaagcgatgtgcgcttgcgggactcgcattcggggtggggcgtcaggagcgtgctccgagagaacccgcggctgcgcagtacagcccggagcaggtcagtctcctgtaggtactctagggccaacgctgacgtttgcggagaggagtgctaaataaacactttgacctatctcagcttgtctgatagagattatgtcaaatcctttactggctccacagcgcctttagcttgtagcagatgttcagtaagagtttagtgaagggaccaatgccctctcaagcattgtgccgggttcccctaggaaaagcctcacgccaattgaatgactcataactggtccagactattcgtgataaactcattcttattagccagtagttggactaggcataagcatgtgaccaatttctggcccataatacttagagaagccatcaactggggcttctgaaaaagcttttgtttattctgttcttgttttcaaagttcaccaagacttctagttgaatatgctcaagtgttttgcagccttttttttcttcctgtctctaaggttgaaaattcagttactggcatgtgcctgtgatatgacaaatgctaaggccaacaaagcagaaagattgagagagcctagttctcagatgaggttaagctatagtctcaggtttggacggtgtatccctggatgtttgttgtatgagtagttttactactagtaagtggcacaacttcagttaagccctgcagtctggctccagacccaagatctcagctctgtaggactgctttggtcttgggcgttatttctggcaatattatagactggctcagttgcttcaggtgtccggctctgcaaccccatggactgtagcctgccaggctcctgagtcatgggg

SEQ ID NO: 27890 - DNA, 4748 bp, Bovine  19866880606395
cgtgctgcggtggcgccccctcccctccgcagagccggcccggccggcagacgtcaccccgcttcccgctacctgccaggctgggctgcgcgggggcgggtgcaccgacagggacagcaacccccaccccgcccactcgccagcctgctgtggcctttcttcctctgccaggctccttatgggcacccccgggcccggccctcctccctggcattgtcggagcagctttcaacacctcgaaacccaccctccctgtcccctctactatggaacccagaccagccggtttctatgtgtgcagatttggtaaacagaatgcttgagccctgacttgctggaaggggcgattcccagctgacagcccagacgcgcgcagcctattttcggcctcctctccccttttctctcccccgccaaggtctgtggtcactgtgttcacgtgggctccctgcctcctccacaccagcacccaccattgcgcccaccattgcggggggtcagaggacgcaggagtgggtttcaggttcttttcctagcctgggccccgccaggtccccagccccctgccgcgccccctcacccatccaccaggctgcacccgcggatgcctggtatccgcttagcaaatgctcttgtccccgctcccccctgtgaatgccgtgattcagcacacacagagaggagcttcacttaagaaagaaagcattcacggccgccatccagctccagcaggcgccgggagtcagctgctggctccgcccgccaccctccacacacagaggggtctctcctcctcctccttttttaatgacccacagtctcttttggttgctggaccaaatgcagtttaaatctgtgttcagagcacctcgttaataagtagcagattaatagtctcctggaatcaggagaacaccacccagtccataaaatgcacactacaggcccacgtgtgcccggcgctgggctgggctcctgaggacaccgagccagccgccttgggatcccatccgcactcaggaccccttccatgtctctccttcactctgcgttttgagaactcatgtaaatgatcgtcgctgccgtgtgtactgtgacgttcgggtcccgggtgaagctctttatcacctcagggaacccatgactccttgtcatgaacacgatgactctgatctccaccatgtagatgaggaaaccgagcctcagagagtcagaagtctcgcccagggtcaccgggggccaggtcttgtccccccagaactgacacagagctccgtttctttactgttgcaacacaggctgtctctgtgaaacacgctgctggtgtttggtgaaaagaaatgcctcaccctcttgttaacaagctctaccagcccttccaatccggccggccggccgggagtaactataggatgtttgtcgaacagaaccgaggtggtggtttccggtcccacctccagtctcagctgcctccccacacccaccccggtgactcttgggggtgtcccagaggagggagagtcctggattcgcagcaagggtggtttaagatgaaacgggtgcttctgttccccagagccaaaccaggaggctctgggtgagtcctttgcgaaaatcaggtgcctcctacagtggagggaccaggtacgtgagaaccctcagcctaccatggagcgtagtaatgcccccggcagctgagagtagggggctgcgttcttttcagctcccttccctctctggggaagaagagaaagagggtgattgacatacagcccccgaaatccgggtcaccctgaacgtggaagctggtgcctgtttctggtgtgatggtggtcgtggtggtttagttgctcagttgtgtccgactctgcaactccatagatcgtagccctccaggcttctctgtccatgggatttcccaggcaggaatactggagtgggttgccgtgccctcctccaggggatcttcccgaccaagggattgaacccaggtctcctgcactgcaggtggtctcgtacattgcaggtggattctctattgactgagccaccagggaagccattatttctggtgtagaggtttcttgagggggcatgtgtgggatcaccaggctcagagaacatgggtgtctgggaagagatgggttcacctcccactcgcattggctctggccctcccaggatgccagcagcgtccccagacgttactgtgtctccaggtgaaggggggagaggctggcagttgggcaggagctgcggccacccagatgaccactgcactaagcagtgggacactcagcctagagaagggtcgggacacacggcccttgtggcagggtaaggatgcctggcttcctttcagccatggaggggtcaggctggagagccagatcacctgcatcagagggaccagaccagaccagctgttcccaacagtgacaggtggaccccgtgagtgtgtctcactatcccctggcagagaatgggcccagggaggtctgtcggagtctgaaaggtgttggggaaggaggttcaaacaaagaagatggcctcgcggaagagctgaaccttccatttcatcccctccaggcccccaggaaggaggagggagtgaacaaagatgagctttgaattgagtttgaatcaagtcttcagataaacagaacccactcttaaatcttgaaatgcaactatgctaataatgggaagtggctgcaaagctatagaatctggcccagatttcactgagggaccaggtgcccagaattggaaagggcagtcaacacagcacagtcgggcagtgggtgttgaagagaataaagcatttcatgtctggaccccagcggactccagttctgcaataacctagtaatgataacctcagtcatccaaggaccccaggttgggagtcaccagtctggccacctgaacttcccacagatgcgcagaagggtaggggaggtgctgtgtctatgtgggatgagacctgctgggactgccagccaggggcgccctggcagcggaggtgaggggtgaagagggaagagagggatgcaaacaggaggagggtctctggagcgttactgagctctgtcctctgcccggggctttcacaagcttcttcctcacccacacctgactctggtccaagcacagcacgtcagcccccagcccggcggggcggaggctctcacgggccagtcagagtttctgcctgtttgtcttgttatgtttctctgaagccagggacgagggatctctctgccctggttgcagcatggtcagatcctgacaccactgatcccagtggcctcacctctggcccatggagtgtctgaatgactgaggccggggcctgaggctcagcagcacgaggggtggagagcgggttgtgtgcaggccgcaggcgcccactcaggccaccgcccccagcggcacccattctggggtgcagccccctggtcctgtgagccattctgggattcttaaagtccttccccctttaaaagctggtttcaggtgagtttttgtcacttgcaactggggtcctgacttacacatctccccctcctccgcctcatcaccttttttcatttaagaactagttcctgagtgcccgaggtggagcagagcagccgtggtccccggccctggggctccgagcctggagggggcaggcgtccagtaatcagcacgttgggcagatgaggcgttagactccactctgtcccttcctgtccaggtgaccttagacgggttgtttaattctctgagcccaggctgctcacggtttcaggaagatgtgatgtagggctggccacaggccttgggaatgtgaagtcgctcagtcgtgtccaactctttacagtccaacccatagactgtagcctgccaggctcctctgtccatgggattctccaggcaagaatactggagtgggttaccatttccttctccagggattcttcccaaaccagggatcaaacccaggtctcccttactgcaggcaggctctttaccatctgagccaccagggaagcccacgggaatctgcctcctttaatcacaaagggactgattgttacagaggagcagccggaggtgggaggggggctctgcagggagtgcagcgtgagcctcaagctgcagagtgagtggattgtgtccaggcggtggggacagtgctcatgtgctcatgtccacagccttatactccatgatacggtgtatgtagcacactggtctttgcagagtcaaaaccttcttaagtgtcagagctaggagttccagccccttagctcacagctgaggttgcggggctgcagggatggggctgggctgctcggaaggggcagggctgagacaggagcccagaacccaaggccagcagctgggccagcgtttgtggagcaccccggtcatccagctgctgggagaactgggagcacgtcccgggagctgggagtcctgatgagagagggcggaccggcacctgtcataccaggctggtgctagaggggaagccgggaccaccctgggtgcaggctcaccccgcacaataggtgtctgacaagctcacaaattgccgccatcctcaggctgtcaaagaggccccagaaaatagagcccttcgtgccagccatcagcccacagagcggcgtgtcccatggagttcggcccctgagggatggagtctggatccttctcagctgtgtgacctcgggcacccctgtcactcagtatccaca

SEQ ID NO: 27891 - DNA, 3566 bp, Bovine  19866880646371
atgcatggacttaggtctgataatgatatttacatgggagcagggctagggagggtgggagggaacaaggattaggcctgagagtggtcaatggatacttttatatgccttgcttagttttttacaaggagaatatagtcaggtattatctatataactaaagataagcttaaattttactcctaccttagcatagggaaaatcttatttctttatagaatgctgcttttatagctccaacacttgatcctgatctcagaaccaaataactaaatagaaaggctggttttaaaaaaaagtgtgtgtgtgcgcgcatgcatgcgctgatgttggactacaaaagtaattcatgctccttgttataaatctaaacaatacagaaatatacagagtaagcatctcccctcccaccctgcagtcccagcgcctggaggcagtcgccgtgaactgatgaatggctctccttcgtggcttttgtctcagcccctccagagctgggagttgagttttggtggtggtgcttttacaagagaggaatcgcactgtacagacagtgaaatttggcagacacccttctgtagctgcacccacgtttgccccgtcgttcgacagctgtgtaataatccactgtgtggatgaaccgtgacttagcaatcgcatgctgatgggcattggagttatttccagtgttttcactcttttgaacaattctgcaggaacttgcacacacaccttggtgcatttgcagttgtcttgggggctggagctggtagcttgctgtgctgtgcagacgtacaaggggtcagacacccatttcttggtctcttttttggaacacccgtgccttctctgtgctgcatccccagaacttaagacttgaagctctttaagccaagccccgcgattctcaaccctggtgtccatcagaaccatccagaaccctttatcaaacagccagccccttcatcccccaccccctacccagccctccaaggcagtccctctggatggacctgcaaatctgagggctgtcaggctgcctgggaattctgggccagtgagaacccctgctgcccaccttctcttaaccactattttttttttttgcctcccagaataggttctcagactatgagaagaggaaggtaagagaatgtcttttgtcctctgtcacttttcttctcattaaacatctcaactgttacatttgaggagacgagctcttccagcctctaagtcagggggtgaagtaacagttgcccccacgtatatcacctccccatggtctcacccagccttggtgggtgggaaggatgtccccactttacagatgagaagattgaggctcagagagattgagcccatcccctgcagctctcacgtcctaaccccccagagcctgtgccagcatcaccagggtctccgttcttgcaggaacagaagatgctggagaaacttgagttcgaacggcgcctggagctcgggcagcgagagcacgcccagctcctccagcagagcaacagccagaaagatgagatccttcagacggtcaaggaggttcgtgagcggctaagtggggtcaggcctgtctgcttcctctgccaggggcctcctgactcaggctgactcctgactccggtccctctgatgtgggaaggcagtggggtgacctctcttaggcccaccctccaggacacagggctggggaggagtcatccatacagatcacctagtccaggctcttcccatacgtggacaccctgaagcctagcaaggggaggacttggtccaaagtcaacacagagctggcaagacagaggaaacctggtctcctcgtctcagccctgggcccctggctgctctgcggtacctgaaagggtcccagcagaccccagacctctgcttgtcctgccgcaggagcagtcccggctggagcagggcctgagcgagcaccagcgcttcctggatgcagagcgtcggcggctgcaggagcagctgaagcagacagagcagaacatctccaaccggatccagaagctcctgcaggagaaccagaggtcaggctcccatctctccggtcctcagacccagagacctcccttaacatgatgcccacgtggggctcaatctctccctcaccgtctctgattctacccaaggtctcggtgctgcatttggcactgactttaagagagtctggtttccctgatgactcagcgggtaaagaatccacctgcaatgcaggagacatgggagacatggtttgttccctgggttgggaagatcccctggaggaggaaatggtaatctactccagtagtcttgcctggagaatcccatagtcagtggagcctgatgggctacagtccatgggttgcaaaaagttggacaagactgagcaactaacacacttgaaagaatccgatccagggatgaccaggtttgcctcttggggctgctactgattggatctttgcctcccaggcttcccatctgtaaagtgagtgggtttaacaagttaaaatcacatcctgctctaatattttggctttccagtcacatgtcactctgaggtcagccattcgccttacagtgagatttgccttaatagatcctgtccaaggccagagccacagggatcaagctccaatgggaaaaagcaggttggatagaggtctcaagaagcctgagaaagtttagctgggggtctcttggggaaagattccagaaacaggctctgccacaccccctgctgctccagccttctgtccactgtcctccgagtccttctcctccctcgcctgcggttgagtgccagagggagccggctggcctgccatgcgcagcgtgcccatccccgggggcacccaggaaactgccctctgttggctgcttcttacatgtgaagtactctgtctgttttcttgttcacactttaccaatactccatgaagctttaaaaaaattattcttcccatttcacagatgaggagctgggatttggagtggttgaggaattggcctgagaacacagccctaagtggccagttcctaagccgccctcagcagttctgttggaaacggacccaacaatgactgccggctgttcatggtttccttcacaggcagaagaaaagttccgagattctgaagtctctggaaaacgaaaggtcagtgttttgctctagcacattctcaatgactgcctgccttcctgtgggtgagcagacctggggagagaaggtcttgtgattcttgaggactatgtcagaaagatttcctagagttttgaggagattcaggcttccctggtggcccagatggtaaagaatctgcctgcaatgcaggagacccacaagttcgatccctgggtcaggaagatcccctagagaaggaactggcaacttccttcagtattcttgcctggagactcccatgagcagaggagcctgaggggctacagtccatagcgtcacaaagagtcggcccagctggcgactaacactttcactttatcatgaggagattcacccccttacagagtttgaattaaaaagaatcgctgc

SEQ ID NO: 27892 - DNA, 747 bp, Bovine  19866880707267
tattgttttcctctatttctttgcattgattgctgaggaaggctttcttatctctccttgtaattctttggaactctgcattcagatgggtttatctttccttttctcctttgccttttgcttctcttcttttctcagctatttgtaaggcctcataagacaaccaattttgcctttttgcatttctttttcttggggatggtcttgatcactgcttcctgtacaatgtcacgaacctctgtattcttcaggcactctgtctatcagatctaatcctctgaatctatttgtctcttttactatataatcataagagatttgatttaggtcatacctgaatggtttagtggttttccctattttttcagtttaagtctgaattttgcaatataaagttcatgatctgagccacagtcaactcccctgttttgtttttgctgactgtatagagcttctgcaactttgcctgcaaagaatataatcaatctgattttggtattgaccatctgatgatgtccatgtgtagagtcttctcttgtgttgtaggaagaggatgtttgctgtgaccagtgcgttcagcttatctcttatttagcaccagaggattcataccagagtgaaaccttataaatgcagtgaatgtggtagaaccttcagtcagaatgcaaacctcagaaaacaccagcgaactcatatcggagaaaagccttgcaaatgtactgagtatgagaaagccttcagtgactg

SEQ ID NO: 27893 - DNA, 921 bp, Bovine  19866881091500
cagcaccagcaagaaggtaaagccattccctagcggtgtgggagggtaaagagggatgactgagttcagtagtgggccttttaaggttcagttgcccacagggatgtcctgtgggcatatgaacagatggcattagatgttgttgatagagacctggaaagactatatggatctgtgagtcaccagcctgaagacggtacctgaaaccatgagggtaggaaagatcacgaggaagagcagatcaggtgagaaaggtgtcttgagacagagccctgagaagcatccaaatgggaggaccagacgggaaagaaggactccctaaaagaagcagaggaggtatagtagagatgcaggaggaaaaacacgagagagcagaggcacagacactgggggaggggaacgtgttaagagggcgcatgcgcagagtggcccgtgagctaaagcctggatgagtcacctagacttggtagcaggaaggtctttagcgaccttggcaagtgcaggcttagtgggaacaagaaaggagagcgttcaaaggcaaattaagaagggaatttgtagaactatcgcagggatcgaaaagggaatttagagtggctgaaatgtattcctaaagtaatggtcaagtcttcacatctattcagcaaacacagcttgagattatattttaaaacactgcaacataaagataacggcaaaagaccaattaaaagactgaggccaaaaaacatacgatccttttcttacacataaaggagcccaaagtaacggctttaatatgtaaaatacttcaatataaaaaaattagaatattagttgtggcatgaaactggaggccctttttggtaagttggtcacagcaggtgacactgggtttgggcatgattttccctaaattcacccagtggagggaataggggg

SEQ ID NO: 27894 - DNA, 614 bp, Bovine  19866881159486
ctctgcctgaccatcagctccatggcacaggcaacactgagcggtactccaaggccagccaccccaaagcactctactgccccacggactgctgactgacactcgtgccccagcctgcacggtgacctctacaagatttttatgaaaatcgcactcctttatatggacattaaacgtcccctcttcccatggtatccacgagagagccccagcccatggcggccacagtccagtgttgacagcaaggatcaggagatgttacactcttctaaccaggactcatcacaaggacttgtgttctcaagtcagaccccatgggaaagaaagaagaccatggacccagggttaccttgtgcaaatctggcatcaaatcctggtataaagatcgaatcaacatatccagagttcgtcgacgtttctgggcgaatgttggggtttccaaagtggctttttcaccgttaattactaagataaatcaagttacaaagggaattacaaatgttaggttattgaagaatgtccttctcaaggaaacttttcacagtaaatgccacccatttcctaatactgttattaccctcctttcatggaagaatccttaaaaaacttgctaa

SEQ ID NO: 27895 - DNA, 1287 bp, Bovine  19866881290685
atcttttctcctttttctctcttttacaaactcacaaacatactgaagataaaatgagtaaaattagaaacaaacaaagttgagattcagttgattggtaattgtattatatatcatacatttttgttcacatgtaaaatctgtgttttgctgaatattttaaatagtgagacaagaaagataaaataagtcagacgattaagaggaacgtacatttttttaaattagaaaattaagactagaaaagataacagaaatgaggaaaggattaaaattaacagtgatgagacagcatctgaacagttaaacaatgaagctaaaaaattagatgagagtataaaaaaagaactcaaaaactcaaagagtaaagttaggcaaaaagacaaaattaaacagtggaaaaggtttaaaagaactaacatttaagtgtttctaaacataattttaaagatgaaagggctagacatgctaaaacaatgaaaaaatcttagtatttaaagattaaaagaatataataaacataggaggtatttccttctgtaatgttccatgttaaagatgtatctgtatttactgatttacaaagatatccaagactggattagagagaagagcaaattacagagcgctattatagtctcagtacatatgtcacataaaagttgtgaatatgtagacagaggagtgatgggaatcataccaaactgaactgggagaggtaagggatcggaagtgggggtgtcatgcataccatcagatcccttcaccatttctggaatcttctcccctcccctcttcagtgcacttttgccctaccacccacacctgggtggccacccttcctaggtgggctaccctcgcgcttactgcagctgctctgcccacctgtgcagagagcaccgtgtgcctggagtttacagcccccaccccgcgacccagggccctcagctcctcgtcgcaggtgggacagctctgatgcataaccgacctcaagcagattgaaaagccagctctgtatgtgattttacattttctagccacattaaaatccatacactttatcttcaacatgtagtcaacataaaaattattgagacagtctgcatccttttttattcgtactaagtcttcaaagtccggtgtgtgtttcacatgcgcatgtcttactttccctgcctgcatttccttgctcagtggtcacatgtggcacgatgctactgcatgggacagcctgcctccacttgagttgaagctgttccttcacaggacttctcctgacaatgaaac

SEQ ID NO: 27896 - DNA, 1274 bp, Bovine  19866881309123
acggggggagcccgtggtttttctcgagttcggcgggattctcgagttacgacggggaattcaggctgcctcttgtgttggcccaggcaagtccaatcttccattcgagttgcgaaggaaagctggggattgctctcgagtgactgcagggccagtagacctcatctaggcctggaggctgcagtgctgtactgaagcagaggggttgggaaaggcactgaggacagagtagaacacgggccagtgctggcctgttccctccctgggggccagcccgtcagtaataaggggtgaagacaagacactcccaagatccaggtgccccaccaagactgcaccaaacccttactgcacactgtgacatcacggccatagaaccatccaaatcctatcacatcccttagcaatgagtggaggcctccacactcccaggcagtggagtcgaaggtacaaggaggacagtgagtatgtgaaccatcacagacttatttagaaaaaggcagcatccgctggggaagggaaagctcggtctggagtacctgcagaggatggacctcatagccatcggtgtttagtccaggagtgcctggtttatctcccaacttccaattaaaacagccaagaagagccataaaaagagcctatgctggcaacaacgctgtagtcaaaaggaccaaagtcacatttcaagagtaatggcatagaggaagtaagcagtaaccacttgttgaattaacgaatggatggtttatgggaagaaattgagaaatgcattgctgaaacaagcctgtttctttctccggtgacacagtgaggaaggtgggaaggtgattctgggacaaaagagggcagctttgttaggaaatgtaagcatcccgctttttctgattggaattattttctgagccaatcaacagcattcttccctcatctctatataaagtgacacacacatccaaagcaaagaaaatccaactacttggaaatggaaaaataaaaatcaatcttagctaacacttatgtcaaaagggactctttatactgtcttctcaataaacactgtgatgaggcaaaagacaagagccttggtggtcttattagtgaggaagaggcctctgacagggagcccccatcctgctgccgggtttagatgccaagagaagtgactccacacagcctgggtgtttggagccagatgggcactacccactcccaagctgctacagtggtaccaattataggctgcaggcatgttgcaaaaaaaaaaggtcgct

SEQ ID NO: 27897 - DNA, 595 bp, Bovine  19866881362536
ttttcctagcagaaagccagaaagtattctgctgtcttccgacacttccgtttcctggttctaccttggggcttccatctgaggactgcagccaccctctcaccctgccggctccagcggcttggccccagggaccgctgggggattacacagcctttggcccggcttcagcttaccgctattcctcccccgcttgcggtcacagccaagtgaggcccggtgcccagctccgaggcccagatgttgcgggtctccgcaacgtcgggaaggacttacccgacggcttgtctgtggaggacgggaggctggtgagggtgggcatggtgggcagagggggcggcagcactttcaggttctggtcactctggatctcgttggtggagatctggttcatcatgcggttgtaggggggtggctggtagacgcggggtggggtggcggggggcggctggggcacaggccgggcggcgggcacccgctggcagtgctcctccagctgggcaatgatctcagactggttgtgggccagcgtggccagatgctggtacttgtgctccaggtaccttgtacttgctggccagctgcagcatgtcag

SEQ ID NO: 27898 - DNA, 789 bp, Bovine  19866881371390
gcccccggggcaggtggaaccactgttgctctgtagataaggagctttgccttctttcttccttttccattttccagtatgatgtgtcagttgagtgtagttgagagtaaaagcgcgacattcccgtcggagaaagcgaggcacctgctggatgacagtgtcctagagccccgcagcccccgcaggggcctcgcccttgcctcctcctccgccgtcaccaacggactctccctcggtaagcgtccccggcctgcacacggcagcgggtgggccacggcccggcgtgtctgtgtctgtgtccgtcactgcagtgcccgggggccccgcaccccacccccgcatagagggctccctacaggcatcgccagggccaaagaggcctttgcttcccggtctccacttcacaaagggccatgggtcctcatcctgccagtggctctgagaggggacagacacgtacctgagacccactgtccttggcaggcgactgccaaagccttgtggctgctgcccccgcggggctccgtccctggggagccacaaaccctggcccacagggcaaaggaggagattctgcctggggacagcagcaaggcggccccggggtgctccccatgcgcttgtcttcataccaagaagccaaaataagggaggatgaaaaattgaccttctgggatgaaaatgtatgtctgaactccagccagaaatggtgcttatatcaatagaaagacagaggctgagctgctggggccagggttggcaggggtggtatcagacctaagggtggca

SEQ ID NO: 27899 - DNA, 2885 bp, Bovine  19866881489385
atccctctttaataaggtttagagtcaaacagttaaggggctagaaggtttctaacacacagcttcatggaccttagaattttgattggtagaaagaaaatctcaaactggggacaaaagaggtagagaatagtagtttccggccacactgtagataccatggtcacttccccttagctccaaccagagctagtttcttcttcctaaggttgcctgcaccatggataaaaggagctgtgaagttaccagatatactcggaaaaatcaaagtgggatttcaaacgtttcatctcgtcttcaaatcaatagcttaagatagtcaatactatttgtttatattaatatgttgaaacaaaaagaccaaagacaaaaagaaaaatggcaattaatcttccaggacagaaagcactaccgtttctcttaagtattgttttctgttttatgtctaaagtatctttattctgactgcaccggctcttagttgtggcgctggggatccagtttcctgaccagggatggaaccggggccccctgcattgggagctcggagtcttagccgctggaccaccagggaagtctcataagtagtgtggaataaggctgttttaaaagaaaagactcaagaatgagggccaatttttgtacaagatagtgataagcatgaaattatttgggaaggattctatatttaagaaagaaaaagaatgcacattgccctcatgcgttaccaacagcagcagacctcaacgattaatattccatttcatctgccagcctgtatctgttcctctataaaacaccttgtcctctatctttacagactgcaagaattcttccttgaactgcagggatagagaataatagatatttatcttgatcctggcaggaatccaagatgcggcaagtatcttaaattggtagatatagcatttaatggctctgaatcacatttcttgacttaaatgggggttaccctaaggattcaagggttaggaaaaatatactttggaaaaaaggggagacgagtgtttcatatcatcccagaaactcagagcagacaacagtctagtctagtggttctcaacgtggagtgatttgcccccaaggggacacccagcaacgtctggaggtgcttttgatcgtcatgactggagggtgctggggcactagtggggcttcccaggtggtgctgtggcaaagaatctgcttgccaatgcaggaggcatgggttcgatccctggtttgggaagattcctgagagaaggaaatggaaaccgcttcagtattcttgcctggagagtcccatggacagaggagcctggcgggctacagtccatagatcacacaaagtcagacaccaccaactgactgagcacgcacacctatgggcattgagtggggagggaccagggacgctgctaaataccccacaacgcacaggctcatacagcccaagatgtcaatagtatcgaggctgagaaaccctaatctagtccattttataaagacaccgaaccagagagaaatcaagtgacttctccatggcagcagtggtagaaagtggtagaaatcatcttacttccaaagtctgagattttgaccagctctaggatttaatgtgtcacagatcttcaggtctcagatatttaaacatgtgtaatctcacagacagacaaggccacaagtgcagtgctgccagtggataggtgtccaacggacagaagacaaaagccttggggggaagcttccagaaggcaggaggagctccccccacccacaccacccaacacacacaaaggcctagtttcgggagggctgctaccttctcccaaatccaggggctgcttacaagacgataccagaagaaaacaccctgctggacctgggctcaggctcacgcacaggaagagggtggagcccggaagagaagaaacactgaaaatccagacgagacggctgagtttgtgcaaaattttcaccaaacaggcagactgggcgacctcctccagtcagtcttccatactctatagagaacagaatctgcttcttaggttttcaattggtttattagttctgcaatcccatttttttaaaaaataattttaaaactttatttacttttggctgtgttgggtctttgttactgtgtgtgggtttttctccagctgcgttatctggggctactctccagctgcggtgcgccagcttctcgctgcaggggcttctcttgttgcagagcacgggctctagaccacagactctagttgtggcgctcaggcccagctgctccaaggcatgtgggatgttcccagaccagggatcgaacctgcatctccttcactggcaggtggattctttaccaccaagccaccaaagaagctccagtcccactattctttgttttctgtttcctcggcccactttccattttgctctgctgtttcacattacctcccatttgaactcttggttcattatttttatgtttgagggtgatttaattttccttatacctgtcttcttccagaataaattatttacctgagtatttatgccgcaattctgtcatttttccatatcaaatgtttacaaagttcctgtgtagagttttttttttttcttttttgttcaaatcacctagactctccagaggcgattctctctcactgtctacttgtaccaaaatgcacaggtgggctatctttgccccctcctcacttaccgaggcatgatttgaagactgccttcagaatatgagttgtttccacattgggccagcaccctttgcccagtcttccactaggggatcagtaggggagagatgactggtgaaatttgtctctccaaactgtaattcagcaaaatattcgggccaaagaccactc

SEQ ID NO: 27900 - DNA, 1116 bp, Bovine  19866880415125
ataattaccatttttgaaactattttggctgttaaaaatgtttctttttaataagctgattaaaagaggctgcttattagcataagctctttgccgttcagccctcttcctaattaaaagcactcatctgtggagacctcaatttttcccttttctctgtgatgagtttttggatattttttccttggcagtttgttttatttcactcttctgtctttggtagttttcggctcccatattccagagatagaagccactgagccaaataatacatgagaggaaatgtgcagtctgaatgcttgagagaggaggggaacatctacctgagtggttagtgttgaaagtgtaagtcactcaattgtgttttattctttgcaaccccaaagactgcagcccaccaggctcctcaattctccaagcaagaatactggagtgggtagccattcccttctccaggggatcttcctgactcagggagtgaacccaagtctcccacattgcagacaaattcatcacctgagccaccagggaagtcctaagaatactggaatgggtagccatggtcttcctgtcccagggatcagtcccgggtctccctcattacaggcagattctttaccatttaagccaccagggaagccccaaaagttgggtctaaaagtcttacgtttatggtagttgtatagttgtgtcaaatctcctactctcaagttaccaaatacgacgtgtaaaggtaaaaagcggtgaatacaaatccactgttctttgcatagtttatatccccaacatcaatagatatgcctttgcaaatgttgctactctaaaggctgctggaacacatacctgtgatgcccttagaacatggagatattcaggggatgacatgttatagattgtagatacagccaccccttagaaacagtccttaatatatgtgactaggaaacttgggaagcaagtatactccaaatgctgtgatatgtgtcatcatcatatatatttttatgggaagtttttaatataaacaagagtatacatcaagaaattatgtacattaagaacttattagcaaaaagagtggcttgctaaaaaacctggaacaaagtgagtgaaagg

SEQ ID NO: 27901 - DNA, 2560 bp, Bovine  19866880439368
agaatttttagtttctccgctgttcttatgctttgtcctttagtctctggttatgtttacaaatgcagtctttggcaaaaagaacaggtaatgattcttcttgcaaatcactttaaaaaattttagaaattattctcctgatgggaatcactttatgacccctaaaacatggacgagagatatagttcagtgaagagaaagagaagaaaaataacgaaatagaaacaagcaaggttaaaactattaaaaataaaatgtatttggtgacattttgctgactgatatgtggatgtgtaaccgatatctggacatactctatgaagcattttaaaacttcactgcaggtagaaaacatttgagaagtttgttaacgtgcagatttgaaggctgcacccaagaaattctgatttagtgggtcttgaatgggtcaaaattttgtgtttttagtaagtagaaggaacaactgcatagaccaaatttagaaaaagaatattttgtagtgctctttgacagaacattctgcaatgatggaaatactctacacatgtgcttttaatgaagtagtccccagccacgtgtgacttctgagtactttcaaagcatctagtgcaggtgaggaactgttagattttatttcatcttaattattttaaatttaaatacccacatgtggctagtggctgtcatatgcggtttagttgctaagtcatgtccgactcttgtgaccccatggactgtagctcaccaagctcctctgtccatgggatttcccaggcgagagtactggagtgggttgccatttccttctccaggagatcttcccaacccaggaactgaacccagttctcctgcattgcaggcagactcttgcgctgctggcatattctttaccaactgagctagaagggaagcctggctatcatattggagaattctattttagaatatatgtactttgttttgggacaaggaccgtgcagttgtcttctgtattgtacctaccacagtaaggaagcaagagatactatattgaaataagaatggcatgatataatttttgcaggatatttccattcaatccatgaataaacatagcagtatgattttatatggtcagagtaaacatgtttatttgtatccttgtctgtaaagagtgaggaacgccattttcataaggtgaacaaaatgaaacatctgtggttaacttcattgatttgtacttaaaaataactgtacactagaaaggaggtatgttattggattatatggcaatcccaccaattaacttaacaatttctctgctgatagctgataggtcaagcacagaagccttgacgaggtgtcaggaatggctgtaccatagcttatgacagtctccaaatccatagacctcccttcctaagcaaacactaggaatatcaactgtcaagaaagtcacaacagaagaaactgagattccaagttatcttttagtgtttagtgcaatataaatattctaagtcaaagagcatcaggttatagtattcacacaccaaaaagagatgacacagcagactgtccctccaaaattagttggattcctgtgtcaaggttagcaggggtgtgaaaccttattttcactagacctgtgctgaaaaatatttagccagaaaagttataaaatgtacgcatacaaacacacacacagacaaacacacacacacacatagactaaatagatggggtttggcaggcgagggaagggaatggcggattgggatgttggaatgaaagtgcataatcatgtcaaaataactcacccccaagcagaaaagaaaataaaagggaagtagggcagaaaagaaagaacactaatggatccgcctcctttgcccccagagacaaaggttctttctgcacattcacattagcattttggcatatgaaaatgaattctagtgctggtctataacaaattactgctctgctagctgaaatcttagataatctcaatatggctggcaataagtggttttaaagaattgctcttagtgtgtgattggtgatacatgtgtcttgtgtatgagttggtattggcaatattccatgcagcttggtgaaggtgcctggttcttgacagaccctcttctggaaaactggctctggcctgaaaacagaggtagggagggattctgaagccagtgtctctacatctttccccattgatgccagaatatcatgagggctcacttttaatcagagatgggaaactattgcctcttataatgttttaaaaagctatcctcttcatggcacatctcagtatccctttggggcaatcccttgtgggttcaacttctttgataagcactgctttatagatgcaaaagaggaagcttctatcactaaaggtcatttaacaaatcagtgtgtttggtttgggattaaaatcctgattttctgatgcttagtctcaggaatattttacaattccacattattcccctatcttaataccatgcttctaaaaaaaatttttagaagaagtttacagatttcattcacaagacataaaaagatt

SEQ ID NO: 27902 - DNA, 1773 bp, Bovine  19866880478906
acttggatttgaaaataccttaattccaccttatgggagcctagctgtttttatcgaaattcagagcttatcacttaaatcatattgtacctttaaatttaaatggatggtaaacagcattatttgttaagcctaaatcttcaaagatggaaaaactcattctgcttctcacgcatttgaccaatagtgacaaatcaccagctgtaggcagcccaagcagccaatgtttattaaatgtctcactcaaccccaaacctcatgaattgtttaacatacaagagagacaaaaagccagtatttttccttgtgtcagctcttgttaggagcatctctgctctgctcctctccctgctggctagcaacaacattaacattcattgttcttaaacacatgggggctttgggggcctctgtatacacagccaatcctgtgccaagtgtctataaatgcacacccaatgtgcaagcacagagaagcgaatctgaggaccacactgatgatatacatttaggagggcagggcagtgggcagaaagttccgtcaccaccaaagacaattcagacatgtgagagaaagaacctagtaaactcacaccaagaaaaatcccctgttaaatcaacagagataaaatgagactcttcatgtcgcccttttaaagttagcaaaaggggacctgggttaggtagctggtgacccacaagactgagactctcatccagcctcagggatagctaaagaatctcaccaattttgcttttccccctggctgctaccttccatagttggtgggaaagaatggtggtgctaaagaacccgcctgccaatgccagagacacaagagacacgggtttgatccctgcgtcaggaagatcccctggagaaggaaatggcaacccactccaatattcttgcctgggaaatcccatggaccgagaagtggcaacagtccatggggttataaagagtcagacacaactaaactgacttagcactgtttgggtggtaggtcatttattcagaaaatctccgggggcacttgtaatcatgaacccctgggattcaaagtagctggacaattttaataaataacctggatttttctctgagaatacaatattctagcattatagatgtgaaaagttcaaggaaaactttatttcaataaatgtctgcttaagagtcattcgatgctaccatatctataaacaggtttcagctggccccacaaaagtcaccattaagttaatcttaaaggattttttttttttttaaagctttgtaacagcctccaggaaggccaattatatgacattcatcattaagaatcaggggacaactcaagtgagttggaaacataaattgtgatcaacaaagacagagttctctttggtctataatatttgaccctattaaaatggaccctgaacactgaataagtctatctctttctggagttctttgatcagtgagattttgagctcaagcagcagccccagagcagctctagatgggagcacagcgcatggcctcgctttctctctcctcttctttcctgaacggagagctaggggtcttcttgttattacttcctgttactattgcaaaagggtctaagggatggatacattttcaaactgaataaatacagaaataaaacaatttaccatctgcacacaccaaccaactatataacataatttgtagtaatcagaggtcatccacagaaatacagaaagctggaggtggtattttccattcatgacatccaatcc

SEQ ID NO: 27903 - DNA, 2581 bp, Bovine  19866880501204
ttagcagtgaagctattctcttcattttacttcttatttctgggtcagagaagtaggaaatgggggctttccagtggtgctagtggtaaagaaccatctgcaatgcaggagacataagaaatgtgggtttgatccctgggtcaggaggtttccctagaaaaggacatggcaacccactccagtattcttgtctatagaatcccatggatagaggagcctggagagctacagtccatggggtcacaaagagtcagacatgactgatgcgacttagcgcaatgtgctcaaagctacagagatggatattgacacttagggcctgaattcaggaggtcttgggtttcccctaagtacacttttcactgtacttcactatgatgtccagctaaactatcaagatgccacctatatacaagtgcaatagggagaaagtgtgaaatgggccaggagttgatgtagatgtagaagataagagggttaggacatgtggaagaactgtgaatgtcagagtggtcagggtaagagcatgatacaactgctcaccctctgttgtatcttttattgtcccagggaacatggtcattgttcctcacaaacatcccctcaccagtgttgcccttctccatgtcctccctgtccccgccaaggaatactctcatggaaaatggaaccttcctgttatgctaacccaccactgttcaatgctataggcttgaatacaaacggatgtgtatccagccaatacaaattctgctggccaagtggttttcccagactaaaggatgacaaaggcaggaatagaaattacaattgaagtcttctgagagtaaagagagattatatggtataagaagcaagaatgtggagaaatggattgcagtcctgtaatttccctggactaattgtgagcccttgaagctcgatttcctctttataaaatgagtggatttgtcatgatgtcctaatggtgccaacgtgatgtaattaaatctattcaagaaataatccttatcttgattaggtaaataggagttgattaattccactctgattaaccacccacctctcactatttcctagaagcatttacctggtctacccaacatttcaccattttctcccagcagaagtgaaaaatgctccagtatccgtcacaatagagatcaagccaagatccaaatgctttaaaacataaaacacttctacagatggttgtggtttgcctcacaagtgggatggcattggtggggacaagatgaggcaggggggaaagggaggaggaggtataaaggagaggttcctttaaaacatcaaaaagtctttatagatctttcctgccctttcataaacacttcatctggcagccagattgccttaatggtctgcctagaaagacccaccctggcctgacatagccagacacactctccagttttgctttgcttctttgatgctgtcacatgttcttcattttctacatttcattcattctttgcctttaagctataaggataaaagtgcctggcatttaaaaaaaaaaatcagcttacattttttaaaggggcagaatttcatgcagcctttgattttcttctgggagaaagtcattacttttctttaaagaatactagagagatttttcttctgcctttcccccatttccatccttcaccccaactctcccgctttcaacagtaagaaataacactggttatagagcaggaatgggctagagaaaaaattgcctcctagaaagtacttatggcactgtagtgaataaaaaagcctgaacattcatttactgctaaacaattacaaaagataattagaatgttttaaagcattgcactatatttcacattctgttaaacactggttgagatagctatttttaaaatctggtagtgttgaggagaaaagataaccaagatagtatggtgctttttggcctttgaaatctataaaaaggttacacagaaaggtctgaagcattgtatatgaaggagagtataaacagaaacagagtaaaaccctgtagaacaaagacaacagcaacacaagagaattccagtgtgtggaaatactcaaataacaaatgcgtctataaggacatgctctagatagtcttccccaaaaaagtgagcctaactttaaaatacctagggatagagagaaactgtagaagaagaacaagtagtgataactaaaggataaaaatttgccagatatggagtgtctaaatgcacacattggggaaaaatagggaatgataagatttccaaatagaatagatgactatttctttttttttttttttttttgcttttcaggtaattttttaaattaaatttatttattttaattagttaaataaaccacaagaaaccttaaaacatttaaaatacctcattggaagttcatgataagtgcctttagagaatcaaacagaccaagcaaaactgaataaccagctaagtcaaaatgtctgtgttggaaggaaaaaaaaaaacaagcatctttgggagagagaaaagcaactagaaaaattggataatcaaccaactagagaaagcaccaaaca

SEQ ID NO: 27904 - DNA, 983 bp, Bovine  19866880516414
tgggttgggaaaatcccctggagaaggaaatggttacccactccagtattctcgcctgaagaatcccatggacagaagagtctggcagtccgtgtagggtcagagacgatttagcaactaaaccaccatccttcaaataacaactccagcatattaccaactccttccctcagaacttagctaccctatcttccagtcaaaagcaaccactctgtccaagtgtgcccaaagcttccccacagccagtgatttggacatttttaccctttcatggggtttcttccttccccccaacccactctctccactttacttcaaatgccatttctctcagcaaccagatatgctttttttcctccattcaatcttcctggcactttgttctgacaacacttaaatcacttcctttaagttaagtccctttagttattaagttgttctggtaccatcctattagatgataggtaggttcattcctggaaggaagaggtgaagtgtcacacaaagctttccttttagaaggtgcccagtaaatacgtatataattgaagtgaacacatacaatgtgtatacgttttactgaaactccctggattgtttgaacatgaatgtatccggtgaagagtgccagctgtctctgggtatgagagatgcagcaaatttagccagagaatctgttcaaaatctgtttgaatgatacagtccaccatgtcccagattgctgcttcttactaccccaaaggggtctatattttccatggaaattgatttctacaaggaaaaagaaggatttggatcaatttacccatttgttctcatccaaaatgatactgatttgtattggattatcttcaaaattcccttggcacaaatagtcttcattagacaatgtcaagtgagtgatgtttaacatactgaggatccctgcaagcttagcaaataagggcagcatgatttgccagactatttgaggcattgttgga

SEQ ID NO: 27905 - DNA, 1506 bp, Bovine  19866880606495
tgaattgtattaagtacagtgaatgtacaaataggccaggaatgtgtcatggcttgctcggaagtgcaatattactaatttgcatattttgcaagttatcactgagatttgatgatttgtccaagtaaaagtgcttaaaaatataaaactttaatgggttcatagtccattgcactttctgacattgcctgttgacatatcctagcatattttaatgctttttcacacttgacatggtactactgtacagtaattaagttcccataaatatgttcagtaatgattgttatttaaactgattagccattgatttgttcacatcaattcaatgacaactctgtttctcaaattaaacaagtcaacaagattatgacagtcttaacttacatcatttaatttgaagtagaagactaagaatagaccaggacaatatgctcggcattgatcactgtaaattcatttttaataactgttgatttttatacagcattggtacttatgttttcttacaaggatgaaaaatagggattcatgtgaaaagtactcaatttacaaaatgtctctaggaatccagaaataaattgtaaaataaatatgaagggcttatcacacattagcttcatctcagaatattcaccttggctaaattgaccagatgagtttatgttgttttacatgtacataactcttaaaattaaaaaaaaaaaaagtaagtattctgcctgaaagcatcccctaactgcttactttcactttgaattcttctgaaaattctcttccatctcagatttcttcatagcccagggacaatatccaaactatataatctggtatttcaagacccaaatttgattttttcaacttctccccaacatgagctctctttcagagaatttagtctactctctttcaaaccaaaactccccagaatctcctctaccactctcctccagtcaccgattctcttgccttgatttccctgtgaaatacatattttattttaaacagcacaaaaggagaagaacaaaatgaatgaagaaaatattgactccatctgtgtatctgcccaggtcagagaatcttcttctgttcatgatcagttgccttgtttctttacttgtttttctgagtgtacattgggaaaaccaatttatagaacagtttggcaaagctgaagatcctcatacatagaaagtctactcctgggtatacaccttggggcaacattggtacatgtgcataagactggtacaacatcatcaccatttgttgtgtttcaagtgaggcaaatggtgagcttggttgataggcagaaacagagtttggtatttagatcctcctcttgatctaggggagctatcttgaaactgggaatttgacctcagttatctttccaggctgtggctttacactgacaacaacctcatgccaagctcttttgttggttatttgtatgatacaacaaaattgatctctattttccaatattcctattaaaaaaaaacc

SEQ ID NO: 27906 - DNA, 1126 bp, Bovine  19866880623077
atattaaagtatttcaacttactcagcatggtatcatggatttactatgaattctcttccatgtcatcttcatctcaggatactctagctgatggagtagcctctatgttacagcctctatctctaacattgtcagttgggaaaaccaaatcatgaactcagttcttcttccaacaagatgggaatggataattttcctacaaagggaggggcagtgtagggtaggcaaccaaatatgaatgagcagtaatatgacctatactgaagtcaatcactataactataggaaagagtctaatgcagacttagacagtccagattcctaacatagggagctggacttctggctttccatatctccaaattacataaaaattggtaaaatctggtgattcccaagttgtagtttttaagttaatatcaaagtaggcttacatcttattttttaaagaatccttattccagaatttctttgaaggaaggaagtaactactagagaaaaatcacatactattgtccttctttttacctttccctttagctataaagaggaaaaaaaaaaaaaggcaaatcaaaatcattctctaaattattgatctttttgatattatataaaaatataatataaatacacatcaaaagctgagcttggttataaaaagagagtacatattcaataaatttattcagatcaaatgggtatagtgaaagctttaaataaataactgataagaaggaaatatctagcaataaagtagctaaaaaatgagtgtaaatctcatgtgaacccatgggaaatataatgttacagtagaagagctgacaacaaaattaaactaataaatgagaaatacgtagtgtatcaattcgtaactctacaatgaatgtgctagtttactttcccaataaagtagcttatttatgactaattttttttaggtataggaataaatatcaggattctaaaaaccagagttctttcaaattcctttgaaggaataaaataagaacaatgtaatttatttctagggaccatagaaaacttgtctaagttttatagggaacgaaggtgttcccagttcagatatcagcttaatttcagtggaactgcaagaaaacagaataa

SEQ ID NO: 27907 - DNA, 1088 bp, Bovine  19866880686477
tcaagtattccctcctcaactcaagcatttccaagaatcaggcttacagtagcactgtagagatgaggaggtattagtcaattctactaaatacttgcttccccagtggctaatcggtaggtttaaaaaaaaaaaatccacccgaaatgcatgagacctgagtttgatccctggatcgggaagatcccctggaaaaggaaagggcaaccaactccagtatccttgccatagaaatcccatggatagagaagcgtgatgggccatagtccatggggtcacaaaagagtcagaaatgactgagtgactaaacaataacaacaaaactacttacaaaaaaaaaaaaaaaaaccagggggaaggagtcatgagagagtacattcacaccaagctggcagtggtcggaatcttggctgaagagttactggacagtcacaaaaataatgattttttacatctacaaaaatgttctcccatcaagtgtacacaatgatatccttatgaatattagtgttaaaatatgtgatcagataagtgaagagaaaagataaactctctgctaagttcaaagaaaacgtgctctagagactggaagatattataagtaatgctttttccaatattttattaggcaaagtgaaggaagagctgaagcagctagatattgaaagttgttgatgaaaaagttctgaattatccatgctaactctctaataaatcatattgcctagaaaatcactctcttcttccttctactttctccgaaatatctgattcttgtgttttgcccctttaataaaataagagtccaaaccaaagggaaacaactgaccttaaaaatttcagacttggaatcagtctccactgaaaggagctactgctgtctctcagcccaaaagtagaataccaaatccatacgggctcattaaaatcttagactccatcaggcccatctgtaatgatgacaagtggtaatcaatgtgattggagtatgtgcttaatgctttcgtatttccatgcatgcatacatgtagaatggttcggagagactggagatatttcaggattgttttatcacttaagatttcagg

SEQ ID NO: 27908 - DNA, 830 bp, Bovine  19866880739563
agatgtaaaatcagtatgggtcaagtaaagcttagtaattttaattgcattcatttagggggaaaaaaaaaaacctcacatcttaacctaaaccttcacatttctttctgccaaatttgacttagggcaaagcaataaaaaactgccagcgttcacttaaatggacagagcgatgtaataagttattcagaagagcagatcactcaaagatcacctctatttgggtttataataacaattttcagctgatttactttcttaattatatttctcttaggttattaaatttgcaactcttcagaatatactaactgggtggcagaggcctggaaaaaaatcagctcttctgaaggagccaactcaggtcacataatacactggggggaatttccaaagagaataatccaaaacagagtgcatcaagtgtgtgctccagccttctagaactgctttcccttttggtgacagtctaaggaaatatcacggggctttctcctttaggttgggcctctaaagaaaatcctgattcacaaaaattgtcatgcagtgttattcaaaatggtaaaaaattggagacaacttaatatccaacagtaaaggactagttaaacaaattataatacatcaataagatgggttcttgtactattaaaatagcatttatggagaattttaatgacttgagaaacagcttatgatataccataaaagggaagaaaaatcaggttataaaattgcacagtatcatcaccactatgtggttaaaagcacaactgcaggaatctggctatgaacatctgattcctgatggtagcagttattaaatattt

SEQ ID NO: 27909 - DNA, 1738 bp, Bovine  19866880749566
tttttagttcctcttacttcctgcctaagggtggtgtcatctgcatatctgaggctattgatatttctcccggcaatcttgattccagcttgtgcttcttccagcccagcatttctcatgatgtactctgcatataaattaaataagcagggtgacaatatacagccttgacgtactccttttcctgtttggaaccagtctgttgttccatgtccagttctaactgttgcttcctgaccttcaaacttacttcagtaaattcattaaaaatgaatgaaaaggcggtgatataaaccatccttgcttttgaaaacacagtgacagcgtttcccttctattctttattatacttacttagaaaaatatcagaaaacagagcttccatagctttttgattggcttaggactgaacaatataaaatttcctggggaatttaagatttgccttactttacactctcatgcaggtttttaggtcagctaccccagtaccaagatgtttccttcaaattaatgttggaacactattattacaaatctctcttaaaggggtggtgatacatgtattcctccatttgtctgatgcttttattagatgagagccatctactactaactttaggcgttctcaaggagccagtgaatttgagaagactgctgttaaggaaaatcccatggacggaggagcctggtgggctgcagtccatggcgtcgctaaaagttggacacgactgagcgactttactttcacttttcactttccactttcatgcactggagaaggaaatggcaacccactccagcgttcttgcctagagaatcccggggatgggggagcctggtgggctgccgtctatggggtcacacagagtcggacacgactgaagtgacttagcagcagcagcagctgttaaggattgattttattaataatgaacttaagctctgtacttcagtaatacttttcatgtaagagtcttgaaatacttgcaatttaaatgaattaagtcttctaagatcctttgagctagagaagacttggttttgaaatagaaaatctaaagaagagagatacaaaattagttttacattttaaaagtaaaaaaaaaaaaaaaaaaaaatcacctttccctgaccatcccctcacttagttgtagagtaaagctacatctttagctttgactctctgttctctggacccagccctgtgccagccactcagctccccagacttgtgggcagttggtggtaaattcttccagaagctgttttactgtctacttttcaggatttaaaaagaaaaaatacatataaaagttttaaaaaagcaaaatgcagagggcagatgtgatgacagatttttttttttttttacaattatgccttttaaaaaaatttagaatttgtcagttttactgtgggttggctgttgatgtttcatcaggacaaccatttctttgctgagttcagatgaggaggaagagccatgccaccaaaacaaaacacacaaaacaaaactacagagtcatctctaaccttttattcaaggtctcagttttccttaactttgcacacaagtttcagtgttgagttgaattgtgcctgctttttatatttggagagagtgtgactattgaaattgaaaacttaaaaaaaaaatcacctttctcccctctcccttgattttctgagttctgccccccttgctctctatccccctcctctcttttcccatgtt

SEQ ID NO: 27910 - DNA, 2494 bp, Bovine  19866880779532
ccttgacttacaatctgaaaacttcgatgtgttttaattttcgtagttcttgtgaccatctgatacttgttctgtattaggtgctatggtctacctaggtaacaaagggattcattcattgttattgaaaagttctgttttgagtccctactagtgccaggctctatttcaagtactaataatagagaagtaaatacgtcaaatttcctgcttccactgagttcgcataatatgaacagaggatgataatatgcaagtaactgaaaacaaaaacacacaaatatcgccaggtgccagcaagtgctacaatgacaaataaagccagttaagtggaatggagccaggggtaggggtatggagatgaatctgagatgaaacaaagggaaatattattttcaggggtggttttgtgctgagaaacatagttctggtggtatatatgaaggctaatttgtatggtggtgagatagggattgctggttaggtatcactgtaattgcacagggcagagctggcaatgattgtgcgaaggggctgacagtgaggtaaggaagagtataagtaaatggataggtctatatgtgtataattatgcatcatatacatgtatgactatatatcaatatgtgcatgctaagtcacttcagttgtgtccagctctttgtgatgctataccaggctcctctatccaagggattctccaggcaagaagactggagtgggttgccatttcctcttccaggggaatcttccctacccagggatcaaacacacatctcctgcgtcctctgtattggcaggtggtttctgttccagtagcaccaactgggaagcctctatatcaatatgtgttgttgtatttatctgtatatctaggaagaggaagagactgaatagagaagttgtgagccatgtttcaaaataaaaaaagtagactggacaggacttggaccctttttaagtctgttgggcagctgcttaacttggacaatgcgctagacacatgatacacatgtgtgggtgcacaatactttacataggaaggtctgttatgtgtcaaacaacatgtgtctacatcagagaatacttagcaaattcatgaactgtgcctgtcacattttgcgtgtcttttcaaaaaggagataattatgtttagagtgtgttagtaaaggaaaatatattttcaatttaaagtcatgcctgtattatataaacaagtcttcttttccctgcaggacacaaagcctggtcagccctactgactgaaggtagttaataaagtcatcagactctcagtaaagaaacaattgccttaaggatgagaagtgttagcttatagataaataaaaattgactgtttcccactcatactacaccccctcaaggatttagccaccaattccatgtacatacccatatgaagtaatttttaaagagggttctctaatgtgatgagtgtcacttcaaaatgctttttcttcccattagattggattattgagccagagagttgtgggtttgtccctttctgaccaggacactgatgagcctcatgaattaaaatttatgtcttcccttgttactgatttgccacctggctcttttgaattatcacagccaccaaatgaattttatagtccattgggggctgtccatgcttgttaaggtgatatttccatctctggcatagcacaaaatctcatcttctccttggtgaataatcacggtgccgaatccccatcagacatcttctgcttcttaaaatggcgtaagttatgcatcctctgcttcatagcaggccaaaagatggaattacaatcaaaccctaaaagccctgttgttatctctgctatgtatcagcttccagctacaccagcctctggtttagtgacatatgttccctagatggatttattctattcccatctgattttccctatttcttccctggtggctcggatggtaaagaatctacctgcaatgcgggatacccggtttcgacccctgggtcaggaagatccccttgagaaggaagtggcaacccactccagtattcttgcctggagaatctcatggacagaggagcctggagggctacagttggtggggtcgcaaagagtcggacatgactgagctagtaacacacattcttatttctcttattttctacttctctttcttccttattctattaaaatctcttgagttcactctgctgggagattttcttacattattgcatttaattctttcaagaatctatgagtaggatttctattcctatattgcaagtgcaagcaagttgcccaaggtcatgtaggtaataggagaaaaagccagaatttagcttgtgattataggatcacaaagactatgtgtttttttttgtttgtttgttttggtttttatatctgatattgcctctaaagaaagccatgcattttcctcattctgttatacctcactctggcattcccagtgtctcacagcaaat

SEQ ID NO: 27911 - DNA, 1363 bp, Bovine  19866880867755
aatgttattgcaaatatcaattagagaatgcatgtgagaatatttggaaaaaggtgatatacaaatatatgatatcattattcctttgctggtaaagctttggtcatttagttaatatcaaacattttataaatttacagtagtctataattctttgacaagatgaacgataacctttcagtatttctttttgccgccttttacagagaagttgttggaagtatgataaggtttaaaactgttagagctctatggaatatacctaaaatgaggaatgtgattcacattagtatttaaatgtacaccactctttgttctatttataaagcatcaattagcaattaaagtgcccacataattcctactttgttgacaccatcctttcccattacatggacaaactgaaacacatctgggtctaggagtgttactgtagattaccaagtatgatctggcacaagaattgagaatccctttctaactcagagctgccaatagaattgtctgtgatcaaagaaatgcttgatagtctgcactattcagtaagtagccactagccatatgtggctttttagcccttgaaatgtggtttatatgatggatgagctgaatttttaatttaattttgattaatttaaagttaaatagctgtatttggctagtggtacttactaaattaaatggcacagttttaaccaagtcactgtatttagcatgaggatttgctcattagccaaatgaacacttaaaaaagaatgatgatatgttattttataatgtgaaagaaaactccctcacagactgtcagcatggccagagatcctcattggaagaacattatgatgagaggttagtgtagggggcatagaatcagaatatgaaggtttattctgatgattagatgattcagaatagttataaaaactggggcaatggaacaaactggttttactgctagaatacttggcccaccagccaagactttccttggatattgctttggcaggtattgctacctttgctctggtgactctccttgttaagcccctttctggttgacaagtcctttctgctctttttctccaaactcatacttcatgtatactggcagagagaaaagtctgtctcatctttttggctttgctcccccataactctcagtcctagaaacagatctctcctttcatcagcgagagaaatgctgggaaggcacagaagggaaagaatatttattttaacccttctgataaggaaagaactcaacctgtctgggaagccattccttcttttccttcagacataccgtcaagaacatcttaaggtcagactgtaaatcatgtaaaatatctttatcttttcaagg

SEQ ID NO: 27912 - DNA, 2659 bp, Bovine  19866880880183
tcctgaggagaaagtttcagccctcatgaagcttgcaatagtggaaaaaacatatttgaacagtcactacaatgcaatgtaacagagaccataatagagatatgtgtggaatatttcttcaatgaatcatcttaactgttttcaccaaaatactttccactatgttgtgagatcagaaactttcttttgcatttctatacaatcaccacagttcttatttcctaaaaaccaaggtcatatttaaatctattaaaaatccaaggccacttgtaatttcccaaatgttgtgcattgatttatagtacctgaagtcatagacttgtcactttatttttggagaatcacagtgaaaagtacccccatacacacacacacacatgtgcacacacattttttttctcctttctccatcagctctgtagttctctattatatctgatgttgtatgagcgttctttttcatcctcttaagatttcatgtcttctgcccagcattctttcccattctgtgatatgtactgtatactttctagaaatccatattttttggcattaaaagccatcatttggcatgttttcatttgagacactgcagcgttatcttcactctgaatatctacatgcaaaaatctcttccaaagccataatctttaaatttagaagaaaattccacttgcagccataatttctagtcttgaaagtcatagaattgagttcatgaagggaacctaaataccattgacatcaaccctcttcttttgacaataacaaaaacaaagcctggaaataggaaatgacttgtccaaggtaaaagttgctacagatacattccagggttcctctggctcaaccatttgttctcacttgaatcaacaaagtgggtggcaaatggtgggtttgatgagtcttgggaggcacagcatcacccttggagaagtgctctgggaaaataataaagtcttcaatcagccctgtcaacctacataaagatacttatgtaagtgactatgatcacgtcttacttctaaggtctatgataaggtgtcttgaatttattagtgcctataattcctcctgaataaaatgtggctcatgggatgtagttgcttcttcagctgctgtgggaaaagacaggatgacttcattttaagaaatacagcttttttttttctccctattttctgtgtcatatccgtcttctgaatctcccatttgtttattcattccacaagagattgttgagcttccaatgcgttctgaccatgttctttggcactgggcataaaagagtgaataagacagaatttgtctctgccttcatgtctgttttcagaactgttcagcaagattgttatttatgttttccctctgtattatttctactaggataccttaaagatactttgcttgtagagaaataatcttcattttttttttttttactatgcctgtgcattattaggacatctcatgaaagtaaactattgtgatagagaccctctcaggtactgaaatgataagtttcttgtccattctctgaggttccatatagaactgaagttctctatcattaatataccagtgtgaatttcaagggtcaactatttatttcctttttccctggtcccgttcacttgtgggtgcttatgcattcaacactctgtaagtcagttacatagtcttcagatattagcatatctatctaacaaaacactatatatccacattacttaaaccatgcctagaacttagtaaatgttcaataaatattgcatataagtgaaaggaaaaatgaatgaatgagcttcagaaatgtactgattctgtgctggctggtcatctccttcttcattcctagaactgacattaacctgaaaaagattagaaattagcattaatttgcacaaaccttgtttagttatagccttgttaaggaaaaatcattttatgtagactttcctacactattcagtaatgttttcccacatcctgctgcttcctttactcagcctcttttcctggaggtggttgtcatactggacacatgacccacctgatggagcccacctggaggcatcttagcaaggctttctctgggacaagggttggaattagcaaggcaggtctccttgtatagctactacccactatctagtatatattcccattgtttgctttatttctttgcctggatgatggcttattttcaaaaaggcacaaggcataaataaaaaatgcaatgaattaattttttttttcatttagtaattactgcactgcaccaaacagagctggatctgagtgaacgttgacatctaattttcaggttttgaattgcttggagaaaagcagatctctgtttttatctgctaacttttcactgtgaggtaattatgcataacagagtatgttcctgggcagtgtttaacacaggcaggtcataactagacagaaagcggacccttgcttttaggataggaataattaaagattcataattttggagaaacagcagtgatgtcacttaatagacagacatggggaattgcatgcttaaaaggcatgtgttttaccattttagatcattcataaactgtaaacataattggaaggaaagcctcttttctgtattcttgtccctatctccatagcaagattg

SEQ ID NO: 27913 - DNA, 1118 bp, Bovine  19866880886583
ttccttgtagtagaagcaagtacattagctaaataaatgaatgaataaagaactatgcgtttggatagaagtgtgaaatagagcatggaaggaacttaacagtttaaattaagtataaaagagaatacagagtcattgtaagttcataaataagaaagtgatagaatgcaattccttttttagaaaatttgagtcaattaccagcattaaagtgcttcaggtggaatgaagacaaggtctagcaattaggaagtcactgaaggaatctagcaataagacagggggagaaaaactcaaaacctattcatttgtctgaattagttgctacagttgtatctctccatgtcattacacctaaattggtgaagagtaccctgtttgtttctccaactctcccatcagactacaagcttccaaggtcaggactgtgcattatttgtcaccatgatgcaaatatttgccacaatatcttacaaatagcaggtaacacaaacattttgcatgagtaagtgaagaagaaaagtaacaacccagatgagggttatgacagtgagaaggaaagaaaggaagacaaagtgcagagtttcaaaggaagatctttgctgagctgttgccttctggtgttccagtcatggtgttctaggcaatgctcattcattacacattacctcttcatctcatgaggatgtctttttttcttgctcttgattgctaaatctccacttaagtgctggctagttttgtttttttgttttttgtttttgttttttttttttgtaaataaacattcaataaatcttgactgaactgtattctaagtgtaggctctgacagcctagacttcctacaaatcaatctaaattgtatccttaaaatgaatacttcttatccactttctccacgtcccactaaaatgccccctcagctcatctctactccatctggttgtacctctttgctaccagcacccattaccacatactctaccctcacatggccccagtgctctttcactcaagccatgactcaagccagactctacctggtccctctctactcagtgtcacctaagagtgtaatatctaagagtgtaactcctgaaaatgtgggccttacat

SEQ ID NO: 27914 - DNA, 2697 bp, Bovine  19866880886970
tgcgtgcacgcccactcagctgtgtccaagtctttgtgaccccatgaactgtggcctgccaaactcctctgtccatgggattattccatgaagtaggctgccatttcctctttcaggggatctttcccatccagggattgagtttgagtctcctgcatctcccgcattagcaggtggattctttaccactgagccatctgggaatcccacgtggaggtcgcaaacgctcatttaaacattttccagagtacctgatgtgctgacacctctaggtctttcagcatgctcttctgccatctgggtgaaatgcttcactctttatgtcaaccatcaaggaccattatgaagaccccagctcccacatggaactttctattcctaaccagagcacatagagactgcttctcccacagcattgcttttccactttgcacctactcttagctaattaaaagcagacctttcagtccttcacacaagaccctccactctatcacctaaaacatagttttctattccacctcctactgttgtccacattgatcctacagccccatcctactgaacctcatgttctcctcccctctgctccctctccttcttctcctcccatgttcagtaaccaagcaccccatccatcaaaggccagcacaaaatcccattccttcttacaaatactacaggatatgatctctctctgttaaacctgatatcatttatatcacctgcacagatatttaattttgtggaaagattaaaatttacttgaggggagaaactttcaagactctctggaaaatccccttagaattttttttttcttcttggccctaatagtttgctttgagtgtctcaaaggacattttgtaataggtttacatggagaacttcatggcaatctgaaatgtggacatcattgtcagtttggacttcaaacaggaagtaactccccaccacaagaactttatgattcccttgtcattatcagggagtacatagaatgtgtattttatcaatgggaaacaagctagtgaaaggaagacagacacaagacattaggtgtgtagagagatgctgtgctactcagtcacttctgcaaccaagaagcagatcctactggaagaaagcaaggcctgaagaagtgttttgttaatatagatttgggactaaagatcatagtgtaagcaaagatttctgaaccacagctcaataccaagttaatattgattgtctaaatgacaataaaggggaatgtttgtggaactgaagactaaatacttcaagatgatactcagttagtaaaacacaatttgtcttcagagtgtctcctgggtgcctaacattgatattgagaccaagcaaggacactttggaggtagtgggacttctaaggaggaagagagaaaaagggaaggaataaaaattcaataactctgcaaaataaaaaaacaatgagtaaagaaattaaattaaaaacaacactagcaaaaaatttaaccgtatgaagactacatagaagacagcaaagaagcatctgtactcccaactggcagaaaacccccttgtcaccaccaccatcctagtttacacaccacactgtcttgctaggatcaacgcaacagtctgctaagatgcttgctggcctcagccttgggtcctgtgagcacatcctccacacagagcgctctttctgaacaaaaaccagttcaagtcatcaccatccccacaatttgcctgactacttctgcactcagccttttcactctctctctcagtacttgtttaggatttatgaggcatcaagggcacagaaacaaagcagaacaagcttgattcctgcactacaggagaaacgtttcctataattaagtccaaatgccttgatgtggcacaccagtctcacattccagaactttcttatctctccaacctcctagaccactttcctgtggttttgacactccattcttagactcattctgtattcttacttttctctattagccttctccacactcttttgctgtcatctttttcaaacgatactttttgtactgaaatacccttcccctcccaccttcctggacagtctcctaactagctgctacttctctccaggataccttttagaaccctctgttttctctttgcatgtcagctgcctccactatactgatagatgagagagatcccacattatttattggtagataactccaatactcagagaggtacctgatttatgtgggtgctcaattatcatcagttgggtgccctaattacagtttgaccttgtgttgctcatttctactagactgagaggaataggttcaaactgtgcctgaggcagggactttggtgcacagctatcttcagcttggtgaatcccaggcacagaataaatatctgttgggtgaatggatgaaagaatgaattaaattaaaagaaatagtattaaaatacatctacacaaatgtgattagaaccaaaacttgacattgagtattcttttgaccaaatagaaatctggaacattcaagggattaaatatcataagaaaaatactcatttctaaaaccttttggtatactccaatttcccctttcctcgcatggcacagtaaaagcactggagttgaaactgtgagaacctttacaattttacttctgaattatgaaatgccatatctaccagcct

SEQ ID NO: 27915 - DNA, 962 bp, Bovine  19866880929851
tcctatgttaggaagctactgttacattttcaaccttcattctcaaacccgttacagttttgactttcattctcaaacccagtctgcaacaggttaagagctataccacgaggcacaaaagcagatactgaatccatttctaacttctagagtttttcatctgctcagctccaagattacagaatatagctcattaatacagctcaggacacaactgaacacctgaaagtgttgggaatctaccaccttctagaaatctgctgagccagccataatttgctcacaccaatctctcctggattcattacagcatgtgcaatgtaacctaatgggcttacttttgtccccaggcactcccatttattgtcacaaactggtgcaataccttcaggtcaatatctgcaacagtccactctgattttgcatctagatagaacgtcccatctttcctttcctctccttttctctaagaagctctataaattactggcattagcagtaacagaaatttctcagtagcaaaggtaggttctggtcgcaacaagaagtggatttaatcttcgtgtatgaatactatgattatgaaacccagtctccctgtgttccaacactagcactaatagttggtatgctcaatcttccagcatgattttctcaagggtcttgcatggttgcacagtctcctctgttaactggtttctgcatgtgtagggtggacataatacagccaacacttgatcaacactcgtgtcctgaagtaaatgttgacctggtagtgaagaggacagaccacgtgtggccttatgagacgtgtgcttggggtcacgtttagatcccagaccgaccacttatcaggtaaatctcaaataagttgcataacttcctgaaatttcagtttcttcaagtggagaaatgaaaaagggcaacattcatctcgtggagttaatgtgaagagtaaaatg

SEQ ID NO: 27916 - DNA, 1310 bp, Bovine  19866880942660
ctgtccatctcctgctttgttttatgtcattctcatctagctggcaaaaccccaaacccagattcattctttagccatctttcccttctaatttcaaatacctgattcctggtagagaaaaccatatacaccacagcatatatctatggtctcatgtccatggggtctcaaagagtcagacgtgactgaatgactaacattttcactttcacttctcataaaaatagaccaacagcctaaaattaggtatttgtgtgaacatgtaaatgtgtattaaaaaatgagctacgtttttaaaattataggtcaaactattagtaggttgtataaatagttttgtagttaaaatatacgtttttatttttagcaaaatatatgagaatagaaagctgaggtcagactgtcttatttacagtaaatcaatgtattgcttcctaatatgtgtgtgcatcatgagctataaagtataacgaaattcttattgtggttcataatcaaaataattcactgatctaaaactacacaggatattggtgagaaagaaagaaagtgaaagtcactcagtcatgtcaactctgcaaccccatggattatacagtccatggaattctggattcccagaatcccgggcctggagaccgggcggattctgtaccagctgaaccacaagggaagcccagaatactggagtgggtaggttattccttgtccagcagatcttcccaacccaggaattttatcagggtctcctgcattgcaggcagattctttaccaactaggctacaagggaagcccaaagtgaaagtgaaagtcattcaattgtgtctgactctgccaccccatggactgtagtacgtggaattctccagcccagactactagagtgggtagcatttcccttctccaggagatcttcccaacccagggatcaaaaccaggtcttctgcattgcgagtggattcgttaccagctgaaccacaagggaaggccaagaatactggggtaggtattggtgagaatggggaacaaatggaatgctcattcaccatgggtggaaacataaaagtttctcctctttggaagaaatcatactttcttataaagttaaacgtatacttaccatatgactcagtaatttcacttctaagtatttacataagaaaaatgaaaccttatgatgacaaaaagatttgtacttgactgttcaaagatgctttattcacatcagtgaaaatgttggaaacaacccaaatgtccactgactgatgaattgataaacaatttgtgggtagatccatatagtgaaata

SEQ ID NO: 27917 - DNA, 860 bp, Bovine  19866881073914
acaaagagtgagacactactgaagcaacttagcacctatattgaaattctggaatataagagtgctgtgatagcaaagatattacaaactcaacattagagatgttttacttatgtttttcctatttgcttcaatgcttatgcgtatgtaaattttagcatgtccttatttaagatgaattgacaatggcataagatcattgtgatattttgatgaggtaatgcatgcaaaagcacttggtaaactgaaaacaacagcacacccattgtatgtacacatacaaacaaataatactaatcccctcccttgttggttgctctgttcagttcagtagcacagtcgtgtccaactctttgcgactccatgcactgtagcctgccaggctcctctgtccatgaaattctccaggcaagaacattggagtgggttgccattcccgtctccaggggatcttcccaacccagggatcaaacccaagtctcctacattgcaggcagattcttcactgtctgagccaccagaagagcccaattctctcccttattcttttctcagtgtaggtcaactctgaaggtaacctacaaacctgagatgccagtttttctctttacatttcactttgtaaatttatcagaaactgcaattgatgagcgaacaccccatcttagtccccccccactcatttattcagttctgtcctcttgcttggcttattccctagactattctgaaaagtttcctctcttctctcagtgtttacattcttcaaacgctcatagacagttatcatacgccaactcagttgttgctttgccaagctatacagatttcatcctttcatctttcctcataagtcaatg

SEQ ID NO: 27918 - DNA, 1014 bp, Bovine  19866881120602
tttttgttgttgaaagatcccctggctgcagagcaggagctggatcggaggtgagcggggtaaaactggaagcaaggagactgtgcatgatgaggatgacgactgaaatcagagagccatgatacacttctctccccaggaggagaaaaaggcagaattacaccaagaagtaattaacggggaaggtagaaaggcagacagagttcactgaagaaagcagatatcctatcctgactcaggagcctgcagaaggaagattatcagaatcctgcgtgaagggagcagttacgaaggggcgagccaagggtactgttttaaagacagactctgtaggaccatccatcaaaagtggctcagccgctcagtttcactgctaacaggtgctgaaacctgatccataaaacattcccagggtgtcattgaattgaaacattggagggttttactcaccctgaataagaaatcactttcagggattgaattttaacagattatctttttctgctgcttgtctaacacacacacatatacccttttttaagtgtatggttgtattaactatagggctttccttgggactcagatggtaaagaacctgcctgcaatgcgggaaatgtgggttcgatccctgggttgggaggatcccctggagaaggaaatggctacccactctagtatttgtcctggagaattccatagacagaggagaccggtagcctagatgagatgggaaaggcaacagacttctcattgtacgtgctgctgttatgatggattcaatcattcatttatacattcatgttcagaattcacagagttcatttagggaggtttagatactgtgatggaaacaaaaggagtaggtgctcaaggatctcttttcaaagctcatagagcttaaaatcatcaaatcgcaagtaaaatttcactctttaaatcatgtgtgaaatttcacaacagtattcggttaagtagtggcccagcctctgaatcatgcctatcataatagatttc

SEQ ID NO: 27919 - DNA, 650 bp, Bovine  19866881196580
ttttttcctcccctctgaatttaaaagtcttaagtctttgcttgttctttgggtggaaagagaagatacttaacatgtttctgacatatataatctatgtccttatttgctacttcaagcctaacactatttctttggaatacctctatattctaatctctggaatctaaattaggcatttataagctaaaaagaaatccccctgtggcttaatgtgtttaaactatattttttttttttttccccaggatcattttaggttccagcaaaacaaacatttataaaatgctttgttgtttacacagtgttttcatatgaattttcacatcagggcctcctagaaaccaaggttcagaaaaggttagtagcttaaccaagcacacagtaatgagatgtcaaatcaaagcctatgttagttagttccacttccatatacatatattccatatattgtactcccaataagctagaaaaaagcaatgatagatatataaattaaatttgaatacaattatatatgttcaagctggttttagaaaaggcagaggaaccagagatcaaattgccaacatctgctggatcatcgaaaaagcaagagagttccagaaaaacatctatttctgctttattgactatgccaaagcctttga

SEQ ID NO: 27920 - DNA, 800 bp, Bovine  19866881198298
ctcttttaaaatccccttgaagtctttgaaacctgggacaatgttttggagttttacctaatgtattagttctacaaatgaaccatttttctcttatgctttcttttatctttctctggctcttgctaatcctttattttattctccattgctgtcttttctctccttccttgttttgaatgtatgccttttatatctgcagaattgccatctcctattattcttattacccagcccaccttgcttgtgattgtagggtaaagtacattctctggctggggagcaagtcaggtaatgtgcagaaacaccatccctgaggcaaggggaaaatttaatatggtttctactttcttcttcccctgtgcccctcctctgctttcctgtgtatcaaagtactaagagtaattattttttccccctgttttcttttctcttgccttgttttattttgtcagcttgtggaagactgagaaccaggatgtatgatgaaagagcctgagcctgacagtctgagagcaggaaagcaacataggggtgggcaggattgaggaaactcctgctgactgctgcccactcctggcattctccagcttcaatcaaatctatttatttacttttcgttaaaaatgaagccaactacctgtggttttattgccctctttcctaggctttgtctttcttatgcccagtgcttggccccctctgctttttcttcccctcttcctcttttcctagataactatcctccctttcctctagctcatatttctttcaagaacagtataaaacctcttcatttc

SEQ ID NO: 27921 - DNA, 805 bp, Bovine  19866881211298
cccctactatctttgcttactccccaaagcctttcattgcctcggcttttcattgtcatcatctctcattctgttactctcttcacctgggggcaagctgccagcacctcctaaaagacatattcaatttaaaagggacaaggccatccaaaatctgtttcaaataattagtgcttttaagcagtagtctctgataaaactactgcacccccaacacacacacacagctggtttcatcacccacccctgaagctactacccttgtctctgcctttcccatcctgaaaagaccaggagagatgcaaatggactgcatgaatgcagactctaggcatggaatttataactttgtccttgtcactccttcttccaaacatctcacctccaatattcacatagagccagctgcttcaagttgcagacagcatcactttttttttaactacagtgccaagcaatcatggtttacaaactagtatgaagtatacaaactcaccttactcagctagatcggctaagttacaacgctccagactcagcgtattaagttaaagattgcttaaagctctgtgccaactcgtcaaagccttccctatttcactttctagacagggcagcagatttttgtaaccaaatgatttggattgttctctttacttctcagtacaatcttaatttctctctaccaatattaaaccatctactttatttttaataatgagaatcttctggttcttcagaacactaggaaactgagagctaggggaaatatagtttcattctacagatgggcatatgggcatct

SEQ ID NO: 27922 - DNA, 1049 bp, Bovine  19866881240444
atgctgggctctaactgccatctttatgaatattatactgtattctcatacttaggcaggaggatttgtttgtgaggggactttcccccttcctgcatcacttctctgaaactaaactgttgatgagagaagtatgctggactaagaagaggttgataaatgtcatcagtggagtgttgcactctcaaataatgagtgaggcagctgcagtgtcactgaatgctcgatggcatatgagcatgaattttgaggtttctttcatttgtttcatccaagcataaactgggcaatgacaagctgacttgtggcaggaatttcagcatcagataagaatatcaactggtcctttaggttccttctaacactgaaaatcaacagtcctctgtttgatggagccacataaagaatgcccaaatgatcaagaaaaatatgtgccacttctggaaaaatagcactgttggattcttgcttcaaataatcaaaaagagatcgtctttcagtgagcttcttaacccttggccagtgagggcaacgttaggaagacaacctctatcaaaactaatgctcgggctgaggaagaaagtggaggattattctcttgatgcttaggacatcatgtgaatagctaaggtaggaataggtgtcatacatacccagcaatcatttgagaggaatttctagcagctgagatccagagtgggctggaaaaatacaggtaaaggtgtgtgtgtgtgtgtatgtgtgtgtgtttatatgagatggaaacagacacccaaactcctctcttttactgccatcattttctcctgtcttcaaagaaaagttttttaaccccaatttatgagccactttctttctttgtcctttgtcaacggaaagagtcaccttctaagccaatgcttctcaaatttatctcaattttagtgggtatatgaatccctggggactttgttaaatggagtttctaattcaatgcttctcaggtggggcttgacattgtgcatccctaacacactctttggagaaggcagtggcaccccactccagta

SEQ ID NO: 27923 - DNA, 1120 bp, Bovine  19866881278147
agatcatcacatattatgtaacttcccctcttgttcataaagaatagacttacactctcacaatgtctatagagtgatgctataattgataactatccaggttcatttgaagatatcaggtagctgaataatccctacctggatgaggctgaagcaaaaacagactcagcaggctggcttgtcctgcctgtctatgcagttcagagtgacctgcattctgccttcagcttctgttgtgttgatctgggctgtgcctcttggaagctgaagaaatttatgagacatggcaaaaatagttcctatgctcggccactaatcaacacagagcgcatgccttcagtaaaccccgagtgacctgaatctatcataaagactgcctgtggccagcagtacaggtcactttctacatggcatgctgcattctactgaccatgtggagctaaactgctgcctcaggtgactctcttgtttccattaaagcacttgtattaggaaattacctgaaacctaagaaaccattttctttactattagaatataaataacatgtggaccctgctgattattttattgctttcacattccccatcgatcccttcaggacggtcagtggcaaatctagggtaggcttttgctctgcctgcactgcctactttcagggtcacaaacctgtcctctctgtaacttaggggctctttagtgacccatgtttcactgtgtttgctctatagcagatgtctgactctttaaagtttcccctgagcaagatattctgtctttgcaaatacatcacaagtaggtgcaggaatttcacattttcttcccttccactccagagatcggtgatggatggtcactgcagtttctttttttttccttcagatacgcccccctgcccccttttgtttgctaatcctacatatttcatcactcactctgttcccaaattgtatcttcctggtattgtgaatacttaacacataatggaacaacttttcatttctccttcactctctttctcacattttcactttggaagaaattcatcaatattgactcctgaatcatgaaaatgatcctccagtcactgaattatagagtcatagaatgttagagctgg

SEQ ID NO: 27924 - DNA, 837 bp, Bovine  19866881304985
tgtgttttctgtctaaaactgaccagtcctggtgattagaaagtgatcataatgagggggctggtctgagtcatgctttgataaatcagaattacaacaggcagactttggtatctgcggtggtagtggtggtagcggggcagaaggcaaggtatcagatttcaggggagaacaaagctctaggtgtattgacaaaattggtgttgggttaggccaggagtagcagaggaaacacaggatttagttgcattaatggactctatgattgttattctccatgttactattataatcaaggatagtgttgtgtacatatatcagtgttgaatacaaatgatcatttagttgcctctcattcttgaggaattcgagtctttttctgacttacagtgaaataactataagggaaagagtgggttgagactcgggagatgttgttgataaacacagaccctggatgtttgcccctgtaataagcttccctcttatatgactgtcctctcacctcatatatgtgggattaaaatgacctgttctgaataaagagaggaatgtagaaaggaaccggaaacatttgcataaagatacatagagccctcagtacctggagtcagaggaccgaattcgccagtcctccagccataatagcatcattttcaacccaggacacattcatgaagcagcactccagtgcaaatgaaacaactaaagcctcacttccttgctgttctaggtgaatatataagtgtatagtctcatctattcttaatgccaccaacctggcaatacaccttaagctaattagaaacagatttcccattccaccatggctttatg

SEQ ID NO: 27925 - DNA, 1204 bp, Bovine  19866881333078
aatgacagagccaggactatcagactctgtaatccttgctccacccacagtgctttgcatgatttctggccatgatgcatgtcctattcaagactctgtgagtcaggaatttgagtagggcttaatatggacagtgtttttgtgcttcatgatatctgggtcttcagttgggaagatccaaagctgggggtgactcaatggcttggagtgactcactatctggaggcgtctgtacttagatatataaccagtgacgcttgctgttgactggttcctcagctggggcagtcagcaaaatgcctacagtgatgacttctgtgaagtgtagcagcctgagacttctcatctggtaggtggatcaaggctctgaaatcaagtcttaggagaatcaggcagaaactgtatcatcttttatgacctgcacttggaaatcatttagtgtcacttcctctgtgctcctttggtcaactgtttcctaagatagcccaggttcaaggggagaggatgtagacctcccttccccttgggaaagtgttcattatcagacatatttaaaacctttataattcaagttttgatgtgagttcttaaagaaatctgtttcttatggctttggttgttatagtatattcttaacaatggttgtaattcatcaacattggttgataaacctatcaaattctgaactctactccaaagattctgaaggggaggggagcttgggagtctgtagttttaccaagcttctcatgattcttagaaagttggcctaatctaagggctaaattttacttacactgcctctataggtgaagatgttttcaaaagcctacagccaggccctctaattgattgggctgtcccaacctagtaaattcctcagcctctgctattacggctgcttgtttgtcattctcatctcttctccctgccttggagaggcccctgaagcttcacagaatacctcctctagatttacaaaagcagtcctgatcccatctcatcagggatagaggacaggactttaagcaaaatctctgctgaagctatcatggcaagaggtgtaccagtttaaagctgtcagttgataatcactctactatgaatggttgggctggtagcacccagtgatttgatttgcatatttataacttgacatatgcacagaagtgccactttcggggtgccactgcagcagctccat

SEQ ID NO: 27926 - DNA, 1202 bp, Bovine  19866881387588
ttgaacttgggtctcctgcattgcaagcagatgctttactctctgagctaccagggaagcctataaaataagggatcgctaattattgtgcaagccagataaatgctgtgctttacatacatattccaagctattggaaatcaacctaaagaactatttaatgccatagctcagaagagggtccagggtaaaaaaaaatactcattcagcccagttctgctctgatagaagtgtaaaagaaagttcttgcaaatcatgttagtattccgaacctctgatgcctacattctcttcttaagccactatgtgcatgcctgctcagtcgctttggttgtgtccaactctatgtgaccacatggactgtagccctcaggcttctgtctatggaattttccaggcaggaatactggagtgggttgccattccctcctcagggactcttcccaacccaagtatcaaacctgcatctcctgcactggcaggtggattctttactatggagcctcctgagaagacctaagccactatatataaatcatattttgagcctaattaagtttttgacttcttctacctttggaagcagtcaaatgtttatgttagtgtcctaggaactagacgtcaggttaaaaaagatgaataatcaattatttgttgttaaagaaaccattctgtgatctgaagacagattgttataatatagtgaattaagagagttgaaaagggagaagtaatctagcctaaagagaaggaacagattagaaaagctacacaccagcttttcctttgtcttaaattcacctgttagaaggttcaagaagctagttctaacattggctagtatgaacccatctatgttttctctaagtaaagttctcattacttataaagccaatgttatttattcctcttcaactttcatagagaatccttatatatctgagatttccaattctgaagagacagaggatccattcaaaatgcttgtctgtcctctgagtgggcctcacagagacaagaatagtttaaatatttccccataagagagagagctgcatacctttacaataacaatgagaaaaagtctttcccttacatagtttcaaagagcctttaattgcatccctttagtaacttggaggatttttctaaacatattgacaacgaggctaagaagatgtgtaacacgtataaatatgcag

SEQ ID NO: 27927 - DNA, 694 bp, Bovine  19866881462260
tttggttcctgggtcgggcagatcccctggagaagtgataggctactcaccccagtattattggatttccctggtagctcaactggtaaagaatctgtctgcaatgtgggaaacctgggatccatccctctgttgggaagataccctggagaagggaaaggctacccactccaatattctggcctggagaattccatggactatatagtccatagggtcacagagaatcagactcaactgagtgactttcacttttatttacatccccaaaatcaaatattctggtctggcaagagcagaatgactatgtgagtaataattcaatggaaaagaatatgtaggactgatgagaggtccccaaaagatcaactgtgttgaaaacattgtcaaaatttaaacactgcagaaatgcctagacaaaagggcagtcatccatgtgaattgtggagaaaagtttatgaaggaacttaaggccctttggctttgcttcagtgggttggtggtgaggttggcaaggtgagggagtaatttgtaagtttatgcatgactgacttaataagaaaccaagtcatttgaaatgtcaaggaaaagcagactaatctcccatgcaggtgggaatttacacccctcacccaatcctctttatttggcatggtcaagggaaagagaggagacgggaaataggactccacca

SEQ ID NO: 27928 - DNA, 2994 bp, Bovine  19866881520679
tattggtctgtctagctcctggaagagtgaatagaatttagcaatggctcatcacaaggcaaatgagagcataaatgacaaacatgtgctaagaaaatgaatgatccaaatgtgatactctcatggaagaatatcttccaatgggctcatccagtgtatcaggtcttatattgctgctgttacaaattagcacaatctttgtagcttaaaaaagcatgaacgtatcatcttacatctctgtaagtcagaagtctaagatgagtcaatagggctgcatcccttctggagactatagagaatctgtttacttgcctttcccagcttctggaggctgcctgctatcattggcttgtggctccacgtcactgacttctacttcattgtcacatctcctctctgactcttctatcatcctctcccatacctcatgattatattgatcccaccaatgtaattcatgatagtctccccatctcaaggtccttaattaatcacacctacagaatccttgatgtcatgtaaagtagcatattcacagactccagggctaaggatgtgagcattgttgggggaatcatcattctgactgccaccatcccctggactaaaccgtgtcttgatatgacagatacttttaggcccaattttgaaaggaagatggaaagtagccttgtagggaggaaatggctgctactgaagaaatcagagatacacctacaaagaccacctagggctcacaggcaagttcacaggcttatacgcatgcccatggggggcatgcatgtatttctgccagccccttcatagccagtcttttctgatccatctccaagtcaaggccttctattgtgctcactagactccacatttcccttgtgcttttcctgagaaactttttctgaagatgaacctcagcttgatttcatgtgttatggtgcctgatgaaggtgatttgcttcagcttctgcccactcaaaagggctcatgagggtaaaaaagttctgtttctcaagctcacttcagtcttcttgacatggcgaggcacccctcagatctctactgttcaaaactcagttggagcactggagggaagaatgtgaacatctttgctttgagatggttgtgattttccaaagagtttcttgttttgtttttcctttgaaaagcctcaggaaaaactgtcagactgattccaagactcatagcctgaaattcaacctgcccattgatctatgcctgcctttaagattctctgtcactcctctgaggtcacaggttgtgtctgaactttaaatacagttttgttcctgcacgactgaaagcttctttgatgccgttgttacaccttcagctgggagtcagtcagacaactgttgaaatggctctgcttcttttcccttgagacctcagggtcctccctgtcccaactcatcagtcctctctctcactctatattctctaaagtctgtttgtatacttgtgcatgtatgtgtgttggtatcctgagagtgaaaagccttgtctctccccacttagctggattcagactgtaataagactgtgttctgaaatagcggcactaatcctcttgccctgaaggggatggtgtttagaatcttgaaagtcctttatcagactaaactctctttctttataaccaggaaccgccttccatcataaatattgtcatgctactgtcttcagctgacaagataatgccttatcaatccataaaattcccaagttatgcagatgtctccttctattctgtttgtattgtcatttaagaagaaaaaaaagaagtatagatgcgagactcttaatcgggtcacttcctccgtgtacttgaaaagtcaaagacttgtttctcactggttttaagaaacattgtcactcatgcaaaatcagttaatagtcattagacactcagtttattaggggcactgagtgagggggggaagtggcatggggtaattttctggcaaagtcaagttctgcagtgttgactgaatttgatttttgtagaatagttaacaactcgagggcattatccagagctgccagttatatatcaaggagttctctgaatttggctaagcttattaggaatagcattatcatttatgagaaaaatccatgaggtttttttaagtacatggagtcctccagcaatatgaaaaacacacacagtgaaccacgagataggcagtgctcagtctcaggagaatgacaggttgtctcgacccaggctggatttgaagctgaggttcatgatactgcagagaggagttttagatcactaagtaatcccctctggctcgtcttctctgcttagtctgtgtcaattttttttttttaagtacttgaattacatttttatgttgctctataaataaagtgattgcaacatttttaatacactgacagttcttgtaagtcactgctcctttcacttaattgaaaggcaggttgggtcatttgaatttggtaacatggtatgaaatgaaattcaaatccaactcggaaataaacaagctccttcaaatttaagtacaaatgaagctttagggctgttcaaaccataactcaaaagcatctttatttaaggaacctaaatcattgtagaatctattagtgaaatccacaaccaaatataatggagtgttagctctgaagttagtcacctcattttatttttctttgcttttcaggagcccagtagattgatattcatttaattgtccatttaccaaacattaatgcctgctatatatctgaactgttgtacagcctagaaatacagaaataaatatctcaattcactcttttaaggagaaatatatagaaagagttgtgggacaatgtaggacagtcgctgcctagccaggggaagaacaaaacatatcctggaagagagaattcttgagctgagcttgaaaggaaggaggaggtagccaaaccaagcaatggggattagaaggggccatgctaaga

SEQ ID NO: 27929 - DNA, 954 bp, Bovine  19866880429600
aataaattcctgggcttgtttcagaagggcatagtatgaccaaaactgttgctgaggagcatgggagaaagatgataatgaaaatatagtaataggctttccatgagtccaaactcatggcttctctctgttttcagttcctatcttgtggaaaatttttgctgttttcactctgtcacagaacagatggaaccatgatttatgattcacagtttatgaagctaatttatattctaccccacttcatgctctatcacgtttcccacatttgcaatattttttcttctgggacatttgtcacaaaaggcacattgggatgttggaatgggagaaggaggcaacctaaagtgggggaactagtgacattgcagggagcattcatgcgttcaacaaatgtttagtgagccctttcatatgccagggactaaacatcctgacaatgagtctgaaaagtttttactctgaaggagaaaaaggatgaacaagtaaataagtaaacaaacagcagggtcatctcatagaaatgctttgaagaaaataaaatatggtaacattataaagagtcactggagttggacagcattaaatagggtggtcaaggaacgtctgtcacaggaggtactgttaggagatgcctaaatgaaaagaagggattagctcttcagaagtcataagaagtgtgttccaagaagagggagcagaaagcacagaggtcctaggctgtgaagaaatctggagcgcatgagataacagaaacaagagcagcggtggttacatgcaccatctcatccatagctccatcctgcccctgctctccacccggccactgatgtggatgccacggggcacatgggcccaggatgtcggctttatgttgtttcgtgcatcaaataaaatacttcctggctcgaattcagaagcgttagtgtggctctgatggaattctatttccca

SEQ ID NO: 27930 - DNA, 2316 bp, Bovine  19866880441688
ttgtttcataatataaacacttcagtttaagaaaggtaattgaatctgcccttttgagtggagcatagagccaggatgagggcgagactggcaaggcttccagggtgcttgttgaacctggaagtgagcgcctctgtaaatccgtgatccgggtgtcttgcttacctctccctagtccaggtcctcaacatactgaagaatatgatgtatactggtttattttatgtgtcagctgaccaggccacagagcacccagacatttgatcaaatattattcttgctttatcggtgaagttgttttggatgagattgacattcgaattggtagactaagggccaatgtgggtgggcctcacccaatcagttgaagatctgaatagaacaagaaggttgaccctcttaggagcgagaggggagaactccacctacctgctgccttcattcagaaagaatggctcttcttgggccttgagcctgccttctttcagactggaatgtataccactgatgctcctcattctcaggcctttggattctgattggaatagcaccacgatctctcctcagtctccagcttgctaactatcagcctccatgattatatgaaccaattcgttatagccagtcaatctatttatccccttggtttcttttctctggagaaatctaacacatctagttttccatgtcagctgcctaacagtgggagaagttaccatcaaaatgagacaaatgaaaacctcggccaaatcctgatagacttaaactcttggggccttcatttcttcaagtactaaaagaaaagaatgaatttactttgtaccgtggcagcaaaatgcagttgcataatgtgtacaaagtacttgacacgtagtagacactgaaaaagtaaggccttttcttccctttgtattaatgagctgttagtgctaaatgggagccatgaagccaaaggaaggtagtcagccagatcccaggcagtgagcgtgctggcagggtgcccagattccaccccaagccatggcagctcactctctgaactcaagagtgtcacactgagccggcctccggagacctggcttccggcctggtccccacaccatttatctggttcctcagacaagtatttcattttctttctcatctgtaaaataagagttcctttcagttctaaaatgtctgtgatttattattcatcattaccatttctgcattgttcttagctttatgtctgaattcaaatcacaggaagaaaaaaacagtttggactgttcagttaattgtaacaacaacaaaaataaattttaagcagaattaacttttcaaaatcctgtttgccttcagaatgcagatcaaatctcctaaaatctattttagacaacttttctctggttttcttattagcttgattttagcctattcagtttgactaataaactgagaggctaaactcagaggcaggtaagacagggcagctatagtattactattgattatcctttaagagcttctccaaatcataacatttattcctggcttggctgtttacaaagaatagagaatcaactcagatcttgtctcactgttacaaattgagatttttttttttttctttgcaaactgtctttatagtaattataacttgcaaaacccaatactcaggaacataaactaggcttcattagagtttgtagtacttaatttcctgggtgtaactatttctttttatgaatgcttatagttttcttttaacttcattatgtttttccatcataaactagtacactctacatttttttggaaaatacagaaaaagagaaagaagaatagggaagtcatgtatggttaacttatgttaagaaatgttaatattttggtgttttttatagaacatacttatggctactaagtggggaaggaatgggatgaatagggagattgggactgacatatatacactgctgctgctgctgctaattcgtttcagtctttgtccgactctgtgtgaccccatagacagcagcccaccaggcttccctgtccctgggattctctaggcaagaacactggagtgggttgccatttccttctccagtgaatgaaagtgaaaagtgaaaggtgaagtcgcccagtcatatccgactcttagcgaccccatagacggcagcccaccaggctcccccatccctgggattctcctatgtataaaatcgataactaatgagaacctactgtatagcacagagaactctactcaatgctctctggtgacctaaatggggaagtaaatccaaaaaggaggaatatatgtatacg

SEQ ID NO: 27931 - DNA, 3888 bp, Bovine  19866880457976
tggaatgctactcacctataaaaaatgaaatattacccactgtagcaacatggatgcacttagaggacgttatgctaagtgaaataagtcagagaaaggcaaatgctatattatatcagttataagtggaatctaaaaactacaacaaaaacagttgtattgaactgttacagtgaatataacaaaaaaaaaggagtctcagagatagaacaaattagcagttaccagggcatgggggaggggcaacatcagggtgaagaagtgggaagtccaagcaattaggtgtaagagaggctgtaagaacgtatggtacaacttggggaatgcagtcaacattttgtaataactgtaaatggaaagcaaattttaaaaactgtataaaactaaaaaaaatttttaataaaagaatactttggaaaaaaatgtagtttaagtttattggttcaataaaaacaaacatgtcttcagagttgttgacattaaatgtaataaaaacatacaatttttcctacttgggtttgctctgtcacataagctcatgctatctctatgttacaaaatttgtcaataagaaaaataacttaagaggacgtttagttgtttgatgtctaacaactaagaatgattgttaaaaacaagtaatttaaataaacaagataaaagtttatactaagttaaactaaataacagatattcattgaatatctagattatttccaaataagataatatactgagacattgatcattaaacatgttcatctacttttggctttttaatttttattttacagacagacaaaagataattgggtctattaataaatgtcttttaccatagtaaaagttatactataaaaaacatatctttaaaaagtacaagttttcataattatacatttataaatttgctaaactactggaggtggtgctcagatgctcagtcatgtctgactcttcatgaccccaaggactgtagcccgccagggtcctctgttcacgggattactggagcaggttgccatttcctccttcagaatgatctgggtagaatctacccaaatgatctacccaaatcattcccaaatcagggatcaaattggtgtctcttactgtcccccctattctaaaggagatcggtcctgggtgttctttggaaggaatgatgctaaagctgaaactccagtactttggccacctcatgcgaaaagttaactcattggaaaagaccctgatgctgggagggattgggggcaggaagagaaggggacaacagaggatgagatggctggatggatcaccaactcgatggacgtgagtctgagtgaactccgggagttggtgatggacagggaggcctggtgtgctgcgattcatgggtttgcaaagagtcggacacgactgagcgactgaactgactgtctcctgcattgtcaggcatgttctttacctgtgagccacctgggaagctaatccaccacaggatgctaatatgtgatagacaattggtaagtacctctttcctagccttcactggaaggcaaaagctactatatgtaggacaaaactataagaaacaatgaatgaagggaaacaacttttcatacaaaatatgggaagaaaatgggatgtatttttatatgcagagtatgcaagggatataaaatgtgttttttgttaaggaaaaagagggtaaaggtgtctgaaatatagtaactacttgttctagagtaagaaaggaaaagaataagacaaaacctaaatgaatatagaaagtcacaggtttgtggaaaggaattttatgttgtgaagtgaaagctggctgaaattgaatggacttattataaaggtttttaaaataatctttaataagtagtgtcctatgtaaagctaaaacttaacatgctttcatctgctaaaaggacaaaattgtattagaccattggtctgttcctaataagctctgccaggtcttccttatccttaaagtaacctgcctagaaaacaaggactctgtgttttatcaaaatactttctggggcttcacattgtcttcatcacatttttgattaagaaaactgagttctctctattaaaagagctaaggttttttataactatataccttcctcaattattctttgaaatcctttgtcactctggttgaatagattaggtattgtttacaatgacctgtaatcctatttgttcaagtgtttaaaccttttgacattttggacaaacttccccaaatcaaattctgaattatctttttgaccttaaactaactttgggattttccagagagggcccatggaagatcccaagagatactctctctctccttataaaagaaaaatgttagtttatttacgcttatttgatatgttaagttgcatgggaaacatggtaaaataaaaagtaatgtttttttagattacatcttagattacatttacatggctatataagtgctccagaaattacacaaaattcctaaaaatctgatatgtcctggtacaatgctcttagtcataattccagttattactttataatactatatattataaaaataacaattggcttttcaattgtatcattcaggtgaactttctctcaccagatcctgaacgatggtgtttttaaatctttttatgctctattcttctctgaaagcatttacaatcgactatagcaaaatgaatctgcaaacagattcatggaaaagacgctggcaagaactttagaatacaggtttctgataactttaggatcatactactgaactgggcaagaatttctgaagtttaatggaaaactgatagaatcataaagcttcaaacccaagatgaagcaaaacaaaaattaattacaggagactgaatgaaccgatgaagatgattataatttttatgacttcatttaaaacactgttggttctttaatgttttattttccagatttgaagggccctttttctcctctcttaaaaaagctatttatactcatacctgtttgataaagcatacttctgtaaacatgagttaaaacatttttttctctctatccaatccctccagaattcagaaacctttattaaatatattttttttcatgacaatatatttgtttatataagtccaataagaatcttttcttcttgtagcaggacacaattagacaagttcttagcttggtttcttatcctaaagaaactttaaaaatttaatctgagattccttattaccagacagtgttaaagaactaaggttgactttaatcaataaaacttaggctgaaatgttatatttgagaatatgcataggattactattgttactacattgatatgaatattaagactagaccttttgttttaacaagttagtttcactgtcaatatctttggcagaaatgggtaactataaaaattgtgtctcaatagaaaactgtagcatacccattctcagattctggtccagtttgttgtcttgggggctgtgttattgactttaaacttcagagacattagcacagtaaatttcacacggacaaccttcaggcctgttgctgtgtgggccactcaagaatgttcaacagaacagctgacgacttcatcaaagatagtcaaactgcttgatgtatgatgcagggaacccaagtcagtactctctaacaacctggagggatggggtggggagggaagtgggaggggggttcaggagggaggggacaaatggtatgtctgtgggccgattcatgttgatatatggcagaggccatcacaatattgtaatcatccatcaattaacatatatatatagtcaaacggcaaaccagagaaatccatccaactgagactgccaccctcattccatctgctaa

SEQ ID NO: 27932 - DNA, 1856 bp, Bovine  19866880536246
ctctttatgaggattttccattggagcaggcagatcctccttgcttgttatctgtttatattgtgaacaacttcttcacagcactgcacgagtcccggaatttgtgaggcagacagcagctgtcacgaaatgcgtcacctttctccttcctagcctactgcaagagctaccacagaggccatggtccttgctcctccccttccctccatcgttttctaactgtacagttttcggttatttcattaacttttctgaactcctataaaacaggaagaaaaacacctacctgctgggattgttgggacaatttgttgggatcatgtacacacagctggccaatgggtgaggccctgtaacccagcagccttgcccttagtatgttagcatgttgatagtttccttttgtggggctggtttctaaacagtgattgatgaggttttaaataatccctggagggccatcacaagccctattcttcagtgagtagaagggctgaggttagtgttttgatgctgtatggcccctcatgtggaaggaaacagattattcctttttttgttgtcttagttaagacaatccttttttgattcttaaaaaacagtgaaaatttctcaacatacaagacctgaaaagcaggctagctagtactagcttttttaaagtctccaaatagtcatttttatagttttatatagtcattattcatgtttattttccagtgttttttattcctccacatttttatgatcttataccagagataattgttctttctgcctaaagggctcctattagatttctttgttttaaagcacaggtctgctggcaacaaatcctcttactttttgtcttaaatgtttttatttcaccttaatatttgaaatatacttttgcttggccgttattttcttttagcatttagaagatgttatcccagagtcctttgacttccattacttctgtttctcattgttctcctgagggtaatatggaagatagtctgactgattttagggaggattttctttttttgttttgttttcttggaaatttggttatgctattcctagatgtgttttcctttggatttatcttgctcaaggtttgtagtacttcttgaatctataacttgatccctttaaatctataacttgatcccttcaaattgattttgaaaaattctcaaatattgcccctattgctccaattcagtttcactctagaacccttctggaattttaattacacatatgttcaaccttttcacaatgtcttacatatctttatgctattttctgtatttttcacctttttcttctttttttgatttggatgcttccatctggatattttctattaaccaatcttctgaattgctaatgcatttttcatctatctaaactgttgttaaattcatttactgaactttaatttcatctgtctaaactgctattaaattcatttattatattttgcagtttgggaatttatatttggctttttatttttaatacatagatttcaaatctctgatgaaattctccatcttgtcatctattttcttgaacatgttgatcacagttattttgcattctgtgacagataattctagtgtctggatcatctctgtatctgtttctattgtgtattttttctcttgccccgtccctttgtatgtctggtaatttttgattgaatgccagacattgcatatgaaaagttataaagactctcaatgatgttaactctggcaaatggtcagattaaaagcagaataccttaaactaataagggaataagctgacttgagccctggatttttaagcctttacagggctgatctgcatctcagaga

SEQ ID NO: 27933 - DNA, 1919 bp, Bovine  19866880606988
ttatgaggatatggcaaaaattgtgaggaaaaccttctaggtcttgaagggttgggacttatttgttagctccagaagatccaaagtgaagtagctttctcctattctttatgtctgaatatgagaagagagccatatcttctgactctctttggggtatctagaaatagaaggggtgactgatgagaggaagaccttggtcttttcagagtggtctcattgtctttggcattggacttcccagccttcagaccctgttgtttttctaaacaaggacagctatctgggaaataagagtccctgcccttgaggaatgtttaatgtactacgaaagattaaaatagacttcagctcaaattctgtcttcagtactgaccatatgacctcaagcaggttattttctgaaccttagtttctgctggaacacataatccccagatcccagtggcttcagccactgaaattttatttcttgcttgtattgcctgttcattgtctgtcagatgggaactctgctccacgtctcctactccaggattgtggttaatggagcagccatcatctaattatagaacattgctgatcactgttggagagaaagagagttctggagagcttcacgccagcaattaagtgatctgtcttagaagtggcacatggtatcatttctgttcacaacttcctccccaggactagtgacacaatctcatgcaaccacaggggcctagaaggtacctggaaaatggagattcagagtgttgtggaaatatcactaatgactaccacatataggaatgcctacctcagggttgatgtgaagattaaatgatattagatacagacatggacatgaacttgtgtgtgccaggcgcttctctagtagcagttttgtgaggaaactattataaattccagacttacaaatgagactttcatagctcagagtaaaccttgtcaaatgaaacctagctagttggtgagaaggtttaaatttgaactcaagtactagaaaagcaaaactattacataaacacaacaaaatgaaacagtcaaaaagactgaaaaattctgaaggtattttttaacagtaatcaaaagtgatttgtttatgtgggttttgcttttctgttggcactttttaaatatgaagaaaagctttttaggtgaaacacatgtaatgtagatgctgtggactgtgaaatcaatgtataatttagaagaaaaaggtattggtgatagaagttttaaaagattaatgtgagggacttccctgatgacccagtggttaagaatctgccttgcaatgcaggggacctgagtttgatccctggttggggaactaagaccccacatgcagcagggcaactaagtctgcatgatgcaactgagcctctgtggtgcaacgactgatccgtgtgcctcaactagagaattggtgcgccacagcgaaagatcccacgtgatgcaacgaaggtccctagtgcagccaaattaaataaatattaagaatagattaatgtgagaatgaataaacacctgcatttgactagatgactacaaaacaggaatcctgggaaaaaagatagcatttagtagagttaaaagtaacatcagaagatggacttatatctgggcttccctggtagctcatctggtaaagaattcacgtgcgatgcaggagaccctggttcaattcctgggttgggaagatccactgaagaagggataggttacccactccagtattcttgggcttcgctggtggctcagacggtaaagaatctgcctgcagtgcaggagcatctgggttcgatcacggggttggaaagatcccctggaggagaatacggcaacccactccagtattctgccctggagaattccaggactacaaaacaggaatcctgtaaaaggtagca

SEQ ID NO: 27934 - DNA, 1331 bp, Bovine  19866880640534
ctgtgataccaaaaaaaaaaaaaaaaaatacaaatttaagggtggaatgtggtggataatcattgttttgggaaccaggataccaaactctttgccctggccctgttatcttcccatcactgaagctctctgctcaactcagaaatgagccaacctcaccctagattgctctgtgaccccaaaaacagataacaccaaagcgtggctcaggaagaaacaaaaggaatgtgagtgagcatgtccctacttttctggaagttctggaatacggcattttcacctccagctgtattatgtccataaaacaccactgtgtttgctctagccatagtttctgaagttgtagtgggttcagaattaaataatactgacttactattttaactttcaacctctaatttatttgtggggattttttcactttaatgagtaatagctgaaatgactatttttttttatagagttcaaatgaaatacttctgaagttttcatagaacatgtaatttaattgtcaggatgtggtttctgttcttgttaattaccctgccccgataaagatatctctgaactaactcccctcaattttctccacacacttacactcagactttgtgtacttaattggttcatgtttatgaatctttgttcatgggttcctttctcttcatggacatatgctctttcatgcccttaggtttatgacctttccattggcagagataatgttttctactctttttttcccctaattgcaccaaaaatgtgggcctttgaaagctcttgattattgccatcacaagttatactcaaatccttttaggaaatttttttttctatcgccagaaccatattaccaggaaaaattaaaatcggccttggattgaaaagtgcctatagtgtaatagagacaaaaagttgaattatatatcttatttttaacatgagacataattcacatacataaaattattttaaagcatacaattgatattgattatattcacaaagttgtacagcatctatttctagaacatgttaccatcccccaaagaaaccctattcccatcagcagtcactcctcatggtcctcaccccaaacccctggaatccactaatgtacttagatattggatatttcatataaatagaattatacaatatgtggccttttatgtctgacttctttcacttagcctattttcaaggttcacctctattgttacatatatcattacttccttttacttgctaaataatattccattgtgtggatatatcaacgacatttggtttatccatccatcagctgatgggcacctgggctgtcccca

SEQ ID NO: 27935 - DNA, 931 bp, Bovine  19866880820999
aagaaataaaaaatttaataggggagttggaaggtaaagttgaggaaatattcccaaaagcagaacaaaaagacagagatgaggtcatgagggaaaaaagggtgtttaaaagagaaatccaggaggcttaaaatagcattccataggatcaaaatttatttactcagcatttttatggcttaatattaaaactgttttcgatttttgcaattatcggcagttcttgcagtgaatgcctttgaagctaaattttgatctgtgccatgattatttccttgggataaaattacagaatgaaattaccagattaaaatatataaacatgttaaaggcttttgatacgtgttgccagacagaaagattgtttcaatttataataccaggatatgagaacagttgtttgtgactttttcttaaattcaatcatctttgtctcaatctatctggtaatgggttcccactgtatcaacaataggtatgggaattggcagttacaatttacttttatttcccaacaggattaaacaaattatcattggctaaaatcctgacttgtctgggtacattctgctttgttctataaataaaaaccccagagaaatccagtattgcttacaaaaaagctctgtgataccgagctcgctgactttcaccattgctgtttcagtgtttatctatttttgtatttctctataaactacatattttggactgcttatcaggtttatggacttcttattggttcatataaaagatagagcgcctagtttagaacaagaagactaggtcaggcaaaaggagaaggtgacagaggggaagaaagacattccctgcatctccaagtatttagttttcttggtagctttaccagtgaaactgactggaaaagagaacctgattagacatgaaacttgtagcttacccactggta

SEQ ID NO: 27936 - DNA, 1646 bp, Bovine  19866880875146
tggcggctgccgtgttattgttattactgttccgcgtcttggtgccgcggcccccggaccggtgctgctgctgctcttcctctcgaagcttcttcagcttcttgaggtagaccgggcgggtgctctccgtcactgggccaggagataggccgtaacggcggagctgagagaaaagctcctcatccgagagctgctgaggcgccgaagccgctgccgccgccattttctctccagggtgttttacaagctccgcgctaccggaagtgacgcgccgccctagaccctgaactagaccgggctgcgtcgccctcccagcgccacgggcgccttggccaatgggaggcacgggaggagctcacctgagcgggaaagggccacctgagccgcgcgcggcttcagcggccgaaagtttttctgcgcttgcatctcggggtgtctccttctccgtctgttctccgccctgcccttctcagcgcctttcccgggagttgcctcttgccaagccacaccttgacctcttctttccaggttcctgccaccgggcagtaataattgaagggaaatctgccttgaagttcttggcattaattttcttttcatccagattcccgctgccaaggggagcctagagacttaaagaaatcttgatggcaaggtgattggcaaatttccctgagccctggtgctcttttcactttgtctttccgcttgactcaccaaaaaaaaaaaaagtttctctcgcggctcattttgagaagcagctcctctaatgtttcaaggaaaagatacagagtaaaccagccccaatacagttttcttcaagagtaatgcttattgattcccgagttagttgtaaggtatcatcattttttcgcttttaaaatctgataaccttgatataggtcgtcatttggggaattgaaagagccaatcacattatatgactgaagaaacaaaaatgttccatcttgcttattttcttcttggaacctttccaacctatagttatttgtttattagtgattatttttatgcatttgtcttcctatttatttattgtcttgtgcctttaaactgtaggttttatgaacagaggaaccttgcttcattcaccccattagtgcctgagagtagaaattcagtagatacttgtcaaactaatttaatgcattgcaaagctaagacagtgtgagatgaatattttcacatgagcatagtggcagaagagaagaaaccatacacagtcaaaaaacggaatcacttaagacctggatatccaaccctctcatttacagaataggaaatgattctcagagagatgagatttgccctgtttggtaaagaacatttcccttttcctctaaccctggcagattgacacttcttgaatactcaaaccctagcacctgacctgcctcttgagaaacctatatgcaggtcaggaagcaacagttagaactggacatggaacaacaaactggttccaaataggaaaaggaggacgtcaaggctgtatactttcaccctgcttatttaacttatatgcagagtacatcatgagaaacgctgggctggaagaagcacaagctgggaatcaagattgctgggagaaatatcaataacctcagatatgcagatgacaccac

SEQ ID NO: 27937 - DNA, 2096 bp, Bovine  19866880956265
ttttaaatatatatataaaatgtcactttttaaatgatcagcctaggaagtgttttaattttttcttatcaaagttgtatagattttttctatgaaagcagattcacaaacaactttgcacatttaaagtttaaaaaatttttaaatgaaaaagtttcaactgtatataaaaatagagggtatagtatagtaagcacatacgcattcatcatctagcttttactgttatcaatactttgccttttgtttcagttttctgtttttgcttgaattatcttaaagtgaaatacatttcatgtgatttttaaaacctgaaaattatgaattgtgttgacttattgaaataagtcagttatttttctgaggttttcatttatctcagaaatttgagtcacatacgaattcttatggaaaggatcttgacattaccgtgtccacattcagttggagattttggaagttctattcatgtggtgaaggttaagaaaaaatcagaaggtgctgaattaattctaatctgagaaccccagaattgttctgttctcaagactaatttgatgcaaactttagctaccgtctagctgtgtcctctatgtaccgagttgtatcctgtttaacccccatttctgtttataacccagtgacctaaaggtgagctttgccaattgagaacaatcagcctaccttgtttctaaaggagttttaagggttccattttaatactgtttcctagttaatgtactaatgttgcttgtctatgatcctgagtagttggtgattttactaatagagtaaaacagacttccttttatgttcagaagtagcaagaggcagtgctcttctccccacctcccaagaagggaagttagttgatgctggaggaagcagaacactgagtttcgtgtagtgattaaacatgaaagccatatatcaaacctcaggagaaacatgcttttgaaagaggcagagaactgtggagcatattgcgtgataggctatgtcaacagagccctggaggtcagtgtgtggatgcaaaccaattaaataaagaccttactggctttgctttctatcatctggatggggagaatcacaagttaacatgcacagggctgaagtgtaaactttgcttgaataagctaggcacctttggaaacttcattaactctttcaattcactaccaagtttggttggggttttgtcttgtgtgttgttgtcgttttttaaaaatttaacccaagtccttcttaaaacaaaacccagactgtatgctctcttggcctttccgtacatacctatcagcaaaggtgccagtgatgagcagaaccgaagacaaagcaaagaatgcattgctgaaaagatcaaagttggctgtgtagtcaaatttcagtgacgtgagcatgtcttttaaaaaacaacccgtttggaaaagcagagctctggcagaataactggaaaaagatgttttttctcatctcctgaattctgggtatgaggaaaagatatagttagaatttactagctactacataacatcaggatattgttatttctgttctattaaaatagtttttgaccaagaagaacatgaaacctgtaagttaaaaactgtatggtaaggacttcccagagtcttacattttgtggtcctcaccttctcaggcagtgtttgggtgagaaaatgaaataccaagttaaatggtatagtttcatggtccataaacattcaaaacaaagatttttttttttcctgtagagtcatgttggctgagaaagtgaataagcttatgtttagtggttgttgattctggactgctcggaatagcagtactaaggaaatgggctcatagaacacagcgactcaaaggtataagatgtcatggaagcaaattgtggagggttaagaaacctaatgagcatggtttagtgtggagagtggaggagagagctcactattaaataaagtccaagagtgtacaaggttaggagatcctaaaagacacgataataaaaggcacaacagaatataattatcctgaaagagagagagaggaaaaaaaacccaaaaaccctcaaaagctccagggaacacaaa

SEQ ID NO: 27938 - DNA, 1588 bp, Bovine  19866880958413
ataattagttttatttcaaatagtcaaaagatgcagttagcagacttaaagagtgtagtgaaaatagtgtaagcctctgtttggatatagtcaattctaagatagtcaaataatagattatgacagtccttaactatagagggattagaagaggactgaaatccagcactcacgttaaggtgccctggaagcaagagggatatatatatagagtcctaccccagatattacagagatagacaagaaataaagtctagtatctagaagttacactagtgaaattcacataaatgacattacctatgagcagtacctatctgcatgcttgtttctgcaatggaactggtctggtctgtgaactggcccttttttaagaaataaagggtttgcaagtattattgctgaatctgcccagcaaacacagaggcagatggtgtcatcctcactttataggtgaggacagtgagactcaaagaagctaagaaatgtacccacagttaaacagctagtgagtgacaggactaagatttggtttcagattttttttcaactattatgcccatcctactttgggtattatttatagaaagctttctaaattagaggatacttttattagaattaagaaaataattgaatacttggtaggatttcatacagaatttctgtatgaaaggtgcacaattctcaactaaagtgacttacacatctttcttgtcactgttaagatgaacgactaatattttcttaggcacgaaaattttaaatggactagaaagggataggattgctagggcttaggtaaccgccaatcactttcacctgtgtggaaggaaggaaattataaagtagtttgcactttaataagtggtaaatgtaaggtagcctggggggtggaaagaacagtagctaagagacagagaatccaggtcttaggacttgtcaaaatgaccttaatcaagttaaccctgagccttgttttcttacatattaaatgggaaaaacagtttatgctgtatgtcacagttgtgaggatcaaatgacacagtttgtaaacaaatgtaaagtgatattcaaaagtttggacagcagttgtattcctggtaaactacagtatatatgtgaagagaaatggttgtcattttttttatatttactagagtatttcttgcctattcaacatttaatttttattgaattctgtgaaatacatattatagatattgatatagaaatttgagtcaaaatgtgatgaatccttaaatgtattatatacttgacctactgtatatactggtagaaagaaggtgcctgttagttcagttagtgtgcacacctaacggtgagtaacttcactccctatatttatgtattctgaatcctttgtcacagtataatggttagtcagtgcttaactgtaggtttcgttgatcaacctgtgtgcttatggaaatagtttactttgagtaataattttaccagaagattgtacgttaaatgtgagaggaagctttagcgagcttttattacttatcttttaaattatgtataacatatagtagattagcccttttctttaaaaacttat

SEQ ID NO: 27939 - DNA, 2550 bp, Bovine  19866880965358
tgaatggcagccggcttctgccctacagctgccgggaaaactattcggactcggaggaagaggaggacgacgacgtggcctccagcagacaggtattgaaggacgacaccctttctcggcatcggcccaggcggggccacagtaagcctctctcgccgctgcctgcgaaatcggccggcggccggctggagacctcagttcagggagggggaggaatcgcgatgaatgacagggcggcggccgccgggagtctagacagaagccgaaacctcgaggagtcggcggcggcggcggcggagcagggaggagggtgtgatccgctggactccagccccattcctagataccgcgttaacgctaagaaactaacccctctcctgccgccgccactcgcggacatggactcaaccctggattcgtccacaggctcccttcttaaaaccaataatcatatcggcggcggggccttcggcgtggactcccccaggatttttcccaacagcctccctcccagcgcggcggtggccgcctcgagttcactcaggatcaatcactccaatcatacaggctccaatcatacctacctgaagaacacatacaacaaaccgaagctttccgaacccgaggaggaacttctccaacaatttaaacgggaggaggtgtccccaacggggggtttcagtgcccactatttgtccatgtttctcttaactgctgcgtgcctatttttcctcattttgggactgacttacctaggcatgagagggacaggagtatccgaggatggaggactcggcagtaagtattcaaccccgtggtgaaggcaacaaagggaatgctgttagtggccggctctagccgcactgggcattttacccgaggtgacttcaacctgcaagcacatggtttaatagtgcaacacaacacattgagggcattcgtgttatctttctttaagaaagaatatggttatcgtgataagaatgataaccctgtggctggttttaaaatttttctgtattatgtattggggaattcaaaacatcttctaaaagaacaaaatattataagcaagcctgttagtagagagcattaaaaatgtgtgacttaaattttctttgggccttaagtagtaaccatatgtggagataccagtccagttactcaaaatttgaagttattttgactgttcaggaatcataaaggcagtgggtttttttgtttttttcaaattgagttgttctgaaaggcagtgtaagatctcttgaaactgtagttaaatattttgtaatattgcagtgttatattttgtaggattaagtatatgtgtaggtatctctaatttctttaaagtgaatgaatgcagaaagtcagaaggcatgcttctaaactgattgatttcccagcccagagcagctccacttccaccagtggaaaaaagtagtggaatggcagtgcaggggtttgcagtcaccttaatttgggttggtctccaggccctgccttttgctttgctgaatggctgtgggcagtcacattcactcattcattaagccagcatcatctgtattgagcactcaggatacagcagtggttaagtcaaggtgtccctgcccttcaacacaggaagaagatgaatactgatcactttatgttctatgaaggatgtaaggatggtgtaattggtgtactgtactatagacagggctctactatatagggcttccctcatagctcagttggtaaataatctgcctgcaatgcaggagacatgggttcgattcctgggtcaggaaggtcccctggagaaggaagtggcaacccactccagtattcttgcctggagaatcccatggacagtggagcctgacaggctacagtcttcgggatcgcaagagtccgacacagcttagcgactacaccgccactctagacatggtgatggtgggaactttgtgaaatgagacctgaagcaggataagacgacagccttgtattagacaggagagcattctgggcagaggttacaagaggaggaggaaaggccttgatttgagcaagggggagtgagctagagtgtgagcttccctgacataatctgtaaaatgatgctaatctggataagaatgatgcctgggaagattaaaagaatgtaaatttagtaagatgtactttagatgtactttaaagaaattagagatatctacgtgtatacttcggagaaggcagtggcaacccactccagtactcttggctggaaaatcccatagacagaggagcctggtggactgcagtccatgggggcgctaagagtcggacacaactgagtgacttcaatttcagttttcactttcatgcattggagaaggaaatggcaacccactccagtgttcttgcttggagaatcccagggacaggggagcctcgtgggcttctgtctatggggtcacacagagttggacacgactgaagcgacttagcagcagcagcagcagcgtcacacataatactacaaaatgtaacattttgttagattcagcagtacattta

SEQ ID NO: 27940 - DNA, 1106 bp, Bovine  19866880999083
aatttagtctgaatcatgtccaatgttaccctgactctgggacacagtgattgtgacagctggtccctgcacaagaggaagcacaccaatggcacagaaattattcaagaacaattatacccaaagtcctcatcatcgaatgttttctctctatggagaggatctttggtttgtcgctttctcagctcttgagcctgtttcctgtttcacatttgacagattattttcagagacaaatcgtatctgcagtttcttgggggaacttcaaagggggcccagatttttcctggatgagttataagggtggttgatgcagaaatgattgtcttgtgaggtttccaccaagccccatgtcgccaggggctcttagaggaaacagctggtcttcagtaatccttccctaagagcttcacccattttctctggcatcatggaatctttttatttaattggcagtgctatgtggaccttgttgatgctgcttctctgttatcgctaccagtaccttgtttgttttagtaggtaaataatacatggggagtttaaggagatggtggatgtttcattcacttggtaacataaatgaggctgtgaacaagtctcctttcaaaacttccagagtgtttttggtcctgcttagatcagaactatctggttatattttattggcttggtgtagcttttcagggaggtggacctgggttcaactcccagctccaccacttattagtcatatgaccttgggaaacttacttaaccacttcatttgttccttcttctttcctttcttccttcaggaataaaaaaatttaaaaagtacaaggaaaaaatacaataaattcctatattcctaccactcagaattaactatttatagttgaatctattttcttttagtcatttccctgtcatgcttagtaaaaaattattaccctgatgatatatgtgtacactctccctttactccccacttcttggggaataatgcttaccttgtggggttaaaataagataagagacctaaagcacctagccagtgcctgagccatagcagacagctggtgcacggtagctgttattatttttctccttccatccttactgct

SEQ ID NO: 27941 - DNA, 892 bp, Bovine  19866881046411
atggatctgtctttacagcccataaaagccaacacaaaggagaatgccagctggaatcattcagtgaagataaaggctttcaaagccctggctagcagcaggtggaatatgcattaggggttcttttattgttcaaatagtatttattttccatgggaagcaaaatgattcttatatagtcaataaagagcatattcaggagttttgccgtttggccagcatggctgatggtttgtaatgactctggcatccattacccatagaactcagaagaccaaggtaccaatggccatgggtcctggcttgattcttcagacccacgtcaaggtccatacatatacagcctaagggccagaacgatttcagagtcttgggctcctggtcagtgattgcttggaaaactgctcctccaagccaaactagcttctctctgatcactgcttgtttggccagcggcaccacttgggtggataagctgtgtatggaccagggaggttttgagtaaattgtcttgtttgtcctgataacatctttgtttaggagttacagaggtttgcatcctaaaaataggtgggtggtggtggtgagcagatagaagaggaggggattcctaagtggtcccctgccttgggaattcagggattctaggaaaggccaatggtatccaatgccaggagactcagactgtatgctccttggggggaggccttgctggttttgttccccactcttctttcagtgcctggcacccagtaggagcttcttaaatgtgtcatgttgcccaagatcaagtagcatggtagagggtgataccaccaattgtgacaacagtaagctggaaagctttactaagccctacagagggatgctcaagggacttaaaaatctgaaa

SEQ ID NO: 27942 - DNA, 889 bp, Bovine  19866881085258
taatgtttattacagttaagaaatactggcctgaattttattagcttcattataaatcactgagctgatatttactcttcgttttaagttttctaagtacagctgtagcatgatggtatagattttcttgtttcggtgctttgggaccaactttatgttatgtcagttgttcaggttaaatttttgtcttttcagtgtgtacttggcagataatttccaaaagtgcaatgcattcacggtattgagaggctgggcaacattagagaagataaatggaataaaaatgcataaatcacaagggtttggatgaagcagttaaaagtgctgaagtcttcgcatttcaatttattttgtcatgtatttagacacttgttacattttttgaattccccttaaactcataatacattttaccttaccatgaccttaccatgattccagagaattcagtattaaaaaagagagagaaagaaataacactgtggtagtgacatttaatgatataatatattgtaaacacaataaaatagggaatatatgtatgaactgttggcattggcttgaagcaatataatatattgtaaacaaaacacagctcttacataaacattttatactgtttgtataaaataaagatgctgctttagttttctgagtgtggtatggagtggtctttgcatgtgctagtttatggaaataaagttggttgcaattgaatagaagttaaaactttgcaatatcataaaaaagagaagatattctttccctgactctggactagctctccagccccatctttccctcccagttctgcctctgcttcagccaggccaccctacactcctctgttgtcagagcctgcaacactcctatttatgtcagctcccag

SEQ ID NO: 27943 - DNA, 1288 bp, Bovine  19866881217249
gtgtatatatctgagaggtaataactacatacattgttttgttacttgctttttttttttttacttacttatagtagatgtttttccttgtaaaaatcttcattctccatcattttaatgacaatatatagtattcttaattttcaatacatgagaatttacttaatctcattattgagcatttagattatttccaactttttcatacgttccagtgaacatccttattcatatatcttcttgcctttgtacaattatctctttaggatgaattcatagaagtgggataactgggtaaaatagtgttcataattttaaagattttgatacatctcaccaaattgtattgacggtggtatcaatttatactcctatctgtacaattatttcttttcaaattctttctgaaaatttgaaaagcaaattcttttcagcaatagaatgttgtgaatcatttgaaatacaaagtaaaacggtccccttacattaactcagcaaataccttcctaactctaaactcattctgcaacataaaatgctagccatggctaaacacacagtgaagtaacaagggtggaggccaagggaatgaagaggagaaagaggttgtcaacaacgggcttagaagaacttcaccttttttcctcttgccagtgtctgacccaacctcttggacaatgagcttcctcccaaagaaaagtcgaggctggaaagaaggggaaactagaaattctatttaaaattccactgggtcttatatttgagattggcagcaccgaggcattccagatggctctgtctattcttttgaacctaccttttgatcttatttaaatttcctcctcatttcacctgtctgggtttattgcctggaaaacaagcaggtgaacatattagctcctccttaaggtgcccctagactacaggaaattgatgttcaggtcaggaatcatataacatgactacatgctccacatttatgggcaagttaagcaacagggaattttatgctgggatttatgacacaaacttgtagcagacacattgtgaggtgggagggaaatttaaataaggaaaaactctgccattaatattgattcaagttctccacttgatggaaaaaacatggaagaattttattctggaaattgcctgtgagttaaacaaggggcaggaaaacaaaaatataataaacacatcacccctccttccccatatattgattcccctctttcagatgaagtcagttttctagtcagtcagtgtacaggccagaattatctaaaag

SEQ ID NO: 27944 - DNA, 1332 bp, Bovine  19866881246443
ctattgaatatagttccctgtgctatacagtagggtccttgttttttattttatatgtaatagtgtgtaatgtaatgcacgtgcatgcataatgtgtatctttgggatctcatggactatagcccaccaggctcctctgtccatgggattttccaggcaagaatactggagcgggttgccatttccttctccaggagattttcctgacatagagatcaaacctgtgtctcctttattggcaagcagattctttacctctgtgccacctggaaagcctgtatatgtgtatttgtatccaaactcagatttaaaatgaagaaagtaccattgaggggaaaaaaaagtcagaaacagaccattttgctgacaactgactcacatttttgctaggtttttttttttaataggatcactctactgacaggtatctataaaagcaactggatcatcccctagagagcttgttctgcaatatggtggttgatatgatgtaacactgggccccttaatttggttgcaattccaagtctcaaatttccccttggactggttgtgttaagaagacctgtattaaaatggtattttctttcctttctccccttgaccaaaatcaacgaaaaacaatagagagtgaattttcatttaaatacttcctctcgctcttcaaagcaactgccaaatgcccttaaacacctcctcccaactctgaagttatggtagtgcttattgtcattagttaaatccttcaatgtgtactgtccacatttttttcctgatggagttatgattgtgttggtggttacaacccaagtagtttatccctttgcacccttggagtttgcagtggttttatgtcaccaaatgaaggaaatgcctcgatttttgatccctgtttcatggtttccaagtgagaatgtggaaacgtttacatactgtgggcatgatttcttcttttaaaaaagaaggtactcatatcaaaagcacaactttaaacctttagtgtttagattctgctgcattgtggtattttgcattgtggtgttgtggacgtgccaccagggatcaaagagtaattctgcagagggcccatttcattaagcaagcaggcatgtgccagccatctgttgtatccactgatagaaaacagcagtaagtttctcaaacttttgccagggaaaaaaaagagactttatagcttagaggagatgagttgcaaggtaccttgtaagcctcgtctggttctagagtgatttatatggcatacacgtaaaccctgctgggtcttcctcacacagtggtgtcaacatacataaacaaaccttttgctgttat

SEQ ID NO: 27945 - DNA, 1138 bp, Bovine  19866881264032
cctcattagacactgaccaaatgagctcttcctttgtctttccttctctcgactcgagaactcaagccttgagaacaaaggacttggtagctatcaaaccaaagtcagtgaccattgactaaatttcccttgtattaatatcacaaacacaaaaacagggaggaaagtagaggacaaattaagggacaaatacttattgctttatgcttcaatccagtcaagttcctcagttcctgcttgagaaggaatttacagctttaagtttacagctcacaaggaaaagctgaatttcagaattctgtgaataatccattttaaccaaaaagataatcttgggtttttctaacttctaactgatgttctttattaggagacaggaaggcagaaaactggctggagttgagatcttaagtcttacgataaaaatcaagttcatctccacccatggaagcttgattcaatgaaaagccttatgacactctccagaaactccgaagacaaatgtcctcacagtccaaattagtctctcctcacttccaagaaacaccccaaaactaaaaagcaaatctgtgatctttttcttactttgtaaagatgaatatttactcagagtttgcatttaaacctaaaatataacgcactttgggaagtaacaaacactggccctgaggaggcaaagcagccacaggcaccgggtccacggggcacgttggtgaataatgagtctttggcttgtgtcacaagcactgaacctcaaggatccaagtggagttttaaagctgttttgcttttcagtcatttggatcttctgccctggcttgtttatttggattacgtactaccttgtttctaaaccaaaaccagactgagaaggcagcttcagagtaaccagccgaggtgagccttaaggctacagccatcctggctccacatttaaagccgcccttgaaaggaggatgtgaacacaggttattccatgacaactcgtctcgatgtaagtggctaaaaatgctccaaaggaaattactgccacggctgcgcctttagaagaaaaaagaatgacctttgaaatggaccatcaggttgaaatttaagcaagttgtagccttcctggctttgccgtgtgtccacgctttta

SEQ ID NO: 27946 - DNA, 1439 bp, Bovine  19866881370965
tagattgaacataactcacatggcattcaagtacaccctgatgtgccaccaaactgcacacaaactaactcttctatagacataaacaacaaacttattctgattaaatagctcttctacactgagacaggcacagtgctcacacagcctcagccttggtcatgcaagccactgcctcccaacaaaggaagaaatgagaaaggcaggctaggccagagctcatcctcaatatcacatgattatatgctgctccatgaatataaatcattcaacacaaggtagtcatccatgccccacgctgtgctgacagccattcattctcccagcaatacttactgagcatctactctgggcttcactttctgctcagaacaggggtcactgagaagaagatggtcctcccagcattaacacctatatgacagttcctactcattggattcctgatggtcttggttgagaaacattcctgctgccttggtttcatgggatgacagagacagagtgttccaacaggccaagccttggcttgatggaaaatgttttttgttatccaactcaggtattttactggaccatccagtttgtatttcctctttttgttcccttctgatgccagaaggcaggcacttcctaactgttaaagatcaagagttttctatttcatgcaatgcttaggcacataggagtctgtaggagaaaagaacaccttagcagcttgaagatattaaacagaccagcagagtaatgaatgctacctggatgcttaggagcaagacacactgatttgattaatttttaataattcaagttaccctcattgctcaggctgggggtactgagcttaatgaggcaatgaataatgccctgcaatggactaaaattcccataaacttcctgcacctgcatttctgcaaaaaaaaatcctacacctgcttccaaaaacctactttggccacctcatgtgaagagctgactcattggaaaagactctgatgctgggagggattgagggcaggaggagaagggaacgccagaggatgagatggctggatggcatcactgactcaatggacttgagtctgagtgaactccgggagttggtgatggacagggaggcctggcgtgctgtgattcatggggtcacaaagagtcggacacgactgagcgactgaactgacctgaactgaaggaggggaggttatctgtgtaaagtgtatgtgtgtgtgcatgcatacatatgcatgagtcgcctcatcccagaaggtttgttctttttagtctcaccttgtctaatgcatcatccactttctcctctacatttgatttataaagattctaaattatcagtaaatgatgttttctctaaatgtaactgattgaaatatatattcaaaaccttacagtttcaacatcccaagaagtagattttcagtaag

SEQ ID NO: 27947 - DNA, 829 bp, Bovine  19866881420962
atattgtgcctttgaaaaaatgacatattgagtgttattcactaatgataacactatgtatttctggtacaagttcacagactcaaagtgtcatacaagaatgtttgtaaaatattggaagctattggttttttaataccttcacatgaaaaagaaagctacactgtatttttatgaagaagcattccttttatttcttagcatattagcatctttttttatgtttcagtattaaatgacctgtattttggaaaagaaagggaagataaaatgtaagcttagtttcttttgttcaattggagaatttactctagaggacaaatggtaagttaataaattcttctgctcattagtgggtaaaatgtgtctacttatgaaaatcattgtaattaaaatcacattttaggtctttttattctaaagctgcttaaatggctattttcataaagaatgtgatccagaaaacactttataaaaagtagttactttgaattgagacaccactttggttctctctaattacctgctgtagtataggcatgattatttaagctgccttttccacaggtctgttctctcatttttcctttcaactctagatccttcaacacttacattgtcatacaggaatagatgttttgggtccagagttcctaacaggagggtcatctattctcatacccccattttgcagataagctcactgaagctcctactgctctctgaggagggtattccttccttcccccactacagtttcctcttcatagatactttatggacagctaatcttgaattattggggaaacccagtgataaatcaatgaat

SEQ ID NO: 27948 - DNA, 565 bp, Bovine  19866881462320
agggaaattgggaagtttttttttttttttttttgcaactaagaaactaactttctttttgcagtttctgttctagccagctagtgtgtgcatgcttgagtattaataacacccagagaactggaagttttggggggttgccactgggaccctgaaggccctcagaacaggagggaaggaagaagagttaacagtctagatacaaagtcttctctaaatagctcacaaggaaaagttgggcaaacactttaaaaccacaatatttattttgccacaagaacccactgtatcggtaatcagaagacatcccgattctagtgccaattatacaatttccaattcccattttttaaggaccgctgctcatctctgaacctctggattcactctcagtggacaacgggagctgatctggagccatccatccagctggaaccctcctgccaccgtgaagaggtgaatgtggatagtttctgagagaaggtcaccgtttctttgtgctgctgttgccactgccggacttgctaaagctcctgctcatgtgaggaaagtgcacggttggggt

SEQ ID NO: 27949 - DNA, 1735 bp, Bovine  19866881720552
tttgtgtatatatgtgtgtacaggaaataaatccgatttacttgagacagtttgcaatcaggttatacagtagtcttctccattcgttaactgatctagatacatcactctacggttttgacaaaaatatattttaagaatatctatattcagaacaccagataatttatcttttttcaattatttaacttcttggtaagaaattttagctatcacattaaaatgtatgaggaagtgtgtatcagtcagcacccaatctggatacagaagccacacaataatttgaacaggaaagtctaatacagagaatgactacatgtgacagagaatggtggtgatgagggattggtaggtaagaagcaaatagaaattctgaagaatatagagacagcaaatataggaagtgaccatgacccctagggctgagacagacctcaagggaaagcttcccctgcaaactgcccctgtttccaggggctgatggcccaggagtcactatggggctacgatggtgcaactttctgggaatctgcctcctggaatttactggatacctcctttctggggtgctggggaaagctctttgcagggaagtgtctcactgggggccctccactccaaaactacctgagggaggtgccagggcaggctgctggccaccaggcgctgctcatccccgtgccctgaaaccagcaccttgctgcagaggagatactggagtcacaggagccatcgccagagaagcagcgtggctcaaagtgtcggcaaccagagaggctgtgtataccagggagttgggtgctggggaagctgtccccattgctagggcctgcaaatacgggacactccatgcaccacgtgagccacatgccagggaggcagcgggctctgcaggagcctgtttggaaagcatactgaaaccaagaaggaaaaacctccttctcctgtatccttctcctgtgtcctctactgacaaagtttaatatcgtgttggctgacaaataaaaaaaaatatttaaaggtcccagctccattttagcaaagcaggtgaagaagatacatttagaggtgacaggcaatgtattgataactggcacagagtcgctgttttattcaaaattcttttagggattcgtgagcaaaagtttgaaagccactcagtagtctagtgaattaatggcttcactgtcagaccccctcttgatatagctggtttcatactttgaacacaaagtgtgggaacaattaacttgggttagtatgagtgtgaatgagaaagtgtgtggaggttttgttaggagggagtgaggagagaaaattcggcagaaaagactaaatagaggaacaataggacaaaaaacaatgggaggaaaacagataaataaaaagtaataagaaggaagtgctgagtttaaaatcattagcagtatgaaaaggttgtttttccagctgccatttctgttaccttactcacactcattttgtgtgtgtatgtgcccacattcacatatatgtataattctcttcatttacttgactgatatatatatgtatatataaaatacttccttacataaaaggccattcaaaacttgtactctcccctaagtacattccctctcaacaatatactgcttttttactgcttaccaagtacaagaacgttattcacaggctgctttataaaccaactgcgtaatttattccatggttcacgttttcttcacattcacaa

SEQ ID NO: 27950 - DNA, 1962 bp, Bovine  19866880342081
ctggccgtgaaaaaactgtcgataagccccagaatttacttagaactcggtcagagaaatgttctctgggcaagagcaatttctcctcttcctctgcatcccacagagatgatctgagcccggagcctgctttgatgtcagtaagaacttggcaacctgatcagtttcacggggagcagaataagacaagcaagaagcatagcgaggagcccctgccaactatgaaaatttctaaaatgtaattaaaacacacacagagatgcaatacacagcattcacatacacattttgcagatgagaaatgggatcaatataatatcaatattttggcctctcccaatacacgaatgtcatcagaagctatggcagggtgcaggttggatatgaatccatcctgtttcacccaaaggagaaaataatgttgactttgaatagccagggtgaaggaggaggaagaaaaaagatgctgtaaatccattatgaatgcactgcttgcctccattcttgtatgatgtttcttaaagctgtacaactgtattatgttcatgcaacatgcaggccaagttataatggcagctagtgtggttcactctcactgtgcaagaaagccttcagtaaagctgctggcccctcacatgccattcagccccagattttcatgacccagggtggtttaggagcagtgtgcatgtcacgtggtgactgtggccccaccatccacagagacatcttcaattccatgggaggagcctggtctctggcttcaacgttaatctagccaggcattgcttagatccaacttcagactctgatttattacttagaaattaggactatccattttgtatctcttcctttcaggttgtccccccctctccattctacctccaccacaaaagacacagccaagactcccatggtgcagtgaaaagaaggaatcattgcaaatataagttgacgatgaggcaggggggaaagtgaagagggtcttaagtgtcaggccaaaaaaaaaaaaaaaaagtaaagtttaccctagagaaagtaatttttgattgagagtagcagaaagtggcattttagaaaaattaataaagaatctgcatcaaaaattgattcagaaggaaggataactgtctccaaactggtctatccctttggagacaattatcctagaggaatgcagaggtgataaggatctgcaggaggtaaaagcaggaagaatggcaatgaggtcagcattcaaaggatgtttgtgtgaggacttactgatgatagtaacggctaacacaaatgtagcacttacaatgcttctaagtattttatgcacattcaattcagttcagttgagtcactcagtcctgtctgactctttgcgaccccatggactgcagcacgccaggcttccctgtccatcaccaactcctggagcttgctcaaactcatgtccatctagttggtgaggccatccaaccatctcatcctcatgtccacttctcctcctgcacattacaagatttaattatctcatccctttgaggtgaatactgttaggaaatagaggtacagagtgctaaagtaacttgccagcacgacccaggtagcaacagagctaagaagtgagcccaggcagtctgactccatatccttgcttttaaccaatgtactggttatactgcactgcccttctcagtaaagagtcatccccacaggatcttgtgagctcttaatggggtgacacgaataggcattaccaataatttcacagagggcagactgggacagcaatgtcttcgcccttactcttgtaaagcacacaactctcagccagtgtatcagtcccctcagggagacaaaacctagatgctaggaacacacacacacattccgtgactttcctgtgtgatagataagccagtgcttgaggagaatcactgatttcccagtagatctaactgcttctcc

SEQ ID NO: 27951 - DNA, 1314 bp, Bovine  19866880381491
cctttggcatgaacaaagatgcagactatagagaaaattgtagggcttcagtttccacagtggtgtccgtttgaaaggtaggtgaggagagtcccatggttttgcatttaaactcaagccacttatttaaggagatcatggcacaggtccttcacccttggttgttaatgaccttgctttgaagtcctgaatggaatacgcagtagggtcaattgcagactcagtgacaagaattaaagtgcaaagctccctaatgagatctgtgcttattccttgtggttcaaggaacactgtggtgaacggtttacagcctgcagggtcaatccccttgcagaggcagagttaacttaggcattccccaggctgtataaacaacactgtctgcagtaggaagcttgaccctccttttatcaagccaggaaattcttggactgcagccacactctaatatttatggttccataagcatttgattctgaaaaacttcctaattctggaaaatgaccacccgttagctgttaatgcacaagtgatagggggaaaagccaccctttagaaggagagaagggacaaagagaagagcttacgaggcttaagtgtgacaagcgtgacatctacctatggagcaatcatatacacatgtttaatacatgcatatcaaatccttatatacatctttccacacagagaagctaaaatggtaaaacaaacgcttacattttttttaatttaccttttttttgtatttaaaaaattgtggcatataatgtttctcaaaacagtggtataaagtaatttgaattcatataggcttcgaatcccagtataaactgactttcttgggctcttttggctgaaaggaattttgagaggttctttcatcctttcctctcttctctacactaaacctctacactggatcttcaatgcagcccagacaattgtttacttattatttaagaaatgtaaaaaaaaaaattttttttaaacttctttggacatacacatctccatatcttaaagaaaaaagaatatcctctattttgaatccgttacctccctttctaaaggatatttacattaagcatagagaatcacctgtatcaaaacctaaatcagaggcagtggtttcatacattttccaaacgtcctgtctccaaggtaacctgtttcttcctgacaggctggagggctggagagaagtgagaagatggaaacatggatgaagtcgcatccaggggatgaggtggccactggctggatgggatcaattccgacaagaataaaacaattcatagaaatcaatgtcaccga

SEQ ID NO: 27952 - DNA, 2133 bp, Bovine  19866880581310
ctttctataaatgctagatcttttctaataagaagaaatgctgtgatctcagagatgccttggatattgtgacaaatatctgggcctctgggctatttatctaaagctggacttagactgtatgcttctccatatctatgttttcctctgtatagctcatctttgttcacaaagtaagtgaaaaatatgtattctgcccatttatcaaaaaaaataaaatggctaaaaaagaaatacagtcaactatatcaaccctattagagagatacagtgggggttactttgggtaaattcaacccatgaggtcttattgaacacacataaatggagataaatctgccctgtgccaccatatcccatagctctctgttagaagaacttctttcctgttttcttccctaagaactcactaacttaaaaaaaaaaaaataagaataagataaatcaggatgaattacagtatactaatgcaataagcatttataagaacttacatactagaaggcattttgctatgtactatgaaggaaagcagaaattataatactagcaccacatttgctctgaggaaatctgtagtttcttaggctcagatgttcagttgtgtctgattctttgtgaccctatggactatagccctccaggctcctctgtccatgggatttctcaggcaagaaaactggagtggggtgccatttttgtcaccaaagcactctaatcgagggactgaactcacatctcttagtctcctgcattggcaggcagatgaattctttaccactagcaccacctgagttattaaccactagttatttcttcagaccgttaaatcagctcttggtcttcagaatctaggcacgaatactttagcctttcactttcatttcacactcacacaagccccctccattcttctccacagttgttgttttaaatttttaacttccaagttcacaataatagcaacttttgttagtaaccatccccatggaaaagaaatgcaaaaaagcaaaatggctgtctggggaggctttacaaatagctgtgaaaaggagagaagccaaaagcaaaggagaaaaggaaagatataaacatctgaatgcagagttccaaagaatagcaagaagagataagaaagatttcctcggcgatcaatgcaaagaaatagaggaaaacaacagaatgggaaagactagagatctcttcaagaaaattagagataccaagggaacatttcatgcaaagatgtgctcagtaaagaacagaagtggtatggacctaagaaaagcagaagatattaagaagaggtggcaagaatacacagaagaactgtacaaaaaatcttcatgacccagataatcacgatggcatgatcactcacctagagacagacatcctggaatatgaagtcaagtgggccttagaaagcatcactacgaacaaagctagtggaggtgatacaattccagttgagctatttcaaatcctgaaagatgatgttgtgaaagtgctgcactcaatatgccagcacatttgtgaaactcagcagtggccacaggactggaaaagttttcattccaatatccaagaaaggcaatgccaaaaaatgctcaaactaacacacaattgctctcatctcacaagctagtaaagtaatgctcaaaattctccaagccaggcttcagcagtatgtgaaccgtgaacttccagatgttcaagctggttttagaaaaggcagaggaatcagagatcaaattgccaacacctgctggatcatggaaaaaacaagagagttttgctttattgactatgtcaaagcctttgactgtgtggatcacaataaactgtggaaaattctgaaagagatgggaataccagaccacctgaccagcctcttgagaaacctatatgcaggtcaggaagcaacagttagaactggatatggaacaaaagactggttccaaataggaaaaggagtatgtcaaggctgtatattgtcaccctgtttatttaacttatatgcagagtacatcatgagaaacgctggactggaagaagcacaagctggaatcaagattgctgggagaaatatcaataacctcagatatgcagatgacatcacccttaggcaga

SEQ ID NO: 27953 - DNA, 1730 bp, Bovine  19866880607152
tgtatgagagttaaaattcagcttttacaaaagtgctcggttgtaagttttatccttgtgaagttcatttaatctccttaatgcatctggtgtaagtcttctacatcaggcagaaattagtataaagagtcttaaatcatgttcatcctttcaaaatggtttaaactatgcctatgtacagtcactaaatacaatcaagtatttttattgtaataagtaatttgaaaattttccattattaatcatctaagaacattcttgctgaaaacagaacttatcatgagtttgaaaatgtacttttggttttcaatttcttagtcctgtgttttgatttaggtttttaatcagatctatttcagtaaatcaaaacttaccgtagctgtgcccaaggttatgcagtttaacagagaacagccttttgtactcagcaagttttacagggtagaatgaaaacatgtttgtagattaatgatgtagtattctttgtgattaaattttcaagtgaagagtcgcagcatcaagtagtggaaataacactggggctggagttagaagaactgaatcagagctcatttatgggttgagtaaccttgggaagtcaattgtcctctctgaggctgtttttctctttagtctaggggatgataaaatccaactcatagcatcattgataggcaactttacagaagtcagtgtcaggtttcttctagttagtcaataaatatttatgttttattttataagaatcaggggcagttatatctaataagatatatttaaagccttaattaatgcataacttcagtatttagctgcccaatatttagaagtttaacattaagaggtttaatatgctcattaaatgacaatatgaatttttagttttggacaaactaccacatttgagataacaatcctgattttatagctttacttagaaaaaaatgtatatggtcactttatatatacacagccaagtttagtacataaagaaaaatatctacaggtttatagaacctctaaaattttagatgtttattgtttcagctgaggaaaaaaatgttaagttggaattatttttattttttagcaaatctaaggcagttcagcaactctgtaactgtaaacttttggggttgcttgggaattggttgaaatcatatggaaaaatctagcttgaagttccctccaggtttcatttctctagctgaaagaggaatgcgtttaggaagcagtgtatttaagctccaggagattaggatgtgggaatgagccaagacgtgttggttgctacttgatgaggtgacttatttgtggagtgggatgggcagctgtattggaatctaggtgatctcagcccgaggcactgtgctataatggtagacatgtgcaagaagattaatgagaaactaggcttaacagagtgaagtgttaaagagggaactcaaagaccttgtccatctggattgaccttcaggttgaaagtaggtagagtcgaatgcactacatgtatttgtcttagagtgctcctcggtcacacagaaatatgatttttttctgatttgaactcttcaacatgaaatgttaacaaaaatgtctagcctagggtttagcaatgtattcaatgcagaaagtcttgataatatttaatacttcaaataattttccctagcctttgagatatcttgcactaaaaatgtcttcttgctgaagcattctctaaaatatta

SEQ ID NO: 27954 - DNA, 1637 bp, Bovine  19866880644695
ctgaatagaaactggcctacaattctgtgtgtgtaagaataaggtggttgttataacgcattgagttgaaagaggtgggggggggggtagctgtttgttacatatcattatttctgtagtaaataactgatacagatacacagcagtcttggcttcagttaccttctgtgaaagtgaaagtgaagtcatgtccgactctttgagaccccatggactgcagcctaccaggctcccctttccatgggattttccaggcaaggacattggagtgggttgccatgtccttcgccaggggatcttcctgactcagggattgaacccgggtctcccgcactgcaggcagatgctttactgtctgagctaccagtgaagcccttaccttctgtgagcaattataattttaaattactccactaaatataattttcaacagtattttccctgtatcttaaccctagacatttctctactttgataaatgttgaaagaactgatcaatattgagaaaatacagtaaagttttgtacaaataaattccttaaaattaaggccgataatctggataactcgctgtttcaccatattttatttactgggtttttaaagctttattgaggtattatttacatacaaaaactgctcatataaatatatattcaatttgatgagtctggacatttaccaaaaccctggatgacatagagtgttcattttaaaattgaaaatatttatgagtggttaataattctcccaaagtcacttgcaaaagagtgagaaagatagtatctatctcagctactacaattgtgatcaattggagtgtccagagactgacttttttgcatctgtcaaatttttgtctaggttttgactttttgtgcctgctttagaacgtttatttcacagctgattcaaaatttcaacaaaggatgatcagaagcagaagagactgttatatactaaccatgaactaaatatcatatcaagtatttaaaatatattgtcttattaaattctccaaacattcctatgaattatttatgttttccccatttataaatgaagaatttgaaccttttaacttttcctaattttttcaatgacatatcatactaatatatgatagagttggagatgtaagcttaaaactaagggaggcttcctccagagtccaggtttccttcattaaaccaggcagtttccacaatcaatgtaaatttagtaacttgaattaataaaacggaggcctaaatcaagggctaaaattaagtttaaggatgagagcacagaaaatggattatgtacacacacaggtatttgtgatttcatttaattttcctcaatttttattttatattggatcatagttaattaacaatgttgtgttggattcagatacacagcaacgtgattcaggtatacatatatatataatatatatatatttacaattctttttccacttagattattcagttcagttgagtcctcagttgtgcatgactctttgagaccccatgaactacagcacaccaggcttacttttccatcaccaactcccggagcttgctcaaactcatgtccatcgagtcagtgatgccatccaaccatctcatccactgtcatctgcttatctt

SEQ ID NO: 27955 - DNA, 964 bp, Bovine  19866880671182
tgaaattgaaggctacttcctccccgacgtctcgggtggaggaacaccagaaaagaacagcctcacaacgggcacccgctgcccttgctaacgtgggctccatgtgcttctgtaaaaatggctatgtgtcaaacagtagagaaatgtaatcattatttttagaaatttttagacattttccatttcctagctgactatcataatttatttcccacagggttgttcatcatccataaaaattgtgtaggatttgtgaagcaatcttgagtttgtaccctctgggatattttagtgtagaactagaagaagcctagagtgattttattttattttttttttcattcaacctggagaagaaaactatctgttgatgaattgtactgaaggcgctcagtacagaatcacaattgcaagggctttatttttctctctcttgaaagtttaatatctggaggtcattacgtagtttaggggctatgcaattagactatggtgttcaagaaaggcttgtcctcaccacaagggaaatgagtagaggggcttgggggtgttgcctagaggaatgcagctgagaagagatattatttttgccgtcctgtgttgtatattctgtcagaagtatccctcagtgctttgcctggagaaagcccaaaatggatgtgagacctgggattacaagtcaaccgccattgctgctgaagtctgagtttggattcatatgcctgggaaggagttcgtgtagccatcgtgtgaaatgctgaacctcagaaaacccggtggttaggacaggtttttctctattcccttggaaccggtattcatagaatcttaaataatttacattggaagagttagactacctccatgcattatcaactgaccagttattttttagagtccttgacaaattgctttttaaccaggtgcaaaagtaaaaagcaaaataagacaaaacagaacaaaa

SEQ ID NO: 27956 - DNA, 2245 bp, Bovine  19866880709415
ttttggtaattctcacagtatttcaaactttttacattattattttatttattatggtaatctgtgataagtgtcatgtgtgatttttgatgttactattgcaaaaacattacagctagctgaagacttagatgatggttaccattttcagcaatgacgtattttttacttagagtatgtacatttttcttttagatgtcatgctattgcatataatttttacatgcactaggaaaccaaaaaattagtgacttgctttattgatatacttgttttactgcagtggtctagaaccaaatctacagtacctctgaggtatgcttgtttacaaacttagcagttttgaatctacttttattgctagtaaacttagaagataaatctctctttttctttgcacatttttcagcttgtgacctaaaatattgatgctgaactatcaaatgcgcagtaattttcaaatcctattccttggaaaattagtatttctgactacttctctcagaactactttgggaccaaattttgtttagttggtttattttttgatatgcataaactttaccaaatataacgttagactttagagttctgtaccagagagctctaacattaacttttgtcagagtacatttgaaaatgtcattacaggaaattgtaagctgtccatcatggaattatacagtgttttagctgaaagaatcaataaacttggagagcctttcagtttttcagataagaaaatttgtggcctgctcctggttgtgtatctgattatttagagagtaggaattaaattaagatcatacaagtctttgcattaaatacagtcagctctctttattcatggtttctttatttgcagatttgctcacccactaaagtcgtatttgtaagccgagtatctgtactcactggactttcattaccgttcaaagacttgggtggagtggtgaaaaatttgggtcacctggcactcacatccacaacctggttcaaacaaggctatgctttgctttgttttagctctcatactctaagctagtgtcctttcacagtttagtgccatacttttcacatttttgtgcattttgttgatgatttcattgtttgaaacagcctacaggtgtagtgctgaaatgctgcttacattgtcttatattcctaagtacaggaagactgtgatgtgctttacagagaaaatacaaatgataggtagtctttattcaggaatgacatataggaccattggctatgagttcagtgttaacgattcaacaatatgtactaaataaggtgtccctaaacagaaacgcagtgaaaccaagttatatgttcaagattgatgaagatgttctgaccagaggctcataggaacctaaacttgtatttgccctgggagttctaattcagtgttcattaactgagtatttcaagttactgtgtagaccgtgtgtgtgtgtgtgtgtgtgtgtgtgagttgctcagtcatgtctgactttttgtgaccccatggactgtagctcgccaggctcctctgtccatgagattctcccagcagatatactggagtggcttgccatttcctcctccatgggatcttcgcgacccagagattgaacctgcgcctcctgctgctcttgtagtggcaggcagattctttaccactgagccacctggaaagcccatagattgatagggagagacaaaaggaatatatcatgccaccatgatgctgatgtcagtccctattggagtttttaaccaagaaaatgttttaattaaaaaaattataatatatttataaattaaaatttgaaactatatacatgcatagaactttgtgcatgcttagtcactttgcaaccccatggactgtagcctgccaggcttctctgtccatgggattctctgggcaagaatactggagtgggttgccatttccttctccaggggatcatcctggccagagactgaacccgagtctgctgcattgcaggcagattctttactgtctgagccaccagggaagtcttcacccactgtttcaattctgcagttcacccctgtcaaagtcctctgcacaccaacttctacaaggttctatccttagtttttcaatatatatctcttgctaaggccacttgacacaccccctttcttcagttatcttctataatatgtctcctcagccagatatttttcctgaactctagattcataattctcaaatgaacattgagca

SEQ ID NO: 27957 - DNA, 1351 bp, Bovine  19866880781085
cctcatctttagtgctgaggagcaaaaccatgaagaaatataaaaatgcttgttttttaaacctactctagaggctgtatttggttatgctttattctttttacatttttgtcatctttaagtggatccaaatctaagtaatatctgcaaacaaattagtaatgagtttccccagtggctcggatggtaaagtatctgtctataatacaggagatctgggtctgatccctgagttgggacaatcccttggagaagggaatggctacccactccagtattcttgcctggagaattccatggacagagaaacctgatgggctacatacagtccatggggtcgaaaagaatcggacaggactgagtgactaactatttcactttcacttttctcaaagagaataaagcatttaaatcagtactcttttggtctcagaatatttccagtgtgtgggggtggcgtgggggtggggctttcctctaaacacttaatttgaatagtagggtggaaatggttaatgatgtatttctggaactgcttatctaatctaatgacaatgccaaaggcctactttagaaagttcaacatattcttttgattaattttttactatatcattaattacaaatgaattctgaatgaaaaatggtgtgtatctttctgttagcacattttcttgacccgtatttccagagataacattttccagttcattccaagttttgatagtcacctctcttaaggtcaagataaagatacaataatgagaaaatagaacaaacagcagctaatggaagaagcagtccataaaaagctgtaatggtaattccacccagacagcaaaggaatgcagcattttcactgagcactacctgacagattcaataatcaagggaaagccttaattgatgacacttcattagcataatgagtcgaggctgggaaaagagagtcccttattaattaatcaagcaaagcacgaactgtttcagtctcctacactctgccattttccattaatcaagaaaatgtgtattaaactcatttgaaatcctggcatgtggagtatcattccaaagaagagcaatggcaaaaaggtttgcccagctgcacacatctgctctggacttatgtatgcctccataagccttcagatctgcaaggctgaaaccatgcacagagggcccagagtaagtggttctctaaaacatgtaaatcaccatctcattaggaaaatacacaaaaccccatcatcttcactaggaaaaaaagaaagagaattaacttcatttgccgttccttcacctattgtccaaaacctctattgcataaatattatcaaatatgcatata

SEQ ID NO: 27958 - DNA, 1702 bp, Bovine  19866880805452
aaattattttatgtgtaacagtttaacatcttattataatcattaaatgcaatattattttaaccattgtatattatctaattattatattctagattatttagtgaatccacaaatgctcaggttccagaatttctcccaagtaaattgtcttataaaaattttggccaagaatttaatagagtatatttgggaggacaagagtaatagggagaataaaagaatttgagagggcacactgaaccacacaccctcccagggtatatttctagctccagtattcctgactcatataccaaaaaaagaaaaaaatataatataaatatattcagcctgaacattcaactggtttaaagtcctttgatgactcaaagcacagttccagacatcagaaatgaaatctcaatctgtgccagttaaatgttaaataactgtatttcattattaataccaataatattttattcattacacataccaaagagatcagagttcattcagtctttcattcattaaacacggctatgacagccttgctgtgtccctagaatgagaggaaaagagaaaaatgaatatcatcatttttagtgtgtgaagtaggaaatggaggcaatttgggtggtcaaatccaagtaacttatagttttctttcagtgcccagctgattggaattgctttagctgggcctgctgcttatctaatcaggctcttctacttctgtgttccaaattgccttgtatgtccacccttcatacctttggtcttgttctttctttgcagaaaagaaaactgcattttagcaatgaagactcaactgcttcttaaatttttcttcggtccctttcgaagagttttttaaactgcattccaaaatttgctgtttacaagtaattgatatctttgtagtggaaatagagcaacttccatgctttaaaaaagtctaaccacccttggaaatttgtatttaaataattttgaggggtttcattgtattaggacttaaattctttaatgtggcagtaacatgaggaatcctcaggcctcctgttttacatattcctggaactttatactactcatttgcagaattatcctagttataatttaaataattgtttgtttaattcatgaatcccccataggaaaaagctccttgaaggcaggtaccatgttcaccttcatttctgtattctagagtgtaacatagtttgtggtacaaagtaggaactacaaaatacaggttgaatgaataaatagctgaatggatagtcaagaacaggacagactatatagtatttctcagatgcatctgaccaataaattatattaatacataattatatattaatatttcaccaaattgatgcatgtcttttatgtatatacatctatttttttaactttaagttgtgaataaggctcacaacagcttaaattttgagaataattgttcagccaacatagtcacataatttacaaacatcctctccacatctatcttgtccaaaaagacatcagcaaaacactccattaaatgtctcattgtcatgcagattcaccatgtctgtataatttaattagtttggtataatttattcttagtgaacttaaagtggctcttggtgattgccacttcctttctaggtgttcatgagccatctgtctaattatatgtcttggaattttgctgagaactgatgaa

SEQ ID NO: 27959 - DNA, 4049 bp, Bovine  19866880818781
acatgtcttactaagataccctcttaaaatcctaagtatcctatgaataaaaaagaaaaacaacaggtggctaaagacaaagatacatacagctgattgggtggtatatggcttagagtggcattatgttgttaattttagcattaattgcatggttagggtacctaatgttattgtgtacatagtcttctaagtgttcagtatgaattaaatcaacaaattctcaaaataatcctaggggatcagatcaatatctttttttcacaaatgagcaaacggaagcaccaaaagatgaaataactttccctaaatcatacagctagtaagctgggattccaacttagctagctgcctacagtctcacagttactatgccccactgcctctccatatattttttcccagtaaaaattatctgtatatctggatgttgtacatattgaataatcacacttttggtgtgaggattagggttagatcaaagatgaaatcttgtcctaatattgtgccatgctatgacacaatctatcataagccacttgtatttccttttcattttctagaaaacaccacattttaatgaacttaagggatctatcacataccaatcttcttattacgaaacttggaaattccctggatagttcaatacaaagaatatagcattaatacaaattcctagtagtggaaacagatgttttgagaaaagcaaaagttgaactgtttccctaagtcttcgtgagctgtgtaaaattcctgagaggccctgaataaagatcattctaattttgaattaaaagcctacaaggagagtttttaatctcagaagaaaataccagcagattcatctacagacttcagggaagaatagagattgcctaggtcacgagtataaacagttttcttcatacatttcagttgtcagtggctatgttgaacagcaagctggggctgtatttggctcgctgggaagaatgcaacacttacttggtgacccatgtcttagatgcagaatttagggaagggcagcacagatgtcaggcttcactggtggctcagatggtgaagaacctgcctgcagtcttctgtttcataggaagctggacgtgactgagtgactaacacttccactctttcatttcagtgcaggtgtcatatttttgccatccttactagagtcaattcctttctttactacttcttctcccctctttccagccatcctcctagcaaacagacacatgcatacacatacatggtcacacacacatacacaaacacactcagtacttacaccaccagaaggagatccttcaaatgaaatcctgggctgaccttcagactcaaacttctgtgcttcacttaatttctaacgtggggtcagctaatgcttagcagccacctttatcagcatataaaaagtaatactgatattgagccaagaagattgacaatgtactttcctgatattaaaagcttacaatcaacttgtttctgttgaagtcctttaggcatgaataatacctctctgagcttacaggaagtcatgctagttttgcatgaacaacaccaagtaatgttgagtttaatggactgatgactggggacctgggggataggatgaaggaaacaggagggaaaagggtgggaaggtgctgaacccattttggagaaaggaagataggaagaattgttgtgtacagaaatgtgagagggaatactcagagtaggatggacatactacgtggaaaaaagaaatatgttaggagagacttagtgaccagtattgttttatgcaatgactgtcctgtgtgtgactatatacacatgtgactaaatgcacatatgtagtttgtatttaaagtctaatgggcacccccacacacacatgacagaagagggaaacactgaggaagtcaagatcaattttctctcattattatatgaatatatcaactttttcaaggcaagccattggttcctcttttcttgtttcaggaagaaaaggaaacaaggctgtcagtggtctgtcttgggaacaccacttaataagctcctcccagtgcagaccaagctccccagagcgagtacaaatggcttttattaaagcccccttctaaagaggcaccatgagaaccatgcaataaaacttctgaatggcctttgagtcaccattcataaaaggagaataacaatttgatagtcttttctatggcttagtgccatcgtttaaaaaatgggaaactggtcttagcaaatgcccctgggttgagagataagtagtaaaatcatcaatggcctcaggaactaatgaagctaaaccaaaactaaattattaatgctactgtagtatgactctgttctggctcttgaacagagctgttcaatggactggagagaacagtggctacattttaggcaacagaaacccaggtggtaccttgtttttatgtcatattttccacttcaaacatttttggggggtttcacaattgggatggggcattgtgctaacatttcaaccaacgttaagcatccctgaaaaggctaattcggcttacactaagtggaaatgaaatcaaaccaaacgaaatcaccttgacacaatccaacagaacattctgaccttggacaattggcctagtaatagcataataatcatcttgcaaaagcaggacaatcagttactggctgttgttagtcctgctttttctaagctctgtttataggatacaaaatgtgaggaagattggacaattatctgtctgatttgatcagggtaggcagccaaaccagctaattcagcagggaaatagaaccctgactagctacactgatcaaatcaagagaataactgccagatctcccctttactttatgccgagtagatgctgccttggggaatggcttacattcaaaggctctgactgtttgaagtccccccaaagtctgttaattggagctctttggattctttggacagttaaagttgcatagcttggctgggttggctaatcagttctcagacaccataaattcaagcccccttaaaatggtggggaaagaaaagaccttcataataaaaattataattacaatagcatgattttcctgctaaaaaggaagtaaaacgaacttgtgtgtaggatagccagctattctttcatttggcaaaccagccaggaaacgtagagatggatatttcagttcagaagagtgcttcaggcctgagtcctacaggcacggggtcgcatgacagcttctttgatcagacaccaagtttcattaatgtcaacagtgaatagacgaaacaacagttttgatgctatagtctaattttatccccccgaaattaatctggcaagttttttagggacatataagttttttttttctctaagaaattatctcctttataaaataaggagaagctagaatgaggtgatagtgctggctaactctcaacaaagctaaaggaagaaggtgtttggggttaataaaactaacagaattcaacacagggtggttactcgaagggctatgtgtttaatttatttttaagaatggttcattcaagccaaaacataaattcctaacaaaattggttagatccttctgttgcaaatatgtggattgttactccaagttccttctctcactatctctccatcatgtgttcaattttatgtcctcacttctcttaccctgagttatgttaccaccaccaaaagtctccatgcccacaagattcttaagacaaaagaatgggaaactctgacaaaatccttcctggatgattgccaatggaaatagtgcccctgaagaaacatgaactactattctgtattccttctttgaaggctaagttataactgaatcagctcccataaaacagcaaagtcaaacaacaatgagtatttattcatttgcaatcactgtcttctaaggcatatgggaccaaatcaatttcatccagaatgtggaaaacatatagagaaagaaaaaaaaaaaaggaaaactttatttaaaaaaattttggccacaccgca

SEQ ID NO: 27960 - DNA, 1214 bp, Bovine  19866880856024
agagactgaaggaacttgtctacgatacttaggtttttaagtaggtagatgagtctagatttaaactaagatttcacagatttttcccttgcctgttacatacttgagaaaagtatatgtattttataaatgaatcaaatactgtatacatatttgtagatatttgatgtttcataaatgaatatctatattttcatttctattatatgatataatgagaagcctgctgaacatgtgaaagagtgtagatagaagcacttatatatttataatatataaatataccatcaatttaggtaagtggttctcttttcctagattttttaagataattctgatttgggagccttccctagtgactcagtggtaaagattccacctgcaatgcaagagatccaggtttgatccctgcatcaggaagatcccctagaaggaaatggcaacccactccagtattcttacttgtgaaatcctatagacagaagagcctggtgaactgtagtccatgcggttgtaaaagtgctggacacgacttactgactaaactaccatctgccttgtgtcagtggcgttgagtatagtctgtctcccttgtagcattaatctctctctcctattgcaacagtcttgaataaagtcatcttatccaggggaatatttctttgcttggaaatgaaaataatgctagtggtgatagtgatggtgatggtcataaacatcgtagaagaaaacaatgtatactagagtgtagtaggttaagtacagttttggtttactgaaatcaaccagactaaacgtgatactaagattggttaaccttgtgctaattcataaatggaatgactttagtttatcttaatcttctttggataactttagagaacagttcaaattcagaatgataaataacgcatgacgaagtacagaaggaattttatctaagaaagctgtaccttcactaatctaaactttttgtctattggagagagaaatatgttaaaagtctgtcccaccggatagttcaagtgtactttatacccctgaaagtttctgtagaagtttcaactgatcacatgttggttaagaaaaagcaatgctggctttcagctgtatgagtttcttatatattttggagattaattctttgtcagttgttatgtttgcaattattttctcccatactgagggttgtctttttatcttgtttatgtttc

SEQ ID NO: 27961 - DNA, 2908 bp, Bovine  19866881048502
actggagtgggttgccattgccttctccaatattaacccttaggtaatgttataaaattaaccaccacaattgtactcatttcacatgctagcaaggtaatgctcaaaatccttcaagctaggctttcaacagtatgtgaaccaagaacttatagatgtacaagctggatttagaaaaggcagaagaaccagaggtcaaattgccaacatctgttggatcatagaaaaagcaagagaattccagtaaaacatctgcttctgcttcattgactacatgaaagcctttaactgtgtggatcacaacaaaccagaaaattctgaaagacatgggaataccagatcaccttacctgcctcctgagaaacctttatgcaggtcaagaagcaacagttagaactggacatggaacaatggactggttcaaaattgggacaggagtatgtcaaggttgtgtattgtcaccctacttaacttatatgcatggtacattatgcaaaatgctgggctggaggaagctcaagctggaatcaagattgccgggagaaatatcaataacctcagttatgcagatgacactaccctcacagcagaaagcgaagaggaactaaagatcctttgatgaggataaaagaaaagcatgaaaaacctggcttaaaactcaacattcaaaaaactaagatcatggcatccagtcccatcacttcatgacaagtagatgggagaaacaatggaaacagtgacatgtttgactttcttgggctccaaaatcactgcagacagtgactgcaggctgtgaaattgaaagatgcttgctcccttggaagaaaagttatgacaaaactagacagcatattaaaaagcccagacattactttgttgacaaaggtctttatagttaaagctaagatttttccagtagtcgtgtatggatgtgagagttggaccatgaagaaggctgagtgctgaacaattgatactttcaaactttggtgctggagaagactcttgagagtcccttgaacagcaaggatttcaaaccagttaatcacaaaggaaatcaaccctgaatgttcattggaaggactgatgctgaagctccaatactttggtcacctgatgcaaatagctgactcactggaaaagaccctcatgctgggtaagattaagggcatgaggagaaggggacaacaggaggatgagatggttgaatggcatcatcaactcaatggacatgaaactgagcagactctgggagatagggaaggacagggaagcctggtgtgctgcagtccatggggttgcagagtcagactggactgagtgactgaacaacaataagtatatagtttgagtttacttcaagtaggatttttcttttttaatatgggaaaaattgttgctaatttaaaacctgtcacaccaaagctttgtgctatatttgtataagagtaaatgtgggcctataagaatttagtcttgaatgcaattgatgcaattgatttttttttttttttttttgcagaatggaaagtgagagtgtaaatgggaaatcttattatttccccatgattatccatcatatttagtcctaaataactcactcattcaaatattttaagtgaaatttagaattattcagaatattgtaaccaaggcaattatcaaagctgtttcatagcaattataattttatagacaaactagcacaagccattgtgttccttgccatagggaacccaaaaattgaaaacaaaaatcatctcgtgaatttgtaataaaagtaatctagtacacagcaaggactagtctgagttttgttaatttataattttcagagtggcttttgggctcaatattttgttttcttttttcatttcagtgataagtaattagactcagaaaagtcaaattatttacttgaggtcataagtcacagatattaaaaatcagagctagagctatatgttttaaatgataatgcaatgattttccttcctcagaattacaatagcaaagtttgagtgaaagtttaactacttagagatacattacacattagcagtgcaacttaattaaactctcaaaacaactgtgatggggctcatagattgtaatttgctggagcttcaaaaacagattgctttattttctgagtaatgtgttattctagagtattttaaaagaaatataatctgttcttaataattcttccagtcttatttatactgctaaaatgcttccgactctattttcctgatattttacaaagataaacacatacctagttcttttctgaaataacataaatcccaagatagtcaaatcataattaatgaagacacactgaatgccaatgtatgagtctttagtatgtgatgcttattattttaactggcctgcataaatcaacaatgaaaaatggaaatagtgataaatagcatgctaaacataacaaagatctgagtgactgctttgtcctcagagatcttcaaagatttgaacaaataaagtattcatccagtagttcttcaaataaaactaaaaaggaaaagaggtcagttcaatttctataagtaagatattggaattagttgaaacatgcttgtggtagccatcctctggggagaatagttgttaactcaatgaatcaagtcctgagatggagcgggagaaaaacaaaccaatcaaggctaatggttcctgatgaacccagattaaacacagagattggtctggcttaaatacactcaagggaacagtccttcagataagagtatcaattttcactctgggtcaatagaatgaagagtgtgcggttaaaaatcagatattgcaaatgtatacagcttgaataaggaggcctgctggggggaaaaacaaactttgcaatcagaagagactttgaaaa

SEQ ID NO: 27962 - DNA, 1299 bp, Bovine  19866881126425
cctcataagctagcatggtgccccagaagagaatagtagccctgacagatatcctaataccttatcactgctgcatcattcatccatttaaaaatactgcttgttaaaatgtaagccatttaaaaaataattcaaataaagctcttctacctttgtttatcttttctaaatctgtccctaatatgttttcatgtgccggcattcatatttgtatcatctgttgtccaatattatcctggccaatgtgtttagtcaattctgttacatataatgaaatatctaaatgctaagcatttatgccagctagtaatagctaatctatttatttttcagcatctgcataaactctttcagagtgttgtcacttctctatttagctggaaagactgacaaacaaaatctgaaaaagactaatgtttgcagaacagagggtttcatacctcccatctccctggctgcatattttcaaattttatgcctcatctgctaaaatctctttcaacacaaaccccaactgtgcagctgtgtaaatcatgcattcccgtgaccaggtatgccaaggatgactgtggagatacccctgttaaagtaatcctcccactagaagagacactgataacattgatttttggatgtcaacaggctggatggcttagaagctaaatagtttaagatggttccagaatgttttcatttgaagcatgatgattataactgtgttgttataaagtttgggaaaactagaagcaccttctctgtgctaataattactggagagcattgttctttgcagactcgggaatccttaacatataggctgaacttgccctgctaaaatttttctgtttcccttctgctgatgctgaaaaaataataatacgaatcatagtttttcatctaataagcatcaattactcaacataatcaaaagaagacattcatcttttaatctatctctgtcatctgtcttgtatctatctatcatggagctaccctgaggccatcagtcattacacaagttggttgtttatttttttaacttagttttacagcatgactcttaagaaatggctaccttggatatgcctgtgatgaccacagtgaagtaaaataacactgccttgctgcctcgagaggaaatcactgacttttattatagtagtgtggtttatgctagtgttctctttcaatgaaggtctaatatgaaaaatggtgttagcggaatattttaaatcatcgtcacaaatcagtatatattattccatcagtttgatgtttagatgtataatacatattttc

SEQ ID NO: 27963 - DNA, 1952 bp, Bovine  19866881158066
aaataaatgtttcatgaaaagtacatagtgactttttaggcttccatctagtcaaagctatggtttttccagtagtcatgtatagatgtgagagttggactataaagaaagctgagcaccaagaattgatgcttttgaactatggtgttggagaagactcttgagagtcccttggactgcaaggagatgcaaccaaccagtccatcctaaaggagatcagtcctgaatatttattgaaaggattgatgctgaagctgaaactccaatactttggccacctgatgcgaaaaacttactcattggaaaagacccttatgctgggaagtattgaaggcaggaggagaaggggacgacagaggatgagatgatcagatgacatctccaatgcaatggacatgagtttgagtaggctctgggagttggtggtggacagggaagcctggcgtgctgcagttgcaaagagtcggacccagctgagccactgaactgaactgaggctttatataactgtgtccttctgtacgttatccatgaaggttctcttcatttgagataccttgaaatcagtgacattatcattttgaaataattttgttgatctgtagacaatgttcatgtgatatactaaacagcatgatatagaatttggtctaaacctgttcagcactgtatccaaaagtttgtagagacttagagctaaatttcatgtgccagtgaatctactaagtttaaatagacagcagctatttcagtgactttaatgagtgggtgtccatactgtcacgaatagtttcaaaaaaagttacaaaattacacctataaagatgtctgtcagtgaattatgaaatttagggtttgaaaaggaagtcaaatatattgattctcacattgaccagaaaataaaatgtatgttgctttactataagtgggagtaaaaaaaaaattaagacaagagagagaattttaggccttttaggtggcattccagaatatcctttgcatttcaaataaagtatgaaattaattgccccatgacaataatttacaaattatatttcatcaaataccttcctagaagttaaagcttgttattggcttcccaggtggcccagtggtaaagaatccatttgccaatgcagaaatcacaggaaactcaggttggatccctaggtcaggaagacctcctggagtaggaaatggaaacctactccagtattcttgcctggaaaattccgtggctagaggagcctgacaggtcacagtccctgggtttacagagttggacacaactaagcaactgagcactactgtcccccaacaccatgacactgaaagatccacttgtttatttgctatacacaagacagtgaagttggtttgcattttggagactcaatttgtcttcaaaattttaaaggggggttggggatggggaacacatgtatacctgtggtggattcattttgatatttggcaaaactaatacaattatgtaaagtttaaaaattaaataaaatttaaaaaaatgtaaagggacaatctactaacaaatcacagactgaatgctggtatttttcatgccttatctgattgaagcttcataataacttaaagccactaactgaaaccaaccattaaacaaactagaaaacgggttcagggaagagaaataatttgcctaaaattacatttcataaaggacttccctggtggctcagaggttaaaacttctgcctccaatgtaggagacctgggttcgatccctgggtgggggaagatcccctggagaaggaaatggcaacccactccagtactcttgcctggagaatcccatggatggaggagcctggtgggctacagtccatggggtctcaaagagtcaggcactactgagtgacttcactttcactttcacatttcataaaaatagcagggctggaatttttatctaa

SEQ ID NO: 27964 - DNA, 963 bp, Bovine  19866881199101
aggaatcaagaagacattttctttttaatcagtctaagatgattagtaactttgcttgtggaatgatcattttccaagtacagcaatgcaatggtgtagtaaaatagagggaaaagattaaggagtttaatttacttggcatgttataactatgtttattaaaacactaagaattacagcaaaactttattatttgttaatattacttttgcctcaatgggggttatattgagaaaataatattctagacataaaggccattgccaagccatattttttaaaaacatatttttctactttcttataaaataaccccctgggtacttataatgaaatctatttctttgttggaatgtaattattccccctccctcaataagctttccatctctggtttattgctgtaatgttgttcaaataaaaagacaggttcagaattctgatatattaatcagcatgccttatatcataaggaaaaggataaagggactgtgaattatttctcaacaaatgttttgtttgcataatggcacacttgggatcttctttctggttttatggttttatcatgaaattaattgaattcagtatatacatgcaaagaactgtattaaatgtggaaaatccatgttaaataaaaaatagcattccccaaaataaaactgaaagttttataaagaggtcagtgattttaacttactggttcttgtaactttggcttgttttagtagtcagagagtctttttcagaatcaataggtattctttgatttccaagaagaaagttgacagaaagttggttccaataggattgaaatatgcaaaacaaaaaccaataaaatatggacagctttctaagcatttctcatgacagtggtatattatgtaataataccttatgatggaaaccatctttgctatgagaaacatggtatatttagaaaggacaataatatatttatca

SEQ ID NO: 27965 - DNA, 1352 bp, Bovine  19866881334770
ttttaaggtatgaagtcttttaaaattgtatacaaagccacttcctgccccacaaggacctcgtggtgttagtgaatcaatgactcaggttattgtgttttgagctccttggcaaggttctaatatcccaaggtgttactctctgtgcaagatttcctgactccagttggttcgacagcagttacactgaatgccaatctctgagctgggacaggtagaaaactgggatttcctttgttcaaccaacctatgacctaaggcagtctggcacagaatggttttgtggatggatgagcatctgttattatttacaaggatgctacagagtactgtcatgctccttgcctacctcctgggactttcgtgaggtttatcatgattactccagcagtgcaccaaagacaagagctttagaagtataaaatatatttagtgttttctgatgactaacaacactttcagtttgccacttactttcgatttgtgattttcttcaaaatggaattcgtgctgaatatgctcagaaggcggaagctggtgaggcaaagtatctcgacattattttggtgatttttttttcataaaatttcacattgtttaaccataggtccacaagaagcttttatataatatcagtagatacactttcagtatggttcttcttaggatgttgtcacatcccctctattctctcttctcatctgcctgttcctgagtgagttctaatctacattcctggcttcagcggagctcaggtaagaatatgcaccatgatcttccactgctgccaatcaaagagtaaacactttttatttccaaagtaaaatttgtgtttcttctttctaactttgggattttgcagtttcacttaaacctttctttcacatccccaaggtccatttaattaccacgttgtgatactccatctactcatcaccgcagctatccattttgtcctctctatccacactgccaccaacctcggggatattgttaaaagcctcctaacacttctactggctcagtcgcacttacttctacaccctctggctgctgtcagcggaatctttttaatacaataacctcatcacgctgaacatccttcaatggttccccattgttttcatgcagaatctcttctgactcttctgtccattttcatctcttttaactcctaatactcactgtatgtgcccagtcataccaaagtacttacattttaaaaacagtcatgttctttcatgactctgcccttgggccaattgttctttctttctaaaatgactttccagccaccttgacttcttaaaaaaaatttttttttaggcttaacttgacttgcctttcaagat

SEQ ID NO: 27966 - DNA, 1523 bp, Bovine  19866881428802
tgcttctgtttttctctagtatgtaaatagtcagagctgtagattgggaattgcttccttgtattgtgaaaactgactcattagaaaagaccctgatgctgggaaagattgagggcaggatgtgaaggggatgtcagaggatgagatggttgtatggcatcaccacctcgatggacatgagtttgagcaagctctgggagttggtgatagacagggaagcttggcatgctgtagtccatggggtcataaagagtcagacacgatgaacaactgaactgaactgactgtgaacaatctcaggggatatgtatgtaagaggatatacatgtctcaccccttgctaaattacagtgatcacctagcatctgttttccagttcttagcactctcttctaatggtaggcctcaagaatatttatttctgctatgctgctgctgctgctaagttgcttcagtcatgtccgactctgtgcgacccgctagatggcagcccaccaggctcccccatccctggaattcttaaggcacgaacatgggagtgggttgccatttccttctccaatgcatgaaagtaaaaagtgaaagtgaagttgctcagtcatgtccgactcttagtgaccccatggactgcagcctaccaggctcctccttccatgggattttccaagcaagagtactggagtgtgttgccattgtcttctccggatttcagctatggcatatgattaaattcgtgtttataagtcagataattatgcatgtattctaaggtatataacaatttaatattataatcagtgtctaatattgtgtactatctttcttaggcaatcttcaagcaaaaattgaacagactttaaagatgattgtttttagagttacatatacattaataataattcagttgtactaagcttagcactgtgaatgcatcccaggaaatggcagtgttagatgaatcagtgctatcacagtcaacttggcccagtccctttgggattgcatccccaacattatttatttaaattaattgatgtacaataagatgtttattggttgatagctttatatttctatatgctttagaattgttagaacaagttagaacagttttgctagggttgacctagattttgctagggtttttatatgatttccctcaatctgagaattcacttgctagtcacacagtaaaactggccttttaacataacccatactgcaaaccatgattactaattctttgtaaaataattagagtttcttcagataatagtatataatagcactaaaagaattttgggggtaaacaaaataaagagattagaaactgctgtgaaaatggaggaaagttcaggaaaggggccaaacatttattggaataagagtaaattctgccatactggctgatcagtgttgtgaagagccataaccacgttgctgtgctaaatccagtattgctgtggtcattcccactcagttctctaaaaagcctgttctcatccatttgctttctaagaccc

SEQ ID NO: 27967 - DNA, 790 bp, Bovine  19866881517498
aatacaggagcaaaaagtcagctactgttgaactttgctgcccgcctcaattgagtaactaagtttgcacactacctattgaccttgaggttcagaaatgtcaaagactgacttgatcaaagatggaataaactttcttatattctgacctccagcaatcactttgcttctttttagatttttagcatcatagtaaaatggtcgagtgtttcacatagctagcaagttctccatggtaattctcaggagcagatttagaaacagtggaaagctttcagcctcccctcttggcttgcaagaaattttgagggaattggaataactcctgccatccatcctcctctccttggaattgactgcacagcattctgagcctcacattcagttgggttcaatgcagagcattacaagagggttcacatgattttaggaattattactcatagctgggctgcttctaagccaacggaaggtgcatgctgtacttcatggagccaaaagttttcatcctaaagagcctgcctactccattcaattctaagcactactcagtgtttataaagagaagaaaaaaaggcataatgatgctttatgccctccacgtagagaccccatagaataagtaggtgtttaggctcattttaagatggcaaagaagtatctgtcaagtgttgattagtaaattaactttctctgatataagccaagacctgctaccacctttccctgtccaaaagcaaggagaaagtcagaaagccagacatgtgatatgagaaagctttacagaaat

SEQ ID NO: 27968 - DNA, 1607 bp, Bovine  19866881567456
attgaggagatgtgaaaggaaactactcctgaggtagtaaggacagaggcaatacaattagttcaacagtaattaatcctgcctccaacttcttgtgaaggtttgctgagatttggagattgtttgctgaagctattagtctactctaataaggatatatgtatatacatgtgtgtgtgtgtgtgtatatatatatattttatatatatatatatataacaattgagcgtgcaggctttagcattagacagagaagagtctgaatcatggttccacagtttactaactgcaaaccattgggaaagttgtttgacacgttccttcctctattgaatgggaatattatcagaactacttcacaaggttgcatgaggattaaatatatcatgtaatgtttttagaatgataccaaaaacacactaagaacttaaaatggcagttattgtgctgttaatgaattaaatagctgaagatatacaattcatgaggtcactccccaaatccttacttcaatgaaatgacttatgataaaatttttatatgatagcaagagattaaagcagaccctactagtagtcaaataaatacagaaagggtagattatagtagtagaagaccacatgtcaatgttatatctgggagcttaataaactgcagagaaaaagtatacaaaagaaactccaagcttgttataaaaatgattaaggggagggaatgtcttagatttaaagccatagttgaaaagccactcaaaataaaaattataacatgtagcaaaaaatgtatcatgaaatttgaaaagaaatgtgtttggtcctagaattattttttactaactccaccaccccaccttgactacaatttgtttgggatcttcagtattaagaaaaatataagtgtgtgtagatgtccatagaattgctgaaaagtgaaagtgaatgtaaagatagagtgggtagtttatgacaggacacttaccctaaatcaagagtaaattaaacattattgtggaagtgcgaaatttccataataatttaacaaattaccaccagcataatttcatatgcattttaaaaagacatttatcatcaagttacaaacgccttatttcatttaattaaaacaaagctgaatgcattttgtgacagaaatttttaccaagaaacaatatattccaaaatcaaatttattatgttttaaaactagtgacctggttttaggcaaggagaaattaactcatttcattttatacttttctccaatttcaacttcattgttaaaacttgaaaaattatcaggaatttctacctcatggtgatgtatactttgagtagggcatttcacattttgtttgatttgcagatacatcaagaaaaaaaaaattgtcaaatgttgatttaaagtatctacttgccaattttggaaatggaactaacctaagcattagagaaaccaaaaaaataaatgtcattttagccataaatttccaagaatgtctcaattttatgaggttatttgttttgtttagttttgttttagtgagcccatttctcaacataaaagacaattagagcatcatcactttccttagcatcatcttatataga

SEQ ID NO: 27969 - DNA, 1486 bp, Bovine  19866881651228
tttaactgtgaataattacacacttgaataagtatgtgattagcactatttgttgtggttgggactggagtgacgggacaagaatggagtgattgcattatttacagcttaattgtagacaagtaattacttatgtaagctgatggtgtggggtcagagaggaccggcagaagaatgcagccgatctgaaattcaacttcttaaaccagtcaccctgaccccctccccaccgccaaagctctccgagcttgataaagagaatcaactatgcatttcttgaatgaaatcctttagaatattaaacgccttgttcagtctaagcaaaagatcagcagagacattttttaaaaaaatctcagtttcgaaagtaataaatcacaaatgccacctagtggttcttggtatcggcggctgttttatctgctaagtgtagccgtagcccagttccgggcagttttctactggagtggggggtcttctagtcgtgggaactgaactgaatggagcagaactccaagtccatcccttcattcccagtttctctccttatccgcccccgcccccacacttctcattcacttcgccttaaaacctgcctacacagatcatcatagtctgaaatttgtccccactttacatcattgtaacttctctctacagtggaaatttgagtgcaaatcactttgcagtttttcctttccccaagccactaaaaaataaatgagagagccaacggttttcttgatttgagagtagactcatggttgtgtttccttacttcccacttctcattcaccaggtggttgaaagccactttcccaattactacactcttcgtttcaagtgttcacatctagatttgaatccggagggatcctgttgctaaaaactctcccggggaaagggcctgtttgataaatgcattaaaggggagtagcagagagaataatttttgtcaagccttgtttattttcacacactccctctccctgagcttcttctcatgatttcattagtaataaatagaaaagtcaattttccttaacaggtcaacattgtacaagtaaagttccttgaacagatcccagagactgttgctgtaaacccaacagtacaagttgagctgagagctgccctgctgtgtggctctgtgcaaatgctgtcttccacaatggacagggttgacattggagccgctgtttttcttgttgtaatacaaggaaaaactgtagtagtgactctcatgtcccagggtaccaacgcagcagtgctctttgtaggtggtggccactttccatttgagagagctacaatttcacacggagcttgtcatttcctatggtgggtccatttccctgtgtgcttatggtttcctttgtgagacacgctcctgcaggtggctcctcctgtctcacccagggagacgtctctccttcttgggattttacctgcaccctcttggatcctgtcacccctcaaaaatatg

SEQ ID NO: 27970 - DNA, 727 bp, Bovine  19866881850775
ctggcagagttggagcggaatataggcatcccagttcccctctgacagccttgagaggaaagggagttttcacagaggcttcaattctgtgaatagattaagtggaatgtgacagatggactgtgtttattgctgctcccatcaacatggacaattattgagatgttacatggtgtaaagtttaacatttacttgttgacatctatgtttttttactcattgtttattgtgcttcttggagaattctaaacattttataaatgatatcatttattttcctgaaaggttatctaatcaagcctcaccactaactggagatgaaaattgcaattaaaactttattttcaaagcaaattgttttctctcttttggtgacttgttttctggcaaccacatataggggtggaaaaaagtttgtatgtccccttgtggtttttgtttgggtcatgtcactccagcatgactttaaaaaccttcctcacccacagtggaagattctcatgtagtcagtgtgaatttgaatatattcatttctcttttgaaattacatcattagtttaaatgcctttgagcttgtttttctgtttcttggtttgtgtcttttttctaaacattcttttctttttacccttttctttttcttttatcctccatgctcttggccttaaaacaaaataactgcccctggagtcagactaattatccatctggctagagtctgtaaagt

SEQ ID NO: 27971 - DNA, 1404 bp, Bovine  19866880418543
caacatcagtccttccgatgaacacccaggactgatctcctttaggatggactggttggatctccttgcaggccaggggactctcaagagtcttctccaacaccacagttcaaaagcaccaatcctttggcgctcagctttcttcaccatccaacttgcacatccatacatgaccactggaaaaaccatagccttgactagatggatctttgttggcaaagtaacatctctgctttttaatatgctgtctaggtttgttataactttccttccaaggagcaagcatcttttaatttcatggctgcaatcaccatctgcagtgattctgaagcccagaaaaataaagtcagccactgtttccactgtttccccatctatttgcttttagggttacctaaaaagtcattgtcatatccaaggtcatctagaatttcactttttctgtcttctaggagttttataattctgcactttccatttatatctatggtccatttttaaaatcacattgattttttttaatgatttaccatcaaattgtctttaaaagacaaaactggtattaaaaaccagagtcctatatttcagttataagttatcaaactccagtgagcttttgactaacaatcagaagttggtgcattcttcgatttatgttccaatttccaaacctaagctttatttttctttaaattcacttttctgtcttaattgccagaggttagcttgtgaaaataaataaaatgttctcccttggattaaagtgcgagctgttacattcacacacaagtttctgtcaagaatagtcacagccatcaagctcagaggtgagtcatgcttggtttgatgtgtaagtacaagaaaattcaactatttaccaagtaataatactactggcttacttttatatttttcaaagaagttttacatccattgttttatttggtcttcaaattaatcccaagaggatgttatcattgccatcattttacaggtgaggaactgagatgacagtgctcgtggtcacaacatgagtaagtgcagagatgagcttagagcaagactgcctgttatgaccccggggatgacggtgatgatgacggctgaagtctgctgagtgcaccctctgtgctgagcagctcagctgcctatcacagttaacaaggaccaggtggtttgtcttttttagttgccctgaacccatataacaactgtgattatctgccactcatactgttgaaccaggcttagccaagcacctctgagtcctgtgataaaaagctacaaagagctcatgagtgggaaacaggaaagtaacgggagtgaggttggcattgctgctacaatctatctggactgccctctgcctgaggagatatagcaggtttctttcaaaggagcaca

SEQ ID NO: 27972 - DNA, 724 bp, Bovine  19866880564282
accttttttgtatagttcttctgtgtattcttgcccctcttcatgacatcttttgtttctgttaggtctgcaccatctctgtagtcacaggtgggtgagggaactgagcctcaggtaggtctgcacagtgcctggggctcccagcaggttgaggtgagaggatcctccataaggcctgaagggtctctctctgacctggggcacctacaggcccgtttccaagggctgtccttgctggaaggccacggaaagcaaaggcttccaaagagggaatgttctagtaggggtatggggtgcagagagatgagcctcccaccccagggtatgaaggggcagctccgtggccttaatcatgaggaattgggtgctgctgggcggtagacaaagctccaccagggagctagaaggtttcagcgcagcctgtgacctggactagcaatttaacctctgtcatcagaacgtcagaatagctttctcactgggttgctgtggggctaagaggagattacaaataatggttgccaatatttgttttattgattactggctaggaaccaggcaggaagtcccagtcagatggaacatctgctccttaagaaaaatggtgttttaatgcctgtggactgggctctgaacctcctcctcaggaggaggctgaggaggctcagcaggaaccggggagacccagacatcctgggacccagctcctgctgcccacacatac

SEQ ID NO: 27973 - DNA, 760 bp, Bovine  19866880591927
gttgcaggaacagctataaatctgagggtgtgctgcctgtctcggcggggggagaggttagggcgtagagtgatgggagttcttcgtagtgattggcaaagagcctttattcgtgccatttttggatttttcctttgccatggcaattctctggagagttaaagccattttgcaagatctgaagggttggaataaaccattcccctcttcctcgagtgtcctttctgcagcagccttgggtggggagaagcgagaggtccgactgcctcctagggggtgggggtggtctgtaggccatgccagcacagggaagcaagcaacggctgccccatcgggcagagatgctccaactcaccacacgtccaggcatcccaatggcacctttgtccccctgatgaaggaggcagaaacaattagaagtggccagagccaggccagcatgtgaggggccccatggctagcgacacacccaagatctggtttgcctgggtgcttgggacgattcccaggcatcgtgggtgaacttgccccttgagccccacagactggtcgcatccttgtcacgctcagcttcaaggcagggagagtgaatggcagctcccatctgacagaagggtgaatcattacccttgctctgtctctgtcagagctggggaacagtgctcatggtccccagctcctccccaagccctgtgtctgcaaagactaccaatacagtcccgcccctcctcgccaccaacccggcaccaacagtgcgcca

SEQ ID NO: 27974 - DNA, 1495 bp, Bovine  19866880607285
attttaaaacatttttttggttttgttttcctcctttgtgtttataaggaaagctacataaacaatcccagaaagaggccaccagctccaaccagctgcttgggttcagggtcaaagtcattatttttgggaaatgggtctttcctctacccctgcctccatctagagtagaggccccactgtttagcataactcggggggcacgcatgcagggctgtgccctgtctactcactgtgcccctatgtccccagaaccacccaacacccattttgccactaggaaactcacttgcccgagaccacatgactggccagtagttggcagatctgagattgagatctacgctgtatagagtttaaatccttgccacaatgctaagggggcctcctaaaatgaagatggactgcagtgagaaggaggtggtgggggatatgggagagaccagtggggacagcagggctgtgacttccttctaaagaagggcccccagggtggaaacccacccccattcacattctgggaatactgtgcagtgtgtatacacattcctgcaaactcacacgcatgcacgtgagcacacacaccatcccctcagaagcacccacacatgcccactcacacagaaatcagccccaccacagcagtgcaggggctgctggaccaggccagctcctaggacacgttcttcccccacagacctcaagagtacagacccagggacccgctctcccacaggcagcacatagaggccaggaagctgctcgcttggccttcactttggcagttcctctcttctccttctcgtgccactgccctctgaccatttgcaagtcagagaacagaggccaaattgggaaagtgacttacctgggtctgtggtaggcccctgcccactcaaatgctttctgcagtcatttttcaaaacgttctagcttgggagtcctccttggcctagttgacaaggattaagagatttcctggcagtaggggtgagttggggcccctgaatgtttgctgaaggagtgagtaaatgaatggatgaatgaatgaaaaaattagtgaatggatacctgaatgaatggatggataggtggatggataaatgaatgaagtgagtgaatatggaggaaaggaaaaaagaaataaatggatgaatgaatgaatggatggatggatagatgaaaggataaatggatgggtgaatgaatgaatggatggatggatgggtgaacaaatggagtgaatgaatagaggaaggaagaaggagaagagtgaatgagtaagtaacacagccgggtcatccagggcttacaattcattcaactggaaatagcagacacaaaactatactttatcctcacagagtctgcattttcatggggaaatctgaaaaattttggaaaatgtacataaggtaagcattagtccctcagctgtgtccaactctttgcgaccccaggactgtagttcaccaggctcctctgtccatgggat

SEQ ID NO: 27975 - DNA, 1437 bp, Bovine  19866880691004
ctggagaaggaatggcaacccactccagtattcttgcctggagaatcccatggacggagaggcctgataggctacagtccatggggtcgcaaagagtcggacacgactgagcgacttcacttcactagggtatgaacttgggtttggttaccagagtattacgaactttgattctctcatttgtaaactgaggataacaatagtataggcttcacagggctgtgacgagggtcaaatgagatgaggcgtgcaaagtactcaatgaacaggaacttaagtactcaatgaatattagctgttcttctagaaaacaggttatcccaggggcactgtgacataacgctgaggcttacggaaatccatcttaggtcgagggctctcaggtcaactcttccttccgagaacctacctacccgctggtcgccacttctgactttccccgagcgtctagaaaaacatgcactcgtatctgaagccgcgagatcgagcgcctagtttcgctgctagactccagaaccctactccacccattgggctgcagcgctgccacgtctcgcgcatcccgagctccctacgagaggtagagcccgccccagagcgattcgtcacgccgaggcccgcccctccgcggccccagtcactggtagggcggcaccggatggccacgcgccgtgacgctacgaaggggtggggacgagcacgcgcccggaagttccggggaggggggtgttacgtatatccggcgagtagctggcggtcccgggtgctgctgggctctgtactctgagggagggtccaagccgcttgctgccgccggaggaaccccttgggccgtgagtcagggggcctcggcgaaggaggaagctggggccggaggcgcgaaggtggcgggcagggagggtctgggtggaggccggcgcaggcgaggttgggggaggaagtgacacgcaggcggttctgtggggccgcggggcttgttctgggcggggacgggccggcttggccgggtctgcttggttccctgctggcctcaacgggtatcgggtccatccgcatttcactcgggggtcttggcagctgttgggcaggataccagttttcctgtctttactgtgcgtccgggtttacgaatcggcttcacatcccctgtgtcggatgattctcagccctcggtggggtggattgaagtcttgataattatcctttttttttttttttttacagagattaaggcctgtagaggcatagtgaattgctcaaaaccccgcagatagcaagtgtgaccgttcgaactagatatcctggctcctagtcgagggccctccccacccccacttcagccacacttgtattatcatctgctgtcctgggttgaaccccgtgttttcttcttccgccaccctccttttccctctcttcagtgcatgggaaaaaaat

SEQ ID NO: 27976 - DNA, 1636 bp, Bovine  19866880725319
ttgaatgacgagtctggcaggtctctgtgaggaggtatagaatccatatgactttatccttaaagcaactgagatttcctacatctggataaacgtcatcatctggcttaaacggcctcttatgaacactatgagactagctaatgataactgattttgaaacatggtttagaattccttgtagaagaagtatggtataaattaacctcaagaagcataaagatgtcatctgtccaggaacatggaaattccatacactgggtttgctgatgccctaaaaaccatttttaaatgttctcaaatgcatgcagtgagtggaatgtttaacgggcaccctggttttgggactgttcctttttggacccatgtcttgctgcctcatctgcaggaaggcctggaagggaaatcgtgcatgctttatcccacggcagaaaatggagcccacgtacaactctgccctgaggccctggaaccccgggaaagcttaccttgttccagcagccctggactggcaagccatcttcaccctgcagtgaggaagaaaggcagacggctcagactcaccgggatggcccaacaagcagcaggataaggggaacaagggcgcggcccacctgatattgtctgtttctcttctctaccccagggcctagcctcggaaggaggcaggaagcaagcccgcctgtctgcttgcaggccgagctcacatgtagtgacagctcaaagctgagatgggctgtcctatcgcctgtgggcccgtgagcagaggcgacctgagcgtggtggagaggacagtccggaggcctgctggtctcctctctggctgtactgggtgtgcagtgcctgtgggcaagccactcagcacctggaggcttcagtttcctcctccataaaacctggggaaggtgcggctctatggaacgaacacaccccactctctcattctctgatttctctctcttccttagcagctgggggcggacatccaggcagctcccatctgttgatcaataaggaggaggagggttgatttcgcaggctttcaccgtggggctgaggtgccttcagcaaggaggcggggctcccggcacagcctttgctgtctcttgggacttggggggctgcgcagtggtaggatgagaacccaccaggggccacttgtcccctctgctggtgcacccgctgagcacctgaagcctcaggacatcctgagtctcctccgcccccggctgtcctggctgctctggtgcgccctgggggaaactggaaacccctgaggagcaggcagggaggatgaggctgaaccagggcagcgatctggttctcagtctgagtctattagaactgcagcccaggttctagaactccaggttccagggcagagaaggagatgcacacagggtttcaggagacccgagcaagtggtcagcccccgaggggctggaatgggagccccctatgcctgaacctactcatccacccatgacaggcgcggaaactgctcacctggagcccagcagacagctggccctgcacgggtgctgaagaagtctagttaccttgtactaaaaatcctgatcaatagcgccgcctctcccccacccccgcccctgccgcccactgccccacgcccaca

SEQ ID NO: 27977 - DNA, 1359 bp, Bovine  19866880737215
taataccagaacatgttcatcactactctcccctaaaaaagactccatatccattagcattcgtttctcattccttcttccctccaacccctgtaatcattaatctttctgtcgctatagatgtgcctattccataccttttgcttccagtttcttttgcctagcatgatattttcaatattcatccaagctgtaacttgtatcagtatttcattttttttatggctgagtaatattctattgtatggagatagcacactatgtttatcctttggtccactgacgggacatctgggttgtttcccccttttggctaaagtgaatgatgttgctatgaatgtataactctgcatgaacaaaaaaattctgttgagtatatacctgtgagtggaattgctgggtcccatggtaactctagacttcactttttgaggaactgcaaacccaccatctgattttactaatcatcaagccaagagaatgagcacagaggatcttaacggaatcttcccagatgcagaaatgtcagcataaaagaaggtccaagagaacagatgctccctgtccagcagctcctaagaaatgctgtctttgccccttccccaacacgcacacagtgtggtttatactcagattttctcagtaaatcctgtttcctctgccaaggacactcagcctgatcccaacgggactcttctgcaataaaacaaagggcttttaggaatcaactgaaaaacaaggaagttacgttttggccaaagctgtgaagaggtcacgcctcagaagacacacagcgggaaccatgtgggctctgatcaaagggtggatatcaccccagaattgtttcatagagattacaaataaaacccaccgctttcgaaagctcactggttatgcccaaggtagattccatagccatttccagagtggctgacctggatgagagggcctagcgtgcgtgtgtgcgtgcgtgctaagttgcttcagtcatgtctgactctttgagactccattgactgtagcctgccaagctcctctgtccagggagttctccaggcaataatactggagtgggttgccatttccttctccaggggatcttcctgacccagggatcgaacctgcatctcctgcattgcaggtggattctttaccactgagccactggggaagatctgaaagggcctagagagtgactcaaaacaccataaacatacccctccccacgggggaaggcaaaggggtgaatggcctcccttgctggacaccagggcccaggctgagagtgggcactccacagtcagctcctcaggaaacagatgcagaacaaaccccaaaagacaagtttccaaaagggac

SEQ ID NO: 27978 - DNA, 1841 bp, Bovine  19866880739263
cagctagttggaactttcagacactgcaataccctgaccttcctaaacttcactcttcctccttaatttcagggtcctgctggaagacccggcctccccgtaagtacctttcgtttctttttccctttgcctttctctcacaggctgttcctcacttcaaggacaggagagggtgggtggccactttccaccaggtgtgtctggatgggaggcctctcttcagcatctctcacctacggctgagggtgaagcacctgggtacctttcctggggtcccaggcaggccaatgacagcatgcagcccctgcagggctgcacctgacttcagactgatggcccgtaaaggggggctggatgggaaggcagccccctggcttactggttatcctgcctaccagcgtcgttaaaggccactgtccctgctttgtcccctggtaagagtagactcaaacactttatttccccctcgagttaccatttctgagtgctagagaagctgggtccagtaaccacgggggctttgggacaaaagtagaaatagtactcataaccatctctcactgagaccttaatacatgccaggcaccaagctaaatgctctttatacatttgattcgttcaccaactcaataaaaggggtactattacgcccattttatagatgaggaaatagagagggaaaacagctggtccgattgtccaagcctcatttgtagacctgttgaaggccccatgttatcacacagcatcccacactgctattttctgtgatccatactgggtatatgagacccatctttaaagtcttcaaagacattgccctgtagagtgtagcctggggcatcgatgcatggagtactggataccatgggctctcagatggctgttggctcaggagagatgctctagccagccagagggccaaggtgggcatttagggggagccagggctggcaccaggctgccctctctccctgccccgaaggccacatcaattggattccagagcctcctgtgcatctttctatcccagttactcctcttttcaatgtgaattgtactataacctcttgactacaccagtaacttctagaattcaaatctagcaaggactctcttaatgaaatacatgtgggagaatgtttagctttgaaaatgaaaactgtcccagcaagtatgaaccctggagcaaagaaggacagggcaatctgtcccatgaaatccaaggagggggaaaagtcagatgactgggggaacgtgggcagactttgtttttttttttctgacaacgtccacctttaaaaagcatttgggggcaattcgcagagcaggggccgccacacaagaatttccagtctccggccactccatgcccgtccctaaaccaagcattttatggccaggactgcaaagaccattagtttaaaaaaaaaaaaaaagaaatgaaaccaaaacacacatcctgcaagatcattcaaaagcacaagagcaagtgagccattgggatgtcacaagcgatgaccagtgggcctggcatcctcagtgggaagggtcacagctactctgggagtgaccaacaaaaagatctgctgatgcttgttgtgaagtgcaaaagtgtgaagtacacacatgtttataacagtcgcttccccggaaccttgctgggctcagtacctgtagacgaagtctgcacggcactcaccaggtgacaggcacccagagttagattcccagagccatcgtctcttgacatcctctcagggagcttcagggagctcatggatcgtggttatgatccatgctcataacccttgctgcaaccctgccactctttcccaaag

SEQ ID NO: 27979 - DNA, 1274 bp, Bovine  19866880745101
aattatacaagacaattcaagccaaccaaatgatgccaagtcaaccaaacgacgccaattcaagaggaaagaaggattctgcagttcatatcaactccccaggaaatcagaggtaacaaattaaaaggttctgaataagtacagctttgagaatgccaccggagaacacatgccaattagaggtctctcctgtaacgataccgcataattggcctcgggctgtttgctccactgcctccagtcagagcccagctcaggcaggttactcagaagcaacacacagattagattttctgccagagtccaagtgtcaggacagaactgtagcaatttcctggtagaagtacaatgaatttatctatttctgatagtctagcatagaaaaaaagtaagactcagcacacataaggatgagatttcatctttattattctagacaaacactggaatgtgatatcacaggtattatgtattaacatctaaaagatttgcactcactgtgggtcaagcttcctggctgaatgaaaaacaaaaacctcaaaggtataaaaaagaatcagacatttgtccttgtgtcagttcctaaatatgtataaacttttcctactgggagggagcataaaacaagaaatggctttaaaaaaaaaactatttaaatttgcacaaataatacatgttctttgcaaaaagattaggaaagataaaaaggcaaaaatgaaaataaaaactaaaagaattaccagcaattctggtggtttttttttttttaacccaggcagctttaatacatttgtttctgttcctctactccttctccaaattatagctgcttcttctaaccaaaaaatctgaattgaagacagtctcctttttagtcaatgcacctttaacttgtagaacaatgaggcattttaagcacttgttaagacatataagaaaatccacatgtcaaactgagctgagcaaagagactatggtcagagaatgaagtcttaccttatctgcataaattggaatatcatgaaatggagagatatattgtcctttttcattttctgcaaaatcaattagaaaatattactcttatttgttaattacatttccagatgcatgaagtacacgtttttcaagactttttttaagaagaacgtttagatttacaacaaagttgagaaaaaggtatagagatatcccacataccctctcctccccatatcaacaccactcgccagattttattcccaccccagaaaaactggctttatacttgactg

SEQ ID NO: 27980 - DNA, 2409 bp, Bovine  19866880748906
aatgaggcagagagaaaagctctactggggtgagcccatgccaaggcttggctgccaagggaacctatcagccaattcagcataaaaggaatgattcagcttcctttacagggatgttaaattatttacctgatttctctatcgcacaactgaatacaaatatttcccttcctttctgcatctaaggattgaagatttgagattaagcccttcctgcgtgtatgtgcgctaacacatgtgctaacacaacacttgagttgtgtctgactcttcatgactccatagaccatagcccaccaacctgctctgtccctgggattctccaggcaagaatactggagtgggttgtcatgctctcctccaggggatcttcccaacccagggtcttccttccacaggaaatttggcttgtaagaactccacaggagagggtaatggatagtccaaaggagtgattgtctaatagtgaaattttgttaaacatagccactaggggagaagggattatcagacatccacatctgtagttactctcttcatggatgcttaagtcccatcctgattatcatggcctagaaaagttttccagcagtttctcagacccatgccatgctcttttcacattttctcttactaagccatgattctttgcttctagaaacataatacctcttccgagagaagtactatggaaacctcaccacaaatacactcttgtccctgattgtacccaattaaaggaagacgttggtggaaaaatgattttaaggaaacacagctttattatttttaagttaatccacttgctcaagtgaactaaccattaagcattccacagagctggtctgtaggggacctgctgtaatggatttactggatgatccattagttattaaacatttattgcacaaccgccatgggccaagggctggggattaaaagctgagtaaatcccagcgtctgccctccaggagcgcagtctggagggggagacagacatataaccatgattttaaagaggagtggattggaaaagaccctgatgctggggaagactgaaggcaaagggcgggagaggatgagatggttagatagcatcaccaactcaaaggacatgaatctgagcaaactcagggagatagtgaaggacagggaagtcgcagacatgactgagcgcctgaacaacaaaggtgtgatgagagtgatgtgtatggagactgctggagcacagaacagggcaactgtagaagggtggagactggggttactagggaagatttctagagggaggaaaagcggacttcctacttgggtaggatgaatagatcttgcggtggtaaagttggggggtgagatagagctttcaggggacttctcaggtggggcacagcatgtacagagtctcacaagggagaaaaagtgggatgactagagacactgaccacaaattggtgttcctgggatgtagcatgacgttgcgggggaggtagtaagacctgggtctagagtcgtcagcagaagccagatcctagaagcccaaaatccttggtaagggtttgagcttcatcatacaaacaagggttgggggacattcaaaagttctgagcatggaaatgatacaaacaaatctgtgtttcagagagaaagagacagcatggaggatgcgctggaagcagtgggattggcggggacagactggaaaggaagtggcagggcctctccctggtagcaggaggaggaatggaggggaggagatgtttctgagaaacgcttagggacagaattagtaggacctggtgatttatggatataaaagaaaagagggagaaggaaaatggcagaatcacagatttacagcttgggttacaaagcacacagtggtcccttcaactgaaattgagaattccgagggaaagcagtttagaaggagaaaaaacaggatcaatgtttgatgtggagtttgaggaacgtgtgggtgggacaccagtggagagacagcaggcagcttgcccctgtggaggaagatctgggctggaggcaaagatctgacaggcatgcacattagaaaccacagacgggggatgggatcatcgtgtgctcatcaggacactctaggcttcaaggaacagaacagacacttgaaagtggctgcaacaaacaagggcatttcacttaatttcgttatttcacttaataagtttaggaggtcggtcttgggcttcttctcaatatgtcatcaaggatccagaactttgcatattttagctctgccaactttgtccatccataaccgtgtgtcccacagtaacgtgaagatagatgaggttcccaaaggacttggaatccgagggaaagagggtagaaaacactctctctcaatttgttcattgtagatgaacaaatgtgaca

SEQ ID NO: 27981 - DNA, 2714 bp, Bovine  19866880752143
tgcccagagttgcttgcgggtatgttccagggctaacaccaaatcttttgagtcccgagttcatgatttttactgttactcattattttgcttcctcccagtgctaaaggttgggagagctagcctgtcattttgtttctcttgtatccaggagtgccataatctcggcacgtgtggtgtttgccacccaggagacgtctcccttatgacatagcagttgtgaggactggaggaggacctagatggtgtccctgtacctgtgcctgctgagcatttccatgaaggtaatgaacaaagggtccctttggtcaggaaaggaccttggaaaatcagtgttgggcacatcaagcctacagatcaggggccagcccctcagatcagcttccttccccacccttgctggagtaacgagtcaagctggcacctcgttgcatcctggttacagtgctttggctggagttgctcttagaggcctccctgctgtgctcagcatgcccacggtgctggggggcaggtggaattcccagcggaagataaagcatgtctttttcctgaggccctgcagcagtgtagtgtgggaggtgctgaaccttgaggactccttataacactgcaggctggtctgcgaggctccagtggcatgattggagtaaaaggccttgtgatgctgccacagaagtaccagatgttttggtttgtggatgtgatttgttattacgtaacaaggattatgagctcactgcattggcgtctcttctgccacttactagccctgaatccttggacaggcaacttcatattctttgtctcagtttccacatttgtaaaatggggataatgctacttacccctaggtcttgtgaggactgggtgaaatattgcctgtaaagcacttggtgaaggaaggtgatgcccattttgtagttattgtcagggttttattttcaccaatagactttttagtcctaggagttgggtgttaattccacaaacatgtattgagcacctggctagatgctaggaatcctaaaaagtgactacccagtccagaaggggaatgagggctgaagagaaatgatggagcagatacagtggaggtcctgacctctttctgtaggggcctggggaaagttctcatggaggcaacaggcatctgagcagaaactagaaaggcagacagggtttggaaattcggagaggattggtgggggttggggggggcttggtgagggtgtgagtcctgccagacggaggaggctccccagcttaaccctccttccttccctggcaggtgaggctgtcagtgtagtgggcttcggcgtcttcggccaggcttgcgggccctcggtgacctcaggcatcctgtcggctgtggtgcgggtggatgacacgctggtgatgctgcagaccacgtgtgccgtgcatggtggctccagcgggggcccgctcttctctgcctgctccgggcacctcctgggtaaccagccccttggccctctcccggccttcccctggccagagcctcagtcccacccacgagtgcccagtgaccagccctagcagccaccctgtctggaaggatgatgggccttatgcccagggctaattagccaaggttttttggactgtggtgcttctgaggtcggagaggatggatgctgggcttggagggaagagatctgagttctagtcctttctctgccactaaggcactccacgacctcaggtaagtcacttaatatcatttgatctgtgaaactcagtagttggatgagtccaagggtcacaaactcaaaagcccaacctaccagttgggcaagtaaagtgaatgagtgaatgaatgagtgagtgagtgagtgagtgcatatcttcagtgagtggaggacaaaggagaaacggggtgaacaccactcaactccagcacattcttgcctcattacaaagatatgtgggcctaacactggctgactttacagtttttcacaaagtgtgaactcttttttttttttttaataaatatgtgtttgttaaatctttcaatttaaaatttttgttaagttttttaaaaaaaaaatctgtttaaaaaaaagccaaccatgagtccatatggatacctccacctacagtccagcacacagggttcatgcaagccttccccttcccttacttctgactgctttctcccatagtgagaaacgttgcctttttgttgctagctgcagtagatttacttatttcttcaactgtagtgtacaaaaaaagtactttcagaattcctaaccacatccctgtgagaaacatttaccaactagaagacaatatttgagcgagtaccattctttagccttaaagtgtccagtcaaaaagctgttttccaaagtttcttagattagctccttccccttcagaatggttatgtgattcatttgaaatacagttaggtacattcatcctagtccgaattccatctttctcccatatactggttgaccttctaaaagatgtgtacagataaatggatacagagataaatataaatgtgtgtatgcatgagtttgtgtgtgtgtgtatatacatatgtctcttatcttcgtctgctgagaggggctagaagccagtgacactccagttgcaatgagcatgccgagagtccagatcttggtttctaagagtcattctctaataaaaagaaccaggaactgactgattccagg

SEQ ID NO: 27982 - DNA, 1619 bp, Bovine  19866880799198
agctggaaacttctgggtcttgtaaaaggcttcgtttatcttttttagttctctttggcccagggagacgacaggagactgttttactttctttcttttttttaaggaaaattttccattatggaagtggcacgtgtttatttttagaaatccagccactgggatctataacttctgtgggaaggaggcggcggcgcaggggccaatgctgaccctcctatattaaagatgggtctgagtttctttagtaccctgggttcctccctcctaggcctctttcattttgtcagcagagcaggaatcttgctcatagacaagaaagagaatgacaaagattgaagtccagggattacaatagcgatagcatcaaaaaaactggctgacattcattgaacgcttactgtatgccaggcactgggctatgtgcttcataccttgaataattcattccccataacactgagaaataggaactattacctgtactttacatgggagaaaaaatctagtctcagagaagtagtaaccagcacagaatggtgaagtaagaatcacacacaggtttgtctgaccccaacactactctgacagtctgtctgaacaaaagcagagggctgcatgctcactactacaggtaagggctctctgttggggaaaaggagttgaaccccaaggaagaggcaggcagctccaaataacccagctcacctcgatcagggctccaccctcaatgggggtggcaggaccaggcagctccctaaaacacgtggcttcttccatgggacccccagaagttcactgcctctccaactggccccaggccctccttctggaaaacgctttcatgagtagaaggggatggaagaggaggagttcagggaaaggactggatcagaggcattgctgaggatggagttcaccctgatcacacttcccattgtgctatgataagttagagggtgggacctggtgccaggctgcctggcttcccactctgactaccgtgggaggttttttggccgtactttgaggcttatgggattttggttcctcaaccagggattgaacccaagccgtagtaagagcaggcagtcttaactactggactgccaggaaattcctccaccctgcctttgtaatggtgcaactttgggtgagtcatataacctcttctctctgagttttcttctttgtttaatggggagtaggaatacctgggcttccttggtagctcagctggtaaaaaatctgcccacaatgcaagagaccccagttcaattcctgggtcaggaagatccactggagaagggataggctacccactccagtgttcttgggcttccctggtggctcagctggtaaaaaatccatctgcaatgagggatacctgggtttgatccctgggttgggaagcccctggagaagggaacagataccactccagtattctagcctggagaattccatcgactgtatagagtcagacacaactgagtgactttcactttcacccaaatatttaaagatataattcaagaaaactgctctgaagtcaaagaaaacttgtatctatgtaagaacaaaccacattccaggaaaacagattcagaagagctaat

SEQ ID NO: 27983 - DNA, 995 bp, Bovine  19866880801508
ccagggtgtaacaagtcaggctgggtgagagtggagttggggatccagctgatgggcagggcaaggcagctggcaccttccattcatctggaagtgggtaggaaagcagggtgtttctcgggtaggggggctgttgcctttctgaggggtctgcaggcctgagcggggtggcaggcctcccaacctatgagatagatgatcgaggtggtctgagcctctgtgccagcctgcagcatccccagggagagaggggtaggccgggtggacagggggtgtctggggtgccctgggactgggagctggtatctgagcctggcactcactcttcctgttgccctgtctcccctcaaccccctacccttaaccccaccccaggagcacctaagtggctctctagcagctctgcgctccaaccagataattattctgaaggtttgtaggttctggaaggtctctgggcccctctggtgacaggctccatggacacagagcccaatattgcacatccccaggccccagtgagaaggctggggctccttgcgaagcagctacccaccaaggtggcagtgacccagaaaggccgtgactgggctcccgggtccctggctgggtgcatcctcagcccaagcagcccttgcttcctaatgctcctcccagccaccttgtgcgagctacaatgctttcagaaacaagaggtggattatatgccctctgttttcacatgggttctaacctcttcctaaagctgtgggtgctcaactccactggatagagaggctggaaacagacagaatttccagaaatgaaaattgcgttagctaacatgattgcctctccccaccccacccccacaaaaaagtgcttgaacatgccagagacgtctttgtccagcctcgatgttccaagcccctgggtgagacctcagtaacacttagctggtgcccacactggtcacaccctcctgctcagcccccaggatccgggctcggctctgc

SEQ ID NO: 27984 - DNA, 1955 bp, Bovine  19866880818692
tttgaagtatacccttcccagtcttttttctctttaaagttgctatcatagtcttttgtatactttttctcttattgttttcattttgctttaaaatgctctcccaaacattgtggaaccgtggtgcaataaccctagttgacttgatagaacaggaaacccctggtgctgctcacggagaggacttggctgcggctggttaaaatgtccctgtgggcgaggactttggtgttttctcctggaggcaccattcctcctaggataaacatgattcctcagcgttcttcaagcactggctggagtcctggagatctgtccctcatgttttcattgctcagaggccttcacccatgaaacaggagcatgggtttcattcactcttcagtctcaattgctctttttctcccctgaaccttaaacctcgacaaagtccttctttcttttttttaacaatttaaattttttctagaagattatataacttaatttcaatatacggtcattagaagaaacagaaacaatagagaggaataacagtgtatacatcaccaaattgggccgacaacctacgtccacacttgaatgacactgggaagtcctaagtaaaagcaatctggagccccagctgggaaaagggtccaaggtggtgcatccgcaccatggatgagacttcaaatcgcagttctgcttataagcagcctgcaaactgatactattaaccgtttttcacatgaaaatgcagctctggttttcctttaacttttacatgctattcatttcaacttgtgaatcttaagattccttagaccctgggggactagcgaggtctccaggggcttaagaaagtccaagacccactccttttcttatctaaagtgccacttgacttgctggtaaccaccagcaagtggcaagacactacatgtcttgcaagcagacatgtagttctgccaaggtcagaagtcagtcagaggcctgctcccctaattttgaatctcgaacaagactacctccattttaatttccctaacagttctttcctgttttgctagttcatcttgagtcacaggtgtgtacgatctagaggtcagcaggaaaagtcagaacatcttgactgaaggcagacaacggctgtggggcaaaggccttttttcttacaggcaggcccagaagacaggatctagtgattctctcaaccaggcaccttcgttacttttgcttcccctatggggaaaaataaggaagagagcctctctcccacacactgatgccctctgggacttgtgttccaacaggacttagatgtggacatcctggctttggtcaacgacaccgtggggaccatgatgacgtgtgcctatgacgatccctactgcgaagttggtgtcatcattggtaactcaatttgccttgctctttggaggtgggttgaaaggggctggtttggggcttagtttcaggaaactctgagtaaattctgtgggaagagtattggtggtttctacttagaagaagcaacatagggagatagaaaattaatacacgcattcattcaacaagtgtttactgagttaccattgtgtgctaggccttgggctctgtgttggattctcgatggtgagagtcccaaagattcctgtactcctgaaattttcagtgcagaggtgggtgagagaccaaaatggcctaaacaaatcacatttcaggtggttagtgtgatgaggaatataaaccagggtgatgtgactgagagggagggcagtggggttgtgaggtgagacctcactgaggactgacatttgagcagggacctccgtgatgaggaggagggagcaaagcagagatggagaggaagcgaatcctgtggcctgtgagaggggaatgagtctgggctgcttgaggagccctaaaaggctgaatggttgtaatcaaagcgagtgaggccattcgggtag

SEQ ID NO: 27985 - DNA, 1458 bp, Bovine  19866880849747
agatctccctgacccaggaatcaaacctgggtctcctggcaggtggctaatatccccattttgcagattctctggggggaggtgccaggctcaaggtcatgactattatggaattcggagctcacctggcctctgttctgggctccctccctcacaccatgtattacatggacacaccccatgtattacaaaggcccaggcagagcctgatccctttaagagccctggggctgggctcagggagggaacgggccctaaaccccaggccagaccggagctgcattctctggggagagcgagtggccacttggcattttccctttgatactgatacaggcattttaatagctgcaatgatcaggcaggtggtatttcagctctggccatgaggggcattccaggaggccctagctgccaacgggtgaagcaggaaggcttctctgtccagggcggctgggggtccaccccagggactctgaaagttttacacctgccccagagcctcagcgtggggatttcaaaccaagagtctcaaactcagatgcctagcggggccaggctagtggcctaaggcagtgaggcaggccagggggagggtactgtggtggtctggatagcacatgcccacctgaaaggggcagccatcctcccatttacaagacagatcagaaatctagaactacatgagatctcctgagcaacacgtgtttactgaccacctatcatgtgccgccgggccatgctgtaagcactgagaatatattaatagcaatgaatgaaacagatcaaaatattcatgtccttgtatagcttgccttctaaggaaaggggaagcaataagtaagctaaataagacaatgacaacgacagcaaaattggaaggagaaaatgaaacaaggaggaaggctagcaaagctattacagaaaggcctcctggagatcaagccaggaaagaggctaagagcctggtaggagtggtccaggggagagcaaggaagataccctccatcagggagtttttctaggaaaagagctaagtagagtccatgaggatttttcatttcttttcttttttttatgatgggaggaagaacagcatgtttgcataaagattgtatcagaggtgagcaaacaagcactgaatcccattggaaggctgttttagtaaatccgtttttatgggaacacggccgtgcttattttgtctttcgcctacacagtagagctgagtggttgtgacagaggtcgtatggcttacacagcctcagatatttagtaactggcccttcacagaaaatgtttgctgaggccaggccctacccccacaccaagttcatcctgtgccctgtccattccttctcctgtgtacccccttcccttcatccgccgctctctatcaagctgccaggccataaacacgacctccagtgtctctctgttggatgcgtgactgacagc

SEQ ID NO: 27986 - DNA, 2946 bp, Bovine  19866880857076
tcaccaggtattttcaaacctacttggatgtaacgttggaacatgctgccccagtctgtcatctttgagcatgtgtagaagagtggttttgcctgcattgtccaaacccaagaatacaagttttccagatttcttgtagagtcctaaaaaagaaaataataatagcataattagctcttacacagcaaaatctacctatatttaaattgttttgggaaatgcacagcatttgaaatgtgtatttcagggaaatggctttacctaggaactggagcacactgctgaagccattgtagatccactcaaagatgaaagacattattaatgcttactccctgtataaaataggaaagcagcaaacattagccttgtgaatgctgatatacttctggagacgttaactcgcatttgctggccttcatgcatggttagggccccatattttggacctaaaaaatcaaaggattttgcaccctggagggaagtggaagtctctggggtactcagatctgcataaactcctgatttcctatcagtttccaatctatgatactcagagcactaggcgttaaagatacactttcctctttcactgtatgactcacttctccaggcacctgctcattcacgttccctagatacaccacagctgtctaccagttaacaaaacttctaggaaatcaccctcatcaataatctggatcaaaatgtcacactgatgtgctaactagaaaacaagaataaaaggcatattaacccattcttgtaaacaactctaaaaaacaagctcgctaaaatcctactagctggcacaatttgcactgctccatttaccaattctatctcttctttaacagtattgtttaatctcttctatagatgtgtctcaagttagaaaaagatgccagcactatgttggagagccatgaagagataagagagtccagtcataatgtgaataattaagactcacctaacccattttacaaatatggactttcttaaaataagaaaatgcattcaggacatagtaggcaggttcctacccaactacatacctcaatactgatattaacagcactttttctactgtttcccataagcctagacaaaacagaagacgacccaaagctactaaaaggtatacatatactgggaataagcaagaggacctctaaatgtaaccgtaatagaatccagagccaatggtgggtgtttagttttctgagtcagcacttcctgatcacactgaatgcctcagcaccagttttggtgcagaaaaaagaatgatacccactttcactcctctccaacagcaagaacacctgaacgcaaggctttacactagatgtggccaattgttatcaaacaaattccctgaagttttatttttttagaaaagtaaaggtttactgtaaaagggttaactacaaaaacctacctatattcatttaaagaatgagacagtatatgttagttttctttttcatccaattactgtttttgttttggtttggttttatcaggcctgtggcctgacctgtaaactttcaggactgcttagtgcttatcttctatggcttaccataggtgggtcaaaagaagcttgggagtttgggtgggggtagagactgagggaaaagcttttatacaaagatactaaataagatttttttgccttcttcaacaacatcaaaatatattttggtagaaaaaccaaatttagtatgttaaataatagttgtgtctggaaacttagtctctaagaaggccaatgacttaaatacacttacaaagttcctgtgcttaagtttccactgttggtaagtaaaagaacaatgtgcctctcctcagcaatcctaccaaaccagtcatccttccctattttctttctctaccacttgaagtctcacctttagaaagcatgtctcattaaggtcactcccactgatttcaactttaaaacccaacgcatatattcatttgtactacaatggtttgcagtcagtactttatagacattttgtaaagtttcaccacatcattacagaagtgtacccaactagataaattctctggaggtgacagaatggcagaaaatcccattttaaggaatgtttcataattaacagaactactttaactctccagtttatgttcccttgatatccctgtttgaaaaatcctagaattcttccctccaaaatgaatgtgatgttaaaaaataaaaaaaccccttactggacccaaagaacctcacagtagtgctacccaaagaggaaatggctctgatggtgcctccatccttgagatcttaggctttgcaccctcgagtgagtcgtttctcagtttctaaggtgcctgtacaaacatctcatttcagcctcacactaaccctaggaggtagggatccccggcttcatttaacaagatgagggcgctgatggtcccagattagttagcttaaccaagagagctcagctgaaaaggtaacaatgtgaagactcaaacccttctattttaatgccaaagtcaaagcccttccttttaatatcacataaaattccaatgcaattcacaaaactgcttcaaaaaaaactttcttaaaccaccagttacagctatgataatccaatgttttcatccttagaactcatcacaacttttaaaccataagttaaataactagcactttatttcttttctagccttgacccactttacaatccttatggcatcttatggcaaattagcttaagggctctaactaccaacaaaagcattgccaacgtacctaaaatttgcaaatttaaggacggatgattcaaataaatgaagagcacgagactgatgatcagtcaataaaaaaagctatgcatcacttatattgcacatactcgttacttatatatgctccgagcaactttaagacacatttcagacaga

SEQ ID NO: 27987 - DNA, 2249 bp, Bovine  19866880887243
ctctcgtgggtcactctcccacaaccagtgcagtgggcttgtgcaggggttgggggaggaaagctccccacaccagctcctcccaaccaggcctggtttccacactctcagggcctggcatcactggagagctggcatgggcactggacctctgagtgggcatctgctgggctctccacctgtaagagcagaaagcccaccctgctgactctgcccacaggagaggctttgtctctttggttctcagactacacaacggggggagggtgaggtgggggagcgagcttctggagacagatgtgggcttccccgagctctgcagccatttggagaaccagggtggctgctctgaggggtgacacctgcagcttcggagagaaatcagagctctctttctctccccattgcccccttccttctctctccctgtctgccttgccatgcccatttcctgttccttggtctcctcccctgcttctgcctctggccagccagtacgcccgccccaacaaacaaatgtccacagaggccaggatctgtggaagaagggtgagaggagctcccaagccccctcctcagggcgtgtagtccatgtagtcaccccaccttccaaccagcccttacttcctgggaggctctttgaggagactggagaggttgcccaggtttcgtatgaaaacagaaagtggctgtcggaaggttaccatgtcagggaaggctcatgtgttctttctctggtttcagggcagcaaaggtgaccctgggatgacaggaccaacgggagcagctgggcttcctgtaagtctcatgggatcagaggctccacccgcccgggtcccccaccacagaagcactgtcaaacagaatacccagggcctggagcaaaaaatctagggccaagcgaggagaattctcatctctgtgacagatgaagcagccaactgccaccagcccactctctagcactcccctgctgggctctgctccaggcaaacccccggggtccctggcccctgatagggaatcaggtcctcaccagtgcggaccatctggcacacatggctgagcctcttccctgaaggcctctgtgttcgatgcagtgagggtctcacaggtgactgtgccatggcccctgccctcatgcagggacagagccacgtccagatcactagacggcagggagacatctcccaagacaggcagcttcccatttgcaatggacttctccttgctgggttatagaagtcggctgcctgggaggggcaggactttggtttcccacccacttgaaggtcgtacactaattgggttccatactcggcagtgcttcgacacctccagccagtctttgctttacatccctctccagcagaagacaaggaggaaaagaattgaaagcagtcttgtagagaggtttagtcacagcaacattgtttgcaagagctaaaaatgtgaagcaaccaaagtgtctgtagatacatgaatgaataatcaaaacgtggtatatgtgtgcagtagcgtattttccagtcttaggaaggaaactctgacattctacactacggtgaaccctggggacatttaagtgagataagccagtcacagaaagacaaatactgtatgacttcacttatatgaggtatttatagtagtcaaaaccatagtgacagaaagtagagcactgatgaaaggtggaatgagtagttactgtctaatgatacagagttttagttttgcaaggtaaaaagagttttgaagatggaaagtagtggcagttacacaaaaatatgagtgtacttaataccactgaactgaatgctgaaaaatggttaagaagggaaattttgtgctggttgctaagtcgcttcagtcatgtccaactctgtgcgaccccatggactgtagcctgccaggctcctctgtccgtgggattctccaggcatgaatactggagtgggctaccatgccctcctccaagggatcttcccgacccaggaatcgaacccacatctcttatgtatcctgcattgaaagccaggttctttaacagtagggccatattttaccacaataaaaaaaattgaaggaaaaaataatagagaacaacttgcaccttgaaaagaggggctcaggagttttggagtcatttttatagcaagaggcaagtgggatctaggaacccaaatctggtcagtactctgacaacccagagggatgggatggggtaggaggtgggaagggaggttcaa

SEQ ID NO: 27988 - DNA, 1311 bp, Bovine  19866880914205
cagaaaagccctccactgctcccaacccacaactggagctttgtgggagggttccaaagggccctagtgtcctaaccattgagcattctggacagagacttaaggttggatcataggttaactcccatctagaaaatcatatctcaacagggcccttccccacttggggagaggggaattgtatgaattggctagtcttagctgcaccccaatctgagaggttcagaaagcagggagaatggcccacaggtacagaaaccccacatgcttcccaaagcaccccattgtctgggtctgatggtaacagtcctcacatctctgtgggtctttgtaatttccaaggaatcttccataaattgtctatccgattaacatttgttgagacttgactttgtgcctagaagtgtgctttgcccataataacatgaacaggtgctgtgctgaagcctttaacctgtatcactatttagtcctaacaatgacccctctgtaaaagatgaagacaaggggactcagtttaaccatttctcaatgacgcacagtgctaagtaacaggactagggtttgaattcgcctgtctcaggtgactaagactccccatccctgcactccctcatctctagacttttcaccttcccctaattacactgaaaaggctgggacaggtatgaatgtcatgaacaagctgacctttggtgggtttaggggattttccagagacctaataaaaggctgggtgggagtgccaacctggctcaacatccccactgtccatgagaagccttacccccaacaccacccccactcccaagcccagcttcagcgccccctcttcctgtccttgccctcactcaggctccctcccagaccctgctgtacagcatgtgtgacagcaggggacaggctcccagggacgaggatgttaccccacaactggcttgtgagacatcagcatgggtgggcagatgggctccagagcaggttccccactcatcaaactgctggccccttgggctcctctccccccagcttccctcctccaggtggggatgaccaccattcctgggagctgaggccaggagcattctttctgaaagttcttgccaaatccctgcccacccaaccaacggctttgggctccatgacaaggtcaatggttgcccaaatgtcctcagatcagatctattttgctttcagactggccaacaccaaccagactatttctcatcatctcttcccattaatatgctcttgtctctcactcagaagcaaggactctcctggtgttttgagacctgctcagggggtaag

SEQ ID NO: 27989 - DNA, 1407 bp, Bovine  19866880919705
tgtgtgtgtgtgcatatgcgcacgtgcacacacatgcacggtatgtggctttcagagcactgagtaggggagagagctccctctcctggtggcaggaagcatctccctatctgtaagggcaggaaagagggcctgctcaagaccagctaaggaaagagggctgggatggagggatggcctgcatcccaacctctcccatcacatggggggtggggaggcctgtacatcctgcaacactcagattaatagaagcctgatttttaaactgttagtccataccatctttattcttcatgaaacattatttctatttttagatcctgattatataccataggttatatttaagaagcattagatgaaatttccctcctggttagtccgttctaccagctgctgggggtgtttaaggaaaggcagccaagctaacgtgaccattttcatgggttgcaatctggctaacattcagggaatagattggggttcagcaggggaacccctgcatgcttccaggctagcgtcatgggcaaatttgtgacaaatctccagctgatgctggggcaggagtaccttgtgggaaccctgtggttttgttcctctgatttcctgaccagtcccaatgtcacttatctggaggctcagccttgtggcaataatgcctgccaacaatgatgttaaggtataaaaaataaaaagttgactcctctattagagagaggacttctaatcaggacaagcctatttgggaccacaagcctaaggcaggagtggctgatgagttcatctgaataaattcaggtcccgccctggcccaccctgtctctccctgcctacttttaatggtaacctctgggtgcttggccagaattctcaggataccagcctcactggggtcttgtggtctatcctgtctgggctgtggcccaagtctgttccatgccgctgcccatgcttaagagagactgtgcctctctcccaaaggatggccaccccatggaggcttcacccaggcctccattcctgcggaccacaaaccaaccaggctcccttcctgcaagcgggacctgctgcctgagaaacacaagccattgcgtgcagtctgccccggggcctgccgtggtggaagcctctgtcctgtagtgacaggccttgttctatttataacattctagaagtgtccatccatggggacacagttctccaaactgaggacaaagttgcaataaaagaatatattgtaagaaagacactggatcttttatttttttttcctttcattttctttaaaaaaaacaaaacaaaacaaaaaaaagcctgaagcaaaatctttttaagagtagttacagatattatagggttaaaggtgggggcactaaaacagaaaaaagcaccagtgagatgcccttc

SEQ ID NO: 27990 - DNA, 1769 bp, Bovine  19866880943034
ttagtgggagaaggcaatggcaccccactccagtactcttgcctggaaaatcccacgaatagaggagcctggtgggctgccgtctgtggggctgcacagagtaggacacgactgaagcgacttagcagcagtagcagcagcagcagcagttagcgggaggagccagggctgattttcccagggtcttccttttctccctcatttgataccaacagtcttgtcatttagtgggacacacatgatacaatttcatcctctgggtccgtgtttatatagatgctagcacttctatagctcttactatgtggcagtagcaagactttacatgtcaattcctgggaaagcagcttagacagattaagcacattgcccaagattatgcatggttgcctgttacacacactgcaggagtagcttccaggagacctggtgggttccctaggaccaagagtatgttggggtgggggacggtgggaggggggaggaaattggggaccacacacagaggaaaattctcagtatcagtcttccctataaagtcatggccatcctgttgattgtcaagaggggatttctatggcaaagccaggctgggttaaccttggaagttcagtagaggcatttgggaagatctgggctgagaagttgggttggaccacgtacaggagaacaacagttacaccaaggtgctatagtgctttgctttggcctaggtaaagtacctgggattacagaagaaacagaaagaacacgtattggaaaatcaagccaagaagctgaggctgccgactccactgtcaaagcaagtgaaagtacatgacagcaggagtgctttccttgcagagaggggacaaatgactgtctgaagttctaaactggcggccaagaccacccccacaactgttcaaaatatacctatttgcctgggccccactctaatattcttattaggtggaatcccatatctgtcattctgatccagaagggatgttctggttaagatctaagagataaatcaagtaagagtaacaggctcctctcctactccagaagggtggcaccctgggcccctggcatttcactaggcattcaggggaaagagaacagggttaggaagactccattcaagggcctctgggtgtgtgtgggtgcaaggctgagacagaggagttgcccagaaggaattcagactgggagtgggagctcagtgatgcttagtcagggatgctgaacggcgcccacagatctccagagttgcttggcatcttgcccaagtcccattcaccctctgccaggaggcacagaactccctactctggggttctgagtaccaaggatgagaggagggtcccaggcccctacacacagtgcacctccaaggcatgagcctgagaccagaaggcctccatagtcctcaggattatgacctgaggcctggaatctagtcctgacagctggtgagggagtggagtgcgggcaaccttcagggccttacttgggggtagtggagtgcaccaggaccctcgccgtctcccgaggggccacatgccggcaggtcaccacgagatggggcgccacggccactccggagccccagacagaaccacactccaccagcacggccgcagctgcccaagggggcccggggtctcggtatcggaggggcaggccccatggggcacccatctcaggcggtaggagggcagccagggcggcagtgtcggggtgaaggcggcagagggcggctcgggctacgctgagcagtgggg

SEQ ID NO: 27991 - DNA, 929 bp, Bovine  19866880983831
tcctgctgagggaagcagctttggcaagcccgggagttcatgaggaatgaagctgacatgtcaagtccacacttgtcggggtgttaatggtgtactgttatgaatggagtcaattgtgaagaagtcccgatgaatatgtatgaaagctgactgagcacatttaccgagaggacgatgagtaaactgaatctcatgtttttaaaaattcaccgactcactaatatttttaatcctttccctgtgccacttagcctcttctctatttgatactaaaaatattccttactcatagcctgccacaaattgttcctagcataagctacatccttatctttgacagtgatgagctatcacataagagagcaacatgcattattcaaacataaattcactccaaggaaatgcctcaaacacttgagtagtgaggagtggctgcagataggtacaacctgtttgagatatattgggatgatggaagcgttccagctggactgtggtgatgattacaaaactctataaattcactaaaatcactaattattacctaaatgagagggtttttatgcttcaaaccctatgcttcaaaggtagtctttgtttggccgtgacatgtggcatgtgggatcttagttggccaaccaggggccaaatctgtgccccctgcagtggaaatgtggggtcttagccacaggattaccagggaagtcccagtaaagctatttttgttgttgttgttattgttgttttaattttaagtatctttccctggctgatatttagtctcaggattttaaaggcaacatgagaaataagagtcgtaggcaatcagattgtaatacaatatccggaaaaggcttttctcagaaaagtacagacactggcacccaattagcaggttatcagacagtcagtaagacagacacagccga

SEQ ID NO: 27992 - DNA, 886 bp, Bovine  19866881029965
tgcctccttggtcatggattaattgaccatgtgtgtgggtttatttctgaactttctgtcctgttccattgatctgtatttctgtttttgtgccattaccatactgttttgatgattgtagctttgtagtatagtctgaagttagggagcctatcatgattcattcttacccattctccttcatttcagcaggtttctgcgtatcccttgactacatcagattccatcagcaggtaaaaaaggggtgcctgctgggtggacggtggacagtgttggctacagctaaaatttatatgggaaataaaacacactcatgtttctatttttgtacgaaatacaagggttatgggggtggggtgggaataagaaatggatttgggtgtgacactcaaaggggccttgggtttcatctgcagtttttaaaaggggggctgaaaaaagaagactgtattcatgtatcacttatgtaattaaaagttagttttaaaaaatactatcagtgttcagctttggcacccctaaatctggcccaatcccaacccaatccaacactgcagaaacaaaagcagtcacctggccagaaagttcaacccggggtcccctgggagaagagggaggaaattgcctgagtgactcttggctccaggaaaaaagttgggagctgatcacttactgcttcacagccctttcagcagggctgtctttgacagacagaaagtcaagccctcggtgtttccttgcaaattcgaggggcctccctctggagtccttcctcattcttcaaacagaaactgcagtctgattaaaccgcctgtcaaataccggcagtgcagctgctgtccttaaaaccacttacgagaggctcaggggcacaggaggcaggacg

SEQ ID NO: 27993 - DNA, 1688 bp, Bovine  19866881043052
tgtagacgtcttctctgagggaagatgacagggctgaaacgcagccattccccatgggacctctgtcgctggtcaccttcgtggcaccgatgttctcttctccagccaagagagaccaagaaaaaaggtctccaagaaagtgctttgtgcaactcactccttccccactgacctgcccttacactccaggagagggctccccgagtagcttaaaaccaaccagctcctcctaccactccggacacattcagccaccaatcacagtggatcggccctcctgcctcccctgggaggtgtggtgggcggtgtgagtgctgtgactgcagcagccattttgagcccaacactgcagggcagaggcagccaggaactagggctcgaagccatatctgagccagagccaggtcctgagtcctggctgacaaggggccaggaggaagccaagggcaggacagatcagaggcaggtccacatccaggcggctggcctctgctctgagggagcccagctggcacacccagggctggctgtgacacagcaaaagaatctgctccattcagagccgggcgcgggagccagggatgctgctgggacctgaacacgcggccctccctccccccaaatcaaggagtggagaaacatgagctctcattgttcagacaggaccagacaggactgccctggccacggttgtgttgaggatccctggcaggagggcaccctgctaagtccttgctgccccacctagctcctgtcccaggcacctgtgggaacagctttagtgccacccaaactggaatctcagcagacaggagccagactgcctgaacggaactccagccctaccactttattatgctacttacctctttgggcctcagtttctttacctgcataatggggatcacacagggcccacctataaggttgttgtatgaaagatagaggtggatataggtaaaatgctccagtgcctgactaatactgagccatggtccttgctgtgtctcctacctaattaagcactttatgtgtattaacttatttcatccttattataaaccctatgagatagatattatcattatccccattccacagatgagaaaactgaggcacagaaaggttatataacttgcccacagttgtagggctgatgagtggcaaattattttcaatccagttaaatctagcttcggattccaagctctaagcactgtgctgttctgtctctcccatggacagtgtcattaaaagtcacctgtattactgtcatgctggcagccaccagccccagcccagcccagcctctgctcgctacctccagctcactcctctaggcagtctgcccccgctaactgggcaaatttgacaacaagaaggttcttcccccttacggtggactagtcagccttgtacacctccctaccttgctgctgctgcttcttttttatttttggctgcaccaggtctccattgccgtgcccaggctttctctagttgcggggaacaggggctactctctagttgcggagcatgggctcgaatgctatcggggttcagcagctgtggggcacaggcttcgatgccccacagaatgtgggatcttcccagaccagggatcaaaccacgcctcctgcattggcaggtggattcctaaaccactggaccaccagagaagtcccacc

SEQ ID NO: 27994 - DNA, 3851 bp, Bovine  19866881130682
cctgtccccgaatataatctgaaaggctggcttgccccattgttagcctgctcctttgtcctccaaagaagcaagtggagtcaaaggagcaccaggtataagaagaaagaggtcatctctactcaggtccgggtccttgaaagatctcctgccctttcagtaaacaggtcagtgagtgtggaccgctcctaggacatggtcttcgccccactgtgtgggcagctccatctggccaagtcacttcaggcaggtggtggctgttggtggtggtatttttatgtaagagggatatgtcagcaagttagactgggaaacaacacaatgtcgaggcagccggtcggtctccttcccctcgcattgccctagagtccaaggcagggcgggtgagccgagccatttccagagaacctgagaagagcccaaggagactgtctccccgaagtaatggatccagagaacaggagcgtgtcttctgaggacagcatttgataccccaacaaaagacccagagatcacgccccgaggagctggggattggagttgaaagggccgagccctccgcatcagatctttctcaaggatcctgaaagcctatcaccagcccttcctcggagaagtcatttccatagctgttgtcttgatctgaaccgtggagagcagccaccctgtttgtaatgagaccatgatgttccgttccatctgtgttctgaaaggcacattgaacccaggctgacgataccgcccagcttgctcgttgctcacttagagagagaggaaaatcttgtcattccctgagaggaggagggttgatttatcgtgcgtgttttggatgtcagacctcaattcctgtcatcaatcttccaaaataaactctgcataggaaacttcgacggaccacctgctggaaatgggctgcttttccctttcttttctgacaaagccagaaagagtcctcacctcccccactccagggacctcccccattatacctggtccccacagccaggctccccagctaacctgaatcagtgctgggtccctgcctgacttgggggctgtgctccccaggaatgcagtgtcctgagagcttctgcaggccttatcccacaatggtccccagccagggaggtgctgtcactgctgggggctctgcagggtgggagcaaattgggaggtggttgggtgggtttcccaggaggcactagtggtaaagaacccgcctgccagtgcaagagacataagaaacataggttcgatccctgggtcaggaggatcccctggaggaggacatggcaactcactccagtattcttgcctggagaattccatgcacagagcctagtgggctacagtccatgagatctcaaagagttggacacaactgaagtgacttagctcgtatgcatgcatgggtggatatgatcctctcctcccagtgcctgcccacccagcccccagtcccatggagtgagggacaggggcccaggtagctctcctgaattctcaacctgacacagaagaggcctgagtcttcacccaaccctgcctgaaaccacaagatgaagaggaaattggaagcctaccagggtggaaatcacccccttgcctgctctctctgcttcccataaaggaagaatgctaccagccaggggcagggagagggagatggcagttgatcacaaggccggcctgccaccctctgggtgtttctcagggcgcctcctggggtaactccggttcctgtggacacacggacagtcagcatctagagaactcaaccgtggaggatggatttaagtagcagcggggatcatctgggtggtcgaaaataggtgcccaccactgctgcacccccgctgcccatgacagacattgctaatgaattaggaggcatcttaacagagtgctttactcagtcactaccagtctgctggagtccacactagctgacagttgttggccattctggctctaggttttaagagagagtgtcttaatgatgccaactgtgagactgaaacagatgaccaagggaagtatatgtgtctctttcttgaggaaatacaggatgttcagctgctagccttggttgaaagtgatgcttgctggaatactagctaacacttaactatgtgttagacactgttgtatttttatggaagcagtgtaataaagtgattacaagcatggactctggagccaagctgcatgggtctgaatcctgcttctgccacttctagctgtgtgaccttggacaaattactttacctctctgtgcctcagtttcctcatctataggatgagaatagtaatagtacctgcctcatccagatgtaaggaatatatacataattatatgtatggcctggagaaggaaatggcaaccctctccaatattcttgcctggagaatcccatggacagaggagcctggcaggctacaatccatagggtcacaagagtcggacacgacttagtgccatctttctttcttattatacatacatatgtgtgtatatgtatacatattatacatacctacatgtgtgtataattatgtatatatttttccatgtaaaatatattaactcatttaaactctagaaagagaaggcttccctagatgatccccaaagattttcaggaggaaattattagtctttgcatttttattcattaatttactacttcattttatttctatcccacattaatccaagaaacatttgggagtgactcataaactagataaggaaacagtgggtaggtgtgtggagagcagaggcaagaaaacaaggggcatccaagctgatgaccccacagcatcctgtgcagccaagtcacaggttcagcttggagcttcctggtggacagagaaaacgggaaagcagagctgttgcgaaagtcagggatcagggagagttaggtgaagcacttctttacctggtgccaagaccctagagaacttcccctgagtgcaggtgatatcagtggccagcacacgagcagttggacagagcccctctgtgcatctctgggtcagagcccctgtgtgaggctgggaagcctccacagatgcgcctgcctcctgggaccaagggaggtggccgccccttgtgggcgcactccctgatggcatttagaagcggcgtgaagagggactggctcagggctacagctctggatcaaggaggacaccagggcggccccaggctgtctttgtggggctgggaaagaaggcggctgcgtttccaggttcatttgttcacaagcatgaattaaggacctactaaaagctcagcactccttgaggcaatggggacacagccaggagcaaaacagaacgtgccctgcctgccctgggagcttaccttttagtgccccaggggtaaaactcagcagagaggaggagtggacactgaccctctacctctgcagccgctaaccagcataccctgagcttggttctctgtgggggtgtcactgctccccaccccgcctcacggacatcctcagaaacaaggccccaggaagggggccttatttctggcactgcctgcatttgctcagcagccctggggcagagggacttgtctccagatggacaccctgagacctactcctggtgttgccatgggtttctgggaagagtgggatgtctggaaggagagaaacagacctgatggctgtgcctctgaaagcagagtgggcccagctgcacacgcctgccagccagtcctcttcccttctaatgactgtggtcctcagcgctggctccctgccagccctgtgccacgtgctctacatacatcagctcattcgatcccaagaggtagagattgttctcccatt

SEQ ID NO: 27995 - DNA, 1530 bp, Bovine  19866881141948
atccccaagggaccagaaatctgtcagtgagccgccacctgcccacccactggagggtcccctccagcctggccctctgctctagtcaaagctaagtgggggttggacaaaggggctccaattcctgtctttaatgagtgtgtggtttcttgtgaattagtcctccttgaatcagttttaagactatagaacctctgcttggcatgatgatagaaaacctccttatcctgtggctttgggtccctgagggcatctcaggcctccatgggggagtgacgggctgagtaggatacagaccctccagtctccctcccatcagagcagctctgcctttgtcaattttaatctgtaacatcttatggaaagacccgaatgaatgaactttttggccagcccaagggatttccttcccccccccccttttttttcttcttttggccaggatgggggaagtttcttctagaataaatgtagtagtagggagattctagactaactccacattggaagctagaatcctacttattccccagaaatagttttttgcctggtggagcctggggttggatgcagaagccacgctctaccctcacctttttttttcccttgctcctcccaggccctacccttttcacatctcatcctggccacgggcagcactgggctcttcccgggcaagtttaaccaggtttccagccagcagatggccatccaggcctatgaggacatggtgacgcaggtgagctgcccactgccaggggcggggattgaggcaggagctgggggaggggccctggagagtgaaacagctgtgggacacctggggcggcagcagggagcccccagaaggtgtctggggctgcaggagcactgtagagatgcagagttaccagaaagaggctcctgggggaagacctttggacctgtcttgaagtttggacatgggcatctagacctgctcgtgtagctattggctgctgtttgtacagggcatatgttttacagagcaggcttggatccatgctcttggttctcacggggatcctgagaggtgggtggaatgggtctgtccccactgaatagatgaggcatggggatctagagaaggtcatgcagccgtgtgactgagatcaggcctttccttctctgcaaggccactgagaggcctggggaacttctcacatagtcatgagcagatgttagacttgaagttaagaacctagcctatgaactcaggcagatctgcttatctgcaaggtgggcaggcagtgagagcttagtaagaaatgcagggagacacccagcaagagcctgacccccaggaagcttatttggaccctgaacttggaaagggttctctatgcttccttggtcaaggaacccgcttcctagtctggacccagaggtggggtggacttgagggtgtgcttccatctcctgcttctccaggtccagcgctcacagtccattgtggtggtgggaggaggctctgcaggagtggagatggcagcagagattaaaacggaatac

SEQ ID NO: 27996 - DNA, 2447 bp, Bovine  19866881207605
taatatgtcaaaaactattgagttactcacttaggtgaattgtatgatatgtgagttatatcttaataaagttgtttttaaaaggtcatgggatacagcttaaattgtgcttagatgaaaatttatgacctatatacttagaattgatgcttttgaactgtggtgttggagaagactcttgagagtcccttggactgcaaggagatccacccagtccatccaaaaggagatcagtcctgaatattcattggaaggactgatgctgaagctgaaactccagtgctttggccccctgatgggaagagctgcctcattggagaagaccctgatgctgggaaggattgagggcaggagaaggggacaatagaggatgagacggttggatggcatcaccaactcagtgggcatgagtttgagtaaactctgggagttggtgatgaacagggaggccctggcgtgctgcgtgcggttcatggggttgctaagagtcggacacgactgagcaactgaactgaactgacatacttaaagtttacaaaataatgagctagcatccaatttaatgtggtataaaaagaacaagtgaccaagcctaaagaaaacaaggtatgaaatcatgaacatgatagaaattaatgaaatagaaatgtttataatgacaggatgaactgaaccaaaagttgcttttttgaagacactaataaattgagacaaatctagcaagttctaatttaaaaagtaaacaatttataaatacaaaatattaaaagggtcagaatgccacataatgcagatatttaaaagacaaatgatattgtaacttaatcctgataacttcaaaatctttataaagttgataaattctagaaaaatttaacctgcaaatgtggttcaagaagaaataagccagctctttggcaagccgcaaaccccaggctctgttccacagcctggggtttgttgaagttgtcaagaataaagcctacttcaagagataccactgaaatttagaggacggcaagagggcaaaactgacgactaagaaatgattggtaatccaagataaaaataagtacaacacactcaaatacagaatgacagttcatgtaaccaaccaaggtatcatttgacagattacttataccagtctaaaaggagatatatgcagcttatgctcacgaactcccaaaataaggcgtgatggttggtctgacaaataaccctgcagcatattacactggccttcaggcttcttaataggtttcgtatcagcaagatttatgaaggccaagtcaaggtgactgtagatgaatacagtgtagatgaccacctgactggtggtcagccaggtgccttcacctgttatttggatgcaagacttgccaggtctaccactggaaataaagttggggaccctcaagggagctgtcgatggaggcttctctgtccctcacagtaccacacgattccctggttatgattcaggaagcaaagaactcagtgctgaggttcactgaaagctcaccatggagtaaaacatggcaaatgacatgcatagcctgactgaagacgatgaggatccttgtaaggaaccattctctcaataccgaaaggactctgtaactccagacatgatggaggaggcgtacaagaaagctcatgctgcagtacaagagaaaccagtggatgagaagaagcctaggaaagaagcagaaaagaagcggaaccatcccgaaatgtcacttgcccagaagaaagattgggtagctcagaagaaggcaaccttctttagagctcagaaacaggctgctgagagttaatacagaaaaccacaattttctatgaagatatttcagataaagacaataataaacatattgaccaagcaaaaataagccatgtgattttaccaaacatttataacaaaatttaaggaatatataattttaatcttatgcaaattattttatgggatagaaacagaagtactgctccttatgtctttggcatgagggtggcataatcttaaaatctgaaaaagacgggatgagaaaggaaaataacaggtcattctctcgtgaacacgaatacaaagatgtaaaaataaattagcaaactgactccagtgacctataaaaatacacatcctgaccaaactgagtggattcccaaaatgcaagtttgatttaactaacagctgcatttctaagagagctggccaaaaaacagaagaaatacacccagtgtgttaacggaagaaaatttaaggaactttttaaagatgaacagaacccacaatgaacagtgggacatctggtaaccagaaatagccagaagcctctaggcctgagggggcacagagtggaagtgcccagtgagagatgaattcagggaagagaattgaaccatcagtggggtcatcatagagaaaggcaacctctgccaga

SEQ ID NO: 27997 - DNA, 954 bp, Bovine  19866881246830
aacaccctgaaaaactctgggcaaacccaaaccttactttgtttccatcctcatcttttgttcatttacttcttgctgtgctgtgctgtgcttagtcgcccagtcgtgtgcgactctttgcaaccccatagtctgtagcctgccaggcccctctgttcatggaattctccatgcaagaagactgaagtggtttgtcatgcccttcttcagggggtttcccaacccaaggatcaaacccaggtctcctgcattgcaggtggtttctttactgactgagccaccggggaagccctcatttacttcttacacctcagctgatatcaccaaggattcagagtcactggcaagaatatagataataaaatagagagatgtgtaaagaaaagtttataagtcagagtcaaggaaaacaagtcagaggcgggggcaggagagcccgggagaggcggggaagaacctctcaagtttcacctccaggggcttggtggtaagagaaaaaaaatcatcagcctggtttcatttggtaccatttgctttggttctgtctgcctggagacttgcaaacacccagctagacgaaagactgagtcagccccctcctgagtgatggtataacaggtcctctaggtccaaggaaggattctcaccaaggtcggccacttgtacctgtgcatctccctcagaaggagccagcccctcccacacgccccacggccccatcaccgcctcccgcacgccccatggccccatcaccgcctcccgcacgccccatggccccatcaccgcctcccacacaccccatggccccatcaccgcctcccgcacgccccatggccccatcaccgcctcccacatcccccatggccccatcaccacctcctacacgccccacgaccccatcaccgcctcccgcacgccccatggccccataaccgcctcccacatcccccatgg

SEQ ID NO: 27998 - DNA, 896 bp, Bovine  19866881247454
ctaccagttgtatattcattcacacattcacttaacccatctgcacatccagtccagtctagcctcctcaatcaacttgcagttgggcaccacccaatttcttctccaagctgaaaaacctaagagaactctaggcaagtcctactccaaagttgatgctaacaaagagctcgagaaacagaaatgtgacactgtgtgaaagagtaacttaaattcgcttttgaacccgcattctcatgctctcccaacttccttcggaacatgaggaagagggtcgaaagatgatcagcccagggagagtcagacgaaacctagaatgcaacacagggatcagccttccagcctggtcatcccaccaccactcagcacctcccaggcctgggaaggctctccaaacaccactatctgaagatgatgtcagtccttgagtgattatatgaaatttatcttcaaccaaaataaagcaccaaagaaacttactatgaaatggggctctgacatttcttgcataaagatggtctttggagaatcatatcgagataaaagctccctcctctgaggctggaatcacagcttctccgtgctcttgatgatgccggacaaaaatgtgaccacatgctcttacactggctttccaccaaacgccacagagtcggctcatttgcccaccacctcataataattggagccaaatctctgtttcatttttccgaaagaaaaagactacatcccaccacaacagttcattgaattcaagtctctacccagaggaagcaaaaggcttcgtaatctcaagcaaaaaatgccagctatgtgctcccacaggctgccagtcccctggaggcgcagggcaccagggctatcacaataacctcccagcccattcacaattcaat

SEQ ID NO: 27999 - DNA, 3183 bp, Bovine  19866881293978
ccgagggggtctaaggcaccagacccagttcagtcccttttgaatagaatggagaagcattcacaacccagctccaatcctccacactcacaggtttgctccgtgttgcatctgaaccctgcacttacaggctgtacatgcttgattcaagcggatgcaccttcatgtgtcagcatcaaggaagaagccctggggcaggaggctagaggtgcctggccctggcaggatgtgaggtgctgtcaggctgtgtctgtgtgaagctgatatgaatccacacagagttggttactgccaaggtgaagcaagaggaagtgaattggagtttaaatgatatttgattccatctttttgctttctctttctggtaagtgtagagtgtcctccagtatcatctggataactggaggaaaaaagatgaatgtcagtactgatgatctatgttatatcagggtatttgaagagcaaattttattgatgagtttcactgacaatgaaaataatgatgaaatcaaaccttataaacatattccttgtaaattaatagttattgaggctaaaggcaaagttattcctgggattgcttttgaatatttaagatgtggatgtattgaactgtggggatgtgttctgggctctctttgtcttatttatgctttctaaagagttttaaattttctgttctctctgattttctataccactcatcatgcttctttccagtagtttatgatgtctttagtattgtttactggtaaattgcctcaggaactggtgaaacttgaaacatgcatagtatgtccttagaaaacaaaagatacagaaaataagatttaaaaattaaatgtagtgtttatggaaggattcaaaatcctcttgacttaaagttttttgtaacttcactttttgtgtatcagtatcatcttgaatgttgatatggtccttatgccagagaaaagagaaaaatcccagtgccttgtattagctttggctgatcattccaaactagagtcagccacatagaccccatacaaccacaagggggcaggaaatgccatcctgcggaatgcctaaagggggggagaaatgtaaagtatttggcaaacagtaccaatgactaccacagcaatttggcatttttaacagacaatgttacaaaagctttgtgtgatagacaatgtgcagtaggttggaggctgttgtgtgtgataaataatatgcagtaggcttggaagttgtggcatgcatggcatttctacatgtttgaattacagaaagtcttacatgtaaaaatgaatatgtagcaggtttaaatgtgtaaccactaaaacagctgtttaaaaatgttataacagtctttattagcttcaagttaccgtaatgtttactctgagtgcccattctccataagaatagtggaaaatgcatttttcagtattactggggctcccttgctgcaggattatatggtcaggggagatctttggctaagctgatcatcaccaaccataagggagttggtcatcagccctctggtcacttttgagttgtaggctatcaagtccatattccatccttctcgggatgatggctctactgcttctgggctgagcttggaagcaccagaatctctgctgaagctgggaagtctggagttaatggcccagcatcctaccctaggacctctttaaggttactccactttcctggggcactgtcatcaagcagaactccgatgcttggggaccaccagctttgttcctgtctcactctgaagcaagctctctgtgtcctctggtcttctcaaaggacaggaagaactgctagccccgagccacttctctttcttcaaagcactgaagttctgtagcccacctctccattggttcacaagatctgcctcttgagattatcatcatggttggaaggttttaaggatagttgtaaaagcatgcaaaaacatgaacccggagattatcatactaagtgaacagacaaagactaatatcatatgatatcacttaggtaggtgcaatccctgggttgagaagattttctggagaagggaatggcaacccactccagtattcttgcctggagaattccatggacagaggaagtctggcgggctacagtccatggggtcgcagagtcagacacgactaagcgactaacactttcagttttcaagggtggtggagtgtggcttttgtctagagcaggagggaagagatctacccagcatattagggtggggctcttgttccgggggtgtgaccccccccccagttcactgcccgaccctctcaccttttgctgggagggtgaggtgtgtgctccgtgagagccctcccggctcctgggcttcatggaagtggctgtacagccctcctccaggcagcaaggacagtggacccctcggcttcccttgtccctgacggggataaacctggagggcccgtcctgcctggctgggctagtggagcgcacattcagggaggtgttttcctcaaataacttttcgcagaacctcttgggaaactcaacctcactcccccaagttgcttcttggaacctgcctccccttgggtcccttgggaccagatgtcccgctggtgcttctcagggctgcagagcgcactgtgtccagctgttaggccagccctggcttgggccttggccttggagacacacctgccctctgccagcctcctggtcaacgagcctcccctgacaggcgagcgagtgagcaacctggaggcactgcctgtcaacgagcgtcgcgagtgcatcaaggtgcagacggacaaaggcacggaggtagatgccaacctggtgattgtctgcaacggtatcaagatcaacagtgcagcctaccgcagcgcgtttggtaagtgggaggctgagcggagggcccctccgcaggttgcctcttctctctccagcccctggggaaggtcctgcaggactctgccccaggaatcggctttctgccccccaccccaacgctatctcaacggctcatttggtgtcttctgaatggtgacatcaaacttcaagtttgggtccactcctgctgtgcttccctcttctgttttgatggtgacttagctcaaggtgcccagtgaccagactcttccaaaatcggatcccgcgcccctagggttagagaggaaacaggtttca

SEQ ID NO: 28000 - DNA, 2051 bp, Bovine  19866881349509
cccacagttccccaacattcagcacagaccaaggggcaggctgctgtcttcagtcctttgaactatgaggggagaaaagacagagaccaaccacctccctcgaagttagtgatggtaactctaccttccacccccagggagaaaaaggcgatgctggcaactccattgaaggaggcagaggggagcccggtctcccagggcctcctggacccccagggccaaaggtgagtatttccctgggatcagtgctcaatccaagtgcctgtggtccttatccctagtccatttggggcactctgtatcctgggcaccttgccttctctcctcccctaaatgttgtttagtggattcttaacactggttgttccagtggattctagaaggtccgagctcctgggactgagctcctacttccaagcagtgaccttgaccctccaaaagagatgccctctctggggcagatggaagtaggagccattgactcaaatggctgtgatgtaactgagtcaaggaccagtggctgccaggtctttggataatcagaaaggcccatagcctggacattgaatcagccacagagactcctgcctctccctgctcctctggtcctaggcctcctggggccccctccccacatacctaggcccttcccacttgcctctgcctcccaggcagaacctggtgaggtaagtgttccaggctccaaaatgacctgcctcctccagccagaagttcatgagggtccatagttaggggcctcaacaagctggacacgtgtgtgttgactaagaaccgaggagagcctggcagcacagaactcagagggagaaaggaatagatcaggagggctgcttggaggaggtgggcctgggcagggcccaagggtgggggaagtcagacaggtggaatagggggagttagtagatatgagcaaagagacagagcccagagacacttgctacaacatgaatggctggaccatctcttgccccctgtgtgtcctcatcccatctctctcctgttgcccagggggaagctggagcagatggccagccaggccccccaggagagcaaggagacaaggtacagagggcctcgatctaagagcaggatgagggtcagcttgggagctcagagggagagaagtctttggccgtcgtccctgccactgagcccccagacacagggctgacggccatgactcccgcctgccatctcttgtggtcaccttgggctttggggaacttcctctgagatggcagccaggcacagggaggcctggggaatgcagtgacccagagtccccgcatctactattttccaactgctggtaaaggcaggctccattctctccagctccttctgggcacaggtcagcatggtgttgctgtgggcactgcaagactgtgggtgcgggggaggtgccggctgctatctggaggtgacgctccctgagctgaccaaatgaagggtcagcagaagttgaattatattaaagggtttgttttccctttgtttttactttctgtcttcctttttaaagctgtgttcagtgttcacattttcccagctcaagtatggaactgtgcttcgcttttcacaacttacaccacctttcatttattccccacggttctgtcctgtttccaacaagtacaaatcctccccccacccaacctgctccaggaggcagggtgtttctaatccctcaccctggccccccacgtttcctcccacagtttgggtcttccaccagcagacaggaaccgctggggctctccacggcgattggcgaccacccaggcaatcggcacaaagtttctgaacccttgctccttgagcgggatgggaacagaggggcagagagtctggtctctgcacccaaggaggtggctgacttaggggactaaagagaggtgcccagaaaaacaaggatagaatcaccaacagctaacgcaggacagaaataagaccttccagtgtgaagctgaagggagctcagagggagagaggcatgcgggctggtggaagcacttcccaaagggaggacc

SEQ ID NO: 28001 - DNA, 792 bp, Bovine  19866881371053
ctcatctggacacacaggcacagctgatccacttctgagcccctgagggaaccatgtcctggggattcttagcttttatccctcctccatgctgtcacaagcccttgcccaggacctgtcttctttgatcctcatgattagctccttggtgcacaggctatgattcctcccattttacagatagaaaactgacccacagaggcacaaggttacttacccaaggtcacagagttagtacttggcaagggttcagatgcaaaccaatgcctgtctgactttcaggccacactctgcacgccctcctctcttggcagattctcttccctgccctggactgccccaccccaggggacaccagtatatttaaacattttagcctcagtgtgggtgtgtagccaggggcctacacatgcttctgttaaaaccttctactccagcctgtgtgttctccataatctcagtgattggattctccttaaactgagccccagctcattttcctccccatctagctttgttttgccctcatcacagctcaggggcaggcctgacccacagctgtggcttggaagggacacattgttgctgatactgtgaccatcctcttccttgtagagcacgatgctggtttcattgcccctcaccacagctctaggaaaagggcagggcaggaattgtgcccattttacaggcaaagaactgagactcaaggcttgacctaggcacactggggatgaggaggagcggaaaccaaaggcaggtctctatttttcctctcatattgccctaaga

SEQ ID NO: 28002 - DNA, 740 bp, Bovine  19866881381884
acccccacataagccttttaagatgctcaaaccccagtctagaaaaggaggaagatttacctaaggccaagctgccaagaggtaggttgagaattgaactgaggactgtggtagcaactagcccagggcatcttcccctccacagtgagtgccaggaacacagccatcttctgggtagccccctgcaccccacttctgtcctccacttcacctttccagactgtgccatctgtctggctgcaccctctcccactgcctcctgtccccacctacaacccacatacactccacatctccctctgctcccacctagggacttggctccggtgtgtttatctcagagaagctgcacgggcaaaggtctgtgtttgtaagatcccccacctctgtttactggtgtttatccagttgtgtcctgtccgccctcctagccaggaggccagggggccagaaggccaggactgctcgtcctgcctgctgggtgctatcccccactccccgtgggctttggacacaggcacgggccagaagccagccaacactgtgcccgcactggggcagggctcagtggctgacacagatataaggacaccctagaggaaacagggctgtgttttgggtaacaggacccagatcttagcaatcagagtcagtataaagtgcgaggttccattcgttgccatttactctatgtagagactgcactaagtgctttacatgtacatatcatctggcttaag

SEQ ID NO: 28003 - DNA, 1427 bp, Bovine  19866881409404
accccatgaagaaagaaatggcaacccactccattattcttgcctggagaattccatggacagaggagcctggtgggctaaagtccatgggatcgcaaagagtaggacacaactgagcgactcacacacacgctgggaatgaagaggtcattcctaaggctgaggagggctcaatgagagatgctctacctgaaatatctgaattaataaaagcattttcattgctctgccaagttctgcagtggcaaactcaatagtaacaaagctgccgtggctgtccctgggccgtgtccctttaatgaaaggacgaaagactctggagacaagcccaggtagcagctgggtcatgagcagtggttggcaagtctgtcttcagaatattaccaataaaacaacaaccaataatagctaattcatataccacatgctgtttgcccgccactctttttagcacctctcacgtgctaactcacttaatcttcacaaccctatgggggaggtattgtcgtattatccccatttcacggatggggaaaatgaggaacagagaagttaagcgccttgcctgggtcacacagccaggaggttgctgaggtggggtttggatatctgcaggtaagctgcacagctcctacgcttgagcattcatgcagaccgcctctggattcttcggtggttcagtggtctctctgccatcctgttggtcctgatggagctccacatactctttcttcctggatgataggaaagcccacgccggcctgattgacatccgcactcctttgtaaagaatgtactccagtggatcttctaggcccctgctggtttcccctgtggctgccccctgctcctcacccctccctggcatccccccaggcccccagccctgccacccctttgtggggaccatggcccccagggccagcctggctctgcgggaccggtgattacaccctccctatggaaaatcgcccgctgcgtcctccccctactctgtgtgctccctaaacagctgagcccgtgcaatgtgagaggggcggctccttgccagaggtttccggaaagcatccagaggtcactgtgggctggcttaagtaggctgggccctgaccaccgctctgaatagccactgtcccgcccggggctgctccctcagctccagagggggctaattggtgggtggggagctgtggagggctggatgctagtttgcagctgaaggaggcgacaggagagccaggcatttagttcggtagctgccaaatagcaaatgccaagagaagatggaatggagcatacgaatcttcaggctaaaactgccttcccaagccccgtctttgtgtttagacccaacctcctcccgacagctggcctacccacccacctccctaacaagcccacccagaccactactagccagccagctt

SEQ ID NO: 28004 - DNA, 1346 bp, Bovine  19866881434738
actgaggagggatggcctatctccagggaggtgtatgtggagtctgattatttccaaacatttcatcagcagtaggaagactttttttttgcaaagaaaataacaaggagactccacagtgtaaggcaggtaagctctgagtgtgtttaggctaaagacaggggtggggatcctaaagccacacctatcagcctcttccttccccttcccactacaccctgggggatccttgggttccaagaagacaaatctgatcttccctgacagtgattttaaaatgtctctgggaaacaacccaaatgtccatcagcaggtgaatgtctggtacattcacacagtggaatactatacggcagtgaaaaagaaccaagcaccgcccaggccatgccagaaaagaaactctgacacgtgatgcggagcaaaagaagccagatgcagatgctgacatactgactgactccattcacaagaaactccagaactgaagacagatctaagctgtggtgacagaaagcagatcagtggggtaagtgtgagattgactcttgagtctcatgaaggaattttctggagtgattgaggtggtggatacaaggctatatacatttatcaaaactcaacaaattctatacctaaagtgggtacattttattgtatgtacagttaattcaaggttgattttaaaaattaaaaaaaaattttccatgaaagttttgtttcaaatagctatttcaaataatatattttaatgtttgcaaatgaagctcactgattccagaaccatttggtttataccaatctctgggattgaggcatcgtatgactggtgcttaattctggatttgtatcatctctaaatgtgttctctggcatatggccactaaaaaatattgaatgacataaaatgtgagtagtttaagaatttcttgatctctcctcttttctctgacttggaagttaaagcaggtggtgatcattttaactgcagatattcaccgagggcctatcactggtgggcacccatgcaggatccaggcttagaatacactggttttccagatgcaaataataaaattgatttccaggaaaggtggaggattgctgctgattttttaggattatactttattagtgaaaggttgggtaaaaggagaaacatagaaatgtcttcctccataccactattttttcgatgctgctgcagagagaacccagcatttatcttttgacaagagcaccctgctgagttggtgaagagccactctctaaacttctggaggggagacctccaggcttgtctttcatgttgcccactcccagccctcagcccagcacccggggggaat

SEQ ID NO: 28005 - DNA, 1240 bp, Bovine  19866881809440
ctgaagtcctgggggacatgacttgtccggtgcccagggagcccgtggtagaaccagaactgaccctcaggggtcctgtgcccctgccgagtcgacccttccctcctccctcagcctctgcaaagacaaggactggttctgaaaagtcaaacagtccctgctattgttccaaggttggctggaggtggaggtcagaggttttggagtcattggaaagaagagggatggtaacgaggaggaggggggtgaagcaagaaaacccctctaatggccttatcttggttcccctcagggagacccagggatccagggctaccacggccggaaggtaagaaggaggggaaaggaggaccggctctccaccaggtgacaatccacgtagggcttcaccacagtgtacacagggtctggacttggtccatacatgcttttgcacacacatcagcaggggcctcaaaactctcgaatttaaatgatcagggggtttgtgtctccactgaggaagcaggaggctcagagaaggaagggccttgggcaagtcagtggccctgctgggcctcaggccaggaatgtgtcccctgccaacccaactggccgtgtccgcacagaggcagaccaggttctcacctgccccctgagagcttagtaagtggagaccaggcagagcttctgggtatggtaggggatatggatggtcccaactctgctgtctggccactcacaggccaaagagacagggttcctatgcaaataaccctagtgaaggcaattgcactaaccactaccatcccaaagcaccgtgtcagtattggggtagggggttcagggaaattcattctaggttgggaggatctcgggaagtcgtctgagagaggacagcctctgagttcaatcctggtgaatgggtaagtgtatccgttatctattgccgtgtaacgaaccatcccaaacttactgtcttaaaacaattctttcccaggattctgtggcttggccagctgtctcctcggggctcactcatgcagtcacatgggatgatggctggagaggccggggggccaagacagcctcgtccacacgcctggggctggcgctagctgcggcctgggctcctctgttctcctccacgtggcctcccagcccctagtgtagggcggatggatttcctcacagcacggcaggcccaggtcagccttcaaaacaggcgagtcctagtgcacaagggcttttcaaaaagcat

SEQ ID NO: 28006 - DNA, 981 bp, Bovine  19866882110530
atccccaattgattgattaattagttcagaggatggggtgtgagcattccagtcagtaggaatagcacatgcaaaggccctgaggtaaaaatgagctcagtgtctgaagagaaagggtggagccgcctggtggagctggtgaaaaggagggaggtcatgcctccagaagggcacagctctggcctgtggggtttgtaaatttcatcactggtgaaccaaaagttttaaacggggagccgcacacttcatgtactattcatgaagccgcacacttcatgtactattcaggtagggagagaagagcctactgtggggtccaggtgagaggcggtggtaacagaggatataggagaagaggagaggcctgggctgtgttttggagttgacattggcaggccttgctgctgggccgtctgcactgaggggagacggagaagcaaggcaggacgcacagcttttcagctggagcactgggttgtgtggggcgtggggctggagcgtggctgaagccctaagtgccgggttcctggaggcacggcagcagacctggaagaagagactggagggagagtcagtggccttgaaggcgccggctacttaaggatcttatcattttcacacccccagctgtggcatctgttgactggagtgaggagttggttgaatggcctggtttcacttccagttcatcagttcatgcccgggtttatcaggtgcagagaggggctgggtttgggaggagggagagacgggcctgtctgtatagttgtggaacacagcttgttggctggtgtgatgcaaagggcccccagagtaaagatgtcctgagttccccttcccaccacacggctcccggcgcacttccttctccactgactcccgcctggctaggatgaggggccccctttgaaacttgagcaaggtaaatttaggacaaattcagggaagtcctgcttctcacagtaactcgggagctcaggg

SEQ ID NO: 28007 - DNA, 1928 bp, Bovine  19866880482506
tcaatttgactgatgttaagtgtaacataccccattaaaagactttggaagcttggggtaacccttagaaatattctcccattacatcttccctgtcacaatattgtatgaccaagacccaggttagactaggctgttacaatattccctaaaatcaatgtcctaattaatctctaagagtaatgtgtttttgacacagataaatatattggtatacatatcaatatagtacatgtatattatatgtatatgctcaagtatacatttatgaatatattcttacttgacaccattaacctcaactgaagtccacctacctttcccatccctacaatttatctcagtttaggtagtgcgctccccaggaacatttttctgagcccttacttcaacgcttctgaagtgccatgtacatacctctgccactgcatttgcttacaactgcctgctttagtcagtctgcttgacttaaattattctataagcaacttaaggggacaggccatacattatccatttgcataatcactgagacatgatagaagttcaaaaatagctggctgacttaaacagacatttagtcatacagtaattactcaaggtaaagatagatggtgatgtgcactggagaattcaataaggaattcgggcttaccctgtggcttcatacctttactggtgacagaaccatcatacaagtgttcagatttctgcatttttcattcagtggtatctacctctagtctccatttccattattatcctgtattacactaatatgacttatggtagtctagggctcttcgtgcttggagctagaaatcaaagaagctattaggaaaaaaaaaaaaatcagagcagtattaggtagcagtccagaaaatatgttaagcagacaatatattttaggctgtgtacaaagactataaaaggaaaaaaaaaagacaaaaacaataaacaaaaaaaaaagtaaaatgaatgcaaacagccatggaagcaagcaaacaaactacccaacctacttctgcattcttccactttggagaaattgcaacattagaaccatgctggccaaattaggcctcacacacagattccattatgtaagctcactgattgcttgatttaacccattggaagcaccagaatcttggccacagtgttagtttggttgattagtcaggtagctttctttaatatcacctcaaggggttgtggcttttggcaagaacagaactaatttcagcttaattgccacataaagttttccctaaagcacagaagccactgaccttatgctgcttcctatgacacacttttcaacatccctcctgagtgtaatgacatatcctgggttggctgtttaacagcttatgcctacagtagatgattttgtcaccactgtcattttaccttgcctgcaaagaggaaaaatgtcaagagtctaaacctcagacctctgaactcccattttgttgtgtttgaaacaacttccacaacttccagtagctgtcctttgtccttcacagggattcttagcacaggatgattcaaacgctaactcttcttctccaaagtcctttcacctgagtgtagtctctcctccctgcaaagtagaaaggattagtgtatcttttcctaaatatagcgttcattttcccctctccaccagtgccttaaggataaaaaactatgttttatacacctttgagcttgctacaacatgattaaacttctatgttctattgattctctacttatacatcacaactgtggttccctcatttgttctaagaattctgtggtgtataatgtctttgtagtacagtttatggtacttgtgtattcctatagtgtttggcaagctcagtaggaccacacttaattatttgtattactttcaaattttcaaagaatctgggaagaaa

SEQ ID NO: 28008 - DNA, 4084 bp, Bovine  19866880522678
tttattttttccctttactggaaattccagaaaacttgagggggagatcctgagcatcctggaataaaccaagcagctgaaagaagaccaggggctatggtaaggtgagtgcagctggaccctggtgccactcaagatgagagctgagtcctacacttttagcgctaagaacacagtctccttacagttggtgtgagtggtagagagtattgtgggactcctgtgaaaacaatcaagtcacctgggctgacaaggacctgagacaaccacagtcatgaagaagaggaaacacagacaagccctggagaccagctgcagcaaggattctcccctcttcctgggaactttcttcccagcctcctttgcaactcagttctagtcaattccaggcctgtccccttagaaacatcccttcagctcattccttcccagttgcaatattttggggaccacattttcccgatggtgcagctacaaaaggaggaggatttgtgagtaacattatgttaagccactggattgcagcattaatttgttacaggagcataacctaatccactctgattatattccctctgcaacagagacttgtcttgattggtataaggtgaattacctacaaatgtactagaaatacagattcctaggatccataccaagtttctgacagatttcctagagttcagataacctggggtgtagtatgtctggtacaaaagggaatgaaaaatgtcaagaaaaatacctaatgaggaagctgcaggatttctgtgacagtttggttgaagcattggagggaaaaaatgtcaaaggcttctagcttgagaggctaaaaaaaataataataaaataaagtgacagtctgaagggttcattttagagaaaaaggcaggtttgatttccaggttcagctgcgctaagtctgtacagttggcagactgggcacacggatgaaggcaggtctgtgggtagggggctggggtgggactcttgcagagagtttctgagctcccccaggagtgagctggtagaaggtgaggcctgagcataaagagatgcccacaggactcagagaaagtggagcaaagagcaggcataaaatagtttggagggcagtcaggccagcagttagtggcagcaccagacatgagggcggggtgtgctgaggccacagctggcccccctgtaggcccagatctttgggccgccatgaccacagctcaggctccacagcccacccccattccctggcccttgctgtccccctcctgctcctcctcaccccacttgggtccatctactgctctttctcctctgctgaccaatcaatgccctttgtaccacttggtctttcctgggcgtggcctcctacccacagtgccttccccaggccccttctccccaaaccagagcctagaagttctgctacccctctgaaccctggatagcccttctggagcagggtccctcctttcccttatctcctccagaacccattatttgtccagtggttcccagcaagactttgctgtcacatttgtggtcgccattatcttcatctactaaagatcttagtgccatggggaatggccttgtcctggcccctgaggggagtataaaacattatagggaccctatctcagtctcaggcttccctggtggctcagacggtaaagtgtctgcctgcagtgtgggagacccaggttcgatccctgggttgggaagatcccctggagaaggaaatggcaacccactccagtacgcttgcctggaaaattccatggactgagaggcccctcagagcctggtaggttacagtccattgggtcgcaaacagtcggacatgactgagtgacttcactttcacttttctcctgctcttaatatagtgaagtactgtgcaccagttatgagaaaatataaacatacagtaaagagatagggaggatagaaataattgtattcatttacatgtaaaacaaatttaagaattaatgaaatatataaatattcaggcacatattgtatattaaaaacataattacaatggaaaatgtaagggtttatactgagataattggcatgtcaaacagtataaataagaaagaattcacagctaaaaacaacagttaaattaaaaaaaaaaaaaatagatgaagacaaaattccaaaaaccttctgaagagtgtaagctataaataataagaattacactgacatgcttctcagtgaaaatactgactataaaaagacaatggagtaatattttcaaaatatcaaaagaaaataactggaattttgtatcgagtaaaataacttgaatatcaggaaaaataaatttattaagtattaagggtcatattaagttcagaaatttaaccaatccttattcttagaaataaacttgaagaaatatctgaatgaagggagaaaaatacatgaggacattataaaatatgattagtgagagtgactaagaggctaacaagatttgctattttattaataaacagtcacaaaaaggtaatataggtgtattagtgagcgttctccagagaaacagaagcaataggttaatattaatacattatataattttatatattatatatccattgtatatatccaatagaatacaaacccaacatatactggaatattactattccaattttctgctagaacaaagaggttctggttcagggaggtagctataaactggagacacaagaaagagcctaagagcggggagtccgatggattccagtataggactaaagatttgagaatctaaattgctgagggaagaagatggatgtcacaattcaaacttccaggcagagcaagtaaactctctcttcctccaccttttagttctcttcaggtcctcagtggattgcatgatgccgacccatgctggggaaggcaatttgtttgactcgttactgattcaaatccctggtccttctggaaacactaattcacagacacatcctgaaataaacagacatctgagcttttaagttggcatataaaattaactatcacagtaggtataaaaatactgaagatagattttatgtaataacagtacaatggatttggggattttcttagtctgttcaggctgctaaaagaaaatactacaatagttattgctcagagtgttggaggtcaggcagttcaagatttaggtgtgggcaatctggtgtctggtgaactgtgtgtgcatgcttttcaggaagaaataatcatgaccgatttttccaccagtagaagttctgccaagtgaagttcatctgaagtgctatattcttctaactagggaactccaaatgatttatcacatgtgagatcctaagaaacagtggtgatatttttactttcaagtcagtctgattaatcacaatggaagaaatgaagtaaaggctttggaatgaaggcccacccatgagatattttccaatagtaagtgtaatatattatgtatgaaggagaatcaaaataacaagaaagaatgccaaaatacttaagaatgatatgcagctccttctaatcttatagttaattatttaatacatttggttctgaaatgcctaagtattaaatcacacatttttttattcaaaagagttaatttgttagagagtttaaactctctcaaatgagaatatatatatataaataacagctggcattataaattttaatctcaaggaatttgagtatagtatggtggtggtggcgacgaaaggagttaccttgtgtccgaggtcaggggcggggaccaggaggagataccccatgccccaggcctgaggccaagggaggcggccaggaggagcaaccccacgtccaaggagccgtggctgcacgggcgcaggagggcctagaggagctatcccacgttgaaggtcaggaaaggtggtggtgaggagataaccctcatccaaggtaaggagcaatggctgtgctttgctggagcagctgtgaaaagataccccattctcaaggtaagagaaacgtgagtaagacggtaggtgctgcaagagggcatcagagggcaaacacattaaaccaactc

SEQ ID NO: 28009 - DNA, 1567 bp, Bovine  19866880607838
gtgtaactaaattaaggtgcttgagatgagatcatcctagatttagggtggaccctaaattcaatgagaaatgtccttataagagagatggagacagaggcttgagacacagagtcacaggggagaaggccatgtgaaaacataagaagagattagatttatgcccccagaagccgaggaatatatgaaggtattagaagctaaaagaggccagaatggatttttgaagggagtatgggtctgacaatatcttgattctaaactggcctcctcaaaactgttaaaagaataaatttttattattttaagccaccagacttgtggtagtattacagaggccctataacactgatacactgctactccatatgaagattatttgattgattatgattaaatatatacattaaagataacaagaaaaatagtgaccaaaatgcacaccatgattcttggcaaagaactgcttctgaaatgacttttgtatttttaatatttaattctttggcaattacaactgtgaaaaatatgtatttacatatttttgcaccattttattggaaaattttatatgaatgctagactggaacagaataatgcaataaagtcataaaagatacaggaaattacagtaggattttataactcatggtataaaacctgttgaaaatgcagttgcaaaaatctttactcaataatttactcaacaattatgtatggagtagctatgttcttggtttacagatctttatgatcaaattcttaagaaagatgcaatgagaaagccaattctacttttggaaagaatcatggctccgcagaacatatattggtttgtcaacattttatcagtgacttatatatgtggaacagaaatatctgtttaaaaaggtacatgcttttacaatgcaacaaagcatctcacctttattgcaaacacagacaaacataaattaccactacacacctaggcaaaggaataccaaaacatgcaccatttcctttgaacattctcaagtaccttttcatgcttgtccttggtagccaagtacattaatccacgttagaaccattgcaattgatgactcaagacttggagttttgtatttatacatttacttgttgttgttcagttgttaaatcatgtctgattctttgtgatcccatggactgcagcacatcaggctttcctatacttcactatctcccagagtttgctgaaattcatgtctattgaatcggtgatactatctaaccatctcatcctctttcaccctcttctccttttgccttcaatctttcccagcatcagggtttttccaatgacttggctctttgtataaggtggccaatgtgttggagcttcagcttcagcatcgattcttcgaatgaatattcaggactgatttcctttaggattgactggtttgatctccttgcagtctaggggactctcaagagttttctccagcaccacaatttgaaaggattgattcttcagcactcagccttctttatggtccaactctcactttcatatatgacttctgggaaaaccatagctttg

SEQ ID NO: 28010 - DNA, 620 bp, Bovine  19866880705711
atattgtgtaatgagattgatctcaggtgccctgaagccacatctctggattctttattcatcaacatctattcagtttagctgggagacgagtacacgctaaactgtaagcgaaacctcttataaataagaatgacatatataaaatgtccttataaaattgaagtttaaatctaagttatcttctattttcgaagggaagtcattaatgttcaagaaatgaaattttctccccaaatgtacaaatagacaaatatttagccttatatttaggattcttatgtaatcgaatgttgagattctacaattgctgaggaaattattcacatgaagaggtctaaaacataggcttattttccaaaacaatataattaacaataaaactgttgacaaagtcaaataatgttgtcatcaaaggatgatgttttaatataaatagttacctggaaccacagtagtgggcaccttctcactgatgctcttaatgcaaacaaacctgtattatttcagtgtcctgaaagatggaatgactttataaataatcatttcaaagaatggaatctttatataaatacctgtataatttgtagagttaggaatgtaacatattagctataagt

SEQ ID NO: 28011 - DNA, 1115 bp, Bovine  19866880751726
tccatatatttataaacacacacccagatacatgttcactctcctcctacattctataatattacataaaatgttattaaaagtgtcaaatctgaatgaatctattattattcttggactctgagtctttaaactttctaatatgtttatgcctaaataattcaccaagcagcttaaacacaagatttatctcagatccaatagatatggacctctaccctttcatttgtaatgaagagcagattaaagatttcactaatgaaaatgactgagataatccagaaaagctaaaacagaccttcccaataaacaagccagctttaaacattgttaatctgatgaggctagagagagtttaattaaaattctatcttccatttatctaatattcatggtaaaatagctccttaaacacctttctctttaacatgattctttttcccctctttggtgatgaatggaaaaaaaaaaatgaactgaaatagaccaaaaccatttcagtagctctattattataatttttggtagaaatcacagggcttagttggtaattaagatgaaattctgctcagtaacttctttgggtctcccatgtgtgattgaaggtaatataatgtgagaagttttattatctgtgcaataattcagtactagtagatgctgcaggatgtagtgtaacaacacgtatttgcttatttgattctcaagttagtaattctagtaggtgacgtgtattagtagtaaggaaataaaggtggttactaggacatggaataacagactggctccaaattggaaaaggagtatgtcaaggccatatattgtcaccctgcttatttaacttacatgcagagtacatcatgaaaaacactgggctgaatgaagcaaaagctggaatcaagattgctgggagaaatagcaataacctcagataatatgcagatgacaccacccttatggcagaaagtgaagaagtactaaagagcctcttgatgaaagtgaaagaggagagtgaaaaagctagcttaaaactcaacattcagaaaactaagatcatgacatccagtcccatcacttcatggcaaataaatggggaaacagggaaacgggacaga

SEQ ID NO: 28012 - DNA, 1583 bp, Bovine  19866880778550
tttctatcggatagctatacaatcaaaagaactttgtagtcaatctattaaactttctatttgtcctatgagatttagaaaagcatagtatttaagtattgtgcataatataatgaattttaattatcttgaaaaagcaatgctacattgaaaagtaatttaaaattaattctcagttgtaacttggttgattcaaggagaaaaagagatctctttttctctgaacatctttatataacaaaatggatattgctgtactacattttcatctccttttcaaatatttataaccaaagacaaataaaacatggaatgaatctttgataatattcgttttgcttgatttaactgttcttaaagtccaagtaaatgaaagattagtaggaagaggtggaggaagaggacaaggaatggaaactgttttgtgttttcgagtaatgacatcaagaaaaaatacaatgtactattactacatcaattctgtcttagcagagttatatcatagagtagttacaacataaagtatttttgctctgaaattatttacagcctaatcattaaggtctaccataccaactttatatagtttttaaggtccaaattctaaatgtactataatacatataactacatgcttataagacaacttttgattcattgacaatggctttgagttaatgatttcataaatataagttgatacataattttgcaatgatgcttattattcctggtatcatcatacaaaggttgttatggcttgaatatttgtatactcccaaattttacatgtttaaattttaatgcccaatgtattgttattaagaggtgagtcttctgggaggtgcttaggttatgagggtcaagtcctcattgatgggattgttgtttttgtttagttgttcagtcatgtccaactctttgggaccttgtggactataccctgccaggctcttttgtctaaggaattttctgggcaagagtactcaagggggctgccatttcctcctccagatgatcttaccaacccatggattaaatctgtcatctgctttggcaggaggattctttaccactgagccaccaaggaagccctcatgagtgggattattaccctttaaaaaaccacagaattctcctgccctttccacaaagtgaggaaacagtgaggagtttgaagtctacaacctagaaaaatgtcttcactacaacctaaccgtatcagtacaccttggacttccctgactccagaattatggcaaataaatttctattgcttataagttacctttcctatggtattctgttatagaagtctgaatagactaagacaagtatgttcctgtgttgaaatctcacctaagatagaatctagtaactatattcagttttggcaccagggattctcaaagtagacaagcttattctccagaggttcctatttatttattcatccagtattcactaaacatacttagaaataaacaaaaaaaaatctgttgcatacaaaagaatttttcacatatgtatagataacagtgggactcaaagaaatgagaaatacagtgacaatgtaactgcta

SEQ ID NO: 28013 - DNA, 1132 bp, Bovine  19866880836957
tagttgccttaggtgagttactaggattctctgatttttttatttttttttaacctaagaatagagcagagtctaatgccatgaggtctgatctgagaaccaggtttaaagcctgactttctcatctctgcatcctctgggatgcagtttcctcctccagcaggcaactatgtacatattatttaacttctctttcctttcttcatttataaaatgaaaataatagtagcatctactgcaaagggttcttgagagtattaaataaattattacatgtaaacccctagaacagtatccacactagcaaaataataattaaaagttaactgttaatgacaggtctatgaatggttgttggagattaatccctattaacatggaattaaagtaataaaaagaaagatcatttgaaataaattaaatctctgaattagaaaaaacagtttaaaaagacacactaaagtgttgctgggaactacacttcttacatttgaactttctagtctaaaatattttttctttaattgtgcaaaatgcactatatatctatagctagagaaatatatatgcaaatacaaaaacaatttgggagaaagaaacacttaacatgaaactgctgaagcagaaatacatttagtacatcaaataactgaaaggaagtgttgttttattagagtgcctctaaaagccattagacaatttaaagatggttcatttctttaagtgtacagagactgatgcactacagaaagttcaggcaaagcctcttcaaccatcttcctaatgccacttttatttataaatagattattttctggagaataccagggacttaaaagccatctattaaaacctcttagctgataagattaaggattttccttaagataagaatattattccaaaaaagttggaaatacattttaaactaataaagttattgctgtcatatttttgggggggggatatttcacccttggtataagactcaatcctcctttttatgtccagaaggatattttttaaaaaacctttttagagtaaggaagaatagtaagaaatgccctactatcaattttgaaaaagaacaactgaaaagcctgttgaaacctaaatgatggatgatcagtgg

SEQ ID NO: 28014 - DNA, 1467 bp, Bovine  19866880917549
gctatcattttttcctgtggtcatgtatggatgtgagagttggactgtgaagaaagctgagcaccaaagaattgatgcttttgaatggtggtgttggagaagactcttgagagtccctaggactgcaaggagatccaaccagtccatcctaagggagatcagtcctgggtgttcattggaaggactgatgttgaagttgaaactctaatactttggccacctgctgggaagagctgactcatttgaaaagaccctgatcctgggaaagattgacggaagggggagaaggggacgacagaggatgagatggttggatggcatcaccgactcaatggacatgggtttgagtagactgtgggcattggtgatggacagggaggcctggcgtgctgcggttcatggggtcacaaagagttggacacaactgagtgactgaactaaactgaactttatttctcttatccaaatttcaaaattgaagtgaaatatatttagattgttttacaatgccaaactaagtatttcagattgctgaaataccagaaagataacaaatctgttatctgtcatctattatctgcttacctttctgtctccctgtcatatcagtatacttatattttctttttattttttttttttaaattgtcctttacatttggcctatgctattattagatgtgtttagctttccttttgaagctactatagtacttatttcctatagagctctttgatttaacacttgaactcttaaaaaggtgtgctatgccatatgtaatcacactcagaatatgtgaaaatttccaggccatggaggctaaagtacgtaatttaggaagtattctttctcagaagagcaacatcaaaaatcaacagtgcataaactaataaatctaaatcttatttttgcataattctcccagagaccatcactgagattccttatacaaattttgcaagcaatatattaagaccaactagttactaaagttgtatgtttctttaacttggcagaaagtattccagagttaaaatttctattgaaaatgtcatcctgaagaaggggttatgatgtcttaagtgatttcactgtccctctggatctgcatctaatgatacctcatttacttagctctctgaataatcaagctacattataacaggcagctaacttaaacagaagaaaagagactggcacagttcttggggaatgaaacagttctggcagtcaacaggttaatggagtgtaaggagtagtgttttctctcctcagtggtaactactacctagcaccaggaaaggctatttagaaacctaagtaggtcagaataggcttccagacatatagcagaggggaaagcctgatttccacaactcaagcagttggcgaaccccctgaagagaagtgggtcagttgatgacggagagtcctgaattaggagttctttccctgaattcttatct

SEQ ID NO: 28015 - DNA, 1203 bp, Bovine  19866881368939
aaaaataatgtgtataaatgaatgtaatacacattcaatatacacacacacacacaaatacacagaaaaaagctaaaagtatgtttgcattttgttaggtcataggattaagtgctttattaattatatttattttttaattttctctaatgttgttacttttatatcgaaaactagaacttaggacttaaaatatgatactgattaaaaagcaaagaagataaagtcattactcataattctgatgctctgggattagagactttcaaaaatcagaatcagtagtggaaaaagtatagtgttgctgatgacatctcttacaatatgatcaacttcttcaccactcagaaactaaaatgaggtgaaatattactcttggaccctgcaggatctattttgtcttcaaaaaggaaatacaggctctccagcctatagttttagaagcagaaaagtatactgtcctcgagtctatttaggattatggtgtttttactatccctgggttgggaagatcctctggagaagaggacggctacccactccagtattctagcctggagaattccatggactgtatagtccacggggttgcaaagagtcggacacgactgagtgactttcactacagtttaaagattccttcttttcttcattttccaatatggccatgataaagactaggaattcttattggataaatatatgacattcatttgagtaatagtttagatgttattattgtcttaagcaaagagttatgaaaataaggagaaagtgttatgtttcactttggagattatttgctgaatgaagaattcacgattttaactaggcagctgtcgtagctatttacaaaaatgcagtctccttgtagctttaattgttaagaaaatcaacaagacaaatatattttgtgcttcaccagtctttctaaattatctgttcaaattaataatgtgaactgaatgaaagggtgaatgactacatgctaaaaataaaatttaaaacagtcaaaaaacatgggtttctatagccagaaactgcgttatgtacatgtaaaatacttttatacaaacattcctataataaccattctttttttcagaacagtttgccattaaccatggtaagtgacatttttttttttttttttttgccaagatatgtgggatactttgagatcaattcctgtaaatatcagtt

SEQ ID NO: 28016 - DNA, 734 bp, Bovine  19866881595411
acacactccacaggcagccatctgtgctcctgtctttaagttttatcctacaagtcttttcctcatgacactgctgccctattacataaatcacagggacattcaagcccttggaatggaatcagaaacccaccaaagctgactgctgtcaggactcataaggagtgcaattaataaatttattatttaggagtagagctgttttcattccaaaaattcatgcaaaattggagtgttatccagagtacatatcaaagtaactaagctaaaagtgtcttttcatcttcaagttcacccatttgacagtcattatattttctgcttcatctctgcttctgtaagctctgctggtgtcagaacacatcattcattcattcaatcaacaaagatctacttaatgccagttttcttgtgtgtgtgatgaacaagacaaatccctgccatcatggagcatatgatctagattttaaaatttatttctgtacttgaaactacaaaggtagcagaatttataaagctgaaaagaaagtaggtaataattatgttaaagagaaataaaatattaaaaattaaaaatggtaaaactggcctgccaattagcagaaatgcaatatgatatagttaaacattggctaaagcaaagtttcatagggatttatagaggtagtgtggtcattgagatgtcaacataggttgttccgacttcagttcctctcacaagtagtgtgtgtctg

SEQ ID NO: 28017 - DNA, 744 bp, Bovine  19866881616027
atgttggcagtttgttctctgattcctcttctttttcttaatgcagcttttacatctaaagttctcgggttgacctactgctgaagcctagcttgaaggattttgagcataaatttgatagcatgtgaaatgagcacaatttacagtagtttgaacattccttatgtaactgtatcctatgttgacttcataggacagttcatttgtttgtttgctataattggaagataattgctctacaatattgtattggggcagttcatatttgagtaaagttcttaaaaattcatcaacttattattttaagtttatgcttaatccctcatgtgtgttttgttttgttttgttttgttttgtcttctacttaacagagtgtccattgtcgattcaactttgggcccttactgtctaacacaggaataaacacctacaaggccattaattaaaatttgttgactgggttcaaaggttacagctctcttgatgctcacattcagccagcccctggtgtccacaatacagcactgttacagagaactagctctatggtattgaaagaagaaaccacatgctgagttagaattagccttttgagcatgtaattcataattgaattcataaataaattaattacttaatagatttttaagtttagagaaacataaataaatatttacaatttgttataacctataacttggcactctaaccttaaaaaattaagaaataggaagatctgtgccc

SEQ ID NO: 28018 - DNA, 949 bp, Bovine  19866882145273
ctctgaactgaagatgtataattcactttacagtttactttgaattgaaaacaagatcttattgaactctagtcattccaatgtattttaggtttcccatgtaatataatttatttatagaaattatggtatacttgaacatcattttttctgttgcatttatgctaaagcttcaatgattcaaagaagtcagatctaaaaagcattactttttgcaatttccttttcctaggatgaatggatatccaattttagtaatattatccaacagtattcaaataacagcatcaatttaaaacatagttattactccttaaaaatcaagtactaaaatatacaaacaacaaaatctttgtcaaattgtaaatgaaatgaattcacacaaactgttctcgaaactttctaacctaaggaatttgatatcatcgcctcaggttattagatttagtgactgcaatatacttcctaggagagaataagacagaatcagccactttttgcctaaggctgacctaatagtgctcctggcattttcttgtttgttttttaaaaacacttcacggggtcttatacagaaacgaagtttggaaatctatataaattaagaatgatcttttgataaatttgtcttttactacatcaaattaatctagctggacagaatgtcattaaattaaagactatgttaggaattatacgaagtaatgctatttagagtagctgcactttgaaccatgggttattggtccaagagtagctaggcactgagagaaaacataaatcattgcttccttttttcgagaaagtcttgatattaaaaaaatgtccgctgaaatacatggtgtgtttaatgcaaagcgatttacatttttgtacaagctctttatctccttgtgaatcatgacaaatatttcagaatcattattaattttcatatttgctacattat

SEQ ID NO: 28019 - DNA, 1511 bp, Bovine  19866880389633
ctggggttggggcttccgtcctgggcacctggctgtaagatctgtcattcaaggccctgcacagccgaggctcctggcatggccccaccccccaaccttggtcctgctggccccatgagagatgcctgggtgcatgacagcagaggatccaggtccccccagggcatggatgggtagggcaatttctcctggccaggttccagctggctggtctgtcgcacagggctgggaggtgaagcagggctctcgcttctggggctgctcgtgagggtccttctgatggcaggggccccttttggtgggtaccccccacccactgagacccatactggcagggcccacactggatctgaaccatctaacacccctgaccccaaatgcaaaccaagtccacaaagatagagaacagaggcagagaaagcagggctgagaatgtttattttcatgcccaaaaagccagcacagacctggcagacagcagtaccacagggcaaagagtgaaggcagcagtgtcagatggagccaggccctgtgccaggagggcagctggggccaggccagcaggaggctcagtccaggggcagaaaagggatgggtgaggcaggcagaagctggaggcgccaaggggaggtgccctggggcggaggaacagcaagaaagaggcagagagggcagccggccggcgaggaccaggctacgactgcacgttgagcacatgggcagagcgctggtggtgccagtcccggaggcgggtgtagcgtgggctctgcagctccaggacatacttttccctgaggggcagagagagaaggaggaggaagtggaaggaaggagagacggaagggaggcagggagggaggaccagaggaaggaaggagaaaggatgaacctggctagggatggccaggagcagacagggctggaatgggagaggccggagatgagaaggaggggctgcagcatgtcctgttaccttgatttcttcaggtgctcctcatccgggtcttgcactgagagggcagaggcagactttgaccaagagcagacagaaggccaccccagccctgagccctggtagagggtgccagagccaggctccagctaagcccgggtctgggctggggaccaggagcagagtccgcccttccctgggctggcacttactgaactcggtgcctgtgaggtgggcgaggatgcggaaggaacgggactggcctgtcccaggcctcggccgccagtcctctgtgtcctccatcagccgctgcttgctggcatctgggaccagcggtcggagcggctgtctgtggggagggtgtggctcagaacctcatgctggggtgggcagcaggggcggcccctccccggacttgatacaggtgggctagagtgatgggaggacggcagggcaaggctagggccctgctgggtgaggggtggggcagggaagtgagaggggaggagggcaaccaaggtgaaaggagggcagccagagtggggaggggccaccaccc

SEQ ID NO: 28020 - DNA, 2812 bp, Bovine  19866880477455
tagatgtatgtatcctcagcttgtttataaacctccctgtgagggctgagagctggtgatagcttggttatcagtgatgttttggtgaatgggcagcatgtcccaggaatgaactggatgcagacctagctcttgagatgttccttgtcagacaggtaaaagaccaaacaggtaactgaacacctccagttactccttcaacaagtggtttttgagctaccatatgccagatgatgaagacagatgtagcccttgtgatgcacgcaggcgactacagaacattgtgatcagtatcgctgggcttctcagccatccctggggcgtgagggagctggacgctgacacgtccagggtggtgacaggtgagaccaagaggctgaggagcaagagctggggcgagagcagtgcggccgtgttgcagctgggttcatagaaggcctgggggaaacaggcagtgtggagaacggcaggccaagcaggagcaccgtgtgcagagaaactggtggcgatggtaatggaagcccaggtgagagagaacagtggcttggccaagccagcagtgacagggggacaaaaggaggtggacagatgaagacacacaacagtgagggttaaaaacaacaggatttggcagatggtgtaaatggagggctctttgtggagataaaagagccagcagcagatcttttggggtctaaggttagggtgctggaattctttatgcagaggaacagtgtgggaggtatgcacagcagtgtaccaggccccagagaccattaatctgtctgagcaaagtgttctcatctgtcaaatgggcagaatgctcccctagtttataaggtaactgagagaaaactctgcagcatccagccctggggcgcacacctctgtaccctcagctctgaagctgtgggcagcagtgctcatgttttggggtgtctctaagccctttgcctggattagcccactcttctccactgatgaggaaactgacacaacgtggcacccccccgccccccaggctcactcccatccccccgctgtgctcccagtgagagtatggcctaagaaaaccctacaatgcaatatactcagaaactccacaaagaaatcaagatggaatcctgaaaaatgtctaaataacccacaagaaggtaagtaaagagaatgaggaggaaacaaactgaaagcaaatcataaaacagcagactgaaggatgagcctggctgaaggctctgctcccagcacacagtcggagttggtatttactaaggaccaggcatgtgtctgcaggggatggagaaggtgagctgctgtgagcaacaggcagagggtctgcatctgaagggcttccgagacccaccaggagtatgcatgaggcgtgaagggataaaggaataaccctttggaaaggctttgagaaacttggcttaggaaaagcccttggaaaagtctgaatgaatcctttgacatttatatagtgggcacctactgtgaattagatgagatgttactgagcaactccctctagaccaggagggaagctcaggcaggattcctgccgtctgggcctgctggaccaccaggatgaagcagcagccccagaagcatttgtcattgctcccctccacactgggcactggagtcagtgtgaggtcagagggccaactcggctgagactgtatgcagactttctctctcagaaccacggtggccaagtctgtaaaattcagcgatagttctgtcacttggctggtatttagctaaatagaagtaaaactaccctccaaggcctgtctactgcatgtcagggcttgttctatgcctcttctatgatcttacatgatcatatgtgatgatcacgtcttacatgatcttcagcaccacttctcgctgggggtcatatccatttgatagactagagaggcgacagtggcacctagcggatcttgggtttggcctgtctgtgcctctaatgccaacgagctgaactagacccctcagggcagtccctgtcctttgttccttattaaccctagagctgccattccacctctctttcaccctgtagccttttcccactcttgaacagagggctggtcagcagaactaccaagttttggtgagaaggtacagaaaggtgcattttgactataggctggccagtgtggccagtgtccccccacaggtaccaaatctcctgtactgagtgttcacacatacttatttacgtctcactcatcatttaggagagagttttcaacacagactttggattcagagtcaggctaaatcctagctcttccccttattagctgtgtgacctcgggcaagtcatttccttttctaagcctgtctcatccatcagatgggcatgacccccacagtaggaaggtggtattgattacataagattattctgcatggaaggagtctaaaacgaggcttcacacagcagacagtccttggcatgtatttctaattcagctaaactccatcacctccagccccagaagtgcttctgtgacccagagctgttcctgccctgcaagccaaggaggtacctagttagtgccagcttcatcagagcactcctgaaaattcctgtgggctcaggaaaaggagaacagatttaattaaccccaatgactggcagcatcgtgtttttatctgggctgcgtcgccatggcagcctcatggtgggggttgtgaagggggcgggtgaagctattgttcctgccgttatctgttctgaaatggaggcccaggagaaagggactggcacgggcactaaggggcacatggcacaaaa

SEQ ID NO: 28021 - DNA, 2049 bp, Bovine  19866880607892
ccaggctttctctatacactttgacacttacctccatcggagacagccaagaacctaccaagaaacccaaggcagaaagtcagagtagagccccggggggattctcaagggacagtttgaggcccagcccctgggaccagagctgtgttctcatctgcctggagggccacgctgggcatcctcagccgggtcactgcttgctcatggttttgttcaggctgccctgggctccccttccatcatgtgccaaccaccttgtgtgctaggacttatgccaggtaccctccagtcactcctggtagactccctagctcccattgggtgagcccggatgttgagcatggtgggtaggagcataaagtttgaatcttgtttctgttactagctgtgtgactttgggcaagttacttgtttgtctccatctgtaagtgaagggggagtgataataatagtgacttacttcctgtgcctgctgtgagggtcaaatcaacttaatatatttccagcatctacaacaggggccagcatgtggcaagtgatatatctatgttggctgttttctttgagaaaggagagattacctgtgtaattgatgatctccttattgtaactgtttcttcttggaaacaccctaccttgggcagggcatggggttctattttatagtagaaagcagtggttctcaaattttcgtgtgcattagaatgatgcaggggcacctctggagcttcaggttctcccaggcagtgttggtgtggctggtacgaacctcaccgggagtagctacagaggtcaatcccgccctctgtgccccctccctcactccccaccttgggtgcacaattctgacttctctgggaatcccaaccattagtgaaacagaaaaaccctcctttcaaaatgactcttgcagtggtttcccttggtcttcctaccttcctagcagctcctccagcttcctcattatctatacatgcaaggcggcctttacccttctctgactctgttctgggccctttctccctcccacatctccccagcttcaaacacgtatagccaacttcctgctgtgacatctccacccaaatgccccataagcccttccagctcagccagtcccaaatggaagccacttcctgcagccaccagcacatggctgggaaccagcttctctgcgtctggttttcttctcatcaccggggtttgactgatccccggttccttcctgccttgaccctgctgcattttcaccaggtcctgtcccaggagcttccaccacctgtcccttcactccatccctactggaaacacgtgtgcagatgtctcctccccaggaagcctccccctgccctcctggctggaatattcctctctgtcccccacttctacctgggagcaccagggtcacacatctgtgggccaaagctggcctgcaaacaggtaaggatgttattaatatcagaatgttttttttttaccttaaaaggggttacccacatttaagagtcaggcattttacatgacacccgggtttctgccccatctaccctgagcttcttcccaacacggcaaccctggctgttcctgagcaacaactggttcctctagaaggagttcacactctcctcagaggactctggggccagtttgatgcatttctgttacttacggaagaaggtcccaggcaacctgagttcaaatttgtgctctgtgaccttgggcaggatacttcatccctctgtgcctggcattctctgtacatgctaagttgcttcagtcgtgtccaactctgtgcggccccatggactgtagcccgccaggctcctctgtccatgggagtctccaggcaagaatgctggagtgggttgtcatgccctcctccaggggatcttcccaacccggggattgaaccctcatgtcttgtatctcctgtggggcaggcgggctctttaccactagtgccaccagacgcggcaaataatggtcctgacttcaaaggcttgctgtaattaaagaaattaaatatacttagagagaactcagagcact

SEQ ID NO: 28022 - DNA, 1415 bp, Bovine  19866880716485
ggatgcccctgcagagctcacctctgcctgctgcctccaaacctggaggctctggcggtggccccatctttcccccgggcctcttgcatcccattggtgccctccactaccccaaggggactgtcattccttctattccaggcttgaactggagagggactgaggagaggccccaaactagaccaggagaacatggtgcccccatagccacctgtcctccagggctggctggcatgaggaactttatagcacatctgaagttgctggcattctcaacaggtacttgggcctgttccctttaagagaagagcagggcctctatgttgtgtcttctcaaggacccctggagcaggagtgcaggactttgcatgtcactttcatgattatcttgctgcttttgctgctgctaagttgcttcagtcgtgtctgactctgtgcgaccccatagacagcagcccaccaggctaccccgtccctgggattctccaggcaagaacactggagtgggttgccatttctttctccaatgcatgaaagtgaaaagtgaaagtgaagtcgcttagtcgtgtctgactcttcgtgaccccctggactgcagcctaccaggctcctccatccatgggattttccaggcaagagtactggagtggggtgccatcgccttctccgtcatgatatcttacagagtctaaaacagtgcctagaacacagtgggtgcccaatgaatgtttgttgaacaactgaatgaggtgcctacaagacatttagacaaatccaggaagcagctgaagattcaagtctagatacaccttggattaaatttgggagtgagttcagggcagtcatcgcagatattcaaccattatcacagagaggggccccggcaggtcacatgaggagcaaagcgggtaggatgtggttttctttcaacatagacattgctggcatattcagtgaagagtatctctcacttccacaaggaagtgtactctctccctcttctcttgaaccatgaagacctcccagtccatccttggtttccatggatacaagccagcaagagcacaggggcggatggttaagtgctggtctgtggggagccttctgggggcagccgtgtgggaatgctgaactgtggccagacctgccagtttaccaacaacatccagagattgacacttttatgtgaaatttagtttttcagtgctggcaactaagatagatttttaaaaatcttattaaaaatatatatatatataccgtgggccaaatccagtgtgacgatggccagggccccagcctagagaagacatgagagatggggaagcagcagcaacatcacagggcagggcagagaaagcagaaggagccgccagaagtggaggagcacagcctcggagggagggagtttgggg

SEQ ID NO: 28023 - DNA, 1354 bp, Bovine  19866880769640
gaagcccaaaatggttggcaggcaggctgaaaacccccccagacatttcttgagtttatgtgccttttagtgtaaagggtcagaggaaagagagtcattttgagagagcaaaatgactttttctttttatcttcctactctcttcctgaagtgccatttgagactgcagtaaggtaagggaaagaatgctttccttcatgaaaagaggcaggggatcaaattgatgtgtaacttggcctagtgaaggactcccacgcgattgtggttgacttgcctgcctgcacaggtggtggaggaacgatgtgtttaccgtgtgaactctgataatagcggctggaccgaaatccgccgggaagcctgggtctcctctagcttatttggtgtctccagagctgtccaggtgagcagcgttggggtgctggggccaaagccatttatcatcgagtctgggctggggttccatgggcaactctgaatccttccccttgtcattttttgccaggaatttggtctcgcgcggttcaaaagcaacgtgaccaagactatgaagggttttgaatacatcttggccaagctgcaaggtgagggctcgggacacagacagaggctgtcaagtcctaactgccatgactgggccagaggctactctgagcccgccctcaactcatctgtaccctgagtatttccttcagagcctggcccccaggagataaatgtcctgagaagtaatttaggtcggttttcttggcattctctaaaaccagcccccaccctttgctccaggtgaggcccctcccaaaacccttgttgaaacagccaaggaagccaaggagaaggccaaggagacggcactggcagctacagagaaggccaaggaccttgccagcaaggcagccaccaagaagcagcagcagcagcagcagttcgtgtagccagcccaggccctgaagcagcagcctagcagactaccagctccaggccctgtgccccctcctcttgtactttattattaaaagccagcttctagccctctcgactgtctgggtggtgggctgagggtaggtgcccctgtttggcatctccagcatagccagctggttacccatatctgagccgggcttccttacccctgcatcgggtggctgaggacagaggcacagtgacttgcccacggtcaccgcatccaggtgaagtggtcatgaatgctagactgtaagctccatgagggcagggaccgttgttttatcctctgatgtgtcccaagtatctgaaacaaaatcttgcgtgtaacaggcactcaataaatacttggtgaattcaatcggacccagctctggagtcagaaagcttgaat

SEQ ID NO: 28024 - DNA, 1821 bp, Bovine  19866880881997
gacacacacacacacacacacacacataccccacactcctaacgggctcaggagcctgccatcctgtgattttgtctttagttgtctcagcctcaatttctttagccccaaaatgggttcaccctacttcattttcctaggggtgttggaggaattgaataagttaagagaatgggtttcaccagaacaggaagtcgagaagaattcctcatgttgactgagttcccactgtatgccaggcaccgtgctaggtaaggtattatccatccattatatcctttgatccttccctccagccaaataggggaggagtccttagctcccttttggtggtgacagagcaggcactcaggcagacagaatgacttgttcaaagtcacatagcaagtgaacttgaatggaagtgagccgtgaactctactctcttgggccaaaaaggggagggagagctcagggtgactgtctacagagtctgggatggctggtgctaatatatcagcccactttctgtctgcatctctctctctctctgtggcctggaaaagcggcaattcacctaaggtgagtatgtatgggagctggggctgggcattgctctctctgcccatttggccaggattgatggggtacttatgaagtgccaggcccaaggcaggggttggcgggctctgggatcctggattgcaaggctgggccaagagggactcctgaggccaggccccaccccccacctgcctgggagcagagttagggggaggggggtagacattgcctggtgccgaccatgttgttcttggatggcagccgggcccagggaacactggggctcttgtgcagaagggctgccgtaagcccctgcccaggccccactccagcacaggcctggccccatcctctgacccagtcttgtgctttctgttcttctttcttttggtttttcttttaaaacaattttcgttttgaagaagttttagaatatggaaaaagtacccagggtaatagattaacagttgctactcagaattgacaattagtatcactttaccattttttcccaaaccttttctggtttctctgacctcttctggaggtctggcttggcttgcaaaatggaggtgacacagctattgagtggtgaaaggctgggtgttagagtcagacagataagttatttgaatgctgaaagctttgtgaccttagataagtcacttaagttaagcttcagtttcattttccataaaatgggaacaacaactcttctgtgagggcgcaatgtgataatgatgtgtctaaaatatgatgcacacagctcatattcaggaaagaatagccaatactgatactcacaactatgggcctaggtaggacctggtccaaggtgtgggaaatatactcctaagaccagaagggagggactctgagggtcttctcttctccagtcctcatatctcctcataagccacccattgggcacatctacatccagtttctactctggggacaacaaagccaggaattacaggctgcccaggaccttggtagcagaggcagggagcctggtgctgatgtttgtagtctgggagagttctcagggaggccccctgaaccaagaatgatggataagaatggactacaagggatatgaggatccctctgggtcaatcctgctacctcccagagtctcagcagcattcttggtcccctcatgcctggtctcagatactgttagcctgtgtcttggcatattaggaccagaggtgtctgggggctttttgtggtttgccagcctcaggcctcccttagccccaagtctggaggtag

SEQ ID NO: 28025 - DNA, 1081 bp, Bovine  19866880907994
tgtcactgtctctcttttccctgtcttctacagaaatgacagaagaagaacagtttgctctggctctcaaaatgagtgaacaggaagctagggaggtgaacagccaggaggcggaagaagaagagctcttgaggaaagccattgcggagagtctgaatgtaaatatgctatgttgaaaaaatttgtgaggattgatcagcaatattttatttctgcagtgtcatggctaattaggaactagctgtagtaagtagttcatagggttttcagttgacaaatatttcccattatcatttttaaaatctgtgtcaaattgtgaactcaatttagtgttttgttaattctatatggaagagttttctacatcacaaattttcagtccatgtcttaagagaaccatagtatttggcagcttctgaaaagagttactgagtaacaagaatccagaagagagcaagataaggtgttactttccctgtattgtggggagaacaaagggaatgagaactagaggtgggttatgaagggacagaatgagcagtattaaaaattttcaaataatattacattgtgatttgaatatgtgtaattgaagttattttaaatgtgaaagatatttgccagtggcagatcctgagccatcctttatgccattcacttttctatattagaaaaaggtctagtatagtgatctaatacagtgctttgtacatagtaggcatgcagtacacattgtggaatttatttgaattgggcatctacttttttggagaggagaatcgcttagggacagtggactcctcttttttgttcttcctatgacccttcatgtatagctatcttaataataaacctggtctggtgtgggatcacttgtttcagagttgccggccttctgatgcttctgctaccagatctcgacctctggccactggaccatcttcacagtcccaccaacagaaaaccacagactctgggaccactgaaggcatgtctccctgttctggctccttcttctcatcaagcataaccatatcagagggatatcatgcgagagagatatacagaaagtccagaatcc

SEQ ID NO: 28026 - DNA, 1156 bp, Bovine  19866880943654
tgatgctgggaaagattgaaggcagaggagaagtggatgacagaatgagatggttggatggcatcatcgacttgatggacatgagtttgagcaagctctgggagtcagtggtggacagggaagcctggtgtgctgcagtccgaggggttgcaaagagtcagacatgactgagcaactgaactgaactgacctctcctcttaatctaggttcccactcctatgcccagggcagaggccaacaccagccggatgctcaggaatgccaccctggagaaatgtgagtgcccacagtatgggagatgtccagcccagcagggaagagcctggcagaggcacggttatcttccacctggccactgctgcttccagcccaggaggacatctattggccagcctagctcctgggctggggtcaggctctcatgtagaggttaaaggaacacgaggctctgagtccaagagggtggcaaaggttgggggctgggagccggattgagggggcagcaacttgataccacttcccccaaccccacaggcaaccacatctttgtggacacggggctgcctgacctagctgtggggctcatcctgctggctggctccctggcactcctgtgcacctgtctcatcctccttgtcaagatgctcaactctctgctcaagggccaggtggccaaggtcattcagaaggttatcaacactggtgagccccaagtggtgggtgggcaggccccaggacgggccttctggatcttgttaatacttctactgccttactgtgtgatctgggtaaagccctaccatctttgagcctcagtttccccatgtgaacaaagaacaggttggactgggtgatatatgaggtccctgagatgctgacaagctgggaatctgtggctgcttccgttccagcaggtggctccaaagggattcccagaggccattgtttgattcaattaacagtcattaagttccctctgtgtaccaagcacagagtggtgtgagggatacagaggtgagcctcacagagatggctcttgccctcagggggctcatagcacatatgggaagacagtaaaaaaaaatgatcgaggggggatgaatttagataaaagagaacagtaactgccaaacagaaagcaaaaacagcaaatag

SEQ ID NO: 28027 - DNA, 756 bp, Bovine  19866881001956
tcctggcgccccggcagccccgacaccacgagaaaggtgcgcacgcgctgttgtggggggcagtgtcccggtgcagatctgcgggggtcgctcacggtcggcctgagggctggcaccccgcccagtgccattgccttccgtgtgtcttgcagaagccgaagctgaagcccgggaagtcgctgccgctgggcgttgaggagctggggcagctgccacctgctgagggccgcccgctccgcaagtccttccgcaggggtgagggcagaagcgggccgcagagatagagagggcaggaaactgggcaagtctggagaacacccccttcctcctactggtcctgcagtctaagtcagtgaaaatcgaaatgcagggccctgtggacccccacccccaccccgccacgttcccctggtggttcggttcccacgctagagcccagaaatttgggaagcccgcatcagtagcgaagcctcccggaacccaaacacagttagacccctgaaaaagggctccagcagagtccactcgggtgcggagaggcctcagcagaggggtgaggagagggaccctgtcctgctcagtcttcctctcctctagaactagccggcggggcggccaacacagccttgcgccgtgagtcccagggatcgctcaactcctccgccagtctggacctgggctaccttgcctttgccagcagcaaatctgaggtaagccaactgctaggggagatgaggtgtgggcccagttcactga

SEQ ID NO: 28028 - DNA, 1487 bp, Bovine  19866881003694
ccccccaccccgcccgccgccccgcctcccctcccgcctccacgagcagaccgggtctctcctggcttgcaccgggggctcagcctgtcccgcggccgtggtgctctgtccctgaacggcccagggaaggagagaggcaggaggccgtcctggaaccggtgatctgcttcctcccagagccctcctgggcagggctcctctcctgccgactggctgtgtgtgggtgtgtatgtgccagactgaatgagtgcggccagtctgctcaggccaccgcctatggaactagcagcttccagggctcacagtgcccatgcagcggtgtttccactatttctacctgacccaggggcaggcagtggatattccaggctgaggggactgggatccaaaccaacctggttgcaggtacccttgggagaagcaggtgtggggagctgagcagacataatccacagcagtgtgggagcccagggagggcagctggtaacccctggctgggacagcctggggcagaagagggggtcttgcctggggagttgggattgctggtcatgtggaatcacaggcagctcacttctttttggacttcagtttacctagctgtaggatggggtaagtgcaactactgtttgctgtctcggagatcagatgatgaaatgaaagggctgataaaaactgtagagcgcaagtgacttagtgatactaagaaccactccagcaggactctgcctcttcatgagttgaaatggggctacagaatgccagcctctcccatctcctccctgggcccctcttacccactgccccctcttttggagctgggacattccagtctcattcctcaggggcagctgcagtcactcccctcagcaaagctgatcctccagcaggtggtgggaccctccctggggctaggactcacgaggggctaaaggcagtcaaggccagactgggagcttcctaccctagtgctttgggcacactccagaggagatgcacagtggggtcagggcaggcttctaaatgtagagagcctatggactttttcctgtgcagctgaacatgaccttaggcaccttattttacctcctgggcctcagttttctcctcggaagtaggggatgacactcttcctctcccatgtgtgttgtgagcatgtgccaggcccagcatcaggctgacccaacgaggcacccactaaaggacaccaggatgcctccctgagtgtcctgtctttttctgcttcgtggccaggaccgtatcccagccccattctccagtctccaccaagagttggtctagagagatgctcccagtgtccaggctgtctgatcttggagtagatggaggggaaggtggaaacaggagtaaagggaccttgttgggaccaactaggcctgtgcagaatagggcctatgtgactagctgaaagcttgctggcagagcagtgggggtggtggctgtgaggttctgctctgtgcagagct

SEQ ID NO: 28029 - DNA, 1236 bp, Bovine  19866881044385
tagatctgacagccctggagcagaagacaaggtagggtcacttcccttggacaccagacccccagcccctgcctggtctggtgaggtcaggccacctacctcctcttggttgcgcagttccttcacccagaactttgcccgttcaaagctgctgctgtctgtcaggtcttggtgtggaacacaggaaacacaaccaagggtgaggagctgttctgtaaggccagcctggcaccctccccttcttgtttgaggaacaggcccaaactcttcttaccatagcagacgatggcagccttggcgccccgatagtagattcggctcatggcctcatagcgctcagagcctgctgtgtcctgaagggcagggggaggctcagccctggcctgagttacggagctatactccccacgacctcaaactaatatgtcctccagacccgtatttttaaattggggtctagagaacagaaacctccgtgagcccacaagtcagtacaaggcaggacctacgcctcctcaagaatgggttttcccagattatgtgcccagagaacttacccaaatacccaaagtcaccgtccggtctccgacagacatcaccttggctacgaaggcggccccaatggtctgcaaccaaggggaagcgatcagaaccccgcgtgtcggctagccccacatccccctcaacacccgcgatgggccccctcgggcgcactcacattctgataaggccccaccaggaagcggtcgtgcacgtatcgctccaccaggctcgtcttgcccacgtactccttgcccaacatcaccaccttgacgtccacgcgctgcccgctcatgctcccggggccgcctcacccgcgtcagggtcctgagccggggcgcgaggcaaaccgggatctccgctccgacaggcagcgcccttaacctcagtacccgaccccaggcgccaatctaaggttccacacgccgcaacgagcttgagcgacgacaacgcctccgtccgccccggcttttagggcccaggaattctcctaagagcctgggacccggggcggcctgggagcgcgcggggcagcgcccttaacggcgccgcacgccgccgcccgacttgctagctcgctctgccgctcgctcgcccacctagcttagaggccgcgccggcacagattccccaccgagccagggggctcctccaacccagctccggcccgcagcgccgcgacgccagcggtggcgg

SEQ ID NO: 28030 - DNA, 2589 bp, Bovine  19866881203363
cttctgcttctgtctccacctctgaccactcctctgtccctcctgtgtcctcctgtcctcatcccagagaaggaagtagttgccagttccccatcccctctctgggagccaacagctccagctcaacctgagactcccacctccatgggcttagcccacacttccccagagcgagctgtgtgggtagggagtggccagaccagatttcccttctactgactcactgtgaccttgagtaagtcacttcccctcaagggcatcactcacccatgcccattataaggggttgaattgaactagaggtaagataggggatccaagccccaaagccagcttgagggtcagagaatctttccattcagagggctgacctctgagccccagctctcaacaattccctggtggctcagatggtaaagaatccgcctgcaatgcaggagacctgggttcgatccctgggttgggaagacctcctggagaaggaaatgacaacccactccagtattcttgcctgcagaatttcatggacagagaagctacagtccacgggttaacaaaagagtcagacacaactgagggactaacactttcgctttacttttctcaacagaggtgccttaatagggtggagcctgagcctgcctcttgagttgctagctaggcaactagaagcaagttacttaacctctctgttttcccatgtataaaataggtatattcccaggctgtcctccacagggttttttgaggattcagtatgtggtaatactaggtactcgataaatgtaaactgctgttagtacttagcaagtaaagaaaaggccacccagctgtcttacccttctaacttctgaagcatgaggtagagccatcaaaccaagctctcccttcttgccctagtgccatcagtctctgggtctgacccctctgccacctctctggaacctcttaccgcctgaactcagattctgagtgtcggcccaccgaggagccttatggggtcacaggcagcctgtactccgcaaacctcccccaacttgtgaagtgtggttctaccccccagtacttccggcacaagccagctcaaggccaagcgcgttgccagatggccaggcagacctgcgggcttagacttaccaacagcagtgctacttctgcctgtgttgttgccactaggctagagggctgggaggcccagttgggttcttcagggtcacctgtatccagaccctgggagacaccccaccctgggccataaaactggtgcttcctaaccttgagaacaattctttctgcacttgaggtcttcataagtaattggattctctcacaccctaggcagcccattcctctctgttttcgccaaagccccccacttcccagaagtcatcttcatggtttcagctcatgcatatgccacaagcacacatgcacatttcatgcccacatgcacaggccagagggcaggtctggtgggtggaatggcctgggcaagaggccagcaggggcctcaaaagctttggtcggagttgagacacttgggttttagcctgaaggtggctatgtgttgatgtcagcagcttctgaaacgtgaggagggtccctggaggtgaatgaatgtataagcggagtgtttgaggtgatggtgaagctcaagggagccccaccccctcccagatggctttagtattcaacagtagtccagaaacacattgaatgaagagacccctgggttctgcgagtggggcagctgaggaagggcagggttggctgctgtttgcctgagtttggtctgcagagtcttggcccttcatgaccctccatctctccatagctcacccctggaggtaaagctgcacaggctggcgtggccgtgggtgactgggtactgagtattgatggagagaacgcggggggcctcacacacatcgaagcccagaacaagatccgtgcctgcggggagcgccttagccttagcctcagcaggtaagcctgagctgagcagccccggcaggtgggcgtgcccttgggcgtggcccatcatcaccacttccccttctcttctagggctcagcctgctcagagcaaaccgcagaaggtaggggatggtcttgggatatgtgggcagcaggcggggtgggactggacatccaagctcacctgccctccctggtgcagccttggtacccgccgccccccctcccccatccctggccgggagtagagggtggacgccagagctggggagtctgggaactgggagttgggccagggactgccgcacggtcagagcaccatgcatgtctgcctgttggtccatccgtctgcctgcctgcctccttccctctctccggccggcctgtgctgcaagctgcactagcccacccgccctcggactgcgtgggctgagatcattgctcccaaatgggccccttgaaacttgagtcgcccctccccggagcctcaggccagatgtgtgggggtagggctggagcaccgctggcctcttcgtgccaggggacgccccactctggccagatcccctgccgcctcccgccctgcccgccctccccgctctgtctctgccca

SEQ ID NO: 28031 - DNA, 1031 bp, Bovine  19866881218594
tgtgatatgaatcactactttctaaggaatttgttttagcttaaatatatatatatatatatatatagtatatttggcttttcttaaaaatgagggctaatatatacattatcagtagcctcattcacgtgagtaacttcctcttaacgtttaaactctttggacagcgagaattggacaaatgttaccttaagtcatatttagtttttcctgaggttgcatataacctgttagtgtcagagagactcgtagttttctttttggttcctttcaagttttttcccacagagactcatacttaatttacacattagtctaggaaagtcctgccaaagtttaaacatttggcagcatattgtaaaagtctttctttacttatttttaaagtttaactgtggtcatttttgttgaaagtggtttctttattatttgaagtttatgtggattattgtctaatgatggcactaccaagtgccatgattttggcagaagctctcaggaatatggtgtcatttttgtgaaaaaatagcattactccctctccatgtaggcctgttgacctatgtcatccagagggacgcagtaagttaaggatgatggcatgtgacatcaccctgggatcttgcaagaggaacctgcaaatacaataatattgaaatccctaatgagaggaaagttaatgaggaaaaagcaagcccttcatcactgtggttatataacttttgtgatcatgatttgctgtcattaacctgctaattaactccaactgtttgttgatataagccacttctaaatgagttaggtaaaaggtttccctaacattattgttctttttgctaagaaagtataactacttctccatggagctagactcctgagtctctataatttagtgacttaaagacttaaaacgtaagacaccataaaactcctagaagagatcataggcaaagtattctctgatataaaatatattaatgctttcttaggtcagccctccaaggcaatagaaataaaaacaaaaataaaca

SEQ ID NO: 28032 - DNA, 698 bp, Bovine  19866881230339
tggcgtgggggtgggagccctgtccctgtcttcaggtgggacccagtctgacaagccagatggacttagtcttaggcaactcactcaagctactcaaagtgtccaggtgggtccgagggaagcacagggaataacgtgggcttggagaagcagggcccagctgaggtggggaaatgggaaagacatccaggcagagaacacaggtggagccaaggccctaggcatgaagaatacaatgcttctgtggggaggtatatgcctgggttgtgggatttaagcagagagccagacctggagggtttttgagtgcttggctgagaagttctccttgtccccaaaggcaatggggagccacggaaggtttgaatggtataaggaggggatgaacaaggtctgagctgagtatcaggaaggttcctcccttgagctggggggtaggcgggaggcaggtaggtgccaccgatcagggctgacaacctggcccggcctcacccccagagcggtccccgcaccggcccatccttcaggcagggctcccagccaacaccacggctgtggtgggcagtgacgtggaactgctctgcaaggtgtacagcgacgcccagccccacatccagtggctgaagcacatcgtcatcaacggcagcagcttcggtgccgacggcttcccctatgtgcaagtcttaaaggtctagtcc

SEQ ID NO: 28033 - DNA, 2559 bp, Bovine  19866881370731
tgttttgtgggggtgcagaggggtgctcccgagcacttggcctgtgggctgcactcacaccgggccccttgaactctgcagggcaccacctatcagaagactgatgcggctgtggagatgaagcggattaaccgcgagcagttctgggagcaggccaaggtgcagaccccgaccctggcctgctggctgggcggctcctccctgtcttgaccccacggggctgctctggctcctctcctaaagtccctcccttcaacagcagggcccgtcccatgtgcttcccacactgaaagcccctgaattcacagaagcctgggtcagggatcggggtggagggggggtgggggtgggccacaagctcagggcctgcactgccttggcacgaggggctgtagaaggaggaagaactgaggaaagaggaggagcggaagaaggccctggatgagagactaagatttgagcaagagcggatggagcaggagcggcaggagcaggaggagcgggagcgccgatatcgggagcgcgagcagcagattgaggaacacaggtgtgccccctgctccacccccaccttgggccgcggccctacggcggccagtcctaagggttcgcctgcacctttcattccaggaggaaacaacagactttagaggctgaggaggccaagaggcggttgaaggagcaatctatctttgtaagttcttagcccacggtttctctttcctggtctgggaagtggggatggtccctgaattactgggccccttgggggatagtcagagtcttggggacagtgctgggcattcagggtacccctgcatcagcatgggatgtcctgccatgtcgggcctgacccctgatcatgtggggttctgtcccctggctgtgggaagagacctctttggagaagtttagactgaaagagaaaatctacgttgacccaaaccctcactgaccaggcttctcttgcccacttccagcaggacttgaggggctcaaggtagattagccatgcttcctgtatttaatgggacttgaggcctggtccccattgtagtaatgctgtagagccactgaaagaatctgggctgatgctctgaacatctgtatacacgtatgtgtaatgtctcctttagggcaggcacttattccaggggtacttggctgaacttccaaacattgggatggccctaggatcatcgtggattgaccctttcacaaccacagtggagacagatcttcacgctttgaattgaattttaacatttgagaaatagcgaagatcattcagtgctgagcgtggtacagtttgggacaggaagtaggcagtagttgtctggactgagactgtggtgggtagctgttgggccgtggggactcaagcagactccaaggtcacacccacaggaggctggagggatgtgggaggacagtcctgcagcactggcattaatggctgtcatagatcattccactcacatagcccctagagggtggaaagaatgtgtgggtagtaagctccaaagttattcattcaacaaacccttgccacctgccacgtgcctggtgttggaaatatggtggagagcaagatgagcaaggcccttttacaattaactgatgaattaactgcagcaaaaggtacataacataaaaggtaccatctttaccatttttaaatgtatcgttccagggcgttaagtgtatttattttgtacagctgtcaccactgtttatctgcagaattttcttcatcttcccatactgaacctcgtatccattaaacactaactgcccattgtcacctttctcagcccctggcacctgctttctgtgtctgtgatgtgactacgtacctcgtatgagggggaccatttatgactggcttatttcacttagcatagcatcttcaggcttcatctctgtgtcagaatgtctttccttttgaaaactattagtattccgtagtgtatgtataccagattttgtttatccattcagagcaaggtcttttggaaaaaaaaacttccggaaaatttcacatacacgtgcacacaaaagtagaaacaatagtttagtgagcctttgacttgatcacttatcttcaccaattaccaatgtttcaggcaaagatttacagtgttacaccattattttatagtctcatctggcccttcaagtatggctcatgtgacaatgacagttggtattttaacaggtcactgtggtgaccctgcagcttcaggtcccctgaggaaggtctcacacaagaaactttggaatttacaaccgtaaaatgctttcttttgacttgaggtactccgctttctcccttctgataagaattgccttccttatgtgagttccctttttgcctgggatactaggagttcatttatctgaagatgctgaagcacagcagccccgttgacctttccggttactgtgttggtgtctctctgacccccagctctgctttgtttccgtgcttctcacattgttggtagttaaggtttttgtggtaagctgcctctggtccttttttgaagaggcagagga

SEQ ID NO: 28034 - DNA, 692 bp, Bovine  19866881371292
atttgctctcttccccaccccacccccaccatctctgccgctcaggctccgcccctggatctggccccgcctctgctccgcccagctcccttcagaggcgacgccctttatcccaggccccgccccctgggacagctcacctgaagctgctgggcccggaacatgtccggtcgcggttctgccagcacttcctcgccgagccaggcctgcctgtcgatgttcacggggctcagcgcctggctggacaggaactcctggtagatgttacgggcctcctgagctaactggggcagggacggacaggaggtcaggggcatggctcagggcttggtcccatctctcgcagcctcagctcccccttcaccccacctgctgggtgtcgctggccgggatctgctggaagcgctcgcaggccttccagaaagtcacattctcagcactgaactccttcttcaggaactcctggggatggggagaaggaggaggcaggtggagacccagagacctagtcaggggatgtggtcaaagagattgggatagaaagagggcccagaggctaaaccaaacagacagatgggatcagatccagaggcacatagagggaaaaaagaggcagagagaaggaaacttcccagttcggagaagagcaatgagtgccaaagaaatgctggatgagaagccgacagaggagt

SEQ ID NO: 28035 - DNA, 1149 bp, Bovine  19866881406472
ctcctctttttccttactctaagcgtccttgagtccttctgtactgcctcatctatatgcagttaacactgcatgttcccattccttcctatcccacaggcaggagcggtggtgcaagagacaaggtgtgggccctgaagttagttggcttacgtttcccctctctcaacttcccccatctgtaaaatgggtggatgattcccactcatcgggttgctgtgaggtcccctgtgcccatttcccagtcatgtgtcctcaatctaagacccctgccccgcccccagtgcatccaccgggacctggctgcccgcaatgtactggtgaccgaggacaatgtgatgaagattgcagacttcgggctggcccgtggcatccaccacattgactactacaagaaaactagcaacgtaagggaggcggggtgcagctgattggggccaggcactgggacccgtggcccttggcagcagtgtgccctcttccctccagggccgcctgcctgtcaagtggatggcaccagaggccttgtttgacagagtctacacacaccagagtgatgtgtgagtcctggaagctgggctctgggatatatccacaggcaacctttgtccttctaaagcccttgccctgggtctgagtgggaccagacctctaaaagaagcccgtattcctacccacatggtggatcatagttgtggggtcccctatcctagccgcagggttagtgggtgaagctgtaccctgctgagcctgggttctgcctccatccaggtggtcgtttggaatcctgctgtgggagatcttcaccctcgggggctccccataccctggcatccccgtggaggagctgttctcgctgctacgagaggggcatcggatggaccggcccccacactgccccccagagctgtgaggcctcaccccactctccctcactttctagtcctcattctctgtcctaaccttgacctcacggtccagtcatacagagtggtcagctctcactcatggtcaccccctcttcagcctggcagggaaggcctggcagggtactcgtttgctgaatggcctcaccttgtgtcaaacccttctaccccctcaccacaccccctcacccaggccctaggctccttctgaccctcatccgcc

SEQ ID NO: 28036 - DNA, 2113 bp, Bovine  19866881426579
actgctttgggccccatgcatattatgggtgaactcttcagcctgtgtgtgcatgtgtgggtcaccaggtgtatagagcgtgtgtgtagcagtcggtgggtagaccagcccctcgggtgcccataggcttgggtgagtatacatgtattcccataggaagatgtatcctgcctgcctgcaagtgtgcccttgggcatgtgtgtgcctgtgtgtgccccagtgagcttacctgtgtacctgtctttgtgtccttgcatgtgtacacatcacttcccttgacatctgctctggatcagagccaccggaagagccttgggagctcagaaggtgagaatgaaagccgaccagggaagtactgctgcgtatacctgcctgatggcacagcctccttggccctggcccgacccggcctcaccatccgtgacatgctggcaggcatctgtgaaaaacgaggcctctctctacctgacatcaaggtctacctggtgggcaatgagcaggtgtgaacccggcctggtctccaactctaaatcccttcctgatcctgaaccacggccccccccattcctgtctctgctcagctgtgaccccaacaccaattccatctctaactttaacccatcccccattcctacccacttcctgactccagccctcactacaaccttcagccccacgcccaacttcaaatcaatccagcaccaattcctcactcaaattcagatatctattcttaccccacaaaaatcctgtccccatcccattcccatcttggtttccatcttcattcatatccagagactgtgatatgaatacgatatgaagagactccactgctggagctgggtttttccctgtcacccccagacttcagactgcccattcctgaaatggccatttggagacccttcactccctccaggaaagcccaacttcatccagcctatgaaaaattttcctttaggtacaaactagcatagctttgaacttaaactaaaccatccaataagggggaagctaaaggaaggatgctatatcccagggagaactgtcagaatatcattcacccagtagacattcctaaggccctgccaggtgagtgagcagagggacccagggtcctccaggtccaaaggcgggaggtgagccaagcagaatgtgatcacggaggaggagttgactctccagagagtttctggggcaagataggcatttctgggtggtcccaggaggcttcagggaacaggtggtggttgatgaggatgagtttgcctggcagagctgtggggggaggacattcgggcacagggggatctaagaagtgctgggcacattcagaggcctggagcacaggagtgtgagggccacagtgggagaaactctgcccattctcttggcctcccaggcagcctccacaacccagatgggttctcatgtctgctaaatataacttcacacccacactccacctgtccctgcagacagcacaggcctgttccctgggacaggctgcctcccagccctcggctggtgcaggtcgccgggtgatcactatcactgcttttatgtaccgactatgtcaggcactgtgtaagatacttcacatccttctggcctcacaggtgtcttggagggaagagctcttttttttgcagtgagggaacaagaagtgtccttagtaggtgggaatagagagaagtggacaagtgtaaaaaaataaggacaaggcctgggtggctgaccaaaggtgggtggtgagggaggaaattcgtccagctggccgggttaagtttcacatgcctgagggacaaagggcagctgtccagggggcagatccccacttggctcaggaagaggtagtttcttccagcccttaagctggcccttttaaccaagtagccccattactatttcctgcttacctcacctccatgtttcccataactctgcgccttttccaagtctttccagcattcttgccacccttctccctagtctgggccactctaggctctgatccagcctggtctcttactctgtccgaatctctatggctcacccgaccatcagcccttccctctgacccttagggagcctccatagtctaggtcat

SEQ ID NO: 28037 - DNA, 1419 bp, Bovine  19866881506703
ctcttgttcgaggcagaacatgatgacgggcaaagtgaacaccagtgtcttgcctgagccgtaaaggctatgcctatcatgtcacggccagagagactggtgagagaagagaggctggagggtcaggctccatgaaaaacaaagactgcttctcatccggtggctgctcctccccaggactgtcagcttcacactcacatggtggggattccctggatctgaatgggtgttgggtggtggatgcccttcttcttcaggcctctcaggatggctacagaaaacagcctggcttcatttttgtgtttcacaggatatgagacacaggcccctaacgcctgtaaaactcgcactatgcccctcacgttacaaacgacgatctcagacagacaaaaagacagacacacacaaacttgtccaaggcttctaggctaagtggaggcaggattcacacccagttctgtttaaagccatcattacttgccctccaaagctccctaatggcagaggttacaaaatatgaacagctcagggactgaaaaagaagcataaagacaaattcctccttctccactgattagacctgatgcagaagcttctggacttcggtgggggcctaggatgcaacctcacagacgtttcactatcaaaatgtggtgcatgtttcatgatcacaatgtggtactgcagacttccctgggggcacagtggataaaaacctgcctgccgatgcaggggacgcgggttcgacccctggtgtgggaagatttccacatgctgtggaacaactaaaacctgtgtgccacaaccaatgaagcccgcacgccgcaacttctgagcccgtgtgctgcaactactgaagcctgagtgcctagagcctatgctccacaacagaagcctgtgcaccgcaacaaagtgtagcccctgctagctccaactagagaaagcccgtgcacaggaacaaaagacccagcacagcctgtacgcatataatgtgctggtgcttccagctcccaggtacctgcaggaaatttcatttccttgaagctcttaatgggcggtgggatgccatcgccttccaccaagatgtggtacttcttccggacacgttcatgccgctcttcagacatactcaggacgtaacgggggtggtgtccaactgtgggtgggtgacaagggtcaagatagcacctgggcacacctggctttggggtgtcccttccagtctcagccacctatcatcccaagtaagaggaaccaactgcagacaggaaagacgtaccttggttttgattggatcatcgtatgtgattcccttagccatctccttcactgacatcaaagctgagaaaacagatatggctcaaggctggctcctgcttcccagaggccaggtcccttgaaatggaacatgcctagggt

SEQ ID NO: 28038 - DNA, 935 bp, Bovine  19866881573323
tgttttagactactcaatttgtgggtaatttgagggtaatttgcttccctaatacaaagggaattagctaaaagaatttgtttccaaaaagaatactaaagacacaataaaaattatctgtatagtgctggatattaaaataaaatctctattaaatcagtaagactgtagcagacaggatttcttcaaatttttacaagcatgtaaagtttgtttatcgaatatatagaagcactgctgctgctgctgctaagttgcttcagtaagcttctaatcggtagaagaaattactccaaaacaccaatttggctgtatgaaaaatgaaacttcagctctacaactatacaaaattattaactaaaatgaaaaacagattgaaaggaaatagtcatgtccataaaataaaaggataatagctacaaaacactacaatctagataagtcagcgaaggatacagacagcaaaggccacagaagaaatacaaacataaacaaatcactttcaacaataaaattgtattaattaaatcaatctttcagtagcagtatgcatctatttaattatgtaaaaaacttaaaaaaatgttatcaaagttgttttgttatcaaagggaggaaaacgtcagactcatacactattgagaactgtgtaaaatcatacaatccttttggaaaaccatacagaagtaggcacatctgagacacaaagaaaattaacccattgccctgataattccaccatcaccagtttatccttaggaacaactgcacaggcattactatgaaattattaaggtacctatcaaggctttacttaaaactccagtatctactccaccaagtaactaattacagtggtataattaccgacactgtaaaacttctgccccaaagctctactacattaaaaaagcatttcaaatgtagcactttgt

SEQ ID NO: 28039 - DNA, 1306 bp, Bovine  19866881896306
cgtggcacttactgtgagctttcctcacgtcctgaaccacctttgaccagccatgacaccaacgggaacaccaccgctgacccacaatcccttgggtgggaaccacaccctccgtgtgggaaccacatcctcccctcagtgggtcctttcacagaggccccgggtgcgtggagacagtgcaggcctcaccccacgttgctagtggttgtgtgccaccaggcaagttttacttgacctctaagaactgtgattccccaactaggaaatggagaccccagcacctgcctcctggggccgtgccacgcctgaggggacgaggctcgaagctggaaagcacctggaagtcagtcaaagaagagaaaagcagacctcttagggcagccacacaaatgaggttggttatttcactttatttagcaaaccatcatactctgggccccaccaaactgctcctccagcctcacccgagggtcggccttgggaagaagctcggagcgtgaacaggaagacccaggctccccagttggcctcctcttctgccacacacaccacacagcacagaacaagatcactgcttgtgtcctcaggcgcccaccccagtgtggcctggggggcctccagtgttcacagccacctgccaggctctcagcccagcaccaggcacagaccccctgctcctgagaggccggcacagggccagggcctctgcccccggctgtgggcatggaaaactcttattccccagccctgcagccttactccgcattgggcaagaagcaaaatatatgaaaatactttaattatttctttgaaacggttaagaaataaggtcatcttattttccttttacaatcctagtaaaaaaaaaagttcacattagcgccaggacccttccccaagccacgggctggctgctcagtagaaacgcttgttccgttcctgccgcttctgaaacaccacagcccccaccacggcgcacacgatgatgcccaggagcgcgcacagcagcagcagaaacacccgccaccccgtcaggggtccgctgcgaaagttccccgttggatcgtccacattgtctaaaggaggagagaggggtaaatgagaggccgaacgggctcccaggagacagcatgataaggcccccatcccaccctcgaggcagcagctgtggcctgctcgcaaggctccagcacggggcaggggcatgcacagagcgacaatctcactgggaacaaggctccccgggattcaggctgaggtgccttctgctgcaagaagctggtgaactgcacgccttgggatctcc

SEQ ID NO: 28040 - DNA, 2597 bp, Bovine  19866880366419
gatgaaatttccattttacaagtgccattgccacaagggggtaggggtgttctgtgtaactctttgtctgtgctcttcctaactaaaccttttcacaaaaaaattaagattaaaaaaccacagattttttaatagacattttctatactatatgtatttctgctatcattttttttcttgtaattaacatctatccagagacatcagccaagatgttgaagtctagcatatttaaaatttgtctttctgtctcatgttcagcaggacagttctagacggccagagagggtgaccctggggttggaagatttggttacaaaggccacctttcattaatctgaacagatagccacagggcaatgtgtatcctccacaactggattttatcacagcaagttcccttccacatacataacattaaaaagaatgcaaaaacaaaaaaattagttttcttctgttcattatgcatttcttgaatgaagaagaaaacaaaaatgactggatgaaagaaaccgactaatcctttaaagcatgcattaaaaaaaattttttttttcgcaacctgtgcgtcttttaagcaacatgcctttaaaaaaataataactggttgaaacatgcagcaggaaggctatgacatcatttgtggataaggtgtccttcctcagtgctgagttgtccagggcataaacccacagaggtactctgtgtggcgcagaaaaacacagctgggacacccggggaattcctcccaggattcacagaacaagtccagtgttttacctcccgtcttacgggagctaatagattccacctgcggcgtgtattatggcgacgacaccccctttttcttccggctccggaaacgccaaacccctaactcccaccctttctttgtatttcttactctttagcttgggatacgaacctatctgtaccctgggtgcagctggtttcatttgttggaggacttcaacgtgatgtcatgaggaattcaggtcaatatttttaagagaggtgaaaacaaagctgtgtgtgcaggacggcttggatggagatgcaggcggtcgtcgtgtttccctatccctcggtggtgtgcacagccgttctggccccacgagcaatctgtctgtaataagtgacagattccccttcgtataaaggaaggggccggagcagagcagcgcagaccttgtacaatagcaaagcaggtgctccggtcagaccccctctaccaggaaacgcttctggaatgcatgaccaattcggtttcagaacagaatactctctttaatggacagaaaacactaaccttttctttttccttttgcctttccctccttcccccaccctcgcgactccccagtttcaacaagcccccttttcattttaaccctttcaaaggagaaggggccaggctccactccgcacacaccccatccatctagatgttgctaacaacctaggaagaggggaaacattcattagcctagaggaccgataccctgtgcccaggagcgctgaggcaccgtgggggaggggagcactcctccctcctgggaactgggaagcccgaactcgcccaaaactacaagtttcactttttctttcagatgttcctctctaaccaacttcagggagcataggtttagagaaggggctagagtatagaaatgtctgggaataagaagtactttgaaaggaagacataaactatgaaatttgaaataggcaaaatcacattaaaatcatatagtgttgtggagatcatggaggatttgaatgaaataaaatctcactttaaggaatctctgagttgggccacgtctgtacagtactgattgcttcagatagaaaaataatactttgagcgtcataaggttgagttttgcacatatacatatgtacacatgcatatcggtggtgtcaagtggattgcatagtagtaaatatccaggtttccccacacacaaagaaaatagctaggacttaggaaagaaataattatctagtatttctgttaaattctgcatctgcataccctgactctattgacaaaggaacaggtaagcagtcttgtgtgactccttttccatgcaacagcatttgaaacgcagtgacagagactaacgtatattaacagtaataagggtttcccctccgagagttgttgtaacttatctttgaaggtaagctcatttatcatggggagaatagaccccaaaaagtacagcagccgcggcatcctgcctgaggcagagttagagatttccaatagctgctgtaaagaaacattctgaaaatacattcactactgcaccaataaatcttaagacagaagagttttaattacagaggatagcaaagctcagatttttcaaatgaacccaaaactatgacttgagagagagctttcgcccatgtgacccaacctttgatagatttatgttttcttcacctgggaaaaagaatctgctttataaacctgaatcctggaggatatcttcatttgtaacatagtagcaggagtaacagtggaagtgaaatagagtaaaccaatatatatgcatatatgaggagccaaggatatgtcagatgca

SEQ ID NO: 28041 - DNA, 1144 bp, Bovine  19866880412706
aatactggagtaggttgccattcccttctccaggggatcttcccaacccagggattgaacctaggtctcttgcactgcaggcggattcttcatcgtctgagccaccaaatatatataaatatatagtacatatacatgtattttgtgtatatatgtatatgtgtgtgtgtatataaaaactgccttggggaaaagagtattttagaacatggattcaacgtgttaaaagaaagtatctctgaacagagggattatgagtgatttgtaccttttctatgtgcttttctgtactttccacattttcaacaatgaacatgtgtgattttgatcagtaatattacttaagtactacgtattgatgtgcatactcacaaacacacagaaacagttagactgaggcttatctggttgggggccatcctgtgttgtcctgactttctcaggctgaaggcttccagaaggagctaaggagcctgagaaaactcagaaggggaggttgtgagcacctttctaagtgtggacctagattatactccatcatttcagagttaataactttggcatttggagcacaggatcacagggggctcatctgacgtctccctctccatcaccaaaagcctttccctcctttattctattgatgactttttgtcttttctacccagaggaccgtgaaacattgtcaagaaatgtggaatatagattcaagctttctaacattgataaaaagtctcaagcacggtgtaagtaatgagaactcatttcagaacatgttagatacagggggagaaaagaaattttaaagacaaggcatctcagtcgtccccatcctacgggttttagtgaacatttaaaaggacgaattacagcatgcatgtgttccaggagcttggaggagcctgattcttagttactgctttgtaaactatggccaagacggtttattgacgaatcaacgcttatgtggctctagtgccatctggtggtgagctttcagaactggctgggttttgttcctttgtctatgaattgtacttccttttgcctcaaagaattctagtaaaaatttatatattaatcttattaatggaatggaagaagagtagcaagaagaaaacagtggtaatgtgaacctctgaaa

SEQ ID NO: 28042 - DNA, 991 bp, Bovine  19866880467186
tcttccttatgttatgtcttacctatgggatgaaatagttttaaagctaaatgatactagtatttgattctttgttctattaatacctgacacatggtatacatgcaataaataattaatattattactaatggtacctaaaaatactagccccagaggaaattgcattgattctctgtaattcagtgttataattgccaataacttgtttatatgccctgcttgactctaaattctggtgcctatctttatcaccattgtattccccactgtacaagtattaggttttcagtagatatttgttgaatgtaaacatcttttttttctacattatatatagtacaagtataactgatatttataatgataatcttaaaatactgcaagtccccaaagttccataaagcaatgattaccttatgtttagtaaatattagaaacaaatttattgtatctttcattttagaaaactagtgatctgtgttaagattatataacttgatatccagaatatttgattaatgtctttcttcttgaccaaataactgtgcaatatcttttcctatcattttatttcttatctatgtacacattattataaaattttgttgaatttatttttcacagtgtcagcattaccaatgtatgttttctttttgctgcgtatcatggaaatgagacagttgctttctatcgatattcacaggaaagatttagaaacactggtctgctctgaatcagattgtgaaagccctggaaagtatctctttaaggatctggatgggagagccctgggtctgcctccaccagtttctgtatttcctagaactgaaggagaatggactggatccttcttcaacacaggtcagtgcgttctatgtgaacttgacaactctagcagggggagcacgaacagaactgaggtggttttggctgtgtggtccaggggaacaaagtatactggaaaagaactgagctgtagagttggagt

SEQ ID NO: 28043 - DNA, 1766 bp, Bovine  19866880500194
aggtgcccctgttggtattgtcagttacagtggtagccaggctcatccttcacaataaaagagcagcaaaatacacattgtaaacacctcaagaaattcacaaagtacttttcacctctagttttaaccaccactataaaagtacgttgtgcttgggatttaaacaaggcaaggtgtttattcccaaatttcctttgaatagaggtggagagaagaggagccacatgtcactagttgatacagcagttagagaaattgtgtgggctgttcctgagtgatctgtaaaacatgagtaatatcaattatctaacagagctgctttgaggaataaatgtgatggtctatgaaagcacttggaaaatataaagtggcgtttaagggtaagatgttattaacaacaatggtgatttatttaaatagcagctcagtgtctagtgtgttattttggcagatcatagatgtggaatgaaggtaagtggggtgatattcacaagtatgccttctctctgtcaacctattaaaggatatggtggtatgttaattgcattcattgtttaaagagactttaccatgaaatgcatgaggttacttgtggccctgggcttgtttttgtcacatgagcaaaggaaatcacttgaagagggagcatggttatggaatgatcacagaacactgccctgcactcacatcttggttgtaacttctgcttgctttgtgacatttttcagttgacaatttttatgagcaccatctttgtccctaaggagcttcatattgaagacagataattattatgtggacatgaacagttcaagtgcaaatattaaaggaacaagtaaatagatcatattaaaggaacaagtaaatagatcatatgcttaaaaaatcttaaacactggtacaaggataacatgtaaaatgggggaaagagtatagaaaggggaggatggctctgtatttaactttctggtgacctctctttggaaacattctttctttgacaatgagaaccgaatcattaccttttcctagcaatatctcttctccaacagaaaatttccaacttgcagatacaaaacacgtaacatcattgtttttacttttaggagagtgagcaaggaagggagtctgtctgattatactactttatgtcattactttaggaaagaaaatatttatagagaaaaaatattagactgtttcattaactaattaatatattagagctaatacttgtcccaggcatacttatcagtatgatatgatttcttcctatttaatagtgagatatgtattttaaattttactaaaacaatggttttaatatagattcttcaaaaagatgagacactatctttacacaaaatctatattagatgacataaaataatccccattctaagggattttctgcatgttttaatgatttgataggtgggaaagtgaaaaagaatgacttttacaaatactactgatggtttcatcctcagttccatttattttataaaagattagtatttttcctaagtctttgagtaagaatttataagaaagaaaaattactttacaagtttaaaaattggtagcaagtactaaattatagctaataaacacaaagtctataaaaaagtaagaaggaaatctgctaatttatagccaattcatcaaaatgctaaatatgagcattatctcatggcttcccaggtggcgctaaagagcctgtctgccagtgcaggagacataagagacatggggtttgatccctg

SEQ ID NO: 28044 - DNA, 2019 bp, Bovine  19866880529072
cttaagacaaggcccatttgttatctccaagtttctgcaggtcagatgtctgggagcagagtagctggggtctctatacaacatctcataaggctgaagttaaggtgtcagcctagttacatccttacccctgagctcaaggtcttccttcagtctcattcaggttgttggctgaaatcagtttcttcaatctacaggatgagggcctcaatttttgttggctgttggccagggaccagtttgggtccttgaggctgctcttaggtcctaatcacctggttctctccataacctggcagtttgctgcttcaaagtcagtgagggctctctcttttaagggctcacttatatgtctatcccctttgactaacccaaagtcagctgatttctgaacttaattatacctgcaaaattccttcaccattgccatatgatgtaacctagtcatgggagtgagatcccatcctgttcatcagctctgttcctacttcaggggagggaaatatctgtggcatgtatatgaagggggatcaagaatcctgggggatatctcagaattcttaatatacatagtatgctcaaatttggggattagagaaggtctctagacatggcctttgtgaaagtcaagttctgctggccttgcagtctgttccatgtctttctgaaggtcacacatttcactgaaacctgagttctcctggagtgccagggaagggacccattatggtctatttcggagaaggcaatggcaccccactccagtactcttgactggaaatcccatggatggaggagcctggtaggctgcagtccatggggtcgctaagagttggacactactgagcgacttcactttcacttttcactttcatgcactggagaaggaaatggcaacccactccagtgttcttgcctggagaatcccagggacgggggagcctggtgggctgccgtctctggggttgcacagagtcggacacgactgaagcgacttagcagcagcagcatggtctttttccattcctggaggcttttttaaaattgtatttttaaaaactgttttttttttttttttttggtttcattatgtagcatgtgggatgttagttccttgaccagggttggaacccgagtcccctgcattggaagtatagagccttaaccgctggaccaccagggaagttcctccattcctgaaggctttactgaggctgttagttctagcttccagtgaggtgttcaggtttgaggtggtctctggggaacttaggagagagaatttttactcttggcagactacctatctctatattcagtgtttctcaaaactggccatgcctgatgcccacacaagcactggaagaagacttgactttggttctgatccaaatgtaaggaattgatgtgatgtcacctgtagctcagacagtaaagtgtctgcttacaatgtgggagacctgggtttgatccctgggtcgggaagatcgcctggagaagggaatagcaacccactccagtattcatgctggaaaatcccacggaccaaggatcctggtgggctacagtccatggggtcgcaaagagtcagacacgactgagcgacttcacttcacttcacttcacctcagacctagaaacgtgcctgggcatgtccttgccctctgtgatctgtgggcttgattcctccaaagtggtggggcaaggaggaaagaggggggaaaccatggagaagactcaatttgtttctgttcatcagaaacctacccactttcttaattgattgctcattacaaagtagcttgatgcttctttagcctggaagctaagtgtaatcaacttttgtttgtttctgtaaaaaacatttttttttttgcccttgaggagatcattatttctattgtatgaagatggtagcccaaacattaaaagtaattagagcagatggcagtgaatacggctattgtaaaatacagggatgcttacaaacggttttcattctctcggcttcctcctttt

SEQ ID NO: 28045 - DNA, 4482 bp, Bovine  19866880609047
gggaaaaaatggaagcgtgacagagtttattttcttggattccaaaatcactgtggatggtgactgcagccatgaaattaaaagacgcttgctccttggaaggaaagctatgacaaacctagacagcatatttaaaagcagaaacatcaacatcactttgctgacaaaagtgtgtatagtcaaagctatggtttttccaatagtcatgtgcaagtatgagagttgtaccataaagaaggctgagcaccaaagaattgatgctttcaatttctggtgctggagaagactcttgagagtcctttggacagcagggagatcaaactagtcaatcctaaaggaaatcaaccctaaatattcactggaaggactaatgctgaagttccaatattttggccacctgatgtgaagagctgattcattgaaaaagaccctgatgctgggaaaggctgaaggcaagaggagaagggggcggcagaggacaagatggctaaatagcatcactgaatcaatggacatgaatttgagcaaactctgggagatagtaaatgacagggaagcctggtgtgctgcagtccatggggtctcagagttggacgtgacttagtgactgaactgctcaaatctcctaaaagaaattctagaggaggccaggtgctcccaatatggttcttgcagctccccggcctttccctacctggtgcctgtcatactctattatgatagttccatgtctctgctggattctgagcttcacaaatgcagggaccacagctctctctcatactgaagtatagttgatttacaatattgtattagtttctgtacaacatagttattcaatatttttatggattacactccatttaaagttcttgaaagtattgactatcttccctgtgctgtaaatatatccttgtagctaatttactttgtacatagtagtttgtacgccttaagcctctcccttactgtgccctacccatgtccctctccccactggtagccactagtttattctctatatctgatcacacctcttttgctcagagttttatccttagtaaccagtagtctggtgcccagtaggttcactgattaaatcaatgaatggagttggatggatatacatatggatatgaacgaatacacatacaagctttcctgaaagagctagagttcaggaaccttatggtttcaacagcccaaggctttttgtacacacagagagaccataagaattcttgttcacttgttaaccacatctcagaggtggtgagaaataccttggagaactcatgggctaaggcgaaagaactagagagcaatctagttgatttgatcgttgtaaacagacaaaccaagtggttcaagtaaatatgctcttgtggtttgaattgccaatttagataattgtttgcttttttaattaaatgaataatcagtaagtctccactttgctttttatcccccctctatagacagagccaaaaattgtttttatttgggtggcatctgagtttaagattgtagaaataataataggaatgaaaaatgccttaagacaatcacttcaaatattaattcctcagttagaagcttcactgtctcatatcattcataagacactgaaaaggagcaagatactccttatgagctctgatttcttctccctggatgtccttggctaagccatctctttcatttgtttaaaaactatgtagtccagattctgtttaaggacctgagtggtacagagatgaaaagcacatagttcttgtcttccaggagcttcccatctaggcacaagaataaatgtctgagccaatgaatgtaatagtatgatgaatccagtacttgaggattgagcaaggtcaatgaggggaacaggaaggaagggggtcaggtagactttatcatagattgccttgagcaggatttagaagggtgaagagatgtttgcaagaggaagaggcagagaaaagtttttacatattaggaatagcctatgcaaaaaaaattcaaagagcaagttatgattaagaagttgcaaagaaatacaatatagctgacttatagaactgcatgtggtgttagataagcaacaagttgctttcctggtggctcagatggtaaagaatctgcctacaagggaggagacctgggtttgatcccggggttgggaagatcccctggagaagggaatggctacctaatcctgtattccttccttgagatgacagaggacagaggagcctggcggactacagtccatggggtcaaaagagttggacacaactgagtgactagcacagacacacacagaagtttctgaggtggaattgtagcatcttgaatgaatgacagttgagtgcacagactctactgggatgcgaatgaaagctttagggcctctctttgtttatatcttattttacatttttcctttttttatgtattttataagatacataatatagcaatatggtagcatatatctaagagatgtgtcctgagtttttaaattttaatgacagggtggggtgagtattagaagaccactgccattgtttcttcctgggcaactgactaatagcagaaccagtgaatcatatgaagcgggtgcgggggaaaccctgctaagacatgtagcccgagagctgatacctatcaaatgtgctactatttgtccatgtgattgattgaatatggcttttgagggcaaatgtttaaagtataaatctcataagaagtggggttagatttgccttagaagaactagagcagagagatggaaagaccagccctcaggacctttagcatttggtaattagtaatgttcggtgtcactcccagtagaccgccatttctcacccttggcatttgggactggataattgtttgttgtgggggctcccctgtgccttgtagaatgcggggtagcatccttgcctcttcccaccagatgccctgctgtccactcagttgtgacagccaaaaatgcttgcagatggtaccaaatgtcccctgcagggcaaaccacccctggctgggaatcactgcctgagaatacaggctgcatgaggacaatgcccctactactctcatttcactctgtctgcagcacatagcacagagcctgacacatagtcaactcaggatatatattttttcttggacaaataagtcagcaaattgttaaactgtataaatatgcaattttaaaatactgagaataactcagtgacttcagttgccatttgtgatcacattcttttgtgcctctgtgtcacagtctttctcccaacttacaggtgggtttactgtgaagaccaaccagttgaagtttatgaactctccgaacttggtagcatttccatctcctcatgcagccattttggaagacttggatgggtctctgtctggaaaaaatagaagtcacattcttgcttctatggaaacacttccagctacttgtgtggtcaaagctagcttcagccagcttgtccatggcagtgtctgtgaggaaaatgttctctttcatcggatgtctattggtttgtaagttgaattaactctacattttggcttgtcaatggacacgtatatatcattcaggttgttgatatttgtagaagagaaattgttttgcagattctgtttggtgtatttagttctacagaagtgatatgggataattttgacagctgtcagatcataagtttatagtagttttaggctgatttaaatgacagcttattttcaataacagtggaccacatctcatagcccttgaccacttattggcattttgagttaatcatttcctctcaaaaagacttgcaaccaacaaaaaattgaaatgtatttaaattaagaggagtattaataaattccaatattgtccattctcatttatatgcacctcctctccctgagctctttttaagtgtttgctatgctccagggaagcattgctgatgctccctattacttgtgaagttgcttcacaccagttcattttccttgttaattttgtgaactattggatttgtacaaaaatatcctatttaatattggagcaagaactccttgtttatgctacttggcctactattaagtcaggagcttggctgtttataatgcataataggattgcttctgccccctttaatttccaggtaatgattgctgagtgactagggttctaccatttacctatttcaaatgcattgtatataattagccacattcctttctctcctttgttttaaatgtcctaacttcatgaatattaagtcaggtgcttcagccagatcatgctggcatcttatttaaacaggtaaactccacagagagggagtcagtagggtcaggtttgtactaagtctgcattctgaatgcatatgccatccgtatcttgacattctgctttagacaccttagtgataccctgctagcatggaattgtctgaaaacattcca

SEQ ID NO: 28046 - DNA, 2822 bp, Bovine  19866880629487
cttctgactttggcaggctgaaaacaaacccatgtcccaaatccccagctagtgtcatttccccttgatcagattgtcccagtgacttaatgattgacctcgtgatgcctgacaccattaaccaaactatggcattttatgtggcaagtgacttcatttgagggctcaaacgtccattactcattagaagaaatgctgatggcagaaaacaaaaacctgtgaaccacagtggatatggatttattatgtggcgagactagattcttgcaggttggcaagaacgaaggtctcagagcatcagaggcaatgcggttgcccacagattaccaatgtctgcagctcgggaaggctccacagtgtccagtctgggttccacatttaggaagaggcctcctccactggcattgatggcaagaccagagggtctcaccaacatcgagatctgatgcactccaacaggcagcaggcttgtctgacacaccacgtttgtttggtttgagaaaataacgttgcaactcgttttgttcactgtaacttgcagggccttgtagtcaccagagaaactagttcccgtaatataaaccagtaggtccatgtcatcttaaaagaagaaagaaaccatctctcagcaatatcactccatttatgagaactctgtcaaatatccgttccctctcaccttcctctcaaaattcaaggaactgaatgctgacttatattggaatctgtggttattttaatagcctagagccctccacttaaattttctcaaactagtaatgacaaatcactaaccagttaaaaaatggggaaaaactaaagaatatttcaaaacaagggacaaagaatatgcaacattttaagtcatcaacaatctaccatttcaaattgtgaccatttcatttagattagctcaaaattgtccttttgttgtgctactctacattcaccccatgagctgatgtaccttctattcagccatcaccagggacataccctccaacagatcattctgatcttaaagttcacacacagaaatagtaaccccccaccccgcacacgcacacacacacacacacacgcacaagaaataaacccacatttatggtcaccaaagggaaaaggttgtgggagggataaattaggagtttgggagtaacacttacatactactatacataaaatggataaccaccaaggatctgctgcatagtacagggaactatactcaatattttataatatctataagggaaaagaacctgaaaaaagaatacatatgtgtatacatggatacctgttttttgaatgttggcttaaaactcaacattcaagaaactaagatcatagcatctggtcccaccacttcatggcaaacagatggggagacaatggacacagtgacagactttatgttcttgggctccaaaatcactgcagatggtgactgcagccatgaaattaaaagatgcttgctccttggaagaaaaactatgacatacctagacagcatattaaaagccagagatatcactttgccaacaaatgtctgtctagtcaaagctatggtttttccagtagtcatgtgaggatgtgagagttggaccataaagaaagctaagcatcaaagaatcgatgcttttgaactctggtgttggagaagactcttgagagtccctttgactgcaaggagatcaaaccagttaatcctaaaggaaatcaattctgaatattcattggaaggactgatgctgaagctgaacttccaatactgtggccacctgatgtaaagaattgactcattggaaaaagaccctgatactgggaaagactgaaggcagtaggagaaggggacgacagagtatgagatggttggatggcaccactgactgaatggatatgagtttgagcaaactccgtgagatgatgaaagacagggaagtccggtgtgctgcagtccatggggtcacaaagagtcagccacaactgagcaactgaacaacaacaaatacacatatatatggggctccccaggtggctcagtggtaaagaatccacctgccaatgcaggagacacgggcttgatccctgggttgggaagatcacctggaaaagggcttccctagtgactcagagagtaaagaatttgcctgcaacgtgggatacctgggtttgatccctgggttgggaagatcccctggagcggaacatggcaacccactgcagtattcttgcctggagaatccccatggacagaggagcctggtggcctatagtccatgggcttacaaagagttggacacaactgagcaaacaagtatacacacaggaaatggcaacctactctagtattcttgcctaaagaatttcatggacagaggagcctaacagactaaagttcatggggtcacaaagagtcagacatgaccgagcacacagcatacacacatacacacgtatatatacacatagttttataggggatgtgtggcttccctggtggctcaaacagtaaagcatctgcctgcaatgcaggagatacaggctcaatccctgggttgggaagatcccctggagaaggaaatggcaaaccactccagtatttttgcctggaaaatcccatggacagaggagcctgttgggctgcagtccatggggtctctaagagtcgggcacaactgagtgactaatacactcaaacatacacacttattaaaaagactgtcttttctccattatatattcttgtctcctttgtcatagattaagtgaccaaaactgcgtgggtttagtatgtgggctctgtattctgttccattgat

SEQ ID NO: 28047 - DNA, 647 bp, Bovine  19866880700839
aatctgcagggcatttgaaactcactctgtaacagtaataggctttgctgcttaaaaagtgattatgactaatgcaggaaaacaattatcacaagacttaattgccaagagttaagatatatatagacagatagagatggattcattctcattgaaatttgagccattgctaggaaaaactaagtgattttcaaaatcatgaagcaaaactgggaaaaaatgtttttaattcatcagtctacacaaggaagattttatccatattatttttaaagttttaacatttattgtttttaatacatgtggggttgattggagaaattcttaaaaatatttatgaatagaactaccccatagggctggccctataccaccaagagatagcatgagaatagagacaagagtggaatctaacagacttgtttctagttgtggtttggccctgggcaatcacttcatctctctaggtcttagcttcttctttcacataaagaaaactttgggctaagcattgctgggggcctcttcctgtgctaaccttctatgattcgaccttacatgatttaaagtagaaacagtttgttgtctacatttgtccttctctttctgagaggaaggatgagagcaggcttaggaaagaagcaata

SEQ ID NO: 28048 - DNA, 792 bp, Bovine  19866880710331
aatgaaaattaatgtcaaatagactttattaacgtcaaatagaaaattaatgtcaaataatttacagagatgctgatatttatttatcaagaattcatgctcttgtagaaaaagcagaccaaagaagtgctagaagataaggatgcagtttttctataactatattctttgcaaagagctgctaactttatagcttgactttttcttcaaatccacacaggtggtttctttattctgctctatcattttttttcaaactgatcttaaaaataggcagttttcaaagcaccctgaggcacatgattcaagactgaaagccagcttccttacacctgaagaagagccatctgcctgtctggtgtgtgtgtgtggaatggggcggggagcgggggcggtgggaggctgctcatctcattctcacctcatgggaagagtccaatttcaactttggacgataaattcccatcccactccctacatacaccatctcagtgtctttctccatcacagacagacgtgcataattcccacagtagaatcaacattttaaattatgatattttaattgatcaataaaatgtttaacatacagtgtttatctcttcctctagtctataccatctgttcttcaaaaatagtttgaatctatttaataggaaggtctttaagtaaaattaccaactgtatcagatcagtcctctaaagcccgaattctgaaagggaaataccagaaggtgctgctgtttttatagaaatagaaaagactctgtgccttttctcattccaggcttt

SEQ ID NO: 28049 - DNA, 1114 bp, Bovine  19866880715151
ttgcctggaaaatcccacggatggaggagcctggtaggctgcagtccgtggggttgtgaagagtcggacacgactgagcgacttcactttcacttttcacttgcatgcattggagaaggaaatggcaacccactccagtgttcttgcctggagaatcccagggacgggggagcctggtgggctgccgtctatggggtcacacagagtcagacacgactgaagtgacttagcagcagcagcagtatgtggatgattataaacttaggagtgatgatgatatctattttctccattctccagcaacacctggtttgattttgctggtctctctttcttttcacgtaaggattcctttgattatcagtgacctaatagagcaaaagtgcccagaggtgaaaccaaaccaggtttaaagtaaaccagaggttgacactcaccttcaaaacaacatcagagaagtggtaagattttcctgtttatggagaccatttaccagggtcgaagagtttacaatagctttggtaaagagattcttatttattcctttgttaatagatttcttacctggaactccactgggtggattaactttgtaaacaattggtgtctgtgccctggaaaactgtttagaaaatgttatcacggtgagcatttcattagaacaacacaaaaacatacacaagaagcctgtcattcctcacaggtcgttcatctacggaagcaagtcgctgtatttcctcaaatcacttctactacttttcatcttcatgatatttctgtgaagcagagacgatagatgttatcatagttcttccatggatgaggtcaagggactctgacaaggtcatgtgtctccctgcaccatttatcactcacacctgggcaaatctgtttctaccagcccaccggtcataccaggagcatgttttaccaaaggaaaggtagacaagccatgctttaaaataccaaccttttaattcctttattgcaacttgatatcttggggtcttaaagtggggtttttttttaacttttctggacaataatttgcttatttaaattgaaaggattgcaacttaaattattatcagtcagcaccttgcaagctatgaaa

SEQ ID NO: 28050 - DNA, 1315 bp, Bovine  19866880775065
tgggccaggacatcgctatcataaagcaagaagtccagcgatcaccaaggtaccacccgcaccttaacgtctctaacagtgctcgaaataaacacgttccagactcgcattgcatcagcagtggcgacgtctaacaatacaaggataaatgtaatagcaatagagcagctaagaactggcttggagttagaccaagaaggataaatcctgctccactggttactagcttcaactttctctcctacaaagcaagaacaatcccaccagcctcacaggtgcatgtgtgaggattaatttagtttatatttaagctgcttcctagagcgtctcccagagaattctcaacaaatggtaattattagtatcattctcaggagaaccattcttgaaatagtttttttctggacacagagacacagatggataagactttaaaattctgttacttctcaaacagaccaatgtagttgccttccacacgacattgcagagtcccaagaccatggtcttcctgaataggatagctagggaaaaacaggaaaaggtaagagataagaattacctggcaattcacttcagaagctctggttctttacccaggaaagttataaaacaaaataaaattacaactagagttatcatcaatacatacactaccagtcaaacacatagtgtgagagacaaaatttaacgtactccttacctccattgggttctttctttccaaagtctgttttatgacaaggacagcaagatcattatcaccctccccccaaaaaaagtctattagcaagtttgaacctgaaacaggaaaattctgagcaaaccaatggaagataccaggaagaaatcacattatacaatttgcctcttctaaacactagtcccaaaaaggtaagtcacagggtacagaaggttaacccactcagtcccaagtgatttgaaaaagccagaaaaatgttgattatctcaaaagtaagcacatagatactcattttctaaattttccttgtaataaataaacaattgaacaactgaaactttagtgtttttttcctctggctagtcgatacagtacagtgggtgagaggatgaactctggatatagtacagtggttaacaggatgaactccagaggctagtgagtggacccaggttcaaatcccagctctgccacttgctcgtagtgagactctgggcaattacttaacctctctgtgcctcagctcccaaatctgtaaagtgagactaagagctgtatgtacttacaaggttattggctgccttcaatgtgaaagtgttcatgcagtaagca

SEQ ID NO: 28051 - DNA, 801 bp, Bovine  19866880795707
atggttccctccatatgccagtgctcattctcttaagtaggatagattggtcactgacagagcaggatgcaggagcactggccaagtcaagccaaggtgaagagcattgggccacagttacattagagataatccatcattcatgtttctaagtgcattgtatgcataactgcttctgaatgttttctctgaaacatcttgagtaatttcctggaaagcatggtacttctagacaatgtggcatattgatcctaattgtctacacctggagcagagagaggtcctctagaagctgtcattatagctgagagtcattttggacctgatctgctctggagcctactttaggatgattttttttttgtctgcatcaatttcaatgccaactgtcatgtctgttattgtaatgcaaagagaattacttgatataaatctttataagtcaaaggtttctttcatctttgcagaattttgttgtaatacgcacatagactttccattttgaagttttgagaatgaagatgaggttaatctccatataataaaaaaatatgttgtttcaagtatattgccttgtgtttatttatctgtcttcatctgatgatgggaaacatgtctgactcatctttgagttctcaccacccggcaagatgtggcacatattgaggaaggaaaggaagcaagaaagaagtgtgactagatggatccaggaaatttcaaagtgcagttggcacctgaaagaaataagaataatgtttctactcttcttcatcttattctttgcttctaatggctgttgga

SEQ ID NO: 28052 - DNA, 2029 bp, Bovine  19866880853438
gaatcttgttttccagaattttgcttctgcacatatgaggcagaaagaaaaaaattattcttttttattaagactcgcaccaccacctctacagtgtctcaatgaataaaacagaagagagatggccgggcatggtccttaatcaccatgctgtttttggttttgatggcctttcaccccagataatagttttcctactgattaaaagattaggaaggagagagaggggaaagaaaagaaacacttcctaaaatcgcacattaaagatagcaagtccttcagtggttcccagaactcggtaagttgatgaaaagtcaccaggggatgcagttaatgagaggcattctgagctgaaggaaacccggtgtctgcctttgtttggggactggggctaggggaaccgtgtgtattaaaaattaattccacctcgccagtccactccaaagagcctgctgcaggcactgacaagttagaacagctcacagaaggtttatcaagcagctggtggctcggctttgtcactctcatcctctgcttctcagctccccatcttgctgctgccgaccctacttgggctcagggatcagcatgaggaaagccgggtttggaagctcattaatttttcactctgtcatgtctctagcttggtgggtgaccagaggcctgtttctctttaaaaaagtacagctttatgtcatgtcagctcacagagaaatcacgagtggagccctttccgaggtttccctctgagcctgctccaccaccctgaggacccgggagggatgatcaagctctctttcccctgctcttctggaggaaggcatacagctgaagggtagaccctgtattttaagctggaaatcgacgggtgtgttttcttgtgtggtttggacttagttgtttcatctgcctccgtttctaacttctgggagatgggggcagtaaccactgctctatttcacgaagctcccatgataaagtcccagtgggcatgacagtggtctgaaaggtgtcctggtggaggtggaggtctgagtgcaggaggaggctgggagagagggagtgtacgtttggcaagtgtgtgtggagctgtgttaatctttatcctttggtgccagcagagacagctcccagcctgtgaagtcacagcattcttattttgacccccagactgtgcatattttctgtgcactcttttctaacctttctgttaggaagggaggaaactaaccttgatgacagactgcacagatgtgtgaatcaatacgtaaagcccacacttgcccagacaccatcaaagtccgttgattcacgatgtctgatgagggctggtgattaacactggagttactctttagtgaccttctccctgggaaggtggactcctggggtgctggaagctgaccaagcaaaacagtttgctgtcttggctttgcagatgggaggtacagtaggtttggggagggaaggcggtctaggcgcctataagaggtgggggtgagggtagcaggatggggagactgggtctcctcctgggtgaatcatgagcacgtggctcaaaccgcggccagggcagtccatccttatgactctctgtttcttcccactggccctgtaatctgggactaacccagaggatgacaggtgatatggaattcctggaattgtctccttttctcctttgcttccgggcagtgtgtcagttgtctcagatggggcctctccatgcattcacaaaaatgtaaatgtctccttataccaggctgtgcccagggatgcaaccaatgacttaggccttgcccctgcctctctggaacttatagctagcaaatgacgcgctgcaggaggtgacctgagtgccacgaccaggcttcccctgcctgtcccatcaatgctggtttcctccctggagaataatgttgcttctcattcgttgcgtcatgttcccccccacaacaggcaccttgcattttcccgaacaaatctccctttcgtatctttcaaacttctaattttcatagcttgcaag

SEQ ID NO: 28053 - DNA, 2488 bp, Bovine  19866880907620
gggtctgcatgtagaatcttgcatttaaatcattttgcggttgtctctaaatatattaacttcaaattgctgcaaagaaaataaaactgataagttgatggcccaacctcagtgtgcggtttggtttgcttgtttaattttagaccttacttttcagtgacatccgttcagacttgaaacttcagtcattttctgaccttaattctcaaggtatcagatgaagtcagcattaccaaagggaagcccacccataaaaagaaaatttgcatttgcctgctaacgtattgggatagaattctaaatgctttggtttgaaaagaaatggaaagttttctgacccactttaaatcagtgtttcagtaaaatgctagtgaaaaacctacctaaggaagaggcttggtttccatgaggttagtagtaattattactcaaaggagaaactgacatgctcatctgatgagttgggttgtggatgttcatgtagacactggggaaacactgatggattgcggttgttttaagatgacgtgatgtgatatatcttccttcttgtatggcttggtttcgtcacatcttccaaatatcatctcaatgctttcagtccgggaaagatgtgtaagagcaaatctcatttacccagatgatgaaggcataatggactactggggagtcaccagggacagaatacctgtcaatcaaatccctcaggtggccaaagtcacagctgatcaacattcttttgactacataggatgaatttgttaaaatatcatatatcaaggcatgtatgtggaatctagaaagatggtacaggtaaaactatttgcagggcaggaatagagatgcagatgtagagaacagatatgtgggcacaggatacggggaggggatgcgatgaatcaggagaatgggactgaaatatatacactaccatgtgtaaaatagatagctagagggaaactactcgtataacacacggagctcagctcagtgctctgtggtgaccctaggtaaagagggtcagggggggatggaaaggaggtccatgagagaggggatatgtgtataaacatagctgattcacttcattgtacagcagaaactaacacaacattataaagcaactatatcccaatggaaaaaaagaaaaagacgtacaaagagttttgcgatctgactccatcagataaaaatagtctggtctgggctagatctaggctcttacaacatcaaaaatgaatagcaaaaaataaaataaaataaaatttcaaaaaacgaatagcagaagaaagataattagtcactcacaggagctgtttacagcgtatcttcatcaacaaccctgcaagagttagaatgaccagtggtgaaaaaacagaatccagatgttggaaaaggattctacctctcacctctcagccctcaccagtccattaacaatgattcatttagagcttctctctattaatagctccttcaatttatcatgtcacataaggggggaaattcctccaccagcgatttcagggaaagtctgtcacctacccttgcagaattcccacccaacagttcatcattcaggacaggcctcagaaacacagccatagtgaatgcttaacagctttgctctggagatgagcaatgatactatcaggctgatattaaggttgatttttcttatttaaaaaaaaaccatggtgatttcacatatagtaagttgtgatcctttaaacacatcagctttaacctcagagccgagcctctggtacataacactattaatacttcaaaattagatgatctagattttgaacaactggatctaaatctggacctcagctaaatcccaactgtactgattccccaaggccctccaaatgactctgctgcaaacattcccttccctcaaaaccatgtcttcctattaagtgtctgacattgcttcttgtatgctggcccacaaattcaaaacccaaaaagattcttggcagctactcattatcctctctatagtaaatgaaaatcaagagaaaaggaggcttactggtgatgtgaacaccatgagacaacatgacacccatttctttgagtagccattgtctttaaggtgtaatcggagaaagcaatggcaaccgactccagtacccttacctgatacagaaatcattaatgatggcacagggcctcctcttctactcagattagtgctatttttattttaaaaggcgctagagtagaaataaaaaagacaatagtgattatctccatggtaaccccaccacctaagcaagaaattatttatttaattaattttttaatgacagtcttaatttaaggaatatatattcttccatctcccatgttattctctactataagtagaagggaatgctgtttgataatgtaacacagtcaaggagatttgaagatcatttccctaagtcaagaagcccagagacacttcactaggaccatctcttccaaagca

SEQ ID NO: 28054 - DNA, 2938 bp, Bovine  19866880915984
acagaatgccctgttgcagatacactcacaaatcagagcaagtccctttggtgtccccatctggggagggaagagaagcaagggcacagctcctcttcacaaaagtatttcttttaagggcttccctggtggctcagatggtaaagaacctgtctgcattgcaggagaccagggctcaatccctgagttgggaagatcccttggagaatggttacccactccagtattctaccctgaagaattccatggatagagaagcctggtggactacagtccatggggtcccaaagagtgggacatgactgagtgactaacattttcactttattcacttctcactccttctaaaaggcaacctcactccctcctccttagccctgtttgtaggaataagcaggagtgggtgggcatttgttacaccaatttttctggaatgccccctgggcaaatgcttttgtggaacctgcctaagaatcctttgttctgcctgatgggatgctcttctagctggtgacaccagggatactggacgatgttttcacactctcctgtcacagttcccttccctagctcggtcatctccagggaacggcatggctaacattgctttcttcctgattgttctaagtggcctgtgttccactgctctgcattctctctttcttgcctcctcccacaactttctcgctactctccacttccggccttttgccctgcaacaggagcctgtctactttagtgtggtcctctggccacatctgtatctccactgatattgctactgagatctgaatctaatttaaattccccctcaggcattccgtgtgatattagacatgtgtctcccaggaggattgagtgtaccaccagggccccgagtaaaggtgcaaggctctctgctcctcaggcaggtaaggaagtcgccacggtgacattttttaaccacaaggggcaggaagtggaaaggaaggcgtttgaatctgatctcagctgtttgattggctgctcagtgagtcctgcatcatggatcagagcttttctttcagaggtattcttagctttactcagatgcttgacaacacccggggactcctagccccaggcgactgaatggccagtgggttcagtggaaaccacaatccaggaagtgtaactgccatcaagatgttcccatagtgattggtggaaaagcctgagctgcctcctccatgctctgggtcagttgcactccagttcatgctctaagaaggcagagcaacagactgcttcttctttgctcataggacggttagatgaggcagagaatggggtgtaatggggtgcatttaaatgttgtttctttgctgttgtgggcactgtctgttactctgaaaagtagagctgtattgtgatggggccaccagaaacagagcgggcaggggggcaggttccactggtcctttttcactatttatttatttttggctggatcttcattgctgcacatgagctttcttcgttgtagtgcaagggcttctcactgtagtggcttctctcgtgaagcacaggctctagacgcatgggcttcagtagttgtggcacactggcttagttgccccatggcatgtgggatcttctcggaccaaggatcgaacccatgtatcctgaattgcaaggcggattcttaaccactggaccaccaggaaagtccaccttctgtgtttaaacctcctaccccatgtctacaaattgcaagtgcaccagggaagcacttttctgggaagtgttagaacaggatctcaggtgtagttagggatgaagggtagttggtgtctggagtcctacatgccccacaggggctgacttcacagttaaaagcacaggcaggggagttcattctgagtctcatcgaggggaaaactttctaaagaaaggccattcgggtgtaaaaactcattcaaagcttaggctgggcattctccaggtccctgatctgtggtctttactcaaggaaagctctaatccaaggtaacaaatgactatatgaagcaagtgatggagaaaatgtgagtctgaattcagggaatagagagtctgattcctatcacagcggttcctgctggaagctaccagggtcgtggtaggggaatttcctgagtgctgctgatttttttaacttgaggaagtaatttttattgcatttctaggcttccttattacatttagcaggcaagtttgaagaatgttgctctaaaataagatcaaaagagtttaaagtgtacattataaataaaatgtatatagaaaacacaatgtggcagttctggatggttgtcagtgtcctttatacaatgcttttggaatttcttttatggaagagtagcaggggtggggtggacaggcagctgttaacattcgatcgttagctctagacaggcagatcacagtctcctccccagggccctccaggctgtctggtctcaggctggcgggtgagctgggggtctcagggacaggatgagggctgtgtcctgcaaagctcccaagccctcaccccagcctcccattgaccggcgcaggtcttgagtcaaggacgacttctccccttatctttgcctctgcgacctaatggcgacaggggtctccatgggttgcagttcatgggatgcagccccgatttgggcggcctgaggatcctgaggggcagctggagtcctctgtgatggtgactgggtaaggtctggatacctgagggcaccgccagctgaaagctgcctcctcagctaggctgggcactggcaggaggacccaaacttgagtgctggccatacattccctgggcagggtaaccagcacccgcagggaccccccctcctcttaactaggacctggatctcagagggtgaaggttgagccttcttgggaccttgccctttcttgtcagaacagagactaacat

SEQ ID NO: 28055 - DNA, 3777 bp, Bovine  19866880979841
ctctgtgatgactcagatgggtgtgatggtgtgaggaggggatagtgtcatggaggaggggatagtgtcatgagggaggggatataggtatacatacagctgagtcacttggttgtacagcagaaattaacacaacattgtagatcaattatactacacttttttaaaagaccctttgcctggtctcagcctcagctttgagttcagggctaaagaaaaatcaaacatgaaaaacctggctccactgctagaagtgaaatattccacaaccatttacaactgtagttgtaatttccccaaatttcttcaaactggagatcagcaagttcaaataggttctaaataaaaaaggaagaaagagagaggaaaggacagagagaagaaaagaaggaaagaagacggggtgggggggaaggtagggagagacaaaataggaaaagaaggaaggaaaaagaactcctatggagaagatactgctgaacatacatttctaaatgataaatcttaattactcctgctgaatgttcagaaatgactaaaaaaatcaatgagcttaatctcccacatttatgggattggcagcacatagtagaaaattgggtgtatccatcatcaagcgtgacttggccaccacatctttccactctctcctccctaaccaagtcagtagaaatgaaatctcagagttgcttttcatgcctcatcatacagagtggtttttaatgcacaagtatatatgattgaccatatattgttgtatagcgtgaaatttaaccaaacatatatctaagctaggtaaacttaaaatatgatgaccctatcaagttgaagtaaatactattaagacatgtatgaaatgcatcactaattctcagtgattcacagaggccatgattcccaggggttctgtcacttgcgcaagtttggggacacctgtccagcaatccttgtgtgataccaatgtctatctttctcttcaaaacgtcaaccctactctcattctcctgcttcctgaaccaaaagccttcaacagatacacttttgctcacttacaagcttttcttctgcctcagagatagtattagcagtagagggagagagacagagacacatagacaaagatagaaaagcatttggtgcccaaaggcaagcctttccggtcaggtcacatcagagccacctgaaaggagaaagtgggtcacaaacaagatcagaaggttcctgagagcaatacctaagaacccaggagactggaagaatccaagattccctccaggaagccccacggggaggaggggagggccctttggctgactaaaattctaattttagataacaaaattggaaaaatattttagatagacaagaggaccccaggtgaccgaggttgtctttgctgactttttctatcttccttgcagaccacaagcatcacagtggagagaatggcacctttgtgatctctgattccccttgtaactgacatagcacatgtgcgtgtaccaagtcccttcagtcgtgtccaactctttgcgaccccatggatgataggccgccaggctcctctgtccatggtgattctccaggcaagaatactggagtaggttgccatgctctcctccagggaggtgacacagtagtagtgcttaaaaggaagattttcagaggatgactagaaaattgaatctaccttaccagctcaatatgtcaacctcctagaggtgtgtatttttaatttttcaagaaagtcctcaaaagagacatttcaaagagaggatttcagcaaagcacaaagatatattttggaggcagagtctcttcccatgacccacaaatcacagcacgagaatggtctctcttgctaagcttgagatccaatgatacctgacattcctgtaggaatcccatgtgagaatgagaacaaagactgagaagctatgaaagtggaggaaccagattttcctgcaaaacagtctcccaaaaaagactaatagccatctaccttaccacattgccttatcgccctttaacccagcaaattcaaagagttgggagaagccaaaggatttcaaagaatccttatgttaaatgtgattgtcatgcactgtttacttttatgtgtttaaccttgaaaggctacaagtagaatgaaggtcatttgggaggctgaaaatgtaggtcgagttcaagttcgtggaaggagcaccctaccaacactgacttccttcccctgaggttactgtaagtagttgcctgtttcagtcagacactgagaagccaacttcagcccccagaatgctcttcgtgcgtctcccacacagagctcagcagtcaaactgaaacagcatccctctgcatcctttcagacccccacatgggtgagtcagagccatttcccagcctctaccttctgctttcaccaaaggcatggttcaatagaactggcccctggataaagcaaactgtccagaatacactaaaaagaggtctcaacacttgaacctccattattgctctgaggcatgaacatttgccaggagattagaaatgggtagactgtgtgtgtgttagttgcccagttgcgtccgaccctttgcgaccccatggactgtagctcaccaggcccttctgtccatggaattctccaggcaagaatactagagtgagtggattgccagtcctttctccaggggatcttccctacccagggatcgaacccaggactcctgcattgtgggcacattcttaactgtctgagccaccagtggactataatcaataatgttctcccagcctggaaatataattcttaattaggctaatcaaacatccacgttgatgaaaacttaggcatgcaacaaagaaaatgaagattcaattcgtttcctatcattgctataacaatttactacatgcttgttggctgaaaagagcacacatttattctcttacaagttcactgggtcaaagccaaggtgtcagcagggctgtgttccctccagaggctctaggggagaacagtttctttgccatttgcagcttccagagctgcatccctcaattgtggtcccttccttcatcttcaaagcacatcactccaatctgttttatcagtcatgtcatcacatcacatcgtatttagtcctcaaatctccctctgcctccctcttataaggacatctgagattacatttacagtccaccacaacaatccaagagaatgtccccatctcaaccaccttagtatgatcaaatctacaaagtctcttttgccatttaaggtaacattcacacattccagggatttgagcatgagtatctttggggccattattcaacctactatttcatgcaagaaagagtttcaaagaagaaaacaattagacacatcctacagcaccctacaactgaatataagattatcttgattatttagaaaacaatatctaagtttttccacactatgaatatcaatgatcacgatattctaggagcatagaaatgcttgtgaatatagagttctggagaataaatgaaaccagaaattcagcttttagacttcagaataaactatgaggtatagaatcatttttgttcagtaagagtgccttaaaatctttgaaatcttagagcaaatagtagagaatttgagaatttatttttaagaggcaagcaaattttttgttttgtactagatgtatcttgaaactgccaattttttttttctgagaaatgcaaacagttgggtcatttaattatgcaaatataaaagaaagc

SEQ ID NO: 28056 - DNA, 1052 bp, Bovine  19866881017438
ttttaaaaaaatcccaattatcttcatttcctccatttggctccttggtgtatgatttaagatgcctgactcctttccaacccagcgagattggcagagggtggaacccaggcattctggctcctgtctgtgcctctccactagggtgtgctgcccactcaataatcgtggacccctgaccagccaggctggggggtgcccggcaggtttccgggagaacgcttctcactgatccccagtgacaaagaaaaaaatcccgcacatacaatattctttgacccttccttttttcttctttaccaaggcaagttttgcctttgttcggcaaacgtctttacagaaagcagcttctttggaaagctcacggccagagtttggggcttcgggctttaatcagtggctggctggttattttacctggggcatggaattataaatgttctcttcctctgtggctacatccatacaatgaggttaagcttacttatctattggaattgtggtacaaaacacccaacctcttcaagtgtgattagcatgtgttgttacttcactatacactttctcagtagatgatttctctaaaacggttctttcttcccccacctccgcccccaccctgaagatgaacaacctcaggtgccttgaactcagcgtacctgtcataacttgtctgcaagagtctcattctattttccttgactagcttttgtaagataacagattcatgataacatgacatggatgataaatgggtcccctgattgaaacttaataccacttaagcaattgttacccacagactaagataacctcgctcatttaaaaacatctctcttaaggagattggttcaggttgcctttctaatgcccctgagatttctgcccaatgaaccgcttaaacacagaccacgagtgaagtccttgcgtgctatagtttgtgtgagggtcccggaggggcaatatttgctagaataaactgttatgaatggcagtcacgaactgtcacttctgcgccatgcttgtgacaggtcgactgtaaaacaagagtt

SEQ ID NO: 28057 - DNA, 2313 bp, Bovine  19866881026457
agattacctgtttgtagataaatagaacacttcaacaagcgaacgagatatctcattttgatatcttacattgttgaaattccttgcagccagagctttaaaaactaatatttgatcattttaattttcaaatgctctgacacctctctgtgcctttggagtcagctgtaaactaatgaatctggaaatgatcaattcatatttctttccttagtaacttatcagagttcgcctgaagccatgcatcctccttagtgcatgtccaggatgtctgaggcattttctcctttgtgacccagattctctgatttgtgtgtctgtatctagcttccaattatgtagagcatctccttggacatgctgtgtagtccttattagtaacagagaaaaacaagtagctaaaatatgataggtgtattctccaaaggacacttgaaggaaacatttgatttatgatatgtttcttgccatttaatacttactttaaaaatgaataacaaagatttttctatttctctaagaattccaaagtcccaattttaaagtaaacttgggttttttcacaaagtagtgaataaagaaaaaaacaaacagactcccagatatagagaacaaactagccattacctgttggaagacggaagtggggtggggcaggagggggtaggggattaagagatataaagtattctatataaaatagataagcaagtaggacatattagacagcacagagaatgtagtcaatattttataataactataaatgaaatataacttttaacaattatgaatgactgtgttgaaacttatataattgtgtacatcaactatgcctcaatttaacaaacttgggagttttcagagggtatatcacctgtgctcttgaacattcgactggttatcacccatggctcctgccagataccactgccacttcctccaggcaccaccttgctcactgcacactgctatttccctccagacaccacagactcctacctgacactgatgcctaaacacaagaactctgatggtaccaaagccccatgagcatgtgaggggaggcagaggataaatgccttatatcacacctacagatgctctgctgaaaggatgccagggcactgctgctttgcatagagtttgagttcaactctttttggttctgttattcttcctgcttcctcccataccatctggcctctttggattcacacaggactcagttgctattttagcctaaaggcaaggccccaggacaaaaatgtaggcagatgactcaaactttgttccttggtcacgtttgtcttgacaaactcctttttacttgggctgtgttctttcccagatgttttctcagcctgccatgtaaataaatgtctggtgggttggccccgccccttcgcaaagcctgctgggcatctcagaacttccccttgagctccgttacagtcctgtggaggctagaattaaacgaggttgcctggcccatatgaggatgcttagcccagagccagtgcttaggtatagcctgcaaatactttaatcacaaggaatagcaagcccttcaaaaagtgacggcattagatgtggattggttgtatttctctttacggaatcttagtaggagtgagaagacttgattttggtgtaagtaaatgtggataaagcacatgtgattaaatagttcagtcattgagtttagggggcattggggtacgatttgttgaatacacttaaacagagtacaaaattgcaccctcaggcccagtaggagtgtgtccttgcgctagggggcctgtttttatgttgtgattccctgggaacattttacacacattcttacacttgtgtgtttatatgtgtgtagatctagtgcggtgggttggtagggaaaggggcagaggagagaaggccaagaaagatcctctctaaatcactgctttgtccttgaactttggactctagagctctctttgttagcctagatataaaagagagacagttcattactttgaagctcacatcatataattctttccattctttgcccctcatcttcttcccaacaatccgaaccaagatttatacattctaagatctgaatgtgttggggcaggcttctcaccatcagctgggacactttagagtgagtcagctgcctcccacagtctaggagacgaggaagggggggtggttcctacctgggaggccagtggggtccttcctgaaccactggtgggagaactggcctcaattacctgcagttgcctaatgtctttatttaaatattctctgcagctccctaca

SEQ ID NO: 28058 - DNA, 1251 bp, Bovine  19866881041549
ttaaaaagtgatgaaggggacttccccttgcagtccagtggttaagacttcatgcttccaatgcggaggcgagaaggggaacaaaggttcaatccctggtcaggaaactaagatcttgcatacagaggagcctggtgggctacagtccattgagtcacaaggagtcggacatgactgagagcaactaacactttcactttataccttaccatgtggccaaaaaagaaagaaagaaactgatggagctagtgtttatggagagagagcttgttctatggaccagaaatcctgaacttttgacttaaggtccaaacaccatcctttaccatactggccacctgatgtgaagaactgacacattggaaaagaccctgatactgggaaggattgaaggcaggaggagaacgggatgacagaggatgagatggacatcaccaactcgatggacatgagtttgagcaagctctggtagttggtgatggagagggaagtctggtatgctgcagtctgtggggttgcagagtcggacacgactgagtgactgaactgaactgaaaacagatgtgcccacaaaaattgttccatgctcaatatatgtgggaagtacttagaccctttactctaagccttctcagaacctttattatattcatgtagacagtgactttctaagatggagctttatttgactaggaaacaacactgaaatcatttttaaggaacccaagtttcagaaataaggtaccaataaaattatttcacaataccccagaagagctaaagcttgaaggaaatgagagaaattgaactgatccctaaagcagtctagaatatggaaatcttcttacttaaatttacactattaatttatagcatgagatgaggtctgccatcagataaagcatgctactgggaaagagtaatagaaattcaggaaagagataaaattcaagtggtcattaaatcatctacagtttcaaagcagaggaaatttcacatctgctgaagatggcttttctttatatatatattttttctttctgaggtaaaaatatgcctatgtgctgatagctagaatattattttaacatcacatgataattaagcacagattaggactgaaaattcatagcttctcagagcataaatgagcatctattccaaacattttgttttataaatgaaaattccacctattgtaattttggagggtcccatagcatccaattcatagtgcttagtaacttaaaa

SEQ ID NO: 28059 - DNA, 973 bp, Bovine  19866881048377
tctgagaatctgggcacatgacggggaatggagggtggtgccaagaactttagcaactgactggacagtgtggaccttgtctgggagccctggtggtctgccgccgtacccagcctgggactctttcagcgccaggatttattcaggttccttgggctggaagcttactctctgtgagtcctgcttcccacagctaagaagattctctgtgcaggagagcacgggctcattccttgtgctaatggagttctctgaactcttgtgttcccagtgggtgctctcatttctcttctcccctggggagccggtggccttcattcaagctcctcctctgcacagcttgcctcctccccgcaccttccacctgagctgctgatgggcctcccgtggatcagcacctgaggacctgctgggcccggtgtggcttgccgagctggagctcagagctctctgggggtttactgtctccccagcccacaggcctcccgtggcttagcatctaggcgattgacacacctcctgtggtgtcagctagggagcagcttgagcatcttctgtttgctgggaaatcatttcagaggttaccttttctcatttgcatagtgtgaatgcacctggttttgtttcctttctttttttggtgaaactataaaagggagagggtatataagaaaatgtcaacacttgcttatagctgtgacattggctacagcaaaggggcccaagttttgccatttggcagttagtgtaggcctttatcataacgccggtgaggaaatcattataactggggaaagaggagtaggagtagagccagtgtctttctgtatcctggtgtatgtagtaatacttggtgtgtatttaatgatatcttacgagtctgaatgaattaaaaaggcttcccacacatcttaaattatctcattcatctggaagtgccacttcagaggaggctttcggcagagcaagctgg

SEQ ID NO: 28060 - DNA, 802 bp, Bovine  19866881051318
caggaggcaggggacatgtggagtctctctcaccctccggccccacatccaggccctttcatcataccacagacagaccctttccaagaacttgaatggggatccacaacctcccctctgatcgctcattaatctgccccttcagacattcctctgccttttggctggtctggcccaccccctccccaccccccaggaggataacattcagagtggagtcacttcttgtgagcagtaagtaccatccaagaaagcaggctgtcttgtggtacctgagtgttagagatgtctgagctccctcaacttaagctgctctctggacctggaatgccctgaaatggtcactttgggagaagtggatctgtatccattgggggccaccaggagccaggctctgctcggtgcctggtgatgatcaagggaagcagacttttgacagttcagccttgtctttgagaagctgcccttaaagagactttacagagttgctttttgcccttaagacgctgcctgtctagttgggaagataaaacatgaccacacaaagaggaagtatattatgaatttcaatgaccacgacagagtcaggggaggaaaggtgaatttccaagctgaggactcatgaaaatcttgaatgaggaagtgggatttgatttgagcctttaaaggattggcaaggtttacacaaagagggtggagaaagggcaatggtttgaataacaaccatgagaaagcacagggtatgcaaccatggggtgactggcagagggttggctcctggatgagctgatgccaaaggtgg

SEQ ID NO: 28061 - DNA, 1056 bp, Bovine  19866881086597
cttgctccaacctgggaagagagaggagccattctcactcagaactagggatgcgctcttggaaactcaccggttggccctcttctcgttcttcctacgaaggtcattcacgttgacgatcaaccggtactggttgtcactaatcagctcccgaactttgctctgataaattccctggtcttcctgcaaaataaccaccacatgctacagcagctcacaaattaaaaaactggatgtttttaaacagaggcagctctcacagcaagataaatatatcaatctctgtggcagacctgggcccccatttcacccacattttcactcattagcttcggattccaaatacaccctaaactgccagtgtataaattataacgacttcctcacggttattattcctattatcaccaacagctcttctgtgtgcatcacttctgaacttttaatggggaattaaaacgagctcataagaagtctaaaaagacaagtaaaaaccttgtcaaaatgtaaattaaaggtacttttaatatatcaaagtatctttccgtttgcagaatcttgtatttaattaaaatattttatttccctatcatctgtgtaacagaaaaggagttctcatataaggaacttactagccttagttatatttacaaacacagcactatcaatccaagatgctttagcaatattccatggctgtcaatcctaaattgcctataaaatcccctttatttgcgtaccaaccctctttctccgcttcccatcaggtatggaaaaagaatgcggccaaattagaaagtccttttctccagcctgggggcctataacgcggcgggtcactaccgttttcccgcggtcctttccccactctccccccaaattaagagagtagggaactatctctaaaaggtcaacgtgggctttacacttggtttgcacttggagaaaacctgttgactttcgcgagacctagccaccatttgcactcgagagaaaaattacagaattgctcttaaccactgactctgtcgccaagaaagctaccagatcgaggcg

SEQ ID NO: 28062 - DNA, 1466 bp, Bovine  19866881117739
tgtccttcaagactaaatgagccaattaaagattctgttatcacgaagtagaattcagtgcatgcagcaatactgagtaaaagcaattatattcctgcctctccaaaaaaagtatatataggtgtttgtgaaaaaactatgcatgtgggcacccttcagggttgagtgtgtcagggggtgggaggcgagacagttgttacagaattgaattcatatgtccatcacaaaacagttaataatattattaaccatattataattattataattattaaccatattatgatgacgtatttcctgttatctagaggaatctcatgttatttgtttgtaccttttacacttgaattgtcattcttttacagacaaagtgggaggctattaaggcctttaatttcacctctcctcgacattttttttttttttaagacttaacaatcccaatcagaccattagaaaagttcaagggaaaaaaacaaaatctatggctacatgtaggaaattctctagaacagctcaaggcctatgttattttttttttaaaaggggagatgtaaaggagagagagagagtgaggaggaaagaaaacagagggagagagaggaagagagcaagaaagggagggaggaggagacagggaggaaggaaggaatataaaggaagggaagcaaagggaccgcatctcacttatccatccaagcaccttgcagctgctattactgttatttatttatttcctcccctttggagtcagatccttttttctcatttagtccaacagagattgtcctcctggagtgaccttttattctttccttttccttcacccctccgggctattgccctcatgccagtaactagataacacactctatcaaagattttttttttaaaaaaaaactcattgggaaggcagtaggactgttagtggcatcaatcgtgggctgacacaggccggggtcaaccatttatcttggcgcgtctgtagcccgtggttactgggctgccatcttgacttgcagacgtcacctcccagcctgagaacatctgctcccgagtccttttcttcccttgtttggcctgtttctttgttctattccagtagacatcttttcagacaaaatcaaggtgggaatgagtgaagcccctcctttttatcagagcctttccaaattccagggccagggaaacagttataggctaggaaaagaatcttgcttgggggaggggggcaaaattttcagaataaaactgaaacacttttttgttccttaggaaatccagctatgcccataaagttaaactaaactcacagaatgttgctctaatcccactagacatgagattttaatgaaacatttcttttgattaactcatgctactccatccttttcccatcctgtcttctcttcaccccccacataccatttgcaatcattttttagtcacttattcagcatgcagca

SEQ ID NO: 28063 - DNA, 5563 bp, Bovine  19866881135810
agtgggttgcctttccttctccatgcatgaaagtgaagagtgaaagtgaagtagcttggtcgtgtccaactctagcgaccccatggactgcagcctaccaggctcctccatccacgggattccaagcaaaagtactggagtggggtgctattgccttctccaatgaaaacttaggttcatacaaaagccttaaacagatgggtgagacaattttatttgtagtcaatcaccaaatctggaaacagttcaaatgtccttccacaaatgaataaactgtggtacatccatatagtggaatactgtcccccacaataacaaggaataaaatactgtttcttgcagcaagttagataaataccaaaggtatctgccagtgaaagaagccagtctcaaaaggttacatactatgttatcccattcgtatgactgttgaaaagaaaaagctgccgtgacagggaatagattagtgacctccacggggatgtgaaaagaaggtgtagctacagagatggagccaaagggagggctttttcaggctgatgcaactgttccatatcttagtggtagttacataaatctactcatatgttaaaaaaatggacatcaaaaagtccattttactgtatgttgttataaaaaaataaatattaaaaagtctaaaaaacaacaaaaactgcttccaggatttcctgtaaaacctctttcaacaaataccatctaatcaagctgttactgcctcactcttccactgcccgaaatagatgtatgtttgaggatcaccagaaactgtcaagagtctccacctggaagacagcgagaaaaagaaacaaacaggagaaacaaaacccagtggagacaatgccagtatagaaatcagaagggaaacttaataacatcagcgaaataagactatcatgttcatgaaagaagaagcctaaaaaggaatttttcagaaaaaaaataataggagagtagaattaatacattaaatagaaaaaaacatctaagaaagtaggataaaaaggcaatgggaaatcagagagaaattaagaagattagaaaagtaattcaggaaagctaatatcaaaataataagagtttaaataaaacagaaaatatagaggacataattatcaaagaaataagtaaagaaaatttcccaaaaggaaaggatatgactttgcagactgaaaagtcctgcccactgcctagcagagtggttagaagaaaaagccatagcaaagttacatcatactgaaattacaaataccagggacaaggatgagatcccaaaaatctccaaagaggaaaaactaataggttacatataaaagacttagaattagagtatctataaactgggttttttgtgtgtttttttgcaaagtcactcagctatatacatttgtgttgtttagccactaagtcatgtctgaccgttttgcgatcccatggactgtagcccaccaggctcctctctctatgggatttacccagcaaaaatgttggagtaggtttccatttctttctccaggggatcttcctgacccaggggtcaaaccaaatctcctgcattgcaggcagattctttaccattgagccactgggggaagtcctccagttacatatacatcccttttaaaattactttccattatggtttatcacaggatattgaatacagttccctgtttatccatcctatatatggtttccatgaagcatctaaaaaccctttaacttcaggactagaagatagaagacgatgaagcatcaactccaaagcatcaaggcaaagtgaactccaacctagtggtctatagtaacaaccttccaagaacggggtctccatttttaggtcaaaatctttaccttccacagaccatcagtttaaaaagttgccataggctaaaacaatgagagttaaatcagaaaagaggcagatgggggaaataggaacaagaatactacagagacatgaagaaattctacagaatgttggtcaagagaaattccaagacctagctctgaaacactttttgcaaaccggtggtacaagttaaacacttgggattgtgtggggtttggcatcatccactaaagctaaagggccagcctctgagccagcagttttaaaatctggcacatactcaacagatatgcatatagaagattgttcataacatctttctctgtaataaccctaaactggaaacaggcaaatgtccagcaatagcaacatggctttaaaaactatgatacagtccataaaagaactgatgctttcgaattgtggtgctggagaagactcttgagagtcccttggacttcaaggagatcaaaccagtcaatcctaaatgaaatcaatcctgaatattcactgaaaggactgacgttgaagctgaagctccaatactttggccacctgatgtgatgagacgacttattggaaaagaccctgattctgggaaagattgaagacaggaggagaaagggatgacagataacaagatggttgggtggcatcactgacacaatggatatgagtttgagcaaactctgggagatggtaaaggacagggaagcctggtgtgctgcagaccatggggttgcaaacagttggacatgacttattgactgaacaacaataatgacataacaattggaagaataaattattgaaacagataaaaacatgaatgaatctcacagacataataatatgccaaagaagccaggcacattagagttgcacgatgtatgattccatttacataaagttcaaaaacagattggaaattaacctatacttgagaagtctgaataatggttctcctttggctggggggtaggggttggggttaactgggagcagacattaggggttttagaggaactgatgatgttctatttctagatctgggtggtgtgcatgtgattttgctttacaaaaattcatagagcgcttcacttgtgatctgtgcacttttccccataaatgtcatatttccatgaaacatctgttttaaaaagtataacaaatactagagaaaagtaatgaatgagacgagagggtgaagaagttaaagaagtttaaggtccttgcatggctcaggtgaagtttaacagtgccaatgtaattaaaactttgtgaagatgagcaggcgtgtcacaaatttaagtccaagaacctatatgattttaacagaatgaataactttcaaatgagtgtatattaaaaaagatattattcaatgcaagacaaatcaagtttgaaaagtagggaaaaaagcatagataatgaattccaaactgaaagcacaagataaaatggtagaaataaatgcaaatatatgggagacatcagcatgtggatggtaattgaaaccactagagaaaatgagatttctcccagggagagcaagtatatgtagaaaagaaggagacctaggatggaatttagagaaacaaaaagatgaaagttctaaattgaggaagacagatccaccagtgaaaatgaaaagtaaccctgagagaaatagaatgaagcaacctcagcagcattttcccgaataagatttttttttaagtagtatcatttgcttgaatgaattacagtaacagcaaaaaggcaaccatcgtacagatacttccaaaagtggggtgatcataatttacatccaaatcaggacatcttggagactgtggaagggggtgctaattaaaagcaaggctaggacagcagaataaaccaagcttggatgtatagtgatggtttgcacacctcttatcttgcataataaagccattctcactgaaaattattctactcatctcaataccaaggtaatgttgggtatgaaagtaccaacataaacaaatatatctaatgggaaaaaatcctttctaataaacaattcttccagaaactagtgtttgttttaaaacatgactcactgatcattgtgtgtcaccaaaataggcaggtggaaggtctgagaatgattaagccaaagtgtctgaaatttttaattcctaaagaaatggcagatttgaaagaaagaggctaaactcagatttctacaaccaaagagaggttggcatcctttttttaaaaaaaaacaactaatacaattttatacaacaataaagcagttcccaaataaatctgagcaatagtgtgctaaataaagatttacagatttttcgtttgtttgtttttaaccctagaactttgcaaagactttaatgggttaatacgcaatgtgaatttcagaggatgggagggatggtaaacagcatgtgtatgtgtgtgtacgctcagtcactcagtcttttctgactctctgggaccttgcagactgtagcctgccaggctcctctgtcaacggaattttccaggcaagaatactggagagggctgccatttcctactccaggggatcttcccaatcctgggatcgaacctgcatctcctgtgtctcctacattggcaggcagactttttaccacggtgcctagcacatcctatatgtaattaacctaagaatcttccttttctcagaccctttcttggaactagccttccatggaaaacacttcagagaatattggagtaagcacgaataaatactttgtgccaaggccattttcccatatgtaattaaatgagtattggaccaggcgtgatatccaggtgtccaagctccacaatactgggcatgatcttgggttctcatatggcttctcaaagcctccatttctgtacctgtaaattcaggagttctaactagatcttctcttaggtattatctatctctaatattacatgactttatttatgttttattaggatatagttgctttacaatattgtgttagtttctgctgtacaatgaattgaatcacttatatgtatacatatattcctccctcttggatctcctttccaccccctccccatcccagccttctaggtcaccacggaacactgagctgagctccctgcatatactagtgatctactttacacgtgatagtgtatatatggcaaccccaatctcccaacccatcccgctccccctttacctctgtgcccacacgttctctacatctgcatcttttttcctgccctgcaaataggttcatctgttccactcttctagagtccacatttatgcatcaatttataacatttttctctttctgacttatttcatcctctatgacaacctctaggtccatccatgtctctacaaatggcccagtttcatttttaatagctgactaatattccattgtgtatatgtgataatgtcattcatatacacaataaattgcatggctttaagattcagatgcctaactaagacctagatcatgcctataaaaaattgtttaacattttccatccaaggactttggtcctgcacttacttgttaagagactgagaagttctcagctgtattgcatcgctggtgaattataccccaggggtgagattatatttgttatgataagcacccttttgtcataatctgaatctaatttatgtcactcttc

SEQ ID NO: 28064 - DNA, 894 bp, Bovine  19866881206477
agggtcccacatgtgtttgtacatcctttatcacagtgaagttattgacattgaggtacctcaatgtagaattattggcattgttctgtaagaacttgggaaggtaactaactgaaatgtgcagagaagtgtttttaatcaatatcactgtcttatagcaagtagtgagcacagtcatatcagacaaaaccatgtcaactgtcaactcaaaatgtgacaagttagacaccttggtaatgcctgaaagtctaattaaatattggattttccctggaaaaattcagctggctctgtgaacagagaaaagttagcttcttttcctaagagtggggaatatgaaacacatgtctaattatgtaatgtttctaaatttttgagaatcagtctattgccttacaaataagtttatcttccttaaaatagacccaataaattcctaaatactctcacttatacttacttttccaggaccatctacctcatctttcccacctccacttctctctagctacactaacctgtaatttgtccaagtctccatgatctctagctcccagaattttataagttccctctacctctacctccttcatttatttaattattactaaccaacctttaaaatcttccatgtcttgttctctgaagagctttccctgactcttaaatttagattaaatcaatcaccgcatttgatattgttacattatggacagtgttgaaatttacatgaactgtataatcacagaatacaaagatggctgagaaatctcccagctctttacatccagagaaatgtctaacagccaagaatattccctgccatatgcccagaaaagtctcaccacctcctgttcggtgtgttattgcctctgttaacctcagatcctcttc

SEQ ID NO: 28065 - DNA, 850 bp, Bovine  19866881232592
tttatgtgttaattttcacctgctctgtaattagaaattttgaactctgggaatttttttttaagataaaattattgcccgagtaaacttcagaaattatatcattaacccagagacctttctaagcctagaacaacattgctggtacaagtgcaccgctctccaacatagacaaataaataaggagggaagtttaaaataatttgaaaatgatttattgttggccacctctgtagttagagagtcaaatattcttactttagtttaacaagggaggacaggaagctgctgtgagctaaaggtaaattatgatcaattgcgaaggaggaggaactgtaccaaggagaggagttgggaggaagccttgtgttttctgaggtactgctccagataaagcctggaaaaaaaaaatctctgccttgacctttgttggaaaaggccagagtaaactacaagtctgactaccttcttgaatctttgctggttaaggagcagcttatggtttgggaagggtccgatagttgcactggaacctaaaacaaacccagttatttaaggtcacacattccactttttttctgctctgcttagccatcctatccctagatacaccccatgttagagtaagaagggattacttaacacaccaagacttaggtggatcattctcatggtaatttttatttttaactctaccatcaccatttgtacagtgagttgaagtcttaagtttagaaattcgtggtgaacttatatcttggagcacctaatagtcattggttttaatttggaagaacgaggctataaatttattctcaaaacagtgtatgcagggaaggaagagagaaga

SEQ ID NO: 28066 - DNA, 1473 bp, Bovine  19866881253283
gtctgactctttgtgaccccatggactgtagcccaccaggctcctctggctatggaattttcacagcaagaatactggagtgagttgccatttctttctccagggcatcttcctgacccacggattgaaagctcatctctggtgtctcctgcattggcaggcatattttatttaccactgagccacctaggaagtccaaggaagaggatagctcataacattttacacgctatttgatcacagagcttgttttctcgtgaactgtctttctaagttattgagttacacagaatgtcttttttagggctccctcaaatgaaggaagttgctctaatgccactctgtgaagttgattgatgggaagatactctgggctagactgggttctgaggtgcctgaaagtttacattttggatggctgtcttttccaaattagtatttatttgctcacaatggtctgcttctgtgttcaccttcaagggctcaatactgccccctagtgggtccagtcggatcctaaattttctgtgccattgtcctaaacttgggaagtgaccttggcagtttctaaaaaaaaaagaaaaagaaaaagaaaaaaaaccaccttttcaagttacaaaaaaagatactactgttatgatacctgatatcacttaaaaaaactttacgacacaataataatatgtgtttgttttagaatgagaaaatttaaggtaagtaaaatgaagaaaataaaaataatctacaatcttacctcagggttaacacttatcattctaacatgtatgtccatgcagtctttttttaaatctacatttatctaaaaattcatacttcccctgatcctaaactaaaaatatgttttttccggactttttcttgtatgcccattttacttgaacgtcagttaagaacctgctccttgagcacttttggtccttttgaaggaggcaggagaggagagggggtgaaaattttaaacatttaaaggggtgattcaggggctaagtgacccactatgtcttaggggtgattgcaccagtgtcttccaagaggggcatatacactttaatggcaccaaatggcaacccttcctggctgctgctataatacaattatataacaatacagtgttatataaacatataaacaacatctaaggctgtggcttaacgaaaacgtagtggcttaaacaacatggatttgtgatcttacagtctggggtcagaagtcaaagtcagttttgtagggccaaatcaaagtttttgtagggctaaatcagtttcgtaggggctgttccttttgggggttcgtctgtttccttgcctttctgtcagcttctcaagacccttgcattcctcagctcatggtcctttttctcccaacacatcaaactctgactcctgttatcacatcccctactactaactctgatcctcctgctcctctcctatgaggacctttgtgttgata

SEQ ID NO: 28067 - DNA, 1304 bp, Bovine  19866881297429
gtgttggagaagactcttgagagtcccttggactaccaggagatccaaccgtccatactaaaggaaatcggtcctgaaaattcactggaaggactgaagctgaagcttcaatactttggccacctgatgcaaagaactgactcattggaaaagaccatgatgctgggaaagactgaaggcaggaggagaaggagatgacagaggatgagatggttggatggcattgccgacttgatggacatgagtttaagctctgggaattggtgatggacaggaagcctgatgtgctgcagtccatggggttgcaaagagttgaacgtgattgagccactgaactgaactgatatacattttctgagactgacagtagatgactgttagaatgatccataattttgtattagtggctcttcttcattggtttattaacctggataataaagagttaattcaggagatgatttcttctctatcctgaggttagttcaccctaccaaatgccatgtgtcctcactagggctctgctgtgactgaggcgttggtgtgggagtggctcagtcatttctctggagttcttttccatttctttgatggcatcattgctatgtccccaaaccataaagcagcaaaatattgggaaaaccccactggacagcaaagagatatgattacatttagcgctcacatgtcttctcttcaattatccacccaccagagggtcattttattgcacactccctcagggggatcttttggattgtaataagcatctatttaggttgggtttctgggttctagtcagcctttttgtgctaataattaaggtgattgatttgggagcttctggaaataatagagtgaaggcaacatcatgttctagttatcagatgttttaattaataatccaaaggggagaattgaagtaaaagggaagtaaggttattaaataaacagtcagggtctgtcctttgtgccacagtgcctttcgtactgggagatttgattagaatcatgctgtaccttcttctgtgccccttgacttcattctgtgtctcaggtgatttgcagaactgtttgtattccaagagtgagaagatgctgggatccagggatttgggggccagagtcatcgttcagtcctttccggaggagcccagccgggtccagttgaagggagtgcagttccgggacttgggacaagccttccatgagcatgtgagctcccttgatgctggtaggagctatgagaggtgaggaggcccaggcatgatgtctcatctttcttcttctatattcaaggctct

SEQ ID NO: 28068 - DNA, 1091 bp, Bovine  19866881393064
gaccagccagagcaggggctttgataacagaatgggccttgcctctctctctctctctctctctctatatatatatatagcagatctctctgaaaagatcatgcaagctgctatggagtgaatggatcatggtgggagcgaggttgggagcaggtggtggagttagaaagctgggggttagggctccacagatgcaggactccatggttggtccaccatcccgtgctgcccacagactgtgtgggtccacagtgaggtgatgacagaaatgtcacacatagacagagctacttgacagtaattgtatgtctgttggatctaatgagcaaaaattagagctttcattgtgtatgctaatttgtctgataatttgcattatattttaatgtattggttcccaacagactggaaattttgaaacaaacaaaacccaccccgttcttcttgctcttgtcctccttgtcctcctacctcctatttaggaggtaaagttgatgtgcttagcatagtggctcctgaagttgacttaaaatcagaatcatccaggacagtaaacattcatttgaatgtgggaggattttgaattgatagggatgtgaagccccatcgggcctttatgtttaacacacacatgtacataaatacacaaaaacacacatttatacacatctacatacacatctacacacacatgcatgcacacacagagacaccctccccaggtaattctgctgtgctaaggtttgagaatcactactgtagaattgtataccccctttgaagtaaatagacaggatgttaagaacacaatatttttaatttaaaaagcaggcagtttcagtttctcatgaagaatcaagaattagctttctgtgccaaataccagcagacataaacatacttgcttatttacacactggatatacttctgaaagggaaaagaacattatctaagaagacagagaagtatttacagtctaaattaagtctttgtgtaataagaatatattcaatctttttaaaaaaaattatattatttttcctattttgaagtgagttaaatgacctcattgttgtatcacttccacaat

SEQ ID NO: 28069 - DNA, 1408 bp, Bovine  19866881467118
caatttgaggtcggtttctgttgtgtgccttgtcgatccatttcatttggctgcaagatactctgacatattttgttttgaatcactgctactttttcacaaagtgatctatttgggagggaggcggccagagggagaagtgagaaaatagagttaacctaattacaatataatgttttttctttttaataattcatataggatgccttgaaatgttgcaaatgtaacgtctctaaatgtaaggaaaatggaaacttgtcctttatcaggataaagtaaatgaaaaggctaattgatttcaaatgaaattatttgaaataattctcattttttgacatttgaaagaacagtattcctatgcacatataaaatgctgcaaatctgatattgtctaagattattttggttagatcatctcaagtttataagtctgtgtcttaggggccttcagaggaaacacagagactaacattttcctaaggctttgaccgatgtgagttgctctctctgcaactcgactcctccatttgacacatccatactccactatcagcaccagctcagaagttacttcctccatgaagtcttccctgataagttgagattttctgctattggcatcccagacttcctgtggcatatctatcactccaatgccttctccttctctggccagaaaagaagaagaaaatttaactatggcttccccagatgtggagatcaaatcttattcttcactgtaatatacagattcagcacctacttcctggcatgtgtagacacaaatatcagttggtaaaaagcaaatggactgtccttaagtggaagccatttcaaaagaagcagggttttcttccaaacatcatggttattgtgggaaaatattgaaatttcttagctttcaaaccaatcattggttcgggtttcttatctatagtggttaattttggtcctccaagattaagagatttgaaagccccatgagaggtatgtgtgcatgcatgcttcagtcgttccctactctttgcaacccctatggactgtagccggccaggctcctttgtccatgggattctcagcaagaatactggaatgggttgccgtgctctcctccaggggatttttccaacccagtgataggactgaagtctcctgtggctcctgcattacaggtggattctttacccactgaaccacctgggaagcccatgagaggcatgaggataacaatctttcctccctaaagttgaggtaacagaacagtctcaaacaagtaacagtaattcaggggctttgattatggatgcatgtgatcatgcataattatttaaaatatggaatgttgtaactagggtcttgcaggttaactgaaatgtttgttaaaaatggtagattctggtttatcagg

SEQ ID NO: 28070 - DNA, 748 bp, Bovine  19866881467378
aatccgatcctttgatcttggacctccacaggaagcttagatctcagacaaattagataaaaaatgaatttatagcagatatgtgtcctaaggcattcagctgaatgtttgggtcttagggaaggaagaatagtgagtatcaaaacatatgcaacagcaagcctcctttcctcctccaccttgttggtgaatccccattaaaatggaaagataggatttcacattgcccctctatgtctcttagagtcctgttggtgggtttgatcaaatttcagggagactatgggcacatatatctttactctatgaaaaagagaaaggcttggtggtttggggtccatgcaggttcatccacagttggctgtaatttttcttaggtatccttaacctcttttggcttctagaactttcttggacaaccaatatcctgagtctatgattttaaagatttgtgtggatagtagtttttagctgcttcttcttcttttttttcttgcttgctttttgagcattcaccagtttgctaaattttttaagattccacatataagtgatatccaacagtatttgtcttcctctgtctgacttacttcactcactcactggttcctttgcaataggaaaattaacaatgaatattcccctccctccacaccactccctctctatttttatagcctagtctccatgtgctgcatttactgtaggatgacttggattcagtatgaaagacccaatataagctcct

SEQ ID NO: 28071 - DNA, 1223 bp, Bovine  19866881591003
acagtaaaactatttatataacaaatgggaatcctgaaatatgagttggttattatgtaaagcatgtcaggaaaaaggacacagaagaaaagaaattttcctagacctagaagccaatctctctactacagaattacggactccctgtaggacccaattccaatttgcttaactccctcacaggaaaaatattaatgaaattgaatataagttcctgaaagtaattgccatggagaaagggagatgaagctgacttttttttttcctgtggctgtggataatgtcttcccttttgggtgatgttggtgagatgcaactttccttaggtacagcccatgaggacccatccctgcatctaggccatattctgtcttcttgtttgagcactttagaggcaaaggagcagatcctggagttataaaactcacaatgcctataagctactcagctgctcacctggcttgggatggacactaagtaagtactagtgaccactgtttttttgtcccatttattctgcctctgactgggctgatgacttgaacatttgagcatccagcttaactggttcttttaccagttttctgctgccatgggagattgtataaatgtactggagtgagtgaaagtcgctcagtcatgtccgactctttgcaacctcatggactgtagccctccaggctccttggtccatggatttctccatgaaagatactgaagtaggttgcctttccctcttccaggggatcttcctgaccccaggaatcaaacccggggtctgctgcattgcaggcaggttctttaccgtctgagccaccaagggaagccccactaaatgtagtggcttaaaagaacacccataattgtctcatagttttacaagtcagaagtctagatacttggctggtttctctgcttagagcctctcaaggctgaaatttagctattgacagtactgcatttctttcttgagtctttctggatgaatccacttccaatctgactcaggttcttggcccgattcagttccctgtgactataggacaaagatttctattcccttgctggttgtaggctgggaagggggtaggtggggctcctgcttaaagtttagggctatcctctctccctgactgtgacccacttcacctgcaaagccagcatcggtggcttgtgtccgtctcgtgctttgaatttctcttgccttctcttctgcagcatct

SEQ ID NO: 28072 - DNA, 916 bp, Bovine  19866881619435
actacgcaatttcctctatgtggtgaaatccaaactagctatctctttctgccaagtaataatgtctgtaataaaccaagaacaccctccttttaaataagtggatgattttttagctgactctgaaaatgtaaatggaccccaattaacgaatgccttaatcattcttcctgtttcttctttatagacacattatttcctgcctaagggtgaatgtattcggggtacatacattcagatatgaatacacatatacatatacattttcagggtacaaactttaatagagaagaactaaggatattcattaactagaactacaaagatctctccaaggacttctatttgtaccagaataaagtctatattccttagtctgacattcaagtcttgctgaatccaacctcaactatgtttcatgagatattccattttccatgagcaactagtcctctctgttctgaatttccaaaaaactcattctctgctctaatcatttagtattttatggctctatttaaaagttttttgctacattatttctcagagcatggaaaatagctattgaatatagctgataaagaattttattaaaacttaaaaatagatatagtttttttcaggatataatttttctggttcatgatagaaaattttaaatatatggcataatattttaaaagttaaaatgatctatgattccgtcacagagagataactcttaataacaccatgagctatattggctaactttcatccaagatctttccatgttaaaaaaacaaatagatcagactcagtatatttatatgatatgctatatagagtttttgaaattgaggggccgggttttatgtatatatatatatatatatatatacacacacatatatatatttcatattcaggattatca

SEQ ID NO: 28073 - DNA, 1021 bp, Bovine  19866881785260
ataaacagcaagggacctattttattgtatagcacaaggaactgtgttcaatattttgtaataatctataatggaaaagtttatgaaagggaatatgtatatatacacatatatatatatacctatatacacatatgtatgtataactgaattactttgctgtatacctgaaatatcgtaaatcaactatacttcaattaaaagaataacttcatagctcaagatataacgactacctctcctcatgctggatgcagttttcagaggtcagaattggtctgtaagccttagctgtttgtttcttgagctgctgtccattacactgtgatgagaagtggaagtgaaatctctcagtcgtgtccgactctttgcgaccccatggactgtagcccaccaggctcctctgtccatgggattttccaggcaagaatactggagtgggttgccatttccttctccaggagatcttcccgacccagggattgaacccgggtctcccacattgtaggcagacgctttactgtctgagccaccagggaagtccaaagagtagataccaaagatggcggccaccaggacatcttgagagccatgcgttcctcgtggcttggccatgctctctctttctcagatggttttcttttctgacgtgtgggccttggattccactatggtgatctttggtgtctttaagatacattggtctaagctgcctgtttttaaatttctgctgccaactccttatttcttgaattttattattgtgtggaagaatgttcgtagttatattctagcagcatttggggatgatcaacagaatgtgaggagcctttgagattccctactgtttaccatcctctttgtcgttcaggttcctacgtgcagggttgcacagtgccggcggtccttcagcagaggcctcagcatgtcccagacctcaggcctgaaggtggacagtaatgtgttctatgatatttcaggccatgcactgctgctgggtaagtgaaatcggcttgtttaa

SEQ ID NO: 28074 - DNA, 2090 bp, Bovine  19866880275879
aataaacactcttgtaatactgtttttaaagaaaactctgctgcaaattcctagttcaaatacaggaacttaggacaaggcttcaaaaaatggcagtggtaacaaccctaaatttgatattgtacagtaagaaatgaatatcctgcatgttaatatggtactgcttctagatagaagacagttcagaagtagtaatttagaggcgctcagaagccaacctacctgggtgtggctgtgactgggcaaatcacctgtggcaccactggacagccactgacaaccttaaggttatatgctgctgcgaagtcacttcagtcgtgtccaactctgtgcgaccccacagacggcagcccaccaggctcccccgtccccgggattctccaggcaagaacactggagtgggttgccatttccttctccaatgcatgaaagtgaaaagtgaaagtgaagtcgctcagtcgtatccgactctgtgcgaccccgtagacggcagcccacgaggctcccccgtccccgggattctccaggcaagaacactggagtgggttgccatgtccttctccaatgcatgaaagtgaaaagcgaaagtgaagtcgatcagtcgtgtctgactcttagcgaccccatggactgcagcctaccaggctcctccgtccgtgggattttccaggcaagtgtactggagtggggtgccactgccttctccgtaaggttatataaacccagaaaattagtcaactacctgcagtaatacaaaacaagtattcttcttctacacacacaaaatataactcaaaaaacaggtatacccatcttataggccacacttaaactactgaggctagcactaagaagacatctctcttcacctccaaaactaaagctataaaaaaaaaattaaaaaatcatcagcattcaaaaagcctcaatgtagaaatacccttttagagttttagacctcctgttctaaaatgtaaaaataacacgaagaattctttttaaattcctggagtgacaagagtgttttttgttttgtttgtttgttttttacttatgtggcaccagataaattttctcaatgagagaagagaagaaatccttttccatcatgagtttaaaatgctgggcctgattcttgctgctaaggaaagtaaatagctcacttccaaaactgaatgaacaagcttcttgaaattatatcaattctctaatgctaaaaagattctctccaaaatggtaagtaaattaccacttacagcacaatttaaagcatcactttgaaattaggaccctctattttaaaacagagcattttcaacactgttatgagaattgcatgatttattaaagagaaaaaccatataaaagtcaacatatatttacacatatataaacaacaagtctgatcaaaattacttgaaaacacagagacgtaaaattctgggggcattttttagtagcatgagtttatatccagtctctcttcttccttaaaataaacatttataataacccttccaggtattaaagctgtataagcccttaatattctagtggaaaaagaatagaggggaaaaaagtcacccaaataaatgtataattataatcagtagtaaagcctaaaaaagaaagtactacttcctatgacaccaagaaaggcctctctaagcaaacaccaccaccgaggccgcctagcgcatggggctttgacaaagattgatcatgacccttcccgttttccagacaagctagacactacatctttataaggactcaaagtttcagtaaagtttcacatactttaacatgctaaatttagcaagttcaaagttttcaactaagtcactctgctgtaaagcaaaaattagcacaagactgtaaatcaaccatgtgtgagtgtgctcactcagtcatacccgactctgcaaccccagggactgtaacccatcaggctcctctgtctatggaattttccaggcaagaacactggagtgggttgccagttcctactccaggggatcttcccaacttagggattgaacctgcgtctcttgaatctcctgcagggcaggcagattcttgccacttca

SEQ ID NO: 28075 - DNA, 3698 bp, Bovine  19866880391982
aaaactgagcgccaaagaattgatgcttttgaactgtggtgttggagaagactcttgagagtcccttggactgcaaggagatctaaccagtccatcctaaaggaaatcagtcctgaatattcattggaaggactgatactgaagctgaaactccaatactttggccacctgatgcgaagaactgactcattggaaaagatcctgatgctgggaaagatagaaggcaggaggagaatgggatgacagaggatgagatggttggatggcatcacccacttgatggacacaagtttgagcaagctccgggagttgatgatggacaaggaagtctggtgtatgctgcagttcatggggtcacaaagagttggacacgactgagcgactggattgaactgaactgaccagtgtcactcaaaacatcaactcttcattttcaaacttacatactcaccacctccatgccttcatctcttattcaaaattcattctccactaaatgatttatacttgtatttcaggtctcagcttaaaaattttttccttgaggaaagccatcctttgctctcagatgtaatcagattctccggttagactcaggcacagcacactgcagggctccttcacacacttatcattatttaagtatttgtgaaaagatgttggtgccagtgtcttcactagaacaggagctccactggggagcagctgatcctagatgtctcctcaagagttatccccactgccattcaccgcacctggcatgtgactgctgcttggtaactgtcgcctagctcaacatttcctgaggctggatgctacccatttaaacctccaggggacagaggtcaagcagaggaggccaggtggtgaggactctggtaaattacagcagaatcccatacagcattcaatccccctcaaaagcaaaacagtaacaagacaaaacaaaaacaacaatgtgtactaaataaaacttatcttccattgtctcctgctcacaggcaatcttgtaagtctgattcaacttgtattctctcaggtagaattgcctctttactaggcaagagtcaatcaaacaacattcacaaccaatgtggaacttccagggagcactctgatttaatacaactttcattaaccctattctaatatgaatactgaacatcagcaaaggatgctatttaaatgtaatcacacagtgtgacagatgtgcatttttaattttttttaatttaaaaataatataagtataaccaaaacttaaagccatgttagaacatatacatcgcacctcacacttgtactttccacccccaaaagcaactaaagtaagtggtttcttccatgtttttctggtaacttcctgtttccacatgtcatctaccaccccttcctacaatcctcttctactcactgaatgtaggagctagagagaaacgtaagcatcacccactccaatccattcattttacaaataaataaattggggcagatgacctactttgcagatcacacaactggttattagagatagaaataaacgcagtaagaacccaaactcacctaagcaccatccagtgcttttcccatgtcaccatatcatctaaaatgaagttcaaggtgacttttaaaactgcaacactctgaaactattagatacaagaatacttttcattttgtatctattttgatataaaatataaatacacatgtggataaacattctcatacattgcttttctttaattctgggcatgacccagactgggatctgaaatttgatcccttgctaatgagggacaactaaaaggcaaagatttaatgatagaaattgtttatagttggccacaaataatgcagtaatggaatatttattgatcccaggttcagtagtccaaatgagtgatgaaggaggaaatgcctgccactttctgaagcctcacacacagtgccgtccaccctcgtaagggaacgtgctaaaaaacggagccaaaattgacagagctatctggacattccaggctgacttattcacaagctggttcttttctcagattcccaggatagaagagacataatattaggctttgtacattgaaaaaataataataatgtgaccttgcttcttgttactgctgtcaaacttaagaaaaaaaaatacatgttacaatggtctgaaatataagttcatttcatggcccatctgtctcaccaactactaacgctcctcctctgaagaccttcagaatccctgtgccaccgtgctttgtctgcgttttattttccctagtttccttggagctctaggaaagattcaaacctacaaccttgatgcctttttccctcccccacgcctccctggcacaagtggtgaacagaaaccaccttgctgcctctgtttaatcacagaacgataatatttcaacataacagaggggctgtttgtgctttatcttttactgcgtttttatggggagcaatatattttcttcctttcctcccctgatactgtaacaatctttcctaaattaaatatgtaacaaatttctcatacgactttattccccagctctttttaaaccatcattaaatatcttcatgctgtttgacagttattcctcatcagtgtgttaccttagagactgcaggctgtaaagggaggtttaaagcatgcagatggagaagaagagcactgaggatattggcaggggtggtaacttgagaccaccccccaacagtctgcagaaataaacaccagaggaccagaaaggtacacatttgagaaacaaagttcatcctatttatctttgtatgcctcagacctctgtatgttccaggcatagcaagattctgtagagatatttggaagaaggaaaaggggacaagagagaaggataaaggagaaatggtagaagaggtaaatgagggtggggggtgggtaggaggccaaagtttggggaggtgttcaatgggggaaaaagacaggtggaaagagagacatttgaagaagtcttccacttactcactgatttgatccaacacaaaacaaacatagatggcaaagtgcttcctcaagggctataagtcctgaataaaatgatactccacagagcagaccatggcctccccccaggcctgagaccacactctgcaatgggcataggcagctgtgaccccaggggcatcctggcaggcaggaagaagggctcaggggagggttcagagttgaaccacactagcaaaggtggcaatcactggattgggggaaatgtgaccgtagtaacattgaactaacagccatgatatctggaggaaatgacacagaccagaagaaacactaatctgtctagtagctgtaattatctggatttatggatcacatcactgagcttaactgaaagacagggaaacagattaggcttagaggttggctatagtcacagctgccgtgtgtcagctttaatttgcagccattctctttgacacatagtctttgtagtgttgagtgagacctggtaaggcttctaagtgcctaattcatatgacttttgctgatgtctggacttcacctaatgtaccatttaaaaaaaaaatctggatacaagagctatatttaagtttcttttaggtaacaaaattgtataagatagtgctactttggcactttttatttctggagtcaatccatacatctatgg

SEQ ID NO: 28076 - DNA, 1318 bp, Bovine  19866880417435
ggaagtcgctcagtcgtgttctactcctagtgacccccatggactgcagcctaccgggctcctccgtccatggggtttgccaggcaagagtactggagtgggttgccattgccttctccaggactttctctctaccaatctaaattgatctaaacttgcagataattactatctctaagaagcttttccttaatctcaccctataggcactcctcccattaaaataaaaaaaaattctgtctcttgaatacccttaaatgtatcacctagaacagcattcctcaaatggagttatacaactcagtcacctgaaagaggtctttaaaagtataaattcctatgtgcccctaccattgacctactgaatcagaatctcttgggtgaaggtttttacccaacaacctttagccaggttcttagtagatccacattgcagctggaaaaggtgttcagaaatcactgaactagaagaggggttgggacaccggttctggtaaatattttgggctgatgagccatacagtctctcacaattatgaatccaccatcaatctcaacacagctgttacagtacaaaagcagtcatagatgatatttaaacaaatgggttcaactttatttacaaaaaatatggtccaggagctatagttttctgatccctgagctagattaatatttaatttagtaaaaatcaactacagtgtctaaactgttactctacactcagtaggtacttttgggaagaactaataataataaataaaggaatccaaagtaatgtacttagtggaccattttaaatttgaatgagacaataattgcaaagtaatgctcctagatgatcttgactaaaatcatgctgacatatggaaactcttggtggtctggggagagggaagcatggagtatacatctgaattctaattaagcctgatcatttcttggttttccatctataaattatattctacctaattgacttcctgaccaaggtttggttgaagagtaatttgtttaatgttttgaaaaggctacatagatgctgagtgttattgcagaacaaggtttctaaggaagaaccaagaattagcagctctaaatgcccaacccccacccgttgtttttttttttttcctgattcctgacaaaagctttagttaaatgtctcctggaaagtggcacttagcccctaactcaaatgtcactctgctctcccattttactcaggaaaacctcaaatacattgtgtgggtgatactgaaagacgtcaggatcaaagtgtatttaaagttgctaagaggaagcagatgttcgtttt

SEQ ID NO: 28077 - DNA, 942 bp, Bovine  19866880428364
ctgcttgcttgacactctagattgcaccaattttctaatggcacagaaccaattttctagtggtttgagttttgactttctcttgacattgcttagtgggtcagcatgagtaagcttttaagaaattgtgtatttgttccttaagtatatttctctttttaaaatgctgatgtgtttttccatatgtctaattaaagtttacataaaccttcatgtttgtgctgtcccttgcattttataagaaaagttatttttaaattgacttaattaacataggaacaattagaaataggaggccctgcatcagtaaattttcattattcattaaatctaaaaaatattgctcttaagagtgtccattcaaaaggctactatctcaaatttgtaacaggctttatccagtctgattcatactacaaatgcatcagaaaaaattaggagacagaataaattttgttttttgtattttttgctcaatttaggtatttttaatgtttaataagagagccgcaaagctctagtcatcttgttcaagtctcgtaaatataactagggacaagaagttagttttagtcaaaagcccaattcataaattcagtaggctgaaggagaaatttttgctttagttaatttctgtgtaaagtaaatcccttcccccaataagaactctttataaaggtaaataatctgtgatgtgatagtgaggcagctcaaggaaatgaagcatatgttttcagtaaaaatatcttttttaatttgacctcataaaagcgacgtttatttggcaaactctctagacagttaagctgcctcatatagatctctttactatgaatccgatcttcattcggtcctatattataggcattagtgagaatgctatcagttacctgactggttaagaagggacttccttaaatatttcttatataacaactaatc

SEQ ID NO: 28078 - DNA, 1113 bp, Bovine  19866880444066
caataaatttcaggttactgatggtaaacacctaagtaggaaactttagtatcaactgctagttacataaagtgtgaaaatacaaaaatattctttggcacatgcagctgctactgctgctaagtcgcttcagtcgtgtccgactctgagcgaccccatagacggcggcccaccaggctcccccgtccctgggattctccaggcaagaacactggagtgggttgccatttcccttccaatgcatgaaagtgaaaagtgaaagtgaagtcgctcagtcgtgtccgaccctcagcaaccccatggactgcagccttccaggctcctccatccatgggattttccaggctagaatactggagaaatggaccttaataaatattcatacactaatcattctccttgaggagactaagttattgacagtggttgcagataatagtctctttactagaaaactaaaatattacttttttctgaaaaatgaaaaattttaaagtaaatttgctcttaaagagtctaatttcaggtagtttatttgaatcatgtcgtttatgataattgcacgtgttttaatcattattgtgtattagggagtgctgtattcttaatcttcacttatagaataagaaatcacagtatttgcatttgaaggagtacgagttgtaactatggcagaatacatactccttactcaacctgcccagctccaattcaattatgtgatatgtaactatccattatacctacttaactgtttattcagcagagtaaagagacatcaacctaagtagcgccaagtggcttttacctaagtgcaagattgctttatagacattgttgaattctaattgcatagtggataacatacgaaatgaatgaaaatcatccagaatgaatgaattcttatctaaagtatattatgtaccacttaagaaaaatgctgaatactttaactgtgatgaaagaaaatttgaaaataaggttccttaatttggaatagctattctatggatacatatgtttaatagcattataaaatatcacttctaagacaccattatatttgcagacagcatattcttaggtcacaaagttatgattcatatatatcaa

SEQ ID NO: 28079 - DNA, 2832 bp, Bovine  19866880444315
ctgcatctattttcaccattggatatgaggcctgccctatacccctgtttcagtataagttaggttttgtctttggccctgaatttccacctgtgaggctattttctacccggagagagttaaatctgcagagttcatctggtgtctcgttcttaactgtaccctagtccttcttaaggcattaatagttcagtggtaactcactccagtattattgcctgaaaagtcccatggatagaggagcctggttggttatagtccatggggttgcaaagaattagacatgacttagcaactaagcaaaagtcattatgattgctcattcatacatgaagcttgtgagactgaaatttggaactattttaagattttttatagaaaaaggatgacctgggtgaatcaggttttatgatagaaatgattttatccattatggtatttgaggcaacaggctttaatccttatttcccaagttgaatttgtctttctatacttactatgggcttccctggtggctcagacagtaaagaatctgcctgcaatataggagatctgggtttgatccttcagttgggaagatcacccagagaaggaaatggcaacccactccacaattcttccctggaaaatcccatggacagagaagcctggcaggcttcagtccatggagttacgaagagtcgtacacgactgagcaactagcactttcactttccaccgtgcctagctgggaaaccttaattatgttactgaagtcctctgggattcaatattaccatctagaaaaatgaggataataataacacctacctattaggtggctgtaacactggtacccagtaaacacaaaaaatacttactgtaggcttctgttggtgtgtttctcatgaagaaagaccaagattcaagtacttggtccttgatttggagttgttcattgactaaaacccgggcagtatagaagaaataagcctagcagtaggagagcacctaaatgctggaactactcactgcagggtggcaggaggaactgggggttgggaaagcttgggacagtacaggagcacactgctggtgactatcattctgttggtgggactcggcatctctgtgtgcaaacaccctctatttcacagatgaagcaactgagaccttgtcatatgtctcacttctctgcttcagtgagattcagggtatggggaagatgatttccatgtttccctccttttcactttaatccctattgaatattgggacagattttatccagtacaccagacgtgtatattacctaccagacgtgcttcagaggtggtgagaattgtcctctaatggacaaacaggatgtggttgtgtggaggcagtgagactggctggagaactccctaagctgcatgccaagttgctctgctgacacctagctgaggccagacaagcctgcccaaggccagggccctggctaaggaagggtgggtcctgggagcttactgctatgacacatagcatccacatcactggttccttgagtcatgttgccacttgttcctccacttccagttctcctgttctcaggcatgcccagccaatgactgggtcaacagttgaggtctgtaaaccttgcagacctttctcagggattaaagggctgcccgttctgtggctactgtggtgcctggcgcattctccaggatggctgtgcataggaaatatacttctacagtggagactatctagtattttatgttgacattggtgtgtggtccctatggaatattggtaagatgaggaaaatagagggcatgacattttaatacatgtcaagatgtctttaagggatgagaaaagcctctaattagctagcacctatttggaatgattccatatgttatgtgttaagacactgttggagagcttggccagagttatactcctgcatttttagagtacttgtaaagaggagtgttttctccatgaggatgtgagttactttgggagacttggttatttcttcttaagagtctaatagcatcgttcagtagaactttttgtgataatagttacattctgtaattagccgctagcctcataaggctcttgggtgccttgaaatatagctagtatgactgcgaatgggatttttagtttctttaattttaattaaacagccagtgtgaatattacctaccatactggacagcacaggagtgcaatactactgcctaatttatgggcagcatacccaatcattatatgttaaattgaattgaacttacattctttagggcacttgctaaaagatacctgtataatatggttttcaaatttatagcataatttattttcagtaagtctagattttctattcatataacactttaactaaaaacttattctaatccaaacctaaaccgtcattattactattgcagtgttttgagacccctgggcttgggggaaaggagaatcccgacagtgatgcatgactgttttgctatttccataaatatactttatagatcctctctgccttccacagggcttcctagatcatttcccagtgaaactgggaaactggatatttcatatctccactgtctctcggctgcgtgtgcggggggaagagagtgagtagcacttgccattgagagatgtctaggtttgaatccccatctgcaactttggaaaaatcatttaaatctttataacttcagtttttcttatcaaatgagaatgaactgaattttttcagccctaggtgtctttcagagctgaagcataagaatcttcgatttaaaatgtgtgtaaatctttctgagctggaaacactctaca

SEQ ID NO: 28080 - DNA, 1494 bp, Bovine  19866880446099
acaaggacattgttgaaaagaaaccacagatcatattaatggctaccagttattgaagcttgttgcttgttaccaagcacttttatctttgctgtccttaattttctcaaaaaacctggagaggtaaataatattgttatctcagtttgactcatgaggaaactaaagtaacaagaccaaatagcttatggaagttcatgtgccaaatggcaaaacaagaatttacacttgaggctgtctgacagccctgtctgctcttccgcagagtgaaaccaagcaggtcacggcaagaaagtgcaagtccttccatgaatggagaagagagaaatgtaaagtggaaaaaaggagaaactgcttgagggaggaaccacatcgtaatctcagttatgtgacccacagtttctagattagagtctccaaaaattatttactgagtgcagtggttataatcaatcaactgcattcactcgtttgcactctgagctgttaatattagtccatttacacaaggaaggaaggattacataaggaagacctttgtgccacttactccctgcctctcaccaccgcttcccctgcccccacgtggcaatttagctgtagactgttcttaaagacagattttgcgggcaaagaaggcaatatacagtaattcagtttcctttattacaaatttgaaaacctagctttcctttaagctttcaatttcaagttccatatctaagtctctcttttaagtgaatgtttacaatttagttaattaaattcctttgaattattaaactgcatttatacatttaatatattcaatctttttaaaatactttattactcaacaaacaaaagaatcacaagtcatgctcataaatatgataaattaattttaaaataggatgaatcttattcttttgaatattacaaaaatacagatttaataaactcatatcttttcattagaaatcacaaatctaaaacaatgacagagcttatggagatagtttaaattggcatctcgaggataacctgttaagcattctaaaatgtcaaattatcttaaacataaatgtttataagaccaaacacaaatatgcacaaattatttctaagcatagaataaaaaatttactttcgtagacttgaaaagtttaagtaagtaatgagatacttctttgtttaacttgatgctttactgggactaaaacaaacatgctttaaataaaaaaattctactggtccaggtgagttaggatgagtggctaatcgtcctaagaggttctggctggatatgtagacattagggtagcatttctcatagctgataaaacatactgaatcctccttaatgccagtcaatgtgaataacaaattatcgcctgcaaatggctagtggtcttgccgctgttcctgttcacagattctgcctgcatctatttcttgcaagttatttgtatttgtgcccctactgctagattggggctagggtaaagaacccga

SEQ ID NO: 28081 - DNA, 2578 bp, Bovine  19866880465496
ataacccggtgctctacttctaaatgtctaggtaaaataggctttcataggcctgtttgctccttcagggagaacttgactcataaataatacatgacttgtatgttctctaatttggagaatattagaaaaagtaggaattaactctcaatactccatatttaacatgacttgtaatgttttccagaggttcaaagtgctgacattcatgagctgacacacacaatacagtcctccacccttatccaggcatcaagcccattgcttaaagaaatgcaaccctatgtcaaagggagagaaagtgctctgcaactgtgaagacagaattaggatccaaggcagcagtcactaggatcaagattttaaaataacctgaagaaggctaggacttctagcagtggcatcaggtttcccctgaagtagtcagctcacacaccattagacatatttaaaaaacagaaatacctggcacttgtgttaaaactgaaaaaaaattttacatgttaagcctgaagaattctgggcctccctgaggactcctttgcccattgagcagtcactccaaactaggtcttgactaatgactttcttaaaacttggtgcagggacttactgaatatgtctgtccatccatctgttgattcttctgtccaaccactgatcattcattccatccatccatccactcgtaaacactctctaaacctttctgtcccaggagtggttatacttatggcacctggccatttcctttccaccatgttctcccttccctggtattctttgctctctctccctcctgctgctcagatatgatcatcttaatccaggactctcccttgcacacactgtcgggtgtgtacattctgtgtctaaccacttactctgacttgttctctctccatgagacaaaccccttaaaattctggggaacacaatttctcctcttgtcactcacataattttacttttataatacccatgtgaagaaggcaacattagtattaatgtttccactttggagctgaagaaacagagacccagggaaattctgttaccaacctaaagtcacataagtaaagtgataggaccattacctgaatctggttcctctggctccaagcttggtggtctatccatcctcataagtgggacaactaggaactgataatttaaatgggtaattcttctttaaggctagaagattaggtatatatgattccatttttaagtgttatttgtctgtcgataaaactaatacacagatctataaatgttcctaatatcaatctctttttacagagtacgttgcagcagttataaactgagggtaccattatctaagttggttaatatacttttgagattatacagaggccaattttatctcattttaagtcaggttaatttaagaaagaaagtaatttcaaagacagtaagctacagtgttatagaaaaacctttgccagctggctataaaactctgaaaattaatgaaatcatcacctcttaaaatttcctctagaactgtattgtcaggaacttactttttctaaatttagctgttggcaaacagttactcttaaatctaataaaatttggtaagactttctatatatactggggtgtgtctttttacatagtaaaattctaatctaaacaattgttattttgtggcaaaaatgaatcaagatgagtagtgctgggaaactagaaaagaaactccaaggaaagagtctctaaatgtttgtggtaaataatttagcctgggttggaggaaaatcagagttttatttcaaccctaaatgcacgtactgtaagtcttcaagtatccaagtagggtgatgataaatgtcacaaaaatccaagcagaaggaagctgcatagatcatcagtcctcagtaggatcttgctgaaggccaagttttggtgaataaaatagttatgatcgccataagtttgggggcataaaatgtgttacatttgcataaaatttacataaacctacctaaacgattccagctgctgcagaaaatatatgggcatcatctcacaatatcttagaactcatataccttaaaaatgaaagaagggcttaggaaaacttgcttgcaagattttctgaagaactctattataaaatttgatagcttgattaagcaaaatatcaataactgggttaaaggaaatctgtttggctaattttaaaccaagtaaatccatttttaaaaatcttcattgctgaaaatatgcctacaatatgtccctttttcttctccttaattagttcaatatatggtatggaatattattagaggggacaaggtcatttaggcaaacactcaaatagcttctaatcctaagcctgacatttgtggcctcaagatataaggcaaatactagaaattctcccattttatattttctcagttgtagaacacaggacgtgtgtgctaagtcgcttcattcatgtctgactccttgcaatcctatgcactgtagtccaccaggctcttctgtccatgggattctccaggcaagaatacggagtgggttgccacgccctcctgcaggggat

SEQ ID NO: 28082 - DNA, 1887 bp, Bovine  19866880488260
taaaagtgaagtgtaattatttgataatcacctgaagcagctttcccctctgcctgcttacctccagcacatcttcaggtttcagctctcatgtcccctcctcaaggagcccttctctgactccctaggccaggttacttccctctgcagcacttaacctttattaatattaaagacttccctgtgtcaaagagacagcaaagagacttcagaatcctctgattcacgttggaatcttggctctgtctcttacttgctttgtgacattgggcgatttatttaactttgctatgtttctgtcttagtccattcgggctgctagaacagatcccagaccgggtgacttacaaacaacaaacatttggtttttgtagttctggagcctggaggtgcaagagcaggatgacggcctgggggtggttctggtggaggtgcttttctgggccctcctcgtgccttgtcttcccaagaggaagcaaaaagatggctctctggggcctcttttatctgcatgcactaatcctattcaggagagctccatcccatgacttgatcacccccaaaaggcctcacttcataaggccatcacactggagtttataatttcaacatgtaaattttggagggagaaaaaatagtctatagcaataggcagtcacttcactgtataatggggaatccctattacatgtcatatgagatcatgctcgccagcctggcttataccagagacaaatagacacataaaggacaatgcaagtttacattaaaaaaatgcttgtttactggcaggtatagatttcctttttaagaatttggtaatatgaatatattatgatctgaattcctactggacattatttttcttttatttctgctcatactaatgagcaatattttaattgttgacatgctcttttcctcatacatctctgtcttgttcgtcaattttatttcccatatctttgaaaatggactttgcccttagctatggtgtctcagatggtaaagaatctgcctgcagtgtaggagatccagatttgattcctggtttgggaagatctcctggagaagggaatggttactcattccggtattcttgcctggagagttccgtgtacagaagagcctggtgggctatagttcaaggggttgcacagagttggacatgactgaatgactaacactttcacttctttagttactttcccaggtctgttcattttttttttttttttacttgttttatatagaattgtgtctgcttttctttttccacttcttgactcgtattacttttcttcatcagagctcttgagcccaatataccatctgtctcttcctcctattttagccatctcagatcttttatagacctatagcctcaacatgacagagttgaataggaccttagagaaccaagggctagtgccatcattttacagatgagaaaattgagccacagaaagagaagtaatttgcccagcatggtggaactagttcttggaagggctggggtcagacctctggactcttaatctagtccattctgcaatgggccatgccacaccactttgcattcacatcactcaagtctttcattttctgtaacacattataaactctcttttacaagagaacattaacatttcctttaagaaactaagatcagcaagatttttctgctctcttttctcttaaggaatatatttaggttgctttttaggtctgaactgggtctatagactaaattgtttggtgtggttagactcatattctgctagaaaataggcaaagcatattgtgcaatgctccgctcagatagttggcaatgatgcccccagtttctagactacatggaaacactgagatccaacattggctttt

SEQ ID NO: 28083 - DNA, 1431 bp, Bovine  19866880509353
taaaagccctaagtaaggcttggctgtcataggcaaggagacccttaattgtgcccttgacataatgagtatgatgtgtgaattacattttttaaaaagtgatcctggttttctccagttggtctctgttattttctcgtgaacatagatgagtgtaacctctgctgaagacaccagtgaggacacgcaggcaggcgggacaccttgttcttgcttgtgatcactgaaacagcaagttttcagtctggtttttctccctaggctctcttaaatgtcataccaagtaacactgtagacagaaagctaaagcagtgatggagattctaacacagcatatgggttcctattttcttactatagtccttgctctatagccatggggaaaaagacaattgaacagggaataaacatatagaataaaatcttggttatccagaggcaaagaatacatgaattctgtgggggtgttgtgtgaagaggaatcataggacttacatgatggtgtgtgagtgcaggggagattaaaaggtatttcttaggtggacataggattttaggaactgctaaatcagaaagaagatgatgccttagttacagggttggctctgagggagttgtggaaagatgactgaatgaggcagccttggagggtacggaggcaactgctgggcagtgagagaaatgagagaacttacttttatttattatttttttaaaggagcgttagtctttaatgttggtcttccctggtgctcagtggcaaagaatccacttgccaatgcaggaaacataaaagatgtgggttcgatcactgggttgggaagatcctctggggaaggaaatggcaacccactccaatcttcttgcctggacagttccatggacagagaaacatggcaggttacagtctatggggttgcaaaagagttgtacaagacttagcgactaaacaagtctttaatgttaaggagattggatcttaacgcgtatgaaagatcaaaccaaaaagtactgtttggagcaccagttgtatggaggcactgcagcattctgtattttcccctaatgttcacagttgcttcttctgaaatgaacataggtggaagaagaagagtttagactatgtctgtgcaacttggctatttttgtcaagggagcaaaggtagtccaagatgagccagcctggagaaaccaatgcatttgtggcctctcctccattgctatttttaatcttataaactaaagcttaagtactatgacacagtagccataacactccttacggctcttcacaatatggcaattactgaaatgacttctttcccattatgcggccaaaaagcagtgagatcatgaggtaggcagcaagagcaaacagtatttaattggttactagaagggcgcggtgggaataaagaatccttcttttta

SEQ ID NO: 28084 - DNA, 1530 bp, Bovine  19866880513361
tcccgcagttatttccctaaggaatacatgtgcatacctaccgagtgcctagatccatgaattctaccacagcacataacaatttctcggttaaattcagtgaaaggaactaagacattgtaatcagctgctttatgaaaatcatggagtatgtaaggaggaatggaaagagtaaacctgcaagagagggacgctgggccaccagcaaagttcacacatcagctcagcgactcctgggtcactgcagccagacagcatgcgcctcaaatctgcgcttgagcagaagaacaaactgctctatgcatcataaatcttctgggtcatctgcaaatagttcaaactggaaatgttaaatccatgaatgccaaggaggcactcatatatcaaaatgaacatttgtgccgacaatatgagtccaactgagagaaacgtgcagctgcatttatgtgtgaattggatggataaaaatctatccattgactctctgaaacaatatctctatagccccctatatttcaaagtcagtgataggtataatgagcagatttttctgaatcaaaatcagaccgtgtgacttgagaaaatattttttctgcgctttgcgctgtaaatgtatttataaggaaggatgccttgggctcctaggaggacaaaaaagctacaaaattacagatgctgacaggaagtgctaaagctggaaggaagaaagttcatctgaagaaggtgggaggtctggatcatacagcatttaggtgcacataagactgcatctgggcaagaagagcccgggagcccgggcacctgacagacaggtcacccagggtgtgtctgtagagaatggacagcaaaagtctgagacgaagtcgaaatgaagaggcagaagtgtcctgctccaagatcaccaaggcagttgcacaaacatctaagtgattggaatccacccaagggagaacaaggaggaagacaaaaaaaaattctgaggggttctaatttgaatgtgactgaattacaaaccggaacttgccaagaagtatctgaattaggctgagtttacacagaaatgactcaactcaaaactttctgctgcgtcagaaattacatttattgtaagaagataagacaattttgcacatctgagtgtgtgactgggaaagaaaaagccatctcttgggctttgtttactctcttctcttcaagtggacaaggtccctccttccactgaggccaagccaaaggcaatggccactccctgagagctccctctagagccactgcagtgggaaatggcccagctgaggccaccagcagaggcaggtgtatctatgctttccgtcattcacttacatgctcaacaattgtcttctttgtgctccacgcctctaagcctggaattctggatcaggcagccaaggagaagtttgggaagccaagaacaaccacaccagacgttcctctaagtggacagtcccctttaaaacacttccttgggcttccgtgggggctcagtggtaaagaatctgcctgccaatt

SEQ ID NO: 28085 - DNA, 727 bp, Bovine  19866880513399
tatgcgtctcttatgtctcctgaattggcaggcaggttctttaccactagtgccacctgggaagctggtgtcatccaaatatgatgctgtaggaaggtgttaacaaaatgtaatatcctaagaagacatttctggtgggataacagcagttcaaaggggaatgatacttgtgttagtgtcatttattttgttccttgtccccacgaggtgggataagaataatgttttgcacagatctagatttctgcacaaggaggatggggtagggtgagaacctcctcagtgactcttagctcagaaattcttcctttgtggaaacttaggacaaaatgaataaacttcttctggaatgtgatgatacctgggagacagagacatagtgtgaggtcatttggggcccaacagctatgctcaattgaattagaattataaccagtgaggtcattgattttggaccaatgctgctagggtgtggttccctagagagtaccgaaggcctactacccatcttttgggatatggtcaaagatgaaatagagcctggagaaatcagaccaagagcatcatgggaagggaacacagcctgcaaagccaagtgacagtgtgtatctctggaagcagagcccagcactgaggtatgcatgcacgacgtgctggagacagaggaggcatgaatttccctaggaggacagcaaggagggccttgtcagctctgtaaagcagtgca

SEQ ID NO: 28086 - DNA, 1716 bp, Bovine  19866880574122
ctaaaggaaatccaccctgaatattcattggaagcactgatgctgaagctgaagctccaatactttggccacctgatgctgggaaagattgaaagcaggagaaggggacgacagaggatgagatggttggatggcatcaccgaatagatggacatgagtttgagcaagctccaggagttggtgatggacagggaagcctgctgtgctaaagtccatggagtcacaaagagtcagacacgactgagcgactaaactgaactgaactgaaagcccagctgcactatggacactgggtcagaaggacctgtcgtagcaatccagaggagagattaagtttgtgtgaatggggatggaaggaaatggaatcagttgataatgggaagaagaaatgacaacacttgctaatggcttgaatgaagttaggaagttgaaaagaaagaagactcagatctgacttccagcttttgccttggtcatcttggtaggaagagataccattcattcataaacatggggaacacgtcagggggtgcaaccttgaggcagaaatccaggtttacctttgtgttaagaggatgcccagagagggagatttttttaaagaattatgccagtcttccaccatctcaaaagagaaactctccttggggaaaatgttgctgttcttgtaagagtagcctggctgttctgtaaaaattaaaagttaaaaagtatccccttgccctgagaaaaaaatgtccccttcacaaagacctgagaaggaaaagcaattcctctcttgagtatatgataagataaatcaattcactttaaaaatgccttctgagagaaaagcactcaggttcctaccaaaactcaaaggtatagacactactgggcaaagactgcagggcatgctcaaggtctagtatcaagggaggaccccaagattcccagaggagaacttaccagaaacagaggctatggtattataatctaccctgttggccaaaaaccccataggaaaccccagctcctgcacggcattaaactgaaattggaaatcattccttcctggcctaagtgttaataaatagtatttgtgcatgtgagctggaactctggagtctgagacaacccactgaagctctggcaagggtgaagcagcagatttaatacaaggaagagacaaatatcactggtttgtgtgcgaccagtcctccacaataacactatatggttataagagaaaaagcaagaaagaatacctaaggatatcgaggactgactctctttggtcagaggcaattttggaacattctggacaaatcaagattgataggaaatcaaagagaaatgtaccgggacttttcttcttaaaagctagttggcatctgacctagtgcattaaaaacagttaagatgggctcgataaaggacagaaatcgtatggacctaacagaagcagaagatattaagaagaggtggcaagaatacacagaagaactgtacaaaaaagatcttcatgaccaagataatcacaatggtgtgatcactgacctagagccagacatcctggaatgtgaagtcaagtgggccttagaaagcatcactatgaacaaagctagtggaggtgatggaattccagttgagctatttcaaattctgaaagatgatgctgtgaaagtgttgcactcaatatgctagcaaattggaaaactcagcagggccacagga

SEQ ID NO: 28087 - DNA, 3177 bp, Bovine  19866880585009
tggaatatatacatatatatacacacacacacacacacacacacacatttttaaacatgcttccttcctttcaaatccaaagttccaagtgaaaggatatgtgtcctgggcattaggtgagacacacagggtgttctttatgtctccatatagaacagaggcctccacagtataagactctttgagctgtagaggaatctcagacctccatggttccatatttgtttaccctgtccccttgtgtggactggcccatggcaaaccaccataaaaaaataatgaagtctcataagaattgtgcttgagtttgtacattccttggtgttggctaaagccacaggaactctggctgggttttaaagttacacccattccccattgcaatgcaggtctgtgaaataatgccttagctctgccaaaaaccacaatgattatcaacaacgtaagtaatcaagtaaaagcactttccacagtccactgaccagattgtcaagaaagcaagaagtagtagcaaaaattgattgccgtttgcgaaagtaatttctatctgaattatattattgtatagcaacagtgatgcataatgtgtgcctggcatctttgcagtaaacattttaggtttaatttagaaatctgagtcattagaaaacttctctctcacaatgataaaggagccactgtggactcagaactattataatctgaagagggaaagggaataaacaggcaagctacacacactaaaagtgaaagaattaccattgggccgaaataatgggaagaaattcaaatgacagatagttgcttactattgaacagttaatacaagcatggttattttacattattaaacagcttgagcatttttaactttctaacataatgtgctatggtcattgatttgttgttgcttttgttgttttaagctcttcatttctatgagggaaatgggcttcaaattataggaaacaggccaaatagaaaaactaaactagacctccctgtccctcacagatacccaatacgacttccttaataattgacactaccagtattcaatagctaagttggcaagatgttcacccctatgcagctgaaaaattttatttaaatttaattttttcctattgaactcttaatgttagaacctggaagatatctattgaaaagcatcaggccttactataaattaatgtagtggaaacacaataaacttgggccagaggcctcctcccaagattagtaggtgtgagtcagtgcttcaaaacctgattgcttattagcatgaggtggagggcttttttttaaaaacactgatgtttgagctgccccctccagggaccacttactaaaacatctggtgagaatggggtccagccaccatgtaggttttgagcccctcctccacaagtaattccagtgtacaacctggttagagaatcactgtttcatgttctggcatgcctgcagagagagagtttcgtgcgtatttgtgtagaaatacttgcaaccgattacactgaaagcgcttggcactcagcgttagagacacctggggaattttaagagtgctgatccctggttctcacccgccgggatgcctgatgttctgggcatggacaatcacttcccaatgactccgaagtatagccacttttgagagccactgctctccagctgtgacactgaggagggctgagccggaggtggtcaactaggagtattaacaagataggacttcaggttagcctacagacgtcacgctcaaagaataggagtccttcctcccgttgccagaactgcacgtgctgatgtctagaatgcacagaagtacgtgcataaacaagtgtctattttgagtaataagatagagttgtctccatagaaacaactgactaataatcataatggttaattagataagtgatttccaaaatctatttgtatgataactaatgtaataaacttcagacttcttattcagtgacatgtttttccttagttctcttaacggactgtcagggcttggcactcaggtcaacaaaagccaggttaaacttaacacctccagaagaattactgagtgtagagaaaagtagcctacaacaagcacaagtgtgggagtcagaccaaactcttgcatcctggctctgccgctgattaagccgcctcagaaatgggggttgaaccttccgcccaaacttcttgtcaataaaatggtagtgatgctgcccaccagaaagcacggtagtgaggagttcagagacctaattttcctgccacagtgcttcacataaactattcctagaagaagcatagtaactgttattaaaatcattgcctagatcaggaggctgttcagggttaacatgccgccaaagttaaatttctccagacaggatgaccacaaataaaggtcaaatgactccttactgccatctcatcagaatacagagtcttggaataactgaatttaaccgcctattttttcagcacatttccggttttttggaccaatgaccaaaatatttggtggttatccctggtgctgtttccctccctggccacactggtttccttccattttcctcagggtgaagacgactggcctatcctgcatgttccttcattcctctcctgatcctgcctcagtgcagaggccaatgccatatctcacggacaagtttctgaaacttaataaaaacagaagatgccaccatcaatcttatttactcagctaaccaacaagcccaggcaatgtgcacaggctggaaaacagtacgaaatccatggctctgaccccctgattttagacatagatgagtcatagtgacgacctcagcagagagattccagatgactgttcactttcacatcctcagggtacacttcagcaccctggggagggaggttctgttccagagcaggaaacagaagcctggagaagatgaaaagagctggtacaagagctaaggcctaccaattcctggttcaaggctctgtacacgcagcaagttagcagctttccagatttttctcagattgtctgcatagagcactaccgtagtgaaagtgtcatccgtgtatagcatagaggtgaagtgatactcatttttccctgagagaccttctcacaggtaaatgtttcgggctgagcgcatgtctgacgggattcag

SEQ ID NO: 28088 - DNA, 1539 bp, Bovine  19866880592063
gataattaatgatgttgaacactttttctgtacctgttgatactctgtatgtctttggtgctttcatgttgggtgttatatgtatttataattgtatatcctcttgatgaattggtccttttatcatttataatgatcttctttgtctctcattacagtttttgacttagtgtatatttttgtctgatatatatatagctaaccctcttctcttttgctttccatttgcatgtacacttatgtatattttttgggctgaagtgagtctctaactggcagcatatagtatggtgttgtgtgtgtgtattttaaatctatttagccactctacactgtttgactggagaacttagttattctcttccttgctatctcatcctgtggctgatattggtagcccatgccttccttccttgctccaagctgcctctatacatcttaactttgttggtctcagagcatggtaaaacttatgtgaatcccttatgcagtgtctgggaaggctggggaagttggtcactcaaccccactctccctttcccagtgaggagaaatctctccagtcaggaagttccctcttgatactgagcaatgccttcctgggggataggttgggaaagggaaaatgaagctattctttgttttctgtgcagtttttcttaagtgttgttgttgttagactattttgccgaggttccctgcgtggactcctgagctctcccagagctatttttgttcatgaacagatgtctaattgttgatctttgtgaggatggaggctggtgtctcctactctactgttttggtgatatcccagtcagcttaatcttaatatcgcaaaccagagactctgtgtaagcacaaaatatgcactatctggcttttaagttttttcccctcaacttctacaattttctctaaattgatacatttttatctcttgcagcaatagtaagataacagaagttacagtgaacttggagtcagagaatctgagattaagtcctggttaggttacttaagagctttaggacttgcagccaaatgagcaaatttatctgggccacagatttgtcatctgtaaactggggatgataaagctcactctaaaggttttctggggtaggaagggagttggagggtacagcaaatgagaggacatatgtgggtcaaaagcaaactgataagtattgtactgatgtaaagtattcttgttatcttcaactatgaaaatacatttttccttggagatgtttcagatgaattgctcaaaaacatgtgatcagttttcaaatgatgattccccatgttacaactctctaggaaatagaagccattttgtttcaggagaatttctcaaacatttctgtactaattaaaataactctttgaggtccaacaggcagaactggctcaagagtttaaagggactgccaaggcaagtagtcaagtgtgtctgtggtaccaagagacttgtgacttcctattactggtcctttttttataacaaacacgttcctctgtgcaaccagcacacac

SEQ ID NO: 28089 - DNA, 2227 bp, Bovine  19866880644374
aatgaaaataaaatcaacttatttaaccaataagtgacaagggatctatcagattggtattttggcactatatatatatatccaattacatgactattatttcatttgaattatctcatttttcaggaagttgcatcctgacctcagggacacagtctctggttgtctttccaacattattttctgcctcttcaaagtcatgactagggaatatattaggaattttccatttaaataataattttgcctcaacaatagtataataatgttttattcattttttaaacacatcatttgactcttctgccctcattgttataatttgattgtatgtttggctcaggctggagggaaacactgagtgaggaggcctttgctatttttaggataaccagccagctaaagttgattttcatttggtggatcccaactgcaaaagagttggtgaacttgtcactggatcttttattctgaagaatcgtatagtgttgttactacgtgtttaattaaattaactgactgagcacttgctacatgcagagttgcacagtggaaaactaaaaaaaaagaatcctgtcgcattatcggttatttccttcacagcacttattgcattatctaattatcttgtttgtttgtttctttacacactgtctatcttgtccactggaaatgcagagacttttttttttattactataaaactagcacctggcacattacctggaacacagagatttcaaaatacagttttttatctgactcaagaaaagatgcttatattttctggtaagagaatattacctgattctcccacttttcccatttttcaaacctctgcctcattaaatcacattcatcttagccttaagctgctcttctctcctctaatatctcagtggttactgctggtcttattattcaatgtactattatataccaatctgtaatctctttaaaaaaattatgtatctttaattggaggataattgctttacaatgttgtattggtttctgccatccatcaacgtgaatcagccataggtatacatatgtcacctccctcttgaacctccctccaacctcccaccccatcctacccatctaggttctgtgatctcttttttattctcacttaatttatgcttctttttatttattttcttattgatatatgcaacagaattttgttgcaagtattactcattataatgattactgtaagcttcttgagatcagtgggctgagagtgttgtttctcctatggaatcttagcaactgaccctgtactgtgtcaatgaataggtggataagggatgactttgtccatatctctaaagatgaagaccaatttgacctgagacccattttggagtttttcctcagctgtacatgtgtccttaggtaagcccccgatatcagcgttgcctcagagattttccccgttttgtccctcctcttggctcttagatggacattcgttgtctactgaatggagaacagatttgctgtccagggtcagcgctgtgcttgagatggaaatgggagcaattcagtttctgagggagactgtactcaagccctcctgacaatctaggggcctggtcacttgtacaggccacagggctatgtggctcaggccttggctccatcagggtggcattgtccagtatgtgaaaccgctggggtctttttgggaagagaacactctccgcgtctccaaaccatgttgtgattgtccaacacagccttaaatatccaagccttattaaactgaaggactcagagagaatatgagtgcatgctcattaacttaagtacctggtatacacatagggcactaggtcagggtctatgccaggacaaggtgcgggctcccagtgccctggaattgtattggatatccacagcaaaggcatcacagaagactcctctacaggggagtggacattgctagggttttcctgtaagtcatgggtgtattctccttagacatttagcactaagatttttgtaccaacttgtgaagcagtgccaagttctattgcctgagagctccttaaaagtttgctcagatgctgacggaagcaatcaaagcatgggttctgtttattcttttgctttttttttctttttgcaaatgagaaccagaagtgtaaatgttccataccaatagaacgagattgtatcaaaaaccacacctttgcccacatacacaactcccgtg

SEQ ID NO: 28090 - DNA, 1571 bp, Bovine  19866880683561
aatactggagtgggctgccatttccttctccagaggatcttcccaactcagggattgaacctgggtttcctgcattgcaggcagatgctttactgtctgagccaccaggggaagaagtatattaagatatatatcatattaaattttttttcaataaaaccagaccttgtggtagctgttttcatattttcagttgagtctaaagccttaatggtttgaatgaattattccccatcttcttcttatcctgtgcaactatatgaagctctgtgagttcattactggttagaaatgtgtataaaattctcttaccaactgccagtcagaagtattacaacaaaagaacttgttttagagttaaaagagcttgatttgtgtcttagctttaccacttactagatcaacaacctcaggcaagtaaattcacttctctgagcctcaatttcatctagaaaatggagattaaaaatatccttgaccagggtagtgttgaggattagaagtagtactgtcaaaggaatgttggtaaagtgcatgccaatggtagtttaatttattgtatttattgatctttttcactgtgcagccaaggattttccgaagagacagaaaatatgatttgtcttcaacatatggcaatttttaagttagaccctatgcattttcttatttagtccaaccttctcagctgatgactagggcttaaacctttatgcttctctactgattcaataacgtaacagcatctgcctcttttgaaagacaatgagccaataagagaatcctctgcactccaggcaggaaatgtgttcgggacatctaaggtagcacatgtattgttagtattattcacctggatcattttttgtgctgatacagtaacatcatcaccacccaaagtggaaaaaaataaattatttatagctttgcatactcatgctgggtccagaaagcatttgtgaatagtgaggacttgagctgaactctccaaaggaacaatgaagggggtcagagtacagtggaaaggagacctgtggggatcagcttccaactgcattatggcaaaatgaataattcaagaatattgttttggatcagatatccctttcagcatctttaaaaacctttctttctatagaaggattgcatatctattcaatatcatgtcaaggattctttcttgactatagcgctgcatgatagcaaaatgaagtaggtgaatgtttcagagagatgataatgtgttcattacagcaaaatatttatttcagttatgatctctaaacacttgaaaggtatgttttgaattcagtaatgtctagtattttattcacttgattttccatcttggttataagcattaggataagggtaggaaaatgagatccatgcaccagatcatcaataaatgttttagtctgttatactttttctaatttcaagcattttatttttgtagccaatgataccctttagaacactgtttagagaacttctctaaacttatagtttagaataagatccctttccaaaaggatcaggccagtgaatcctaacggaaatcaaccctg

SEQ ID NO: 28091 - DNA, 1389 bp, Bovine  19866880714704
gtcatcacagagcaccaggcaacactccctgtgttatgtagcagcttcccaccagctatctgttttacacaggatactgtatatatgctgaagccaccctctccattcatccactgtctccttcccccactgtgtctgcaagtccgtcctctgcctctgtgtctccattccttcccttcaaataggtttatcaataccatttttctagattccatatcacagaggatttttgcatagcttctgggactgcctttagtcaatccttaagataatagtttgaatgccaaactattgacctttgaggactatgaagggaaaacaggacagaatatttggctaacctgaaaaattcagtcactttaccatacacatttacttggcagggaggtaatggcagcaaacgggataatacttttcaagtggaaacacattaatcatttacaagggtgaccccttgtccttatctagatttgaatagcagagagaagctggagctggaccctgagtttccacggtgactcccagagcaccagtgctcaggggtagaactgacaaagaaagtcacaactcaaaagggagtatcatctacatacctaattctactctccttttcatcccgggtcacccagaaggacagaacatcccttgagtgcctgtgctctatttcatgtgctctggggttagatacaagggtgatagtctccttacccaacactttgtctaaaaaattactatagcataatagtaggtgggcttggtgtcagtctggattcaaacctaacgaactgcgtaacctctctaagccttagtttcagcatcaataaaatggaaaaaataaccagcacctcactccctggaatcactgtgatgactgacataagcaaacaacgtggttcatgctaaaaattcaataaatgttaaccactgttgctggaaaagaaaaacaaggtgtggtgggttcatatcatcatatcagcaccaactatatgcagttaatatcttctagtgctttcctggagcttcccaggtggctcagtggtaaaaaaaaaaaaaattcacctgccaatgctggagacctgggttacatccttgagtcgggaagatccccggagaaggaaatggcaacccactccaatattgttgcctaggaaatcccgtgaacagaggagcctggcaggctacagttcatggggttgcaaaagagtcagacgcgacctagggactagagagcaacaacaatggcaggaactttgaaaagcataaaattagaaagcatatctcctgaaattaaatagctataatattttgaatagaaaatgtagaattataatttttaaataagttaaaataggctggttttcagtgcagtgagacagaaaatccaagaaa

SEQ ID NO: 28092 - DNA, 1384 bp, Bovine  19866880716475
cagcatggaacagaagaaatataataacagattcaacagggactttaaaaatggtccacatcaaaaaaaactttaaaagaaaatcttggtaaggggaagaattctgtgagctttttgagcctgggctgctatcttcctcagtgcttccctttatctttgagagtctcagttgcatgcacagaggggatggtgactgttaattacaggaaaagttaattagaatctagatctcctaaaacttttccctaccttcagcaattcctcaagttcctaaaagtgctgcttagaggaaaacacttgcacggacgcagaacttaggctgtgaaagtaattccaagatgattacacagagaaggctgtgacttgtaagcacaagagcacttggcattttggctcacaatggtttgccattaggaggtgactctagatgtctgggacagaaagtcctcaagagctgtctcaaaattgatgattcatatgcctcaatgaaagagacccaaaactagggagagaaaaaggctgagtaaatctcccttctgcacccaaggaccagtttcagtagccaagatgcagttaatttaacctacagctctttttaacccaaggttctctttaaagaagtctcttctagaagcaaattaacatttggtgcacaaagggaagtgagatgaatgatatgcaagaagagttgtgaggttttttttttaatttttgctttcgtttttttagtctcctttctaaatatgtgtaggaaaatatggtcacatgtacaatcccctgaaggactctttcttttgcacttggataataaatgctaccacttaaaaaaaatatattcatccttaggcatccactttgtcacatcctggagccaaaattcataccagggacaggtagaaggggaaagaattgctacagcataagcacataagcaggagaggggaaatctggttaatgtggatctttcatgaaataaagtgaccgtaacttctggaatcaaaccttgggactaaccttcacttcaaacttacagctggaggtctctgaagtgcagtttcctcatctctaaaatgagggtaataacacttgctgcttctggtcattgtgagggcaaaagcagatcatgtgcaggatgttcagcccagtgctttgcacacagtatgcagtctataaaaaagaactatgctggcagggactttaacactctttcctaaacaacgttaacatccaggtgtgaggggtagaaataataatggttgccacaaaaccagctgccatatggccagacttatttgcctctctctccccacaatgaatttttattctggcacccccaaaaatgaatagctgtacactgagatgagtgcaaatccaacatctatta

SEQ ID NO: 28093 - DNA, 1163 bp, Bovine  19866880732405
aaccctaaaaaaaatatgtccaggaaaaaaacaaaaatgaaaatattcaaaagcccagggtaagaactgtgaagggctggaaaggagctagaaaaaccaaggacagcattatactaatgaggagtggggctgaagagaaaacctttaagaaggcagaggatgctagaagtcaacaggaaatgaactgtggctttggaaggtctgagagttacatgtgccctaaatgtgacccctggcaaagcaggccaggtctccacaggagacactaagagaatgtcttaagaaatgcattaggttccagagtttgtcagtatctgatctgagaattgcctcggagggtcacctcctctatgaagccagcctcacataccaacgacgcacattgttgcctatgtgtgagagacctgcaggtatacacatcctatcctactcttgcctgagtgtgtttttaatggaccgacaaaaatggcaaggctccagtcaggagcataagggtgaagagcacctctttgtcttcagcaaccaaacacccacttcctgtgaagtcagatggataattacgaggaaagcaaaaccgtatttcagggtcattggtccagccttgcaacttctcaacaggaatcaatgtagtgagtcagaaaggcttgtctggatgtgtctgagtagcgaaactatacctggagcattcagcaacatctgaagcatttctagaagccatctacagggaaggggaagccaccacccaaagtcaggcatagactttcacaacagtccgttctccctaggctgccgagtgtaaaagcggctgatgagccagaacacaaaatcaaattggcttaagcaatactgaatcctcttagattgcaggcctctactgcctaactttgggaaaaccaattaaattacggccctaatgtctcttgtcagaacacaaagggtcaaagtcttcccccacttcctgggaagaaaccagtagctgggacagctggaatcacactggagtgtgcaagccacaaacgtctaaatgacccagccaagtgagtccatccagttctcgtcagaaaggtgccctggagcaagacagacaagcagagcagattcccactgacagacctagcagggcagaaagcccaggaagccggtgtgattaaaaccgatgaatg

SEQ ID NO: 28094 - DNA, 1396 bp, Bovine  19866880761061
tttataaatatgtttacagtggtcaatattctagagacactagaaaaatagtttttctgataaggtatcagttttgcagtgaacacaatgaaatatgtcactttctagttcaagtcgactccattattgaaactctaggcaaagccatcacagcccttgtcatggaggccatataattggtattcattgcacaacctacattccctaaaagatgattgacactcctgcagtttgtgctcttgtgaaactggccttactgtcaaaacctgggcaaacacaatgatctcaaatgattaactgaaattcaactgaatacaaagctaggaggaagttttcttcatatctttttactacataattttttaagttatgattagaataaaacaatagatttacactccccaatattgtagctactagttgcatgttgctattgacatgagtctaatccaaatgtagatatgctataagtatacaatatgtaccagacttcttagacttagttttttccccccttatgaatgcaaaatatcacattaaaattctttacattgattacatgttcaagaaataatgttttatatttatcaatttaaataaaataaatagcaaaattaatctcatttaattttcattttaatgtgattactaaaaatttagattatatatatatatatatataatctaaatggaactacatatatatatatagtatatatatatataaactaaatggaactactatatatatatatatatatatataatctatatatgagccatatatggctcacattgtagttccattaggcagtattgctttcaacaaaagaggagataatgcaccttctcaaactggcctcgttgatgctatttgaagctcatgatagcatataatcatatacacaacatgtgagtccaagatagtaatgttgctccattccactttattttaatgcatctcatgtctctctacacaactgtactttcagaatattcttttatgtataaaggactttgatatataacagcatgccttatagagtcttagaactgatagaaatcctaaaaaaatcatttaagtcagtcacatctttttaggaaaggaaactaagaaatagagagttaaagtgatcaccttactgtcacttaagagtaaagctaaaaatggagccctatctgaattccaaaccacttctatcatagcaatgctacttaaatttgactgcataccaaagtgagaataaaattattccttgctttttccccacagtaaatagtcttaattttacaaaagaactttaactcaaatgcatttttttctggtttgtaccttttggctgccttcatctaattctgcgaccccttctcaccttctggtaaccatgaatttgat

SEQ ID NO: 28095 - DNA, 958 bp, Bovine  19866880792020
tttaaaggagacgctagcttgtcccccatttttatagacagataaattgggaacttagagacagcatggtcaacccaattcccttgaccattaatggcagatctcatgttcaaactcagtttatttgcagagcctgtgtagtaaccgcttgtttaccctgccttttaaagtctcctggtcccttttatttacatttctattatattcattttgatgttgtgatactactaattcttaataagcctaccgctttcaagtcagctttctttttcttgaatttaaaagtaggacatatgtttattgaagaagatgtggacattatgggcacattaaaagaaataaagattgcttgtaatccaaaaacaaaaatagtcttgtggtccgaccaaatgcaagttacataaatggaggtatgaatcacctgacgcagttccatagcttcccacaaatgggaagatcatgtgtcctataaagaaaatgcctttgttaagtggaaaaaaaacaaaaaaagaaaggtgatgagaaattgtatctcagccccaacaggtcctatggaaaaataatgcatgggcacaagcaaatggaaattctttaatttgttagatggcaggattatggtcaatgacccttttctcttccactgggtatcccattaatgttgtttatgtactgagaaaaaaatagataataattaaaaaaaaaaaaacaaacaaagaaatggagttcttcatcactgtattccttgtaagaactgggtttcctcctgctgaggaagagcagagaagttggagttacctgtaacacgcaagacggtgctcatgtcagagaggagctaattcatgtttctcaaagatccccgtgcaccacgctttgtatgaataagaaaaggaagtgcagtatttggattacgttgcctcgattactccttgtgtaagcagtatggatatttctgactgtc

SEQ ID NO: 28096 - DNA, 879 bp, Bovine  19866880806547
aaaatatggaaatattcacatttgtggttttattagggcatgtttagatttttcaaacactaagctattttttgaaagttctccactcagcaaaatagggatgcatttgaccaaccactttttcttcctccaatttaaacccatttgtattccaacaggaatttaatctgtacatttatgattcatttgtgcttaacttgtcaaaatgtgaagagtggtttgaaataaaagaagccattggattctgatgcttatataatttttatccttagaatcagaaagccgtgtctttacagagaatcaacaatctgatactctataggcaaattaatcagatatgagaaattgcagggctcaagtagatcacagatatattgctgttactttgaattttaatataagatatacatttataagtaacacaagtaagctcttaagcctaactttctttaagcaaatcatataattaaaataaatggtgatctattttaaatgaagtttgtatttattcctttcttttcagggccatgaggcaatactgcttatgtggcatattgcacaattctgggaagcaccattctcaaaaacagaacaaatcttcataatgagtcagtttccttgtatccttaaatttcattcttcttttctgaactcaaaattcaggaaagagcatcacccaggaatatcatcaggctgcaatttctttatcaactaaaccaaaaattcaatcttgatttgccaaattttcaaggacttacaagggcttcgtgcatattaatctacgatagtgtctggtgaatttataatcaggctttgggtttaactccatattcatgttaattatatctagatatatgtctcttaaaaggtcctttactt

SEQ ID NO: 28097 - DNA, 1328 bp, Bovine  19866880873885
tagaaatgattatactttggcttcttagtgaagcaattcacagtcctgtattcaggttcgtaatatgtggaaaagtaaatattaaacactagattcttttatagcacagagagaccaccaatgacaaaagcccaggaaactccatcagctaacatagggtgagactcgtgtatcccagtgtaaacccactccccgttttgacagatacacacttttccaggagacttgtcactattgctttccctttttcttatccttttggtctgctctctcccctcaccttcttcccatgacctcctcaaaatgcataagttaaacccatataagatacaactattctggacctcactttaaacaatgtgagaagtgctaaggcagaataaaagttgaaccaaaatgttgtaaaagatggttttaatggcatatctaggtgttaacccactctggcttaatgaaccctccttcattccaaaggagccctgtgactgagaatgacccagaaccttcctacctcacacatcacctggaagactgccaacgccttactgaggagtccagcccatcctctccgtcaccatggatgtggtagcccacaggatcaccaccactgtgtgctgggaattccttcataatgagtattcagttattataatgccatatttagggaaaaaaatcatatgttaatttttaaaatcatttttggcataattccaagatgtaaatgcttttgatcttctttattttaaaatctacagttctattaaaacctccaaggagctagtaggaaattctgcctgaagggtaagagaaatcttcacagaacagacaatctgtgagctcagccttgaagaaatgggttggggaggattctaggtgggcagagaaggatatcattactggagacagaaagaatggaagaaaagtgcagagatattcttcttaattaaagaagtacaatcacaaagtcaaagaaaccggccttgaccattctcttatctccactttgtccccactttgcttgtccctcatccctcttgtcacctgccagaggcacatgtctgcattccatggcccttccattcaagagaagcccaaatttcacagttcctactatctcatcatcctggttcagctagcaaacagtaaaaccatgaacctagctattcagctaaggtgttaaaattaatgccctcacttcttccatcaaagtgtcctcaatttgctgccaagttaatcttttccctgtccatagcccatagcactctgaaaccctaatactacgcttaggcccataatatacctattcataatgtgctgcccttgtttgt

SEQ ID NO: 28098 - DNA, 1760 bp, Bovine  19866880941188
aaatttgtaggtttgtgcacagaaaagcatgttgggaaagcaatactcgggagtccttccccttccttgagcaggccttcacaaaagaaagctttctgttacttctgcaggaagttgcggagggaggcctaataggattcttttgcacacagctcgccctgtgccgaggtgaatcatacatttctctgatcaagccttgctgtcagtgactcaggcctctcacggtgtcccctgtacccttaccctgggctgcctctcagctgtggcgcgcagcctctctcattcacaggagggcagatgccgtcttccagtcaagttctctctccaataaaccactctgcttagggctcaccctggtgtgataaaactgtggcgggcctaataatagaaaccacaaatcctgcctgccaatcctgcattctaacctctaatccacttgtagcaaggacaaatgttttcaggaaaataaaatgactctgcgtagagcacagtgacacaacagcccccgttgtcaaaatttccacccaaaagcctagaaacaaggggctggcttctacactcctctcctcagtcgccatatacctggtttcagccttcctctaatttctaatacagcctgagtgacaaaagcaatgaaaaagaaaatgaaaagaggacacgggcaggaggaggaaagatacatacaatttcatcattgttacaacttatttaacgatgggaatttgtcttctgtcattcagtacaaggcagatagcccaatagaagttcggtgttagatgaataggactctcacgttaatcaaacggaaagttggctacgtgggtggattccttaactgagtgactggatttgaggacctgcggcagccagcacagtggaaagtatcctcagaaaacccaagattgagtcccagctcaccaccccaccaatcagatctggttccgagagacaatttatttcatccctccagcctcggaactctcatctctaaaacagtgttgaaagtaacagacctattggctgcacagagctgatgttgaaccgtggtgagagagaatgtctaggaaatgctgtgtaaactgtaaatctgtctgtaactaggaggaatgattatcactggacacagatccatcgattgtttctgattggctgtacacagaattaaaggcccccagaaaatagctcagccttcctctctagcccccagaaaatagctcagctcttcctctctagtttgactattctactcaaaccttgcctctcacccttcagtcctgagggtctccaaagacctctggctctcagttaactgttacacccccagccagcggtagggcaggagttcctggtttgatttgtgttttaaccagctcggccctgctgcggcttggtcaccaatgtgctgtcacaaagacacaaaccagagtggaattaaacacaaactatggtgagagaggagttctgagaagaatctgatttaacaaatgagctatgtgaacaggactcggaaaactgtgactgcagacttctctcaggagctcgaactttctcagttttgaaacaccacatttacttagcctggtggtgagtgtcagtgaattaacaatgtgcactgaagtctctcagctggcagtgtgataaaatttaaaatatttttctcgttcagtatcatgttagaattttcatggcattaatgaaaggacgtgatgcaatggaaaaggatctgcttgctaatacaggagatacaagagtctcaggtt

SEQ ID NO: 28099 - DNA, 1952 bp, Bovine  19866880944769
tttgatggagcatcttcttaagaccctcttacctagtgaaggggtctgcgtctagctttagggaacagggttggattatattcattaccctgtgtggcaggctttgtgtggaagtctgttgttagcctatccatcacagttcattttatgtgtgtgcacacacacatacatcctatcactgtctcagattctgtgaagttaaataagtcagtagatagcggaggttagttatctgtttactctagagctctagtaaggaaatgccaataggtgatcataaacctaagccctccagagaacaccaggccttggtaagctgagcagctggtggatccatcctgtgtttgtgcataaggcagggagatgtctaaaaggtgtgtttcaggaaattctaaaaagccattatagtggcctctttatagtacaacacataccattggactaatatttacctaatgagccctatgtattaggtaactcactgggctctaggacagagaagactggcgtgctgcagtccacggagtcacaaagagttggacacgaccgagcgactgaacgacaactgtgtacaacagagatgaagaagtcagagtctatgacttctcagctctccctatccagtgacaaagaaggaccagaaagaaaataaccatcagggttgtaggctgcacaaggacccaggtcagcacatacctagtgctgtgaggtgaggtgggaggggaaagccatggaaaactgcaggaagatattaaagttggatgttatggttcagttagaattcaccagggttatgagaacacagggcattgcaggcagagggaagtgtcggggcagagcagtggagtgaactctgctcctggccagtgaggagtgcctggcttgagcttcagagagtttggagaggatgggatagaaatgtggaagcggaggctagaaagggtcagaggtcacatcacaaggaatatagctttatcttgttggctgcagttagggtaatgataaaattgatggtttaaactgggatgattttgagagtaaagaggagatgctaaaaatctttggaatttaaatttttgaatattcatttatcataaacatgattctattaagttttctgaagagaaaatcccttattaaaatatgaaaaacatttgtttttgaaaaacaaaaaatatgaaaaaatcttgtatattaaagtaaaaattaaaaattgctttatgtgaacaataaaaataatataaaaagcaaaaattattcttactatagccacatattttaatctgcctgtttataactaccttgaataccatgccattagtatttttctgaggttatgtttttccatataatcttatttttaatgttttaataaaacagcagtgtttaaagctcctttttatggtatgtagattacaatgtttgataactccaatgaactcttctctttttttaattgagaaaatactttccctgcaggcactgagaaatgttcaaaacaaattatgctaaatggaggatattctcaattcaatttttttcatattaaaatgtgtaaacatctctggctgttttcttcttttcagtgtatctttcttcagcaaattttttatgagataaaattcatcaaacaagttgtttctgtttatgatgtttttgaatttttgccaaatataaatgttgcaaattatcagctttctgaaatttcattatgtttcagaacagaataaaatttattcaatgaaaaatagtagcttaccaaatgacactccctacaagaaatatattttaaaggacaattatagaatttcaaaacaaacctacatacctttaagcccttgtcatttaagtaattcagtttttgctttgcttttggggggggaagtttcaatgacttccttgtaagctttgtctttagaaatcaaaattcactaaaaacttcaaaaactgat

SEQ ID NO: 28100 - DNA, 673 bp, Bovine  19866880975881
aaattctccacccagtatcatcagatgtagcctgtttcctttctcagggcatgtggaaacttttagatggtcttgaggtcgtatgagggctgagggcgactccaaggggctaaactgagctttccttccggcgccccacctccgccttccccacatactcacaccattcaaacagtgttccccggatgcagctattctgtgacaacttgctctgagtcccaaatgagaaaggaggcaaaagcacctcctatttgcatacacctcattctaggctcccacccccattttgggggaggggcgggcgtggggtgcggaggaggctgtgatgttcagtcccatgtgcaggctcctataccccaggcacatgttagacctgccactcatgggccaggtctggctcttgctgtgttaaatgaggtcaggacaacttggagtggttttctttcctttcttttttccctctcttcccaaaggttggctttcatgactgttgtcttgaagtggatttgtaaacgtcagatttatgacccaaagatgatcaatggcctcttattccttgcagcagtaagcctttggcttggctggtatgtcagagctgcggaggaacataatttaagggggaaagtgtattcaaaatgccaaaaatactatccccattatatgctttgggttt

SEQ ID NO: 28101 - DNA, 801 bp, Bovine  19866881061884
gtaataataataatagtgaaaatgctacttttcatttgtttcaaatggataattctgtttctcaatacacctgggtttaagtcagctctatagcattgtagcaaattattcaagtctcacctgtaaataataaagggtaataaagactctctcagaggctcacttaacaagctaaaggtagctggtacacagtgaagactgttcaaaaaaggtagctattattcggaggcatttatgaaagagaaaaaagtcagcgggcatttaaggtctgagtttatcaggaggacagggttggcttggtgttttcatctgtaatttctttcagcggcacttgtattcagtatctcatccatcatagccccgtgtgcacgacgtaggccattaacacatatggttccggctctgcttcacggataggaatggattgctcaacaggaattgctgtgttcttatgttttaagtgctattttcccctgaggctttcagtatgtcactctatttcaaaaacaagtggctcacatgtctagaaaaccatgtgttgaagctcactgttagagattctgtttattcacaagcaggtcatcagcttagagagaaaaggtccttattttaactccaggctcatatgcataactacaaagagttgggggcttaatggttcttttgtcaagccaccttgaggtcagtagtcctttcacgattaattcatgggaaagcagatattcttgtgatgtgtggcataggaaacaagtggcataggaaatatattggatttacatagtgccagaggatatatgtaaa

SEQ ID NO: 28102 - DNA, 1279 bp, Bovine  19866881077729
tttcattttttctctagaaactataaactgctgtgtgtggtaatacagaatatcattgcaatctatcatgacttgtatctcatagattctaacatgtatctttttacatgttaccatctctgaaattggctgcatcttacaactgaaggaatcatagtaatggatagtattttttcttttataggaaggtgatatatcatgcaaccaatggtactttagaactgatgaaaagtaatttaagtctagtcatagctaaagttttaaattcatatttggtagatattgtgtgatatctggttcaggctcattctatcttttttgctgtgtttttctgtactacataagctacaatacttaaaaatttcccagacttcaatattgctggagttctggctgaaaacttgttcagttgctaagtcatgtctgactttttgcaaccccatggactgcagcactccaaacttccctgtccttcactatctcccaaaatttgttcaaactcatttccattgagtcagtgatgccatccaaccatctcatcctctgtctcccctttctcttcttgccctcaatctttcccagcatcaactcttttccatcaagtcagtttttcgcatcagatagccaaagtattggggtttcagcttcagcatcagtccttccaatgaatattcagggttgatttcctttgggattgacctgttcaatcttcttgcagtgcacaggactctcaagagtcttctccagcaccacagtttgaaaacatcaatttttgttaaatagatgagcacacaaaacttggaaggtgaaaatgagacaaagggtgtcttcatgttccctttgagtgtgtgtttctggcaaacagggtcttgaagacaacatgttcctttgcaggagcattccaatggctctttcttagctttctgggaccgagaggcacctgtggaagtggcaggaggagctttatagagctgattccagcttcctcatctctggatcactactctgtggtgtgctctctggctcagcgtttctaagtgggatcagaattcctggtaggtgagttgtgtggtattctgggagcaatttctggagaatttctaatccttacaacaatttattatgaacatctaattctctatattgtataactgcttgcttaaaatactttgtgggtttttggtttcctctaccgtggtgactgatagttacaacagattattaaatacactgtaaaacaaatcaaggtatcaaagggatgaggacttttacctatttt

SEQ ID NO: 28103 - DNA, 1279 bp, Bovine  19866881084058
atggatactgctaagccaaagaccctcccgcagctgtagcgctagtcaaattcagggtggatgtttgtcagcagctgtctgagttcccgtgacagcacccacggatggcttgccaggctggagcaatgctctcagtagcagcagatgggaggcatggagggggctctggatcagcccatggagagtaccctacccagtgccccaccccccacagcacgagggctaagctggtaatggagagaagagactgaaaagagactgactgcctggcaattagtaaatgagctgtccgaaaatcatttgtattgcaaggagaaacagttttccttcctcttgattttctgtgttttcatttatttacttaattacataagccccacctcatttaaaaaatgatagggggaggcttggcgtgatttaaacagagctccacggaacatgcacccaggaaacaatttgcttctcactgttccaggtctgtttttagcttccaaacaattaagcaggagccccataagctctcccaggctgagcctgcacccacagcaaccatcagttggcatttagggggagggagaatgaagagaaagtgagttaaccttttccacgcccccagacaacagcttcatttcaacgaagatccaggaagagctaaaagaggtagagactccacagtccttccaaatttacccttcttccttgtaactcctgccctctcagttcatctggaaggaaagactgaggaccaggcttctctctagagcaccttatcattcttactaagttaattaggagagaagcagaaggtgtggtcaaagcaagcattatatccagctgcacacgtttaaggcactggttggaaggggttaattatttcctgtggatgaacctaaagggagcaaattgcctgctcagagagcacagagtacaatgcacaaatagaaggtcatttgggtcaataactatcatgagtctaagaggaaggtgggtgaagggagagctattctgaagctatagaagagatgatctcagtaatcagccagtgttaattatgactcctctgtgctaggagcacagaacacaaacatggccggtaataaggtgtggtccctgcctgtgaagcactcagcatctagtagattccagcggaaccgcctttaacttggggttgttttctagagccagcgtctacaacaaaaactgaaacgaaaatgctatgcgaaatatcatttgaaaaaaaaatcatttaagaaagaactgggttttcctccagtgttag

SEQ ID NO: 28104 - DNA, 5148 bp, Bovine  19866881100464
acggggcagtggtgtaggttctgtggggcatcctttgaggggccgggcagggggctgagatggtgctcaaggcacaatgtacccccgagaggctcaattagtctgtaggaaggggacctttccctacctggtccacagaagagccacatatctgcagtttgtctagaggggatacatttccttatctgcaaaaaggcactgtatatgctaacagcttgggagctaggtaagaaatgggatggataatgatatatcgtccacaaacctgacaatgctgagacgagaggaaccgtcacttttaggttattattgttcagtcattcagtcatgtccgactctgcagccccatagactgcagcacgccaggcttccctgtccttcactatctcccgaagtttgctcaaaatcatgtccattgagtcaatgatgccatccaaccatctcatcctttgtcatccccttctcctcctaccctccatcttttttagcatcagggtcttttccaatgagttggcccttctcatcagatggccaaagtattagagcttcaacttcagcatcagtccttccaatgaatattcagagttgatttcctttaggattgactggtttgatctccttgctatccaagaaactcttcaagagtcttctccagcaccacagttcaaatctcttgttcactttagctcctaaagccccacccatctgcaaccctgggatattggagcttttggaaaaagccaaccagagatttgatgccaggtctaggtttccttcaggagagggtaggagtatagagaagagggggaagggctgacatgtttcatgtctaaactttatgacgtttgagggcaggaactctgtattattcactattgtattcttagtaccgtgcatgcaacaaacctgtgtggaaggaatgcactcaaagccattttattcttttatcttgcttgtgttttcagtaacagagagatggttaaacctatctttatttatttattttttaatatccacaaaattcaatcctatgttaatctggcaaataaggcacctatgtgaacatttttttaaatcttttaaaggatcataggaccttagcgctaaaagtgtcttagtctaatctgcttagttgcaataaaggcagcagtggtctagagagtttaagtggcttgtcattgatttcaaaaccagttggaggcaaagccagaactggaggtcagaacaatagatccccaaacccaaagtctttctccaagatctcttgccctgagactaagagatcaagcacatataagcctctaacatgagtgttgtctgctgtgttaggcagtcagcctcccacactgagaaggtcgcacctttgcaagcaccagccccatttccctagtgctaactctgacactacacaatcagctgtatgtttgtgtactctacacactcctggactcaaaagtgagtaatcagatagcaatctgaaaacatttacataaatgggccccaaagaaaatacctactagtctgtcactttcaatttctttgtgaaatgagccatggaactttgaaaaacgatcaacactgcagagcacgtaaatgtgtcatacaccatcgtttaacattggaagggctaggtcagagcagtaataaactgggaagccccatggagtcataggaaagtggtctggttttgcaaataccatgcatcacagatactgaggagacccaccataaggtagccaggatgaaacaagagtcatttctttctcgggcaaagtattccagtgactgccgtagaacaaggtggaaattgttcctaaagaatgctggattccagacaactagggaataacatttaaaagggtaactttgtctagggaggaagtacagattttctgacctccatttctaataactggaatggcatgtgtgtctggtaactcaaaagggaagaccattataatagatggaacattttagtcaaataattacaagtcatcccttactcaggcaaaggaaccaactggttgggtgtggtaggaaagtgaaaattcagaatctcaatcacatggggtcacacaggcatttttggcacaagatgaacttgaaaaatataataaagaaaaaatctacatcaggcaacagatttatgggctgaaaatgtccctttgcccttaaaaagacttctggaaatagattttcattatattttggacaacatgatgttctatcttttgtatctagaaagttcaaaatgaaccagctatgaaagaaaataactgtcatacctttatgtctcttgtttctatgcaatattttctcaactgagaatattttatgcctggtattaattaccatttcatttctattgagtgccagtgttaaagatgctgcattgaagacgtgatgaaaactaactaaattggcaaaatggagttgagggtaggtggttattcaaggagcttgtgcagctttctaaaacttgaagcttttccatagcagggttctatacataaagaatttttataaatggctaagattatggaagagaaaagaagggaaggacctgaaaggaaaccttgtaaacagctgtctagaactgagttgatatggtttaaactctaaaccataccatccagcttaaaataatcaagaatgttaagggaggggtactaacaaattattctttaaagataaagttggttccccatttgagcaacaaaatatagtagtgttggactataaccaaaaatacaaaatgtataatcatgtatacatactgatattaaattttaaaatattaaatagtgaatgaatggaggaaaatagaccaatctcccttgcagaagaatttcaaataatttccatagatactttacccttaaggaggctgagcataattccccattcactccttaagtatgagttgtgcacagtaacttctttccaaaggaaggaagagtatatactgtgaaagaagggaggttggggtggggagaaaaactttacagtggagagatctggcaaacactacctccatcagttaattaaggcgaacaccagtgataagtcacattcacaccatggacccttggtaagatgtaatgagtacagtgtattatttctctgtgtgtttttcttgtttgttttgtttttatttttgcataaaactcataacctagtctactcatgaggaaaacaaatacatcccaattgagggatattctacgaaatccctagtaggactttccaaaagtgtcaggatcttcaaaaacaagaagagcttttttttaaaaacaaaaccaaaaaaaaaactgtcacaatcaaaggagcctacagaaacatgatttctgaacgtaatgtggtgtcctggaggggattctggaatgggagaatgacattaagaaaaaactaaggtcacagtatggactttagttaaaagtaacatatcaacatgggttcaagtatgccatagtaatgtcacattctaacaacaggggaaactgggccatggaaactccctggaccatatttctgttttttctgtatttttctaaaataactctaaaataaacattcatttaaaaaaataaaacggaagttggttttggcaaaaaggacaatagaagaggtgaggaaatagaagttaatagtcaaaaagtaggagctctcaacccaatggagcctgatgtgtcagcattagaaaaacacgaagtcaaaattcacctctgaatgccaaggagaactgtttgaaacaatgctttaagaaaagtggggaggtatttataagcacaatgaacactttgcctgaacaggagcaaaaaaataagccgcctgtgggaaggcaaacaggccagggtcacagacacgtcttatgtagcatctaaaatgagataaaacacccgatgagaggaaagtgttaagcaaacagggcccaagttagccacaagaactcccatgttatgtgttctccctagtgtttctaattatgaggaagttaaattctttctacaaaaatatcacattgacattttttgtcacttttacaaaggttttgatgtctcgatacagacaggaactgcttctcactactttgaattttgcctcgtaggaaagaacctgaaaacaacatcttgcaacactggatctgaccagccttccatttcagcagcaggttcttaatttggaaggactgaatcatccatttctcacctttctcaccagccaagtatttttaacttactgtcagctacggagtgaacatagtctataagagaaaagatagcccatttttcacttttccacttttggctgctgaacccaagaatgcatcacagcaaaaaggagggtcttttatatgaaaataatattggtttaacattttttttccattttgttaagtacctaaaatgagtccctgctactgacaggacccacttcttacctagaggcagcttttctgcactctctgaagtacagaaactgtgggcagcagccttgagctccccagtggccagggtaggaaggtcatggggatgcatccagttccccataccagaaggacctgacctggaagttgagcctctgtggacctgttctccttgacctccaggttctggaatgggaaagagacaaatcttgaagtgttgctcaagagccactggacacactgatagtcagaaactcaacttcataaaaacacttaatttcaacatctaaaagaaacagttgaggttctattagattcttaggtttaaattgagaaaatgaaagtagggagaggccaaataaagcaaaactttgaataagaagagagcggcattttctcatcatccgtttaagcagataaaatggcaattaaaaacatttacgcatggcttttgtttctcgttttgtctgtttgcatgacagataaagaataaagaatagatttcatggtcagggacagaaaggcatatggcaatgactgggtgttgcagaatgatgaaattcagttctatttggtgcaatgaagaacagaggaatagattataccttggaacagaaaggcaaggagaaatatcagagccaaagaagacgatgatgaacagagaggcatgctgagtacatactccatgcccaaaagtgtgggcacaaagaagatgagggaat

SEQ ID NO: 28105 - DNA, 1062 bp, Bovine  19866881157625
catgaacttctcactccacccctccttcatgcagggtttattcatttctgctttagaaatgttgggtttgcaatctgcaatggcatttaaatgtgggcaacaacactgcaggtcataaaaaatacacagtatgactgttgacaagtttttattatcgtgtggaatattttagaatagttcgttacttatagcacattgtttagaacagttcctttcatttgatcattaaatgccgacctttagggcacatcaggggccagtccacccactgcatcagctggctctcatagcaggccagaaaagagctacctagctctgtttaattgcctcctgtgatggaggaggagttcatgacctccattcctctgtgaaacagctgcacttgttagaaagtctcactttatgctgtgctgatacacgcctcactgtatcccctcccccatcctccaccccacccctgctgctcttgaaccaaataaccctaaattcgcatccacatggcaaccccttcagttacttcaagacccctgacaagccacatctgaagtctgctcttctatattttatgcctttgccagccttgattttttatttatggaccacatcttgctattttactgcatgcattcctgtaagcagccttaaatcctgtgtgggataaggccatatataaataaatccttgtgcctttcctcaaggcaacaactcaagttccccacccgacggtctcctcactaaccttgcgtcatttcctcagatttattctctcatcattctgacactagaatagggaaaatatagggctattcccaggcccatgggattgtctctgggtgctgtgtcttaggaataacagacagagtttggaaagatgacaaaaggttcatcactgctgtttcacagtttcagtttgcaaaacagttcttaatgacatgctcaagcattggaaatccctataaccacccacttctggtacttaggtgacgacctggcctccttcagaacggaagattaaggtcataggactagaacacccctaccgccctccacacaattcagagt

SEQ ID NO: 28106 - DNA, 1559 bp, Bovine  19866881204133
gtggatttcctttaggattaattggttggatctccttgcagtccaacgaactctcaggagtcctctcaagagtcctctcaagagtcccacagttcgaaagcatcaattcttcagcgctcagccttttttatgatccaactctcatattcatacatgaatatgtaaaaaaaaaccatagctttgactatatggacctttgtgggcaaagtgatgtctctgctttttaataagctgtctaggtttgccacaactctccttccaaaacatttcatcccctctgagacattcttcatccagctacttgcagtccatggtccacttcagctatttgcttagaaggttattaaactacagagcatagcaaagaagcgatttaatgttaattgaatattgataaaggaggaggggaaaagttaattgagtcaattagttgcttagttgctaaggtaacttttctcccagttggaaagaaattatctcaggattagagacaggttttagagaaagaaatacattatcagcttttctctttcggtcttaggaaaagtctgaataatcaaagcaaggtggagtgcaagaaagagactctagaaataaaagacagtgtggagcttcctagctcggggagtgacatcagccccaagaaaaagcaatgagctctcttgcaagagagagctagctaattagcgagatcctgagcacaatagctgagtaaggaagacattggcccatgagcctagatgaatttaagcagcaagaaaaacggcaacaaatgtttttaatactcaaattacaaaggcctcccgggctgagggaaaatgctgagaaattttataggtgagagatagcagatgttttcaagaggcagaaagaaaactaaagttatgttatgttgagaagatgcttgtaaggttaaaggaagtggtctttcacttgccttttccagaagtattttaatcttgatctgtgatacaaaacaaaaacaaacaaaaaacagtaactagggatcactaattactcaccctgttatttttagtaatatatttcatggaaaaattaaaaattgttgaattgcggtccatttccctggtggctcagatttccctggtggttgcaatgcagcaacctgggtttgattgctgggtcagggaagatcccctggaaaagggaatggcaacccattccagtattcttgactggctacagtccatggggtctcgaagagttggacattactaagcaactttcactttcactttccatcccctgagttagccatgtctaaaacattccactcattgggcctttttaccccttagcagactctcccaaacattgtccaatggtagctgccagaattacacttattatagctagaagggaatgatctgtcttgtgtttttaaaatctgttttggaagccttgaggctcagaatcctccccttggcttgagaaggataaaccagacttccacccaatatatttgttcagggctgtacaaaatttcagttactgaacaaattgttagctgcctcaaacaaggccctgtatatccaggg

SEQ ID NO: 28107 - DNA, 2099 bp, Bovine  19866881223775
aatatatttttgtgcctatattttgaaaagaatcttattcaaaattaaaaatgatagcgcaaatctcttaaaatccaaaaggaaccataaaaatgtattaatataggtctaatactattaattctttaattcaaggattactaggacattttatacctattcacaaaaacagagctacaagagagacttagttatctgtcttcagttgggtaaatgtctaaacctattacttctcaatggaaatgagagatggaatatggaataagttgaaaatatccttccaactatgcacattccctctccctatcaaggaaaatgcaaactgccaagcttaacctttagccaaccctccccacccaccttcctaagaactctcatctaactatcttcaggataatctctacaaataaagactcaataataataataataataaaataatgacaaattcttatattgggcttccctggtggctcagatggtaaagaatctgtctgcaatgcaggagacctgggttctatcccagggtcaggaagatcctctggataagggaatggctacccactcccagtattcttgcctgaagaatttcatggacagagaaggagcctggcaggctacatacagtccatggggttgcaaagagtcagacacgactgagcgactaacactttcactttgtcttattaagtgtcactttactatttacaaagcccttttgtcttttttgagcctcaagtaattctatgaagcagtcgtggtatcatcccattttatatggtcaaagaaatcaagggctttccccagtttccactgtatgtgcttgagctaagggctagaatttaaggttacctgacactcagtttagttctttctcccgtacaatacgtctcctgtgtcatactaagatggtgttccctgaatttaataatattttttatttaaaagttgctctgacttaaatgtaagtcaattacttcatttagttccttcttatgttattccaacttctgggttaagacttctaaaaaagatataaaaggaaacaaatggaagaatttcccacccccaacacattatattttggcaaatacatatttaaaaccattcctaggcatacgtctaccaaggacaactgagcaaagaaaggggtgtgagctgatgccatatatcaaaaattcatggccagagaaacaaagagaagattctgaaacaagagagagctgatctaactcagctatggacccaaagatcagaccctcaaagtcacatcagcttcataaaataaatagaagaaaaatgtactccactagtaatccttgctcagagaggaagtcacatgggaatcaggtaaagaagactcccacactgtaacggaggcaagtgtagacagactgaaaataaatgtaatggaaaccctgaaaacataatacagaggaagaagaaaggaagggaggaagaaagaacagaaaatatctagaaggaaatcattaacatcattaacatttgcttcatgctatagcataacaccatctccataagtggctcagatggtaaagaatctgcctgtgatgcaggagacccaggtttgatccctgggtcaggaaaatcccttgaaaaaagaaatggcaatccactccagtattcttgcctagagaaattcacggacagaggagcctggcaggctagcagcccatgtggttgcagagtcggacacaactgagcggacacacttccactttctttcatagcataacttaagaagaataagccttcaataaagcatgagctcaaagataagatgattacagcacaaatgtaaaaagaagattcagctgaaataatattatcacagaactaattgataaaccagagataacaaggaagaatagacaccgctgaatatgaaattttaaaacaaaataaaagttcaattaaaacagcattaatagagaagataaaagataaaaaccccaaataatggtaattgatgtctctgtgctatagaaactatcaacacaaatgaagcagaagctgtagtgaaagatataatagccaaaaaaaaaaaaaaatccctcataccctcatcccaagtgaaa

SEQ ID NO: 28108 - DNA, 646 bp, Bovine  19866881276424
tgaagactgtgggcctttgttaagataccacccacaccagacgtgcagcttgccattcctcttaggaatttcactattccttgccctgaggtattctgctcaagtgccagagtaggaaaaccagataattactttggtcaagtagtgtgtgtaaattaagtcagtaaaagcttaagtgcaggaggaggacctgacaacatgaagacttctcaaaatcccattaagaaatgtgtgagattctgggagccgatgttttcagataaatgatctcacaccgagttcagtgggactgaatttttaacgtttaagatttgactgcttgaggtatccattcactgcctaaattcccgcacagcagtcctaccagggagctctgcgaccaatgattttgatatttctggtggtgcagtatctcttaaagcagcacgttcggacactggattgtatcactttctaagatggcttgctttcttaatagaatcatggtgtattttttctgtgtagattacactccactggtcatcattcttaaaatgtgagtcgtttgcacaatcgatcatacaaacccaacaaccaagaaacagtgataattgtctttctgtactttactaaacactttgtgtttaatatattttaaattataaag

SEQ ID NO: 28109 - DNA, 1108 bp, Bovine  19866881314303
tagatcttgtaaaagagaagcggcataaagcaaactttggaaaagtggagatacctgttttctgcatagatgggctgatcgctgggttctaccattgttatctggtttggggaccatgggcaagccccgtttcctcatctgtaccctagagatgataattcagcttcagtgagatagtacagactgagctggaaaagatcacagaaagaccagtttcgttggctgagaggcactgactccatttgcagtggacatcccttactttctagatgcctctgtgtcaggggattcccgtcttgtcacttaggcaggaaagtcccttcttattatgtgggttgcaggggtgtgggaagatttctcttctcactgctgtgacagtgagggttaggggagtcccttttcacccctttaatatggatgggaaaagggggaaaagaaaatgtggggagaggcagcgtggttcagaggttcatgggactggaagcacattctcttcttggcgtcagttttgtgctggtgctggtgggagtgctggcctgatgtacattttactaaaggctgatccccagtcccgtctccccagaaatctttaaatgtcagtagtatcaacactgtgctggcttcttgctcctgtgtctctcctcttctcatcagttgtgagtctcaattcctattggcaggatatgccaacgatgtggaaacaatcctgttcttagataagggagatgtaagaaacttagcctcaatcctcacacacagcacactagataataacactcatccttgaggggcttgctgcctggtgggaagaactgagtacatggacacagctgtgatgcaggagaatctgtgggcatgtggcagactcgggacttccaagggtggatgttgagctggctgttgtgttcaaagtgttcgtatttaggaggtaactacaggcaaaatgtacagattttgaagcattagaatgtacttgttaaatgaatccaggggagctgatgacattgcccaggaagaaaggagagaactgtgcttctcaatcttggctatgtataagaaaattttgggggatcctacctgcatagcctctgacttaaaaataggtata

SEQ ID NO: 28110 - DNA, 1323 bp, Bovine  19866881387748
ggacctgtgccataaacttgttccagtaaagtgaacttccttcccctgtgcttactgaagacagacttgaagtgacctttggacaaataaaagcacccagtgtggaaaagccttggttctccctgtgaaggggttttaagggaggcttaggggcttccccggtggctcagtgataaaggagtctgcctgcaatgcaggagacactggttcaatccctgggtccagaagatcccctggaggaggaaatggcaacccactccagtattcttgcccagagaatcccatagacagaggagcctggcgggctacagtccatgagtagacccaatttagcaactaaacaacaacaatccctttcacttctatattccagaacctatctgatatgataaacattgtggcttcaacatgaaatactcagataaatgaggcaccatacaaaggtcacatgtattgttaccgccacccactaatcattccaacacatgtagtataccagatcagaggcctcaccaaaatgcaatagttaggcaagaaagccttgacaacaaagaagtaactattgttaccaatttccaatactttgtcctaatctaaaagctgtccttatgctttgaatataaatgttaatatgtttctaaaaaagagaaattattgttactaagaaattttaaagcaaagtgagtgaagtccttcaggcctgtctgactcttcgtgaccccatggactgcagcctaccaggctcctctagcaaggaggcacattattaagttctgttgaactttctagctaactctcaacaaagagaaacctggggccagtaactgttaccagaagttacatgtttgttataaaatgactaaacaaatcttgacttgttttatttcagtaatattacacccgggggtgtggaatggcaagatagcctacacctttgcaacttatatcactcaggaaatagaacgttttaaaattaaggtggtttaatcccagaactataggatctcattactgtatttttaaagccaccgtgatgttttaagttgtttacgtgagctgatctatgtaattaaaatattcaaaacaaacttaataacatgaaaaagacatctgataccaaaaatatgatcctggcactgtaactctttctcgtatttttactcacccgggaactcagtggctttgtgtctgcagcatttaccctcaagcgtctctctggcaccctgtgatatatttctgtttcattctgactagtttgtgtaattctttgtggctcttccagtgttcagggtttgccatccacagcaatgcacatctcagaca

SEQ ID NO: 28111 - DNA, 1690 bp, Bovine  19866881449725
cccaactactaaggggaaataggctattactctaccatgaaggttacaaagtgtgtgaatgaaatacagaggatgccttaggtcatctcttagtattaccattctttgtaattaaggtcagtggaaactgcaacacctcagtccaggcaggactacaatggcccagacccttaggaaggaaagtttgagttacatcaccaaataaatgaccatgacttactgagatacttgatgaaggtaaagggaattcagtgtgagtagtggaagaaggtacatataaataccagctatgactacatgaacagatacagaaatgactagaattgtctttagtaattccttcttattttgctacgaatacatttgtgcatatggtatgtgtgtagaaatacttattttttttccttcattcccttatcatgtaacataagatgcactggctttatgtcatagcatttatgtattgctaattttacattataacatttaggttatgagatatcaaggagaacagtaaatgtcactcaacaaatttatctcctcttctgggcaaggaattattggacttttagttttatgaaggatggttctatcaagttaggtatacatttgaccttcttattgtctttatttggagataaagtatgtttttaaaagatacgtatgggtaccaagttgaccaggggtgaaattgtgatgactaattttatttgtcaacttgattggctgtggagtgcccagatgaaacattatttccagatatgtctgaaaaaatgcggatgaacgtaatttaatctattggttctttttccctggagaagcctaacatataactgatcttgactatgaactattgcaatttgcatttgtttttcccatattgttgaccttaagttctggaacacttattacgtactttttgttaaccttcttggagtgcctccccatggatttcaggatgaaatgactcctaaacaaaaggcaatctcaggacacttagaaactcactacatagtaaagatgactgctttaaagaaatttctcttataaatgaataatgaaggtgatgctggacaaaatgacttatgccatttagcagtaggggccagagaggacaagagaagaccaaacaagagaattaaaaatttttttgtcaagtcagtctatgccttgtacccatgcctaattacaaaaggaaattagaaacaagtacatgtatattactgcatgtattaatgtagaatttaattggtttagagtaaattaatggctgcttgcaatatttctggcaattttttataagctgtgtaattttaaattggtttcttgaaaatgctggataaaacattttaattcacacattgctttaaggaattgatttggggataataaaatataatgaaatgtgttacctcagatggatgtaagttctatttgctctgccttttttttttttaactttaatgcaaataatgagtatgctgctaggatatttagaagagctgtaactgtttgaaagttatctctctctctctctctccattggacaaactatagctattttaaaattctattttcttaaagcagtcaagaacaaggaaaatcctctagggcttttctgtttatccaagaaaatttatatggaaatgaaaggcaaggaggtataaaaatcggcaactcagcaaggaaa

SEQ ID NO: 28112 - DNA, 829 bp, Bovine  19866881452739
aaaacagtcctgggcaattgatctcccgattcatccattcttacagtcagtactcaggaatgtgccagggtggtcacgagttagtttgcatctggtgaacgttagaaagataatcaaagtctccataacagtgaagagtgatcaagaggaagtaaaaacctctgagcgatgacaagaaagattccttaaaaacctttaagtgttctctctgtcaacagatgatgctaccaggtaagacaccccagtgggagatgacagccaggtaagtcttccctcccacagggagatggtgattgcgcccggcagagcggttcggtggtagcaacttatatcttttctatttccgtttaaggaagttgcattatatacctgaagctttactctcttccagtcaacacaagcatctttataaaaactgtattagtatctatttctttaaaaaatgaataaataaaaattatctttgagaagtccttgagaaaagtccacagagcaaccaaagtatctcttaagcatccagcacaagtgattttcctcaacattggaacagacatatttctttggttaaacactgaaaaaaggcttggcttacatttaaaaaccatgctatgaaggtacaaatccatagctttaatcatacggtcatactaaatgtggtgaatgcttttactacaagaggcacctggatgctaaatgtgatggaaagaacagcagtttgacatctcccatctgagatttgctccttctgggacaaaagtgattgaatagaatgacaggcaaaaatcaaccaccatatttaaattcttgtttttcgttatgttttccttat

SEQ ID NO: 28113 - DNA, 1064 bp, Bovine  19866881501905
taaaatggcatagtgtttgcatatactcaacagcaaatcctcccatatagtaatacttataatcatggctggattgcttcttataatacttaatacaatgtaagtactatggaaatagttaatagcacatggctaattcaacttttgctttttggaaatttccagaattttttttccaaatattttcaatccacagttggttggatccccagatgcggaattcaaggatatgaagaaatacaaagggccacctatatcttgtcatgattcttttataaacagtgattcattgacacaggcaagtccaggttgctaaatgcagcattactatgacagaacatatactttaagaaatctttaagttagtgtccatgttaaaagtatcatcatgtaatttctctataagttgttatctaatgctatagatatatagctgtattcatattgttctatgctataaatgtttgtactataatactattaatgccagaaacccaagaataaacaaataccagtctcattcatcattccaatgtcttcattcaaacagcttggttgttagtgaagagttattgatacctatactttgtttattcactcagcaattcacataggcgctaggctggtagctgagaatacagtgatgagcaaaaaaacccataaaagtcatgatattggggacaagagcctactagtctcaaaaaggaagtgcagtcatcaaacaataatagaaatgaatatatggttacaaaccatagtgagtgctatgcagaaaatgcataaagtgttctgggacatgggctatgcagaggggttatgcaggggagatctatcggaggaagtggttatttggatggacacctgaaattgacaaaatgataactaagtgtgggagttagtgtaggagaagaggctgccttagaggtagagaaaagcatgtgaaaatctatgaagcaaaacggggcatgaatttcacttcaaagcacaggaaggagacctgtgcagctggagctgcaaaaagagtgagacccagtcactctagaggcggctgccatcaccccagg

SEQ ID NO: 28114 - DNA, 1420 bp, Bovine  19866881527213
cttaaactataactaccgagttcatggttggggaagtttttgtctcccctggtgcagttggtgaggggggggtccatgccttgtgggtgactgaaattgattactttaagtgcccagcagtgactggttactgtggctatatgtgggtgactgattcctttttaagaagccagctcgaaagtaaccacggataagggaacccctactactttcacatacataaaatactgacacatatataaatacatgtacataaaatattggtgttacagttttatattaaaactagaattgcttggttccattttgttagccattaaatataaaatttattttcccccctttaagcaaaatataactggggagtttccttggcatcctgattttgatccctaggcttgtagtaggaccttgggtagctgcaatggtaatagatctgataataattcatagcatctttaataaatatatagaggcaagaccctgtggactttaaggtagtccatccatccgctcattcattcataaaacctatatttactcaagatctgcagattacttggagcagacttatggacaaatactacttgaggaattaatagtctgcttgcagagagaggaagttgagcccacaactgtaaccaacatagtaatacatgctgcaacagaaacaactgcgaaagttctcctggagtatacaggtgggagtaactcatgtggtcctgaataactgcggaacacttctcagtagatatgctattcaagttaggccttgaaacgtgaataagagtgaagaattctctgcaaaggcagcataatttgtgcaaaggtctggaggctgggaaattgaggatttagctttccagtcattatagtcaaggaagtcaagtatgaaactggttgaaaatgggtgttgggttagccaacctggagggcctaccatggtaggcgttgttattcccatagagatgacacaaagttcaggaggctaagttaacttacttctggtctcatagctggtgtcacagctggattccaagctcacttaatctaactcaaaaatctatatgggttccactactccacatagtcctcttctcaaaattttagagtttaattcaattcagtctgtctactgggtatgtactaatactcaaaacactatattgggatcacagatggacacatagataaacaaaatattgttcctgctttccaggaatcaatcagcttgatggaaagagatgttcatgtatcacctattcagggtagatcttgatgactaatgtcactggggcatatgcaataagttgtgggctggggagagagaaaggaattctgcctccgtgattctgagaaagctccctggaggaggagagattttattttgggtcatctgtttgtaaatatttattttata

SEQ ID NO: 28115 - DNA, 1349 bp, Bovine  19866881580358
aatagggcctgtgcttgaccctttaacaatatggtggcttctttgttgtcttctttttcacattaagtttggcaaagatgtgagcacatgctttccctttaaatgtagagcctttttttcatgcttaatatttatgacttttataattactcttataaaagatccactattactagaaacttcagctcttgggttaataatcctgcattttaatgagctctaggtaattacactttgaagtccaaggcttcttttcaaaaattgtaaattgaggttcttcttttcataactatgtaattttaatttcatgttgaaaagcagtgaaaatttgtacattatagcacaactgtaattttagagggaaaaatcagtaatagactatgtaattttaattcaggtcacttctacacaagggtagtcaaaataaactgagaacatttttcttcagaagctacagaattaatctattcctcaccttgaaaaaatagcatgtggatagggagacctgtaaaacaggttggttctctactttatgaaaatggttttgtctatgccaagtctcactaatgttaaacagaaaatagatattttagttgctagcttttctctgagcaggtactggcagccacccacacactaccagaaccatgagagtttgaaacataaagaagacacattttacttttcccacataagctcattccatgctgccagtcaatcttccttatgactggtgtctctaccttcttcctccaaaatcccactgtattttcccgaatctcaagattttgtaccaggtggtttctagatatttaaaattgtgatcacgatgccagacaaataatttttttgccctgttttgagagcaagggagttgaatgcgttcatgcttcctttccacagggataccctggtggctcagacagtaaagaatctgcctgcagtacaggagacccaggttcagtccctgagttgagaagatcccctggagaaggaaatggcgacccactccagtattcttgcctagaaaatcccatagacagaggagcctgggcaggctgcagtccatggggttgcaaagaattgggcactgagtgacgaacactttcactttcctcaggtgtccaagcagcttggcgttggaatgaataaaatgctggagggagagccttgagatgaagtcagtgtgcctgggatgattctgccctgtagtgttgtctctctgtattagatgagagattataaacaacttgtggcagaaacttaggcttacagatctttcatctccttctcagctctcatcacagtatcttgtacttaatttggtggataaaagcaagcttataaaa

SEQ ID NO: 28116 - DNA, 1621 bp, Bovine  19866881933897
ctgtgggcacgcgggcgggtgtgggagtgtcgcccaggcgctcatccgtgtcccctctctgcccgcaggaggatgcatgcatatgaagtgcccgcagccccggtgccagttccagtggtgctggaactgcggctgcgagtggaaccgcgcctgcatgggcgaccactggttcgacgtgtagctggagcagcggccgcgcaggcgcactcagccgccatcctgctgggccttactgtcttatgctttttcctctctctaaacacacacacacatgcacacacacacataaacacgcacatttccagttctttccaaaaccaccaaagcaaagttattggagaagctcccaggatccccgtctccggacccctgagaaaccgccgagctagtgatgagtcccgctggaagtattttcaagccccgaaaatacactaacagtcagagcatagatgacggcgcggttccccgtctgtgtgcgctgtcattcttgaatgaattcaagtcaggctggataaatacatagagacggatttctcagttaccttttaccttcagcaaatattgcgaagaagcgtttggtggggtggggaatgatttcgagggacgattacctgtggttctctgtaagactgcagtggattctgagaacttcatgcgcggcttcaatagcaatggacttatttaaatcttcaggaagcatgtattcccaaagagccacaggcagtagtcagaactatatgtttatccccaagaattctatatttatatcttgcattaatgaaacatcaactctgaatgaatcagcttgtcaactaagtgagaaattatgaaagttaatctgaacattgaatgctcaaaatgtgtgaatttgaacattcactccatttaactctctgcaactttagaagttgtttttctgaaacattacaaaatctagaatttgattttaagcactcattttgagcatgaaaaataagctcatatgtctggcttcactgtacatgtaatgaaggtgcctctaaaggagaccctgttagaaatgagttcagtaatgattctcagtgttaacaaacatgcagtttattaaagcagaatctctaaagaaggaacctttccagcccatcagaatgaaaccaggcagatcagaagggtcatgctctttctctctgcctggataacgttaattacacttttttatatcagagtatattttcttctgatctctttcagatctgattcaaattgcagttgtcaaagcaataagacgcaaagggaaactgcaacaacaacttaagtgcctagaaaggataaaggggtcactgcggatgaattgtgatgtggaatcaaaatacaatataaatgtaattaaccaggttcagggcaacccacacgggggctctgcccacccagtgggttacttagagtccttttctctacgattgtaaattcacaggagaatatttcctcatattagcacagcttgaattggattgctgatcgttttcatccttgttttatgagtcattcgcagcgcatcaaagagagggcgcgttcacgctgaatgccgccagcctccttctccacggcagagtgtggtgggtggggacagtctaactgctgc

SEQ ID NO: 28117 - DNA, 860 bp, Bovine  19866880512090
aatgtattaaaaaactcactgtcttttatattttccccatcaccaaatcataatataaacagctaccactttcctcttttatagcacccttttaactgacttcaaggtcaaaattagttactgagaattttccttagctcaaatatattcctgctgtagcatttgatgatccaaaaaatgtgattaaaactagaagaaagcagggatggggagaaaatggcatgatggaccttgactaatagttaagcaagtgtcaaatcatagcaaaatctgtactcatctggagaatggtcataaaggcttctccatccatctgctcatccatccattttccatttattcagtatttgttgagtaaatgatgaaacgatgaaaaagagaggacattcttaaagaatttaaatcttaataagcaaggtgacatgaacacatatttcttttatgaaagagaggttatcacagtatggactggagtatcagggatggttgccggtgtatggccagggaagggcttaaaagttacagaggcactgaaggtcaaacctgaaagatttgaacatgtgagggaggtgaggtagaaatcatgtttgcattttaggcagagagaataacatgagcaaaatcctaagtgaagaagcaaccggctatgttcaagaaaccatggactatttgatttttcaagaacaaagaatgtcttaaggggagtaacaagagataatttatgcctacttctttctcaggaaactttgtcccatgtctccaggatgtctggacacccttgttctgtcttcaccagtatcctgtgcttatctgcctcacagctaaatggctagaatatatggcttcaaaaagtctggtag

SEQ ID NO: 28118 - DNA, 1619 bp, Bovine  19866880582409
tgacgcttgcttaataaaagtagatagatagaggtttcgtacctctcaaattcaccatgaggaagaaccacattttaaaagcttttaatacaccttgcatctatgatttttaaaacatactaaaaattaattatgagaaaaagcaaatagaaaagcattagatttgatagatataaaattactctgccaaattgctattaagagtatcaaaatcttcactttcaatttctgtgcatgtcttgatgtggaccattattggcccattattggcatctgagtagcactggtttagaggaattggaaagccagatacttgagaaaagaggagagaagcagaataagatggaatataaggtttttatgttctccgcatacctctgttctctgtgttggctttgtagaattctgtcccagtagcaagtaccccatcatggccaagggcaatggcatatctcattggcagagagtagcaagggaagcagacaaggaactcaagggtgcctgcatgccccttggcagatgctgaagaaagctgaagtgtggggagttgggtctactataggtccctgaagcaagacatctagtgactatgatagaggctgtgttgggtagcctagggccaagctatagatgaagaatatgcttgagtcttagaggggtttgctgtaccagggtggcccactgtggggccaaatcactcaggaagagtaggatgtgactaaactgagagaggggctctaggctatatctgcttcaaactttagcagcagatgcctgcaagctcggtggttcctggtggttcctgagagacaccagaagcagcccttcttcagaaaagaaaggagaggacaatacaaagtaggattccattcatccagggccttcttggagaggacctgggtggaggaagaacctgtaggactgagtcttttatttgaaagagattaagcatttaactcaactgactattgtatcagacaatttatgaagttgaactaaagactccctctgatagatatcaaggaaaatccaataggctgcaaagaaaataaagaaaatgtattttctttgcacatctggctgtaatgtttaaaactataaccgctcttcccaaggaacgtgcatatctgtgggcaggaggaatgaatccttggtaaattagccaccctctgccctccctgacatcttcctttgaagaaatgtggagacaataactttactcacagttatatcatttctggaataggcatggtcagcagatagagtttgaatttcctaacctcactataactcattttcttaaagaatgtctgtaaaaatgaatcttctaccttccagccaagtcatttggcctttcttcatgccattcatttagagtttgcctacaagtgaaagtacattggcaaaagggagcacaggatgactcagattcccaagggctttgtaggctctaaaataatagtcagaaccccaccttgaagtaagtaacaaaaggattactaaagggaccaatttctagatttagtaaatgcaattcctggtgaatgacatctcttccaaccaccagcagaggggaagggagactcattttctttcagtatcaatttatctcgactttt

SEQ ID NO: 28119 - DNA, 2224 bp, Bovine  19866880651015
tgtaatgcgattgaacagtatgactttggcttatcaaaacaaaccccactgttgactggcaggaaatgtgattcattcttttggtactgctgaggctgttacctgctggatgggatggtgaggtttggggtttgggtttttttggggtttgggttttttttggttttttgtttttttaaggtttctgatccttggtcagaattttactaagccaatttgaccatagccccttgaactttcaaagataatttgtcaaggaataaatttattatttcagcttcatttttaagtaaaaatatttggatagtagattggtgttctctattccttctgtgaagcttctgaaagtgtgtgtaaaacggcattttttttaaacgggttaatatgtgtagaagagagaaaatgaagaattgctactcttgacaaaattgagaatcatagcctccattctgtaacatataaggaataccacactaataatcccttattccaaggcagtattttcagctctctgaatactgaagtgtgtatcattaattcactaattcatttcagaatcacttagtgagcaccaactatatgtcaagctatggtttacacagatatgtaagacgctgttatggagaagctcctagtctatttggagatactcgcatattaaaatttcaatgacatttttcagtggaataagacaaaggctaggggttggtgtaaaaatatgtcccagtggatgtaaaggggcaggggtggagataagtgagaatcagaacagtcctctgagataaacattctaaacctcactttacatgaaaggagaataaagaacgaacagttaaaaaagatttatgcccaaaactccatatgtggttagtgattattaaactttcagtgaacatgagaattttctggagagtttatcaagtatatatcccatgagtcctcactctataaaaatcaaagtgaaaataagcactccaggtgattatcatgcccccaagcatgagaattccctgcctgtactaattgtttgattaatcataatctgtgcctacttcctttcagaaaatggcccagttttctgttttgttaccaagacattaaaacagcatggctgcccaggagacttcgaaattccagtccttttgggaattcctgcttgagaaaacagaaaagatatgcagctttcatgcccttgctccccaaggaagaagtgataagacattgcactcatcagagatgccttctcaaagacttggactgcttcaaataattgaaggaaagcaaattacacttccagaaaagaaaaaaaagaagacacctttcaccattcccctattaaatttgtaacaataaaggtagtcagtaatattcctgtgctgccaaggaatttgaagaagaaaagctcttagactatttactggtgtgactgtaagttggtatagtcttttttgagggcagtttggtaaaatgtatcaaaggcttaaaaaatactctttgtgctggttaaactcctaggaatttatctttaaggaattatcagagatacatataaataattatgaataaagaaggatgtataacatagttatcatagcaaatattcaaaacaatctgaatatctaacaaatggaggtaaatcatggttaagctcttaattagactgtgaagcagccaactgaacatcatagctgcacataatgtacaaaagacattgttgctgtataatatggaatgaggatgtgtaagcattttacaatactgattttgttttaaaattctacatagttatgtacaaagaatagaaagaaatatatgcactcttctgttattgtatttgggaagagggatactggataattttttattttattttttccatttcttcacatttttctacaatgaatataatcgaatagtgaagttttagaaataaaaatgggattagaaagatccagttcttgaaaacccactgtttttggtaatgcaacagaagttaaaacggcactgcagttccatctttatattgttaaaaaggccattaatgactgtatggttagaacagtatttggatttgcaacaatgtgagaaaagctgagtgtttaatatggagctaatcttaaattatttaagagaccatatacacacattatagtgtgtgagatatttttaaaactggtattgacttttgtttctacaccttttcagattgagaatattttacata

SEQ ID NO: 28120 - DNA, 1249 bp, Bovine  19866880676457
atgtggcagttattcttgaacttgctctgcctagcgtagtgtctggtgaatataggtgcttagttgttagactgatagttaagaatctaagaatattgaaaagcataagagagatattacttatctaaccagattctataggactaaaatacttagtagatgtgtcaggaacaattcactagcccacaaatcagtctgggacaggtgaggcaaagactgctaactgataaagttgcttcagtcttcgtctgtacgaccccatagacagcagcccatcaggctcccccgtccctgggattctccaggcaagaacactggagtgggttgccatttcccttctccaatgcatgaaagtgaaaagtgaaagtgaagtctctcagtcgtgtacgactcttcgagaccccatggactgcagcctaccaggctcctctgtccatgggattttccaggcaagagtactggagtaggtgccattgccttctcggggggcaaagattatgctcctcttatttcacaacagcacctctggcatatgtagcttgatgtctggcacatagtaagtgctctgcttattacatagttgctgagccaatattgtgagaccattattcttataagcctgccatagggatacaatatgtgtacccaacctgtatatggttactatgagaatgcccttattttaaaaactgcatccccatgccaaaaaaggggaactttagtcaaaacagggaattggtgacctactccatcagtgtaggcataaatttcttctttcaggctctccatgatataatttagcaacaatcaagatcctctgactttcccactgtttattggctcatgttacaactaatgggtaaataggatttgaataaattacatctttatgtgagcactgaagaacagcctgatgagctaatgggccaggtgcacctcatctaactcagaagcctctccttttctggcagaacttcaacaactgcatttcaaagtaacgtgatttggccagcccttccacacctggggagacctttaatgcttctgaacacaaatacagctccacacccacccactcactcacccacacgtcttttcccagactgagcttctaatggactgatgctccctttacaatgacacttttattttcccctgagggtcctcatatattcttcagtaaactcgatgccatgcagttgttgaacaaatcaaccgtgaatcagtctgtgagagtggatgatgatag

SEQ ID NO: 28121 - DNA, 2477 bp, Bovine  19866880831793
aatattaaaagtgtaaaagaactaaaatatagaagattaatgagataatcaataaattaacaagaacaagtttatgcaataaacttgataatttatttaaaaatctaactcaagaagtaaaagaaaaatacgtattattctataaccacaaagattgaattcatattttaaaattctatgaagaaaattccagggctggatggctttagatggttagtttcaccaaacgttcaaaaatccaatacttacaatcttatagaaatttttctaaagaattgaagaagagggaatgctccccagctctttctgacccctgattggaaaggatagtataaaaaaggaaaatcaaaaggtcaatctcactcctgaacagatttttttttaactatcaaattaaactcaacattatatgaagaagacaatatctcatggacaagagtggtttatcctaggaatgcaatgttagtttaaagtagacagtgtgacagtggagtgggagtaggtaaaatcacggttaaacttcctctcccatgctcagagtgaaaactgaaaatggatctcctcttccacagcgataagctctgtgataccattaaacatcctgaggaaccagttttttcagacattatatctttgcatctattcgtttggaaataaaactgggtttcagctagttttcttaagcaaagggatatttcagacattatatctttgcatctattcgtttggagataaaactgggtttcagctagttttcttaagcaaagggataatttactgacaatcgaagattataggaaatgctgtctctatattataggcattgataatacatcatctggttattaacaagttttctgttttgatagacccaaactacgggggtgatcccttcattcttctaacctgagacctcagtgaaggcacttagaacaagcattctaaaatgggaactgtgagtcctaaacacctgtgtgtgtgtgtattggtaggactggggggaggcagtagaagagagcattgtcttgactggttctctacaataatggttgccatgtgctacagacatgatgctaagtgctttcaacatattttctcatttaatcaacacaattttgtaagaaaagtcctagggaacatcagaccacttgtccatgcatctgctataaaaagatgttagtaaagagaacaaagttttatgaccatataacaaaggtattttccccttatgtagtgactggaagattctgattataatcaaataatttaaagagtcagcagactacaaacctacatgtcgttaactgatgtgggaaaaggagcagagttcagtccccagttgacactcttctcgttttaaaatgatgagaagtttttttggatgctagtctgggaaaaggagtaaagatgattcatttacaaatttgctgaacggcatctattcgagctgtgccttggtcactgatgttgtaagaaatatattcttgcacactgttatttttttaaatctcataaatgtatcatgaatttaaaaatccccaatatttctttatgatactaacaataagccctattttctctcatcagaagcatccaggttcattgtcaacccctcagtctctctcagctttagtttatacttaacgtgcagatattgcaagcattagaaatatcgtgtgcaaggcacctcatatactgcctgtcacacggtaagtgctcagttaaaggcgtccatcccatcgcttctgctttactttctatataagcagattgctatgatttttgcacaagaaagcatatgttctttcattataacatctttcaaactacttagttcctttatcataataagtgaggaaacttacaaatgtctaatggaaaaagcttaagacactatcttcaggtaagatgttgttccttataagacttttgtgatgcaatccctatataaaacttttttcagccttcttaccagtccctatctgcaaccttatatggcagctaaacttagttatctgtatctcttttacacatgatattcccttcagttcagttcagtcactcagtcatgtctgactctttgtgaccccatgaatcgcagcacgccaggcctccctgtccatcaccaactcccgttcactcacactcacgtccatctagtcggtgatgccatccagccatctcatcctctatcgtccccttctcctcctgcccccaatccctcccagcatcagagtcttttccaatgagtcaactcttcacatgaggtggccaaagtactggactttcagctgtagcatcattccttccaaagaaatcccagggctgatttccttcagaacggactggttggatctccttgcagtccaagggactctcaacagtcttctccaacaccatagtttaaaagcatcagttcttcagcgctcagccttcttcacagtccaactctcacatccatacagaccacggaaaaa

SEQ ID NO: 28122 - DNA, 1933 bp, Bovine  19866880844931
atgtacaaaagttatgtctagatctgtaatttggtttttctgtaactgagtatttctcttattctcaatcactggattgggatgtgggtttatagattgtggacattcttctttaaacaaatgagctcaaagactacctgaactacatactacaagatacattaatatattgttcagctaacatgtaacttctaccagagatttgtttcatgccttcttgtgctcagaaatagtatgagttaattccactggaatttctttgccctttgctctgctgaggttgaatgtggttggaagccagaggtctagggggaaaattgccaatagttgaaacaatatctcctgtcaaatttgtttgatctctttgtgttttttaccctctagatttgtccttggatactttccccctgcattaggattctttagctttctacagagaccattttaaataattgacaccaaatgaaaattggtatttaggttggggatttcttatctcatatactgacttttgtagaatattttgtacactgtatttccagttaagaaaatttgcctctacctagccctatactaataattattattttataataatgaatagtatcccatttggaatagagctggaaacggacatcttcatcaattaggttcacatttataggtaaattgtatgtggctactaaattgtagtaatagttatgacaaacctagatggtgtattaaaaaagcagacatcactttgccgacaaaggtccgtatagtcaaagctgtggtttttctagtagtcaggtatgtgagagttgtgaccataaagaaggcggagcaccaaaaaattgaggctttcaaactgtggtgttggagaagattctggagagtcctttggagacctaggagatcaaaccagttaatcctaggggaaatcaaccctgaatattcattggaaggactgatgttgaagctccaatattttggccacctgatgtgaagagctgactcattgggaaagactctgatgctgggaaaaattgagggcaagaggagaaggtgatgacagaggatgagatagttggatggcatcactgactcaatggacatgagtttgagcaaactccaggagatagtgaaggacaggaaagtctggtgcactgcagtccatgggggtgcaaagtgccagccacaacttagtgactgaacaacaacaaagactgactcagagggctaaattttatttcaggtagtgaaaagcacccagagttttttgaaaaataattatagttgttcaaagtaaaattctaaagaaagctaattttatcttgtgtgtttaactacttcattcttgctgaccctttaaaaaattaataagatactcttttaaagcaacaggaaaaatatatatttgtatttatacatctgcttatttatattaaaaaaacaggaagtacaaaaagaactatatgaaatgaaactttttattgacagaaatgaaaaaaactgcaaagagtaactaatttaagtatacttttagatggccttgcctgtggaactatgttaaatgttctgaacatgtagaaaaaaattagtaagtgtggagaaaaaacgctaatactgaacagcaacaaacaatggatcaaattatcttttaaatgattaataagaagatgcaatatgaaataagggaagaggagtagaatctgtggtttcaaactggaagtaaatgaaacatgactgtgtgactaaaattttataaaaataatgtacatatggcaatttcatatcaaaactgcttaatttttcctagctctgagtgctgaataagactgctgctgctgctgctgctcctaagtcgcttcagtcttgtccgactctgtgcgaccccatagacggcagcccaccaggctcctccgtccctgggattttccaggcaagagta

SEQ ID NO: 28123 - DNA, 1071 bp, Bovine  19866881036158
ttccccttcaatggactgtcccccaatgcagaggttccacataccctatctgcgttaactcccacaagactgagtgcccgtctctcttttcttgtgacactatggccagcacaaaaacataccaccttgcatttactttccctctatccctacctcatttcctttttgtccttttctcttgctaccctggaatcacaattccaaatacagtttcagcttcaacctgttttcctggacctgagctgagaaactagtttattattctgtactagctaggtgcccagcactcttctaggagctttaaatatattctcactgcattctttaaacaattcaatgacatcagtatccttagtacgatcatttctgttttacaggtaagaaactggggcacagaaatattgaggatctttcacaaagttctatagctagtaatgacagacctaggatttgaagcacagatggtttgcctctagggacaaggccctatgctctatctgcagttgcattggtcttcaagtctgtttttatggttaaatgtatagatagtgccaattccactgggtcaaaaaggctgccacatattatccaagagagtactgctgagtcagacataatatgagagatatttgtctaattataaaacttgaatcgagtaaaggaagatcaccatccagaggccttggaggaatacttgggaggtctgggttccctctggcttcctcagtttagttagctatttgaatttggataaatcatataaccactttgtacccatttgctagctatagcatgaatgtataatccctaaactgcttgcttcacatgacttttgtaagaactgagtaagtcatattcattaaaacgtttctaaatactgaattattactactacctcaatgagaataattctactaacaaaaggcttactaaatattatgaaaatttatatcagttttttatatccccaaaaaaggactgaagtagacttttgaagagacttgaatataacaaaatcatacaaattgaaataatcaataaaaataaggcaaaggaaagtgtgccaaccaa

SEQ ID NO: 28124 - DNA, 1247 bp, Bovine  19866881061561
tgttgaaaaaactacagtcaaatcatagaaaatcatgcttcctgggggcaaatgaagaaatgcaaaggcacaggctagaaaaaaagataacaataccatatgatatcacttatacgtggaatctaaaatatggtacaaatcaacatatctacggaacagaaacagactcacagatagagagacttgttgccagtggtggaggagggtaggagagggaaggaatgcgagttcctattacatataggatggataaacagcaaggtcctactgtatggcaccagggactatattcaatgtcctgtgacaaatcatagtggaaaagaatgcgaaaaacaatatatatatatatatgtatcactgagtcactttgctgtacagaaattaatacaacattgtaaatcaactatacttcaataaaattttttaagattatattaaaacaattggatttcttttccctctttcaaaaataaaaagcctgtaggaaacctcgccttgagcatttttgcccaatatcatagcaatcttcttttgctttccctcaaaaacaaaggtaatctgagtgtcctccagcacacacgtgcagtttagattcattttagaggaacagtccgctggtgtctctggcatagcacgagactacgggattgtggaagcattttcagcagacccggaatactgattcatcactccaaactagccctgttctctagctcactcctaagaatcaatattcttttcaaatgttctttatttttatctacaaataagaaaaagagtttctttacaatcctaaaaatggcattataggaggcaccaatttgaatggcaactccaatgtgctctggtggagggaagaaaacattgggagcttaaaaggcaacaaagagaaattacacaggttatctttacagagctgtgattggtgctggcaggcattcagtcacttgctggcagcagataggttgctaggctgtgatctctaaggaataaggaattctaggtggtctccagaggcctggatccaaagttcatgttgtgtcaggggtggacacgtgtaagctctactttcttaatgaccagaaagctctactttcttaatgatctccctctcagatcactttgaaataaatgacttcatttcttattgatttaagccacggatacttaaagagatttgtgttataacacctagtactctcagctaaccatcatttatggccccctcacctccctactcttttcaa

SEQ ID NO: 28125 - DNA, 1706 bp, Bovine  19866881094290
ttcaaattactttcatgtcctggaaatgagaggcactgtcccctcacccctcactcctttctcatatagcatcctactgagctgccattgctaacaagatcatgccagatcccaggggtgcctatgtgcaaagaagcctgaaggacattgagctaagaggatatacaaatcgctttgggacaccgaggacttcctggatgattttattgacaaggaactgtttttgctttttttttttttttgaaggatagaagtttgtcaattcagagaagaatatccttagcaacggatacagtgtgcaaaggcatggaaaaaagaaagagggaatttattctctttaggaagtgtgaaggatttgcataacttcagcagtgagtgtgtgtgtgtaaagggactggacatggttgatataggactatatttcaatgaatggtgtgtactccactggaaagtttttactctgctttttggagaaagtatcaattgtccccataatcaataccttcttcatagtcaaattcaaatttcaggaatagcctggattagaattgtctttctggctgtctcctatccctatctcttcttttctagacaactgaatttgcagatttgataggaaccagtggctgaagaaaatttcctctgtcaaccagtttatcttgttactgacatgaataatcaaattcaattggattaaacaagttgtaacacactgtcagaagccattagcaatataagagtgtccagccataaagaactctttttgtatatcttagagttttcctcatgtagggaaaaactcaaactaaaggaaacagtgtggtttcatttacaagctctgagtcctctagggtcttctcataagcactgtggtttgattttttctggaaatagcagtagcacggtcttcctgataatctcacatgtgtaatgttttcttgaaaaggattaaaaagcctggtatatctaagtttgcatattatccagattttcaaaaggaaaaaagtgaggagacataaatcaagaccaaggcagaggagcctgatacccctgctgtcttctgagagtttatctgctttctggagctgctgttgtgcttttcctgactcagtgtcatgctacagctcctaagttcacatggctgctaattccctgtatatacacaggtagagaagttggctattgtaattgacaagatgccagtgactccctggactatcggaagtagaaaacattggcagagctacataaaaacataaatgagctgcagatggacccacattgaacaatcctggtgtactttgcactgatcattttcctttaaagacaatcccattgcaggcaaaaacaatatctgatgccatccatttagtaactttattaaaatgcctagaaaatagagattacttacacccactcgatgcatttttgaatgtacacactgtccctgatgaaatgatcaatcaagccagatacacaagatgaaacttaaatccacaccaccattttctcttctcttctggacctaatcatctcaaacatgtgttgatcctgggttcaagtaaataaaatgcaaagagagaaaaaaacaaaccctaagagaggaagttttgatgcttcctatggattcattttcacaaagtgctagaggacaatagcataaataacaactgtgcatcaggtacctgctctccagcacctcagac

SEQ ID NO: 28126 - DNA, 1345 bp, Bovine  19866880345318
taatgaagttgacatggtgttacatttcgtagatctttaattaaacatttattaattttgatttgcaattttcctctgtgttctttcagttttcagacatttgctgggtccttaaaaagatgataggccccaggccctgtgataaaagggcctaagtgttaaaaaggccctggttaggctggatcttcctttaacttaacaatctaggggcctggccagtcaaggctggaaagtctccctgttttccagttcatcctttcctttaggaggagaatcaaagtaagtttttattctctctttcttttacttctagaatttggggaaggatctgaatatcctattattaccattttaacactgtaggtatgctctagttcaaaaaggtccaagataataaaacctgaccttatcaaagaatatatgaattgaaggatgataatttgctttacaaagggttccctgctccacaaaatgaattcaactttggtgtccctaaaatagccagttcccttggtgcatgttaaatataattcaatttacaaaaattcgatttgcatataaccttttcagtagcacatccattgtgcaaagcaatgtacacttgtaattggctgcaaattgccaggagaccacctttgcacatattgttcctagatgtgcaattttttcttaatctccaagggatagaaagtggagtggctaaatttccagttgtttatctgatcccactgactatgctgagaaaggacatttgccaattattagggggtgacatgtgctttgtacagattaatgttgtgtagtgagaaacaggaggtatgggatggttaagggaactgtggactgtctggctgggttcagggtaacagtcttgctgagctgaggaagctctctttatcctggtggcttgacaggcatcaggagaaagtgaaatgaaacaagggatagtcatggatttggatatcaatttttcccccatgaggcagtggaccttcaggagcatcttcccagagagacagacctagtctagtgacctgagccatatggttaaacagtgtcacagcagacccaccagctacagtgacccgcccccaggggttctgtgtgcagtgggttctggccacagaaagccacggcactaacttagcaaggtaagtgtggcattttctcacatgtcacataaaaagtgacatcttttatggcaaattgaatgaattaaagtagattattgtccatgatgccaagttgcatctaaaaccctttttgacgtgaatattaaaaaccctgcctggttcatcacactcttttcagacacgataccttcctcacacattcccactgcccc

SEQ ID NO: 28127 - DNA, 1555 bp, Bovine  19866880357057
acaccacagcccataggtttgcagcctgccttactttgcttgatgcgtgtatctcagagcaattcccactcacagttctgaagcccagcaaagtgaagaactctgcttccacaagcagcatctcttcagacacattttcactttggaggtgctctatataaaaaataattaagagggtcaacatcatagcagacgtatttctttattagaataatttgaagttacacccttggtgatccaatcaaccagagactcaaagacagaggaaaaaaaaaaaagcaagtaattaaaatacataaagcagaagacgcaattactggcatatatcatgatcaataaaatgacaatgtaagaaggcaagcttcccagcgcaccctgaggctagcacgccaagtctctatcacactggggagaggcaaaaaaactccttaggcaagtgacgtgtagacctgtcaggcttccacctcctcacagaggggatgtgaacactgtcaggcgctgtggttgttctctgtggtggggcgggtaccttgagaataaggtcatcttcaagcacaattcccaattttttccttcccaaatgcatataaacccaatgctcacagctcaggttcccaagaaaatatgcagacatgttttttaaaaataaagaatttggggaaagttaatctgtactatgattcatcacactgatggcccctctcctgttggctcagccctcatgggacaggctgaaggctgcccaccacactcagaactgctgacactacaccattcaagaaggagtattccagcgcaagcaagaaagagggctgttacccacggacaatcttgaatctctccaacttgttaaaaataaaacttaacctttaaggaagcagacttaagctactagaaacaaattctggccatggacttaaaattggcagaaccctccctgtgtgacatatcatgggagttaaggacagtcttgggcttcccaagtggtgctactggtaaagaatctcatgccaacgcaggagacatgagagacaaggtttccatccctgggtcggggagatctcctggaggagggcacggcaactcactccagtattattgcctggagaatcctgtggacagaggagccagcacagcacacggcaggacgctctttgcagatagctccttagggacttcttaacccaagccagaacttggggtcctcactgagggagagggagcctctggcctcagggtgcagcctgggaccgtcagcctttgggccgttaatactgagtgtccactgcgagcagggccttgtgctggctggggtggagagagagacacagggagaaagaggaagtctggcttttgctggttaatctgctgggatgggcaaaacgaaccccacaaaaggctgtgcccaatttgggtacagactgtccccagcgctgcctcttcttgcatgatggtgttcactctggatcccagactcttcagcagattcccaacttaggcttgttgcaagaaaggcaaaatcagaagacaaccagccatcagcaatacagaggac

SEQ ID NO: 28128 - DNA, 846 bp, Bovine  19866880427297
gtttattccccagatcacttttatcaaaacctcatttctcaactgaaaaaaaacttgggtctgccgggattaagttccttgctcaaggtcacgtggctaagcaatggcctagctggaagtcaacccaggtcttctgacacccagcccagtcctgttcccactaattactttaatttcctactgacctcaaccaatgaaatgggtcagtccttttctggtccagaggctataaactctgaaagtgccaagcaaggccctgggtgcaacccctgtgtagccttctaggggtgacctctgggcacctggtaaacgtggcccacagctggactgcttaatggagcccaggggtgtaagtgaggaagggaaactgggaagagtcaagggggctggcctatgcctgccctcttcctcccgggcttgtattctgaaggccacatgctaattatggtcaaagtgtaggcggggattcccgaatatgctggaaaaatgccaaactcccccctcaaacttctgttacagtcttcttacagaaacaaaaatgttttacatggtatatgcacttttctgaatctggcttaaaaagatgagtgattgggacaaaagattgggaaagcttgttagggactggagctggttaaatgtacagagtgtgtatctgtgtgttttatctgccactcaaaggcccaggcaggctgtcattaatacattctctggccgcccactgccccagagttgccccaatttttctaagccctacagcattgtcctttcatttgtctggtgagggaattagagccagtgaataagaaggcaccaccccactcagtaatgatatatttcctttcc

SEQ ID NO: 28129 - DNA, 1111 bp, Bovine  19866880441857
ggttggtttcctttaggagtgactgctttgatctccttgctgtctaagggcctctcaagaatcttctccagcatcacagtttgaaagtttcagttcttgttagtggttattttccccagttcccacgaaaggaaactgaggtagagagatgttagctgcggtaacatctggtagcattgatggtagctgcgtcaagtcacagagctgataagcaacagagttagggctccaaccaggaaatagggttcagtattacacaaaaagacccactctttctcgccctgctacttttgaagggggcaaggtcacatcgggtttgaggttgatccattctctgcctgcctaagatgcaaaacaattccctcgagttttggaagaccgtgcaggcgatgatctgtgaacgcctgtccatccttcaaatctcccttcctccagggtcacttctcccaggtgtgtagtcccctggcagaaggcagttggcaggtcggggcaggtgagtagcctgtttctcagtctcgtgtcccttgagatcagttagaatagagagcagaattgtgggaactgaggggctcaggtcagcctatgagtcctcaattttccaattcctacaccctggcaagccatggcaagtgtgtgctccagctcagctgcctgctctgggacaaagaagagcctggggttgcccagcacatcgccatcactggttttttctattagccagagaaaggtcaggggcaatcacctggccgaggtcatgaagtcaagtcaacacaaatgttgaggtaactgacagagctcacactggaattcacaaattctttaagtctgggccgcagcagtctttcctactctatttcatgtctttgaaactagcttacctgcatctctctcttggcttcctcttgaatagtggctttataattagatttttttgtcagtctcatctttcattttacagtggaatgtgatcagttacaaactacaacagaacatgctcaaagctgtgccaccagcaagtcaaaaggccccaatgtaatgtccatagcttgttgaaaacacaatcaaatggctattcagcaaatctctttttctttattctttttttttcttt

SEQ ID NO: 28130 - DNA, 1180 bp, Bovine  19866880442197
tcaatcctaaaggaacttaaccctgaatattcattggaaggactgatgctgaagctgaagctccaatactttggccacctgatgtgaacagccaagtcactggaaaagaccctgacgctggcaaagagggcaacagaggacgagatggttgggtggcatcactggctcaatggacatgagtttgagcaaattcagggagacagtgaaggacagagaaagcctggcgtgctgcagttcatggggtcgcaaagagtcagacatgacttagtgaccgaacaacaaaattgatataaataagtcattcttaggtacacatctaaaatgagtggctatttaaaaacctattgaagataatcactaacaagcatgtattttaaatctgagaatcctctgttctggagtaatcttagtggaaaggctagcgtatggagaggtgaaagtaactgtatggggattgagaaggacctgccttctcccatcacactcttctccctcccatctcaccctgggggctctgtgaggcaatgtctgaaacatctttctaagggaccacctttccctgggttctccccaatcccattaggccatctaagtttaaatgaactatgaaaagatttgcaaagcaccttgcgaggtgccagcagacacagaaaacagcctaagtgtcggattcagtcttcccttggcttccacttctttcattctagctcctggcagcattgatttcccgtgaagcccctgagaatcacagatgtcttaatataaggctcctcagacctcattaatttttgtatgctgccacttcatggtaagaaatgttgaaaggaactgatccccagcctgtttctcttggtttttactccctcactcctcctgtgttctatcggatggtactctctagagatccacattctagcaaagagactcccccagtcagatttccctttagcggcagtttcctgaggacaaacacaatactaacttttagggagtgacaaaactaaggagagaatttttctgaaattgttgctctgacgttcctattagccatgaatgagagaaaaaaatctactatcaatggactcctgttataaacggaaagacagcctaaacgaatgtaactggaacttatttcttggtcccaacaatgctactagcacactacatgtacaacacagaa

SEQ ID NO: 28131 - DNA, 1885 bp, Bovine  19866880443716
tatccttagaagagcagatgctcttaattttgatgatgttcaatttatcatttttttcctttatagatcacgcttttggtgtcatgcttaagaaatctttgcctcaccttacataaaaaattttgaaaaaagttttgaataacaaaaaggaataggaacaaggagaaaagacaaatgactaagtagatcaaaatatttgaactcatatcataaggtgctaatttgtctagtagataaagaacttctaaagtcaataagcaaaagaccagccatctagcagaattaatggcagaaatacagcagacagaagatagaggatgaaatacaaacgcctctcgtacgtaagactcctaacttcctcatataaagaaagatgtaaattaaaaccatagtgagagccactgtttccctctcaggttgtcaaaaatcaaaagtgaaagtaaaagtcactcagtcgtgtctgactcttttcgaccccatggtcgcaattccatccagtccatgcaattctccaggccagaatactggagtgggtagctgttcccttctccaggggatcttcccaacccagggatcaaactcatatctcccgcattgcaggcagattctttttcagctgagccacatgggaagcccaagaatactgggagtgggtagcctatcccttctctagcagatcttcctgactcagtaattgaaccggagtctcctgcattgcaggcggattctttaccagctgagctactggggaaacccagggacagttattagccccaattttatagccaagaaaactgaactataagaagaccagataacttgcctaacgtcacaacagcagaacaggaatttgatcctaggtgtcagtgacttcaaagacttaaaccctaaactacacaccatcctcagcttattttaaaagaccaatattcctctctgcctggcagtctttctgcttagagaataggggcaaagtgaagcttacctcggtggcagcaaacactttgaaagctgcctggcctggtctgcccacccatggccccacagtcctgtttgcagttgttagcagatcttacctagtctagttacccacctgtgttctcagaggctaagttcaacctctgaaaaaaaaaaaaacaacaacaacccattaatgcagaatagccaaatatatgctgttgattaagaactgtagtatataataagcatatcgacagggcggcctggcgttctgcagtccatggggttgcaaggagttgaatatgacttagtgactgaacaacaacaacagcaatcatacagaaactgcttactgcagatggaataaatggaacctttgctcttcttttccagtccctcttgttatggagccagtgaaaacccttaggtcactgtctctgtcttggcctgtccttacctcatgtggtccacaggctctgcagaccctcctgcccatgggctgggctgtcctgctctgaaatggggtttgtgctcctgtctcagcctctgtttttcccctcattattcagagctccctctaaatacagaggctttgtccattgtattgctcaggaggctttgcttccctccagcactgttctcagaacgtctgtctgctactgagtcctcattactggggcctggtttctttctccgttgtgtggttctcctgctttctgtcccttaaaactgagacctctgtgttttcgggtcagaggcctctgggttctcttctgctgtggggacaggaaaaggggtttattttctgctttaagtaggcagagtaatttctagtttgggtcagaagttaacccaaaaagagaatgcatatttctatacagtgggcaaatctctgataagtagctcctgtgtaatactatcaacc

SEQ ID NO: 28132 - DNA, 1450 bp, Bovine  19866880444783
ctgggctgctccacataggtgtgatttcagtgactgactccagaaggtgagtgctaccaatgtctaaaaaaatgatcaagaccaggcagaaacaattttttaagaagatggaaaaataagtagaaggcttcctttcatgaaagactaaaacctcctctatcaaaagtcgtaatagcatattcttataaatttgaggtccctgaaacagctactcaaatccagtcaattaactataacagataacttcagtaggcacaccaaatagtcttcctttactggcctggccaagtaaaaaagttttccaagaagcttaacagctttttttagacgcttgtttataaacttgcattgcactccatgttcactacccacacccctcatgccccacagactccccccacacacacacaaaaagctaataagcttgcatttctgactatgactcacatcaactaagaaccagaagattaacaaaactcttggatatgactaagcaaaatgttctaattaataaatagttaagaaaaacacaaattttaaaaaataaaagaaaacatatgaaaacaggagattagggagggaaggcaactttaaatccttgtaagatgtccccagggaggaggggggaaaaaaagcccacatttttctttaagggctgaagaatcagcagcaataactcaaacctatcatgcccataggtggttttaagagagttgtattcaatacaactggcagttttccacataatatttcttctttttgattttctgttttacagaattccacttgagagtttttacaatttatttctcttaccaaatctgaaataaactaggttatgacaaatcaagaacctcatataaagcaaaaatcatctctctggccccttctctactaaaaatcaccatattttttttactgtttctttccaaaacaaaagcaaaggcccatgaaatttgacagtctgatatgttataaatatttaatttcatgcttatacttactatttaaactgaagcaatacagaaccctgacgatgggaaaaggaaactctttcgccttacaaggaaaaatctgtcaccagaatttaataatattcattaaggaaccgcacactttcatgcggcctcggctgtgtcagtcacacacacgccgccccgccccctgcgctgtcagtcacgtgcaagccccgcccccgggctgtcagtcccggcgctggcccgcggctgaactggcggcgctgacgtcagctggcgaccgcggccgcattcctaaacagttcagacaaacccactggtgggaagcttcgaaagccctcagctgtagtgaagaaagcaacggcttggctggcagccagactcctgagctcagcattttgtaatgcacttcctttttacttaacagcttgcataatgcctttaacccttcctttacctgcttcacaccttta

SEQ ID NO: 28133 - DNA, 817 bp, Bovine  19866880451491
actaatccaaacagactaggtgacataattcaagaagctgactttgttccctgcaaatctctctcctatatgacatgaaattctaccaattaaaaaaattcctttgggactttccctgctggtccagtggctaaggctccacgctcccaatgcagggggcatatgttccatcccttatccaggaactaagatcccacatcccaaaaggagcatccccccaaaaaattgttttttcaattatagacaaggaaacttctaggaatgactgtgcaggagatagggaactacaaaagggaagcctaagattactgagcagctaattttatttcctctgccttagtaatagtaggattttatagaaaagccattaatgactaaaaactctgagatgaggtcaaggaatctctgcattttattacggactcatttaatcaggctgatttaatcctggggttctccaagaggggttcccttttgcttatcttatcttatctaataaatacacagtaggacaaggaatcagtagtaaagctcccaggctatagggataaaaactagggtaaaaggggcctacaacaatgacagctgcattactctcatagcagaagctcaacatatatacatacatttttactaaaatgctacttatatccacatatataaacacatcataataacaagagttaccataaatttagcatagactacatttactgaagtatgtttacatgacaattttcaaaacgtttgagagtcaaaatatctgtgccttcatatagtccctaacttaatactaagatgtaagtatgtcttttta

SEQ ID NO: 28134 - DNA, 2419 bp, Bovine  19866880454943
atgctgaaatttaaaagccaagcccttagaccagagccctggagtaaaagggaagattgtagaaagccatataaatggattggatctcttgttagtggtctctattctcttggtagggccagggaagccagcttattatcaataaaaaagaataaacactttataggaagcaatttttgctgtcaccaaacgttttatatacctgtcaataattgtagcagttaaatatgacgtattgatgaatacagtgggaccaaaggatacttttttctgattagggtgaaaagactttatgttctttcttttatggatgaaagtaatccaactcacaaacttcagctgtctataatcctctatgggaaggcaataaaagagaagggaaattctgaaaggagcctttttaaccaagagctcaaccccatggagcctatccttactgaactgaattggtttcctaggctgtctggagggtcccttgagggtctgacccgtggtggcatctgtgtggggactttggccaggaggccctgtactcctgggcacctatctatcaccgtctcaggtccgggttgaccagatgcggcagttaggatgtctctggctgagcaggcagagagaactacttgaaagatagagagaggcacttctggagtcgagttcacatgaatatgtggttcatggttcatgaaaatgaacgcatccccacgtctccatctccttcctccacctgcttcatgaagttctgtccatctttcctgcacagatccctggatctctccgtttctctccgtctctgccaccaccctagtccaacgacctccacctgccccctactagtgctgaagtagccagtcagggaggacctggaaaccactgggaccctggcgggtctgcaggggccccctggggtgggctaggggatcagagtgaggtccaggtcaagccccttccccttcacaaggcccttgtgctctcagctgctcttcatcagctggattctagctcactctttgacttcaggctgaacactgttttccttgggggcgttttcctgacccccttgaacctgccatggcaaatggctttgttgacatcatctcttgccctcctttcctaggatcctgagggaaaacagatgcttgtcgatgcatagggcaagtgggaatgagagttctggcttaaagagtgactgcttgagaaacactgcagagtgttattctcccgattgatgatccacttaacagaaaaatgtaagaacttaaagaaatctgtgagttaatttgggtggagctagcaacttaaccaaaaagtggcgtgggagcaattcagaccatgttgggatgttcctggggtatgggtgtaaaaggcactgactggggccttggtccatatcagagtctggaggcaaagggtacaggaggcttttgagggcctgatgcagaaggcagggttatgaattgtgtggaaacaagtgtcattggggtaggtggtatagtgaatagtttggtatctgatattgtgatgattgattttatgtgtcaacttggctatgccacagtacccagatatttggtcaaacactattttagatgtttctatgaaggtattttttggatgggtttaacatttaaatcagtacatagttgactcttgaacaacattggcttaatcttcttaggtctggggaattccctgcaagtccagtggtgaagactccgtgcttccactgaagaaggtacaagtttgatccctaattggagaattaagatcctgcttggctaaccaagaagcaagcagacaaaacaaaaaactgcacaggtccccttagaagtagacttttttagtaaatacatgctaaaatactgcacaacccaaggttgattgaatttgtagacgtcaaacttcagatatgcagaaacagtgggtacaaaaagcggactatatatagtcatatgtggatttgtggattttttgattccttggggtttggccaaacttttattggcttctgttctgtttctctggagaaacctgattaatacaggtagcatgacacaagtttagttatatggattctactttattatatctagttcataatgagatgaataacgtcacaggaataactagcgacaaaagctcactttaaggcgacacaaaaccaaggatgggaggactctgtaagaaatcttatcatttggtgtctttccattcaagtcaaacaaaattaaaagcaattcctttcaactggtgccggaactctccaacctctatttggccagtctcctctgtccatggaattctcctggcaagaatactggagtgggtaaccatttccttctccaattatgcaccaggcatggttctaaatgctttccacatattcatattatctcagttaatcctcatgacatcccta

SEQ ID NO: 28135 - DNA, 1020 bp, Bovine  19866880476980
actgaagttttcttataatacttaaaaacaagcctattgtcagagccagggacattataatgatcagaactgcacttactttcactccttcacacattttcccactggatgagtggctcccttgtataagtatggaattcactaatcataaagtggatttcatccagatacaaaatatgaacaaatgaactcatgagaaatgacccttgaaatgcacaccaccctcaagtcttgaaaggattttctatttcatcaactttggatgagccataataataaaacataaaatattatacaaagattagaaaatcaagagccacatagtttctcctccgtctcattttcttagcccaactcatttctcagcatttatagctggtccacttggccttccccaggaatcgcaccccttggttgagtgaagtgtttctcccctgtgcttccaggacagtcttcatggcactctcctatcactcactgtacaattttgaaatgacatgggatgtggctcctcctcaatttgattcccagctctgcaagccaaggaccatgtggtgttcatctttctgaacctgccagctctcacagtccctggcgcttggtgggttctaagtcattacttgttttgttgtgttattgttagtatgttgaacaatataggggatagtttgttccccatttttgttcacctgtggcaaacacagctgattgcccacctaacagccatcactgccccttccccctttatccttgcgggagaaactttgattttaagcttcactctccacaaagttacatgctcaggaaatgactcctctttgctggctgggggagagcatcatggtgactggtcccatcaatctttgcagtcccattcccctggcctgtggcccaaatcccactgatgaagtctcagaacatctagtgaggggccttgttcaccaaaacttggtctctccacgtcgttctttctctcaccttctggctgaattattcagcctcttttctccactgaatttc

SEQ ID NO: 28136 - DNA, 854 bp, Bovine  19866880506682
attgctcaatgctttctactatttcatttcctcagaattgtacttgatttctgcaaaacagctagggcaactgggctcctggcttgaaagaaataagggctggccaaaaagaaaccacataaggatttttactcatcattagaaattcaactcacagaactagatgaaagagtcattttttaattattcagagagcagaaaggctccctacctcagatttccccaagttggtaggttactcatgttttctactaagagtctcattttgtcttgcccagaagaggccaaaaataacctaaatgcaaactgtagtgctacctcacacaccccagaatgaaagacagttgagggccttgtaggcagagttagactgaaaaagacctggggaagttctttctctcatctggaagcagtgatttcaggcccagtcctgcctccaactcatgtgggacttcagagatgcctgaaccaaatgaacactcttttaccccttaaacactgcctgcacaattaacttccttctgcctcatctctgatattacctctgctcacagttttctctaaggtcactgcatagtcaagagagtggctttaccagtgttctccctgagtgctgccccacttacctctactaaacagagattccttcctgtcattcattactcacatctggctcgtctactttgctaggtccctttcctttcctaaatagtaaatattttccccaaaccaagagtgtcttcgtccctttgcttttctctctgggtaatgaatcctttctcatagcatcaactgtgtcaaacccacaggcccacttgactcttcacccaagcagcttctatctcccaccaaca

SEQ ID NO: 28137 - DNA, 2182 bp, Bovine  19866880515801
atatgaaatcactcccaaatttaaataaaaaataaattctgtgttgtgctagaagattctcctgccaaaaactctcacacaattaacacactagcagaatgtgttgctaatttcatgccactggagtcttttctacttcagaatatagaaacaaaatcgggtcagagctccaataataacaggattttgttaaaatatacagccctgtgttgcagatatgttgtagacatgggcgaaaagtagaatcacagtcgtgcgtgaaatagcttactcctgcaaatagaaccagaggaatttgtctccagcttccctgcaccaggggggagagagagagagagtttagaatggcccaattctgtggggaaatccctcattatcaatgtttgtccatccacatacttaaacaagggagacaaactccaggaagagaactcaaggatgcaaagccactaaaccctggagctctaattccctcctttctctcggactccctctctccagcctggcctcccacctcttagcatcctcatagggcctggtcttttccataacaaaaacagagataatgaaaatattttggcagcattcagggctttcacatggtgaccctgacctccaaatcaattttctttattcttaacctgaccttggcatccattctccctggtgttcaatattagttacaaaatcctgaactccaggagaccttccctcctcccccaggttaccaaggcaggccacactggtgaagctctagagaggagagagggagaaggcttcttgacaaagaaaaataagaaagagccccacaagcccgtgcgttctataggcgtctcatttgcaccgaatgccattagctctattatttactcagacaacaggagaggcagccccgctcccgtgctcgcagggggcacactggatgactccatgcatcaccagccggcacagcccagccacttcacttaaatagtgatacgtaaggtagagcctggtacatttaatccatcacccctgggttcgccaagtgcaaggactggaaaaattgcgcacgcctctccactgctgcctgcattaataccaagaaggggagtgagctgaaaagagaaagtgccaatttcagcacacatgtgaaaaagaataaaagggaaaggaagcatatcccagaccaggggtgggagggggtgtggtggcgagggggagattttttaagacggcttttcagaattcttgtgcatttactatgagagtaagtactcacagagacaggagttcggggtcatcatacatctagcaggagaagttagctggcaggggctatttttctgcaaattagttttctctcaagggtaacggtgtgggaggagcagaggaaaatgaattggggcctttgaataatcgtgtattgtttggctggttgtgggacctctgaactgatgctccaagaagtctttccaggccttgcttgtaaatggaccggggtgggaagcctctcacagctgttgatgagtgtcctgtagggcagcaatggggtcacaagtgtggccccacaaaacaatggtccacagaacaccagctccacttggcgagaaaggcacagggctggccaggtggccagacaggacagtgagaagaggcggggcccaaagatcgtgctggtcacgaaggctgtggcaagggccaggagacagacacaacagcgtggcaggaaaggacagatcagctttccttggggggatgtttctagcatgaaaatgaatgagctcatgcaaaagcatgcgtgtctcattgttttcaagtccagatcctgagtgcgaagctcaacatgtgttcatccttcagacatttttctgttctcacttcagcatttacaaacgctgtatcatcaaaaccagggcttctcagtttcccctggagtgccctcatgacagaggagcttaaaggccaagtccaaggactctggaggtagagcccgaaactccctccacaagggagagacttctttgaagtcttacatgtgtttattcttagtaaaagttacctaaactgatatgttgtgcaagtaatggaaatattttgacgttaaaaataacatttcaagttcctctatttccttaattctaggatgtagctcagtctatctcaggaaaaaaggacaccacccatctaatgcacactttac

SEQ ID NO: 28138 - DNA, 1230 bp, Bovine  19866880521646
gccttgaaactctgacatacgtggaggcatactgatgagatgggtaggccagccaggtcatctgtctctggcctctggctcaaggggatcccagatggtgctggccatgctgtagcaaactcatgcagaaaaacagagagcatctcaccaccacgtggatactaagttaaatccatcaaactcttagctctcgagatatctgcaggagaaaggccagatccaggagtgaggtgccttagaaactgtaagcttctttgtccttgcagaggccctcagacagcccaaatacttgatgcagttattactttgccaattcctacagccagaactgaacagaattctgtgatatcagcagttgtcagtcaacaaacctctctcttgtcggtgaggtgcatccaaaggccatgacaatacctggaatgactattaagtcattccaacagtcttcccaacagaaagaggaggcttcgtcacccacattgctggccgattggtaagaaccagggtatatggagaagcggtgccggccggaatgaggagtgtgacatacgagagacagctgatcctggcagggctgtgcattacctcgaggggacagccaagctctgactcttggaggaactgctctctgcgcttgcaagcagaggcaaggcacacaggaggggccctgggagtgtgctcaggaggacatgaaactcaagccctgaaagctaagctccaaatccaaatatgctgttacgcaaagcactcgcagattggctcgcatttgattatcgtatgaggttacttgttggcatgtgctgagtaattccctggcatgcccacggcttgtcagtggcattccttcctgagtcacaactggactgacagcctggctcaggaagcaggggccagcgctgtccaagaggctgtcttttcgatgaaacctacagcccatggtcctgagttgctgatgtcaccatgcctgcttttccatcctcaaggatgagctggtaggcatttccagtgagtgtttgacaggcttgaggaaacattttggggggctgcacgtaactgctgaagtgaggaatatttgtctgtcatcagttggatgagaaaagttaaaattcctgccagaactttggaggcctagggagatggcatctctcatgggagcaacattaggccaattacaatgctcagcattttcccaacgccctaggttcagagctctttgcgagcagtttgttt

SEQ ID NO: 28139 - DNA, 2410 bp, Bovine  19866880539277
gagagctatgtggactttgcccttgacaacatatactcagtgtaaacccaaccttttcaacctctctctcatacaaaaaaaaggaagagttaaaaaaaaataaaacaaaagagaaagaaaaagggaaaaaaattaaaaacacacgaactttcacaacatgacaatttagtctgcaaacgcaatataactatacacatataataccggtgtggctctgttctttaagttaaaaagggtacaaaggcaggctcaagtaaaaaccaaaccatccctcccaaccccacccccaccctcattcatacaagttctatcaaccaaacctctcccgaaccaacatcatcagtttctttttgcctttgtagatttgtttcaggttgtcgataaactgtgtaaactgaatgtgtccatcatgcgccattaagaaggtctctcgggccttgctgaggaactctatgaactcactatagtgccgaggactgatgtgtgtgagccgtgagtgtgttgtgttgatgtaggccccaatcgtggcatccaagagttgcctcaggggggctttgtccagcgacatgagcttaccagagttcctcctcccgtgaagccccaccacgccaggagtggtcagagtgcacctgcgcaaaatgtctgacagtaccgttgcacacttgacactcttgaccaccagaggtattatagctgcaagctcgtttttaccaagggagtggctgagcgcacaggcccacaaaacgtcgttaatggcagggtgcgtgtcctgattgtagctcaggttgagatgggtcatggccagggtggccagcttgtaggccctcatggggtacccgcggtgctccatgtaccgtgctattgtgaagagctgggtgtagctcatgccggttgtagcagcgtcaagaacgatttggtacgccgtctcaaaagctatgtgatccttttcacacagggtcagcgcggagagggcacagttctgagggtccttcatggcgcactgcagtgcgagtgtccgggcgctgctggccagcttttcctgctggtggcagtccaggtggaggcggacgatggtgctgttggacatcacagtggtggcaacaatacttgtggcttcggtgggagtaaagagtgtaaaccagctctgcatgatgctgtccagggcataaacacctgccaagaacacagagaagccgcattactgactggctgcccaggggtcttgccttacttccactctttaatcaatgcttacactgtttactagcacagaacatgagcccggccagaaaatcctgcaaggtaatgtgcctgggagcaaccttttacaataaggttatgatagactgttattcagtgaaatgcctaatgaacatgaacttcctgtaataaagagcaaatcctctcggtagctggtatttgcgctgtgctgctgcctgcctgccgtttcagacaacggcttcttgctaatgagttccagttcactggggcctcctgtcagttaccgactgcagaatgggagtcagaaaaagtacaaccctcaccagaatagggagtctttatgtgatgtgtgtggtgtatgtgcccaagtttaaagtacacacaatacaaaatgattaaacacacaaagaagcaaggaaatgtgacctgtaatcagagagaaaaaagtcaacagaagcagacatacagatgacttgaatgtttgaaatggatgacaaggtttgactgtcattctaagtacacagatcaatgtgcctcagctgcaggaaaatcctaaacatgagccattaaaaagcaggcactaaatcgaagagaaatgaggcctctgtcttggtgcagggtagggtagtggtgtggcagtttttgaactggtattatctttgtattgatgtactaacgcatcacgtggataatataacttttatattgagaccaatttcctgctttccaagataacataccattgtagattaacaaaagaaaaacaacaaggaaaatgcttttacggtatctgctgtgtcagtctttagatacacactgaggtggctggtattctcagcaagaggtgtgtattcttttctgatgcaaacggaaagaaatggtggctgttgaagcaccgtttattttaaacagccctactcggtttgtgtcggcattctcaccaggcgtgtctgggcttttggttctgcctcactgctgcagaggggcgctagctggctgaagggtttcacagacggcgcctgtatgtgcagcccaggtcttcttgtggctactaaaaattctcgtccatctgaaagctcacataaaccgcacccagtggtcacttctctgctgggtaccttgagaaatgccctcagataatgaaggaaaaactcagagcaactagataactgtatattattttcattaa

SEQ ID NO: 28140 - DNA, 1474 bp, Bovine  19866880571781
tgctgaagaattgatgcttttgaacagtggtgttggagaagactgctgagagtcccttggactgcaaggagatccaaccagtccattctaaaggagatcagtcctgggtgttctttggaaggaataatgctaaagctgaaactccagtcctttggccacctcacgcaaagagttgattcactggaaaagactctgatgctgggagggattgggggcaggaggagaaggggacgaccgaggatgagatggttggatggcatcactgactcgatggacgtaagtttgagtgaactccgggagttggtgatggacagggaggcctggcgtgctgcagttcatggggtccaaagagttggacacgactgagcgactgaactgaactgaacctgtgtgcctgaaatctcactgtcagcaggttagaaagtggactagagaggttaagtcctgggagggagtaccagttaaggctgctgcaatgacaaagcagagggtggtaactttagagtcatcccttgaacttccttaacctggacctactcattgcaattaacttattttatttctgtttctttgttttgccatccctttccctgggggtactgatagacaaggtctagtttacttgaaaaaaagtgacgatgtaagtgaaaaaaaaaaaaaatccccgccccccacatatatcctccacttaaacatgtatggtttaatttgtctcaacttaaatatgccacccaactctattaataataaattatagcaccaagacttcctaaaacctttctggaatactacacgtcattaatacacagggcttatctcatagctcggtaagggcttctctcgtagctcagttggtaaattatctgcgtgcaatgcaggagacccgggttcgattcctgagtcgggaagatcgcctggagaaggaaatggcaacccactccagtattcttgcctggagaatcccatggaccagaggagcctgacaggctatagtccacaggatcgcaagagtcagacacgacttagcaactaaaccaccaagttatgttagtgagttggaggagtggaggagggagcgacaataggcaaagttattttgaatctgtgcttggacacctacgctgataaaggcaccccgggtaccatcccgtaaccttctgcgtcctgagttgcagaacctcacagaacagtgagcctgcagctgctccctgcccccatcttttgtgctcacgccccaccctcgctttcattcagtcatttccaaacgctttttcaggcaggagtgcgggcccaccccaccggactccactgtcccagggaccgacatacctccctcatctccccgggcttgtcagctgagcccagatacatgaatggcaaaacaggcctaactggagcccagacagtgctcatcatcctgtcaccgggacaaaggaaggaaattccattatgtcaccttctacaagcaagagac

SEQ ID NO: 28141 - DNA, 923 bp, Bovine  19866880583934
acatttgggattttttttttttttttttttaatttttagaaattcaaactttgttttttcattctgatttgcaaatttaatcgactttcctcatctttctagaaatttaatactcaattttttcattttttccttctagttaaaaaaattcttttatgctctttactctgcctagattttattttatattttaagcttttaaaaaaatgatgacttttccaagtctgtgcttattatgaagacaaaacacgtattgttcaggaatgaaatttctcatgactgagattttaaaattacagcatttaattgtagtacaactaaatgtctaaccgtttactggcatattgatgttgctaaatagtatgttcatggctttacttaaattgcttttattttagagagaactaggtccgaatgtattaagtatattgtctagtgtttaacatggtgattttttcagattttggatattataaacaactttgtttagaaatagctggtgagatctttatctttgatttttttttttttaaagtgagttttatataggaatctgcacctcacaatcacatggttttgtgtgtccagggagcaattaggagggcaatctgttaaatctttgcctcaaggcaaaaccattaggtgtgctgtgtatgaacctcaggggtgtaaataaccaaaccattcatgtaatagtttcctttcatttcaaggcatccatagaacctttaatctatggaagaatcagagtaagctgatctgtgggatccagttcttaaagagatgggaattccagaccaacttacctgcctcctgagaaacctgtatgcacgtcaagaagcaacagtaagaaccggacatggaacaacaaactggttcaaaataggaaaaggagtatgtcaaggctgtatattggcaccctg

SEQ ID NO: 28142 - DNA, 1669 bp, Bovine  19866880585517
acgaagcccttggggctctgctcacaataaaaacattgtacaggccttcaacacatgactcagggtgtattgtgtgtctgattgaaaaaaagattggctttacctacaagtgctaacgtgttggccaagttgaaacgagtgcagtattacataagaaatgaaaatacctggggagcaagcagtttaccaccttgtatgggacatgcaggatccttagaggaaaagtgccaggtgacttttttgccaactgcaagaatagctgtggttggactgggtgttttgttttgtttttatcccagtgtttggcacagagtcctgaacaccaagtggggcccctgaaccctgcctgacaccaaattgcattctctaatgtcattcctgttttgctttgtttgataaagactggataataacaaaggggaaagggagcgagtaattaaagtgtgttttgtgaaaactttatgagctaagtccgcaagaaatagagtgtaacgtttaaaagtagggactctggggccagacacagtttcaagtcttggctccattctgtcttagctgcaggacatttgacaagttactcaaactctctgagcctcaatttttttcagttgtaaaatggataaaataataggaccagccttggagagctcttgtaagaactgtatgagggtaatacaggcaaatagcttagctgagaacttggcccacggtgcccagcaaaggttaactagtattatcatctgtactggggagaggtaacttccccagttcccgtaagggatgttaaggctgaaacaaaaggttggcaagataagagttctttaaaaaggacttgttattttctgttttacactacatggtgtggtatacagcaaaggcaatattggacacagagttagaagacgtggattctggtctccggatcttcatctctttatcatttaaggaatgggtttaaataagtccttcttaactctgacatcttgggacttcagtgcccattcattccctgcccgtaagtggagaccctcactctttaatttccattccctgtggcctgccaaggtcttgattgacttaaaaaaagaaaaccagaaaaagtgctcatacatatctgggaagatgtgccagatactctaagtgataaaaggcaaattgaagacctatacgtaattctattgcgtaaatattctagaataatattaaaatatagacttgtacactggattgtacgaggattaagagaaattttactttagattttaaacatgtctgtattacttgaaccttacactgtgagcatgttttatttgataacaaagtaaaaataataacaaaaatgtaaacaaaattaaaacatgtttattgtagacagtttggagggaaaaaaaaaatctcttataatccacccaacctcaaaagattgttattaacattttaatttatattctctcagtcttttttctatatgtatacttcacctagaaatatatatatatgtatatatttacaaaatgtaatcatattgtgcatgatgtcttacaattagcttcacttaaccatgtgttgtttatagatttccacgtcattaaggtttcctctacaatctatagcatgattttaatgactgcttatttttccatattgtacgggccagtctcctatgttg

SEQ ID NO: 28143 - DNA, 1619 bp, Bovine  19866880721662
tgcaatatcaatatttctgctgctaccccagaagtttacatgatctgaaacccttagctttattttgagtttaccctctttcctggggaagattctgggtttggagtggcatgccagacatgctgttacactgcaagctcccagaagctgaccagaggatctggtggaaatcccccagggctgggaaggggtgcctgctcgcagtgtaaagatgcattttctacaatttaaataggacccgtttctcagccattcttcacattcaggaatcctacatgtttattctttctgattaacctgtgactaaaagaaaacgggtcaaaccccatcctacccagtatcaggggatgttctcattctttgggagtccttcatattgcttactttgggtgtttgcctaaaggaagtagggctcggaaaacatctggctctacagatttggggaggcaattcagtgtaatttgttggtaataggatttgatctgtgctaaatctgaatgtctgtgttatttcaatggatttaatgaagttttgtttgttgttgagatatgtgcaatgtcgtccctcatcctgtcttctggggaccccaggtgggagtgatcaggcaggctgataataataatatgctttataaggaggcattactttgtcagggagttcagatatgatctcattaatatcttaccttggggaaagctgaagggagaggagatgagttattctaaaaggaaaaaacccacatgtgaagagttatgaaataaggaccaacctcaccaatgctacctgtggtggtaagtttccaaagatggctccctcagtgaatcatgccttgcattattcatgctttgtgtactcctgatttcttgcatctggcaggttctgtgacttgcatttgactgatgaaatatggcagaagagacactgtgtgacttctaaagctgatgcgtaagacattttgcatctttttcctggggctcttgaaatgctcactctttggacacttagaacccagctgccacatgatgagaggcccagacacagggagaggacacacacaggtgcttcagtgaacagccccagctgagctcctagctaggatcaactgccagccttgcgaatgggtcatcctggactttcagcccagtggaacctgtggacaactctgagtccagctaccctctgacagaagaatgagggcagaaggatgagatagtgtaagtgattactacccactgagccttgttaacctacagaactgttggacaaattaagagattattttaaaccactaagctttggggtatctgattacccactccagtgttcttgctcggagaatcctagggacacgggagcctggtgggctgctgtctatggggttgcacagtgtcggacacgactgaagcaacttagcagcagcagcaggaagctttggggtatctgattacatagccatagctgatcagagcaccatgctcaatgtttgagtagctgctgctcagtggaaactaaacctagtcctcttggagcgggctgttcaagactgaggatccctgaacaagcttttgctggcgctttacggagacatcctccacaccattcctctcagcaatggattt

SEQ ID NO: 28144 - DNA, 1142 bp, Bovine  19866880769804
tgaggaaaactgttcgcttcctggagcataggatttctgccaagtcccaggcagagctgggctcagggtcccgtggactgaatgcccctcagaattgggtggagaggatgtgagagctagagtgggagcgcttgggggtgtggggaagcaaattcccatggtttagtcactaagttgtgtctgactctttgcgaccccatggactgtagcccgccaggctcctctgtccatgggattttccagacgagaatactggagtgggttgccatttccttctccattccaggcaaattcatcctgcagctgcaaccttgaccaaggcagaggttggggactgctcagatctcttccctctcctcgcggaaaatgcagtttgtttcctgtgatcagtctgctgtctttgtgagcccaggacccttccttgtcccctgttcctcccctctgggtggcagtcagtggttctcctgactgcatattttaaattgtctctgtctggtaaagatttgatctctttcaagtctgagctccaacggaagcttgctccatccttttgcttgcttctttctaagacgaggtctggatgtgggggaaattgtggtcattccgtcatcccaatgttttgaggataatgcttagggcattttgcaggcaaaatattggctcccagaggcaaagaaaccatggcttgagtttagaacatcagaagtcggtgttgaaaactcagtgaggtctagtacagattttagaatttaaagcaataagaattagaggcacaaaaggcaaagcaaaacaaaaccctttatatgtgaaaagcagaagaattagactgcctttctcctcctttctccccatgaaaggaagtttgaaagaagttgatgctattgcagaacttgagagaatctttcagtgttctaaagttgtgggcccagtccacatttcctcagaaggtaccaagacctcagtgattactgccagggaacactgggtcctgtgttgaaaggagggggagcacgctgtgatcagagaacccctttgaaccgaaaagataccacatttaccagctggtgtgatcttgggtgaatttcttcacttcactgagccatcagtcaaattatgcacaataatatcaaataggtgtgtgg

SEQ ID NO: 28145 - DNA, 795 bp, Bovine  19866880813305
aggagccgggtctctctagttaagaggaaaacttcactgaatggactctgtaacatctgggcttagcttctcagagttctttatgcttattcagcttctttgtggcttttcgagagtgttgaggataccatacatttcagacctatagataaatgtggtcttgctgaagcatactaggcactactactactctgtcaaatcagaaaacaaagttagggacagtggctgcaggctaatacaccaaattgctcaaacagtccataaaagcataaacaacctttttcttctggctcactacctaagggctagtagaggttaagaagtaacagctaaaacaagatagggtttatggttagagacactggacagaggagaaactaaggtatcaccactcaaaggtcctcagtttagtaacagtcgcctaaagtactgtccaatgtggtgattcagtaagaacaactttattccacatgctgccaactcaatgttatccatacatgcgctccagctctccagcaaggcagcaaagagaagtgactccaacgttcagtgatgagcctatcagacaaacaagtagcaaaaaccactaaagtgttagaacataatcacactatttactgtgtgacaagtcaccactaaattaaaataaaaggataagaggcagagtgaaatgaaggtgatcatacaaaagctattttgagatgcctcaaaaacaaaagaaaagctgtcaaatctgaaacaaagtttaaactattccactcttactgcagcaactatataaagcactgctgcatt

SEQ ID NO: 28146 - DNA, 860 bp, Bovine  19866880845659
gatactgactggattgccatgcctttttccggggattttcccaacccaggggatgaccctgcatttcttaagtgtcctgcactggcaggcgggttctttaccactagcgccacctgggaagccccttctctattcatgggtacatgtaaaacaaaaaaagcttccaaagcagagtgattgttcttccctcaggccatggtcagcctccccactggatgtccagagtcagatcgccgggtaaggggactctgctctgcacttgctattacactttatgttcttctcttaaggatgtgccatttacatgtttttgttgttaagcaagagatgagctattatatataaactatctagaattttgcttgtgcaaacaataaagattttataagttttaagaattaagaggcccaaagaatagatttaaccaaagaaccaatgtcaaagaaagtgattcagggaatctaaataactgagaaatcatttcccttcttatgagcttctgatattccattatgatctctctccttgtgtattcccaccactggcacaaacaaggccagttctagctctcttaaattccttctcaaaaacaatggaaaagggaggaaaatgtggatatatttgtgtttgtttgtattagcacaaacactggagagatacacaagaaactaacaatatgcttatttataaggagtgggggtggggtgaggaggccctgaagaagatggggcagacatcgtaacatatacacattatggtggtttcatattgaatcatgaatgtatcacttgtttttaaaatttaaatttaaaagtctttctcaagatttatttcatttcataaaacccttatgtaacatg

SEQ ID NO: 28147 - DNA, 726 bp, Bovine  19866881036992
catcaggctcagtgagcacaagggcagcacggacaccctcgggacttttgcctcatgcagctaacgtcagagatgttttattaaacgagagttgaggtcacattgcttcttggataaaaagaactttgcttcaaagaaatttacttgctaaacaacactaggaaaattgccagactttcactagggacagccagccacttttgagctgcccagtgtttccagaactgccaagtaattcactcacattagatcagggctccagagagctgagcgcggaaactcgtggacccccagttttcccctctgtaagaggacagaggctggactacatgaacctctaagctatttccagctctacgctccattcatagttgggaacatcctgtctcttggcacctactaaggaaaaggtagccaagaaggaaaagcaggaggcgcacctgtgggggcagaccgcctgggttcaagtcccagctccacgactcaccatctgtgtaaccctgagcaagtcagttcatctctctctccttcagcttccctatctgaaaagtgggggaaacgttagtacctgcttcatggggttgtcgcgaggctcaaatataataacacctgcaaagcattttgaaacacacctagcacagagcaggcgcactgtgagcatttgctattttcattgctctctttgcttgcacagaataccatctgagtcttttcctgtcagtagtg

SEQ ID NO: 28148 - DNA, 1487 bp, Bovine  19866881037591
ctctctatgtggccagtgtgggatttctcatagcatggcagcctcatgatagccagattttttttttttaatttttattattattattattttttactttacaatattgtatttgtttctcagggctttaggatagacccttttaagagacagtaagtagatactgccagacacttcaggactgggcccagaaactgccccaaacatctaatgtcatattctgttgatcaaacatctacaaaaatgagaaaacacagaccccatatctcaatgagagagtagcaaagcatctgtggccactgtaatctatcacaattaccaggaaataactctgctagattacaaaatggaaaagtattaccagtgggtatgagaatgttgttagttacaattatcaaatccaaacaaaccactcaacataagaaaagagctgcgaattaagcaaaaacaaaaaagtcactatgcataaaaggtatcccaacacacaatattaagtgctgatttgtatgttaatttctatcccttcaagaaaaatcctaacaatatcatgttacacgtgttaagtttctaaatagagtctacatttattaatgtaaatgtatttattaatgtaaaactacatttagttttacaatgtctgtctttagggtacaaagatcacttcatctagttcagctaacatatttctaaaagtgaacggcatctttactgatccacttgctgctgccatgtattgaaaacacttcacacgaacccctgtgagaactattttacatacattatcacatttcaccctcacagaaagactcactttgcaaataactaaatggaggttcagagacaagtagaaatggagtgctactattaaagacaggagccagggtttataactagggcccacatgcccctaaaactaacattcttaaatactatggtgtttagccttctgcccagacacatggtcaaaaagcacctctgtaagcgaggcttgctatgtgcaattagcatatatgaattctaagattaatgattttagtcttttgacagaatcattgatccactcctaatattttagcagtataatacaaatggtatactattgttgaaagttatgaggtagtcttaaatgtacaactaataaaccctgtactttatttaactatattcttacaaacttacaacatgttgcatatacagaatcatacccaatgaaaacttacacaggtccatctaaaaaggtctaattaaacaaatgaaaactctgcatttttcaggactgacaggcatagcaaataagtaatttcactgcagattaaaacagcagataaacaatcaagagttcaacttacaattcaagattgattattcaagtcatatctctgaaaatatgatgatgtactattcgaggcctcttagagtggactcacatcagcatttctaggagaatgcacttggacttgagtgtgctccttgcctgctggtgtatt

SEQ ID NO: 28149 - DNA, 1727 bp, Bovine  19866881066216
aggaagggcgttcctaactgtgtggtctcaggccctctagcatcagattctcagaccctctagcatcacctgggggaccagttaaaactgaagaatctgtgccccaccttgttgttatcgttcagccgctcagttgtgttcaactctttgcgaccccatggaccttacagttacaaaatcagaaccccaaggggtaaacccacaagcctaaactcattcagaagacattcttcaagtgactcttaggcctgctcgatacttaaatgtcagtggtggcattctttagggctgagggcccgataaaggggcatccagtggtagagacacaaaaggagtctaacgtggtaactgatttggatgcggagggtggagaagctttaatccccagaatggggaatcagggagctctgacattttgagagaactttggtcctgataaacaactgctgtgattcctcacccacagaagtgaacatgagaaagtctggtagaagaagataaggaacagctatccctcctctgggtgggcaacagacactcaaggagcctgtatgcaggatgtagatgtgttggggacaggctctgtaaaaccagattctactctaggtcaagcaggtgtgcggcttggcagcattgaccggtgggttccagtaggtactgctgcaccttctggcactttctgtttgtctttgaactatgtaaactcaatattcttcctatggcttagaaagttgacattgacaaggaaggagatgctttgagtggtgcatctgcagtctgcctgcaccaaagaaaggtcaaaacgctcctctctgttggctgggcttggaatcagtaagcagcgtgtgtagggttggaaggcatcaagcattaagactaggaagcctgaaagagacgaggtgtgggcgttatcctctcccgctgcagaaatcaccatcacctgctggggtgattgtttttgcatgtttgtgtcgcactcccctagggtggggcttcctttgtggctcagctggtaaagaatctgcccacaatgcaggacacctgggctcaacccctggattggaaagaccccctggagaagggaaaggctacccactccagtattcttgtctggagaagtccatggactattcagtccacggggttgcaaacagtcagacacgactgagcaactttctttcactcactcactcactcactcactcccctagggtgaggtgtttgagaatccacgctgtcatctttcctcggctgggaacccaaagccaggcgggggcagacccagtaatagactctacccttctcatcctcagcctactgctccaacctccaaaacttcccaattgctgtgctacctaccacgagtgacctttttctggaaaaaaaaaaaaatagaggccagagacataggagggttttccagaatatatttttgccctgtatatagtattcaacacattcagaatctggtttgagctgagaaaattcttgtcctcgaactgagtcctatattagttactgcagccttcgctgtgaaaacaaacaggcccccaaagtgcagtggcttgacacagaggaagtttctctctcttttgtgcaacagttgagtgcaagtgacctggggcggcaggggatggggttggggaagggctctatttcatgcagtcatttaaggatttaggctggcagagccccggctgccttcaggcttggctcccaaggtccct

SEQ ID NO: 28150 - DNA, 2012 bp, Bovine  19866881117308
gcatggcaagccactcggtattcttgcctagaaaatcccatggacagaggagcctggtgggctacagtccatggggcagcaaagggtcagatacgacagaagcgacgacttagtacacagccctcacccgtgtttgctacaagatcgtgagtgctttgattttaactttatgatccacatagcttccacacacaggatgttttaaatatcaaacacgtgctagattgtcctccccctttatgctttgggttatgtatatataaaataaattattaaatcttcagttgggttataaaaaaaagaatgacactcgagtcatgatagaaaaacaagattattgtttatgaatataccactaaaatatgcattttgtaaggctcattgatttatttccaattggagaaaccacacagacatacaaaatggttcatttgatattcattatacctccttagctgcttttattagaagtgcccatggtgccaatggcaaggttgatgttttcagggcttgaatcaatgcctgaaactcatcaattcttataggcagttttggtttaaggtattttgatgattttatgaaatgttttaccctattaaagagctataacttaaacggtgatacagggcaggcacacagtagatgataaatggctttgtgtaagaggtttcaaatttgtcaaatctgcattaaataactatatttgaaatcggttagaaggttgggtgaattctccaggtgaaaatgacatttgttttatggatccctccaaaacaattcccccagagttttcacttgaataaatcacatttcgagttcagtgctccagaaacagcttgcattgtaaagttgcattagctgcttctctgtttcctctttgtaggaaaaagcgctcgatttcttcatttgtaaaggaagtgagactagataacctggagtgagaatctttatatcctctcattcattcattccatgggcttccctggtggtgccagtggtaaagagcctgcctgccaacgtgggtttgatccctgggttggaagattcccctggaggagggcatggcaagccactcaggtattcttgctggagaatctcatggatagaggaacctggtgggctatggtccacggggtcgcagagtcagacacgactcaagtgactgagcacacacgcaaagaaacaacaacatacaaaactgagatcttgttctcatggagatgacatcctagaaggagaaagacaatagataaataagataatttcatggatttataagttccttgggagaaggcaatggcaccccactccaatactcttgcctggaaaatcccatggatggaggagcctggtaggctgcagtccatggggtcgctaagttggacatgactgagtgacttcactttcacctttcgctttcatgcactggagaaggaaatggcaacccactccagtgttcttgcctggagaatcccagggacgggggagcctggtgggctgccgtctatggggtcgcacagagtcggacacgactgaagcgacttagcaactgtgtacgcccccccccccaaataatagaaggacttttaatttgactccttaaatactaccaagaacaatgaaggtgaaaaactaattggccaatgtttgttggccagagaagctttagtttttagcaagtgaatggaagttgaatatgtagagacagtctctgtataccactctttcatgaaatctgactgtactgaaacttgggtatgtcaatagttatagcgaggcaagtggaagagaagaaaaaattagagctacagtaaagtttataataatgtatacagtgagattacaggtaaagtagaatataagatcttataagcaggtataagatttaacagagaattgccgcttactctgagaaagaggtaagaagataaagtatatatcattatatgtcagtttagttaattgtctctgcaaataagtattgatgcaggataagtacggtttccttgcat

SEQ ID NO: 28151 - DNA, 1414 bp, Bovine  19866881174988
ccagcctcaaacagtccctcagtcacttgttgccaggtttcctaaacatgtgcagagaaggtgggggaggccgtcaggaggggcctgattgtatcggttgagatggtatatacaaagagactctgtgtcctctttctccccaatctttgttgcagttcctgctttccttcttcaagtctggataaagaaactgatataatgttgaagactatgtgatttagatgattcagtcactaagtcgtatctgactcttgcaaccccatggactgtagcccgccaggctcctctgtccatgggattctccaggcaagaatactggagtgggttgccttttccttctccaggaagactatgactcatgaataattagttgattggaataagtgtacttaagtatttcaaaggtttggcccaagaggtttcactacaatcaaacaaatatgtcaggaagaaagattcgacctcaccaagggcatgcccagttgtctgtttggaccttggagatgggtttgggcagggtccatttactccctaactagctggacggtctgccctcttcctacattccagtggctcctgaaccctggggtctcgtgttccaggcacatttgtaagcactttaccgcctgtgagataagaacttttattatccccatttcatagatgaagcaactgaggtatcaaaagagcacacagggggaattccctggtggtccagtggttaagactccgtgcttccaacgcaaggagtgcaggcaggatccctggtcagggaactaagatcccccatgctatgtggtacagccaaagggtcggggggaagagcacacaggtagtaaatggtaaagccaagactcggacccaagtgttctggttccagaggccacagtgctctgtgctttagaacatcatactttgaacacacagtttatcaaatcccaggttaggtacaaggcttttccccacaggagattgaagatgtcttctcatcttatcagcccctgaagccttcctctgtcccctcgtatgccttgtcacatgcaacctgagtaaagtacacagtgaatcttgttggcttaccatgggtgtccttcatagtgtcctacacattcaatagctggggtatccttcaggggcccaccattcttgcagttgtttcctgcgagccccacataagtaggacacggctactctcttagtctcctgaactgcatatgctccagaaatgttatatgtcacatttttgaagagttaaggcaaaactttatttaaaggaagttggggaaggagaaaggacattagcagctttgagcacatgtgcaatcagccagacagaaattcaggtggcagctctacttagtgacactgggaaagtgaccatcctttatttgacagagatgttgcaagatttcaa

SEQ ID NO: 28152 - DNA, 1550 bp, Bovine  19866881202506
ttatttagatagatacatgtaatttctgaaataaataatcctacaatatttataattctacaataaccagatacttgagatgtcttcttgagatgatggttgatgcctgttcagtgttatgtatccaataaaggttacagctggaaattttcaatgttatcactcatttatataatcatcccttgtttccccatcactacatacagcaaaggaaatgtcttgctaaaggctggcaaaggttataaggaggaaggaacagaaataagcactaatatcaaatcattacatttctttttttttaactcagaacaatctggaactgaacctctattcaattacaaattatgtaatgattttgccattgctaattatatttgtatgatggattctgtatcagtcttcattataatgtaactattgtttgaacagaatatagcaagttaactggacagtttatgccttaagatcctagcattcttttaccaatgctcatttgcattctcatcagtatgcatgaggttttcactgaactttaatactcttattggaatataacacactataatgagtgtagaagtgaacatgcaagttgaatatcccattaaccactaaaaaagactagaagatgcaggtaggaaaacacttgatgaggcataccttcttcaaacttcagtaagaactgaaaatggctaatacacttttagaagtagcatcaacaggggtttgaggtaaatgagacctttatcactagattcagtaggtgaccattcagaacgaaattataggtttacacaccataaagatcatatataaaaaagaaatctgtataaactgtattaaaaaaaagaaaaaaaaagatatttttaactatgaaaactcttcaaataatatattataaaatgagttattttctaattattgactctgaaaagtttcttaaggatgttattagatttagttggcataattaagttacaaatgttgtgatgttcatggctattattgttcgttttccttaatcaactttattgaggtataatttacatacaatacagtaaaaccattgtaagtgtgtaattccatgagttctgacaaatgcatacaactgtgtgacgagcaccacaatcagtgtatagagtatttccatcaccctaaaagttcccaagtgtctgactacatgcaaacactcaccttaactcacccgtagcccccaacaagtggtgctttctgtcactgttgattacttttgcttatctacaatttcatatacgtggaatattatattatatactcttttgtgctcaacatgctgttcctttgttactgtatacagaaaacagactctgaaggtagcctgacaacccccaccacttggtgattgtgtctctgaatgatctcttccccttgagtgagctcagaacctgtgacttatttctaactatgaaaatatggcgaaggttatgggatgcacatgcttgtatgatgatgctacagaaaataggcaatcttccttgtgaaatctctctttccctcgcggcgcaaggaaaaaa

SEQ ID NO: 28153 - DNA, 1461 bp, Bovine  19866881276515
cccctggttatcatgagatgacatagtaccaaactaagtaaatgaaccaggaaactaagagcaaattgaggaatttagtggaagcctccctgatagctcagttggtaagaatccgcctgcaatgcaggagactccaggttgaatcctgggttgggaagacccactggagaatggataggctacccactccagcattcttaggcttcccttgtggctcagctggtaaagaatctgcctgcactgtgggagacctgggttcaatcccagggttgggaagatccccttggagaagggaatgactacccacttcagtattctggcctggagaattccatggactgtatagtccatggggtcacaaagcatcggacaaaactgcacaactttcactttcacttcacttttcaccatcctgagtgagccccttatacctagtgaaactgatcacaaaattagacaatgtttcaaagctcaagatatcttaaaagtcctaggccccagatttctcctcaacctgtatacaatgatacctgaaattcccatcagcatcgtcacttccacagagcccctggagacaggagcatttagaccgagtatatgcatcatggtacctcattagctaacgccttactttatttacaccagtggctcccaacctttccccccaggaaccctaaattacacaccagggagattccatgactctaaggttccaaagcggatcgtatgttttttttctcaagtgacgagtcttgcatggcgggataatgagcagaactcccaaagtcttaaaccttggactgcacctcctctgcccagttctcctagtcctttcctccatcctctcacccactcagacagaaacaaagattgacatgaaccacggtcactgctttggacctcggcatcatgttgccggcatcatgaaaatcaacttgccctccggttgtttcatgtccatcccatccccagtccacgccccttattctactttgctttttggctatgagactaataactccctcaaatggttgtttatggtctccagtttaaatgcttagaaatgccgctttccatgctgacctgggttgcaaacagtaaggtggttgacattgcagagtgattgttgaacgtgatttacccatgtggctccacagcccttttgctgagaggttgacctgtgggaataatatataggacttgtacatggaatgaaatcaggagctggaaggggttccaggccctagtggggatgccatatagcgacattgcctatatcccagggctgcagggcttcctccctgtgctgtctctcagcagctctgaaatgtggcacgcaggtctggacagaacatcgtctcaggagcctaggatccacaaggtcttgtttccacacagagggaacaattcagttttaagttaaacttttaactgaaggatccactaatctgtgcatcttga

SEQ ID NO: 28154 - DNA, 1786 bp, Bovine  19866881289365
gatttttttccagtgtcccactttctttctaagctttgctaggggcagcttctctgcctgcaggtgcataaaggaaacccatcccagagacctcccttggcctgtaacacccactcaaaatccaacttttaaaaagtgttccatgatttcagggatgtgctgttttattttttccttctggatagtagtaatgtatgtctgatccatagtatcttcttgcttcttggagctgttactatactgagttaaatataaatatgactttcttctttgctgagatttaaaaaaaatttcagtcacagtatttggtgacattaatagtttggcctgaaagaggtactgttttctttttcatcagttcattgattttagtgggagacttgggagtgatggatataggcgatacttcaaagagaacattagtacaattgaagctgtgtgaggctgctgaggtgcacacagctcttactggtgggcagtttcgggtgctggtgggttatgttagcaaccctgttgatggagagatgcagtggtttgctgaagtactggggacattctcttcttattactaaattatagccttaatacctgtgtaactcttagggcagatcttaaatttttctttcctttggtttttaggaagcacctctgtttgcaggcgaggaaagactagatatgtctttccaggcaacatccggggtctttcccttctcctattccctcctgtgtgtaaccatgaggctatataaaggaacatttctggaggctatttaatccacttgcctgagatgccaagacctttattttttcagttgagagtaggcagttgtaagggtatgcaacctgactggctaatagaagattagtgataaagtcaggacactacccttccttataagacctggattattaggtttgccttcttctgatctcattcctgctgaccccataccctctccttgagttagtgaattgcatgtgggttcaactctcattgtatagctggatgcgtctgtagcaatcgtagcttactgtgtagactggtcacaagttaaaagtttaacaaatcttaatttatcatagttttagcacttaaagttacttaatgtatgtgttttgatgatctgatttatgaatatatcatattaaaaagggcttccctggtggctcagacagtaaagaatctgcctgtagtgcgggagacctgggttcgatccctggtttgggaagagcccctgaagaagggaatggctgcctcatccagtattcttgcctggagaattccatggacagagaagcctggcaggctacagtccacagggtcacaaagggtagaacacggctgagcaactaacactaactaaaatgctatattattgctgaaatattgagtagccctgctttttatgaccaagttataggatgagtaattactcttcacagtgaatagttcaaaatgaaataactgtgtgcctaaagtgtgatgtgacaccagttgtatttaagccccaaaggtatgtaattatcttagtctctcgcacatacccacaagtatatttatgcgtatggcaagagttttatgttcaagagaaaacactttctgataagtgaaggaacagttcattatttttgaggggctcagagattgttttacattagaggcaccatttcagtttccctgtatttctttaggatattatttaaagtcatacatcactggattctagagtaaactggtatcaaactgtaaatttcagatattaaggatagtttagggacttttctc

SEQ ID NO: 28155 - DNA, 1213 bp, Bovine  19866881383215
gtcgctaagagtcggacatgactgagcgacttcactttcccttttcgctctcacgcattggagaaggaaatagcaacccactccagtgttcttgcctggagaatcccagggacaggggagcctggtgggctgccgtctatggggtcgcacagagttggaaatgactgaagcgacttagcagcagcagcagcaacagcctacaataaatagctggttccagtaaatcaactatacaccaataaaaatttttaaaaatcagtaggttctgcaagaattgactatgtgcaaatgaaattatcttgtaaaacgcaaattaattattattattatttgtgtattatacaaattattaatgttttatgttaaacatgttaatatgtttaaaaaacatattaatgttatgttgacagtttatataagagcaaaataaaaactgcattatcagaattatacatcagggtcctttctgtataaacttataatctaaattaaaaatctttgtagaaattttgaactaaaatgtaatcaaataggttattgatttggattttctttgggcatactggtaacttgttataaattgacttttgctaaatccaataactgcagaatttttgtactaaaatagaatgtgtgattttatgtgaaatttcagaagcagcagtagtagttacaagtgtttcagggtcagcttgcactgtcttataaaagtgaattattaacttttcaagaatttcctatgctgcttattcaatacagacattattaaaaattaaatcatgtaaccatatacttatattgttaacatattaaaaacaaagataataaatacttaaaattcattcctttataattagctgactgttttttactattatctgttctcttgaggtcatttatgcctattgtgtctttatggtagaaatactgtataagggtgagctactgtacatctctataaactccgtgttcagcaacattgtgttagtagcttgaacttggccatggtagggaatttatagcacagaattagcaaatgctacaaatcagagcttgatgtattggtttgttgattgttggcacttaaggtaatagaaaaaatgttaatacatagtgtatctatagtcattatgttataaattgtataaaaattgaggaaatattctttcagtattaaaaaactatagtccagtcagcattcatgaaattatac

SEQ ID NO: 28156 - DNA, 980 bp, Bovine  19866881953696
taatatcttaatcttcactgaatatatcattggacttactagatgcaaatatttttccaatatgcaaatgaatattgtcaacaagtattactctagtatgataatatgctttggctttttataattattgcattgaaattactaggcaatgtaaatttcttggcaaaaatacacatcaagtgataaaaatttgggaaccattcaatagaaaatcttgttagtgatggtatttcaacaaacacatatgaaatgaaatgtttttatgataaactgtcatgtaatttggtgaccacagataacacaattagtctgactttgtgggggagacgattactgaacccctaatgcttattagtcctcactaaattatacctttgccctgtcagaagaagagaaactgtcacaacaaataattatcgaaaagccagaaatagtttgaaagaggacagggaaaaaaactttactttcctctttaacatttcaccaactatgcaattcagaaaacatttcaaccttattactacatgtcaagaatttcatacattaaagataaaaagcaattttaacccaataaaagtatttaagtacaaataaaaggaaaacatttttaataaaagtcaattaaattaaaagcaagtacctaaacttgtggcatgtaagtaaatagcatttcagcatcttccatcagaaatggacctttcttttagtactactgtattttggcttttagtataatcaagtttctaagctaatgataatgactggatacacaattttgtagaaaatgcactgatttgaaataatattttctaatgtgttggttatttattatcattgtagccaggctttaaggttatttaagatcaaaaatagaaaaattggcctatcacaaacaaaaccattcatttctaaatttgaatatataaactcatagttaatataaactagcaacaagctttctaaccattcaattgggtttt

SEQ ID NO: 28157 - DNA, 1169 bp, Bovine  19866882010791
accacattcatttcctcagaagctctgcttgttcagtttactgacaccgggctctctaaggctattgtcatgatggtacttgaagcctattctggttggctagaacatcctttgaaattgtctcatacctacttttctcagaatgtgtacaatgaggaaaattcatttccctcctgttgagagaagttaatgatcattttctgttatattaaaatattacccattgttatgacttcagtttaatgttcctgcagaaatcaccacgtgctgcagagtttagctatgccatggtcaaagcacctgtgtgttatttcagagtttctctttaaaaaaaaaatgagttgttgcagatgagttatggggggaaaaaggaaaatcacaccatttcaggagaattattcagtaattatatttttaaactcacttttagcatgaatacccaaatttttaacaatgttgtctccagaatataattataagtgccacattgagtctctgaaccagaaataagagccttcctttaagacataataaatgctttaagtgtcaggacaatgttcctcttcagggagagatgaaaagtagaattacaggctatttctgcattgtatttcctcatgtagtttagttaccattgttattttttcaatttcctgccctccttgggggttcatcaactgtgtccacaaggacagggacaggctgggaaatggacaaatggaaaaaccagagtgacctcagaggattcccaaactccatgaattaggggtgtctctttcatgttttggcaaatgtctgaccactaggaccagaattttagcaatgtgaaggagactgtagtgggagcagcgaatggaaggggcaaaaagctgggatcttaaagtggggtgagatacttttgaggagaagggggaacagtctggaattcatttccagcaggccaatctagtattaattcctttccttctttgttatttgcattagttcaatcgggctgccataacaaaatacatgtcacacacggggtggcttaagcaaccgaactttgttttctcacagttttggaggctgggtgtccatgatcaaggcatcagcacagttcgtttctgctgaggtctctctccttgcctagcagacagccaacctacttgttatctatttacaggttt

SEQ ID NO: 28158 - DNA, 1578 bp, Bovine  19866880141311
agtcgtgtccgactctttgtgaccccatgaatcgcagcacgccaggcctccctgtccttcaccaactcccagaattcactcagactcacgtccatcaagtcagtgatgccatccagccatctcatcctctgtcgtccccttctcctcttgcccccaatccctcccagcatcagagtcttttccaatgagtcaactcttcgcatgacgtggccaaagtactggagtttcagctttagcatcattccttccaaagtaatcccagggctgaactccttcagaatggactggttggatctccttgcagtccaagggactctcaagagtcttctccaacaccacagttcaaaagcatcaattctttggcgctcagccttcttcacagtccaactctcacatccatacatgaccacaggaaaaaacatagccttgactagacgaacctttgttggcaaagtaatgtctctgcttttgaatgctatctaggttggtcataactttccttccaaggagtaagtgtcttttaatttcattactttggtcagtaaagagaaagagttaatgttagacataataatgtagatttctcagctccaaagagactgtgttgtcaggtgagtcttcctttcaaagttgatgtgcattctgtaggcttctactatacaggatctcatgaagctcttacgaagaacaaattccttacaaccccctagagggatacagtcactggagagccatggcaattacaggatgtggtgatgagagaaggaggcaaagaactgggtctgttaggccacttttcaaaagattcatgcagtatgtaagcttgttagatacccacaaggtgacccagcgttgctcaaggaggctgcagttaaacggggctggggggttatgtttatgcctcatggaagagaagtctttatccaattctgctctaagactccactttctattacatggaaattcagctctcttgctttttgtcatcattttcattcctacaatgaaatatattaagtaaggtaaaatgcagtacaaaattatttacattgtctggtgattctttgtcatcatagttagatagagataaagatatatagatacagatgtctatctatgaagtctctgtgaagtgtgtgtcatatgtatgtatgaaattctgagaagtagtttctatcacttctaaaagattgattgttcaggggcttatatgtcacttgatcatatatgtctttctaatgaagtctgttagtcaataagaatttactgaagttggaccatgtaaactgcagtggaaaatactctttggaagaataagaaagtgatttttgctttgaagaacttcctaatcagactgagcacccgaaaatagccaaccgtgtgtaatgtatgagcatctactgttataagttgaattatatcccttcaaaatagatacataggcatcctgaccctcagcacttcagaaagtgacccttatttggaaataggtgcattgcagatgtaattagttaacatgagggtataccggaatagggtaggcttctaattttatatgggcagtatccttctaagagg

SEQ ID NO: 28159 - DNA, 1758 bp, Bovine  19866880361601
aaacctgcagtccatggggtcgctagagtcggacacgactgagtgacttcactttcacttttcactttcatgcattggagaaggaaatggcaacccactccagtgttcttgcctggagaatcccagggacggggaagcctggtgggctgccgtctatggggtcgcaaagagtcggacacgactgaagcgacttagcagcagcagcagtatatactagaacggtagttttctgagtagtcccgagaccagcagctggtgcatcaccaaggaagatgttagaaatacaagttcttgtgccccttttatccctattaaatcagaagctctagagatgttttaataagccctctagttgtgtcaatgcaggctgaagttgaagaaccactggctagaaaaaccaaccttcttctctgccttctttcatttctttgtctttattcaatgtcattccagaaaggacttggggtggaaaatctgacttaatggtttgtgtaagaacaaaggttttattttacgaaaagtttagattcagtggtgtgatgtggctgctgccaaaaataaagagttggcattggaaatagtgaccagaacaagggaagcaagaggcagccccctccccatttggcatattctctatatttgccatattgcactagactgtacctggagtttgttgaggaactgattttcagagggatattgaaaaggggtttgacaaggatggcagagctccacaaaccttgtctcgaaggaagaagttgaggaaagccccctcctatgatggggggctgacagagagaagaaagagaacttgacatcttgttccagagggcagaaaacatacagtgttggaaagccccctccactggtatgaacagggcaagatgtttccaggctttttctgcaaggtgttggcaatccaggtaagtccctcaggctttttctcctccagctgtagtacttagatgataagggctagaatgtccacttcacaggtgtctgtgaagactgagaaatgtgacaatgtttcaatatttgaaaaactagcataattgtatgatgatgaaccaatggtactgttattaactaagacgagttgatggaaattttaagttcaagatgaagaaaaatttcaacctaccagttggccaaaagagggatgatcttcctcaacaagtagcaagttcactgtcatgagaggtcttcagatcaagacagagatgttagagtatgaattgttttggtttggagagatggcctctgagtgcctctctgacgcttgtatttcatgacacagagattagtgactcaaggtgaggtagatctaagagattggtgcttggagccagcagaatgaaggtttaatttggcattgcctcgtcactctgtgcatgccaatacgtgccacagcaaacgttttaaacactgaaatgcatttaaaccttaagtacattaaatatcaggcttcccaggtggcactagtggtaaagaacctgcctaccaatgcaggagacatgagctgcaggtttgatccctgagttgggaagatcccttggaggagggcatggcaagccactccagtattcttgcctggagaatcccgtggacaggttgcacagagtcggacgtgactgaagcaacttagcacgcatgcacattaaaaacatttaaaaagtccatccatgtctctacaaatgaaccaattttgttcctttttatggctgagtaatatttctttgtatgtatgtaccacatctt

SEQ ID NO: 28160 - DNA, 2636 bp, Bovine  19866880550623
gattagagcctgtgagaaagaaaaaaaaaaaaaaaaccaaacccaaccatcacaacactggcaaaaaaacacattttcacaggttagcaataaagcaaaacatttttcatttttgcctcaaatttttggcacagccaagggacaattttctcaaacagaatggaagagcgcagaggagaatggcagtatgtaagtggactgttcataaacactggaaaaggatgaacattctagatgctggtccgaggtgtgatttttttttgagaagtctctagcagggtgttttgcttgctttccgtgtctgtttctttctttcctttttacagaaatgcatattttcctatccattaagatttatagttttctgccaactacttcactggaataagttttccctttaacaatgcacatactagactgtaatgtacccataaaaatttcttctcagatagtgcttacaaaatgcatttctttaggactcaagacaaatagaagtacagtatgtgccatttagaaccaagtatggctctcacttattaggagaatgtgttggaaccacaattgttttatcagaagatcaaattcaagaaatgaaacatctccaggttgggacaaatacataaactaacagtttttgagaaaaattaggactgtcactgaatcctctggctcattggatcttctgtatggcttacccattagctggactgcaagaaatgcatctccattttcccatcactgccagacccatgaacttggtggcactgaccatagcactctaaaaaaatcaaggtttaaaaaagagatttaaaaacagagaaaattttttaatcatgctttcataacttttggtgaacagttggtttaaatttccaaataactcttttcaaaaggatagtatcaaaacacatgcaaaaaataaaagactaaataaagcacaataaattatttcactgcctaaggtattagatttcaaagagagaagagagtacacataaggatattagagtggacgctattggatctttgggaattgctgtcagatattgatgaaaacagaaagactgtaggagatcagataaaagagagaaatgattacatttggaagaacaatgtggactacgtggccaacagagatttcaaatgtaagctaatagcagcccacgaaagaacaaagttggagccagtcccacatctttaaccacatttacaatcattcagcatctgtaaaaatttttacatagcatttttgctcatttcgaaatttgcaaaatacatatttaataggtttagcatgtcagtcagtcatttcgtccacgggcagtgaaaaggatttgtgttttttaaaaaatgagctgggttttgatgcctctgccctttcagctctgccccagccagctgtaatcacagctgattcacagcccagagatgctgtaaacaatgtgttctgtacatttcagcatccacgctgctgagaaaagccatcatcttatactttcatcttctttctcccaaatttcacatcccagcaacctggaacagagaggccattttcaaattgcttattgtcctccttaccttaccaaatatcaccaaagagaaaaaataaaaaaataaaagatacatattttcacaaaacatattttcctatctgataggaatattaactgctacatttgaaatgatcagagatgactcaaactgaaacataatttgaaaaaataataattgaaaagccagctgggacagtaactgggaaattgagctaggtctgccagttctgcaagagcagggttgtcaaatacacctggactgaaagtcccttttgtgatgatttcattatattaagacaacctgaagtagtcacagcatgaatggctgtctgtttcatttcaattatatagatgttattttactacaagactcaagcttttcaaagtgtccctgaaacttttcaaaggatagaaatggattccatcctttcttcccatctctggtcatctttatttacacttagtcaacaattgaaaagaaaaaaaaacagtcgatatcaaagacatgctagaaaggcatcctgaattaattagtagcatagatgctattcttcctattgcttaggatctattacaacagatatttgcttccagatggggcatcaatacttcaattatggggtatgagaacctcaattaataagtgactggattagagacctttcctatctttgtgggcaacagaaaagaaatacaaacagaaatttgtaggtgaaaatctctcaacactacccaaattttgttatcacttataaaccctaaactaatttgatatcaaaacttcctttggtgttgcataaacagagatttggaaagctgctccactcagttcatttcatctgccatctgtaacaacttcatactgactccagatttatgtgattctatacccagaagttcataacagaatattatgacttgcagctgaattacaaaaagaattatgcagatacagtataacacagagcatttctttcatggagatcgtttaggaaggggacttattttcataatctgctttccaattttactggaagaagaagacatagctcagggtagtacaaaattattagagaacttaca

SEQ ID NO: 28161 - DNA, 2019 bp, Bovine  19866880585559
attcagagaagttagtcaacactgcggtaaccagtcaccctagtttgggtcattgaagggaacggatctgagttataattaaggttttgttccaggaaacactcagccaagaactgtgggttcgggcaatcattcttcttattttcatcagtctcaaagacaggttctctttctgtagtccttgacccacgagagaattatcgggcatgtattgatcgcctgtgaccaaggcttcacgcgctgcagctgaggggtgggaccagcagttccctgactgtgcccggacccatgcacattaatcattttaattaagtgcatccagtcatccttgtcaaatccatggccaatgaactgcaaactatcagaacaaggtgttggatggagtcgatcatactttgatgagtaaaccaacttgacttgttcatttatgaaagaagtttgaaatgcgctcaggcttagtcatgggctggtgagggtgttttcctcttaaaccactcttcatagaggacaacctgtttctaaaaatgcaggagacgtgtgggcaaagtgaccccagtccctgaataaattgctgcactgacttttctatgagtaaaatattataaattcgaataacctcttcggagcatttaaggtacaggaaatgagtcatcgaaagaacctcctgcagcctctggatgctggcaaacatttttttttaaaaaccctcattaattagtgggaaagtaaacttgaaaaacctgagttaatattattttgaaaagaaatatcgtttatgactttcacgttctttccagtataatgacttcaaagtatttcttaatccagtcctttggtgaatgtgttatttttttttaatacacgagaataaaattcagtcatgtgcatggaaagtaagctgctataacaaagcaaactgttataatgtaattacttcatgtttcattggtgtttgcttattagcaaaagaatgaataggaaattttctactaaggcaaccgaaagcacacattaacttttttaaaaatgtgtctttgttgtagtattcgctctgcttcgtgcatgttggactaattctaaattaaattaaaatttttaattaattattaattttcctcatgaggaggacagtttggtgttctgaagttctgggatttttatctcccagtagtccgtgatagatgttttttagtcgtattggggcagaaaatgtgaaagtgttagtcactcagtgtatccagctgtttgtgagcccatagactgtagcctaccatgcttctctgtccatgggattctccaggcaagaacactggagaggatagccattctcttttccaggggatcttcccaacccaggggttgactctgtgtctcttacattggcaggcagattcttcaccatctaagccactagggaaggccagaacccatgctgtcaatatcccctccattagtctgggttctccagagaaacagaaataggatatgtgtatatataaagaaagaggtgtattgtaaggaactggctcacactgttatggaggctgagaaggcccaagttctgtaagtggacaagcctgagatccaagagagtcaatggtctaagttccagcccaagtgcaagaaaagactgacatttcagctcaaagagagtcaagcagagagaatgaattttcacgtattctgccttttgttctattcaggtctctaacagattgaaagaggttcacccaccttagagaggacagacaacctgctttactcagtctacccatttaaatgtagtcgtagccagaaacaccctcagagacacatccagagtaacatttaagaaaacatttgggcacctactaacccagttgacacataaaattaaccatcacatcttgcttaccaccatacaccaacacacacacaaaatctggcagtggcttatgaaatattagaggagctaggttttaatgaagaaattagaacttgatacactaaggactgaaacaagcagtatgaaataggtca

SEQ ID NO: 28162 - DNA, 2688 bp, Bovine  19866880693225
aggtcttctaagaagaactgtgtatgaaaggataagagatgtgtagaagaggcagctgttgtgatgagggaaataaggtgacctgtagggttgtaggtaaatagtagggaatgatgttggagaggcaggcatgactgatggatataaattaatgagagaaaaataccacatagtacattatttagtgatggattaattgatgttaaaaaagttacaggcaagagacagctcagggatgagaaaggttatgtaagaggctggctgggatatgactgtgctccaagaactgtgactcttcacctctaaagatgccccctccctggagaaaggtcataaagaggctacatggtccagaatcagtgctggccatgaggaccatggcagccccagggatcaaaagctctcacccgacaccctcacaggcagtgggacagtgactttcctgtccttccgggaagcctttagtgaagacagtctggtgtgaagatagctcactcctttttctgcaaaggaaaagactggaagtagcttccgtatttgaaatgactttctcacacatgtgagttctattgttctccacacaatgggaaagaggaaaaacttgtccaaagaataactggcactagagttgttatccaatttcaacctattcttcgtgcctctgttctggctcacaaaaatttgtttgaacctcagagtcttttgaagctatcagaataatggaaataaaatttttgtgctgtccataaaaattttagctcaataaattccctagtgccaaaccattacaggatcctggagtgggcacctaagacttcagtgaataccaatataagggtcaaatattgtcaccagtcactctgaccagttcttgctgacttaatcccaaactgattaaagaacctcagaaagtgtcttacttcatcagattgttgtcacaaaaatcttaatggtcctttcaaatgaaaatgtacctcgcaggcctagtaactgacctatttgattccaacatagatcataataatttgacagtgtcacttattttagagtctgattgccttctttgcctccgggtgctggagaaaaagggattttgtgactgaaagggttaagtggattttattataatgtgctcctatttcattccctccctccagctccttcacaaaatgttaatctaattgtgatactatcactttgatgacaatatgacaagacagacaaatttgattttattctccacagagcaaagcatatgctgcttgggaggctttgacagagagaaggacataaaacaaatggagttcatgaatatacaatttttattgtacacagtagtgacatccaaacttcagagactaggtgggtgagactgaggccttcctattgagattaatgggtatgtaaaaaggtaccaatggagagtactacagtttatgttaaaaatggcgatgtggataagaataattttcttctcaagatgaatgatacacttaatggttgtgagacattcgcgcccagtagcagttcctccaaagtaattttttgttgttattgtaaattatataatcttaactgcaattatagtcctttttaggtaaaggtcaacttagtgctggggatggttataaagcaaaaaggaaattggtatatggattcccttgttgatagcttatgagtgatttcaagtgatatgatttttttagtaactctatttctcgtttaatgtaatatagcgagtagagacagcacacattaacaaaaccacaaattagatttctctaagtaaacatgtatcttctaaaggagttagggccgttggagaaaggacagtttgaaggttaaagacaccagccaaacaggggaggcttattttgaagaaaagcagaagaatgagaagtatggtgaaattctcattgttgggcttatatctctatttttaaaatttggtttcctgaaacatgaaatccaacatggttcctggtctttgccttaagaatcttactaggatgttaaatgagattcagtgattcattcaggatgaaaatgactgtctgaataccctcactgcaaagcagtagtttgaatcttaggatcctaagttcagagtgatcaatacagatcaacgtcaaatctccaagtttattctttatagagaacaaaagtgcccagatcataataggaaatgcaaaagcggtctgtcaaacttcaaagatctttttttaagactataatacatttcctaaaattaaaggcctaaaaaaaagtacttggtattaacagaaggaattgtgtctcaggaagtacaaacatttatggttcaactatatgatttcctctcactggagcttctatatgattttgatcaataggaaaactttcacagaaaataatgttacatggaaaaggttaaatgaaccttgacactgaaggtcttttaagatcctgcagtataacaatacatacttatatgcttagttgtgaaggactctctgtgaccccatgtactatagcccaccaggttccttggtccatgggatttcccaggcaagaacactggagtaggtagctatttccttctccaagggatcttctcagcccagggactgaacccacgtctcctacattggcaggcagattctttaccactgagccactaggaaagtcctgtagtataaccaggtttcc

SEQ ID NO: 28163 - DNA, 3095 bp, Bovine  19866880695307
aattgccctgttgtgtggatgatgcaactgctggagctgttttgctgaatgtgaactttgtccaccaactggactctaaattggttttggatccttgtgaaatctaaacggtcagaccatatttttctaatcttcagttggactgtatctttgctctgaagtggagctgattcgtttctgttcacatccaccgcaggggttgcttctctgtttttctgctctgcgttgcttgttttctcaaggctgctacttacctcgtccattgtgtgtattcaggagagcaggagggcagctccctgtggtactgtggccactgtggcttcagggatggtttactcaagtgttattgttagagagagagctgactggttttcagaaactgaacaggggaagcgtcaggaccagctcacccacaggtatgctggtactatgacaaaaacttggacttggacttcagatagcagagcactcagatcctttactggaagcgctgaccctcagggctgtggtctctacttgggtactctgctactgagattctcaacttcactgtgtataatataagaatcataaactcagactggggtccacctccagaaattctgatttgattggtctgggctgggagctgacatctttagttttacaaagcttcccagggcattctgatgtgcagccagatttgagaatctctgttttgggagtttatgtaacatttgctactgtgatttttgtctagctatccatgtcctgttatgagtttctgcatgaatttctgcatgaaaaaaaaaggcaaagatctaggtggggtgttaataaatgaagagtctggatcctggctttagtaataagaaaatgaataataatgatattgatcactgttagttattgcatacttacgttgggcactgtgctaatctttatactagccctataggataaacagggcatccctggtagctcatcttataaagaatccgcctataatgcaggagaccccagttcaattcctggtcaagaagttcccctggagaagagataggctacccactccagtattcttgggcttccctggtggctcagatggtaaaaaatctccctgcaatgcagaagacctgggttcgatccatgacttgggaagatcccttagaggagggcatggcaagccactccagtattcttgcctggagaatcccctggacagaggagcctggtgggctacagtccatggaatcacacagagttggacacaactgagtgacttagcaaagcacagcacatcataggataaacactactgttattttcagttttacagatgaggaaactgaggcttgcagacatcatataatttccccacagtcacacaggtaacaagtggcagagccagaacttgaacttggtctttctggttccaaagttcatccaacccaatcactcccctaagacgatgaacttaaatatgaacaagactatttggggtaaagggatgagatgtcaagaaaggagaattcactgagtgaaaataatatataactatatttaagggagatcattcttttctgaaaaatgaaggaaaaaaagatatctttggatgactttcttattttcttttgaagccagtatttgtctcccccaaacctatggaaattcagagtgagcagcagaacccaatgacttgcatgatggtgttggaattaggcagtggcttctgagtttagctcatctttacctcctgtctgaggaacatctttacctacccccatttgaggaacgaccatggttgcttcttatccaaacttgttcactgtatggaacatcctgaagtgattctcttgtccacactgggtaattactggagtgtgcaagggaaaatcctggagtttttcattttttctccctatataagaacaactgttgttttttttttttttttcaggctagtaaatctgagttcttaaactactccattaatcctttaatgcctattaaaagttcagaatggtaccagaccaaggccctggaaattccgtctccagctcttggccaccctagtatatatccatacatgtgaaagaatgttgcagattgaggcatccagtaaatatttgtcaagtgagggagtgaatgaactttgcaaatatggaccataatagatatagcatattgctaaggatttcttggggaatgagtgaagtcttagtccactggtctgctcccaggttttccatggggccacttgatcaattagccaactcctaattccttcctggggtaactttttgtacactaagcacagcaatattaatagggttaaaacaatcttattatctctgacctctgtttgtgtctctcagcctggatgaaaggacactgcttttttcttcagtctcagtagtatttttcatgttataagttgggtaaaattcagagtcccctggaacatggagagagaaagaggcaagttacttgccagcccataggaaagccaagcccaacgctgatgcattcttgtcgtggatggtcccacgggaacacctggattagcccccgctcccgctgtgggttcaaagtgctgtccctggagttatagaggggcagttgggtcctcagccagatggcacaagtatttttagggctgttcgcctctcaatctaatttctgcttgaaactttaacacatgcagactgcacagaaatgacttttaaactactctctgggtagtgtaggagggcttggattagtaccacagcctttgagcaattttttttttttttttattgctaactatccaacaggctgaacagaggaaattcaagtctaaccctggagggacccctgtttagtcatctgtctagacagacgagttcatataatgggcctctctgtttcttttgctttgttataacagacggtggtcccttcctttcaactctatgaggatgtcaacctttggtttttgatcccagcctactgttgataagccaagaaagtgactcacacatgagccaaggatgactctcgtgtgtgacacagtctgtgatataatagaaagaaaacatagactttgcataaaggagaatcctgggtaaaaa

SEQ ID NO: 28164 - DNA, 3216 bp, Bovine  19866880735400
aaataaaatccaaggattaaagaaagggatgaggaaaaagcagaaggacagattgtattttacttctgttcatcaaagttgtgatggagtatccagtagaggtggggtgggagtctcttattaaggcaaaggtaacttcaactgaagctgaatgctccatctctacaaaaataaacactactactgcccttcttatgaccaaggtcaggaaatacgtttccttggaaatccactgagctcatttcaccccaacacatttatcttccactgattaacagagaaccacaagcagactgtattctagaaagctatctgacagcaacctctgtggtctcatgccagccccatgtgagaagatgacatctctcctgatgtttcatgatgtatcaacccagtacatcacactgcatcaaggagttcttttgtttttcttttagtggcctcaagctaataaattaacctaaaaataatctggcaactgactttgataggtaattttgtaaaaggctcttcctcttggaggaagtaaagacttagaagtcaaaatctaagagatgacaaggaaggaagggaactaacatagatcgactgcccactctccatccagcaattatatacatggttttatttcacccttacaataaacagcaagtgaactggaattattaagaaagtttagatcgcaatactcacaccactaaacactacaccatgttgtctcattaagggtgactagtgaactagtcaatgaaaaaaaaatactgtgcatagtaattcaccaaacctacttctatctcaagctgatgcattcagatatttctgctataagtattgctgggctcaaagaaatatcttgattcaggcagatggtgtattatcttggaattatctgtctgtccacacaaggaatcaaccaagatggtaggatgttgccaaattctcacaattcccttctggaaggaatgagttctgaggcattcctttggattctccagattttgcactagaagtctcttgggtatatttcaattagcagaaagacggtactattgaaacaccatttacacatctgttcctccaccagaccctgagcaactgcaaggcacaagctgagtctgatatatatggctagattatttatgttgttcagtcactaactttgaactctgactctttgcagagtgtggactgcagcacaccaggcttccttctccttcattacctctaaaatttgcctaaactcatgtctatagagtcagtgatgccatccaaccatcacaccctctgtcatccccttctcctgctctcaatctttcccagcatcagggtcttttccaatgagtcggctcttctacatcaggtagccagagtattggagcttcagcttcagcatcagtcctttcaatgaatattcagggttgatttcctttagaattgactggtttgatctccctgcagcccaagggactctgaagagtcttctccagcaccacagttcaaaagtacaattctttggtattcagccttctttatggtctaactctcacatccatacatgactaccgtaaaaaccatagctttgactatctggacctttgtcagcaaagtgatgtctctgctctttaatatgctgtctaggtttgtcatagctcttcttccatattgctagatgactggcatcaattctgctaccaatgccaggaggcactcactcagagttttctgtctatgaccctgtacagtgtgttggtgtggcagattaaagatgggtgcaacttctttgacactctttctatcaagagatggggtctatttcctttccctttgaatttcacctgggttgtagcacatttgatcaatagaataaggtgaaagggaagttctgctaggtttgaaccttgtctttaagtggaccggcagcttctgccttggacacttgggcccctgagcctcaggtgaaaaatcctgactcttcttctgggaagaccacatgggtacatcctgaaactacttagagaggagtaggggctcagtcatcccattccagctccaagcttagaagcaaattcatcatagatcgtccagttcagcccagctcccacctgagcaccatcaagcgacccaggtcagagccacatggagcagaagaacagcccagtcaagtcctgtccaagtttctgactcctaaaaatcgataaaaaattggtatctgaggccataaaatttgggggagtcagttaaacagtgactaaccgaaaaagttataaaggtacaaatcttattatcctagaggtgataaagtttgaaatgagcagtaaacagagccacagacagaaaaaagaaacttatgattaccgaagggaaaagggagggggataggcgtaaattaagagtttgaggatctactgtataccacagggaagtatactcaatattttgtaataatctataagggaagagaactcgacaaagaatatatatacatatatatgtgtgtgtatatatatatatatatatatataactgaatcactttgctataccacggaaactaacacaacattataaatcaacttgacttcaatttaaaaaaaaaaaaaagggcaataagtgtgaaaagggtataagttggtgagaggaagctataaatagctggaaggtccaaggtctttggaggtcatcatccctaaacacaagtattccttggtggtttcctgtggccacaaggtcatagatacccttaactaacttattaatttcttggtgactcatttctttgcttgtaaatttgaggacttagcttcctccatggtggcagattcacttgctcatgctggcgatatccaaattgaagaagattcctctttcctactttttccccttctcataactctgggcatgattttaatcataaatacaagtgtgatttaatcaaataaagatgtattcaattttccaaaaaggctgagcgctctactaaatattagtaggttcaaaaacattcccagagcactggagctttatcggaacacatttcaataaaggctccctttggcatagatctctaaaaatacagtaagggtcactgctatttggaaaaaaaaatttccgttttcctctttcccttcatatcagaaggctttatccctttcctattccgtgtgatactgctgtccatctggagtcataacatgatcacaccactatatgctctttg

SEQ ID NO: 28165 - DNA, 895 bp, Bovine  19866880823197
tctgtaaaattcataacagcacccaacagcacagaataaccttgaaaatcatcttcatttgtcttaatctttaaaaatctttaaattatttgtttactgtctctcccaaatttcaacattctaaatacgaaccacaaaaaaattcccttttgtttctgtcaattctatgcatcacattatttggcttataatatccttattttataacaaatgaactgtaaatcttttcatttaatattggaaataaaagttatttaaagtaattttttaaagtaattcttgataatgactaagaattcttgataaaagcatctgatactgcccattgaattatttagaaatcattgtacttatattcaaattacttaaagggttattcagtaaaaaacatatatgtcaatttaattcattactgttcatgtaaatacagatttatgcagactcatttctcctataattttaaagtaacttgaagagaaacagtcttcctttgtgctgaaaattggtcattttttaggacttgacttaatatctggcttaaatgcatacacgagagacaagaaacaaattgtcaggatatttaaagagtatgtttcataagcaataaactttaagtacactcaacctaatttttgttgtatttatttcatgtagctcttcataagtgcttgaaactgctttttgtaaaatatccctttcactttaagaaacatgctatttttttttgctataaacaaaatttaggaaatattttatgtctcacattttgaatatcaaaatattttaaaatcatattacactgatcttaaaatcacgatatgatgtgtttaacagttcatttaaaatatggatattttttgtacaaagataatttgcctttagagggtacagtcat

SEQ ID NO: 28166 - DNA, 1283 bp, Bovine  19866880826038
ttgttcgcgtggttttttaaagtgacaaacaatatttttaattctctgttaatactatattgcaaccagatgaatgtaaaagctttcattcccacacaactgcttgcatgctagtaccttcaccagtttaatgaccattgcaatttgagcctacaatcataatgaacatggaaaataacataaagctgatggatggtgcctaatgcaaatattttacacttgttagctaggtgtgtacgtcagataactgtgtatttactactctcggatctcaattaattcattcaagatgattggatatttgtgaaaataaaaaaatgcaaacatcataacattacctgataggatatttcattacctgtagaatgtaggagacatttcgctcattagcatggtctactaaattaggcttttatgttgttagagtatttgtggcttagtcaaagctcataaaatagatagtagccaataatggaggggaatgatttattggcaaagagccaagtctctaagtccttttggttttcttacagtcatgtaaactgaaattacttagacacatcttttcaaatttctctcaggaaagagagaatagattgtttaaagtcaaagactgtttttaaaagaatagatgaaaattgaaagaccttcaaacttttatactggtcactaaagcttcatttatattgatccaagtatcagctggaaacacagatgtaacatgattttttagagtcatttcccatgtgttccttctgttatatttgccagctctatcatctagataaggacacattttaagacgggatgagttattgacttgagtgcataatagcaaccaagacccaaactgggagttagtgttcacagctcaaccaagatactgcgctgttatgcccctgtatccctagtggacaatagctgcgtgtgtatctgagcatatgagtatttctggaggtttcattgacttcctccagtctcaccagcctcaaacactggagcactgcctttgttacacagatgtgcagtacaaatggacagatgtgcagtacaactgaaatgatatagtttcagtttgtaatagataaaaaggttgataaggagtgagtgaccaagaatgagtgtgaaatatgtagagaacaaactagcagttatcagcgggggaaagataggagagggacatacaggggtaggggaggaaagagtgggatactacggccattatatgaaatcatacatgtggaactttcggaaattgtaaagcactatagaatttaaggaac

SEQ ID NO: 28167 - DNA, 1111 bp, Bovine  19866880830151
tggtgcgcacgtgtgtccctgtacaaacagtgaggcactcataggctggaggagaggagaatgattttcaaatcaaagaggtcagcagttgccagagtagcacatgtgtaatgaaccatattttactttcatcatcacttcatcagatgagtaaatagagacaagatccccaaggtcagcaaaaggagatggtgaaaccggtctctagttctttctgcccttcctggatgggggctgccatcagcaccctcaccatagctgggttttttttttttttttttttctatttttttggcgtagaagtgtttgactgaaaatgaagccagagcattggcagcagccccccgcccccaccagaagtgctcagggctgtcttccaatgaggctggaaatataaacagaagagctagtttgcctgggggccccttgcaagagcccttattcgctactgctccctttgctttgggggtgggggaggtagggagggcgatgctttggttgaatctcacccaaaaagctgtatttttagccgaagatggaaaattataaaagcaaagatgtgaaatgaagctcttcggtgagtgttgtcagtggaagaagtcacccccagcatagacgaagtcgctccaagattcccatccacactggagcagggcccctgactccccgcagcaccggctctggcgggactgataaagggactggtcttaagcacttggttttgcttgaacactgaagtcagtagacaggtttctttctctgtgcaaattcagagtttttctttactaccttcacatgccactgtgtcctgtactggacacttgtcataggaactgaatccaaaggatgatgttccatcatttcaaagtttggtggtggtggtagagggggtcatacatacaacagaccttggttatgctactattttgtggagtggattttgtttcatgagtgaatttggtctctacattcccttttctgattcggttttggcatcaagtttatactgcctgcctgagtgagttgggatatttctccaatactttcttttggatagtctgcatggtttagaatgatgtatttcctaaaagtctagggagattcttctgta

SEQ ID NO: 28168 - DNA, 535 bp, Bovine  19866880934471
ttttagttgtaggttttccttataaaagtgcctttttaagaaaactggatctgttgacttactgaacattacagagcttttatgaggtatgatgatgaattagctataaaagcagaaggatttacaggttctaattcctgttaaatgcatatcagtttaaaaaagaggagataactgtgctgtacaacatgtattcaaattttgccaaatctagatgtttgaaaacgggttcaaggtgttagccaaaccaaaaacgcagttatagtcacccaattctgacttatgccatgtatttaagcccatttcccattgggctgtttcccagaatgagcactctctgttgactgccttaaaatatagaccaagttcagcaaaacattacataaacaaagggaattattctgtttctctgcatcagactgaaatgcaacccaattatgatttattgtccatatgagtggccttgattttttagtgtcggtcaaaaacaagtgtcttttaagaaaacaaacttatggataccaaaggggatgcg

SEQ ID NO: 28169 - DNA, 3229 bp, Bovine  19866880995646
aggtgatgaatatgttaattaacttgatggtgaaatcattctacaatgtatacatatatcaaaatgtcatgttgtacaccttatatatacacagtcatatcaataaatatggggggcagaattatcagacataaaaggaacagggataaagagatgaaagagaagaacagattcagaaatgtcagagatgaagccattagcagataaaaacactgaagtagctatttaaaatgtttcttatattcaacaatctagagggaaacaggaacataatttagtgagaaaaggaagagatacagaagtcccatgtagaatttctggtggtcaaaaaacaccaaatctgaaacaaaaaatacaccaggtggatataaaggataccgctgtgatcatttctcagtgtatcattctaaccattaaatacaagtcattggaccctctttgttcataaacacaaaaactctccagtgactccacaaacaaacaaacaaaaaagcacgctattaatgatactttcctggtggctcagaggttaaagcgtctgcctggaatgcgggagacccaggttcgatccctgggtcaggaagatcccctggagaaggaaatggcaacccactccagtactcttgccttgagaataccatagagtaaggagcctggtgggcttcagtccatggggtcgcaaagagtcagacatgactgagcgacttcactttcactatcaacatactgattaatcttttcatcacagcatatttcacaaaggctaacacaaagcaatttcttaataaatagtgttaaatggaaaagcaagtttgatgtggaaaataggggaaaaaggagaaacatgaaagggttcctaggtgtcttacttgatctctgtgtgggtatttgtgtgataataaaagaaaggccaaaggcagtttatgtttcaagaggggggaaaagcatattaggtttgagtttgaaatattcctaagacatcaggtgtctggcaagaagttagagtctggcactcaacgtaaagatacagatttgagggagtgttacaggcatttttgctgataactcagcccatgggaatagacaatgaatagagtaagaagaaaaggaagacaagaggcacaccagacatacaccagtctccaagctcttttccagacgctgttccctttgcctggagtggccttcttccggatagcccgtgaccccaccctcacctcctacaggtctttgtttgtatggtatctcagtgagatgccttgacaaccctatttctactggacaccctcctggaactttcctctatgactcttctttattgcccctgatagaacttaacagtatctagtctattaaatattttatttctttttgttttttacctacgatttaccctctctaaaacttgcaatccatgagagcaggcttctgtttgctcctgctttgtttattactataaacagggtgcctacaacagtgttaggcacataggaagtacttaatgtatattaattctatgaactaagaacctaggaaatcccaaacaatgaagggtatttagattatgcaaaggtcagagtaaaaattgaaggaagaccagaaagacagatggagcatcaagagaaattaatgccatggaggattaaggagaaagagtttcaagttaaaaatagtggtcagaatgttcagaacatcatggagataataagaaagaaaagaactggaatttcaattggatagaagcaataacaaatcttaaattacatgggagaaaatgtctctaaagagcatcatgcattcagacttcttatgcgtgtaagaatttctgtggaaacctggttctcacaatgaagcaggaagtaaaagcacgctataagagcatctgttctcatgagattttcagagttgaatcacaaactaaaggaagtttggatagttcggataaagttcagatacttatctgaactttgggggtggttttttaaccaaactgaatacagtgtacaacagttcatctcctaaagactaaatcaattagtgttctactaaccataatggtattcacaccacatatttaattactgacctttcatattttctgtatataataaagaggaaatggagaaaatacatagatttttgtgctatcattatattggttagaggtgaagttaaataatcatgtaatctgtttttgcccagtgtttaatggattaacatgtttatgtatttacatcttagttttatagtaatattccagtgacatttgaaaagaatatcagaagtattaagacaacattgagaataagtctctcccagctgcagatcaatgagtgttttgattataatacaaaataatggctcacaacttacatacctaaaagatatttttaaccatttttaagttgaagtatagttaatttacaacactgtgatagttttggtgtacagcaaagtgatgcagatatatgtgtgtgtatatggatgctaagttccttcagtcgtgtccaactctgtgtgacactatggactgtagcccaccaggctcctctgtccttgggattctccaggaaagaattctagagtaggttgccatgccctcctccaggggatcttcctgaccctgagatcgaacctgtgtcttctacatctacctgaatggacaggcaggttctttaccactagcatctgcacttctcttggagtggagacatcctatgcttcaagactgatagattcttaagtgaatttcaggattacagaaggggttaagactaaattttctgaatgtacaaaataaggaaaatgaagatcccttgggagagcagcatgctatggtatggcaaaccctaaccctcccgtccattcgtctgtaaattcctgctacgtggggttgagtcttgcttgaaaaatgccatgtaggaattttcacttcctctgtcaaccagtaaagaacttttggacaagctgaacagaaaactccttttccaactcctgtgttatgttagatattggattcagtgttccttttcaataatgccttctttgacccctagccatgacacactccattccaatttatagtctcctttatatacggagaagaaaatgcagtgagttgttcgatgcctattgtctgggctgtaatgatgatgattcagctaaggtttgccgagggtattgacattcttagaggaagggcacagaagtgcactgcacaggcctctgg

SEQ ID NO: 28170 - DNA, 1764 bp, Bovine  19866881001097
tgtagtttaaatgttttaaaaattgcccaagataaccattcaattttaaaaagaggcagcaaggagaactttcatcaggttacataagaaagattaaagagtgggtgaggtaaaagatggttcacagattttgataattctttgagaaatatgaaataatatcagaaatattcattggaaataacaggttggggcatcacaaaaccacacatgggagtaacttacttaaacactaaaatgtgggtcttttcatatagtctggggtgtaattttagtcttttatcttccctaaatgaaaataacagaatctgttaaagtcaggttgcaattttctactaagaagtaaaggcatttttttttttttgaaagagttaagttttacaattatttcctgataactcatgatcataaaaaggaaaatcctaatcatttgtatgtttcactattttgagaaataaaatggtgtatataaatccagaaaagtaatgcttgaaataattatgtttttcccaattattcctgtttatagacatttataaaatatataaaatttcaaaatataagccagaacatccatatttttagcactcagggagaattgttattaacactttaattcatatagttttggttattttcatttttattcacattgtaaaaatacttggatctagtaaacatactgttttacaaactaattttgatttaaaatacccttagaacatttttctgtatcagagaagtcttagaaaagaaaaacattatttcatagtaatcttttattaaatagtttgcaggctgttgtatttttgtttacatactactatcttaaacgatactgagaggatcatgtttgcacatgaaactctgagcatctctttaattgtcatcttaggataaattccaggattagggcttgtgggtcaatacgtaggcagtttaaagatatttacacatattgtcatttttgttttccttctagaagactatatctgctaatacacccatccttgttgactatttacggttttacccaactcctggtaagtaccttgaaggaagaaaccctaaagattctactttaatttctagacacttatgtactttgtattcagagctgaagagaaaacagaagggctataataattttaagttcttacagaacttccttactgatcagaaagaatgattgtaaaaatcttcccacctcagttttgcagatggcagaaatcaagtttgacagttcccagagctgacagctccttcatgataccatttctgaagaagatggaacacaggacagggatcttctatccctttgcctttgacagagttactttccagaatgcaataaacatcccaggatatactattgaactgagttagaaataaagacccccaaggcctggaaaccatttaattgctattcaagcatttctgaaagtgcttggagcccctcacaggaaaattcccttatgcacaagacgagggaattgctaataacaggggtgggaggaaagccatttttaagggtaagaattggcttgggatgccagaattaaaacattcaatgtgtcaggtcaacctttatattaaattataaatatttacagtttccttttcttctaagaagaggaaatagttttatgcttgtttgtttctttgttcatttttaatgttgattagcgggaaaagtgttccattctctggccttgccccctccctgcctctggggatgtcatagagagatgctctgctgtataa

SEQ ID NO: 28171 - DNA, 836 bp, Bovine  19866881027194
tcactcagtcgtgtctgactctttgtgacctcatggactatagcccatcaggctcctctggccatgggattctccaggcaagaatactggagtgggttgccatttccttctccaggggatcttcctgacccagggatagaacccgggtctcctgcattgcaggcagacgccttacctgctgagccacgagggaaacccctatatatatgtatatatatccttatatgtatatatataatgtgaataagtatttgtagtcccttctataaaatgaatcagagcctcatgtccttttggtcgcaagatcagaaaagactttcctgttaaatgggacataatcttttgaaataaaacattctatatccctaatggagaatgacttggtacaagagtaggatgctcagccagaaagagcatcttaaacttacactactgcccccccaccccaaactcccaactgctttgaaccaatactcaccaattattttcacctgtctttttatggccatttaaattatagtttcccactttcagttctgctaaatatgaatgaagcaggcgaagtgtggccccagagcagggcagtgtgtggggctggtttctatctttagcagtgtgtgcgctgctttagcagagatgctggaattcattctcatctcatctgctgagcaccctatcattaaagtgtcattgagaactgacaccacttaattttagcagctttcaattctcgtttgcggcaagaatagctttaaatggaggaggagtgcaaattacagagagagggatatttttacaccacactcagcattttatcaaacaaagcagcctcccgg

SEQ ID NO: 28172 - DNA, 2160 bp, Bovine  19866881056058
tcaaaggctgttgggctcaagacgcattttgttttaaataatccttcataaaaaattcagctttagtctaatatgattgaaactcagcttgagtgtgttttataatgcattgaactggaaagactatgggcattgaattattcaaaacatggtaggtgaaggagtgatatgtggggaggaggtgatcaaaggaatcagtgagacttgatatatcttgttatctcattttatttaccttttagaactcctccaaatattagagaaaagaaatcaatatcaattttcacctctgtcacgttccgcacttcaattattaatgcatgtcaaatttgaccacagttctctataccacctgctttgcaataatatttctgagcctttattaaaaatgtaaaattgtcattgaatttccaaatatgattctccagtggctaattcagcttgttttattaataagcgagttctgatgagtaatactaatttagtacgccggtatgtaagattaaattataaattatttcagctgaaggtgatgagatatgactgtgatgtggtttttgggcaatcaccttcctcaataaaccctgcaagcacacagttattagaagaaaccagtactatagatggtagcaaatctgatattattttgcatgtctcttttagcagtggaatgcacagacccatacacacaaacatgatgggtgaaaaagcacacatgcataccttagatgtttgcattaatttctgaatacaattctccaggaagaaaaaggctttactaatgatttgtatttttatagtttattattttatccatattaaaacacttcaggaaatcacttgctcttttgttgttcatggaatcctttcaattttgagatgctgaatgtaaattggggcttccctgctggcttagaattgacctgcaatgcaggagatccaggtttaactcctgggttggaaaaatcccctggagaagggaatggcaacccactccagtattcttgcctggagaatcccatggacagaggagcctgctgggttgctgtccatggagtcacaagtagctggacacgactgagtgactttcaaaaagcttttgaagcttactcaacaagttcttctttaaaggatagttggtaaatgcttttttaagatgtgtaggccagcccttggcttagaactaaataaaggtgttggtctgtgccatctacacatccacctttgagaaaagagagtggggagagcttcagaaagtgcctgagttttgacccctaccaccaagactttgtctttcctttttataagtttattatttttaaatactgtttatttgtttctggctgccctgggtctttgctgctatgtgtgggctttctctagttgcagcgagcaggggctactctctagtcatgtgcaagagcttctcttgtcgtggagcatgggctctagggtgaaccagcttcagcagttgtgatgctcgggcttagttgccctgtggcacatggaatcttcctggatcaggggtcaaacccgagtgcctgcattggcaggtggattcttagccactggaccatcaagaagtccaccactaaggcttctgaaggcttagaaagataatagagctgtaagacagagctaaagcttccccaaagagaagaaactttttttttttttccttaagaattctctttccattttcaaaatggcagtgcccttttcctttgctggggtgtaaagtgacttgggaccaattggattcactctgtggaggtcctgcctactactgtgtaaccagttttctttcccagtgtcccttcgagcgtatgaaactgtgtacatgttatacctctatacaccaaagtcatgagattgaagctagatggcagggcttgctgtcagataattaaataaaaataagacactcaaacatttcaaggtacttagctgtggtctaggtctgccttggagattctcactttaaaagctgtgttttctcttcttgcaaatggtggctcgaccttgaacgaaagctgcttagcacccaaatgcataagaattcttaaaacaagcataacacctgcggctccattccagaactcggtcatgccacagttcatctggattcctataattcctgtatgttcccatatcttaatt

SEQ ID NO: 28173 - DNA, 921 bp, Bovine  19866881126930
aggatgagatggttggatggcatcaccgactccaatggacatgaatttgagtaactcccgggagttggtgatggacagggaagcctggcatgctgtcatccatggggtcgcaaagagtcagacatgactaagcaactgaactgaagctcacactcagttgtgtccaggcaagattcctgggatgggcttcccaggtggcactagtgataatgaatccacatgccaatacaggagacacacgagacgggggtttgacctctgggttagaaagatcccttagaaaggggaatggcaacccactccagcattcttgcctggagaatcccatggacagagaagcctggtgggtgacagtccatggggtcacaaacagtcagacacgaatgagtgtgcaagaccacactatgaagatcacacaactaactcagttctctgcctcttctctgggccctactgatgaatgaacaccaccaagggtagattattgaaccagaacaaagctgaaagcaaagaaattggaatttgatgttaaaaaccattaacaattagtagtttcagtggtgccttaacaaggattccagatgcctggccttcatgctttcacctgcaggcgatggctgtcaatttctgcagcccatacaggagaccaaagtgctttttgagaatgtgtaacggctgttacgatatctgtctgtggtaagtgagtccataaatgtcaatgtgcttttcaacataaactgggtttccaggtcaaaaatcacctggcttattccacgttagctttctggtgtaataagtgtatttaaacaccagaaaaaatgaatatcagcagtggtttatttatagctcacttctggcctttcaaagtccctgtttccagaactccttacattttctgccccagaattcttaatagttcca

SEQ ID NO: 28174 - DNA, 912 bp, Bovine  19866881281953
taaattatcagtgctgtgtacagtatatcattatagtctgaaggaaaaaaagatatgaataatttaataatacattactaatttatcaatgctaagtgacttcgaggaggctctttgtagttcattgttttcaatttgatatttgattgactgctcatatgattaaaattgaacctatttcatttgttaccaggaatatatagaagcagaagattttatgtatttttttttttttttttgagctgagcggtgtggtgttttctgccttgatgagattacaagatagctactactgggcgctgattagcaggtaaggtaggcatttgtcacaatcagatgtgtgcagtccctacttcttggttgctttcctgaggggaaggtgctaacccttgctttgttcataagcccagcttgcaacacagcagcaattatcattatggcttggaagggtcaagcttgagggaaagcaatttgcacttcacctagaaatgttcctgctgattgtggacaatcaatccactgggcgggctgtccaggagttgcattctataacctcagtccaacacttgggtgtattgatagccaagcacatatttggggaaatagtagcttaccctgaagtgtgctgtcttcaaagacaagaccaggatcttgtagctcttccctgtgatattctattttgtatgaatttgtatgtctatcttttgatatcgacttggtaacatactggtcatgctagtcagatctttgatttttcacataactatatgtcttggtgtggagaaggcaatggcaacccactccagtactcttgcctgaaaaatcccatggacggaggagcttggtaggctgcagtccatggggtcgctaagagtcagacatggctgagcgatttcactttcacttttcact

SEQ ID NO: 28175 - DNA, 2022 bp, Bovine  19866881333146
gtacacaggtaccagtgtgcaccagcaggtacaaagggaaaggaggactgctggagagtgagtgcgagaacgggtttgtgtataatctcaaacaaatacgtctgcatgcctaacacgtgtcctatgtcaaaagaaagaacattctaaaataaaaaagttagccaaatgtaactgaacgcttccggttaggaatcatggcagcggccgttggagactcacgtgtgagtgcggggaaaaagctgaaaatttcactaaggaagaagaggatgaaaatggtagtagcgtctgtagcatcagagctggaagataaggacaaagacgcttccgataatgaaagttctctaggaagctgtggattggaaaaagatcacttttcctctggtgatgaagcagtagaagctgacgacgaagatgaagctgagccccgcgaggatgacaacgacagtgctgcagaagctactgcgggggctaacgcgggctgggcagatgccatggctaggatcctgagcaagaagattcctgaaagcaaacccaccatcctggtcagaaacaaagagctggaaaaggaaaaggagaagctaaagcaagagagactagagaaaagaaaacagactgaagcgaaatcagaagagggcccaggatggacgatcttgcgtgatgatttcatgatgggagcgtccatgaaagactgggacaaagaaagcgatggaccagacggcagcagactggggtgtggaagtgactctgacacataacgctgtataagaaacacagtttacattttgtttttcctggaaaaatagttcatactctgaaggttgggaaattataaaggttgcatttgtaagaaagccaaaagactttcattattaccaactttggtgtttccttttttctgtaaactttgttaaaattacatttcaaaccttatatgattttaagcattgttccttagaacatttgtaaaaagaaatatttctacttgagaggtgcattttgctaggttcactataggtttacatattgctcttggatattggtatttcagctatcaccggtgtttgtggaaatgcaacatcaatttataattaaaatgaactccttgatgttagtgtttttaagcctctaacttacaggcctgaatatgtatattttttgtgggaaagggtgggttggtggtttttgtgaggtattgagaaaacctatgtattaataacaaaatttttaaatcatagcatttctgatttggggtaatgattttatttatagatactctggcaaataatgatttaagaagtataaaatttctacttatatgttgccttttatatgctaagtaatgtatataaataatgacttagatttattttaaatgttgtttatttttgtatgagagatttactgaggtggaaattctcatatttaacttacacagtgaggcataatttcttaggaagcatatttgacatgttctagtttctcttattttccctatttttgagtttttcctcctatatttgagttagcttaaatactcttttatggacggactgaccagtgaaatggtagacaatagatgcgtaggtgtgtgcttagtcacttcagccgtgtctgactctttgcgaccctatggactgtagcccaccgtgttcctctgtgcatggcattctccaggcaagaatactggagtgggttgccatgccctcctccaggggatctttcccacccagggatcgaaccagcatcttctgcagctcctgacttgcaggcaggttctttaccactgagctagcagggaagcccagacaacagatagtctgcatcagaaagctgcatctgagttgacacttgattccttatagttgccttaaagattactaaattgggtgacttttaaagtctagatgttaaacagaaagagataagaaagcaggactatttaaataccattctaaaatttctgtgacactgggcctaagctgcaaagtttgtaggggaattatttaataaaagtcatctgtt

SEQ ID NO: 28176 - DNA, 1198 bp, Bovine  19866881353030
gagttcagaagagtctcagcctttaacatggtgggaaatatgaacccctgagagggcaccagtacccaggtatctcctaaacttcactttcaccacagaatccttgtttatcagacatgttctggaaccagtgcttcttagaaatacatagtgggtgagaacatggaaatggattctgttcacaaaatccagctctgcttcttacttgaaaaaggtacttagcttctctgtaccacagtctcttcatctgcaaaatagagataataaaaatactttgtgaagattaaatgaacatgtacatctaaaggatctaccggcttctctagtggattagacagtaaagaatccacctgcaatgcaggagacctgtgttcaatccctgggaagggaagatcccttggagaagggcatgacaacccactccagtattcttgcctggagaatcccatggacagaggagcctggagggctgtagtccatggggtcgcaaagagtcggacacgactgagtgactcagcacagcacagcacgttactaagtgtaaaatgtgtctgctactgttactacagctactttaactctctacttactaatgatatagaccccatacacatggaaagtttaaattccaaaagttagagaaagttccttgtgacctttctgtaataaaaggaacatctaaactacagaatgatatagtggccttgagtctgggggaaaactcaacagtttgcagtttaaatcatctgtctagttggtatggctacagtcatgatgaaaatgttttttgagtaaaggtaaaagaaaagaaaaagggaaaagtgaacaggggcaagcattatttttattcatctcatttggactaggttgaaatagaaaatgtcaagttataagtagtgtataacagcagacatctaacacttaaaatcccagcttcctggatatatgctgtggaaaaaaatgaagttggtcactcaggtctagctggggaaaaaggtgaagagaaagcctttggcagcaaattaagaggatatccattcaaacagcaaaataaatgcaattcattctctgggtgcacaagataaagttctgtttcaagtgcagaaccaggctgtgaacaaaaaaaaaccataataagctttaggacagaggtagcagcgcaggtgctgggaatctcagaaaagactccactaaaaga

SEQ ID NO: 28177 - DNA, 1354 bp, Bovine  19866881630608
tatctatacattgaaactgtcagatacctcaccctttttgacttcagcaattactaggaaagggtctattcacagaatatgggagaacaggaagaaataaaaaattatgaaaaaaatacagagggaaatgttgtttatctctttaaggtggaaaatgtgagaccatctagatttcacaagactattctaattttaccagacctggttcttcagctgtgttgcacataataccctcttctctgatcccctcctcccctattttcaaaattatttccttcaatattttaatcatcaaattattttctttcttaaatccttatgggggtttacaattccttcttgaatcaagttaaaatcttctcattattcataatgaatattacctctcaggttccaatttcctgctagacattgatttaccctcaatagggaagtcactcaaccatcctcacatatctgtcatatctctttccctctcgggctatttaatgctgttctcattgcctggaatgacctttctcatcctctagcaactaaaatgctgttcaaggctgattatctccaaagcctttgtcggattatcccctttttttcactccatctctctacctcaatacacatggatgcattcagttatatttgtttatgcctatagtactctatcacagtattttgtgagtcaccactcatattatgtatgagaaactcagagaaatccaccaaaacagaagaggtccttgatctctaaagctcataaaaatttctgtgagaaagtcagctttcaaaatgtaccaggtgctaagagtgggtgactgtcttatacagtccctgttagtaacatctaacctatattctccacttctgcacggaatgggacaaacgcaggatgaagagaattagggagcgaggggaagggacagacctcttctgcacaaggagctcacccacagcaggatcagctggggtggggcggagtagaacatttagatttaaatcaaatttgaagttttgattattacagagattgtcactagacacaactaactaccgaatgaagattgtgtttttacctttttcttatttcctaagagtgaccaggaaaccatgaggctgctcaagtttttatgctaagtgaggggaaggcatattcccactgaaaccatttaaagatactgtgggaaacactgtgactgaactcttatgaccaaatcctcaggagtcctgattgtataacatgatgtgatttttccacttccagtaggatttatctttacagcacaggttaaagaaaagcattgacatctttccagtctcacctaccttgttcctctggaagtgattatttggaagatct

SEQ ID NO: 28178 - DNA, 2386 bp, Bovine  19866880244773
aaaatacctgattttaaaacagctttatggacatggatgtatttcccatcaattcgaaacttcagatcggcagtttctggactgtcaaattctttcttcagtgactctgcaactgttagaaagtcttcatgctctgaaggaagcaagcacattaacacaggtgctcaagctttgaaagacttcacaaagatactgactagcacgatggataattccattagatttttctcagaagagttcaccccttactcgacaaatcaactttccagtattaaaatcaatgtcatagaaattaaattaaatttcataggctaacagggagacaaaaaattccaggggccgtcgtcagcactgaatgaaggtactgcagacacaggagatagctcttgatgtccccaagatgagaaggtctcagcagctggtgatacccaaatgtcgctaagtgtatgctgctgctgctgctgctaagtcgcttcagtcgtgtccgactctgtgcgaccccatagacggcagcccaccaggctcccctgtccctgggattctccaggcaagaacactggagtgggttgccatttccttctccaatgcatgaaagtgaaaagtcaaagtgaagtcgctcagttgtatccgactctaagcgaccccatggactgtagcccaccagggtcctctgtctatgggattttccaggcaagagtactggagtggggtgccattgccttctaaagcagccttaatatgagctcaggttgcagaaaaagattttagtgaaatgaattcagattctcttctccagactaccattccacgagtctttgttttttcttttttacttttggtgtttttttcttttgctgacacggtgttttcattgcggagcacaggcttctccagttgcagcattcagccttttctctccacttgctatatgcagtcttaattgccctgtggcatatgggatcttacttccccaaccaagaatcaaactcacctcccctgcattggaagatggattcttaaccacgggaacacccaggcagcccccattccataaatctctggaaagttatggtaccatttggttccagtagtgggtctatgcattaaatgaaagtcagaatatatatatatatatatatatatatatatattccatgttattcagattgaatggaaactgtgctcttaagagtaagggcagaaaagagtcccctaaagaggtctgttctctcttgttacacctggtacatgcctgtggaaccctggtgccctctggaacaccatttgaaaagcattgttcgagaaagaggaattactgaaatttattagtaagggagtaacctagtaaaagtaatgaatgttttcttctggttctaggcaaagtgagaaatcaacacaattggattgtaataagaaaacatatttattatgcagaaatagataatttctttgttcctccaaaaaagtcctgaatctttttaactactaacagatatgtgaacaaagatgacttacaaagggtgagtttcaagtacagtctctgatatatgggtatatatgtgtataattatttgctacatatgttcaaaatatttctgtttcaaggacccaacagccataaattgaggaaatagaaacagacaagttaaacaattgttccgagctggcaccctgactcaagagaatgtagtgttcatcaatatggcagtttgggtttctttccaagttcatggcttcatattccagtcttattccatttctttttttcacattaaaattctacaacactccaagagaaccatagagaatttcaacctttcaactattagacaatggaaaaatagagggaaatgtgtgtgtgtgtgtgtgtgtgcgtgtgtgtgttgtgtgtatatatatgtatatttaacattttagatgtgtcaaacactcacacaattcatcttatgagaaattaccataaataacacatcatcattgatagcaacagtaaagggctattctagactaaacccttcagccagtatttgggtcaggaaaggttttctttttcatattcactggatgaaagaagggttttcaggaggaagccagtggttttgcagcttaaaccctatggcagttaacttcctgggatctgagaactatagaagtctctgatgacatttattataaagtactgtgtttatgcaatggagaaggcaatggcaccccactccagtactcttgcctggaacatcctatggacagagaagcttggtaggctgcagtccatgggggtcgcacagagtcagacgcaactgaagcgacttagcagcagcagtgtttatgcaagataggcaatacccttatatgaacattaacttctttgcagagagatattttt

SEQ ID NO: 28179 - DNA, 676 bp, Bovine  19866880693146
tggacaccagaggctcgaagcccggaccagcaagaatcgaagacatccttcagtcacttctactcaaccaggtttgtctaacagaagtgggttgtgcctccttgccttaactacataggaatgggagctgacgttccatgtcttcagggggagaccctggtctcttctctgcagcaggtacccctccccccgatccccagagataggtcagctgatgctgactcacacagccctacttccctgggtttgaaagatgacactgtggacattaccttgggtgtagaagcccttctcccatggcccacacggatttgtgttccttctgacgactgcacctggcctttctcccctagggtctggcagtggcccccatggggtctgtgagttcccgaagccacagggcggaagcccaggtggtgatgatgggcctggactcggccggcaagaccacgctcctgtacaaactgaagggccaccagctggtggacaccctgcccaccgtgggtttcaacgtggagcccctcgaggcccccgggcaggcgtgcctcaccctctgggatgtcggggggcagagcccactcagggccagctggaaggactacctggagggcacggccgtcctcgtgtttgtgctggacagcacagacgagggcccgcttgcccgaggcagtggctg

SEQ ID NO: 28180 - DNA, 1351 bp, Bovine  19866881101390
tgatatgttcagcatgaattatcattcattgtacattaataggtgaatcaatgttttgtgttttttttttggctatatggatataaaataaacatgaaagaacaaaaaagacaaatggaaacagagattattaaagagtttaaccctctcaagggcttcctctatggttcagctggtaaagaatctgccggcaatgcggaacacctgggtttgatccctgggttgggaagatcccctggagaagggaaaggctgcccactccagtgttctggcctggagaattccaaggactgtagagtccctagggtcgcaaagaatcggacacgactgagcgactttcacactctcaaaggataatatgccaacccactcagatctctgtattatctctgccactagaaaatacatcctaaaaaaacacgaatatacatcctgtgttgccacagactgactctgtatgcactaggaccacagacctgtatcacattccctgggctggcttctcctagcaactggcactgtccctcagagttggtggcatggggaagaaaaggttgtttcattgcactctctgaaagcaaattcaatcaagaggagagacacagaccttccaattatagaaacctgcattagacctggagactgaggagtatgcagccagccaatcttctgatccccctaagaaccgagtgttaagggaaggtacggggaaggcactgttttactgatctagcaaaaatatatttgaaaatgtttagagttttttttaaaaacaggaaatggaggaaaataatacaggaaaactttcatactgaaagttgctgatcaaataatggtctcaatactaaacgataccagaaatttagggtcgccttgtaagccagccctcggcgtccacaaagacctcaccccccgaactctacccagatgtatttggcacaaaagagactgatgtcacagatgggacttcacccccgcaacctgtcttctgctcacccgaaagcttgctaaggaaaagagattataacagagtgagacacccagcagaactggttagctcccagactctgactcctctggctggtgtcatcctcggggcatgaagtgagactgtatcactctttatcacggaagctgatatcctcacaggaaacaggaaggactctgagtgttggaacaatccatctaaaatgccctatgtgttcctcagcataccagccatagccaggtttagacgacatccagaaacagtcatggcaaatatgaaaaatgattttttaattgaaaaaactttagagcacttataatacaaactgaagatcccaagtaaaggtttctctattttcataaa

SEQ ID NO: 28181 - DNA, 1321 bp, Bovine  19866881425697
ggctggctataaagtttagcctggatttttgacggcacaggtggtcagcagcatagctgtcttaaaaggaaaagcctgactgtattttagggaacaatgtaaaatatatgattatttgaaagggattttttttccataggacaaaaccaaaaagtgaagttataagcaaacatttgccaaagatcacgcactaaattcttctgtttgcttattcttgtctctagatcaagcacatgtgaacttgagcatgccccttaggaccacctggggggcttgttaacacggtggctcctttttgatccagtgaaggtgctaggagtttgcatttccagcaagttccctggggcggctgctgctgcaggctgcagggggtgcctgctctgtgtgctgctccttatttggggttactctgtgaggtgtttctgtctatataaaactgaaaatgtttttctccctccagactatgaagaaatcgggacttcactttttgactgtagattgtttgaagacacacttgtaaactttcaagcaggtatgtgagttataactgagcagcagagttcataaatacttccatactgaaaataatataacactagtcaggtgatcaaagtcctattctggaagaatgttcaattcagtttcattcaattaaaaagcccattacaaacatgagccctcacccagaaggaacacacatatacacagagacacgtgcacagaagaaccgcacatgatggaaacagcaggtacccgtaagtggctggattacagtaacttcttttgtcttagtgctcactgtactttccacatttaatacagacacaaaatactttcctaatcagaaaaaaactcatttaaaaaagtagaaacaacaaaaaaaaattgaccgcagaatgaagtatttgggcaccatgtttgaacaccagcaggagtgggtgaggctgtgatatcaatcatgaggccaccgtctccctctcacttggtgtgatgtgtatacatttcaattctgccaatattaatcttcaaatctaatgggggagagggaaagttgtgatcaattctaaagttcatcatcaaaaaagaaccgccaagaaatttttgaaaaaacctgctggaaacagagacataattttcccataaaacactgagcagtggtcctttcaccactgtttcagatgcctttgaaagaggctaagtttccacactgatgggtcttgcctgacttccccaccaaggctgccacacacagctggccaggctgtgccctgcacatcccaggcaggcgcggagggcacagggttggggcagagggctcccc

SEQ ID NO: 28182 - DNA, 1892 bp, Bovine  19866880406783
atgaaagtgaaggaggagagtgaaaaagttggcttaaagcttaacattcagaaaactaagatcatggtatcttgtcccatcacttcatgggaaatagatggggaaacagtggaaaaagtggcagactttatatttttgggctccaaaatcactgaagatggtgattgaagccatgattattaaaagacgcttactccttggaaggaaagttatgaccaacctagatagcatattaaaaaacagagatattactttaccaacaaaggtccatctagtcaaggctatggtttttccagtggtcatgtatggatgtgagagttggactatgaagaaaggtgagcgccgaagaattgatgcttttgaactgtggtgttggagaagactcttgagagtcccttggactgcaagaagatccaaccaatccatcctaaaggagaccagtcctgggtgttcactggaaggactgatgctgaggctgaaactccaatactttggccacctcatgcgaagagttgactcactggaaaagaccctgatcctgagagggattggggacaggaggagaaggagacgacagaggatgagatggctagatggcatcactgactcgatggatgtgagtttgagtgaactccgggagttggttgtggacagggaggcctggcgtgctgcgattcatggggtcacaaagagtcggacacgactgagcgactgaactgaactgaactgaaagctctgtgattgacaggcaagtcaagatctccattcccgcctttcaaaaggtgcaggcaatcaactccacaatctactaaaacatgcaagggaccctagggggctgaaaactcttcaaaccgaaaatcatcaaaacaggttttattttatcatctctaacaacagtccagctgtaatgtcaactgtgcttgttcatttgttcttagaacaaatgaaacttgaatcaagttttggcaagtcttcagagactatctgtacagatagataggtagatagataatatgacaccgtaatatgacacattcccttcacatagaactttctgcagcaggagcataaagaagataatttttcagaaatactggagggctccatcaattttccaaagactctcttaatcctttgattcacaaatcactctcttttgaagcacctgtcgtgtcaactggcctgatgctactacatgctcatccctcaaatgctttgcttgtaattagagccactgtccagcaaaattttcatccattttatgaaaccctgcatcttttgcaagacttgcaattccactttgcaagcatttgcatcatatttgcatcatactgttggatatctctagcatctggcaacctcccccataaagatgttggtgccctggttgacaattaggcttgtgtgacgtggaagggggaatatgtgcataagtgatgagcttatgggcttcccaggtggtagctaatggtaaagaacccacccgccaatgcacaagacataaaagtcacagatttgatccctgggttaggaagattctctggaggagggcatggctacccactccattatttttgcctggagaatccccatggacagaggagcctggcgggccatagtccatagggtcacaaagagtcagacatgactgaagtaacttagcatgcatgatgagcttattggtcatttaccatatcatgacaatatttgattctctgcatgactctgtacaacatgagctcagacaatgaattcccagttaatgagatctcctaaactttatttctaacccttgagtacacaggatatcatctggtatatgctacacttaatcctcttggcgtgagctagactaagtttctgtccacaaaaacaaatattcttaactaaat

SEQ ID NO: 28183 - DNA, 1504 bp, Bovine  19866880427300
aattcatctaaacatgttacacttaagttttctcatctataatatgatctataatttaacacatatgggatcttaactccccagttatagatgagtacctacttctcacaggggcgtgagaagcattgaatgagttaaaggtgggaagctcttagaagaacatctggcccttggtcaatcctcagtaaatgctggctcttgtgatatttccagatgcttactttcaagaagggctgtcagacaaatcagtgaagagcagagtgatgagtgttctcagtctaagaagtaggtattgattggggagcagagacaggaagcctgtttcaatcaagtgggtcaaggaaggcctctctgaggaggtgacatctgagctgagacctggaggaggagtgagaagcctccaggactgaagaagaggggtccaggcagcaaggagagcaggttcaaagaccctgaggcaaaaccaacttgggatgttcaaggaacaccaagaagaccgttgaaccaggtggtgagactcgaggtcaaggtcagagaggtgtcagggaccatggaggccagagtaagaaatttggattttgttccagtgacaccagaagctcctggaagcgtgttatgcgaagaagggatgtgattctatgtatttgtctgggccttttcaagaacaaaataccaagatgggattaaatgtgcaggaatttatttaggggaagtgcctgtttgagagcaagtagagaggcagagagccagaacaggcagggagagctgttgaacttcaatgcaggtgtgatcctgagtgagggaggagacagggagagaaggccggatggcaggatgcctgggtgccatgcagactaaggaagacccaggaaagccatggggaggcctggagctgtcagaggaactccgtgtctccctgaacagacctgcctcagtgtccttgtcagtttcagaggctggctgaaatgaggtccccaggaaccacggcccatggaagatgtggtcgcccaggaaatacagggctgcttcagagtccagcagctggggcccccggttcactgtgttccttgcagttgttggtctagagatatatcctcatcttacctttccaaattacattttattttttaaaagtcttttttgaatttgttacaatattgctttggttttaccttttggctttttgaccatgaggcctgggggatcttaactccccaaccagggattgaacctgcaccccctgcactggaaggtgaagtcttagccactgggccaccagagaagtcgtcaacttgcattctagacttgcacagggcctatgctaaggagcccagctgggaaggtggacgagaggcatgctgatgaccactgaaaattctggccctgaaggcccaggcaggaggggctgagtgggcgacccagatggaacttggtgggaggccagacagaggtgtgtgcctcccagtgagtcaggccccacctggctccttccctgcccgcccag

SEQ ID NO: 28184 - DNA, 1459 bp, Bovine  19866880446442
ctccaggaagaaccactaggctaaagagagatgcaaagaaaatgtggaaggcagagttgtggaaggctctagaccactgtcccctgcggccttgtgctgtgtgagccagagtacgaatgtgaatgttattccaggatccgctgaagctgctggtaagcgcctggtgtggtcttggctttcacaggctccctcagtgaccggatgggagatgggagcgggggcgaaggtggcacagggtgaccagaaggaaggtcttccccagtgaaccagtctggggcctgcagtgaccccagtggccctcgcttggcgccaaggctggagcgaggagcccctcccgggccaggcttggccccggggcaggacacatcctcccgggcagcggtccagacgctgagccggggaggagttcctcttccaggtccgctggctccaggagacaataccgacatcccgaccaccccgtgactcagagcaaagggcctttccctttctggaaagattgctcagttttcaacaaggattaggtgtcaacgggagaacgctgagcctttacatcggagccaaggcaccgtgggagttctcctggctgaatccacagtgtcaaagggaaggaagggaccacaggtctgaaatctactatgtgcctggtggggctcaggcccgacactctgcctataggactgtgtgttaaaaggcacagcacactctcttgtcatctcatctcttatacataaatgaccatttttcaaggaattagaataaaatgcactcagcactaaaaaaaactgcttaaacttaatttcagttaagttccttattaatatcaatgattactattctgaagggaggattgccatcttacatcagaggaaacagccccaggggaaggcaattaatcctcaagtcacacagctaatgaagctggggatgtgctaaatcgctaattcagtcaactgtaccctaccaggctcctctgtccatgggattttccaggcaatagtactggagtgagttgccatttccttctccaggggatcctcccaacccagggctcgaacccaggtctcccgcattgtagacagacactttaccgtctgagccaccagggaagtaagaaggataagatggctgggtggcatcactgacttgatggacatgagtctgagtgaactccgggagttggtgatggacagggaggcctggcgtgctgtgattcatgaggtcgcaaagagttggacacgactgagcgactgatctgatcttctgtcactccccacccttcaagactcagagacttcacacacaaatattaaagtctctagacatgaacattgctgcaaatcacaggtgttaggattattaggaactgtaattctctttccacttgatttttcaaatttctcaagattaaaaaaaaaaagtcagcctgcaatcttgcagctaagggcttccccagggc

SEQ ID NO: 28185 - DNA, 2029 bp, Bovine  19866880468243
acatgagtttgagcaagctctgggagttggtgatggacaaggaagcctggcgtgctacagtccatggggttgcaaagagtcagacatgactgagtgaatgaactgaactgaactgaagatgctacaatgtgggtgcatttttgtgagcatgaagaatgttaaggtttccagtcaccaaaggttgggggtatagtaagagatggcacacattttttagattcacgggcactattttggaatcataaaatgtttacctcatctatttactcatgtatgcatggaagaactaatgtttactgagcgcctactgtgtgtcaagccttgtgctaagcactggtgaagatcttatagagtttacagtctgtgatggaatctgtattttattttgaccatttcacatggcttgcaggatctcagttcccccatcagggattgaaccttggccatggcagtgaaagcattgaatcctaatcattggaccactggagagcttcctgaagtctaaattttaaaacaaaacaaataaacagccattggaaaatggcatgcaagcttcaaaggaagaaaccagaatccagtgatggggactagcagggtgaggaggaaggcaacctactggagaagggtgatcagggtcagatacttcaaagaagtggcatttaaggcctgaattatgcaaaggggactgacacagaaaaatctgccggaagaccatccctaaaggatgtgcaaacatcccaagaggaatagcttatgcaagaacactggtgcaggaaaagcttgctcaagcagctgaccaaagatcagcgaggtcggaatcaagaaaaaggaatggcaaagaggtagtaaagagctagtttttacaccggacaaaatagttgatgccaattgcaatggggagccgtttgaagggtttcgagaatgagagtagtgttatcggatttaggtttttagaatagacctgtggatgctgaatggagaatggattattagaaggaggcaagaggatcaggaaggaagatgtagctgtcacccaaatgggacatagagcaaagaaagataaagatgtggaattaagtgacatatatgtttattatatactggatgtagatccaagaggacttggtgatggactgggggaatctggaatagattgctggggaggaaaaaagcaagagatagagggtaacttccaggcttctggctggatgagggtattgctcagtagggtataagaaacctctctggggtctatagtggtctgtaacggccagtccttttgactcgattgccaaattgttggcccagagatcgttgagaggagcaacatttatatatttgtaatagctgaatctttaagaacacaagccaataatggtacaccgagctcttgggaacagcaagaaggctgacaaccatcagggtccacagtcgtccccatagacaaagcaacttaacacacacacatatgcctaaaacagcagggctttgtcaattactgatggtaaaccacacgctggatcttgaccaatcccaggctcccacaaaagccaacaattaaaaggtgtatcctcagcggatgaccagccactccagagacccctgtctccctgggggttgtctaacagctttcaaaagtacgccccagctctaagctcccgaaaacctggcccaggctctaggaagtgcttcaataatggatgatcgccaatgaacagccagtgatttgctggaaattatgagcgatgaataattgagagggagggagtctgaccaatggtacccttgcctcttgctgattctccttaatgcatttccttgaggcaactccctgcagtatagggtgcagacagcaacatgcccttccgaagatgctgacccatagctcggcgagttataaatatatgggcctctccacttttacaacggagtaacaacaggcagcagttcagcacagatgtgggggctgtccctgttcaacccacatggaccccacttgctgtggggtgatgcacagtcatccccaaaa

SEQ ID NO: 28186 - DNA, 4047 bp, Bovine  19866880493348
tgacactgattcaacttctgagaagagaggatgagacagataggggaaagaagagagacaagacacagagacatagagggataaagtaaataatattaactgaactctacacacccattttactcagtgaacatcttacgacccaggaaggcttcaggtgtaaaatgagcttctgttgttccccaaactggtctagttccccatgtgtctttcaaaatgtggtaatttaatcgattcgtcaaagataattttagataagagtttgggattaacatatacatgctactatatgtaaaatagataagcacagggaaccgcactcaatatcttgtgataacctataagggaaaagaatctgaaaaagaatatatatacatatttacatacgtatatgtataactatatatatgtataactgaatcactttgtgatacacctaaaactaatacaacattgtaaataaactatattcttatttttatacaaaaataatttcatctttaagagatatttctcactgacttcagactaaccccaccatctgtatgtttgttgggggcatgtaactgtattgtgtttatgtgggcatatgtgcaggcatgctcagtcacttcagtcgtgtccggctctttgcaaccttatggacagtagccctccaggctcctctgtccacaggattctccaggcaagaatactggagtgggttgccatgccctcctccagggcatcttcctgacccaaggactgaacccatatctcccgcatctcctccattgcaggcggattctttacccactgagccacctgggaagccctgaatgggcatatacatgctatgaatatctacaaacacatgtgtggatattgtaggtacttgttagtgtagtgtgtgaataaatcatgtctgtaagtaggtgtgtgttccatatatgttgctgcattttgtaccatgtatacagatattctttttttttaactttgtattttgtattgaggtttagccaattaaaaatgttgtgatagtttcaggtgaacagtaaagagactcagtcatacatatacatgtatccattctcccctaaactcccctcccatccaggctgccacataacattgagcagagttccctgtgctattcagtaggaccttatgggttatccatgttaaacacagcagtgttgtatacagatattttgtttggtgactgggtatatctacgctgagggcagaagtggatggatttaacacggatagtgggacactgcaaaggacagaacttcctgtgaagctctcaaatgtatgttgtcccttcttctgaacactcaagtgggttcttatagctgaatttattctttactgctgcctagaactgcccattgcgagtgcaggtgtgcatatgtatgtgcatctgtggatccgggtccataaacttggacttccttagttgtattagaagctgacaccacacgccgtgacatacgccctagatccccctcataaaggaaggattctactgtcactgttgcttgagagtgacgctggaagacggtcctctggactcagccctctttggatatttccaagatggaagaggggctagagcccacactaggtaactaacatcagggtgtaagagaccagactcctcaccccaacctgggacatctgtgaaggacccatctgagcgccagatgccccacgggctggctgaggcccatcctgggctcatgtcaaagctcagtttcttcctccacctaatcttggtttcccaccctccctttacagttattggccccaagtcatctccttaataaacttcctgcatgctaaatctccatctcggagtcagctcatctggagaagctcatccgccatggcacagcagaaaccaaagtctggaatcacggagtcatagtatggaatggatgtgaagggtcatccaattgagcctccctccccttcatttcaaatggttcattatcatggttctgagctcagactccaaagtcacgcacgggcgttcaaatcctaccactcaaaacagccatgtgacaatggacaagtccaactcttctgaatctcattttctataaactaagataatagtagtgccgacagtccagggttatgatgagaattaaatgagataaggcaggcaaagccttcagtcaagggtccagcacacagttaacacccaataaatattagcatctttcactaccttgttctgtgcttgctggtgggaaaatgtgtaggctagagtttcttgggaggcttaactatatttgataaattaatcacacaataaatgccataccaatgttccactttgtcagatttgaaattctcttaaaacaggatttgggcaccaaaatcctggcagctgaacaggaaaggatgtctgtgcttgccggccctgtctattcctgctacttctccagctacaagttttaaaagctcttgggtaacccagactcccatttagcatagtggaggcaggaagagagctgacagagagattaagccttcaaataacatgaagatgcatcagaaagtagggagaggaagtgaccagggagcagtaaatcattacattgcagaggaagggaggaaacaaggtccctcagtggtagccaacctccaagatgggcccccaagactcggccttcgccattcacatacttgtatgctccccttctctgttgaatagggctggctttcgtaaccaataggatattgtggaagcatcagagggtgacttccaaggctagacaaggcaacactgcttcctcatcacaccctctctcggatcattcatttggaaggaagccagctgccatgttatgaagacagtcaagcagccccatgaggggtccacctgtggcaagaaaactcctgccaacagccatgtgaatgaaccatctgggaagtggctcctctgaccaccatcaagccttcacatgaaactgcagccccagctgacatcttgacaacacccccaagagacaccttgacccagactcacccagctaagcagcccaaagtcctgacagaagctctcagatgataaatgtttgcctctaatttgggggtaataggtaactgctatatcatcacttctttttttagggaatatccattttatccaatttcactcattagcttgaaagtgaaaatccctcagttgtgtctgactctttgtgatcccatggaagtccacggaattctccaggccagaatactggagtgggtagcctttcccttctccaggggatcttcccaacccaggaatcgaacccaggtctcctgcattgcaggtggattctttaccagctgggccacaagagaagcccaagaatactggagtgggtcacctttcccttctccaggagatcttcctgacccaggaatcgaaccagtgtctccttcattgcaggtgaattctttaccaattgagctatcaaggaagccccctcattagcttaaatgctatgaaattgccaatgtttgaccatcttaaccacaaacaaaatggcagttccatgtggtacaatctctacaatgaccaagggaagggctcaagggtctggataaacaccagcctgtttatggcgtgatgcacactgttccgataaagaccgcagagtggctgtgtttctggaagccagtgccctgcgagaggaacatccttccagatcacctgcctgcacccatcccctcttcccacccggacccttgggcaagcaggaggacttcagaggtcctcccaacaactctgtctctttctcggtctcacggtgctgttctttacaagcccccaagttcagcaaagctccaagcccttaaaaagaagtagaaaggcatcttgcaacacaattagagagattggttcaggggcctcgcacacagcactccatccggcaaagcctcaaagggtcccgggtggaccatttgctggctttcatttctcaagggctgcttcagcaggtggccactagcaggtagtcaatagggaccttctggctgaggaccgggggctctttggaa

SEQ ID NO: 28187 - DNA, 764 bp, Bovine  19866880495178
ttttaattaaaaaaaaaaaaaaaaaatgaaaaactaagcccttagcaagatctaaataaagatgaaatctgccaactccccacgatgtacatggaggtggctctaagggggtgtagatgcagggggacccctaacctggaccccagtgttctctccccaaaggagactcctctgcggctccccttgccctggattttaaggtgggaggagggtgtgcagtaaaaagcaattttgttttatgaaaagtggtttccttttattacctgtgatagtcgaatggggggtgaccttagcaacaggaaattaacacagaattcattgggagtgataatgactgttcataatcattgggttgataagttaatatcattaattagtcagctaattagacgctgcctgaagccttccgggtctggaggctcagcttcaaaataagccaggatacagtgtccttgccgaaggggagcaagatgaatacacagagagatggagctggtccccaaagctacattccacatgaccaaaaccaaactctccgaacaaaaccagagtctctaaactctggaggttttcctccccaaacccaccccctatttctttttgtccctcaagcaccgagtgcaccttaatttgcttgggttcatatacctctgagaagctgaggaaactgtagggtttcctcccttaaatctgtatatatatatacaaagtacgaaatttttgtatatgatttctgggggatctgctgaagtcaggagtccagg

SEQ ID NO: 28188 - DNA, 1339 bp, Bovine  19866880526544
tcaagtatcatatctgcctactcattacctctctgtatattccgtctttttccttgtagggctgtgtcttcgggtttctgtttctctttgcaggtacaaccgggtatttctgaccctctcctggctcctttcccctgtattatctgtgtgggggtaattctctctgtctctctctcctttttttccctctcctttcctctctgtccttctttctcctgtgtttctttctctctgtgtctgggtgtgtctctctcatctccttctgtctttgcactctttccacctctgcctctccttctccccctgtgatctatctgcccccttcgatgtctcccaggaaagcccagttactccacaaaaccatttagcagaggaaacagcagcagtcaaggaaacaaggctcaggcagggaagattcaccctaactcagagccacagtggatgggtgaacctgtccaaagcctcagtccccttctgtccatcactaaggacgagactggcatcacagaggacccaggtcacttcaagtatctgaacgtggtattaggagagaaaaatactgctgatggggagattcccgggaggtttgctatgtggggggtgaagagcctccactctccctgagaaccttccagacacgctaatcaatttccagttcactcttccaacattactgggggctgccaagcccacactcacagattgatctccattgccaggtttcccaccagttatcacagccaaaactgtccccttggtgaaatcttggagcgtgtctacattttgaaactctgtgaaccaaacgaatgcacacacacgatgcaccagggtcttccggccacagccccgtccctgccttcaacacacaccatttaacctatcaagcctctgcatttattgagctatttcattaaccttctttcatctaaacttctcaacagatcagtgactaggattcatcctctttctataaactgagatgtcagaaaactgggattcggacaaacacagtgatttgtccaaggtgacacagccttgtgtcaccaaggtaggcatctcttttcacatgtaggaaagacaactggaaattcacctgagctttgtttttgcttttttttttcccctgacccctccactcacggaccaatcacctcagagctggattttgcttccaggccaagcatactgggttatttagctttcagaacctataccagtgcaaaaacataatttctcttctctagaaaactacttctcttttattttggcttgggaaatgctgttttctccttcatttaggggcaggagacattccggatatttaactttggaaggcaaa

SEQ ID NO: 28189 - DNA, 1686 bp, Bovine  19866880548068
ccgagctcccctgtactgcagcaagttcctgctagctgtcaattttacacatggtagtgtgtgtatatatgccaatcctgtcctcccggttcaccccccgctccctgcccctcccgatgtccacacttcagttctctatgtctgcatctctatttctgccctacaaataggttcatctgcaccatttttctagattctctacatataggaagagaatatagttaatataggaaccacacaattcaggtgccacaatctacctccaagaattccctatgcatttttatcgtatctcagggacattgccacctccctccgcactgaggttctagagctcttgaaatgccatttttaagggaaggactaaagacaaagaaaaaggaaacattctttgggctcctttcttttaatgttccatcaacgaactatgcctttggtctaggctggttgacttacggacggcatgggatgctaagacagccagaagagaaggtgtgctgttgcattagcacttcccaactagtaaggcacctacgacagaacaaacaacaggtagtgaatggagttgtccttgtggaaatctttagggatattcatcacaaatggtaactatcacagccaaagttgggagggaaagagactttgatcacacttaaaaaaatatatatttattttatttatttcttttatttggggtggcattgggtcttagttgtggcatgtgggcttagttgctccatggtatgtgggctcttaggtccctgaccagggatggaaccctcatcctctgcattggaagatggattcttaactcctggaccaccaaggaagtcccgatcacactttctgtttctatcccttcttcctatttttttccttaccccttccttgatcagtgatacaagaagacagcttctttggtctttttgtccatggctgtttataagtatggttaagtggttactaatggaaccaccaggtatctccatggggctgagggagtcttgaaagaaggtagatgagttggcctgagagttatgggctgtaggaatgcagaagggggatgtatatctgagaggtacattgctaacaaaaacggactgggctatacatacaggtcgggcagaggatggagaggaaatcttggaactttccagactgacaataccctctaactggactcaaacatccagtcacctccccccattccagacccccagagcttattttatcatttgctaaatgtacagaatcgccactcaatattcaaggacaaaggtctttctgggctttcctccctcctcatctctcactcaaggaattttgcagataaatcagcacgttaatcccctggtctgagagttatgggctgtgggaatgcagaagggggatgctgaaatgggacttgggaacagaaggaaactttggatgagaaatgaagggtgaactcacagatggggagcccaccatcaggagaagagagaagtgggttgatttcggacaggtggcaataggaatggtcatttcaaaacaatgtaaggtgaacaggcagagagagagagagggttcaaggcagtgggaaagggaaagagggagttgattgcttaaggagaagaacagaaaaagaaagctctgttcccactgtgggtgatggtgagaggtaaccttacaagatctgatggggcc

SEQ ID NO: 28190 - DNA, 704 bp, Bovine  19866880568355
acacacacacaaacagtgtgtgctggtataaattagacattcaaaatcatcaagaatcttgtgacacatatcaataattcctatttataattttataaatgtctcaacagagacatacagaaacaattttgattacatgacataattataaatgcagattttggaaggctgaaattgatcaacattatctggattgacaataagcccataatgtagcataatggatttttaaaatgcggcataaatctgcttaaaaaaactagctaggcagcccaacatcaagacacattaaaaagtgccaccagttcctcctgggctgtgactttcatgccagcagcttgcagactcagcaatgcaggaaattacacagtgcgtgccttgctgtggtacagaaggtgggttcatgggatcttgctaaagtacatctctattcaagttgtctgagtgagatgattttctattctttaaacaagaatgaaggtggaaatattcaaccagaatttatctcccaataggttgaaccatttcatggaaaaggtacaaaaagcctgagttgaaggaagcacttttttaagcaaaggcagacagatggagctgctgatggacagacagaccttggttacatcaattagtcagagctattcattcttgtgattctaaagcttcgtccctaggaaagtgggctgcttttgaggctaaagcaa

SEQ ID NO: 28191 - DNA, 1707 bp, Bovine  19866880586254
agggcaagaaagtacccaaaatgggaaggtgcacctcttctcacatcctttatgagtcctgaaatgaaggctcagagaagtcaatcatctgccttatgtcccacagcaagtgactctcaaatcaagttttattattactattatttattttttgtttcattttgcttttctttgctgcactttacttggtttgatttaactatattttagctccaaagtgtagctccaaagaacaaaaaaaggctgttggagatctcctggcccatccccatcactcacatgtggagggggggccacccagagaaggtgagcccttaaagaaatccagagagattgtccagattcagctgagcatcctttctgctacaccgtgatagattcacaaaaaggattacccgtcacagatgctggtctgtctagagcagctccatcagcaacaggccacccaaagagcggggggccccattacggcccctgctttccaatttggtcatctcacccccactagccatcatggccacacaggggttcttgcaggggtggtgaagacatcccccccaaaggcagaggctcctgaaagggagtcacctctcttctcccctcttccaaggtttggctgtgtttactctgttcacaaagtggcttcctgtttcgaagaggaatgagctttttaaagggttataaatgtgactcaaaaggctttttggacatcaaatggctcataaaaaaagggaactttgagacaatttcagcataaatgaatgaaaaacatacggtgtgtgtctctaacccttctgttgcaccagagtgtcctggcaagagaggaaagtagaagtggccagtggtttgggtttcactgtatctggaacttgagtttctgaagtccaaaaatgtactttgtaatcccagaccagaacatatttgaggagagagttcacctcgtattaaactcgttaaaaataaaattgaaatgagggaaagtatttccacagacatttttaaaagtctgttctaactgtctcagtgatttaatttctatcataggtttccttttctttttttttttttttttctggtgtttggccatgcctgtgggcttatggatctttagttccccaaccagggatagaacccatgccccctgcagtgaaagtgtggagtcttaaccactggactgctttggaattccctatcatacatttcaactcattctcctaaacctggttgctcagtgtcagcatcattgacatttaggcagatgattcttggcagtagaggccaaggcatcgtagcatcctgagcagcaactctggtctccactcattagaggcccggagtgccctcccccaagctgtgatgatcaaaaatgccaaatgtcccctggcaggcaacttgttccccgttcattgaaaagccattgtctaaagacataattcacttatctagtgtgttccagaggcaataatgtcgaagggtggaaatcagtgactagatgaccttcagggaaagaaaacaaaattaaattataatgggacaagtaaaataaaatcgtttggtttctgtatttccacgaaaggcatgtgcaaattatcattggccatataatatcttttgcagtagggttaatcctgaagggccacttagccaagccgcacaaatgtcttccctccttccctcccttcctcctttctttctctttcttttctt

SEQ ID NO: 28192 - DNA, 1110 bp, Bovine  19866880599121
cagaccaaaaaatgaaggcaaagtgatggagtcctgtaggtgagctccttgccttccatcagactctcaaaggaatatgggccccccccccgccaagtttttgagaaactgttacatcttcgaagttggatgagaacagatattaaaagtgatgagtcataagacaaaccaaggaaatatgcacttccccttgctggtctagctcaccaatgtgcctgtcattgaatgaattaatgaattgaataaatgaactgctgccatagaggaaacatggcacaatgattacccacaagaatggggacatgccaggaactgagagtccatgttaaatctcaattacacataaaaccaccttcactgaacacccagtttcccgaacataccacgtaatattgtaatgcctgacattttctgcagagacagaagttccaaggaggaacaacccatcccacgccagaagcaaggaaggatcaacaggttggaattgtagagtcaatatttaaacatgggaagttcaatagctgttaagtaggttctgtaacaggctcatttttaaaaatcaatactcttactaatagcaagatgctagccttcagtggaggggaggcaactcagttgaaatcattttttgaatcagaagtcaataggagccagtgtctcagacaagtctcaattggtcaaagaaaaacacggtcatgcagctgtctcctaggtatttccatgaagctgggtctgggctgctgaagctgatggggaccacagatgtgacttgagcaaggtggagggtagaagctggataggagcaacaggtaagacaaggagagagggaatccatcacttttctctgggattatttcagccatcaagcacttggatttttaacctggttgaggataatagctgcaggaccttgaggaagaaaggtaactaccttaactgtgacagaagcctgagcgcgttccctacctctccttggtctgaaccatttcaatgcagtcaggcttccagctgccagcacctggtctcagcctgagggctctgcctggactcagacactgaatgaaggcccccacaaagtggccggcaaccactgacggatgggagctggct

SEQ ID NO: 28193 - DNA, 889 bp, Bovine  19866880616030
tgcccaggttcagagcacttccagccgcctgaaatgtctccccacagctgcccggagtccctacacagctgtctcagccttacacaggctgctaggcctgccatagccccagtctgtcctctgacatttcccacgtgtgcacaaactattaaccctttgggaagcagcttggcctgcttgcagtgagggatgggagggggcagggaagtagcttcatattggagggtacagactcaactcatctgcagggagtcagttcccatccccaagccatgatctctccctagtcttgggggagggctggctgtaaaacatttaagagacatttcaactctgaagctaaaatcacagcccctggaaaaggcccccagagtctgaatgcctagggctagagactcatgtctaccacctacctaccagctgtgtgatcttggttaagttactcaacatttctgagctctgctctttcatttagaaggtggaggtgatcataggatcaccgaaaaacagaatagatcaagcactgagaagagcgtgcctggcacaaaggaaatgctgtggagagttattatctattataccacctagttactctgctagacacagcccttaacttagggggaaaattgttttcttaagttttgagggggtgggtgtgaggttatgatgaatcagtgaaataagccttgcccctagtaataataataagttattattaggcagggagacttggtgagggtctggttctaaaaggcaggcaaaggagagtgcatggaaggaggggctacagaggcagctgataaatacctgagaggccagaacgtgctgctgaacatggaagggcagggggccgacgcccccgacagtccctgcgccgcggcagccgagg

SEQ ID NO: 28194 - DNA, 421 bp, Bovine  19866880626840
agcggtgcagctgtgctggggattaaatgaggaggacagatctgtcttcgaaagaagggagaatttcctgtgctggtctgttgagatacttgctttcccaccatttgtctgggtcagatcccacacgccccctcaccctggcctcctccttctcaatagccagagatcgaattaagcatccacacacggaactgagaagagatacggacacacattaatgtcaagatctccagggtgcgttgaagataaatactgttcctctcttcccattcctcacaatgtactccggggatgccccgtgtttgtttctcagctgtgccagcaggtctgggagagggtaccccgggagagaatggatcagggtcatgtaacatatcgctgggcggggggaggggggagggtaatggcccatcactcagca

SEQ ID NO: 28195 - DNA, 2738 bp, Bovine  19866880642784
aaaatttattgaaatttcatgagatttttaaaggggtggggggagatacagaaaaccaaagaactcatcaacaattataacacaaaatataccttcatgaatttttgtctttaaaccatctctcagcacctgactttttaactgtgaatatatgtctctagaggcaccaattcaaaacatcaacactgaggacagtaagtagtcaattccactttgttttgaagaaatcagagactagcaaatacaaataggaaagaaaaattagaaagtcaaaccacagcctctgcactctccatccccccacccgccccaagcaatctcaaaaacactcttaggaatttcaggtggggctaggaagtggcaccacctccccagttttcggtaaaatggcaaatagcactttcccccagttttggacattagaaaagaaattttctttgcagatgactcttttgaaaactatgttggtgtcggtgcagaaagtgtgttttctacttttaaaagcgatcctgtgaccttgaaataaaactgactataggaaaacaaaaccacaaaacctgacagctgcaatcctatttacatagagctatatacaatgtcaataaattaaagtttaattttctgagcattcatattccacctatttacaagagttatcaaataattacataaatactttgtctaatagtctcgcttcttctttatttttttttttaaaaaccttgttattgcatatacaggaaacagaaaagaactgccagagggacaacatgaatcctgctacagaacttagataaaataaattcatttttggtatcttccccatcgcttccttttaagccatcccccttaaggttgtcaatgttctaggaaaagataaggggtcatattttctctctaaaagcaagcattcaaaaataaaacccacaaatacattactgtggaacatgcaagagacctagagctcttaaaacatcacaagaattattaaaaagacacagatttccttaatagagactaaacaagaatggcagagacttccctccccaaacaatgctgcccagtaatttatttagaactgatatgcacgtcactagaaagtttttaatcttcacgaacagaatcatgttaatgtatccatttgtccccagtatttttttttttttcaattttgtgtttccacttgggacggtgaaggaaaaaaaaaaaaaaatatatatatatatatatatatcttcactgggggagaaacttttcaacacctcccctcctggggcctggctacctcagatcttcccacagcttccagaacagcccccaaggagttgctctggccgccaaggctttaactcctacccccaacagctcaatgcaactgggacgtttctgagccagatcccggatgtataaaccacagccaagaagacagggcctgtttctagcacattctctccagggagtccagcacccctttcccagacaaggctgcacaaaaaagggctgacctcactgcacgcccggggtttatgtgacatcccacaaagtgcactgcagactggattggactggaatgaagagacttttctggggaggggtttacggggaggcgctgcgggacctgtcgggcttggcttccaggccgctgaccaaccgctggatgttctgcagttcgctggtggccgcctccttctccgggcagagtttgggcgacaaggacacggagctggaggagagcgtggaggagcggctgttgagttccgagcccgagtccacggccaccgaggccgggcttggcggccagggcggcggccttgccgtcgagggggcccgctgcggcggcggcggcggccatggacggcagggcggtggtgagcaggccgctgctgtccggcaccggcagggggatggagtacgggctgtagcgcagccgcgggcgcatggtgttcaggttcaggaaagggtggcggtgcacggagctggaggctgccgccgaggaggcggccgccgctgcggccatgtacgtgtagggataaggaaacaggcttccgaaaggcgacatggccaggccctgggcaaggaggagaacaacaggacagagtgagcaagcggggcctgcgcggtggggaggagccgacctcatccaccacccctcctccaccccctaccatcccctcggatgagtccttaacctcactccctgggatggggcggggtgggatggggagcaggacgctccaacttctgcgtctagacccaaatctgagctgtgttactctaagccaaagtactccctaggcctcagctttcttgtatggcaaaaacggaaaagttcaacaactcgtattctttcgggggactctgtgggtatgaaatgaactgctgccgcctgcaatatgcttcacataaggtgcttggccatcaagactgctggaaattctcccatcagtcagttgttccacctgttaaatggggctacagtctaccccacaaaagtagctggctgaaaaccagagggcataaactattggacatatatttccaccccccccccaccccgccaattcttgttgccccacctcacagcccttccactccattctagaagtttctaaaaaaataaataaatctggggaagatccttaagcaaaaggcaaaggggtgagggcaagttggaaggggagagagtaaagggtatttgctatgaacagagatggagaaatcatctagccccagatatg

SEQ ID NO: 28196 - DNA, 1415 bp, Bovine  19866880681131
ccccacctggctccttccctgcccgcccagcctacgacaccccctaggtcccctgtctccccggaggaagttaggcctgtagcccggcttcctgctattatgccatttttacagcctggacttgatttatgtgttacccttatggctaagaatatgccctgacacttgaaaggaacttttattattgtcctaatttgtgaagaattagttgttgctttttttttttctctttcccttctccccttttttctctgcagggtcaggctggagccctgttattgttgttaaatttagatctggaactatattgggtccggcctggtgtctctgtgctttcacttcttaaaacaggaaggaaggccccagctgggggctttcggagcgccaaggagctgttctgaaggccttgggggaaatgtgtgtcagtggaaatcactagaaatgcgtaggagggaccggattcagagagtgtctttgcgtggttgagttgaaaaaaaatttcccctggaccttgtgaatatcccagtgagccagaccgcctgttttggtgggtgggagccttactgagggggttcacaaaatcccagctctgccactttctagctgtataatttgggaccgataacatctgctcagcttccgccttgcctcagtttcctcatctgtaaaacgggtatagtgatgttaccaactggttggcttgaacagcagaaatgtattctctcatagttctggggactacaagctgaagattagggcatcttcagggctttgctccctctgaaagcaccaaagaagggcatgtttcaggcctctctcttagcatttagtagtttcttagcttgtggcagcatgacttccatcttcacgtcgtattgtccctgtgcgcatgccccgtgtccaaatttccccttttgataaggacaccagtcatactagattagaggcccagctactgcagcatgatttcatcttaacttatgatatcaacagcacccctatttccaaataggctcacagtctgaggttctgtggactcagaggttctgaggacttcagctatgaaatttggggtcagggtcattattcaacccataacgagaggcaccttgtcataaggtgttttgtccaacaagctgaacacagctagtaagtggtagggccaggatttgagccctggaccgtcagatgccatagctcatagccacaaccatgacactgaaggcagcagtggacgtgggcactcagagctgggtcccagtgctgtgtgcttggtttcgagttggcctagaaggagaggatggttaaagatattgaaagaggagattagaggcaggtgatgaacatcagaagggctggctcttccttaacacacaaatgaaaggagaaagtgcatcccctgagaagacagcaag

SEQ ID NO: 28197 - DNA, 1386 bp, Bovine  19866880705734
aactgggctgcaggcgaggctgccccatgcttcgaagctgttcgacttaatacacccctggagtgggttcaagctctcttcctgcttccttcccttaaaagaagaagaagaagaaaaaaatgccgttttgaattcctcatctttggagagagatgggagcacacagttgtgcatagaaaccctctccctgcacacacatctgttatacacattgccacggtgtactctgcttgttcaacaatgaacaaaatgatttcctctcattacttcccgtgttgcttcaaaaccgcactcggaaaactaaaaccaccgaggggagctcagccaatcaaacctccttgctggccccagtttaggggcttgggggtggcgggcaagggggaggcaagggggtgcagggagctgaggtaacctgtggacgagggaacagagccgtagttgtgacggatcgctgttgcttcctgtgtgtctttttgtgtgtctgtgtgtgtgggtccgtgtatatgtctatacaaatgtctgtggggctgtctgggtgtctgtctgtctgattatctatttgttgtgtcaatttatgtgtcacgtgtcaatttattttattttattactgttttccaactttattgagatattattgacatgtgctccgtgttagtttaaggtgtaccatgtgacgatttgatgcctgggtgtattgggaaatgattaccaccccaaggttagttggcacctccatctcctcatataattgccttttttttttttttaaatgtgtgatgattaacacttaagatccactctcctaacaactttcaagtatgtaatacagcagtgtcttgttttgttctgtttttggccatgccactcggcatgcaggatcttagttccccgcccagggattgaacctgtgccccctgcattgagaggaagtctcagtataatagagtattgttaagtatagtcactgtgctgtacattagatcttcaggatagacccactcgttcctctgcacgtgctgtatccctctgaggaataaggtcgttttgtggtggttcagacggtaaagaatccacgtgcaatgtgggagacctgtgtttgatccctgggttggggagatcccctggaggaggtcacagtaacccactccagtattcttgcctggagaatccccagggccagagaagcgaccccagtccatggggtcgcaaagagctggacacgactgagtgacttagcacagcaccacagcagtgaatgaagaaatggaggctcagaatggctaagatgttcgtctaaggtcacatggctagtaagccataaacatgggatgctaacatggggtccctctggcttcagggacaatacttattaccactacagttttg

SEQ ID NO: 28198 - DNA, 1264 bp, Bovine  19866880707940
ggatgggggtgggcgccttcctctagaagccttctcctaagcttgagcccagcaataaatcacccctcaagtatcacacactaccgtaaaccacagatgtgggaggcggggagggaaagaaaattgagcttctgccgctggagagaaaacaagattgaccaagaacttggaaacggggtttgtttgaggaactcaacttgacctccccccacttccgacagcctttagctgggcatttcagggctgataccttttgagcaggaagcaagtttctcccgaaggattttttttttttacagtcacctcccccccctccatctttccatcccctgcaaaatcgcatagcatttgttcttaatctttcagggggtgaaggttccctttgaaaatctgatgaaagtgatggactcttcccttcattatataaatgattattgacttgtgctaaagcctccaaaaatggttaagactggtttatggggggttttctaggaaaataaagggctctttcccctcccatattaaaaaaaaaactttaaaaaatatattgatttttttttaacgttgaacctttttttatattgaacctttactgatatctacatactgaagagcgcacagattattaagtatttggcttaaggtattttcacagactgaacaaaccagtgtaacctgtgccccagtcccataagagagcattaggtatctggaggtttccttatgtttcccaccagcaactaccctccacctagacttgccactagcttggcttagaagagccagattcgcagcctggacgagacagaagtctgggggagagtgggtgcgtgtgtaggtatagctgggtcgctttgcagtgcacctaaagctatcacaacattgcttaatgggctgtgtgtgctcagttgctaagtcatgtccgactctttgtgaccccttggactgtagcccgccagcctcctctgtccatgggattttccaggcaagaataatggagtgggttgccatcttcccttccagaggatcttcccaacccaggatttgaacctgtgtctcctgcagctcctgctttggaaactctgagtcttaactacctgattgccagggaagtcccagcaggtactatttttgagtctcatttttcagctggacaaatttgaggatcagatgaagtcacttgcccagaattacatttatgtgagttactgggagattacgccgtggagcaagcttgacatgggcttttgacatgacaagacta

SEQ ID NO: 28199 - DNA, 1402 bp, Bovine  19866880814693
caaagaacctcgtactaaagaacacaagataacattactaatatatcattatgaacccctaatgaatgaaaatattattcacattttcctgtgattttatgcttggttatgaagcatttcaaggggagagaatgagagagacaaacactgtggccagcattgttactttgacgttacaaataactgtatttatgatggtattatacagttcatatatttccctctaatagtgccaataaaaagatggcattttcccagcgtctgctctctgctcatgttttatgtcttactttcctcaagggtctgtgggctcttaagcaaaagagctaatttttcacagtattagaggggaaggaaagttggctttctctctttctacactaaactgctcttttcctattagtcttcacaaggcaaaatgttgttccttaaaaagaaaagtcacacacacatgtacataagagcttgcattgttacagagttcttcctacctacccagcacctgggttttatacatatcacttcagttgaccttcaggacaagcttctgagccaagcactctaagggtaccccttttagggatgaagagatggagattcttaaagagtaagttcccccaaagacactcagaatgatccaggactcaggttcctcaaagtcaatgccctgaagaggatgggatgttatggagagagcagcatggaaacatactgattaccagatgtaaaagacagccaatgggaatttcctgtatgactcagggaactcagactggtgctctgtaacaacctggaggggtgtgatggggagggaggttcaagacagaggggacatgtgtatgcctatggctgatttatgttgatgtttgaagaaaccaacacattattgtagggcaattatcctccaattaaaaataagtaaatttaatattttttgaaaagtcagtgctctgggtgacactcttgcttttctgtccttttgttttctctcactgttaagattttcatttattatgatggataagtattctaactggcagcagaaaactcagtctcacaaagcctttaacaagacacttactctttttgttttctctctttttggttatttattcattgactttatatttttattgtttttttattttgtaactaatttttgttggagtatgatagctttacaatgtagtgttggtttctactgtacagcaaagtgaatcagctagatgcttacatctagcccctcttttttggattttcttcccatttaggtcaccacagagcactgagtaggctcagtgctgatacagtaggctctctgtatctctgttattttatgcctagtactgatggtgtatatatgtaaatcccaatctcccagtccattccacctctcctcgcc

SEQ ID NO: 28200 - DNA, 1260 bp, Bovine  19866880816350
tccattggcaaaatgaagaaatacaaatgagcagcaaacaccaagggaaaaaattatcctcatcattcaaataacctgcaactgccctgtggtggcaaaccagccgctgccacaagcattgggcatccaccaacttgtttcagtccttctgacaactctcagaggcagtttctccacgtcacagcacagtccaggaaaccaaggctcacaagggttaagttcctggtccaagatccttgctgctaagtggcagacagaggaagaaaggggatggtgccaactgacgaattgataacaggccgagtttgcagctgacaaaactggccttgcaggggtgatttcacctctctgagcctgtttccctgctctagaaaatgaggattgcgacttccctggtagtctggtggttaagactccatgctcctattgcaggggcacaggttcaatcgctggtggaggaactaagatcccgcgccaaaaaaaaaaaaaaaaaacacccacgggggtggggggaagtgaatgcactcaaagagttgagctaataatcattaaaaaagaaaatgggaatggaataggacgcacgtcacagtcgcaggacgtttttagcaagaaaatacatgattaggacagtgcattcgtgtttatttaagtaaagtgcaataacagtaaactttttactattgatttcgagatcccaaggacccaccatactgagtctccctgcctgcacccatcaggagttaggaagggtccgctcctgacaacagaggtcagaggccccacagaaccaggctgagaggcatttccccccacaaccccatcctcctttgctggcctccgaggggacctcccactcactcacatcccagcctctggggaagcttctggaccacaggggctgatcaatgatggcgtatttgctcaactccacgcccacggtccagctggagagacaccctcgggttcaaggctaaaggcttccaggaaacgcagccggggcttgaagtcatcagtcattcagtaactgcccccttcgtctctggggacggtctggagctccggcttgggacgttcccccttctcgttcctggggagcctgtctgcttcctctcgctctcttctcaagcagtggctgcccgttgtggctattactattatctttgtcactattgattgagtgttcagggctccatgcattttctttgagtgtccagtgctttacatgcattttctcatttaattctccctagaactccgagt

SEQ ID NO: 28201 - DNA, 1018 bp, Bovine  19866880893922
aaaaatacctctgtttatgctgctacaccttacatgatgtccaaggcagacatcgctaatcaatcaggaccctcctgcccatagagcctgaagaggttccagtgctcattgctttccccgcaaagctccaggcagccactacaatcaatcaggaatggaatatacaatgaaacccatttatttttactatctttgcatctactcaaatgccttaaaggctgagatgtatatttgattcttctttacttatcccctgtccctcaaggcaggtctaaggctgagactttcctcgtgcagtaggggaattaactgttctgtgggaggccaagtctgagcccatctgtctgcccacagggctctacttattgggctttggaaaaggggccaagactcctgaatcgaggagaagagaaagaagaaaacagctccagttaagtgtccctttctccttttcttctctctcctcttgcaaaaagaaaagaacaataccagccagctgaaagctcattaatgcacttgaccttccgaaagaaaattaattccaacttcacacctaccggctgtgttgctcagctttgtcaaaacgttggcatcattagagaggagatgacatggctggagggctccgagagtctgccacctccctacgctgggctgagtgagtaggagctggcaggaagcacgcggaggcgccggccctgtcagcttttcactgtggattaagctctctgctgttggctctggaaattgttatcactgtcgagctgccccagtgattcttaccaggctccctgacagcacaggcccacagagcagcagccttgagggccttctgttggagggaaggcagactgtgtgtgtgtggggtggggggggccgggtttgtaggagaatgtgtgtctgcatgtatcagtgtcagcgtgtatgaacatgggtgcgtgtgtgtgcacatgaggatatgggcatctgtgtgtgtgaatgtgcatgcatgtgcatgtatgtgtacagctacactcaa

SEQ ID NO: 28202 - DNA, 1078 bp, Bovine  19866880901321
acatatgtgcttttctctatgtattttcacacctgaatcaaaaagtatatgtgttgatggggaaacatattaagtgaacacatttggagaatcagacaagactgtcttaggggaaaaaaaaatccaaatgggacaggtttcatctccttcccaaaccctgcagtggacggtttatgagcagctttatttaaaggattcttacagaatcccccatctgtttctaaagctgcagaaacaacaactctgcaaggcaatgatcagattgaggacaacacactgttctcagcttctgtacaaacacacacacacacacacacaccccaaacagagatgtcaccaggcctgtgttgaatttcctgcctttgtgttctccggggcagccctgcggaggggaacacgctgcagactgatatgtgaaatgaaccaataggcccagttgagacttctaaaaacaaatagcccttttaatcttctggaggggggaaaaaatcatttacatgggcaatgatcaagctcccttctttgcacccatttcatggcttggtctcgaacctctttcctaaatccttgtcacccataccaaccctgtttccatccagaggactccagattacgatccttctgccatttccaggtctttttttttttttactactttaaaataatttaaacatttatttattttcattttggctgtgctgggtctttgttactgtgtgagcatttctctggttgcggtgcgagggctcctcattgcggtgacccctcttgttgctgagcacggtctctaggccatgtgggcttcactagttgtgccatgtggactgagtagttgcgactcctgggctctacggagcacagactcaatagttatgcatttagttgcgggctgttcttaaaccagggattgaacctgtgtctcccgcattggccagcgggttccttaccaccgagtcaccaggaaaggctccatttccaggtcttagggaacagccgcacagccacggggatgccacaaacagaggtggtaggtgttctactaggttccttgaatgttcgcttcagggaaccccaagga

SEQ ID NO: 28203 - DNA, 2438 bp, Bovine  19866880965934
atgatggctgtctatactgtgaatatgaagttactgtctaaaaataaaaatgaaatatacatactgacatggaaagatgcccatgatgttaacaggaaaacaatgcaaatatcagaacaatgagtgtagcgtgtgcctattttgaaaaataatagtcattcaaggactgctgtgggtgtgtatatgtgtgaatgtaccctcaaaaaagaccatcaagatttaccccaaatgttgatagaagttatctacaaaaatgggagtgaggcttgtagagagaagacagaagtttcctttactacttcattctcatctcaatcatttggattaaaaaaaaaattatagtgaacatagagtcattctagaatacaaaaaaaaaaaaaaaaagagcaaaaacatgaaacctgctgtcaaaggtgtgttttatcattgctgagcatctggaaatgacctcggagacagacgaagctggtccccgtctccccaaaggggtcaaggatccacgcagacgagtcggcaggaccgaactctcacagaccaataactatccatcttgatctccgagtcaggaagtcacttccaccacctctctcaataactcattccagggtttaataacctttccttgcaggaagttcttcctctcatcacagctgagtccttcctgctgccccgtcagtcctaatggatgtgtctcctttcccctcccccactctctggagtcagggacagggacaggatcccgtggagcttctgctgtggcccctctgcatcatgccccaacgatgctcttaggactttggcacggcagtgaccataactgtctatgatgatggccgagacggccaaagcctctctctgcagcccaaagggtccccagggcccttcagtctgcccattccccgccactggatgctgcgttctgcataaactctgcctccctggcctctttcctgccatatttcatgcatctcgatggtcactcaggccaagatttacggaattcatatcctttcgagctggaggaaaatgggaaatgcaagatttactatgcccctaggaaaagctaggaagacatggacccaggagcctgggggtggggcgggggagtgggtgcagggatacagaggtgagctagagacacagccatttgtttggtcacagcctcatccagatggggcctggggatctgccattgctgacagcaagcatgtttctgctcgagtcttctctcctctcactggcttctctagagtgagaggcacaggactaagcaactgtaggtggcaaaacaccaataagacagggctcctgcgttccccaaacttgagattcctgaaaaggggatacacagttacatccaaaattccaatccaaagcaaagatgttttaaacttctcttggggtagtaatgaaacatacgtatttggaaattggtagagtcctcactttgtggcttattagcaggaatgtttaagcaagttacttgaacctggctgattcctactttccttatctgtaaaacggggttggcaactgcactggactaactgtgtgggcaggtaaagaaatgaagcccatgacggctttaaaggaaatgaagcccacaacgggctttagaaccagactggccaggtgtcattcacagcactgtgactccccagctgtgtacccttaggtaggacagttgacctctctgtgcctcggtgttcacacgtggacagtgggaatgataccaacttcacaggacgaatgtgagttggtataggaaagaggcttagaacagtatctggatcataataaatatcctatggcttgcagtcaggatgaacacagtgaagataaaacgggtggaagataaatctgaaagtgagactttcctggtggcccagtggttaagaacctacctgccaatgcaggggacacgagtccgacccctggtccgggaagattccacgtgccacagggcaattaagcctgtgcaccaccactactgagcttgtgctctagagcctgcgagccacgactactgagcccatgtgccaagagcccatgctttgcaacaagagaagccaccgcaatgagaagcccacaccccgcaaggaagactagcacctgctcatggcaactaagactcagcacagccaaaaattaaaaagaaaaatctgaaagtgtgaaacagcatcagatcactccaacaacatcaaactgggagttagctcgacatgggtgagtgggttaatagctcgagctcgtctacaggtggtggtgcatatacaaatggcataaatatccacttcagttcattagcacgtgtgcacattgctgtgcatcatacattatgtctccatgaaaaacaaaaacctctttaataagatatttttaataaaaataagaatgtggttatcagggggtaagcaggggggggtataaatgggaga

SEQ ID NO: 28204 - DNA, 999 bp, Bovine  19866880982750
aaaatcaagcagctgactgagtccaggtccaagcaccgtggaagtgagtgcacagagcaaagcatgcattcacattccacgatggttacgtccagtgatgaatggaccagtttcttgacagagaggaagttcctataggttggggtgaccttcctagcgatgtgtttatttgacagcccaaggcaatgaattcacagagaggaagagaggagaggaggaaaggaagggaaagaaagaaagattatttaagcccaagagcatcttctccggtctgaaaaaaaacaaaagtgtaacaacaaatcatataagcagcttgagaaaaaagaagatcatcagagactcaaaggtcctgaggagatattgaagccaggaaatgcgtgcttttgtctatcttagtacttagggccactcattgttactgttcaatagctaagttgtgtccaattctttgcaaccccatggactgcagcaggccaggcttccctgtccttcaccatctcctggagtttgttcaaactcatgtccattgagtcactgatgccatccaaccacctcatcctctgtcacccccttctcctcttgcccccagtcttacccagcatcagggtcttttccaatgagtcagctcttcatatcaggtggccagagtactggagcttcagcttcagcatcagtccttccagtgaatattcagggctgatttcctgtagaatggactggtttgatctccttgcagtccaagagactctcaagagtcttctccagcaccacagttcgaaagcatcagtttttcggtgctgaacccacctggccccataaatactccagaattatttgtgaaatgaatgaataccaggatgacattattgccgactggagctcccagcgaaggtgttgcaggttaaatgggttgtgggagatggggaggatttggatggccagaggagggaaataactcaggaagagcatcagctttaacaaagatcctcacaagagaat

SEQ ID NO: 28205 - DNA, 1132 bp, Bovine  19866880991340
tgttgatttagttgcttcttttatcaaatgttgaactctaagaaaatgaagggctatatcccagaattttggaaaaggcatctccccagctccaagtaaacatggggctctggacctagcatcatcatattgccaccctcagccacagtgattggtccaggcaggagcatgtgactcagactcggccaatcaaatggcttccctaggatttttacaagggaactggtaggaaagactatgtttgttttgtttactcaggtgtggctataattccagcttcgtggtgggagctggctttgaaaaagagtggagacagaggactgcagggtctgagtccttgattctgggcatccctagagcctatttcctgcctgcctttttctgtagttcaacaggagaattattatctctctacttccctactttgatgaatgtcaattggagttgattttctgtcacttacacccagagtcctcatgagtgtatcctgagtaattatcatgacaaataggtggaaaataactagatactgtgctaaggccatttatatcagcaagtgtgggactcagctcagacttaggtgggcaggggtagtggcactgctagggggattgaatatcacagtaggtgaaagtctgggcttttagagactaaaggtcttaggtttaaatacaggctgcagttccagactagctggataacactgggcaagttactgaacctttctgagctcatgattgtgaatctggtcagcaatggaaagggccctgcaagatgatatatgtctgagtcaaaatacctggagctggaaagtatctaaaagacccctgcactctcctttgtgctggaaacttgcccccatcatcttttacttcacattcatcagcaaggctggttgaaagtcccctctgtttgtaaggcactggggaatagcatcaaataaaatagacaacaccccggctcttttgaagcttacacttataccttatgagtaacactgccttgaggcaggaggcattctgggtgctgtgggtgcatttcggagggacctgagagttccagaaaggctaccaagggaaagtgatatgtaagcggagatgtggacaaaacgtgtagaaataggctaggtaag

SEQ ID NO: 28206 - DNA, 701 bp, Bovine  19866881043310
tatggttggcctgtgcctttatggaatccccactcagaggtgtttttgccaacactaattcagggctgtgagaagaacttatttgtggaagggtatttgtttttccactgaggcagccaaaaccgccagcctcccttgcaaaggaagagaagagagaagaagcatttgtttctcgcgatcgcaagcggtagcccgacaaaacaaaacgcttcccgggagattccaagcaggttctgagaatcacgtactgagactcaagtgtgggtgcgttttgtcctaatccccaggacccagaacctcacaaaggaaactcctgatgcactgaaggctgaggtcaggcccttctgctcctctagcagctccaacagccaatataaataccacagtcctgccctggacacccttcagtcctctggagctaccagaagccaagataaagcaaccgaaacccatgctaaatgctggggagacaaacctcagcactgaacagaaaccaaatcaaacaagcccccaccaacccattgaaaatgatgaagacagaggtgtttcattttttttctttcttctgtgttttttttttttttctcatcattaagtcccaacgaatgaagaagaaagggactgggaacaagaggggagaaagcctgtctgtctttacacaaagaccttgaagtctgaagcctctcatctcagggcatgtg

SEQ ID NO: 28207 - DNA, 1672 bp, Bovine  19866881046014
tcgtgtccactctctgcgaccccatggactgcagcatggcaggcttccctgtccttcattatctccctgagtttgctcaaactcatgtccattgagtcagtgatgccatccaaccatctcatcctctgttgccctcttctcctcctgccctcaatcttttccagcgtcagggtcttttccaatgagttgactcttcacatcaggtggccaaagtattggtgcttcagctttagcatcattccttccaattgtcacaattttttgggagaaggtgctacttactgactggtgtctcctgagtgggggccagggatgctcttcaactttctgggatgcacaggacagctcccatggcacaaagttagccagttcaaaatgtcagtagtgttaaggttgaaaaaatagtaaaaaaaaaaaaatctcacctcctccagacagccttccttgattccttaaatggcagagatatgttctttggctctcatgcacttctgatcttagctgtcacagcctctcccactctgtggtccctgaactccagggaaagagcctgggtatcattgaacctacatctttggcttcctttctctctagcttgtgaatctctggaagtcagggactattgtcatccacacaggtgtctcagatatatcatagaatctgactcatggtgggtactaagtaaatacttgttgaaagagcaaatggatggatggatggatggatgaatggatacagttgtaggctgagactcaagaaaactaagttgtcttctttttatgtgtgttagttgctcaggtgtgttctgactcttcacgaccctacagactgtagcctgccaggctcctttatctatggaattctccaagcaagaatactggagtgagtcgccatttcattcttcagggaatcttcctgacctaggggtccaaccctggtctcctgcactgtaggcagattatttgccatctgagccaccagggaagccccataatgctcccacaggcatgctgttaaacttgctttcaattctagtccctccttccgtattggcttaatacatcgtctcccagtaggctggaccctttgaaagtgtgtggacggaagtgtactgagctctttgcaaaagagaagacccaccctttcgagctgagataccattattttcatgtgttaccctgataatatctgttatccctccgtgcttaggaaagccctggataaaggctttgtgctgcaaacagtacagccacagtctcagggatcttaatctcttatctatgactttattttggaaaattgggcttgcttctagctccaccctttcccccctagttcatgctaatgctttcaacaaagatccccggaaggggaaataggattgagttcatcccagccagcaatcatcccccactaaccagcccaaccccggagtgggtggaggggctagtgggtcccaccccccattcaatcatgtactatcagctccccacacaccctggagaatcaccaaatggagtttagaacaataagaatttgaagaggaaaaaaacaacaatagatttggggctgttcccctaagccaaagtttctcaaccttagtactttggatatccgtgggcatgttcaatcccttcagtagtgtctgactctttgccacctcgtagactgt

SEQ ID NO: 28208 - DNA, 1826 bp, Bovine  19866881090197
ttgaattgcaatgttgtgttccaatgttctttgagtaaaatcaaacaatgacccgatctccagtgaatatcagtgatggagtgctctccctccgctttcctttcgggactgagcttgtgttacgtccccgccagcgacatccagtggggagggtcctccccaggaccccagacccagcttgggttcgagatcggaccactctccccatctcctctcgtttccagcgggccaagctcatggaaggagaggggaccagagaactctgacctccccagttggaggagatggaggctgggccaatttatcccctcccagaccccaggtccggacagccggaggggccttggccttgcctgggggccttggctcaccccctcccccgcagcccccgtaccccatccctgccaggctttgaaaagcgccttttatgaacttttccattttccttctggaggcgtgtttgttttcagtcacctcgctctgttttatgagcttcagagctgatctgcacgttcttccctccgtgtaatttcaatttgaactctccccggagcggccttttccctcttgcaggctgccaagtcgtttgaaggctgcacaaacattcttcctctctcgcgtccccgggaatcagggtctacacccgcgagggcaggcggaggcggttaccccgagagttccgcttcagcagacgccttccgattgatggttggtaaggatggactgggagaagggaaatattcgaaaaactggccccggggcccctcttttttttgatgtggcgtgtgtgtgtaaacaccccccaatccatattcgaagtcttgggagtgaagatagaggaggtgcacagggattagggatgcggtgatggaaactggcaccttctctctgttaacagactagtttcaattttcatctggtttcctggcaaggcgggattatccccactttacagatgaggaaaactgaggctgaggttggtttcccatcccaccctgttgggattcaagttttagtttgaatgaaccctttgcataacaatacttctctggacttacggcttacatcagtaactgcccttacgacaaccgcccttcctttgttaagtacctattttgtgcagggcaccattctaagccactgctttttcatttctcccaaatgtttctcacagtgactatatgaactatgttcttaacacatgacagtaaagtgtcatggcacagagacgttgtcaccagccccaagtcacataccaagggagaccggagtcaggagttgaactcagaggcaggcactcctaaccatcagtatcctgcctctgggagagcctttcccagctctcttctgagtcacatgaaagaaatcccaggattactgtccctgggctgcattttcctccccagggtcacgcggaggcaaacaggaggatgggggtggaacaagggttacgtaaagcagtaacttcaaaggtggtcaccactagggtgcacagccgtggctctgggcacttagccagcggcacaagtctacactgcgggctctccacccacggtctctcacctacctctctgtagtccaaggactgagctggtggtggaggcagctgagggctggaggtctagacgttgaaagtaagggaagcagagatcaggtgtcgataatcagagtaaaaataatgataccagacgttgtttattgagcacttactatgctgtgcataatatatggttctagtccctttaaaaggcacagagaagttaagtcattttttcagagtcacacagccagtaaattcccggctttagacaccctccagtagggag

SEQ ID NO: 28209 - DNA, 708 bp, Bovine  19866881093200
cagagttaggttttgggctcgataattattgacatgttttcacctatgaaaatgtctagtggtggatttgaaagtcctgtgagacacagagtaatcttttatagggttctgtttattgcagaacatctcaaatccctgacccttgcccattaaatgccagtagtgtaccccgcaatcactgagacagttaaagaatacccccacaaacttctggcactcttcttaattggtaacattactatcattggaaaccacggttgtagacctttctcagctccattctggactacttggttggatctatacagctgaaggggcttcccaggtggcacagcagtaaagaacccacctgtcaacgcaggagactcaggttcgatccctgggtcaggaagatgccctggagaagggaaatggcaaccccctccactattcttgcctgggaaatcccatagacagaggagcctggcaggctacagtccatggggtcgcaaaagaatcagacatgacttggcgactaaaccaccaccaccatacagctgcagagacgccccaaaggatcatgagatattttggatcactggaagctatgcctaatgaccccagttcctggggatttgcccaatctgttcaaataaggagcatcctacagagattacttgggaatggattcagaggaaattctgggacgacctgggaataatatttcaa

SEQ ID NO: 28210 - DNA, 1966 bp, Bovine  19866881106703
atgtgagttatgcttaatgctgtaacaaatgaacatattgaacaccattccggtgcaacaaaacaatgtcattggactattcatgaatagcccaattgaaagatttatttaaaaaataaataataaaaggatgttcatatatcaacaagagatatgttccaagcataggacataagttcagagtcatgcgacaaatgtcacctcctttcaatgttctcaggacacttctatgtgcagatatacaaccactggggataatctcaaacattaaaatttgcaacctttgatgaacttgaggctgagatgaaatcaccccttccagcatctactttaaaccaagccttgctggacaaggaggaagtgggaaatagggccagcttctgggctccctgagcacccagtttattgaggaggctcgtgggtaccacgaggcagagacaatcaggatgctctgatgggagaactctgtacagaacctgcatgctcagttgctaagtcatgtccgactctgcaaccccagggactgtagcccaccacgctcctctgtccatgggattctccaggcaagaataccggagtgggttgccatttcctccttcaggggatcttcccaacccagggatcaaacccacatctcttatgtctcctgcacgggcatactcccatcctctgaagccatggcgagtttcatgacccagtagggcagaccgttggggaggctaaccctgatcgttttgcagccccatgactccgagaccatcttgccatgacacaggcttcctccctaagagactcccgtggacctcgacacaccccaacgtccacggagtcagaacacattagagcgaagttttgttccccagagcctctagtcccagcaaagccagctaattcagatttaaactccctcttaataggctgagttgctgagccttctaattaatgccacatgtttccctcagctgtcatcccgaataaatgtttacaaagctattaacgtactgtatttgtaaaccgggacagctcggctttggggagtcatgtggtatgcattttctcctcaaagatggaaaaggcttagcaataataaatacattgttttgcagggatgggagcaaggcgttgcctgaaaaaaaaaaaatttattgcgagcttcctgagacagcatggctgtgtgtacgtgaggaatggaagatttcttgagttcagaagagctatgagggggccggatttggcccaggttcgcgcttggaggggaggaactccaggggcagaagaaagcactggtttgagatccagagacctggactctggttccagcccctctgctcaccagcctcttgggaactcagtttgtccatctggaaaatgggaggctagactcttcaaaatttttccatcttttttttttttaatttatttctctgtgttgggtcgtagttgcagcacagagacttggggctcaggggctgtagttgtggcattcgggctcagcagttgcaggcacgggctcatgtggggtcttagtcccccaacccaggcatcgaacccacactgcaaggcagattcttaatcactgggccaccagggaagtcctaaagaattttccatcttggatccaggattctagtcctaatttgccctctgctctgacctccagaggacacctggaaggttcttgcataagctcttctaagggtccccaaggccctaaagataaagtcctaacatcttaacataagaccccaaactcagtattatcttccctacgttcttctccagccccatttccaaccccgcctgcttcatactccagccatgctcaatgcaccatcgctttcctgaaagaagccccactgaggctcacttctaagcctttgcctgtgccggcttctccaccagcagcatgcttttcccctcagttccctgcttacctagcctatttctacacgtttgtccacatctc

SEQ ID NO: 28211 - DNA, 1859 bp, Bovine  19866881154237
tttggagacagctgctcaatgtcacacctcaggtcttcccttaaggcaggtaccagagaggtttagagataacagatgccagggagatgaagggaagatgatcagtcttcatgaagcccctactgtgtgccagtcctgtggagagcttagcaaccatttaacatcattcactctggtgaattttttaaagctctgcctgcacatgagaatgggcttcccaggtgcctcagtgataaataatccatctaccaatgcaggagacgcaagagacatgggtttgatccctgggtcaggaagatcccctggagaaggaaatggcaactcactccagtattcttgcctggagagtcccatggacagaggagcctggcgggctatgatccatggggctgcaaagagttggacatgactgagagctcacgcacgcacataagaaccatccaaggaagttttgtaaaggatacaggacatcacagagcaccgagctgagtcctgtgatgacctagatggatgggatggggtggggtgtgagggaggctcacgaggaagggggtataagtaaacttatagctgactcacaatgttgtccagtagaaactaacacaacactgtaaagcaactatattccaagaaaaaaaaaaaaagattcaggatgcccaagacccagcggcagagatgctggatcctctggccttgaccatgcctcgacaaaggtctatttcagaagcacgtcaaatgattaatatgagactggagttaagaatcaactggttgattcttcgcaacaactctccaaggatcacactatttatacctgcattttagagacgatgaaccgaggttctgaatggctgagaatcaaagccggggccgcacagctagcatgtaacagaactgggatccgtgcttgctggggggtgtccaactccaaagctggtgctctttctactgccgaggtggcagggtgagctgaccctccagacaccttctatttcactcccagtcacgtagacctggaaggatcaatgccgtcagagtccaggtggactctatccaaacactcctgcccagaggaacgagcttcaggggactctgccttgcacaacccaggttggactcctaaaccctgaagtaatgatggaggtgggctggatcaaaagcaggagatgaactcagggtctgcagttcatccttgtcttttttttgatcccaacaatactcttttccaagatcttcaactgttgttgttgtggtttagtcactaagtcgtgtccaactattttgcaacccccatggactgccaccaggctcctctgtccatgggattccccaggcaaggatactggagcaacttgtcatttcctcctccaggggatcttcccaaaccagggacaaaagctgtgtctcctgcactggcaggtggattctttgccaccgcgccaccaggaaagccttcttcaacttactccgagagaaagaggaagcatgcaggttcccacaaggagtctcaggctcttcatggggaaagaggctgcttcattttcctgtctctttactgccttaattagccatttggtgacccgacggtctctttaatacgcatccagcattggtcctgaaatatggggggtgtctgttgaacaagagtcggtcagactgccaataccgctgtccagcaggctgatccaggctgggtgctgacctgcaatgagatcattgagtcatctgtcctcttcccccagccaaagtgttggtggtgtgtggagcacagctgaggtgacagtgtcgaggccgttgcccggctgacttcaaaccagaggcccagcacaacaaacaacagggagaaaacagagaaggca

SEQ ID NO: 28212 - DNA, 1110 bp, Bovine  19866881167130
gtccatgctgcaacacggatgaagcttgaaaacatgatgatgagtgaaagaagccaagcacaaaatgtcacatattatacaatcccatttatatgaactattcaaaacaggcaaatcagggacttccctgcaggccaggggataggactctgcacttccactgcagggggtggcatgagttccatccctggtcggggaactaagatcccactagctatacaaagaaaaaaaaaaaaaagttgtgaatgtactaaatgccactaaattctacacttacaaatcatttaaacggtaaatttgtgctatgtacatttcaccacaatttctgaaagtgaaaaacagaacccgtattaccacggtcctctgaaggtctgaaaccaaatgcattcatgccagccccatgccaacagattgcccagtgggcagagaggagcaaaagaggcaaacaaggttccctcctccagttggccgaaaagatccatgtctcccagagcactctgggttcagccaagccccagacatgttttgcctgcagcacttcattccggctgtaatgaaattacgtgtgtgtgcttacagggaaagggagcgggtatggttttaatttatttacgctcagtgtctcagaacgcagtagggtagttgctgtttgatgttggaggcattctgcaaggcctctgcataagccttggttctcttcggtaacaagaaaccaaggttagctcagactaaattgtcttgaaagtctgagtggaacaggggttccaaacatcgagcttgccaaggaaacacattccctcattcaaagtaggcatgaaataaggatctggttcctgggacccaggggtttcccacagaattcagaaactcagacgtttcccaaaatctcacgagcattgtggttcagagtcatttaggaagagagaatagaggaaaaaaaaaaaaacctttatcaagaacctactgtgatggcaggtatttgacagatgttctttctatcaaactccattttcatgatgagaaaactaggccccaagaagtaaatcgaatggattaagatgtcaaggggagcctgaacttggataggactgctccagtgtctggttattt

SEQ ID NO: 28213 - DNA, 1382 bp, Bovine  19866881254113
cttgccccgacttcctccccagtcctccagccccccccccccaaccctccagcccatcctcagggttgtcgccatgggaggtctcttcttacaacagggcaaagcaattaaggccagacggggcgaattaaaccagaaagaatgagtttcctccagcaccagagaaatatttggggccttgctttggaggagaagccaggaggagagatggactgtgattgagtggtgaggatggaggctgatgggataggaccaggcaacaacaggaaggagagaaggggtgagtctctggtgtgtcctcagtcatgtctgactctttgtgaccccctggactacagcctgccaggctcctctggccatggaattttccaggcaagaatactagagtgggctgccatttcctactccagggtatctctggatagaaggttaaagtggaaagacaagttgaagggagaatggcagagtcattcattcatccatccacccattcattcattcattcattcactcattcatccatccatccatccatacactcatccattcttccattcaggtatcaagcattgaccttagatgttttaaatccaaggacaaattgtagatcataatgaattgattaggagctagggctttggaatgaacagatatggtggattccatcatttgttactggggtaacccttggcaagagacccaagctccaatgccacagtttcgataaaatgtgtttgtcctgccagggctttgggggagaattaaataatataattgatgcagaatgaacattgctttgcccttaagtagatgttcaagaaaattaatacatcatgtatacggtcctctatgtgtgtctgttgaatgattaattaagtttgtgcttatgtttctaactgttttatatacattcatttatatagttctcaaaaatacacgaggaagtcgttactaccatcttcctttctttctaaatagaaaccgaggcaccaaaaggttgtattatcttccaaaatctcacaggtgttaagtagcagaggtagcatttgagcccagggagcttaactccagaaattgtgcatctgaaggtcaatgacattgcctacaagtgatgctggaggaaaaaaaaaaaaattatgttataccttgtgtgtttaagcagtggacattggatcagaggatccttggagatctctttaaagaattctattcagtgaccccccctgcccgtggccgggcatctcacacacacacacaagggcacaaacacaggcctgctttggcctctgctgacctccggctgctcctctccccgtgcccgcagcggtggctgcttcctgagaagggtggctggggttgctgtgtggatgcctaaagcaaag

SEQ ID NO: 28214 - DNA, 1087 bp, Bovine  19866881308061
cagcagtaaagaatctgtctgccaatgcaggagatacaggttcaatcctcaggtcaggaagatcccctggagaaagaaatgacaacccactccagtactcttgcctggagaattccacagaggaccctggtgggctacagtccttgggagtcatgaaagagttagacatgacttagcgactaaacaacaacaaaacttcaagggcgagatggagctgcagggtggcccttcagagaaggccagcatggtggccttcaaactgggagaccagcagaaagaccctgcagcagggcaaggcggaggtcagagaactgagagttcccataagaaagttaaatgaggtcctctttgggaccacccagaaacacaccagcctcgtcgcaaagatgcagggccttggaagagaagatctatcttcctcccgccactgaagagacctgaactccccaggggcctcttgctgggctgacttcctgcctgggacccttccaaactttgtcgcctccgaccctggctgcccggctccccctttccaatatccgttccctccttgccccgctgccctcagccctgccccggatcctggcaacatcctgttcttcccctgaactgaactccccctccagcttcccggtgtgataggaatcttaaataaatgcttcctgtctctcgtccaccttatctcccgttcctccccaatggctgaggttcaagaaccacaggcagccttgcgctcccttctaattttaaacctgccctccgagccactctccccttcctccttaaggtttctggaaaggccagggggtgtcagaggtccctgttgacccgctgagtcagcagaggctgaaggcatccttctaaagttcccagggagggagtctggagctggggagcctgggtgaggccattttgcagagcctgctcccacgagaactgagtactgtgtggagtagatgtgtgtgtgctgtgctcagtctctcagtcgtgtcagactctttgggaccccatggaatgtagccctccaggctcctctgtctatggggttctccaggcaagaatactgggggaaggttgccatttcctc

SEQ ID NO: 28215 - DNA, 1681 bp, Bovine  19866881340880
tagttccctgaccatgtgggatcttagttccctgaccagggatcaaacctgtgccccctgcattggaagcctggagtcttaaccaggaccaccgggaaagtccaggagaaagtggacttaaggaaggaactgagggaaaaagaaggaaacgaatacgtattttcttccttatatcagaccctttacataatttatttccttaaatctttgaaacaacccagtgatgctgggattatcacctgcctgtatgttacagacaggaacagtggaactttaagaaatgacagagtttcttgcctaatgtagagcaatcagaaagtgtcagagagtggatgtcatgctgcttgtgccaactcaagagttcgatcttcccaggagggaacatgaagaaacagccgagagaggtggctcaatccaatccagtaaaaacggtggcgcatgaaagtccaggatgaatttgtcaggtgtggctctgtgagtgtcttggtaaagagaatgcactggctgcccaaagtggtttcctttgctttccttgtcttttttttcaagattttatttttttttgatgtgaaccattttaaaagtctttattgaatttgttacaatattgctttttctttcttttctttctttttaaaatgttttggtttagtggctgcgaggcacgtggaatcttagctcccagaacagggattgaaacagcaccccctgccctgggaggtgaagccttaatccctggaccgccaggcaagtcccttccttgtctttacagaccaacagagcacccagcagagataaaactcactatgtaccaacacttaatttacccagctaaggagcatccaaagaccggtaaatttcctgtctcccaatttggctgggaatgtttttcttggataatcaccccgtttttttttcacttctttttctctccttgtagcccttggcatacttccatgccacccagcgactacaatagaagcgatataagattttcccctgaagccaaattccttgggtgttaaagttgcattgttttaaaaaggttgatgatggcttagcctcagaagaatgaacatcacactattctttgctccttgctggggaggcgcctgtggggtggtgtcacctgtcactgggagacaaagaaagtcatgtttgttactctgaatggcatctctgtaagagtcactgaccttgtttttttgaggtcctgcctcttgtctagcaggttgcaacctttttttttttttaaggctctgttccagatttcctttgtgaatgccaccttctgagatttggggatgtaagagacctgtttctagtggcttccatgatttcatctttctgccagttgctcctaagacaatgagcttcacatagtaaaatgatttctgattctgcctagctgctttcatagaaataggtggcagagtgaatgaggacacatcttttctcttttcacctggaccagaaatctggggctaaggaaagcatgagcttttttgtttatctgctatcttccgtgaactcacagtaaatgagaactagctttatacaaaccaagaaaacgatgttaattgtgaagaatctgataaaaaaaaattttttttaagtactactactcaacgaaaggctagtattaaaattgtggaggagaaaattctataatcctccttgg

SEQ ID NO: 28216 - DNA, 607 bp, Bovine  19866881393209
tacaagttttggccttgcaaaattgactgtgttgccatttaagaaaaaaaacctaaaggttcctgatgttggatacgtatgtggtggtggagagggcaagtgtgcctccgcacgtcccccgtaaactactttcgggtggttttggagctgcatttgtccagtgcaaaccaaccaccgatgcctatgaacagccagcgactatattcttcagacctcctcaggctcctcagagtctttgagtaggccaaggccaaagagacctgctgatccacaaacagcttgagacctgtttgattcagaaccagcaaaagatgaagaagtctttcctgaaagtcatgcttaccctcagcagattttaaatgtatcaggttctggggacaattggatcaggccctgtcactcagaagactaaacatcagaagctggagctcacctgtcgtgtggcaagttgtgagtgtgcttcctggctccaccacttaggtggccttgggtgtgttacttaacctctctgaacctcagtatcttctatttcaaagggtcgatagcctgtcggccctggcaggatgttgtataagtatagagaaaccatggaagctagagagttctg

SEQ ID NO: 28217 - DNA, 2018 bp, Bovine  19866881421709
caaaatgcaggcaggagccacttagaaacagaagaatctgcaaagcaaatgatagatgtttaggtatcgcactaaacccacatgagtgctttcagcttgcgtgtgcgtgtgctaagtcgcttcagtcgtgtccaactctttgtgaacccctggactgtagcccaccaggctcctctatccttagtattctccaggcaagaatactggagtgggttgccctgtccacctccaggggatcttcctgacccagggattgaacccacgtttcttatatctcctgtattggcaggcaggttctttaccactagcgccaccagagaagtacctttcaacttagaatctggtaaaaggattagccctttgccatccacaaggctgcatgaaaaccagtctattaaaagactcttgtaggcgctccccagctcaaacatcaagctctctctgcactttgataaaagcagacctgcttgtatagacgcatggcaagagaataatggacacctgcttagagaataagagaaatttatgtggggagggggagacaggctagatacaagcactttgcatcatcctctcaaatggtagagaatgaattatttcttcccaatttggcgccatcatccatcacagtcaatttgcagcccatctggaaggtttcaaaaacgccagaatgggatcagagtcaccaaacagtcgcagcagcaaggcttcctaagtggattacagtaaatagaaacataaaaaagagttccctgtttagaggaatttactctgtgctatgtcttgcactcgagttccctcactgaatcctcgcaacgaacttaggaggtgcgaactctaaccatttccgttttgcaggtgagaaaatcaaagctcagagaggtcagcggacttcctgaggtcacacaggcagaaagtggtggatttaagacatagaggtagatgacattgacttcagatggcgcatctcagtcatgatgcgagtgctgtgagctcagtaaatcctacactcctctcccttcactccacccaaagttcaccttgcttcttcatggaggagtaaaagtgcatcagaaaaagaaaccctccttttagattctcatttttcttggatacattctcatagctgaacacggaagtggcttagaagacacataacacagacttaaagacaaagaggaatgtgttttgtgtgcactgaattttactttctccagctgggttggttctcctgatagctgcagcatttgtaggcaaaaggaatgcaaatagtggcccagaagttaagagtccacctgccaatgcaggggacacaggttagacccctggtccaggaggatgccatatgttatagggcatctaagcccatgcaccacaaccactgagcttgcatgcccgaaagcccatgctccacaagagaagtcactgcagtgagaagcctgcgcaactagagagaagcccctgtttgctgcaactagagaaagtccatgcacagcaatgaagacccagggcagccaaaaataataaactaattaaaaaaaaaatttttaaggaatccacccagagagagaaaatatgagtgtggcaggctgaaaggaaaaaataggcagctcttcccctgcattaactgactgggacctgctgcagggactccgagcaagaaatatttgctcattctataaataatcatcagtgcctcctctagcctagccctctgccacatggtaagaagtagcaacaaataggaaagaccacagtccctgctttcatggaactgcatactttgggaagcgtagattaaataagtgaaagtgaaagtcactcagttgtgtccagttctttgtgaccccgtggactatacagttcatgaaattctccaggccagaatactagagtgggtagcctttcccttctccaggggatcttcccgacccaggtatcaaacccaggtctcccgcattgcaggcagattctttaccagctgagccacaagagaagcccaatagattaaataataa

SEQ ID NO: 28218 - DNA, 1936 bp, Bovine  19866881456345
acgtaatgtattagtaacttgtttatggagaaggcaatggcaccccactccagtactcttgcctggaaaatcccatggacagaggagcctggtaggctgcagtccatggggtcgctaagagtcagacatgactgaacgacttcgatttcatttttcactttcaggcgttggagaaggaaatggcaagccactccagtgttcttgcctggagaatcccagggacgggggagcctggtgggctgccgtctatggggtcgcacagagttgggcacgactgcagagcagcagcagtaactcatttaagaggtatgttatcgggagaattgagtgaatgtaagaaatgatcttggaactgggattggcacatataaaccactcaacaatgataacatcattttcatttcatcctcataacaagtttatgaggtaggctcagagaggttaggtaagttttcctgagtcacacatctggtcaggaatggagcccaagaaataagtgagttaaccatttctgaactcctggatcttccatctgccccacctcccaccttggggcaggattacttacatacagtacagggacccaagcctttgatgtgctaattccatttgtttgcctggagatcagaaagggatacttggatttatttatggggtttctgactccaaaaggcctcttgcgattagagagatgagctatttagttgtattgctaggttggatgattaccccccatggtcaagactttcctgctcaccttgctggttttatggcctcgggcaatacatttcaattttcgatttaaatatctgtttgtttgttttttcacctttaaaactctcttcacagaggggctgcactggcaccagcaggatgcagtctcccagactttggagggctgctccctctcactccacctatccagatcccactcctgtttctctcctcccccaactccctcctttgctgaggaacccacagtggcttctcagaatctccaggagcaaatccatttttcctcatctctaaataaagagaataagactgttcaggtcagaagtctttttatgaggattcagataaaatacatttatttatttttttaaattggagtatagttgatttacaatgctgtgttaatttctgctgtaaacagcaaaatgactcagttatacatatatattcttttccacattctcttccattatcacagaatatcggatatagttctctgtgctatacagtgctgtgcttaatcgctcagtcgtgttcaactctttgagaccccatggactgtaacccgccaggctcctctgtccatggggatttctaggcaagaatactggagtgggtggttatgccctcctccagggaatcttcccaacccagggattgaacccaggtctcctgcgtggcaggcagatcctttaccaactgagccacgagggaagcagtaggacctcgttgtttatctgtcttatatatactagtggcaagcatgcatgctcaagtcactttagtcatgtctgactctttgccaccccatggactgtagcccaccaggctcctctgtccatgggattctccaggcaagaatactggagtgggttgccaggccctcctccaagggatcttcccgacccaggggttgaacctgggtctcctgctttggtaggtgggttctttaccactagtaccacctgggaagcccatatactagctagcatctgctaatcccaaactcccaatttatccctccccactgcttccccttgggtaagatgtttgtttcctgtgtctgtgggctgcctcagtttccaatgcgccatccatagcgactcctccttattaccatcccttatttttgttgtcatgacagtaagtgacttactcagctagttagagtactagtactcactgcattggtctgtgccaa

SEQ ID NO: 28219 - DNA, 811 bp, Bovine  19866881471016
tggccggctgcctgggagcagagattctcccgacccgcagttcccagagactccctcaggtgaggctggaggcttcttcctgcccacctacccccatgcctccttccagtgcggtaacttcagcacgggagtaagaaatctgaaatcccgaaagcttttgggtggaacccagcacgcagccactggagcggtttctgagaggtcgtccatggaggactgcatcgattgtattgacctcacggtgggtcagcttgtctcctccatcgatcaccccaacgaagtctaggacgaaaatatagactgaaggaaatcacaaccgtctttgtaaagctggtggaaagtgaccttaccgctgccagggctcaccggtgacccaaggctgtcccaccgccaggcagccagtcaggggaatgagcttctcaatccactcccttttattcgatcactgatccatttttttggtttgtgcaatttttaaaacaaaggaaccaaataagaactaagtttattcaatcaaccaacacttgatgaacccaccgcaggtgccccgaccgcacagggcatttggggtactaatgaggagaggggtttggacagactcctaaaaccctggcagggaggggtcgtcgtaaagtcttctttactgtcattctttagccaggcgaccttggacgagactccctagctttctgtcccacaaattctggtctgtaaaaagcagcagagctgctccgtcctaggctaggtgaacgcgctaaacggggaaacgatggatggggaggttccggagggttagatccctcatcatagt

SEQ ID NO: 28220 - DNA, 1039 bp, Bovine  19866881921516
tcctgcgttagcaagtggattctttaccactgagccaccagagaagccctattctctaatataaaataaagttttcaaaaatgaaaaaagaaattaattttattcagaatatgaagacaaacttactgagcttttttccagtgatgattatagtcatgtgataatttattatatttttattattaataacctaatggtacatttttagaagttttctttggagatttcttactttaggagtaaaagacaaaaaaagccataaacttttctttttcctattttggcaaaactggttgaaatggtacatagacaaatgaacagttttagtttggtgacaaactgaaaatccatcctttgttagcaattactgtcagaatgaatattcttctaggcattgctgaggattggaatcaataaatattattaatataccaaattgaaaaaataaagaaaaataaaacagccagcctggtctggcatccatttcctagtctctcaactcaagttttcccagctccccaggcccagcgtctcacttccccaaacccaatttgcccaaacaggagtcaaattggtggaattatctattcaaattagaccaaccagttactggtcacggttgtcggtcaccctgtgaatcagggtgtctgagacaataccctgataacaagcacaaaatatggcttcccagggcatcgaagagtctaggcaagacacactcccttcaagggcaggcaggccgtgacccgcaccaccaagccaccacctccccagacacgaccctaagtctaaagcaatttgcctctgtgctcccatgagctgtggcccagccagggcctggcttccagagggcagagctctgtacaaagggataatgtgcttcatttggagaccgagccctcagccacaggcacaaatggaagcagttagttgctataatgaatttgtaatgctccttcacttgtttcctctctgtgcctgttggcccttcaaaacagtgtaatccaccaaagaacagtaacgggcttcttctagccag

SEQ ID NO: 28221 - DNA, 968 bp, Bovine  19866881931715
cttgtaggggcctttgatgaacagatgagataatggacacgctttgaaaaagatgaaacaccaaacgaaaggttgtgctggccacggcagtgagtgcaacagattggttaaaccttggacttccttcctgtctggggcaaacactgctcccaatttctgcatctctaggacagccggcttgcacagtgagccctcctcccccgatccacccaccacccttagagagagatgcaactcactagccattagagcacattacatccatcaactgggagaatcatctcaacagtcgtgagcaagcctatgaattcacccactttacagacaaggagactgaggcacagagaattcaaacatgcccaagatcatatggctacttgggactgacccaggatttcaacctagatctattcattccaatgaagacttacaaaacgtaaggggtttatgtacaatgtcttcagttagaatgaaatataacacatcaataggagcaggaaacatggggttttgcaaaaagatgtccctcccagctcctccaaatctgcagaaaagatgactttttcccctcactgcagctggggctcttggcatgagatgtattgggcggtggtccctctgcagggagatgagagattataggatcgtgaagttggaagggaacttgatggtcatttagggacagcatcccctccactatagccgtgccaagaggctatctggccaatactcagacacttgcagagatagggaacttcttcctaaaaagtggcctatttctgttctcatgcagctcacagtcacctaagcaaattaaccgactctgttgaaatacccaatatgttctttctactacccagagatgaacgaggaagtaggtacacatgtatccacagttacgttgtgatagcaaaatatttgaaccaacctataaggcccccagtaggggagtggatgcataaaatgta

SEQ ID NO: 28222 - DNA, 1404 bp, Bovine  19866882077472
tctcaaggaggagagattttattcattgaagaaatagctttctgttaaaactgtaaggtgctctagatctctttcagatagaaataagatttctttcataaggatattcaatgagatcacatgacgagtaggaagtaaaatgcaaagtttttataaacgagctggcgagccttgagggaactcaggaagtaaaagaatacctgctgtctagcagccatcagactgcagccactcctcagagtgagccatgaagaaattctgaatgtgaaaacacagattactggccccagatgactaaggtgcataccaaaagaatgatttcagttagcctagactcttgcactttcccatacatagaaaaacagaaaagcactaaatttcttaactttggatatctgttattttttatttttttaatatttttttaagatctcaaatcagttgtttttttttttaattaacaacaatcttttggtgatcagactacctttgtttcaaaacttctgtatctcctggcccccctcccctgcttgcctccttggatcagttctattagggttacttgagatactgcctactggcttgaagtcctaaaaattcctgccaaataaaacataactctgaacttttaagttgtgaatatattctaagtcaacagaacaaatgtatggatacaaagggggaagagggagtgggataaattgggagactgggattgacatatatgcactattgatattatgcataaaatagataactaacgagaacctactgcatagcataaagaactctgttcaatgctctgtggtgacctaaacaggagggcaatccaaaaaagaggggatatagataaacatagctgattcactttgctgtacagtggaaactgacacaacactgtaaagcgattatactccaataaaagttaataagaattacagtcatgcatctgaacctttgcattgtagaagataaatgatacaaagaattaaagaaaaatgagctgatatgaacattttgccttttagctcatcaaaagctagtagcactttttgttggtcaatatgtatctcctgaattgacaaatgggagtcgatacttacttcctattgttagtacatctattttctgtacactacacgtaagcggcttatacacacaggcaccaatacattaatagctatatcaatagaaaatcaacaataatcatttatttttaatgggcatcaccactgaaacaccaacagtgcaatatgctcaagacaaagaggaacacttagcatgatagatgtctgtggataattgatttaggttaacaacttcctctcctaatggtgctaattgcgttaatcaacagccgatttcatcagaggctttcaaaggctcatccggacttgccaattc

SEQ ID NO: 28223 - DNA, 1192 bp, Bovine  19866880473969
gatgggtttgtgttccggatccgtgtggcctaccagcgggagccgcagatcctgaaagagacgcggagccccgaggggatgatctcgctgagggacacccccgcctccctccgcctcgagagggacacgaggcagttgcccctgctcaccagcgccttgcatgggtaggcccacctgtacaggctctcctagaccctctcccagtcccatcctgctctcctggccatctgtctggagagttaggccaattagggatatgagtgccaggctggagtcaggcaagcactagaagtgctaggattctggccctgccacttacctggctttgtcccttgagcccaaatcccccccacacacacacctgatttttctcatctgtaaaatggtaatcatgctaggaacaacctcttggggtattagttaggaagacatgagatcatacgtgtatcattatttagcacattaacacagaggccagtgttgggtgaaagttgagtgaacagttgcagtcaggctgaaagtctgtccttgggcccaggtgcctgcgcctcactgcctctaccctcttcttcccacaggctccagcagcagcacccagccttttcaggtgtggctcggctggccaagcgctgggtgcgtgcccagctcctgggtggggagctcactgatgagagcctggacctggtggctgctgcccttttcctgcaccctgagcccttcagccctcccaggtgatggcctccacgtttcccctagccaggaagttcccctggggtcagctgtattccttcctgcttcagtccacatgggagaggtggccgaaactaggggcagaaggggttctaagacacccccatccccccgcagtccagactaagggctctaggctccccagactgtggggggctgggcacatgtggctgggcccctgacactttgctcactcctccctctcagctccccccaggtgggcttccttcggttccttttcctgatatcaaccttcgattggaagaacaaccccctaattgtcaatctcaacaatgagctcactggtaagtggtacgatgaaagtcagactaccgaaagaactaccccttgtgggttgcagaggcgggcaggcaagggtttctctctgcttacccaacctggaatgtctactcctgattctggctgcctaggggtgggggaa

SEQ ID NO: 28224 - DNA, 1311 bp, Bovine  19866880586370
ccccatttaaaagcctgacgctgcagcaaagagcatactgaggtcaaggcccacatcctggcacaggggtggggacagagcctcagccctgggcacacagtctcttctctggacttctaggagcaacctgagaaggaacaaaaggcccaggccaagctgacaagtagctggatttcctgggttcattcggtgtcccctctgagctgacccccagttctcctctggtcaggtccaggggactgcacgggccaccatggcccctgtcccagtgctggggcatcagataggaaatcaggacggggatttgttggggacagtcagcatgctcgggccagcaagccctctttggagggtctatccacagtgagggtggtcatgccactgacatcttgctccaaaggtctgtccatctagcttgctcctaggctggaggtcacacggtccacctctcacttcgggcctccacagcctggaccaggccttcgcccaggatggcaaagtcctccaggatggcttcgacattgggcaccatcactggctccccgccttgagacaccactatgcgtccctttgtgttggagacctgggagagccagagacatatggattaaagtgtcatgagagacatacgcagagacaccaagacagacacacttcacacctgacacagggtcacttgtggagccacacgcaggcacacacgcccacacggaacacacgtgcacactcacgaacagacaactgtcaccagccagctcaccttgaagggctggggctggaagctggtgggcttccagaggacaccgatcacctctccgccatgctggtcatagaagaaaagagccaggtgtccgaaggcctcctaggaaagggcaggacaggaaaaagactacaggtgggaacctgatagccaacgccacggccccaactcacctggaagcctcctcccaagggccagccagccctcaaggacctaccctgagctgtgccaggtagagctgaggcggatcatagcccagcacgggcataaagggaggagggccctggctcactgagcaggccccggcagaaggaggcagctggtgagtccacggcctggcggtgccgggggatgtggcggggagccaggcggatcagcacgtcgtacatgtccaatggtggccggaacacggtctgaagaagggcagggagggctcagcagtgcccactggggagctggaaactggaccacaaacccctccacaggcccactctgcttccttctttccccttaggtctgaccccccattagggcccaaatgctcatttcaa

SEQ ID NO: 28225 - DNA, 1304 bp, Bovine  19866880587794
ctttcttcttagtgtgagacattccaagagaccccaggacatctgcaatttacgcaaaagaatttctgaattgatataaaagttctaaccaggaaccatatggatgctagtacttgggattacaatgatgatgctataaagtcttggaaagttagattcttgatagagttaagctatgaaatcaacacagagtgggagaggttaaccagtacagaaagtaggagttgaaaacaataaagtataaattataggtggaaggttttaaagtaaattgcagtgtatagtttacagatacattagcatgtttatactttgatgaatagaacagaacttctctattggtgtgccaattataggtgtgactctacgaatttaaaaatattatcattataaacaatcagaaattacatcgctatttcaccatgaaacctaatgtcaggtaatatgtcagaaacacggtcaagtttctcataaaagtaaaaacaaattttatttggatatttagccaaaatcaatactattttctcaagtagtctatttaaaattattactgcatgtaattacaaagaaaatattttttttccaccaagttcctcgtagaacttaagatgaccccaatatgctctgcatacataattttatctttatgccacgacatcaataaattggaaagcagtggagttattaacttacctaaaaagagaatacaaaatatcattagaagtattcattacttatttctaataaaatatcattagaaaatattcaggaagtgtttaggttggattccctcagaggcagacactgaggcaaggattttcgtgcagtttgttttggagatgatcccaggaagcgccagtaggggagtggagccctgagacagggctgggagggcagcaggacaggttaaggtgcagctcacccctctagacaactagggcgggagagcctcctggagtcaagtagtatatgcttcagagttgtttcaccccacaggtgtggaaacaagttacgcttccacctctttacatcattcttactactattcccaggggtgtaaattccctcccttccagcctgtgtgcagttcagagaaggctctcaggccagaggaagccagcaggcagtcgcaggtatgcacagtgacaaaattttagatatgttaaagatgcaactacatttatggctcactaggttttgatgcttagagaagaatatgtcttgtccagttgatgctgcttccaaaataactcttaaatcatcccacttctatattcttgtccaggctgccatcctcctttgtg

SEQ ID NO: 28226 - DNA, 3575 bp, Bovine  19866880593337
tgtcttgcattcaaattggattgaattactctaattgatcattcaacatatattgtgcaaaaatgtccagcctattaggtctagccctttctctatagcatattactggcccaggaaatgcacggcttaagggtattttcaaggactccagaaccaaagatttatcacaaacacatatatagaaaaataatagcaaataagcccgtggtattatctaatgtgtgtgctgcgtgtgtgctgggcttcccaggtggcgctagtgataaagaacccgcctgccaaggcaggagacggttggatccctgggtagggaagatcccctggagaagggcatggcaacccactccagattatctaatacagtagccctaaaagtgtaataattggatcaatagcagtagcctcaaaacacttaggaacttattagaaatgcaaattcagttctcacactagggttactgacttagaaaactgctggcagggcccagcaatatgtttaacaaatccagcaggttttcctaataggtgcttaaatttgaaattcactgatggatggcgaaagcatcaaaccatcagttcagtggctcagttgtgtccaactctttgagaccccgtggactgcagcatgccataacccacaataaatgttttgttagtatgctcagggctttggggttttttcttttataaaaattttttcgatttttacttgtggcaaaatacaaataacataaaactcaccattaaccacttttaagtagtgtacagttcagtagtgttaagaatattcttaatctgaccctcgtggtccagtgaataagactctgagcttgcaatgcagggaactcaagttgggaaactaagattccacgagttgcatggtgcagccaaaaaaaaaattttttaaagaacattcacattgtaatgaaatctatttctagaactttttaatcttgcaaaaccggaattcaaacaactccctagttactcctactcccacccctggaagccaccattctgctttcagtttccatgagtctgactactccacatacctcatataagtgaaatcatacagtatttgtctttttgtgactggcttacttcttagcacaatgttctcaaagttaattcacttgtgtcaaaacttcatttcaaggctaaaaaccattccgttgcatgcatacactacactattcctctgcttccaccttttggctattaggaataatgctgctatgaatatcgttatacaaatatctctttgagatcttgcctttagatcttttggctatatacccaaaagtgggattgcagactcacaattctgtttttaatattttaaggaaccacctgttttccatagtggctgcaccattttacattcccaccaacagagcacaaggtttccaatttctccacattcttgccaatgcttgtattttctgatttgggttttttggatgtgaggggaggtaataactcactgtggctttcattttgcatttctctaatgatcagtgatgttgagcaactttccatatgtttcttggccatttgtatatcttctttggagaaatgtctgttgaagtcttttgcccaatttttaatcatgttattttgttgttgttgcactgtagaagttcttttaatcttctggatgttaaccccttatcagatatatgacttagagagatattttcccatttcataggttgccttttcactcttatcaactgtgccctgcacagaagtttttcattttgatgtagtccaatgtatctatttttactcttgccatctgtgcttttggaattatagcaaagaaattattggaaactttccccctgtgtattacagttttaggtcttacatttaggtctttgatccgctttgagttcattttttaaattaatttatttttaattgggggataattgctttacaatgttgggttggtttctgccatacatcaaaatgcatcaactctgggtatacatatgtcccccctcttctgaacctctctcccacctcccatcccatcccacccttctaggttgtcacagggcacaaggttgagccccctgtgtcatacagcaaattcccactggctatccattttacacatggtcctggatgtatgtttcaatgctactctctcaattcgccccaccctctccgtccacaaatcttgtggacgtgtgtccacaagtctgttctctatgtctgcatctctctttctgccctgcaaacaggttcatcagtaccatttttatagattccatgtatattcagtaatatataatatttgtttttctgacttacttcactgtataacaagctctaggttcatccacctcactagaactgactcaactttgttccttttatgattaatattccattgcatacgtgtgccacttcttctttatccattcatctgtggttggagatctaggttgtttccatgtcctggctattgtaaatagtgctacaatgaacactggagtacatgtgtcttttagaatgattttctcagggtatacactcagcagtggggttgcattcattttttatatggtgtaaagtaagcatctaatgtcacccttttgcatttggatatccagttttcccagcaccatttattgaaaacactgtcttttctccactaaatggttttggaatatctgttaaaaatcgtttgaccatgcatgtaatggtttatttctgggttttctattgtattccattgatccagtaccaccctgtcttgattactgtagctttgtaataactttttaaatcagggggtgtaagactttcaactttctttcccccaatcccaaggttgttttagctatttcgcttggcggaggtaacttttttaaattccaacagttagacattagaagaccttgaatgaaaatcaggattcttggtctcttaggaaaaaaaaatcaagaaatgcagcaaatttgggcaacaaataactggaattgtgagtagctgcaaagtgctctcaagttaccattgtctccacccactcatttctgtaacctgtctgaccccctgaaggcccctctttctttcagactttgagactcctggcctaagggaaaggcagttgtagccagaggacttaactgcggaggctgcagtgatctaattcagagattttctcaaaaggaaaaatacagagttcttagaggaaatatagctatgaaagtatgtttgttcgatgcaggagagaaggtatggtaggagggactatagaggagtgtcaggaatgtaatcttgcctgaaaaattccatggacataagagcctggcgggctgttacaatccaaagggtcacaaaaagttggacacaactgagtgactgaactcacacacaggaaagacctatctaaggaaaggacaattaaatcgagtccagaaggatgaaaatgaaacagacaagagaagacgtggtagaagaatactataagctagaatcccagggacgggggagcctggtgggcctgccgtctctgggggttgcacagagccggacacgactgaagcgacttagcagca

SEQ ID NO: 28227 - DNA, 769 bp, Bovine  19866881112852
agcacaggctggagtagagccagaattctgagtcattgatactatttgttaaatacagcccacggtctggatagcagctgacctgcaaattgattctgaggatattggccataaattaggagctagcttaataggtaagcttcagaattaaaggaaagaatgtcagagtaattagtgtagtttatatgagactaaagttgtgtgaagatgcatggggttttcttctgaatgaaatcatataatacataggatagtaaagatatgttgaatgtcaggtacaggaccactttatgctttgtagataccagcttgaaggctgtgagatactttgatttaggaatcataaatttagtaatgccttggagatgctctttgtgaccaagacttacaaacaggatggggatacacgaactagacatgactcctgtcagtttgcttttctcccagcaatctctttctctctgtgctttttagcttctcattcactctgtgacctcactccctcgaatagtggaccccatggcagtgagtgtacttttgaaagttttgtgtaaattaaatttttgcaaataaaagtcttattctaaaattgctggaggagctcatctgttaaacagtttatttaacaaagtgaaagatctcttgaataatcacctcattgttcagccagatttttcctgaaatgtcttttttttttttttaaactttacataattgtattagttttgccaaatatcaaaatgaatctgccacaggtatacatgtgttc

SEQ ID NO: 28228 - DNA, 713 bp, Bovine  19866881163628
gtactttctgaactaaaagaccatctcaagcttggcagacagaagtccacctttctctttgttaacctgaagttccttgtaaccaacgacccccaactaggatgtgtgccaagatgccactgcagacagttctagacggattagcagcaccaggaccacagccaacaccccacccggagccaggactacgtaccttggccttgcaggtggtcactgggcagggcaagctgaggtggcagggtgccatacacgggtggccacagttggctctggaggtggtgcagggctgcttgcagatctcgtcccccagacattctcctttgtgacagagcctctgacacttgtgcatcccacatggtagcgtggcaccacagggtaatccacaagagatatcaaccaggtgacagggaatgttgcttcgtaactaggagagaagtagccgggttctcatctccattcaggatctggggtgggttttaacttcctacttaaacatttctgaacgttcacaatcagtatatttaaaaaaaaattttttttttaaaaatcaggctgattttcgaagtctgaaaggttagtttgaaaagaaaacaaacctgagctttatttaacaatgcttgttacagtttgaaaggatttgttttagtagccgagtgtgacttgcaacaaacaaaggtgagtaacaggcatggaaaccagataactagggagta

SEQ ID NO: 28229 - DNA, 1371 bp, Bovine  19866880116733
tcttgggctggatggccagagaagacttgacatttacatgatgcagcttcctaaagtcatgagaaaggttttggacctctactgagatgaaaactgagaaggatagaaggtccccaaaagcaaacaaacaaaaaagtagactatcatctaagggataggcaacagcctgggaaagtaatataccacctgcaactacagaaaagggaggatagaagatggatagacattcaaaagggatgttacataagagattctaactttgggtgagtggctggatcaaatgacatctctttcaattcttagatattatggtactacatttccaatatttccctaaatctctactacaatgatgattgttatgaatatgactgatcttgggaaagttacatgtgggtttagttgctaagtcatgtccaacccttgcaacctcatggactgtagcctgcgaggctcctctgtccatgagattttccaggcaagaatagtggagtgggttgccatttccttctccaggggatcctcccatcccaagttgaaccctggtctcctgcattgcaggcagattctttactgactgaagtactagggaagaaagttatatatgtcaaagcattttctaagtaaatgcattgttcattttgaccagtataaagttttgttttaggcactcccaatagcagtaccttgccttgcatttagtaaatattatatttcctctttattttgaaaaatgaaacacctgtaattattcaagaaatttaattattcaacaattagagagtgggtaatcacaatgttaacaaactcccccacaatttgctaacagtaataatgactgacattattgagtgcttactgccttccagatactattgcgtatacctaataagactgttttctataatactcatgaagatgtataagtggatagtattttatttctactttacaaaggaagaaattgaagtccagaaatgttgatataacttgctcatatcacacatttttagtgatagaatctggattctaattcaaccaatttgactgctagcccatgctctaaattatgtgcccccctattgctatgacatatctatacccgtcctaaacttatttgtatggatttcaatacatatacaccactttacagattcttaagaaaggaagttaatgttaaatatggaatctcttattgattttctcttaaaatgttatgatggtagcaatgatctttattttacctttccagcacgcagaagttcttgcttatccttgttggcaaatccagtcattgctgctgtttcaatcattcctgtgagagcaagtactggagcaatactcaaaatcagcagtgtcatctcccatccg

SEQ ID NO: 28230 - DNA, 2221 bp, Bovine  19866880140920
ggaacacaatgtatacctgtggcagattcattttggtatttggcaaaactaatacaattatgtaaagtttaaaaataaaataaaatttaaaaaaataaatgaatcaaaaatctttgatttttttcctttttgcattattagagtaaccctcaaaactatacaattaataattccagtcaaataggcaacgtgtccttttcttactggctttttaatctgtcattttaccaaacaccaaaacttagaatatggaccagtaagaatatggtccttctttggttgcatgtatagatttggacaaatcatcaaatgttttatttttcagatttaaagtgaccatattagtattaaaaaataaaggttattttctaagtctctcttattagtcctttctcccttgtgaaaagtgaacccaagattttgtgttcatttctctttattttcctcaagatttcagcattcttatccattatcttatccacaaaatattacaaatggaggtttctttgagtcctgaccatggtccagatatccagttctctcccataacccaagtccccttcaaataaccttgagtgtctacctaggtcttcatctgttccacagtccactctgccagtctggaaacagactgtgaaagcaggaaatttctctttcagatcaacatgtgttctcatgtccaaattattctaagccaaaagtctcctccattttcgatacctcttctttttgaaaactatgtaactatgaagaagcattaatataattaaactaaatatcatttttaagggatatctctggcaatccagtagttaaaaacccatgcttcactgcagggagcacagcttcgatccctagttggagaaccaagatcctatgtgttgtgtggtgcagcaaataattgaataaataaatatccttttaaggttaaagaaatcaaaatttaaaatagccataaaatatcttatacagaattgaaaagccacactctatgttactttatggcagtgttcctaagttgcaaacaggttgctgtttgcatttctgtgctagaatgaaataattatttatttgattctctctgctgtctttttcttgaattagctcataattcataagacagctcctttgcatagttacatatggatataatgttgactaacatttgatccctctgcttatggaactagtttaaatagaaattcaatgaagacttgaaggctaaatttagatcagtggactaaatcttttccaaaggaattttccttgagtgtattatcctgatatattactttcttatcttattttgtccatgggattgcaaaaagagtcagacacaacttagcaactaaacaacaacaatcttattttggggaaaggaaaaaagaagctaagaaaactcatcagaaaaacttattgacttgatgtacttaacatgtcttcgatgtgactgtaattcacaatcagaagtttaaccactactaattttatttctcttttattatcttgttttataagatagcaactgaagctgtggagaatatacgtactataatgtcattaacaagagaaaaagcctttgagcaaatgtatgaggagacgcttcagactcagcacaggtgattgtagattcatactgactgtattaactatagtttattcctataaaggcagtactcccgggtgactgcagtggtttgcctgccaattcatttgctctggaatcattcctaataatggcatatcagactttctcacataagtccaccaagaggagactagaaagaggagttgagagtaagcacatttagaacatatgttttaggtcctctcacattgccatgaactataactgggtgagcattttattatttccatgaaacaaggttgaggaaataataatatctaagaaagaaaataatattgcttagccctttatattgaatctctaaaatagttcacattttaaaacaaatatatacgcatcaaatgcgatcacttcttttaattttaaactagccctccttactttatcagaaagacagctttgtattctttcacactcatgcttctttggttagtaatgccctttaatttccaccatttgttctcttagtgcaagattaggatagaaaatatttttaagccaaatctctttaactctttcattaagtctgctttaacagaccttgcccattcatttaaaaatacatgggagtca

SEQ ID NO: 28231 - DNA, 4045 bp, Bovine  19866880372343
gtttgccttggaaacgaaagagatcttctgtcgtttttgagattgcatccaagtactgcatttcagactcttttgttgaccctgatggccactccatttcttctaagggattcctgcccacagtagtagatataatggtcatctgagttaaattcacccattccagtccattttagtttgctgattcctagaatgtcaacattcactcttgccatctcttgtttgaccacttccaatttgccttgattcatggacctgacattccaggttcctatgcaatattgctgtttacagcatcggatcttgcttctgtcaccagtcacatccacagctgggtattgttttttctttggctccatcccttcattctttctggagttatttctccactgatctccagtagcatattgggcccctactgacctggggagttcctctttcagtagcctatcattttgccttttcatactgttcatggggttctcaaggcaagaatactgaagtggtttgccattcccttctccagtggatcacattctgtcaggaaacttttcaggttgatgcaaatgttcattatcttgattatggcaatggcttcacaagtatgtacataggtcaaatcttattaaattgtttgcttgaaataattactgtatatttttaaattatgtattaataaaattattttagactttaaatccccaaaaggtaaagcaaatgttagaacaattaagaatgttgcccagtggtggcagttggctctagtttggtctagatataattgccttcctcatttcatttttgtttagtacctctggaattgggagactggaaataagaagaaaattcaagattgccttataagagagatttggaaaattacagcaaaaatgaaaagcaaacaaacaaaaacaacaaccaaaaaccctctctttccttgcttttcagaaaaaataaaatgtataagaattccaagagtttagagagatgaggaacaatctatccgataatttgcacatttgtgaatttgcttttttcatcatgtaaaagcagatgaaacaaacatttttagcttattagatggtgtgctgggggtaataataatagttcctgccttttaatgtttatcatcagcctaaagagtggcaagcataggcagaaggagttccatcttaaagaggactataaggaatattgaaaccagagagccacagggtttgacacactcaggaagcacagcaacagtggggatcaggctgattgctcccagttctggcagctgtgtcaccttggcatagattcctcgagtaatgtgggcaccgtatcaactgtctctacacctcattttttttcagccttgttgtttatttctgtgcttagtcgctcagtcatgtccgactctttgtgaccccatggactatagcccatgaggctcctcctcccatggggttctccaggcaagaatactggagtgggttgccatttctttctccagaggatcttcccaacccagggatcaaaacccaggtctcctgcatcacaggctcattctttaccagctgagctaccatttctcgttcattagtcacaggaatattgtacaaatcgagaagcttcagccttcttaaaaagatataaacaaatccaaaaataactgtgaggttctaagaagtccatactttccttttacatttgaaaaataatgaaaacaagctcattatttaagagcagatagcaaaacatatttgtggtttggtttcaggtcctcatagaaaatgcaagtaaggaacctgttatataaacaaataaaaatgagcaatagtttttcaccagttaaaccagagtttagaatacatctcttaattgttttaacctggaagaactatattttggggacaaactgcaagtttcaaaaagtgggaaaggtcttctaggaattatttctatttgagaagaagtaagttcagggtcaaatagcctctcaacatgcattgctgagtgctagagtgatgatagctgacatttgtgtgcatgtgtgctaagtcacgtcagtcatgtctgactctttgcaactctgtggacgggtagcccaccaggttcctctgtccgtggggttatccaggcaagaatactggagtgggttgctgtgtcctcctccagctgacatttactgcaggcctatgttgcaccaggtagtttgtttaatctaatttaatccttgtaactgcactacaagttagatactgttattatctctgttttagaaagcaggaatggaagtgtaggtagtttactgacctgctaagaccacagagctagtgaagacatagacagcatttaactccagatctgcctggttctggatcctctgctcttaaacatagaaggctcagctcctcaaccctatgactttcaactccaaaggtaaaacaattctgttttgctatgggccaagttccaagtgcctcacaaaatctctgtcaccttatcttctatttccctagctcttatctttcctctcaccaaataccattatttgcatgtgtattttgaatgtggtaaccagatacatttagaaaaaaatctttgtctggaagtggtgacaggacacagtgtaagtacagtgggcagcactctgttcccaactcaccacaaagaacatacgaactctttgtgcctgacactttacacaatatgctccttggctttaggaaaacattatttcatgttcttactctaatcagtcttgtctgccagtctggagaactgagaggttcattgttatatgcagctgtcatttgttccatctcccggctctctctgccttcaatatctttgtggtatttagtgaaagtaattttcagttggaaatcttctgccctttcagtaagtgcaagtatagcacttcatcaatggccaaagaattctgagctatctgggatgtatcaggacagttgataaaacctcacggagcaacctatgatagtacatcccatcataaattaaaaaaaaaaaaaaggcagaaagggcctttgtcagtgtttatctgaagcgcttttattctttgcccttgatttcctcttcagaaaattgatgcgcccttaaattgaagcaagaggcttgacaggtgatggttagtgtgataactgctcagatttcatcagccagtgtttttctggtggtgcaattgtcagaactttcagccagattacctgtcatccactacatcagataaaagaggcagagttgaaagatgtagttttgccactgtaccttataggaaatgaaaagtgcaggtgtggtagcagtagcgagaaagaagcacaattattttctaatcaggctgtttctttgagaaatttggtgcctaaatttgcaaccattgggcaaaaccattgctgcatttgcattgttaaatttacagagaagaaatgaaaagaactgtcatattgtaggtagtgctataagctatcttctctatccattttatttgttccacaaaatgaagtagtcatagtttatttttagatacaagaaaaatgttcctattttggatgcatctcagtatactgatgtggagcctgtattttgatctgctgttaagctgtttgaaactgtgaaaggagacattattctacacaaagttttacgggaaaactttgcaactagaaagattggaagaattgtgccatatagtcagaataattttgtgacaggtttttttttttttttttttccagattttaaaagccacataggttgataaatcaaaataggacagattctggataaatgtatttttgtgagattatattgtgtactgttttctgaacagttgattatacagaatgaactaatctcatccctttaaatctgtcacttcttaagaagaaaaacaggtatttgaatacagttgtctcatgacaaatggaaatctttttacctggaaagtaaaaggggcaccttgtttcctgataggatgagagagaggtatatactgtattcttaccccattaaatctccactgctaagtcacttcagtcag

SEQ ID NO: 28232 - DNA, 1599 bp, Bovine  19866880392753
cgcaaagagtaagtaaagacaacattaacaggccatgtataccaatgagataaatcattaagaacaatacaggcagtcttttattcataaacaaggaatttatcaaaagcccagactttaaaggtagctgcttttatcagacagttaagctattactctaaaggtcgggaagtaatggctaagtgggaagtgtaggaaaatttatttaggaggctgccttgatggtagcactccctgaaaattaaattgtaggcaagttttcacaaagtgccctacttgcccctccactttactttgttttataaagctaattagatattcattttggttaatttttaaaaatataattacctctgtgacttttaagggaggcattcatatacaaatgcaaatttgtcaaaacatattacctccatcctaatccaaagactttccatttcaacaaagtttgaaacttcagtttttggagactattagagcctcacgaagagttgactcattggaagagacactgatgctgggagggattgggagcaggaggaaaaggggacgacagaagatgagatggctggatggcatcaccgactcgatggacgtgagtttgagtgaactccgggagttggttttggacagggaggcctggcgtgctgcagttcatggggtcgcaaagagtcggacacgactgagcgactgaactgaactgaactgaactgagagcctcactgaagatatcctagaaaatacaagaaattgtgaagaagcagagaaaacaaataccttaaacccacttctgagatacattatgtcttataatttttttctttgtgatttttatatgagtataatttactttttcctcattaatatcaaaattaattttcctcactattaaaagttatctgcaaatgcaattttcagtggttatggaccccatattatcaaaattttactacttccctaatactgggcatctggttgttcccaaatgattgaacatccttatgtatgactttttgttctaatttctgattatttccttaggatactaaaagaggagagaatttttgggataagaacattttaatgactctagataaggatgaccagattactgtccctgaagtatatagcagtttatacttcaggaaacagcagttgaaagaactggccttaagtgcactgaattctttgttcatttaataagaaagaaatgactctcattattgctttaagtcatatatttcagattcctaaacttttcttcaccatgtgtgtttgctggttttattctctcttttgtaaattgtccttccatggctatgccctttcctgaatgatcgtccacgtggttgcaaaatcaagcagatgatctgggccagagaagaacactggagaaacagtgttggctctggaagcagaaactccttttcagtctttgcaccatacagttcccttaaggtgaaacctgcagatcggtttccttttgttggtaccagcttaattgcggtaagtgggcagagtggaacataaatacatgctatcattttacaaaagaattttggggaaacaaccagttgtatttcccaactaagtgtgaac

SEQ ID NO: 28233 - DNA, 1289 bp, Bovine  19866880475838
agaaatgtgcaaaggatttcaaaactactttaaaaaataaaatcttgtttcaaaataaagattttaggagaatgcctctgtaagagcaaactattgcattttaagtgtttttttgttagcaagccctaatatagcaactcagcggtaattgctattttataacctcctgaatattgaactatttattatgcaaattaatactctttggagtaagcacccgcctagccaaggagttcttttttgtttacatattttacttctgcagcttttgccagtcagtgtaaagaggcatcttgatatttactaattccaggcataaacagatttctgcccgacatgtggcagctacacttcatgtctttgtttttaattaaagaaacacatatggcagatttgcaaaatttgaggaaaacatttttttggtaacagctaggagttctctttggcagaattttattgtcatcatgtcatcgtgactacagaatcctgggaccagtctgagtccataatccccagcagactgtgggggagggggtggtaagaagaggtatcaggttgaatttcatataattgtcattttgggggtcaaaatggttgaatattgcaacttcatgtggttcaacaaaataattgctgcatataagctcttttctcaaaggaagctctacagcatagaccccctcaggaacatgctatagagatattccccaggaactatttcctgaatttgataaagcttcataatacaatacttactagtttcaatatatcctaccaagtcattttgtgcagcacagacttggtgggcatgtgttttgctattcagatggatatttgctcaatccaccacagcccttcttctcttgggagcaacaagccccattccagtcctagaagcatcaacaaggaaaaggggatgcccatgttgggctgaagtgtgaggcaggcaacaggagagaatggtctgaatacacaaaaatatgttgaccatcttgaaaactgcttcatgatcactggcccccaaacagttctaccttgcatttgcatgaatatacccataagagaagcagaatgtattattattcccattttatagattaggaaactaaagctccaatatatgaagcaactagctcagggtcaccagtgaggaaatgacatatctagatcagaactctgttctggttcatagtctattttcttgagagataatatttgaacattcaggatactgagcagaatgtccctgtaacttcttcctcttcttagtgccctacacacatgctaat

SEQ ID NO: 28234 - DNA, 2478 bp, Bovine  19866880539700
aaatataggtaagggcatacagaaatggtagagatctgtcctgggtccattgaaagaacagaggaatctcatccatcttaatctggaagacaccaagaaataatgatttgaccatttaaagacatatcctctttctctgttatcacactttttactatatttttcaagtatcagattatgtcctagagaccactacaattaaaagcatacatctttttcaaagcaatttaaatagtgaaggttgggtaaaatttagatccactttatgttatttaaactccagtgacaacatctacattttatagcctagtaagctttcacaagctgtgcctagatatatataaagataaataaataacagaattaatagtatttcaaagatctccattatttggccataaattaatactagtcattaatacttgtctacaaactgtgaatatatattttaattatatctcattatggcaaacacctataaaatatagcttcctgatcttttccttcagggtaaagaatctccatattacaaagaggttcatttcctacatatttgcatatgtttttgtgcactgaatgtggaaactttcattcaattttaaatgtttcccttggacaatgatcaatttttttgtgagtggcattttatcttttaatttattttaactgtctgaaacagaccagctgcagagtggaaagtgtgttgacatttatctgaagtcttatctttattaaatcacttgtattattatactacataaacaacttaataaacacaacaaatacttatctaactggactcagtaattctattgaaccagccaatttacttttaattttctgaaaaagataaaacctcctgtatcagttgagtcaccagggaaattaagtcttcagttatcaaatctgttaccaaatctgaagtaccaccccaagagtacctagagggctttgattctttctttcctattgacacccaatggaacttctagtgacctttctcctcattccagtttacaaatgtaaacagttaaggaagttttctttttctaccttcccctaataccccagtaacattcagttgccctttgccatactagccattaacaagagattattgagttttcttcaaatattcacattcaaatttgtattaaaagaataatgagacagggtctgcacaaaaagaagtcaaatggaaggatttaaatctgtgctgtcaaatatggtagctattggctgcaataaaatttaagttaatttaagatttagattaattaaaattacacacatttaaaattctgcttgtatgtaaccctagccacatctcaaattctcagtagccatatgtggctagtgggtccctgattagacatcatagagacagaacattttcatcattgcaggacgttctataagacaatactaacctaaataacacagaaaattactacttagtctagtctaaacagctccatttttttaattgtaagggtattatttccaattgtattttaaagtaactttattgtatttttttaagtaaaaaagtatgctgaagcatcctttgtttctttcctcaacacaattcccttcatctccaaagggaaccacaatccttaagttaatgagcatattttccacatgctttttaaatatgtttttcctaaattagaatatagcagcattttataattttatattaataacaacaaatatttcattcaaaattttaattaaaaatacgtttgcatgttaatagcttgtttggtattccttggcagttaagtctcagataactttttatgccattgaatgaatatgccctattattcagtcatatttcaccttttatgtattttaaaaatatttctcttctcagaaataaccaccaattaggtgatcagtatagaaaaaaataatggaataaaaattaccatttcatttgacacgtatattctactctcttattcctcagagtcaaataaatcccctctaccaaataaaggactgggttgctgctgctgctaagtcacttcagtcgtgtctgactctgtgtgaccccatagacggcagcccaccaggctcccccgttcctgggattctccaggcaagaacactggagtgggttgccatttccttctccagtgcataaaagtgaaaagtgaaactgaagttgctcagttgtgtccgattcagtgaccccatggactgtggcccaccaggctcctccatccatgggattttccaggcaagagtaaaggcctgggtagtcaggggctattaaacataaaagcttctgtgcttctcttacctaaatactgtttatttaaaagaaagaaaacaactgcagagattaaagtataagataattaaatgaaaagcaagaactgacaatattatcttttcattgttttaaatactttttacacttatttttgacctgttagaggacaggaatataggcttaaggaaaaa

SEQ ID NO: 28235 - DNA, 858 bp, Bovine  19866880562834
acagcatacctctagctgatactcccttacacaactgagggtttgccttcacctaataatgatctagtctctcttgataatccttcatattcatttccactgataggacaaagcaaagccaggacatcaccccaggagtcttattaccactctttatgggtttctttgttttatatccaggttatcatctctgttggacaaattgttcttcaataacctgctcagtcagaaggctgaagtaacttaatttgttaataacaaaaatcttcctctttctcttcctctgaatttgtaggggtccccattcttatgacataaacctactcaccatcacaaatgccttttaacattttgagctatagcatttgccttcaaataagcttttttaatcaggtcagaagacattatgcatcacacatatagctgaaaaataacattcaccagcttcacgaaggcttggctatcacattataaattcctgcagtagaggaggatggtaatagtaatgtcaagtcccacccattctttaccatctagagaacacttcatgtttcttgcttgcttataatgatatttttaattgttgtgtcactcaaatatagcagttattgatttggtataaaaatacttcattattctggaataccttttctatttcagaagcatccacaaagattgctaatttttctcttgagaaatagaatgaaatttcaatagagatattatttgacacaggtatgttattcctcctttatagttttccataaaaaaacaacagagaatcatgccctttttcatccaacacagttctgataggtagaaggaaagtattgctcatcattaagaattcatctatca

SEQ ID NO: 28236 - DNA, 1160 bp, Bovine  19866880581171
aagtcgtgatccttcttcagtatctgccctagtacccaaaaagttcatcttcctacagtgaaatattcctcacgtcactctgctcaaaaacttttagaggtatattcagaaagaagaataaattcctcctctttgttatttgtcatttctggttctatacaattgtctcctccactgccagctcccactcttccccaaattaatctttcgcttcacccgaactcagtatttgtcaccacctcctcgcttgtgctcagtaggcatgagcttgctctcttcctgccttggccagctcttactaatcattagaacatcaccctagtcccacatctgtggaaacttatattttacatttatttctcttagagcttatatctcccgttacctataccctttatatttgctaagtcgcttcagtcgtgtccgactctgtgcaacctcatagacggcagcccaccaggctccccggtccctgggattctccaggcaagagtactggagttgggtgccattgccttctccgctttctatttgcaactactcacaaatgaatgcacactcttgtgttattctgtaactgttcacataggtctgtcttgtctcttccaagaaaaacacaagttccttgtcagaaaccttgcctttaatctcttgaacattaacctgctctggcaattccatttcttaagcaacaatgccatctagtggttggaagtttgcatggcttcggctgactttaatagttacatttataagaaggatatagattaagtaatgaactcaaatgattcccatcaattacgcttgctcatgaaggaacttaaaatgcagatttatgtgctctcctttcccagtactttccccatcctcctgtggtccagtggcccacaaactgctggtaaggggtctctgcgtgtgctccctgcaaaccacaacatccctttcccgtaggaagatcactagacgcttttatggtgattatgcgatttttaattctgtgcttcctgttgatatagaggtttatgtgcataaatatttattttggaaataaaatatgtacttgaggaagaaacttgagatgataaatatgatagccagagtagaaactcatttcaaagccaaatgggagaggcagtgtggtgtagaggaaagcttgtgta

SEQ ID NO: 28237 - DNA, 1705 bp, Bovine  19866880586677
atttgtgaattttctaattttgcttccgcagttgatttctagcttcatcctgttgtggtctgagaagatgttttgtaaagtgtgtatcttttaaaatctattgagacttaattgtggcctaagatatggtctgtcatgagaagtgtgtcacattctcctgagaagaacatacatgctgtttaatagagtattctgtatatgtatgttgggtagagttggtttattgtgttaaattttctaattcttctgtttcatctagttgttatacactttattgagagtggtgattgaagtgttcatctattattgtaaaactgtctatttctctttttaattccatcaaattttgcttcatatattttgatagtgtcattaggtgcataaatgtttataatttaacagtcataacctatggtactgaacattttattaacataaatatgttttctttcttataaacttttttggtttaaagtctattttgtctgatattactgacagctcctttttggttactatttgcatggaatatcattttccatcctttcactttcaatgtatttttgtctttggatctaaaatgagtctctggtagacagtatatagtcagatcatatgtttttcggtattctgccaattttgtcttttcattggagagtttaacacctatttacgtttaaagcaattagtgacagggaagcacttacccctgtcattgtgctgtttgttctctgtatactttatagcttttttttttttctttttgtccctcatttcctgcattactgtcttcttttgtgtttggttgattttttttattgtgaaatatttaaattcctttcttatttccttttgcgtatattctgtagctattttctttgtggttaccatgggaatacatttaacattctaagtttataacactctaatttgaatttataccagcttgacttcaacaacatacaaaattctgctcttttacagctttgtcaccacccctttttgttgctgatgtcacaaaattatatcttatatgctctgtgtgccccaaaacatgaactaataattcttttaaatgcattagtcttttgaattatgcagaaagcacatttacagttacaaactacattcttttaaaaatgtattagtcacttatatcatgttaaaagcataaaattacaaaccactgctacaataatactagctttaataagtgcctctttacctttattgagatgcttatttctccatacagcttcaagctactgtgtagtgttcttgcatttcaccctgcaacacttctttgttcatttcttacagagcatctagtggtaatgaacttccttagcttttgtttatctagaatatcataacttctccttcatttcaaaggacagtttcaccaggtatagaattcttgaagtgaaagttgctcagttgtgtccaactcttttcaacctcatggactatacagttcatggaattctccagaccagaatactggagtgggtagcctttcccttctccaggggatcttcccaacccaaggattgaacctaggcctcccacattgcaggtggattctttaccagctgagctaccactcagttgacaaattaaaaaaaaaatcacttcagctatatgggccccctgactcctgagctccaaagtttctgataagaaatatgagaatttactgagggat

SEQ ID NO: 28238 - DNA, 2302 bp, Bovine  19866880669522
tggaagagcagttgacataatggctcactatggtcaaagaactgagcgtgtgataaatcccctatttcaagcctttagcaattttgtaaagactctctctacatcaagcttagtagcaatgattatgtgtagtggttaattataagcttttggggccacaagagtcatcatactaattgaaaactaaagagtagggtagagatgagggaaaaatgctttaaaggaaatatatacctgctaaatatgaacttaaagaaatgctgattagattccagacactagggagaaaaataaaaacatagattatctgagacaagcagttctcaatcaggggttatgttgcaccccagaagacatgcagcaaattctggaggtatttttggttgtcacaaccacaggagtagagtgtgtattatagcatctcacaggtaggggtcaaggatactgctaaacatcatacacatgacaactgctcacaacaaaggactatttaacctaaagtctatcaatagtgccaaagactgagaaatcttaatctagagcagaacattctgaaacaaggtggctaatatttaacttatgtgttcaaaggagagctacacatgaatgcagcttgcagagtataagcaatactgggccaatatcaagtttgtttctgctgtttcaattttccttgatatcctaaatctacttattaagtataaattctttgtgatatctttatttatctttgggtcaaaatctcactcaataaaaattattttaaaaaatcagtcccaatacaaaatggcttagcattccatgaatgattttcttctagaaatggaaatatgttcatatgcaacaaaatgcaaaaggccacaaagaatgaatccctagatgtggattctaggcatgtgtgaacatagtgtaaaaggtttgggtttgagggcaaagcatttgtgcatgtgagggtttcactagtggctcagtgttaaagagtctgcctgaaatgcaggagatgtgggttcaattcctgggttgggaaaataccctggagaaggaaatggcaacccactgcagtattcttgcctgggaaattccattctcagaggagcctggcaggctacacagtccatggggtcacaaaagagttggactcaactgagcgactgagaacacacatacgcagttatgcatgaaaaccaagtaacaggtagctggacaattggtaatctagacatctcagacatgttaatggaaaacaaaccaatttcataatttcaagtgaaatccatgaaggtctaggtaatttcaggattgtgcaggccaagtttcaggtttacacaggctcaagactctgacgtacaagtcttcccaaaaggagaaaaggaccatcaccaaaaagtaaaattaggttgtaaaaatctatttaaaccaaaactaatgagttatccacagttctagataggaatatttcatttcttttccttttaatgttcatgagcatcacaaagttggaagtcaaagtatcctgaaaatgtacttcttggaaaataatgttgattgaaatttattactaacatatattataggactataattgtctaaagcagtaatctatggttcatataacagaaacatggtttaaaactttatgttaaaaaagcatggagactagcaataaataaataaataaaacagaagagaaaggatagtctcaatttgtattagaaatccactcttcttagcatccagcaatttgggatttctgtagcatgctctggaatgtgtaacccttacactcactttggctgttgctctccacctcttttctagcctttgcctatgttttactcatttctggcttctttccccaccctcttctttttatattttcccttccatctcttgcttgagctaactcccattttgtatttctgctcattcaaattccatcatatattagaaacacacacacacacacacacacacacactctctctctctctctctctctctctgtctccagagtttctcccgtgctcaagatcattcagtctcagtgcaaattttagtatttcttctcagcattaataagctgatttcattgtgaaagtcagacaaggattttagtctatgaataaaatatacaaaagggacatgtgcccaaatagactgaaaaagaaaagcaatacaacacgtttttaaactaggcaaagaggacatatataggaagtatatttttctccttatgaaaataatatatattcttttgaaaacttagaaaatgtgaagaaaatcatctctaatactatcacaa

SEQ ID NO: 28239 - DNA, 1193 bp, Bovine  19866880684650
tcttctctgaatttattaagttataattctttagaaaaggatcatggtccatttaaaagtgtgatttcccatgaactcttgacatttattttattttgcaaaaaacagtcttccctctgttttgcagaactctgtacctgtcaccagcagtcattagacttgttttctacaagaccatttccctctggacaaactcaccttcctccaaggaaggttgaggcacgtgccatgcttcagaggagtcagtgctctccaaacggagctgaagcaggtagactacatgtctcactactatagaaggtgattctggagtacatgatttggcttgtgccaaagctataccttccagggctgctcttagaagattcctgaagccagtattctactttgtctatgcttatagccaatggcaggcttcccttgtggctcagctggtaaaaaatctgcctgcaatgcgggagatctggattcaatccctgattgggaagatcccatggagaagggaaaggctatgcatcccagtatgctggcctggagaattccatggcctatagtccatgtggtcgcatagagtcagacacaattgagcggctttcacttgtcacttgtcatagccaatggcagggatgccacaaaagtctacttcactgccaaagacattatgttttcaatctattttcacttgatatagttttatgaaagagacacaacctaattaaaggaaatccttgttactatgatgtctactaggaatattatgattagaagtaaatcatcgcaacatctataataaacatattctccaacattgtgtgttttgattataaaattttttttcttagctgaccataacacctcccagcttgggaagacttttattttttaaataaaaattgaatccacttggcagtttctaatgaacgtaaataagtgaaaatgatttacccctgtgttgttctctcccatttaactgctgtctttggtgacaaaagtaccaatcatcaatgccttggaatctaataattaagagtaacttactttctgtagcccaccagactcctctgtccatggaattcaccagacaagaatactggcgtgggtagcctttcccttctccaggggatcttcccaactcagggactgaaccttggtctcctgcattggcaggcagattctttaccatgtagccacca

SEQ ID NO: 28240 - DNA, 1737 bp, Bovine  19866880712402
caaggatctattggcacctactaagtcctaggtgctagagataaagcagtgaaaaaacagaccaaatttatcctcacggaacttacattctaactaaagggttaataaaatccagtgttttaagatcttactgtgggccgggtattcttttacccactttactagtattagctcagttctatcactctataaggtaaatatttttattattcccattttgcaggtgtggaaactgagactcggtgagttaaataactcagccagacaccctggctctagatcagccatctctaccactctctcatctttcagataagaggatggacttaatagccggaggcatgaggatgacaaggctgagttgttcggtatgagtttggagactttggtgctgatgttctaatgcctaaatgcatttaatggagcagtaaagatggctgtcttctcacacatgctgtgctcgtgtcaatgaggctgggatacagaataagctcccttgttctttctccctccgggtcagactgtgcctgctccacttatgtaagtcagttcctgtgaaactcttaaccagggaatctgatctgctcatttagtgtgattggctcattcagggagccaagctcttgttcctgaagcccaatctcagtcaaggctccctccactacagaacctgtttatcaggaagaagtagcatggcagcacataaagttttatgtcaagaaactcacagtggaaggagtccaggggtggacaatccacagctatacaacgaacagttgcaatgacaggatgataaagacagatacatgtgtggaaaaacgaagccactcaaacatacacacatgtttagccatttcacacccaatcataacaacaacaaaaaaacgaaaatggccacacgcagccagatgtacaactttgcagtgagaacaaaggcagctataaatattccaaggagccaataaaaagaagatgaagaagaaggagaaaaaaaaacaggagtggttagctctccaatgtaatgggctccataaaagcttttattgttaacagagttactttactaagagctatatgaagaaagctgaatgaatgtgaaaaattgcatgcaataacccaagctgaaagatgattatcaacctctgagtcctgtattttggagccagtcagtgctgctattagaagattgccactgtagttaaagaaaagcttgttttgtacttttctcccccttctgggtaaacagaaagtcaatacaggcttctcctgtgttttggtccatttatttgaacaattattttaaagatgtaatccaatcttcctgactttccagaagtataactcctgtgaacttttccagcagagttctatacacacaacttgctaaatcaagaattgagttatttccagtaggccttccctccttctccatctgccctccaccccaccccattctctagccatctgtttgttttgttgttggctgttaacaggatagtgggtgacatttaagggagatgacccatctgcacttcaaccattcaaaggctagccaacgagaagtgtaaaagttggaaaactttaaaaaaaaaaaaaaaaagggacattattctcttgggctgttagtgtggtttttctgtattctcagtctgaaaacccctgttccctgctctgtacttttctgggtggatggagtcagtacaactttccaaaatgctagtgccagaggagaaaaaa

SEQ ID NO: 28241 - DNA, 1786 bp, Bovine  19866880753323
caggccagcgtttctcatgatttactctgcatataagttaaatatatgccaaattgcccttggtggacaaaaatgccctctggttgagaatcacagctctagctcctcaaggtcaaagtttttggtgatcaaagagctattgatagaaatcagaacaaccaagactgtatcttgacaggattagagaaaaccattattgtgtgtatgatgtaagacacaacatcattatttaaagcagtttacagtgactgaaaacacaaatttttccattattttataaaaataaatctgagatgcctggcactcaccactacccctgtttttctgtactagattattccataattatagatatcaaaaatatttagatttacatttcaatacttcaccaaagttttattaaacttccttcattttgactcaattaaaactgagctcagtgtagtgagtctcaactgacctttcaggcttacatagaaagaagacaccacaaagcttgcaggaggcctggactcataacagaagagagatgtatttaaggcgcattttcatacctttgcttctctagctcttgaaatggataaaggctggaggcggggatctgtcatgtaggtttaacaaatgtccagtgagtcacagtgactgcccttaaagggatagggctgttcaagtgagactttacccaacaacactcaggcaaagtccacgttgttcatgttttcaggacagtgttcgtagtggctccagccaagatcttctgacttgccacctctcccttttgtcaagcccaatctctttgtacttcgggtttcctgacccaaagaagacctcacattctgaatctctgtttcttccttttaaaacatgtccctatccgtttttaagagaatgtgcttaagttttcaaaaatccgttctcaactgtatgtcacacgaatacaagaaattgtattttttcaatccttccaaagctaaatttgagctcagcagcataaacactccctaactgctacctgagaacataggcacagagaaggtaaggacagaagcagtcagaggttgctgatgtttcctttgcattggaaaagccttgcatacccatgggccactgggaatataccctagtgactcaactgctcctttgcagcaactacagaagagaaaagttcttccctgtatatgccctgagctgggctgaagcattctgtgataatcctggtaatccccaggattaccaggcagtagttaatattccagtaaattcttgatttctgcaataatgctcacattcttctgagtgatgagtagcctattccatagtgttgaatacagatgacccactgcatctgactgctcaacatataccccagggagttcctgaaagaatcaggtaaaagagcaagccttgaggtgggcaaaggcaacaccagggcacctctgccccactcattcatcattaaagccacttgtggttccttcatggactccatattgaagactgtctgcatgaaagaatttaagggaccaagtttgtcttcaagtcatctagctatctaaaggtgccatgaaggtgagtatgggtccatagggaaattaagctatagattaataagattacacatatgcttgccacctattgctttgtgctttcagggcctcagctaaaaccttattcagaaagagtcccacattaacactatgctacagttaaataataaagaacaaaattggtctaaaattgccttggcaaactccagccttcaaagtcaagagatctgtgataccca

SEQ ID NO: 28242 - DNA, 813 bp, Bovine  19866880786449
aaatcaattgaagttatttactcatagcagaaaatatgggtgattgccaaccctatggcttagtgaattgctttctcaccacccgctgccctgtaatgagaaggtacatattcacttcaggggttgactaaaacctgttcatgtatagcagcaatttgagatgcagaaagtgtttattattaaaggctaagagtgttgaatgccaaagggcatctttatcacttggcattgcattaacattgacaaaggagagaaacacgcccagaaagcccctcggcattggtcaaatggcactcaattatagaagtgaagccaggtagcagccagtgggtgctcttgccacatccttcctggtatacagtgttatgcagagaccctggttaaagacaatggaaatgtcaattaaactgaatggacagggcctatttgttgatgggttttctctctttagcatgtagtaggtgacctacagtgttttgatgtgagaataaataatggcttgtataacatgggttgcatttaatgtgcttgaatgcaaaacagtataagggaaaaagcaaacggagacagcgatggggatggctgtggaggcgggaagaggctgcactgggagccgcacgtgagtgaaatctcttgcaagctgagaaggtcatttgctcttgtattctctatgtgacatgagtaaaaagcaaacaatagaagaatcatttcatttttagaccagttctgtgcaaccagctgcacaggaccatgatgccaagtcctttagagttactcgatcttgtcatcatgtttgatgagaatagcgcaaaa

SEQ ID NO: 28243 - DNA, 1640 bp, Bovine  19866880792537
actcttaatctcagtcagctgctaccactcacgctttctctgcaaagggcactaatcacatcagccagggcctttgtctttgcttcagagctcctccttgacaattttctgtcagtactacccatcttttgaaaacgggctcatcttcgggcttgcagaacaccacacgattctgtttttttccctcatactctaaacattctatatttatttcttttcttggtctttcctgcttctcctgcccacttaacaatacgcatcatagtccaaaattcaatttgaggcttttctgtttttcatctctctagcaatttatgtggtcatcattttattgtagaagactctgtagttcttcatcaatcttttcatctaaatgcagtcctatattttcatctatcctaagagcatttcagtattggtatattgcaatcagcttaaatacaagattttcagaactaaacaagctcttcttttcaacatatataccctatcaaaaggtttcttttttcaaggttcaaaatgctcaaatcacttttatgattctattcactatttagtctccaaatcccatcaaatttttctttgaaatgtctttcttcatgtgtcttcacccctcacattcttgctgccttcatctgagccacggccatatcagctcattcctggatcacagaagcagctacctatctgccctccccgaccccaagctttctcctctccaaactcacgttcatgccactgccagactaatcttctttaaatgccactttcatcttgtcactgtctgctgagaagctttcaatagccctttaatcacaagtgaaggtgaccttggagtttatctcatttaacccctcactttatagacgaggaaactgaggttcagcgagagtaaggggttactcaaggtctccactaataaaccccagaaggaggatttaaaatcaggctgttattaccttgagggccagtgctctttctacttcaacagtatattccaaaattccactcacataccaccttcaggatcacatctggatgctgcttgtacacgtgtgcgcagttgcttcagtcgtgtctgactctttgcaaccccatgggctgtagcccaacaggctcttctgtcaactgggattctccatgcaagaatactggagtgggttgccatgtcctcctccatggatgctgcttgtatcacttcttatttcacacatttttaactgttctgctttaaaaaaatcatatatatatatatatatgtatatatgaatatatatttatatatatctcacaactatagaaagaaagccattatcactgaatggaattagaagtacaaaataatcctaaaattaatacactggggacacaatcatattattaactcataggtggatgagtttctgttctgaaggtctattttcttcttctctacaaaggaaaattaaaatgtgatagctagggtgatgtaaaatgtatataaaatgtgatagaaagtcttactagtgtaactaaaggaactgaaaggggaataactttctcataaaatgattcagcatttccaagtgcttagtgtctacttacacctaaatttgtcttctgtgccacagttataagcttctcatgtttagagacacaga

SEQ ID NO: 28244 - DNA, 913 bp, Bovine  19866880835904
tcaaccttagtggatagattcttgacctctctgttaacagacatgcttcatctcagttgtgcatatctgatgatatttcttacactatcaaaatgtttagcagtcttatgatggaaagggagaaaggatttaaggtatttaaaatacattcaaatactttttatatagcttcattcttttatgtgcccaattcaaaattcaaagactgtatatatatgtgagtatatgcattttgaggtaaaaaaattaccaatgaaagtatagaattaaaaataactgaaaatagtttatacactgctgcctgtttttataccaatttttaaaaacctttactagttttaatatttactttatgccctttaaaggactcaaattcataatatacaaagaagtttatgtgatatatagagcagagccataaaccatattttatgcataacagtgattaaatacacggttgatatatttcacaaagatggaaaccatgtcaaaaggtttacattttgataactttccttttggggggcatttctaaattatttaagttgaagaataaaatgacttgtttgtgaatttgcatgatctttttaatcatctttaggtaatgctgatatggcaaagacactaaattacaggcagcagtgggaatctgctggataaaaaagcacagactcgttttgtatatgagtccatgaggaatattctgttcaaggagtggagacataagaaaattacctaactcatgaaccacacattaagagcgtagtcagctgttgtaaatgcgtatccaacaacaaaccattatatatctttggcttaattatatgtgcttattatacacctgtactgcagagtagaggctgctatttgcattacttgggggggtttctctatcaaaacagcattagcatta

SEQ ID NO: 28245 - DNA, 1225 bp, Bovine  19866880870255
ttgcagattgtgctgtttggaaggagcttccatctcatgattatgactgaaagttgctatctggtactgatttcacccatttctgtccctgaacctgtagctgcatttaggaggattgataagaacacaaaggaagcagcgtctctgattctctgaaagtcgttttaatttacttgtttccactaattatttatttcagttgactgctcatcattgtcgtaactatagttctttctgcgtgaaactcaaaacagaattttgagggatggtcagcttcttatagcagctggaaactgatgggaaattaaaagagagataaagcagagtcacgggagacagaggggcttacctgaatatgagggatccttatgaaactatttttcaccaataaattattatttgtaatgattcttcaaacctaacattggtaaatcagctattttgttaatggcttttaggaaatatctagaaccagacaaaaatattaacaaagattgttcacaatatgtttgttggaagtgagttttcttttgttggaaggcacctgaatcatcattttggttttattgaactttaaataaagtctttttctagtttccagaggaagctccttgcccccaagatagaataagtgatagcagtatatatatgtgtacatttttaagattttatgtcattgctgctgctgctaagtcgcttcagtcgtgtccgactctgtgcgatcccagagacagcagcccaccaggctcccccatccctgggattctccaggcaagaacactggagtgggttgccatttccttctccaatgcatgaaagtgaaaagtgaaagtgaagtcgctcagttgtgtccgaatctcagcgaccccatggactgtagcccaccaggctcctccatccatgggattctccagacaagagtactggagtggggtgccattgccttctccaacaccaaatcaggaaagagacaagacaacactgattcccaagtacatttctaaagagaaatgtggggatttcaggtttcttttgattattaaggtttatatagcttatttctgaaaactttcacatggtaactacactgccctcccatcatttagttctgactcccagatgatttgagactgtgaaggttccattgtctgtgaaatgatttctaatggtgatactcagggggatttcttcttctgaatgctattagtgacctaacagaaaaggg

SEQ ID NO: 28246 - DNA, 1551 bp, Bovine  19866880890428
ttaaatgagcttttaagtttctattacttccaattttcccagtttcctcccttggctagttcttatgagtgaattttctagtcaacttatgattccacttcagtaatcctctggaaataagagctcaaattaaaacaaggaacacacaagtggacactaacagaaaatattttcatacaataagtcatatgcaaagcactctgtatatactatgaaaccgatacattgagtaggctaaaagccaggttattagctatgacctaagattactgaacataaaaacacaccaccgtttgttttaaggagtggtaagataaaaagtgagttggttgggttatattttaaaaccatttttaaaataatacagcaatttaaaatttttaaattgtgatgtttactaaaagcaactggtctctacttactttctgccttcatcagctgataaccccacagatccttgtatactatccaggaccccagttctcagcctggttacttgttccagtgaaggcagtagctttaagagaattctgcctgtggagtaccctttaaaatcttttgaaatacaaatacaatattagacggggctattaattagaaagtgtttcactgacatctgtaggtatgactgtggaactgctgtggctaagcccaaggagaatataggcttggcaggtatttctaatctaggaggcattacagaattgaagcctggactgctcctgctctgagaaattagcatatccaataccatactgctctctccctccttactcaggaaagagaaaccaccaagagctcgacatccacacatagcaaagcggccacaggctttcatgccaatgcctttaaacaataatcgggttctcaatcccccaatcctatttttattttgcattttctaaagtgtggcataaaacacaaatggttttaatttttttcacatttcagattactggcagagtgcactttagggaggctggttgtaagtatcactgtaaatagaaagaaatacaatgaagaatagacataaaatcactggatgaaattacatatttaagtaaatgtaaaacatgactcagttgatcaatactgttatttacgtggaattttaaaatcatacatgtattacatataaagtttaaacaaattagttgatttaataataataaaggcattaaaatttttttcaccatagtaaaagcagctcttattttaagtaaataagtgttcatatatggagtaagcttgtgacttactctgccaaacccaaagcttgaaatagtggaatcttcagaatggatcatgtaaaccatttcatttactgaagtggaagataacttcccaattctgccaaaaattttacattcttaattacattataattctctctatcctcttgacaaaaggatataatgaaagtttgggtaatagtggatattcactgagagaagcattgagagatactgtgagagaacatctgatggtttggagaaaaggaccagctcaaattactctaatatttgctagaaaatttgggatgttccaaat

SEQ ID NO: 28247 - DNA, 1081 bp, Bovine  19866880893153
tgggcggatgctggtgatttggcgagcaaaaggagggaatccgcccatcccaggcccgccggcttcttttgagccgggaagtgagcgcaggagaagttcacccggcgattcccgcgatgggttcgcgcggggccagagaggctccgggaagcgcgggctggttgggccggtgtcggccgcggctggcgcgctgcaggacgcgcacggggcacagggtggcgctcgctgtccgtgcagcgggaggaggcggccgcggtgcctttgtgtgcgcgggcgccgcttgcggcggctcggctggcagcacaagggggaatgcgggcgggtacggtggtccgggatagacccgactgccgccctacccttcgctgcagctcttgggtggacaacgcagctcgtccgctcaaaagcttccggggaatcggagaggctttttgagagcagctggcaagtcgagaagggaaaggaaagaggaagtagcgtttagagaggctggaaaactctcttgggctcaacacatcgccttgaattcactgaaacagaataatggcaactttgggcagcccaaactcagcctcgagccccgcaagagaagcagcgggtgtctccaccttccctcccgcgcaagaaatggcttgtctgagaagtaaagttagggaatgggcttagaagaaattccccaaatggacaggaaagaacaacagtgaaaagcagcagttttgagcgggcgcttcattcccggttctcagtcatcctccagctcccttcgctgtctctggagctctagaagccccgactgtcgttaggaatcgaagcaaaatgtatttaaggctgcttcctcaccgccaggagactccgcaggaaattaaattaaattaacacgcgcccagggaccaaagaaaacagataccagccccaaaccccctccccccgctaagcaaatcaacacttcagcgtacagggaatgcggcgaacctagagatggccactgacgcgcatccccttaaaccttagcggctggagcaaggaattatcggctttcctttaatccggaagcagggaataaatagggcggaagcaaatt

SEQ ID NO: 28248 - DNA, 1663 bp, Bovine  19866880983453
tgcacacacacacacacacacacacacacacacgaaaggaaaagttaaaatacaggcaaactatgaacactccagtgctgtgagagttctgtacacccactacacagatggtgattgcggaaccaagctttaaagaggtccccacctaaagagggtagggcatccaacaggtctcatttctgctcagacatctgtctataaattctagaaccctgtggcgtgatacagcctaacccacagtagttaaccgatttttatagctcaaaatgtcatgtgaaccactagccaacaaagagggaacaataaattgtattctttctcactggtgaatgcagcatctacctccttccatacccagccttcagatatcctcccaacccctcctctccattaccccatcgtcttccttttgtatgaagctatagaaccagcaaaactaatctatagtgataaaaagaaaaaaagtcaaatcaatagtttactgggggaagagggtggattttgactgaaaaggggcatgagggaaatatcactcttgtccttacttggattattgcaatagctatctcccatgggcttccttggtggctcagatggtaaagaatctgcctgcaatgcaggagacccaggttcaatccctgggttgggaagaccctctggaagaaggaaacggcaactcactcaagtactcttgcctggagaatcgtatgaacaaaagagcctgctaggctacagtcaatagggtcacagagagttgcccacgactgagtgacgaacacataacatatctctcatactgctcacttcagtctgttctcagcacagcacacagacaatattactaaaatgtaaatttgattgtgttgcccttctgcttcaaacccttcaatggctccttatcttacttctcactctaagtaaaaaccaaattccttacagaaggtataaggttctatggagtttggcaccaagctttctggaaccgaaccactctgtcccacattggctaccccttagacataccatagccctttatatcagctaatatattatacacatatttgtttattttctctcttcccctactaaaatatctactctcttctaaaacatctgctgtctattatcaaaggcattgattgcttaactgcagcatactcagcaatagaacaatacctggccctcattagtcaataaatatttgttgactagtgtttggatgagtgtgatacagaagagtttcaaggcctgaagtgctcttttctggacttttttagtgtaggcctgctaccatctagttttgcttcataaatcttgttcaagaggaggatttaagatcagtggataaagatctatatcgcagctatggagttttactctgctactggtttggacctggtgtgccaatgcaccaggcttccaagctgtcctactatgaggaggcatggcagtgaacacctgcaagcccctggggaagcagagaaagcccatgttgattttaggattaagcctgtgaaagctctttgaaatgttaaaagttgtatgcaaatctaaggaataattattaagggaggttcagctataccgcatcagtggagaacctttaaaaaggccctttgctgattatggaaagatgggtttccatcacagctttattctttga

SEQ ID NO: 28249 - DNA, 769 bp, Bovine  19866881026268
tgggaatgtaaaagtcaacagcatgacagaaactgctcagacttagagaaaaagctttttagaatacagatgtgttctaaaaatcctcctgtaaaaaagtgtgttccgttatcacagaaggaaagaaactcaaggtttttcttatgtttagggtatatttatgtgatattaaggatgatgaagcaaatatttagcagctagggtactgcgcgcagctaacaataattcctttatcatttacccaacaagaagataagtgccgttttccttcttttgcaaatatatttgccagcagctgtttcaacatttataaagaccatttccactgattgccaaataaccataaattcatttacacatatttctgagttggaggcataaaaataattacatgtctgattaaatccacttatgccttcatgtcttactaaatctataatagacatgaattgttacgatgtattacatctaagtgcataaataatacaatgcagacgtagagtccagtttttctacaacagaacgtgtggagataatttacacaaatatagttgggatacagtataaaaaacaacttattttagaaattgttatgacacagaaaatgtctgacacagaaaagtgggacttcagctagaaaactaaagaaactatccttgtttatcactgcctcactgtcttgaaatacatattaaatagttatcttaataagcttgtcattagaggagaataattaagctgaaaactccttttcttaatatgcaaacta

SEQ ID NO: 28250 - DNA, 853 bp, Bovine  19866881128394
tgagttcttgtagtattcaggttagactctgtcacctccctgtgattcacaacaattaggtgaacttgcttagtttcaagatggaagagctgtctccagttgtctctcagacagagctggagaatataccaagcccactttaagtccttgttcatctcctcatggcttctctcaccagtatttggtagtcatattgaaaacaggccatccatataatcagaggttgtctgttgaattcctgtgtcctcaattcacatgacaaaactgaggctcagaaaaattaagaaactggcaaaaattgtgcagcttggaagtaatagacattacattcaaatccagaaaaactagattctagttccagttttgaaaaaactagctatgtgaacctagcaacagctccttccaatattttattttaaaaaattttatcacccagagtctccactgtctcacctatacaataaaaggattaaattagatgatctctaaggcatcttccaaggctaaaattttgtgagtctaaatgacaaaatcattaacaaacattgattaagatacatcagttataagcaggcctccaccagggacagaaatagaaaaatccctattcttgaggatccaataatctaaaataaataccaatttcacaaatacagaagatgaaatagagacaagaaaaatatatatacaatatgcctttaaaacctagtgaatgctgaacatataaataaatattgagaaatatgaattatttactttcaataaacattaacaaattgcctttttaaaaaacatttttttttaattgaagggcaattgctttacagaatttaccttgtttgctgtcaaacct

SEQ ID NO: 28251 - DNA, 935 bp, Bovine  19866881170006
aagagagaaaagaaggtataaggggaaaaagtccagctacttgctttaaactcagtaaaggaaaagagtcttaacctcccaactcttaaagggccaatattttagagaatatataataatctggacattacaatgaactttatctcttatcacaaagatttttcttcatggaatattgttcagccataaaaaagaatgaaataatgccatttgccgttacatagatggacctagagactatcatcctaagtgaagtaagtcagaaaaagacaagtactgtatgatattgcttatctgtagaatctaaaatatgatacaaatgaactaatctacaaaacagaaacagacagagaacagacaatggagggatggactgggagtttgggattagcagatgcaaaccagaatacacaggatggattaaacaacaaggtcctactatatatagtacggggaactgtattcaatactctgtaataaaccataatagaaaatatatggaaaagaatgtatatattaatatatatgtgcatgtatatatatgtatacttgaatcacatttctgtacatcagaaattaacacatcataaatcaactatatttcaataaaatcgattttttaaaaatatattttcttcaatgactgcttgtggtccttacttggagaatcaaattaatgacaatcattatttttaaaaggcacctcagagatatacaaatgcccatgttaattaaccttgaatcaaactctgagatctaagcataaatgaagggagtatttgggtggaatcagttatgctcttcagattctgtgtctcttcatttatttgttcaagcacactgattcaatacatacttcttgaaatccaactacaggcaataccatgtgcaagggggaatgactcagaagaaatttcctatgccctctgaaaaaa

SEQ ID NO: 28252 - DNA, 1043 bp, Bovine  19866881275836
agtcggacacgactgagtgacttcactttccttttcactttctgcattggaggaggaaatgacaacccactccagtgttcttgcctggagaattccagggatggtggggcctagtgggctgccatctatggggtcgcacagagtcggacacgactgaagcgacttagcagcagcagcagcaggagcagcagtcctaggtctcaaaatttttactatgttgtctttttctctaaaagttatatagttgtacatgttacatttaagtctatgacatattttgagtcaatttttttaagaagttatgagaattagatcaagttccatttttttttaatctatggatatccaattactacagaaagaaaatattttaaagggaatattacttatatataattatatataatcaataatataataataattatattttatatatattataacattttaaagatggttatctacaatcttctttttaaaaatggtgattaaaaggagctagaatgggttcactaaaatcaagttagtctaaaccaacttttcttctttaaaaacattagatttctagagagatttggagcatgatgggaaaataaaagaaacttaacacacataccccttagactgaaatacaggattcagggagggaaatataagagtcccactatatttaatacttgtcaaagcatttctcaagtagggttttgaccaagggtgacaaacgttaagactgcatcaaagcatatattgagaagaaaggacaaatgatgaggtctgcagttatgacatttgacgactgctggaggaccatgtattgcttatttcaccttcaatggacagtgaaatactggatagtgagcctggaaaacaataagcataaagaagacatgaagcaaatttgaaatgtttggcaggctatctcatggaagaagaagaagaggaagggttatgtacagctttgggaagaccaagcaaggacaaaaggctatgaataacgaaaagcttgatttcagctcagtgcaagggaaatctttctatta

SEQ ID NO: 28253 - DNA, 2279 bp, Bovine  19866881297443
ctcacttagtcatgtccagctctttgtgacctcccatgaactgcagcccatcagacttctctgtctgtgggattctccagggaagaatactggagtgagtaggcttccccttctcccaggggatccttccccacccagggatcgaacccagatctcccgcattgcaggcagattctttaccagctgagccataagagaagcccttaaacataataaacagtgagttatttataatcactgaagtcagcaacaatttgaacattcttttcaactggaaggatctcaagtgatcaaataaaatagcaattttatacctacaaaaagaccacacctgattccataaatacctcaacttcaactgaggtttcaaaatggttataaaaagcactgcaagtttcagcatgctttctaagacttaaaaaaaaatcgtatcttaggggaaaaaaacaagtaacaggagttagggcaaaactgtacattaggaatttcccttactaacagacaaaagtgaaatttctaagacatttatgaagaaaaggccaattacattactcttttttccaattttaaaaaagcatatatgcagaaagagtactgaagaatgaagagggaaaacaaatggtaagctgaaaggggctcagttgaatttatgggagaaatgaataatatctgctgaatagcacagtttctatttgtgtctttgtatgttctgaagaaggagagcttatagtttacaggtatgtgtattctcatgggcagacacattaatccaagaatgttactctcctcatggtcacatggctaatgctaggcagaggattaatgtccagtatcagccatcagatattgttggattaacaatatctactggttaaactggcttgcggccttaggatactccaccaaaagcatcctgtaaacctctagaaagaagttcaaagtaataattggaaaagttaaaatttatattcttctatttaagatattcagaaattcagggaacattttcaaaagttcctggaaattgaaaataaatgtccttgaatgtgggaaaacataaatacacaaagaatgaaaaatgagcagaaattttcaacaaatgtgaaatatagtattagccaattaaaatcacacctaatttcatcaaaaatctggggtaaaaaaataaactattcatagaaaaaaaaaagtacaagcttaatgagaattacacaagatgtgtagtctttagatcattttatgatccatcaagtagatttttgtttttctggattgagtgcttccaattgtctctaacaggacattttgagagaggatgttaggtaccaactgcttccagttgctatgggaaactcatttttttttttttttaatctgtaatcctctaacagcacacaaaggtggaggagttttgttactcagcagttctttgagcactactgctaaaagtcacaagatgtaaaaactggttttgatgactcgactggaggcatagtaactctacttttgaaaagaaatgaccctggcaggaagctatttactcctgcatggtgagctccggtgacagaaagtgtggcaaagggcttcaaatgattactggctttcagggtaacccaatatacctcagcctcctgaaagaattttagaggtgccaatctgagacattcctgccatttgccctcacgacttacttttcaagattattatttgattcaactatttttagttattgcataggtgtgaatgattgtgtgtcgcaagctagacatgttatctgagttcagtactcttctgatgtgggcagaaagaatgactgctttaagaagtcagcagtgaatgagcactatgagaaattaactcctttttaaacatgttccttgagatactgtagttcttaacactccttttcagttttaagttagccttccattctgattctagaacactatacattgaaagagatttgtcaagataaatgcaaggagcaaggagtgaactctacatcttgttttctgtaagttgcatttttgaacataacaattttcgacttgcttctgttaggaaagtacaccacaagaattctgatgtcagatgctgcttgggacacaaaaaggatgcttttaaatgatcaaaggaaaggttatgtcaagaaaatgtttatgaagaaaaaactaaaaactagaatatttaaaaacacattttaaataaaataagataaaaataactaaccaccaacctgatataacatggctttaaatgccaagtgtcttaatctcatg

SEQ ID NO: 28254 - DNA, 779 bp, Bovine  19866881418386
ctgttaaatttaaagaggtatttcaaaattagcataatagaaaaaagatctagatctaaatattataatatggtcaaataagttgatcaggtgatttctgggcggtctcccaaactgttccaaattattttattcttaagatgggtattttggtaactaactgggttcttccaggtagacctaaatatattgaactaaatattgctctacatgattcaaatcaatttaaatacacattgaaggtgttataaaatgtcatggatctagaacatgagattgctgagtcctggctgagaccccaagaaaaccgtagggtaattaaaaactgttaggcacacactgtgctattccatgcctccctccacatccatgtcagaaaaaccagcgacgatgctgctgcagaggacaggagactctacagagaggaaatgtcctaaaaaacaagatatagatagagtcaaagtggattacctctgaaagggaggagagatgattctcccacatcagtatggtttaaactggactttgacttaccagttgacaataagatgaaatatcaaggaccaagcttaagattgccaacagtacactgaatgtatgtcaaatgtataagaatatatcaaagtctattatcatgtggactaaaactaatggttataaaatggatggcacaataatatgatgagcatatactatctttcttggagaaggcaatggcaccccactccagtactcttgcctggaatatcccatggacggaggagccggtaggctgcagt

SEQ ID NO: 28255 - DNA, 943 bp, Bovine  19866881571317
aaaatatttttctaagccttcaattaaagtctcagaaagttagaaatctttcaaaactgatttctggttgaattatatttcatttggtatcacagccttgctgttcagtcagctagctatccacttttaagtatacaacattctgtgatagaaacaattatttgtcatttaaatcccaaagccattgtgttccattcaaagtaaattataaaactaacacttttagaaaaagactgttgcaaaacgtaaacttaaaaatcctttaaggttagggaatttgtcctctatgaatctttgacatactctgtggcatacagtagatggtttgtgaaagagaaaaaaaaggtacctaagagatcctgattccatgattctaaaatttaaggaattcctatttttaaaagcacagcactaaattatatgcttagactgtacattcatctgaatagtaaaaatgatacgacttccttttaaaaatacaaaacgttagtgaattgtcttctgattgtatgggataatatctaagctacaataatggattttatcataaacttcatttgtactactgagatagaaattttgcctagtacttagaggttattacttttaagttaataatgataatttttaattctaatatcatatttccaatgtataaaattcctcttcaaagagcaactagatatacagaaagtgatttcagtgggatttcagtagatacaaaatgaaagaataaatagatgaaacaatctgcagaaaaaactgagagatctggttttaacttctgttggtgcttttattttttcatttctgaactagtttcacatcagtaccccttacacacacacacatacacacacacacactaaattcatagaggatgagaaggcaattggtagtttaacaggaattactaattagttcatttttctgtgatactagt

SEQ ID NO: 28256 - DNA, 799 bp, Bovine  19866881640197
cccccatacatatatacatatatataattttgcattttgcatgcctgataatttctgatagatacttagataagtatctgatagatacttatctgatagatacttgtgatttttaacttggaagtggtagatacttttgtatccctttaagtattcctgagtgttgtactggaacacatctaaattacttgggaacagtttcatccttttgagtcttgcttttaggctttgttaggcagtataatagcggccattaatctaggtccaagtgtgccataccatcaaggcaatgcccttcttggtattatacacaatgaattggaaggatttttatgctctggctattgaaaataaaaactattcttggtcacatatgagtgcgtggatttattaccttaaattctttcaaggttttcatacctgagccttagctagtttccttacatccattctctgatcagtgctcagaagaaaactcaagaagaatataccgatagataatcagagtttttttttctggggagctctgtcctcaaaagtaatcttgtcatcttgttttccctagagccacccccacaaaacctctcaactcagggagagcccatattctaactcctaaattggcaggaagccaggcttactcctctccaggaggaagtgaactgtgtcagtcttccagctcatctcctgtgttttccttccttcctcaggtatcatgggtcttacactctctgctgtccaatgtatgagaacaattccatctatactttagtctttttaattgggttcagttaggaag

SEQ ID NO: 28257 - DNA, 964 bp, Bovine  19866882046433
caacaactaactaactaactgttgtaacttagtagctagaattaattgaactttttaggtggaatgcttatttctcagcaatgatagatattggagaaattcctttgattgagttatatatattgggacatatttatctagaaataggctaggctcagtttgtctctgaatcatcttaaaacctcatgtaaccaatggtggaaattagctcatttgcttgtgaatctttggaattaattgggagtaatgaaataatttggtctttgctagtcagaaattattagcattcaactactccactgtaatgagtcaccctgggtatatttcctagatttgacaatacctgattttttttcagacgaatgtgaataaatttccaaatgccaggttctttttaaagaatgcaagctaaatattttaaagttaaacaaaatcaacccaatattaactttgtatcttaaacatagattgcctgctttgctactctttggagtcaaggctggtagaaaaatattccatgtaaaactgtaaaattatcaatttatatgaaaaggttaacacttcacttcataccattttggataatatttttccccccatctgaaatgtgtacaatttgggctgttttggcataaataatcacaaagctaaaatggttgccaagggattagggccaagcctctctgagccagtcatatttttgaaagatatttatagaactactgaggttactcagaagtgattggagtcaagtcatgcttacagaaggttttttctttgttcttcatgctgcctcttaacccagttcagagtggctattattccactataaataaatgccaaacattctttggaaataaaaaggaaggctgaattataaacttgtgtatttgttttagcatttagtatagtgtatgccattaaagaaatatataatcaaataggcattttaagaagtgagagg

SEQ ID NO: 28258 - DNA, 826 bp, Bovine  19866882107813
caaggataaggttctcttccttctatcctcatggatttttcttagataacatacaattgataacgattatcccctctacatatataatagcaataaagctcttaaagagaattggggtcaatttgtatattgtacttgtacttctgtatcattactcttagagagttctacatcatttactcttagagaactggtcagacaaaaacctaggatatgttatacagactcatgacagtcatttatttgtgagcaaatgacaaaaggaaagaaaagagcagtttgaattcagtgaaaaattacaattttccgtatctgtgattttcttaacaaatgaaaccttaaattcactggagaaaaaaaatccctgaacacttgctaatgctgtggtttattccaacagttgcttcacatcagatcatacaatccttcattcactttgtgaaaccagttactcatggtcactcaatttcattttctttcttattggactctaacagaggcattcaccaggccttttgttttcaaaggttaaaataccccatgaaccactacatcacttttaaagtatgtcccagtcataggaacaaactcagcaacataactccagggaagggaatggggaaaccttaattttaatctgatttctgctactaaatagatgaggaaaaactcagctgattttccacctcaagtctctgcctcagatataattttttaataaaaaaacagttgtctagtgcagaagttcataagatatattccaaagcactaaaatgcttcacaaaaagtttgggcaagactatatatagagagagagagagactat

SEQ ID NO: 28259 - DNA, 702 bp, Bovine  19866882243724
tcgtgtctgactctgtgcgaccccatagacggcagcccaccaggcaaggacactcgagtgggttgccatttccttctccaatgcaggaaagtgaaaagtgtaggtgactagagcagagggcttatctgcctctccgattagaaggtcagcttcatgagggaataagttgtttttatttcccacagcagtatcttcaacacctagaaaaatgcctgctgtttctgagttgaagctgaaaaaataggtttcactactgatttaaataaattaacattgaacaaagaatcagggagataatcttccctacaaggaaaacaaggttgagaaaggttgtgaatatttgcataggatttttgttgttatacctattttcttattcctaagatttggaaattggtcacttattggtgtatcctgaagtcagaaatactgaaggcaaaacttagatttttaccattaggccttttaattcatttccttgaggaagtgtctgtgtttgaatattcttagaccatgattatagctaaaatttgcacattttataatgtggtaattgtatttagctagctgacgtcttttgttttggagggctggggtgtagatactttcgaatgtagaatttaacacctgaagtagtaattatgtgtacctagaaattatagggtagaaatggaaatggaaggaaaaggcaggttatagaaa

SEQ ID NO: 28260 - DNA, 1542 bp, Bovine  19866880412918
tgatactgtttaaataggaggcatttaaagagacctaaggcaatggcaccccactccagtactcttgcctggaaaatcccatgggcggaggagcctggtgggctgcagtccatgggatcgctaagagtcagacatgactgagcgacttcactttcacttttcactttcatgcattggagaaggaaacggcaacccacaccagtgttcttgcctggagaatcccagggacagggaagcctagtgggctgccgtctatggggtctcacagagtcggacacaactgaagcgacttagcagcagcaaccaacgttgaaatgtttgttctgcaattctttgcagggaggattgacttagcctgttatactggaaactgcagtctggtttctgtttctactgttctgctgaaattgttcatcaaagtcagggatgacttcaactcatcgaatccaaaaggcacctctttacccgacattaacagacttcacagtgttcagtacacagcgttgtgcccaccttccaacactcccatctccacctcaaggacaagtcattcttatttcttttctttagttcctccttcacaaaacctctagatgtcagaggttgatccactctccaccttcttctctcatctattttctctcagtgattttatctattcctatgggtttaaatagcctctatgctgattacttgctaacttaaatttctagtccatacatttcctctgaattcaagattctcttgtataatcagaagcacttccatcagaagcaaccctgactccacatcctaccctttggtgtgagtcctccgccttcagcatcacacactcagatgctccaaccagaaccctggggatcatctttgcatcatcccttgccctcacctgtcatagccaatcactaaaacgtccattcttcctccaacttgggtctcaaaccagaccatttcccctcatttccactgctgttaaccaagccaactgagcatcatctctacaatgtgagttgattaagagtctaatggtctccagaccaatctcctcagagcctccccgccgcaccccaccaaacaaaacatatgtttaaacaggaagctggattgtgacttgtctttgcttcaatgatggtctcatgcactttgaagaaggtatcacaaagtatgggctcaggacccttcagtataacaaccctcacaccacctagtaccactgtccccttgcctggactaccctgatttgctctcagttgtgtaagtgcaagaaatccttttcagtcactaggactttgaaaaggtttttcctccagactctgccagtaactgattacttcctttactttatatcttggtttaaaagtcatttccttggagaatactcccataatcaccccatctgatgacaaccgttggcccctaatgattttctaccacagtcccttttatgggggctttatgacacaacttatcacaacttctaaggatgttcttccttaatttttgtctctctccttagcccgcctgcaggaatgtcagttccag

SEQ ID NO: 28261 - DNA, 720 bp, Bovine  19866880586960
cttggctgtactgaggtgggagcttcccctgctccctctttttggcagtctgacattttgaacagatgcgatccatgagaagctataattatagtacaaaccactgccagggttttttctgccggggaatttctatgcccagctagagtacctctcggtgtgatctgtatatcctagattagactgtgccacactcagttcaggcctgcttggtttattgcctcttgatgaatacagagaaactataaagggaggcatgatctgcttacttcaggaacaccaatcaagaactgacagattatatttaaaaattgtttcctgagttagagtctccacatggggactcagtgggtggaggaggaacacaatatccttctatctgctttcagacaggtggcaaatcagaatagcttttctcagttttactctataacctttcagagttcatggaaagtcctcagcttctgcagtggtttttgagaaaatctgaggtttcatctttcagagggctcttcaccatgggaagttttgagtgtacatcaatgtggctggaatgataccattttcaattgggagccatactgtcctggttcctgaaaatacagaacatgtgagaaaattggacataaggtatgtaatcattttttcttggtttcattaagtctcagaagtttcctccttgtctagactgacttttccttgatgttgttgctgttttta

SEQ ID NO: 28262 - DNA, 1291 bp, Bovine  19866880600155
tatgatacattatttagaaaatatgtgtttgtatttaaattacattagaaagctgaaatcggtctttcctctaacattttttaattcatctttttataagaaatgcttaatgagtagctttctggaattttgttaggtatctattatttctatattacattgttaccttaaaagtacaaaacctcagggctttctcagataaattgaattcagaggtcttaatatcatccaccccttttccctcattttattcacagggattttctagaatgtcttctgagataggaagggagaagagtcaggattggggctcagcttggactaggaggagtgtttaaggtggagtggatacggaaagaaagtcttccctttcagtttgcacaccatttactcaatccttggaatgacaacaagaaagtccagataagcagagatgggcaggtatacgatggcatttaatatttttcttccactgttttgtttggctgttattcagtgatttgtttgaggaacaaatgcaagaatacaaattgtatattccatgtgcacatgggaagataatggttcaaatttgtagaagagttaattaaaaacctacttgcaaagtgcctgacagagctctttttttttttttttatcattttgtaaacctgactttgctctgtcattgtatatataatctttcacgtcagttcttggaggttcctattgtctaactaacttaatatgatcaaaacctagtgtaattctgaagtaatttcactaaagtctaaggataagaacagtatctaagttctttatggatttaactaatggtataaatagcaattttatatttttgtggctttttttatttctgttatgctttgccttcatgatactgctgataggcattttaaactagttaaggtgatgggaattaacatatatattgatgactgtgctagcttctttatatgaggtagttcaattcttaagcctaaaataagttattgaccaagttttttgtaggagaaaatagattcagagaatctatttagagagttatctagtcttgctaaggctacatctaatacttcatctgaacaagtgtgactgttcaaagaaccacttgaaaactgttaaggttctttttaagtgcacatgatgtcacaagaggacaataaatgacattcttttcaatatgtaagaatattttaatttttatttgataataattttgaaataaatttcattccttaagagtattatatagtatctaagatggtttctgagggaaaaaacgcaaaca

SEQ ID NO: 28263 - DNA, 966 bp, Bovine  19866880632301
ctctgggtgttaaaagaaattctacattattctctgttacttccagatttgcaaatcttcacaaaggaaccgattcaggtgttgttttgcaatggttcttactgtattcagtaacatgaccccttgagaagtagatttattagactggtaggatgttagacctctttttaaagtatgtattgaacagcataatactcaaacagaaagatctccaccaaacggtagtctctgtggctgcccaattatacatctgcatcttaccctctatcttgactcctgtctgcactagcacacttggaaattgttacatgcactagcaaagaaacaataatcaaattggctctactcaaaatcttctgctgctaattatagcacagaattaatagctgcttgaaacaacatataactcacgaagttcaggctacttccctgcatgattcatctttaattatccaagaaatctgccactttgatgtctttcgtctactatagtacagaaggtccccacaagggtgcttccctatagcccacagcattatctgcctccacatttacctatgttctcctccagtaaaacaaagagaattagctatttaaatgaaacaatctgctttgttgcaacttgggaaattctcagctataaactgtgactgggcaggtctgtcatcccttgttgatttaccctttgttgcaaggcaagagctgtttctctctgccctttgaatccagaggaagctgagactttttcatacgggtttcctgctaggttgcagatgtatattgctctgaaagtccctagctttatcattccctttctatccccagagtgtcctaaatgccacattttttttcacaactcagtacccccatttgtcttctggagtcatcgacccaacccctgtcctgtatcctttctcagaataacaacattagagcactatagatgtgacaatttaattacaattt

SEQ ID NO: 28264 - DNA, 1541 bp, Bovine  19866880639400
gtggcagtggtaaagaatctgactaccaatgcaggagacacgagagacctggtttcgatccctgggttcggaagatcccctggagtaggaaatggcaacccactgcagtattcttgcctggaaaatttcatggacaatggagcctggtgggctacagcccatggggccacagagagtcagacatgactgagcaagtgagcacacagcacacacacacataattaaatataagccaagaagccggccatacaattgttggtagctatcagcaaatatattaattaaatacatatattaaaaacttgtattcagcgcatttgtatcacaaccaggtgaagagcatccaaagagaggaattttaatacagaatcttacaaccctcttcccccttctcccaccaggctcctctgtccatagagtcttccaggtgagaatactggagtaggttgcctctttcccttaatatttactaatttaattctattttagagttctctacacataactgcttaagataaattaccggcctttgattgactttcttaaacaatgataaattgtggttaagacaagtatttcctgtgtacacacaatgtcaagcttacttagacctctgaggcaagagggttgccttgctggtactactgcattcaagaaggcataatgaggttggttcatagaatgtggaagtcaaatctggagacctgaaccaaatgcactgccaggataaagaggtattgctggcaggagcagggtgcagactggacagagtgtgtctcttctccttccagccttctgaggcactctccagtgcttcctacaggtatcctcactgaaacccagcaggcaaaagagaaacgtgttttgcacagtcccagtcccagcattacaaactgagtacagacaggtggatctgaaactgaaaaccagcagcacatccctgacctcagggatcccacctgacctcagggctcagtagtgtgttcacttcacccgcctcttggcaacaactcggggctgttcatttgaaaaatccaacttttctcctccagaaacagatacggtgtttttgttattaatgttgaaacagagcacacaagtcacccactaaatctccactaacagaagcaatgaaactgacgccagagatgaataaacgcaaccttgattgtgtgaagcatcttaactggtgaaatataaatacaaattggccccaaatctctcagaataacaaaatcaatcctcataagtcattttacccgaatacgcaggtctgcttctctctattctaaagtgaatgtggatttctcagtaagccaaggactgacaggcttgttgatagatttttgtgttttttcctttcttctcactggtacctttctcttcagcacttcctctagaaaggaaatgcagcagtgaacttccaatgaatccactcagtgaatttccagtgaactcattcagctgctctctccactgctttttcagagtttcaatgggaaagaacatagaaccatgcaacaaactctgaggccctgcag
